United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 227

SEQ ID NO: 9397306 - DNA, 22 bp, Homo sapiens
ctggcagcagctggtaccttat

SEQ ID NO: 9397307 - DNA, 22 bp, Homo sapiens
ctggcagcagcttctggatcga

SEQ ID NO: 9397308 - DNA, 22 bp, Homo sapiens
ctggcagagtctgctgtctgca

SEQ ID NO: 9397309 - DNA, 22 bp, Homo sapiens
ctggcagaggatggggacccag

SEQ ID NO: 9397310 - DNA, 22 bp, Homo sapiens
ctggcagaggatggggacccag

SEQ ID NO: 9397311 - DNA, 22 bp, Homo sapiens
ctggcagatagccacgcctgtc

SEQ ID NO: 9397312 - DNA, 22 bp, Homo sapiens
ctggcagatatttgcagacatg

SEQ ID NO: 9397313 - DNA, 22 bp, Homo sapiens
ctggcagatagtaagtgatcaa

SEQ ID NO: 9397314 - DNA, 22 bp, Homo sapiens
ctggatttaggactagtccaag

SEQ ID NO: 9397315 - DNA, 22 bp, Homo sapiens
ctggatttactgagttttatca

SEQ ID NO: 9397316 - DNA, 23 bp, Homo sapiens
ctggatttggaagcttaaataac

SEQ ID NO: 9397317 - DNA, 22 bp, Homo sapiens
ctggattttagaaggcttccta

SEQ ID NO: 9397318 - DNA, 22 bp, Homo sapiens
ctggattttatcattgtagttt

SEQ ID NO: 9397319 - DNA, 22 bp, Homo sapiens
ctggcaagaaatatatatctta

SEQ ID NO: 9397320 - DNA, 22 bp, Homo sapiens
ctggcaagaaatatatatctta

SEQ ID NO: 9397321 - DNA, 22 bp, Homo sapiens
ctggcaagaaatatatatctta

SEQ ID NO: 9397322 - DNA, 22 bp, Homo sapiens
ctggcaagaaatatatatctta

SEQ ID NO: 9397323 - DNA, 22 bp, Homo sapiens
ctggatttaattaactgttgct

SEQ ID NO: 9397324 - DNA, 22 bp, Homo sapiens
ctggatgtttatgaaggaccca

SEQ ID NO: 9397325 - DNA, 22 bp, Homo sapiens
ctggatgttttgctaaggactc

SEQ ID NO: 9397326 - DNA, 22 bp, Homo sapiens
ctggatgtccttcccctgaagc

SEQ ID NO: 9397327 - DNA, 22 bp, Homo sapiens
ctggatgtaacgaaggtttcac

SEQ ID NO: 9397328 - DNA, 22 bp, Homo sapiens
ctggatgtcttggggactcctg

SEQ ID NO: 9397329 - DNA, 22 bp, Homo sapiens
ctggatggtcccatgagcagct

SEQ ID NO: 9397330 - DNA, 22 bp, Homo sapiens
ctggatggtcccatgagcagct

SEQ ID NO: 9397331 - DNA, 22 bp, Homo sapiens
ctggatccatcgggtcccgagt

SEQ ID NO: 9397332 - DNA, 22 bp, Homo sapiens
ctggctccctctccctgagtca

SEQ ID NO: 9397333 - DNA, 22 bp, Homo sapiens
ctggctccaggtcatgcactca

SEQ ID NO: 9397334 - DNA, 22 bp, Homo sapiens
ctggctcctcagtattccactt

SEQ ID NO: 9397335 - DNA, 23 bp, Homo sapiens
ctggctccgaagactccaggatc

SEQ ID NO: 9397336 - DNA, 22 bp, Homo sapiens
ctggcctgggagctgctagcgt

SEQ ID NO: 9397337 - DNA, 22 bp, Homo sapiens
ctggcctggcgcagtggctcac

SEQ ID NO: 9397338 - DNA, 22 bp, Homo sapiens
ctggcctggggcctcagctgct

SEQ ID NO: 9397339 - DNA, 22 bp, Homo sapiens
ctggcctggggggacacatccc

SEQ ID NO: 9397340 - DNA, 22 bp, Homo sapiens
ctggcctggtctggcctctcca

SEQ ID NO: 9397341 - DNA, 22 bp, Homo sapiens
ctggcctggtctggcctctcca

SEQ ID NO: 9397342 - DNA, 22 bp, Homo sapiens
ctggctctgggctaagctccca

SEQ ID NO: 9397343 - DNA, 22 bp, Homo sapiens
ctggctctgggcctcagacact

SEQ ID NO: 9397344 - DNA, 22 bp, Homo sapiens
ctggctctgagcccacctccag

SEQ ID NO: 9397345 - DNA, 22 bp, Homo sapiens
ctggctctgactccgcatattt

SEQ ID NO: 9397346 - DNA, 22 bp, Homo sapiens
ctggctctgaccgcgctggcct

SEQ ID NO: 9397347 - DNA, 22 bp, Homo sapiens
ctggctctcgctgggagtactt

SEQ ID NO: 9397348 - DNA, 22 bp, Homo sapiens
ctggctctatctccaaggctgg

SEQ ID NO: 9397349 - DNA, 22 bp, Homo sapiens
ctggctctctgatttcacattc

SEQ ID NO: 9397350 - DNA, 22 bp, Homo sapiens
ctggctctaagtgtcagctccc

SEQ ID NO: 9397351 - DNA, 22 bp, Homo sapiens
ctggcctgcagatcccagggtc

SEQ ID NO: 9397352 - DNA, 22 bp, Homo sapiens
ctggcctgctgggtgaggtcct

SEQ ID NO: 9397353 - DNA, 22 bp, Homo sapiens
ctggcctgctgggtgaggtcct

SEQ ID NO: 9397354 - DNA, 22 bp, Homo sapiens
ctggcctggagcctctgggtgg

SEQ ID NO: 9397355 - DNA, 22 bp, Homo sapiens
ctggcctggcagggagggcatg

SEQ ID NO: 9397356 - DNA, 22 bp, Homo sapiens
ctggcctggcagggagggcatg

SEQ ID NO: 9397357 - DNA, 22 bp, Homo sapiens
ctggcctgagcacagcggctgc

SEQ ID NO: 9397358 - DNA, 22 bp, Homo sapiens
ctggcctgaggccgccttcaga

SEQ ID NO: 9397359 - DNA, 22 bp, Homo sapiens
ctggcctgaggccgccttcaga

SEQ ID NO: 9397360 - DNA, 22 bp, Homo sapiens
ctggcctgagaatgctaccctt

SEQ ID NO: 9397361 - DNA, 22 bp, Homo sapiens
ctggcccttctcttgcttcctg

SEQ ID NO: 9397362 - DNA, 22 bp, Homo sapiens
ctggccctgtggaggcaggaac

SEQ ID NO: 9397363 - DNA, 22 bp, Homo sapiens
ctggccctgtggcctaaggact

SEQ ID NO: 9397364 - DNA, 22 bp, Homo sapiens
ctggccctgtggcctaaggact

SEQ ID NO: 9397365 - DNA, 22 bp, Homo sapiens
ctggcccttaggaaaacaaagt

SEQ ID NO: 9397366 - DNA, 22 bp, Homo sapiens
ctggccatggagaaggtgaagc

SEQ ID NO: 9397367 - DNA, 22 bp, Homo sapiens
ctggccataggttctcagtgtg

SEQ ID NO: 9397368 - DNA, 22 bp, Homo sapiens
ctggccatgttgcctctgagac

SEQ ID NO: 9397369 - DNA, 22 bp, Homo sapiens
ctggccataggttctcagtgtg

SEQ ID NO: 9397370 - DNA, 22 bp, Homo sapiens
ctggccagttgtcctggcttgg

SEQ ID NO: 9397371 - DNA, 22 bp, Homo sapiens
ctggcccagagagcagagctta

SEQ ID NO: 9397372 - DNA, 17 bp, Homo sapiens
ctggccagtgtacttgg

SEQ ID NO: 9397373 - DNA, 22 bp, Homo sapiens
ctggccagtgtggctctgatct

SEQ ID NO: 9397374 - DNA, 22 bp, Homo sapiens
ctggccagttactgctattggc

SEQ ID NO: 9397375 - DNA, 22 bp, Homo sapiens
ctggccagtgtggctctgatct

SEQ ID NO: 9397376 - DNA, 22 bp, Homo sapiens
ctggccagttgccttcctgggt

SEQ ID NO: 9397377 - DNA, 22 bp, Homo sapiens
ctggccagttgccttcctgggt

SEQ ID NO: 9397378 - DNA, 22 bp, Homo sapiens
ctggccagttgccttcctgggt

SEQ ID NO: 9397379 - DNA, 21 bp, Homo sapiens
ctggcccagggatctgcattt

SEQ ID NO: 9397380 - DNA, 22 bp, Homo sapiens
ctggcccaggctcctggggcac

SEQ ID NO: 9397381 - DNA, 21 bp, Homo sapiens
ctggcccagggatctgcattt

SEQ ID NO: 9397382 - DNA, 21 bp, Homo sapiens
ctggcccagggatctgcattt

SEQ ID NO: 9397383 - DNA, 22 bp, Homo sapiens
ctggcccaggctcctggggcac

SEQ ID NO: 9397384 - DNA, 22 bp, Homo sapiens
ctggcccagagctctggccttt

SEQ ID NO: 9397385 - DNA, 22 bp, Homo sapiens
ctggcccagagctctggccttt

SEQ ID NO: 9397386 - DNA, 22 bp, Homo sapiens
ctgcctcatgctgcctgcagcc

SEQ ID NO: 9397387 - DNA, 22 bp, Homo sapiens
ctgcctccaggctcaccttgac

SEQ ID NO: 9397388 - DNA, 22 bp, Homo sapiens
ctgcctccaggctcaccttgac

SEQ ID NO: 9397389 - DNA, 22 bp, Homo sapiens
ctgcctcatgctgcctgcagcc

SEQ ID NO: 9397390 - DNA, 22 bp, Homo sapiens
ctgcctcagccttctgggtgac

SEQ ID NO: 9397391 - DNA, 22 bp, Homo sapiens
ctgcctagcgccatctgcctct

SEQ ID NO: 9397392 - DNA, 22 bp, Homo sapiens
ctgcctctataggagtccacca

SEQ ID NO: 9397393 - DNA, 22 bp, Homo sapiens
ctgcctgcgttgcctcgtgcct

SEQ ID NO: 9397394 - DNA, 22 bp, Homo sapiens
ctgcctcctggctgatgggtag

SEQ ID NO: 9397395 - DNA, 22 bp, Homo sapiens
ctgcctcctggctgatgggtag

SEQ ID NO: 9397396 - DNA, 22 bp, Homo sapiens
ctgcctcctgccgtgcagcttc

SEQ ID NO: 9397397 - DNA, 22 bp, Homo sapiens
ctgcctcctgccgtgcagcttc

SEQ ID NO: 9397398 - DNA, 22 bp, Homo sapiens
ctgcctcctgccgtgcagcttc

SEQ ID NO: 9397399 - DNA, 22 bp, Homo sapiens
ctgcctcctcacgtccacagtg

SEQ ID NO: 9397400 - DNA, 22 bp, Homo sapiens
ctgcctccaggctcaccttgac

SEQ ID NO: 9397401 - DNA, 22 bp, Homo sapiens
ctgcctcctcacgtccacagtg

SEQ ID NO: 9397402 - DNA, 22 bp, Homo sapiens
ctgcctcctgccgtgcagcttc

SEQ ID NO: 9397403 - DNA, 22 bp, Homo sapiens
ctgcctcctcacgtccacagtg

SEQ ID NO: 9397404 - DNA, 22 bp, Homo sapiens
ctgccatgcagttagtccctca

SEQ ID NO: 9397405 - DNA, 22 bp, Homo sapiens
ctgccctggggggcctccttgc

SEQ ID NO: 9397406 - DNA, 22 bp, Homo sapiens
ctgccgtgtttttcatgttaaa

SEQ ID NO: 9397407 - DNA, 22 bp, Homo sapiens
ctgccgttgtgaagctcttaga

SEQ ID NO: 9397408 - DNA, 22 bp, Homo sapiens
ctgccgtgtttttcatgttaaa

SEQ ID NO: 9397409 - DNA, 22 bp, Homo sapiens
ctgccaggtgcctttgtgcagt

SEQ ID NO: 9397410 - DNA, 22 bp, Homo sapiens
ctgccaggttggcgctcgctct

SEQ ID NO: 9397411 - DNA, 22 bp, Homo sapiens
ctgccaggttggcgctcgctct

SEQ ID NO: 9397412 - DNA, 22 bp, Homo sapiens
ctgccaggttggcgctcgctct

SEQ ID NO: 9397413 - DNA, 22 bp, Homo sapiens
ctgccaggtgccagggcgcggc

SEQ ID NO: 9397414 - DNA, 22 bp, Homo sapiens
ctgccaggtgagctccaggcct

SEQ ID NO: 9397415 - DNA, 22 bp, Homo sapiens
ctgccatcctcaccagagcagc

SEQ ID NO: 9397416 - DNA, 22 bp, Homo sapiens
ctgccatccacggcccactcat

SEQ ID NO: 9397417 - DNA, 22 bp, Homo sapiens
ctgccagtctatgctgctcggc

SEQ ID NO: 9397418 - DNA, 22 bp, Homo sapiens
ctgccatctgagggtccagcct

SEQ ID NO: 9397419 - DNA, 22 bp, Homo sapiens
ctgccatcgggggccccactgc

SEQ ID NO: 9397420 - DNA, 22 bp, Homo sapiens
ctgccagggcatcctgtggtgg

SEQ ID NO: 9397421 - DNA, 22 bp, Homo sapiens
ctgccaggggcctcacaggcca

SEQ ID NO: 9397422 - DNA, 22 bp, Homo sapiens
ctgccaggggcctcacaggcca

SEQ ID NO: 9397423 - DNA, 22 bp, Homo sapiens
ctgccaggggcctcacaggcca

SEQ ID NO: 9397424 - DNA, 22 bp, Homo sapiens
ctgccaggtaaactgcaggaat

SEQ ID NO: 9397425 - DNA, 22 bp, Homo sapiens
ctgccagggaggctgggaagtt

SEQ ID NO: 9397426 - DNA, 22 bp, Homo sapiens
ctgccagggaggctgggaagtt

SEQ ID NO: 9397427 - DNA, 22 bp, Homo sapiens
ctgccaggcgatggattggctg

SEQ ID NO: 9397428 - DNA, 22 bp, Homo sapiens
ctgccaggcgatggattggctg

SEQ ID NO: 9397429 - DNA, 22 bp, Homo sapiens
ctgccaggctgtcccaggtccg

SEQ ID NO: 9397430 - DNA, 22 bp, Homo sapiens
ctgccaggcctggggtgctgtc

SEQ ID NO: 9397431 - DNA, 22 bp, Homo sapiens
ctgccaggcctggggtgctgtc

SEQ ID NO: 9397432 - DNA, 22 bp, Homo sapiens
ctgccaggcctggggtgctgtc

SEQ ID NO: 9397433 - DNA, 22 bp, Homo sapiens
ctgccaggcctccgctgtcccc

SEQ ID NO: 9397434 - DNA, 22 bp, Homo sapiens
ctgccagctggagaccaaggaa

SEQ ID NO: 9397435 - DNA, 22 bp, Homo sapiens
ctgccaggcctccgctgtcccc

SEQ ID NO: 9397436 - DNA, 22 bp, Homo sapiens
ctgccagctggagaccaaggaa

SEQ ID NO: 9397437 - DNA, 22 bp, Homo sapiens
ctgcagcagtagtccccaagtg

SEQ ID NO: 9397438 - DNA, 23 bp, Homo sapiens
ctgcagccgcgtggggacgtgga

SEQ ID NO: 9397439 - DNA, 22 bp, Homo sapiens
ctgccagctctctggaggctct

SEQ ID NO: 9397440 - DNA, 22 bp, Homo sapiens
ctgccagctctctggaggctct

SEQ ID NO: 9397441 - DNA, 22 bp, Homo sapiens
ctgcagcagaataatctgctca

SEQ ID NO: 9397442 - DNA, 22 bp, Homo sapiens
ctgcagatggtattgttctggt

SEQ ID NO: 9397443 - DNA, 22 bp, Homo sapiens
ctgcagatgtctcaattttatt

SEQ ID NO: 9397444 - DNA, 22 bp, Homo sapiens
ctgcagattggcctgatgttca

SEQ ID NO: 9397445 - DNA, 22 bp, Homo sapiens
ctgcagaggggttgaagggtcc

SEQ ID NO: 9397446 - DNA, 22 bp, Homo sapiens
ctgcagaggcctcgcctcctct

SEQ ID NO: 9397447 - DNA, 22 bp, Homo sapiens
ctgcagaggtcttgctgatggt

SEQ ID NO: 9397448 - DNA, 22 bp, Homo sapiens
ctgcagaggtcttgctgatggt

SEQ ID NO: 9397449 - DNA, 22 bp, Homo sapiens
ctgcagagctaggctgagtgaa

SEQ ID NO: 9397450 - DNA, 22 bp, Homo sapiens
ctgcagagcttgtctggatgtg

SEQ ID NO: 9397451 - DNA, 22 bp, Homo sapiens
ctgcagagcttgtctggatgtg

SEQ ID NO: 9397452 - DNA, 22 bp, Homo sapiens
ctgcacttgacatgctctcaga

SEQ ID NO: 9397453 - DNA, 22 bp, Homo sapiens
ctgcacttgacatgctctcaga

SEQ ID NO: 9397454 - DNA, 22 bp, Homo sapiens
ctgcagagcataaatctgaata

SEQ ID NO: 9397455 - DNA, 22 bp, Homo sapiens
ctgcagactagatagaaactga

SEQ ID NO: 9397456 - DNA, 22 bp, Homo sapiens
ctgcagagcataaatctgaata

SEQ ID NO: 9397457 - DNA, 22 bp, Homo sapiens
ctgcagagcataaatctgaata

SEQ ID NO: 9397458 - DNA, 21 bp, Homo sapiens
ctgcagagcatgcaaaatgtt

SEQ ID NO: 9397459 - DNA, 22 bp, Homo sapiens
ctgcagagctaggctgagtgaa

SEQ ID NO: 9397460 - DNA, 22 bp, Homo sapiens
ctgcagagctaggctgagtgaa

SEQ ID NO: 9397461 - DNA, 22 bp, Homo sapiens
ctgattccctggtgcctccgtt

SEQ ID NO: 9397462 - DNA, 22 bp, Homo sapiens
ctgattccctggtgcctccgtt

SEQ ID NO: 9397463 - DNA, 22 bp, Homo sapiens
ctgattcctgattcatgctctt

SEQ ID NO: 9397464 - DNA, 22 bp, Homo sapiens
ctgattcctgattcatgctctt

SEQ ID NO: 9397465 - DNA, 22 bp, Homo sapiens
ctgattgagaaggaaggggatc

SEQ ID NO: 9397466 - DNA, 22 bp, Homo sapiens
ctgatttagatttcacacgtga

SEQ ID NO: 9397467 - DNA, 22 bp, Homo sapiens
ctgatttacatatacaaaagat

SEQ ID NO: 9397468 - DNA, 17 bp, Homo sapiens
ctgatttattagcagac

SEQ ID NO: 9397469 - DNA, 22 bp, Homo sapiens
ctgatttcatgctatcaatgtt

SEQ ID NO: 9397470 - DNA, 22 bp, Homo sapiens
ctgatgcaaccagcatatggaa

SEQ ID NO: 9397471 - DNA, 22 bp, Homo sapiens
ctgatgcctctcttcttggctt

SEQ ID NO: 9397472 - DNA, 22 bp, Homo sapiens
ctgatgctctggatgtagtcaa

SEQ ID NO: 9397473 - DNA, 22 bp, Homo sapiens
ctgatggagagtgtgatttggg

SEQ ID NO: 9397474 - DNA, 22 bp, Homo sapiens
ctgatggagtgatggagaaatt

SEQ ID NO: 9397475 - DNA, 22 bp, Homo sapiens
ctgatggagactccactgtgat

SEQ ID NO: 9397476 - DNA, 22 bp, Homo sapiens
ctgatgtcccaagcattcgcag

SEQ ID NO: 9397477 - DNA, 17 bp, Homo sapiens
ctgatggattttttcca

SEQ ID NO: 9397478 - DNA, 22 bp, Homo sapiens
ctgatggatggacaggggtagt

SEQ ID NO: 9397479 - DNA, 22 bp, Homo sapiens
ctgatggatgctacgtaagagg

SEQ ID NO: 9397480 - DNA, 22 bp, Homo sapiens
ctgattagagtgttaatgagga

SEQ ID NO: 9397481 - DNA, 22 bp, Homo sapiens
ctgattaggctaagcaagaggg

SEQ ID NO: 9397482 - DNA, 22 bp, Homo sapiens
ctgaggcagagagaacccgggc

SEQ ID NO: 9397483 - DNA, 22 bp, Homo sapiens
ctgaggcagagaatgagtttgt

SEQ ID NO: 9397484 - DNA, 22 bp, Homo sapiens
ctgaggcagagaatgagtttgt

SEQ ID NO: 9397485 - DNA, 22 bp, Homo sapiens
ctgagtcattgcagatgtggag

SEQ ID NO: 9397486 - DNA, 19 bp, Homo sapiens
ctgagtcaaaggttgtggg

SEQ ID NO: 9397487 - DNA, 22 bp, Homo sapiens
ctgatcctcctttaagtagctg

SEQ ID NO: 9397488 - DNA, 22 bp, Homo sapiens
ctgagagactgtttgtaatatt

SEQ ID NO: 9397489 - DNA, 22 bp, Homo sapiens
ctgagagagtaaagtagaatta

SEQ ID NO: 9397490 - DNA, 22 bp, Homo sapiens
ctgagagaatcatgctgcaggt

SEQ ID NO: 9397491 - DNA, 22 bp, Homo sapiens
ctgagagaatcatgctgcaggt

SEQ ID NO: 9397492 - DNA, 22 bp, Homo sapiens
ctgagagaatcatgctgcaggt

SEQ ID NO: 9397493 - DNA, 22 bp, Homo sapiens
ctgagagagtaaagtagaatta

SEQ ID NO: 9397494 - DNA, 22 bp, Homo sapiens
ctgaggaccccacaggaggccc

SEQ ID NO: 9397495 - DNA, 22 bp, Homo sapiens
ctgaggagggaagtccccaaag

SEQ ID NO: 9397496 - DNA, 22 bp, Homo sapiens
ctgaggaggggcctgagtgaga

SEQ ID NO: 9397497 - DNA, 22 bp, Homo sapiens
ctgaggagaaatgggatggttc

SEQ ID NO: 9397498 - DNA, 22 bp, Homo sapiens
ctgaggagaacaatgagatcaa

SEQ ID NO: 9397499 - DNA, 22 bp, Homo sapiens
ctgaggagaaatgggatggttc

SEQ ID NO: 9397500 - DNA, 22 bp, Homo sapiens
ctgagagaatcatgctgcaggt

SEQ ID NO: 9397501 - DNA, 22 bp, Homo sapiens
ctgagagaaacatgactcagga

SEQ ID NO: 9397502 - DNA, 22 bp, Homo sapiens
ctgagagaagagcgcagtttgt

SEQ ID NO: 9397503 - DNA, 22 bp, Homo sapiens
ctgagagaaacatgactcagga

SEQ ID NO: 9397504 - DNA, 22 bp, Homo sapiens
ctgagagaaacatgactcagga

SEQ ID NO: 9397505 - DNA, 22 bp, Homo sapiens
ctgagagaaacatgactcagga

SEQ ID NO: 9397506 - DNA, 22 bp, Homo sapiens
ctgagagaaacatgactcagga

SEQ ID NO: 9397507 - DNA, 22 bp, Homo sapiens
ctgagactgtaccacttcctcc

SEQ ID NO: 9397508 - DNA, 22 bp, Homo sapiens
ctgagactttcatgtgctttta

SEQ ID NO: 9397509 - DNA, 22 bp, Homo sapiens
ctgagacccagacacctgagga

SEQ ID NO: 9397510 - DNA, 22 bp, Homo sapiens
ctgagacaggagaatggcgtga

SEQ ID NO: 9397511 - DNA, 22 bp, Homo sapiens
ctgagacacggagaggctgtgt

SEQ ID NO: 9397512 - DNA, 22 bp, Homo sapiens
ctgagacacggagaggctgtgt

SEQ ID NO: 9397513 - DNA, 22 bp, Homo sapiens
ctgagaattactctgatgagta

SEQ ID NO: 9397514 - DNA, 22 bp, Homo sapiens
ctgagaattactctgatgagta

SEQ ID NO: 9397515 - DNA, 22 bp, Homo sapiens
ctgagaatgttttctgattgat

SEQ ID NO: 9397516 - DNA, 22 bp, Homo sapiens
ctgagacacagtggctgaaaag

SEQ ID NO: 9397517 - DNA, 22 bp, Homo sapiens
ctgagaattactctgatgagta

SEQ ID NO: 9397518 - DNA, 22 bp, Homo sapiens
ctgaggaggggcctgagtgaga

SEQ ID NO: 9397519 - DNA, 22 bp, Homo sapiens
ctgaggagtcagttccactcag

SEQ ID NO: 9397520 - DNA, 22 bp, Homo sapiens
ctgaggcacagtgaacttctcc

SEQ ID NO: 9397521 - DNA, 19 bp, Homo sapiens
ctgaggcaagtggtggtca

SEQ ID NO: 9397522 - DNA, 22 bp, Homo sapiens
ctgaggcacagtgaacttctcc

SEQ ID NO: 9397523 - DNA, 19 bp, Homo sapiens
ctgaggcaagtggtggtca

SEQ ID NO: 9397524 - DNA, 19 bp, Homo sapiens
ctgaggcaagtggtggtca

SEQ ID NO: 9397525 - DNA, 22 bp, Homo sapiens
ctgaggatctactgtgggctca

SEQ ID NO: 9397526 - DNA, 22 bp, Homo sapiens
ctgaggcactaacaaggacaag

SEQ ID NO: 9397527 - DNA, 22 bp, Homo sapiens
ctgaggcactaacaaggacaag

SEQ ID NO: 9397528 - DNA, 22 bp, Homo sapiens
ctgaggcacctacagtctcggg

SEQ ID NO: 9397529 - DNA, 22 bp, Homo sapiens
ctgaggcacctacagtctcggg

SEQ ID NO: 9397530 - DNA, 22 bp, Homo sapiens
ctgaggcactggtaatgggcat

SEQ ID NO: 9397531 - DNA, 22 bp, Homo sapiens
ctgaggcaccggcaatgttctg

SEQ ID NO: 9397532 - DNA, 22 bp, Homo sapiens
ctgaggcacccatcttctcctg

SEQ ID NO: 9397533 - DNA, 22 bp, Homo sapiens
ctgaggcacctacagtctcggg

SEQ ID NO: 9397534 - DNA, 22 bp, Homo sapiens
ctgaggcaccggcaatgttctg

SEQ ID NO: 9397535 - DNA, 22 bp, Homo sapiens
ctgaggcacccatcttctcctg

SEQ ID NO: 9397536 - DNA, 22 bp, Homo sapiens
ctgaggcagaaaaagcaagggt

SEQ ID NO: 9397537 - DNA, 22 bp, Homo sapiens
ctgaggcagaaaaagcaagggt

SEQ ID NO: 9397538 - DNA, 22 bp, Homo sapiens
ctgaggcactgtcagctgaggc

SEQ ID NO: 9397539 - DNA, 22 bp, Homo sapiens
ctgaggcactgtcagctgaggc

SEQ ID NO: 9397540 - DNA, 22 bp, Homo sapiens
ctgaggcactggtaatgggcat

SEQ ID NO: 9397541 - DNA, 22 bp, Homo sapiens
ctctggcttagtatgctccaaa

SEQ ID NO: 9397542 - DNA, 22 bp, Homo sapiens
ctctggcttagtatgctccaaa

SEQ ID NO: 9397543 - DNA, 22 bp, Homo sapiens
ctctggcttctaccttgcagtt

SEQ ID NO: 9397544 - DNA, 22 bp, Homo sapiens
ctctggctggcattgctggact

SEQ ID NO: 9397545 - DNA, 22 bp, Homo sapiens
ctctggctggcattgctggact

SEQ ID NO: 9397546 - DNA, 22 bp, Homo sapiens
ctctggctggcattgctggact

SEQ ID NO: 9397547 - DNA, 22 bp, Homo sapiens
ctctggctgtcccgatgagcag

SEQ ID NO: 9397548 - DNA, 22 bp, Homo sapiens
ctctggctgtcccgatgagcag

SEQ ID NO: 9397549 - DNA, 22 bp, Homo sapiens
ctctggctggctgggcctcagt

SEQ ID NO: 9397550 - DNA, 22 bp, Homo sapiens
ctctggctgcctctcaggcctg

SEQ ID NO: 9397551 - DNA, 22 bp, Homo sapiens
tttgtgaataggttggcttcca

SEQ ID NO: 9397552 - DNA, 22 bp, Homo sapiens
tttgtgaataggttggcttcca

SEQ ID NO: 9397553 - DNA, 22 bp, Homo sapiens
tttgtgaataggttggcttcca

SEQ ID NO: 9397554 - DNA, 19 bp, Homo sapiens
ctctggctcctgggctgcc

SEQ ID NO: 9397555 - DNA, 22 bp, Homo sapiens
tttgtgaatggaatccacagac

SEQ ID NO: 9397556 - DNA, 22 bp, Homo sapiens
tttgtcttgtgtccttaggacc

SEQ ID NO: 9397557 - DNA, 19 bp, Homo sapiens
tttgtgaagaaaatgatgc

SEQ ID NO: 9397558 - DNA, 22 bp, Homo sapiens
tttgtgaacttaggcaattagg

SEQ ID NO: 9397559 - DNA, 22 bp, Homo sapiens
ctctcctgggctgaccgtccga

SEQ ID NO: 9397560 - DNA, 23 bp, Homo sapiens
ctctcctgaaggacaagctgccg

SEQ ID NO: 9397561 - DNA, 22 bp, Homo sapiens
ctctcctgggctgaccgtccga

SEQ ID NO: 9397562 - DNA, 23 bp, Homo sapiens
ctctcctgaaggacaagctgccg

SEQ ID NO: 9397563 - DNA, 22 bp, Homo sapiens
ctctcctctgaagtggtgaccc

SEQ ID NO: 9397564 - DNA, 22 bp, Homo sapiens
ctctcctctgaagtggtgaccc

SEQ ID NO: 9397565 - DNA, 23 bp, Homo sapiens
ctctcctgaaggacaagctgccg

SEQ ID NO: 9397566 - DNA, 23 bp, Homo sapiens
ctctcctgaaggacaagctgccg

SEQ ID NO: 9397567 - DNA, 22 bp, Homo sapiens
ctctcctctgaagtggtgaccc

SEQ ID NO: 9397568 - DNA, 22 bp, Homo sapiens
tttgtacatcctaattctgagt

SEQ ID NO: 9397569 - DNA, 22 bp, Homo sapiens
tttgtacatcctaattctgagt

SEQ ID NO: 9397570 - DNA, 22 bp, Homo sapiens
ctctcctggggagcacacacac

SEQ ID NO: 9397571 - DNA, 22 bp, Homo sapiens
ctctcctggggagcacacacac

SEQ ID NO: 9397572 - DNA, 22 bp, Homo sapiens
ctctcctgggctgaccgtccga

SEQ ID NO: 9397573 - DNA, 22 bp, Homo sapiens
ctctgggcggcccaggccaacc

SEQ ID NO: 9397574 - DNA, 22 bp, Homo sapiens
ttttattatctttgaatgggac

SEQ ID NO: 9397575 - DNA, 22 bp, Homo sapiens
ttttagttgtagttggtgagga

SEQ ID NO: 9397576 - DNA, 22 bp, Homo sapiens
ttttattctcaagacaatggga

SEQ ID NO: 9397577 - DNA, 22 bp, Homo sapiens
ttttattctcagctccagagag

SEQ ID NO: 9397578 - DNA, 22 bp, Homo sapiens
ttttattctcagctccagagag

SEQ ID NO: 9397579 - DNA, 23 bp, Homo sapiens
ttttattgatatgtagctgttgt

SEQ ID NO: 9397580 - DNA, 23 bp, Homo sapiens
ttttattgatatgtagctgttgt

SEQ ID NO: 9397581 - DNA, 23 bp, Homo sapiens
ttttattgatatgtagctgttgt

SEQ ID NO: 9397582 - DNA, 23 bp, Homo sapiens
ttttattgatatgtagctgttgt

SEQ ID NO: 9397583 - DNA, 22 bp, Homo sapiens
ttttattctaagtatgatggga

SEQ ID NO: 9397584 - DNA, 22 bp, Homo sapiens
ttttattcatagggatggagag

SEQ ID NO: 9397585 - DNA, 22 bp, Homo sapiens
ttttattcaaatagttcacact

SEQ ID NO: 9397586 - DNA, 22 bp, Homo sapiens
ttttattatctttgaatgggac

SEQ ID NO: 9397587 - DNA, 22 bp, Homo sapiens
ttttattatctttgaatgggac

SEQ ID NO: 9397588 - DNA, 17 bp, Homo sapiens
ctctgggcagcctgggg

SEQ ID NO: 9397589 - DNA, 17 bp, Homo sapiens
ctctgggcagcctgggg

SEQ ID NO: 9397590 - DNA, 22 bp, Homo sapiens
ctctgggcaccaaagagcagct

SEQ ID NO: 9397591 - DNA, 22 bp, Homo sapiens
ctctgggcaggaccagtggacc

SEQ ID NO: 9397592 - DNA, 22 bp, Homo sapiens
ctctgggcaggaccagtggacc

SEQ ID NO: 9397593 - DNA, 22 bp, Homo sapiens
ctctgggcacattttccaggac

SEQ ID NO: 9397594 - DNA, 22 bp, Homo sapiens
ctctgggcaagtttcttcatga

SEQ ID NO: 9397595 - DNA, 22 bp, Homo sapiens
ctctgggcaagtttcttcatga

SEQ ID NO: 9397596 - DNA, 22 bp, Homo sapiens
ctctgggagtggccacttctca

SEQ ID NO: 9397597 - DNA, 22 bp, Homo sapiens
ctctgggaggtgttactatctg

SEQ ID NO: 9397598 - DNA, 22 bp, Homo sapiens
ctctgggatagagcctcggtct

SEQ ID NO: 9397599 - DNA, 18 bp, Homo sapiens
ctctgggagaggcataca

SEQ ID NO: 9397600 - DNA, 22 bp, Homo sapiens
ctctgggcaaagatgcctcatc

SEQ ID NO: 9397601 - DNA, 22 bp, Homo sapiens
ctctgggatgaggcctaggcac

SEQ ID NO: 9397602 - DNA, 22 bp, Homo sapiens
ctctgggatgaggcctaggcac

SEQ ID NO: 9397603 - DNA, 22 bp, Homo sapiens
ctctggtctcctgtagctacag

SEQ ID NO: 9397604 - DNA, 22 bp, Homo sapiens
ctctggtctcctgtagctacag

SEQ ID NO: 9397605 - DNA, 22 bp, Homo sapiens
ctctggtcttcaaggccacctc

SEQ ID NO: 9397606 - DNA, 22 bp, Homo sapiens
ctctggtcttcaaggccacctc

SEQ ID NO: 9397607 - DNA, 23 bp, Homo sapiens
ctctggttagatatcatatgctg

SEQ ID NO: 9397608 - DNA, 22 bp, Homo sapiens
ctctggttcagggctccctggc

SEQ ID NO: 9397609 - DNA, 22 bp, Homo sapiens
ctctggttcgtggtagatttta

SEQ ID NO: 9397610 - DNA, 22 bp, Homo sapiens
ctctggttcagggctccctggc

SEQ ID NO: 9397611 - DNA, 22 bp, Homo sapiens
ctctggttcaaagtagtataat

SEQ ID NO: 9397612 - DNA, 22 bp, Homo sapiens
ctctggttcaaagtagtataat

SEQ ID NO: 9397613 - DNA, 22 bp, Homo sapiens
ctctggttcgtggtagatttta

SEQ ID NO: 9397614 - DNA, 22 bp, Homo sapiens
ctctttgtcactcatacagtca

SEQ ID NO: 9397615 - DNA, 22 bp, Homo sapiens
ctctttgtgctattatgatcct

SEQ ID NO: 9397616 - DNA, 21 bp, Homo sapiens
ctctttgtggcaatgtatttt

SEQ ID NO: 9397617 - DNA, 22 bp, Homo sapiens
ctctttgtggaacggcagtgtc

SEQ ID NO: 9397618 - DNA, 22 bp, Homo sapiens
ctctttgtggaacggcagtgtc

SEQ ID NO: 9397619 - DNA, 20 bp, Homo sapiens
ctctttgttggcaaactctt

SEQ ID NO: 9397620 - DNA, 22 bp, Homo sapiens
ctctttgtggccacctaatctt

SEQ ID NO: 9397621 - DNA, 22 bp, Homo sapiens
ctcttttaattgtcataacaac

SEQ ID NO: 9397622 - DNA, 22 bp, Homo sapiens
ctctggtccttctgacaacctg

SEQ ID NO: 9397623 - DNA, 21 bp, Homo sapiens
ctctggtcctgtctggcaggc

SEQ ID NO: 9397624 - DNA, 21 bp, Homo sapiens
ctctggtcctgtctggcaggc

SEQ ID NO: 9397625 - DNA, 22 bp, Homo sapiens
ctctggtcctgacaaagacaga

SEQ ID NO: 9397626 - DNA, 22 bp, Homo sapiens
ctctggtcatttggaagagcat

SEQ ID NO: 9397627 - DNA, 22 bp, Homo sapiens
ctctggtcctgacaaagacaga

SEQ ID NO: 9397628 - DNA, 22 bp, Homo sapiens
ctctggtcccctgtcaccagtt

SEQ ID NO: 9397629 - DNA, 22 bp, Homo sapiens
ctctggtcccctgtcaccagtt

SEQ ID NO: 9397630 - DNA, 22 bp, Homo sapiens
ctctgggttctggcctgcaccc

SEQ ID NO: 9397631 - DNA, 22 bp, Homo sapiens
ctctgggttttgtcagctgagg

SEQ ID NO: 9397632 - DNA, 22 bp, Homo sapiens
ctctgggttttgtcagctgagg

SEQ ID NO: 9397633 - DNA, 22 bp, Homo sapiens
ctctggtcaagcaaagaggttt

SEQ ID NO: 9397634 - DNA, 22 bp, Homo sapiens
ctctgggttttgtcagctgagg

SEQ ID NO: 9397635 - DNA, 22 bp, Homo sapiens
ctctggtcaagcaaagaggttt

SEQ ID NO: 9397636 - DNA, 22 bp, Homo sapiens
ctctggtcatttggaagagcat

SEQ ID NO: 9397637 - DNA, 23 bp, Homo sapiens
ttttattgatatgtagctgttgt

SEQ ID NO: 9397638 - DNA, 21 bp, Homo sapiens
ttttattgatgaatggccact

SEQ ID NO: 9397639 - DNA, 23 bp, Homo sapiens
ttttattgatatgtagctgttgt

SEQ ID NO: 9397640 - DNA, 21 bp, Homo sapiens
ttttattgatgaatggccact

SEQ ID NO: 9397641 - DNA, 22 bp, Homo sapiens
ctctgggttcactgaggctctg

SEQ ID NO: 9397642 - DNA, 21 bp, Homo sapiens
ttttattgatgaatggccact

SEQ ID NO: 9397643 - DNA, 22 bp, Homo sapiens
ctctgggttcactgaggctctg

SEQ ID NO: 9397644 - DNA, 22 bp, Homo sapiens
ctctgggttcactgaggctctg

SEQ ID NO: 9397645 - DNA, 22 bp, Homo sapiens
ctctgggttcagaacagcaagc

SEQ ID NO: 9397646 - DNA, 22 bp, Homo sapiens
ctctgggttcactgaggctctg

SEQ ID NO: 9397647 - DNA, 22 bp, Homo sapiens
ctcttttatgtgacgtgtgtga

SEQ ID NO: 9397648 - DNA, 22 bp, Homo sapiens
ctcttttagagatgaaaattgg

SEQ ID NO: 9397649 - DNA, 22 bp, Homo sapiens
ctcttttaattgtcataacaac

SEQ ID NO: 9397650 - DNA, 22 bp, Homo sapiens
ctcttttacaccaaaaggccta

SEQ ID NO: 9397651 - DNA, 22 bp, Homo sapiens
ctcttttacaccaaaaggccta

SEQ ID NO: 9397652 - DNA, 22 bp, Homo sapiens
ctcttttcaaacctgtttatgg

SEQ ID NO: 9397653 - DNA, 20 bp, Homo sapiens
ctcttttcactctcagtggt

SEQ ID NO: 9397654 - DNA, 22 bp, Homo sapiens
ctctttttcacctctgtcagcg

SEQ ID NO: 9397655 - DNA, 22 bp, Homo sapiens
ctctttttcagccttaccaaag

SEQ ID NO: 9397656 - DNA, 19 bp, Homo sapiens
ctgaaaaacattctcagga

SEQ ID NO: 9397657 - DNA, 22 bp, Homo sapiens
tttttaagagattctccagtct

SEQ ID NO: 9397658 - DNA, 22 bp, Homo sapiens
ttttgttttcttagaaacctgg

SEQ ID NO: 9397659 - DNA, 22 bp, Homo sapiens
tttttaagctcctttgatgtca

SEQ ID NO: 9397660 - DNA, 22 bp, Homo sapiens
tttttaatgcagtctgagacat

SEQ ID NO: 9397661 - DNA, 22 bp, Homo sapiens
tttttaagagtctggaaatagt

SEQ ID NO: 9397662 - DNA, 22 bp, Homo sapiens
tttttaagagattctccagtct

SEQ ID NO: 9397663 - DNA, 22 bp, Homo sapiens
tttttaagagtctggaaatagt

SEQ ID NO: 9397664 - DNA, 22 bp, Homo sapiens
ctgaagaggttgttgaggaata

SEQ ID NO: 9397665 - DNA, 22 bp, Homo sapiens
ctgaagaggactgggttggagg

SEQ ID NO: 9397666 - DNA, 22 bp, Homo sapiens
ctgaagaggacgcagcagcaag

SEQ ID NO: 9397667 - DNA, 22 bp, Homo sapiens
ctgaagaggacgcagcagcaag

SEQ ID NO: 9397668 - DNA, 23 bp, Homo sapiens
ctgaagagccaacaaaaagcttg

SEQ ID NO: 9397669 - DNA, 22 bp, Homo sapiens
ctgaagatgctggagcatgggt

SEQ ID NO: 9397670 - DNA, 22 bp, Homo sapiens
ctgactgtaattctgttcttaa

SEQ ID NO: 9397671 - DNA, 17 bp, Homo sapiens
ctgaagataatggcaac

SEQ ID NO: 9397672 - DNA, 22 bp, Homo sapiens
ctgaagatgaggctgctggggg

SEQ ID NO: 9397673 - DNA, 22 bp, Homo sapiens
ctgaagatagtgtctgatcatg

SEQ ID NO: 9397674 - DNA, 22 bp, Homo sapiens
ctgagaaatacccaagtctggt

SEQ ID NO: 9397675 - DNA, 22 bp, Homo sapiens
ctgagaaagtgagggttaaaca

SEQ ID NO: 9397676 - DNA, 22 bp, Homo sapiens
ctgacttcagggataaaaagta

SEQ ID NO: 9397677 - DNA, 22 bp, Homo sapiens
ctgagaagagggtatgtggcgc

SEQ ID NO: 9397678 - DNA, 20 bp, Homo sapiens
ctgagaactatgactgtctt

SEQ ID NO: 9397679 - DNA, 22 bp, Homo sapiens
ctgagaaattctttctttcact

SEQ ID NO: 9397680 - DNA, 22 bp, Homo sapiens
ctgagaagcaaagaactgcact

SEQ ID NO: 9397681 - DNA, 22 bp, Homo sapiens
ctgagaagcaaagaactgcact

SEQ ID NO: 9397682 - DNA, 19 bp, Homo sapiens
ctgagaatcctacttattt

SEQ ID NO: 9397683 - DNA, 22 bp, Homo sapiens
ctgagaataaagccagcaggag

SEQ ID NO: 9397684 - DNA, 22 bp, Homo sapiens
ctgagaagcactgtctgcaaga

SEQ ID NO: 9397685 - DNA, 22 bp, Homo sapiens
ctgagaaggaagcctccactct

SEQ ID NO: 9397686 - DNA, 22 bp, Homo sapiens
ctgaacatcatagagtgtactt

SEQ ID NO: 9397687 - DNA, 20 bp, Homo sapiens
ctgaacacagaataagcaca

SEQ ID NO: 9397688 - DNA, 22 bp, Homo sapiens
ctgaacaaagaaatagtcatgg

SEQ ID NO: 9397689 - DNA, 22 bp, Homo sapiens
ctgaacatcccgcagtgcacga

SEQ ID NO: 9397690 - DNA, 22 bp, Homo sapiens
ctgaacattcttgaacatctgt

SEQ ID NO: 9397691 - DNA, 22 bp, Homo sapiens
ctgaaattctgcctctgcacaa

SEQ ID NO: 9397692 - DNA, 20 bp, Homo sapiens
ctgaaaggagtcgggatgtc

SEQ ID NO: 9397693 - DNA, 22 bp, Homo sapiens
ctgaaaggaataaggctctttg

SEQ ID NO: 9397694 - DNA, 22 bp, Homo sapiens
ctgaaaggagagctgcaaggat

SEQ ID NO: 9397695 - DNA, 22 bp, Homo sapiens
ctgaaagcaaagtaattcttaa

SEQ ID NO: 9397696 - DNA, 19 bp, Homo sapiens
tttttaatgggctggagca

SEQ ID NO: 9397697 - DNA, 22 bp, Homo sapiens
ctgaaagcattaactccacttc

SEQ ID NO: 9397698 - DNA, 19 bp, Homo sapiens
tttttaatgggctggagca

SEQ ID NO: 9397699 - DNA, 22 bp, Homo sapiens
ctgaactgacagactgcctgct

SEQ ID NO: 9397700 - DNA, 22 bp, Homo sapiens
ctgaacttattgagtgcttgct

SEQ ID NO: 9397701 - DNA, 22 bp, Homo sapiens
ctgaacttattgagtgcttgct

SEQ ID NO: 9397702 - DNA, 22 bp, Homo sapiens
ctgaagaaatatgattgcttaa

SEQ ID NO: 9397703 - DNA, 22 bp, Homo sapiens
ctgaagagaaagggagctcttc

SEQ ID NO: 9397704 - DNA, 22 bp, Homo sapiens
ctgaagaatgacagtgctttga

SEQ ID NO: 9397705 - DNA, 22 bp, Homo sapiens
ctgaagagcaaaccaactggac

SEQ ID NO: 9397706 - DNA, 22 bp, Homo sapiens
gtttacatgtaatgtgttattg

SEQ ID NO: 9397707 - DNA, 22 bp, Homo sapiens
gtttattattcaacttcatgtt

SEQ ID NO: 9397708 - DNA, 22 bp, Homo sapiens
gtttattattcaacttcatgtt

SEQ ID NO: 9397709 - DNA, 22 bp, Homo sapiens
gtttattccagcaatctgctta

SEQ ID NO: 9397710 - DNA, 22 bp, Homo sapiens
gtttattccagcaatctgctta

SEQ ID NO: 9397711 - DNA, 22 bp, Homo sapiens
gtttattccagcaatctgctta

SEQ ID NO: 9397712 - DNA, 22 bp, Homo sapiens
gtttattatacaacaaaagcta

SEQ ID NO: 9397713 - DNA, 22 bp, Homo sapiens
gtttattgataaaagctggaca

SEQ ID NO: 9397714 - DNA, 22 bp, Homo sapiens
gtttattgggtattgtggagcc

SEQ ID NO: 9397715 - DNA, 22 bp, Homo sapiens
gtttattgataaaagctggaca

SEQ ID NO: 9397716 - DNA, 22 bp, Homo sapiens
gtttattgataaaagctggaca

SEQ ID NO: 9397717 - DNA, 22 bp, Homo sapiens
gtttattcttcagcaacatctg

SEQ ID NO: 9397718 - DNA, 22 bp, Homo sapiens
gtttattcttcagcaacatctg

SEQ ID NO: 9397719 - DNA, 22 bp, Homo sapiens
gtttattgataaaagctggaca

SEQ ID NO: 9397720 - DNA, 22 bp, Homo sapiens
gtttattgataaaagctggaca

SEQ ID NO: 9397721 - DNA, 22 bp, Homo sapiens
gtttattgggtattgtggagcc

SEQ ID NO: 9397722 - DNA, 22 bp, Homo sapiens
gtttattgggtattgtggagcc

SEQ ID NO: 9397723 - DNA, 22 bp, Homo sapiens
gtttattgggtattgtggagcc

SEQ ID NO: 9397724 - DNA, 22 bp, Homo sapiens
gtttgcatttattagtcttctg

SEQ ID NO: 9397725 - DNA, 22 bp, Homo sapiens
gtttcctgcacacgtgttatat

SEQ ID NO: 9397726 - DNA, 22 bp, Homo sapiens
gtttcctgactgtggaattata

SEQ ID NO: 9397727 - DNA, 22 bp, Homo sapiens
gtttcctgaaaagtaagggaca

SEQ ID NO: 9397728 - DNA, 22 bp, Homo sapiens
gtttcctatgtccattgaggga

SEQ ID NO: 9397729 - DNA, 20 bp, Homo sapiens
gtttcctatttacctcctca

SEQ ID NO: 9397730 - DNA, 22 bp, Homo sapiens
gtttcctataactcaggcacca

SEQ ID NO: 9397731 - DNA, 22 bp, Homo sapiens
gtttcctatggctgctgcagga

SEQ ID NO: 9397732 - DNA, 22 bp, Homo sapiens
gtttacatgcagaaaatcaatg

SEQ ID NO: 9397733 - DNA, 22 bp, Homo sapiens
gtttacatgcatgcaagaatga

SEQ ID NO: 9397734 - DNA, 22 bp, Homo sapiens
gtttacagagacagaaagtagt

SEQ ID NO: 9397735 - DNA, 18 bp, Homo sapiens
gtttacacattctagaaa

SEQ ID NO: 9397736 - DNA, 22 bp, Homo sapiens
gtttacactccaggctggggtg

SEQ ID NO: 9397737 - DNA, 22 bp, Homo sapiens
gtttacagtactcacttgcatt

SEQ ID NO: 9397738 - DNA, 22 bp, Homo sapiens
gtttacagtactcacttgcatt

SEQ ID NO: 9397739 - DNA, 22 bp, Homo sapiens
gtttacagtggcttcattggat

SEQ ID NO: 9397740 - DNA, 22 bp, Homo sapiens
gtttacagtggcttcattggat

SEQ ID NO: 9397741 - DNA, 22 bp, Homo sapiens
gtttacaacatcttgtccttca

SEQ ID NO: 9397742 - DNA, 21 bp, Homo sapiens
gtttacaaggctttgctcctg

SEQ ID NO: 9397743 - DNA, 22 bp, Homo sapiens
gtttacacataactcctatcaa

SEQ ID NO: 9397744 - DNA, 22 bp, Homo sapiens
gtttacaacatgccaactgggc

SEQ ID NO: 9397745 - DNA, 22 bp, Homo sapiens
gtttacaacatgccaactgggc

SEQ ID NO: 9397746 - DNA, 21 bp, Homo sapiens
gtttacaaggctttgctcctg

SEQ ID NO: 9397747 - DNA, 22 bp, Homo sapiens
caggaagattagaccaagagct

SEQ ID NO: 9397748 - DNA, 22 bp, Homo sapiens
caggaagattagaccaagagct

SEQ ID NO: 9397749 - DNA, 22 bp, Homo sapiens
caggaagattagaccaagagct

SEQ ID NO: 9397750 - DNA, 22 bp, Homo sapiens
caggaagcaagtgattttcttg

SEQ ID NO: 9397751 - DNA, 22 bp, Homo sapiens
caggaagcacagtgaggagacc

SEQ ID NO: 9397752 - DNA, 22 bp, Homo sapiens
caggaagcacagtgaggagacc

SEQ ID NO: 9397753 - DNA, 22 bp, Homo sapiens
caggaagcaccagcccggcccc

SEQ ID NO: 9397754 - DNA, 22 bp, Homo sapiens
caggaagattgtggaggtggtt

SEQ ID NO: 9397755 - DNA, 22 bp, Homo sapiens
caggaagattgtggaggtggtt

SEQ ID NO: 9397756 - DNA, 22 bp, Homo sapiens
caggaagattgtggaggtggtt

SEQ ID NO: 9397757 - DNA, 22 bp, Homo sapiens
caggaacacaagttcagggatg

SEQ ID NO: 9397758 - DNA, 22 bp, Homo sapiens
caggaacagggtgtcctggcag

SEQ ID NO: 9397759 - DNA, 22 bp, Homo sapiens
caggaacagctgacctgacaat

SEQ ID NO: 9397760 - DNA, 22 bp, Homo sapiens
caggaacagctgacctgacaat

SEQ ID NO: 9397761 - DNA, 22 bp, Homo sapiens
caggaagagaacatggaggctg

SEQ ID NO: 9397762 - DNA, 22 bp, Homo sapiens
caggaacatttaaccacagggt

SEQ ID NO: 9397763 - DNA, 22 bp, Homo sapiens
caggaagaggtatcaccgagca

SEQ ID NO: 9397764 - DNA, 22 bp, Homo sapiens
caggaagaggtatcaccgagca

SEQ ID NO: 9397765 - DNA, 22 bp, Homo sapiens
caggaagaggtatcaccgagca

SEQ ID NO: 9397766 - DNA, 22 bp, Homo sapiens
caggaagaggacaggcttcccc

SEQ ID NO: 9397767 - DNA, 22 bp, Homo sapiens
gttcttcagaggggaaagaacc

SEQ ID NO: 9397768 - DNA, 22 bp, Homo sapiens
gttctgtctgagcaccacagga

SEQ ID NO: 9397769 - DNA, 21 bp, Homo sapiens
gttctgttgactgtgggcatc

SEQ ID NO: 9397770 - DNA, 22 bp, Homo sapiens
gttctgtcacacactggtactt

SEQ ID NO: 9397771 - DNA, 22 bp, Homo sapiens
gttctgtagtcatagagcaatt

SEQ ID NO: 9397772 - DNA, 22 bp, Homo sapiens
gttctgtactccaagctcttcc

SEQ ID NO: 9397773 - DNA, 22 bp, Homo sapiens
gttcctaagcactgtgcattct

SEQ ID NO: 9397774 - DNA, 22 bp, Homo sapiens
gttcctaagctgtggccctgga

SEQ ID NO: 9397775 - DNA, 22 bp, Homo sapiens
gttcctaaatctggaggacctc

SEQ ID NO: 9397776 - DNA, 22 bp, Homo sapiens
gttcctaaatttgaaggacttt

SEQ ID NO: 9397777 - DNA, 22 bp, Homo sapiens
gttcctaaccagcagagaaaca

SEQ ID NO: 9397778 - DNA, 22 bp, Homo sapiens
gttccctttcgtatggactggg

SEQ ID NO: 9397779 - DNA, 21 bp, Homo sapiens
gttcccttattggggcaggca

SEQ ID NO: 9397780 - DNA, 22 bp, Homo sapiens
gttcctggcattgtcagcggcc

SEQ ID NO: 9397781 - DNA, 22 bp, Homo sapiens
gttctggagtggtgccaggcct

SEQ ID NO: 9397782 - DNA, 22 bp, Homo sapiens
gttccccttgtgttgttgccca

SEQ ID NO: 9397783 - DNA, 22 bp, Homo sapiens
gttcccatcagggatgagggtg

SEQ ID NO: 9397784 - DNA, 22 bp, Homo sapiens
gttcccatacagtatcagtgct

SEQ ID NO: 9397785 - DNA, 22 bp, Homo sapiens
gttcccaggccctgggctctcc

SEQ ID NO: 9397786 - DNA, 20 bp, Homo sapiens
gttcacaggcttcctttcag

SEQ ID NO: 9397787 - DNA, 22 bp, Homo sapiens
gttcacaggttctctttctaag

SEQ ID NO: 9397788 - DNA, 22 bp, Homo sapiens
caggaacaatatctgtcctggt

SEQ ID NO: 9397789 - DNA, 22 bp, Homo sapiens
caggaaagtctgtaaaggaacc

SEQ ID NO: 9397790 - DNA, 22 bp, Homo sapiens
caggaaatggggtttagttatt

SEQ ID NO: 9397791 - DNA, 22 bp, Homo sapiens
caggaaaggtgtgtcatgatgg

SEQ ID NO: 9397792 - DNA, 22 bp, Homo sapiens
caggaaaggtagtcacaatgta

SEQ ID NO: 9397793 - DNA, 22 bp, Homo sapiens
caggaaaggtagtcacaatgta

SEQ ID NO: 9397794 - DNA, 22 bp, Homo sapiens
caggaaagccgagtgccatagg

SEQ ID NO: 9397795 - DNA, 22 bp, Homo sapiens
caggaaagccgagtgccatagg

SEQ ID NO: 9397796 - DNA, 22 bp, Homo sapiens
caggaaagccgagtgccatagg

SEQ ID NO: 9397797 - DNA, 22 bp, Homo sapiens
caggaaagggatgggctgccac

SEQ ID NO: 9397798 - DNA, 19 bp, Homo sapiens
gttggcactgaaaatggct

SEQ ID NO: 9397799 - DNA, 22 bp, Homo sapiens
gttggcatagtcttttataatt

SEQ ID NO: 9397800 - DNA, 22 bp, Homo sapiens
gttggcacttagccccagtcta

SEQ ID NO: 9397801 - DNA, 22 bp, Homo sapiens
gttggctatgagagctttagtg

SEQ ID NO: 9397802 - DNA, 22 bp, Homo sapiens
gttggccattaattggaggaca

SEQ ID NO: 9397803 - DNA, 22 bp, Homo sapiens
gtgtgtggaaagttttccatgg

SEQ ID NO: 9397804 - DNA, 22 bp, Homo sapiens
gtgtgtgctccccaggagagct

SEQ ID NO: 9397805 - DNA, 22 bp, Homo sapiens
gtgtgtggggccttcgggtcct

SEQ ID NO: 9397806 - DNA, 22 bp, Homo sapiens
gtgtgtggggccttcgggtcct

SEQ ID NO: 9397807 - DNA, 22 bp, Homo sapiens
gtgtgtgtactctgtatataaa

SEQ ID NO: 9397808 - DNA, 22 bp, Homo sapiens
gtgtgtgcaagaggtttattga

SEQ ID NO: 9397809 - DNA, 22 bp, Homo sapiens
gtgtgtctttataagaagaggg

SEQ ID NO: 9397810 - DNA, 20 bp, Homo sapiens
gtgtgtgctccatgcatgct

SEQ ID NO: 9397811 - DNA, 22 bp, Homo sapiens
gtgtgtgccatcaagagctttc

SEQ ID NO: 9397812 - DNA, 22 bp, Homo sapiens
gtgtgtgccaactttatgtgca

SEQ ID NO: 9397813 - DNA, 22 bp, Homo sapiens
gtgtgtgccaactttatgtgca

SEQ ID NO: 9397814 - DNA, 22 bp, Homo sapiens
gtgtgtgtatatatacacacac

SEQ ID NO: 9397815 - DNA, 22 bp, Homo sapiens
gtgtgtgtatatatacacacac

SEQ ID NO: 9397816 - DNA, 22 bp, Homo sapiens
gtgtgtgtactctgtatataaa

SEQ ID NO: 9397817 - DNA, 22 bp, Homo sapiens
gtgtgtgtactctgtatataaa

SEQ ID NO: 9397818 - DNA, 22 bp, Homo sapiens
gtgtttggtcagacgtccgggg

SEQ ID NO: 9397819 - DNA, 22 bp, Homo sapiens
gtgttttatggagtcataacgt

SEQ ID NO: 9397820 - DNA, 22 bp, Homo sapiens
gtgttttatggagtcataacgt

SEQ ID NO: 9397821 - DNA, 22 bp, Homo sapiens
gtgttttaagaaagaagctcag

SEQ ID NO: 9397822 - DNA, 22 bp, Homo sapiens
gttacaagtgttcgagagtgac

SEQ ID NO: 9397823 - DNA, 22 bp, Homo sapiens
gttacaatgtccttacatgaaa

SEQ ID NO: 9397824 - DNA, 22 bp, Homo sapiens
gttacaatgttcttcagttctg

SEQ ID NO: 9397825 - DNA, 22 bp, Homo sapiens
gttacagtgcttggcaataagt

SEQ ID NO: 9397826 - DNA, 22 bp, Homo sapiens
gttacagtgcatgtggcttctg

SEQ ID NO: 9397827 - DNA, 22 bp, Homo sapiens
gttacagtgcatgtggcttctg

SEQ ID NO: 9397828 - DNA, 22 bp, Homo sapiens
gttacagtgagaagatagccta

SEQ ID NO: 9397829 - DNA, 22 bp, Homo sapiens
gttacagtcaggagatattttg

SEQ ID NO: 9397830 - DNA, 22 bp, Homo sapiens
gttacagtcaggagatattttg

SEQ ID NO: 9397831 - DNA, 22 bp, Homo sapiens
gttacagtgagaagatagccta

SEQ ID NO: 9397832 - DNA, 22 bp, Homo sapiens
gttacaaatgtaaattctgggg

SEQ ID NO: 9397833 - DNA, 22 bp, Homo sapiens
gttacaagtgagatttaggaga

SEQ ID NO: 9397834 - DNA, 22 bp, Homo sapiens
gtgttttattggtgcagtcaga

SEQ ID NO: 9397835 - DNA, 20 bp, Homo sapiens
gttaaaagagtaatttgagg

SEQ ID NO: 9397836 - DNA, 22 bp, Homo sapiens
gttaaacaagctggacactgaa

SEQ ID NO: 9397837 - DNA, 22 bp, Homo sapiens
gttaaacagttacatgtgctgg

SEQ ID NO: 9397838 - DNA, 22 bp, Homo sapiens
gttaaacaataactggcacaca

SEQ ID NO: 9397839 - DNA, 22 bp, Homo sapiens
gttaaacaagctggacactgaa

SEQ ID NO: 9397840 - DNA, 22 bp, Homo sapiens
gttacaaatgccaaagctgaga

SEQ ID NO: 9397841 - DNA, 22 bp, Homo sapiens
gttacaaatgccaaagctgaga

SEQ ID NO: 9397842 - DNA, 22 bp, Homo sapiens
gttaaacagttacatgtgctgg

SEQ ID NO: 9397843 - DNA, 22 bp, Homo sapiens
gttaaacagttacatgtgctgg

SEQ ID NO: 9397844 - DNA, 22 bp, Homo sapiens
cagctgtggagggaggaaatgc

SEQ ID NO: 9397845 - DNA, 22 bp, Homo sapiens
cagctgtggagatggggtgcat

SEQ ID NO: 9397846 - DNA, 22 bp, Homo sapiens
cagctgtgctagaagccacgaa

SEQ ID NO: 9397847 - DNA, 22 bp, Homo sapiens
cagctgtgctgattgctcagta

SEQ ID NO: 9397848 - DNA, 22 bp, Homo sapiens
cagctgtgattcctgctgtcca

SEQ ID NO: 9397849 - DNA, 22 bp, Homo sapiens
cagctgtgatatgcctgcctga

SEQ ID NO: 9397850 - DNA, 22 bp, Homo sapiens
cagctgtgagcagccagttgcc

SEQ ID NO: 9397851 - DNA, 22 bp, Homo sapiens
cagctgtgtaaacacatgtgta

SEQ ID NO: 9397852 - DNA, 22 bp, Homo sapiens
cagctgtgtaaacacatgtgta

SEQ ID NO: 9397853 - DNA, 22 bp, Homo sapiens
cagctgtgtatgagagcatgct

SEQ ID NO: 9397854 - DNA, 22 bp, Homo sapiens
cagctgtgggcctgacgtggca

SEQ ID NO: 9397855 - DNA, 22 bp, Homo sapiens
cagctgtggggagcttgggcca

SEQ ID NO: 9397856 - DNA, 22 bp, Homo sapiens
cagctgtgggcctgacgtggca

SEQ ID NO: 9397857 - DNA, 22 bp, Homo sapiens
cagctgtgggcctgacgtggca

SEQ ID NO: 9397858 - DNA, 22 bp, Homo sapiens
cagctgtggctgccactgctcc

SEQ ID NO: 9397859 - DNA, 22 bp, Homo sapiens
cagcttcccttggctgagcaga

SEQ ID NO: 9397860 - DNA, 22 bp, Homo sapiens
cagcttcccttggctgagcaga

SEQ ID NO: 9397861 - DNA, 22 bp, Homo sapiens
cagcttccacagacttggctcg

SEQ ID NO: 9397862 - DNA, 22 bp, Homo sapiens
cagcttctaaagtgtgaagcca

SEQ ID NO: 9397863 - DNA, 22 bp, Homo sapiens
cagcttctaaagtgtgaagcca

SEQ ID NO: 9397864 - DNA, 21 bp, Homo sapiens
gtgtgtctaatgtagtggaaa

SEQ ID NO: 9397865 - DNA, 22 bp, Homo sapiens
gtgtgtcttgaccaggatcgga

SEQ ID NO: 9397866 - DNA, 22 bp, Homo sapiens
gtgtgtctgaagttgagtagac

SEQ ID NO: 9397867 - DNA, 22 bp, Homo sapiens
gtgtgtctgaagttgagtagac

SEQ ID NO: 9397868 - DNA, 22 bp, Homo sapiens
gtgtgtctgaagttgagtagac

SEQ ID NO: 9397869 - DNA, 20 bp, Homo sapiens
cagcttcaatgtcagcttga

SEQ ID NO: 9397870 - DNA, 22 bp, Homo sapiens
cagcttcaactgcacagtcaac

SEQ ID NO: 9397871 - DNA, 22 bp, Homo sapiens
cagcttcatgacaaacagtttt

SEQ ID NO: 9397872 - DNA, 22 bp, Homo sapiens
cagcttcagggacagcttcttt

SEQ ID NO: 9397873 - DNA, 22 bp, Homo sapiens
cagcttcagggacagcttcttt

SEQ ID NO: 9397874 - DNA, 22 bp, Homo sapiens
cagcttcaactgcacagtcaac

SEQ ID NO: 9397875 - DNA, 22 bp, Homo sapiens
cagctgtgtatgagagcatgct

SEQ ID NO: 9397876 - DNA, 22 bp, Homo sapiens
cagctgttgtgtatcaggcaga

SEQ ID NO: 9397877 - DNA, 22 bp, Homo sapiens
caggaaaatgtcaatggaaagc

SEQ ID NO: 9397878 - DNA, 22 bp, Homo sapiens
caggaaacaaagccttgctcat

SEQ ID NO: 9397879 - DNA, 19 bp, Homo sapiens
caggaaacacctactgcta

SEQ ID NO: 9397880 - DNA, 21 bp, Homo sapiens
caggaaagaaaacgtacatat

SEQ ID NO: 9397881 - DNA, 21 bp, Homo sapiens
caggaaagaaaacgtacatat

SEQ ID NO: 9397882 - DNA, 21 bp, Homo sapiens
caggaaactgaggccatgggg

SEQ ID NO: 9397883 - DNA, 22 bp, Homo sapiens
caggaaagaaatgagaacacca

SEQ ID NO: 9397884 - DNA, 22 bp, Homo sapiens
caggaaagagctgccaggcagg

SEQ ID NO: 9397885 - DNA, 22 bp, Homo sapiens
caggaaagagagctattcactt

SEQ ID NO: 9397886 - DNA, 22 bp, Homo sapiens
caggaaagaaatgagaacacca

SEQ ID NO: 9397887 - DNA, 22 bp, Homo sapiens
caggaaagagctgccaggcagg

SEQ ID NO: 9397888 - DNA, 22 bp, Homo sapiens
caggaaagagctgccaggcagg

SEQ ID NO: 9397889 - DNA, 22 bp, Homo sapiens
cagctttaggactcataataaa

SEQ ID NO: 9397890 - DNA, 20 bp, Homo sapiens
cagctttagatctttgatta

SEQ ID NO: 9397891 - DNA, 22 bp, Homo sapiens
cagctttagtaacccactgctc

SEQ ID NO: 9397892 - DNA, 22 bp, Homo sapiens
cagctttagtaacccactgctc

SEQ ID NO: 9397893 - DNA, 17 bp, Homo sapiens
cagctttatgctactgt

SEQ ID NO: 9397894 - DNA, 22 bp, Homo sapiens
cagctttattaatgattgtctt

SEQ ID NO: 9397895 - DNA, 16 bp, Homo sapiens
cagctttatgtcagtg

SEQ ID NO: 9397896 - DNA, 22 bp, Homo sapiens
cagctttaccaatatttggaaa

SEQ ID NO: 9397897 - DNA, 22 bp, Homo sapiens
cagctttacctttaggagtaac

SEQ ID NO: 9397898 - DNA, 22 bp, Homo sapiens
cagcttgttttatttggggacc

SEQ ID NO: 9397899 - DNA, 22 bp, Homo sapiens
cagctttagagaaaacatattt

SEQ ID NO: 9397900 - DNA, 22 bp, Homo sapiens
cagcttgtattgaagctatacc

SEQ ID NO: 9397901 - DNA, 22 bp, Homo sapiens
cagcttgttaccgagggagggt

SEQ ID NO: 9397902 - DNA, 22 bp, Homo sapiens
cagcttgttaccaagggtggct

SEQ ID NO: 9397903 - DNA, 22 bp, Homo sapiens
caggaaaatggaatcacctgta

SEQ ID NO: 9397904 - DNA, 22 bp, Homo sapiens
cagctttatttcacgtgtttgt

SEQ ID NO: 9397905 - DNA, 22 bp, Homo sapiens
cagctttattgaggtataattg

SEQ ID NO: 9397906 - DNA, 23 bp, Homo sapiens
cagctttcagggctttagggaag

SEQ ID NO: 9397907 - DNA, 22 bp, Homo sapiens
cagctttctgtctcatgactga

SEQ ID NO: 9397908 - DNA, 22 bp, Homo sapiens
cagctttctctggtttcaagat

SEQ ID NO: 9397909 - DNA, 22 bp, Homo sapiens
cagctttcttccttctgtctgt

SEQ ID NO: 9397910 - DNA, 22 bp, Homo sapiens
cagctttctttccataaggttt

SEQ ID NO: 9397911 - DNA, 22 bp, Homo sapiens
gttacagtttgggcttgattca

SEQ ID NO: 9397912 - DNA, 22 bp, Homo sapiens
gttacagtttgggcttgattca

SEQ ID NO: 9397913 - DNA, 22 bp, Homo sapiens
gttacagtgcttggcaataagt

SEQ ID NO: 9397914 - DNA, 22 bp, Homo sapiens
gttacagtgggtttggggccca

SEQ ID NO: 9397915 - DNA, 22 bp, Homo sapiens
gttacagtgggtttggggccca

SEQ ID NO: 9397916 - DNA, 22 bp, Homo sapiens
gttattctattaatgtgattgt

SEQ ID NO: 9397917 - DNA, 22 bp, Homo sapiens
gttattctattaatgtgattgt

SEQ ID NO: 9397918 - DNA, 22 bp, Homo sapiens
gttattctgccaaacttccaca

SEQ ID NO: 9397919 - DNA, 22 bp, Homo sapiens
gttattctgcgatgcaatcctg

SEQ ID NO: 9397920 - DNA, 18 bp, Homo sapiens
gttattctctctgcagta

SEQ ID NO: 9397921 - DNA, 22 bp, Homo sapiens
gttattcttttatagcaataca

SEQ ID NO: 9397922 - DNA, 22 bp, Homo sapiens
gttattgacatgtattaagcac

SEQ ID NO: 9397923 - DNA, 22 bp, Homo sapiens
gttattgactctcttgtggctt

SEQ ID NO: 9397924 - DNA, 21 bp, Homo sapiens
gttattgacctccaggctggc

SEQ ID NO: 9397925 - DNA, 22 bp, Homo sapiens
gttattgagacatagagttatg

SEQ ID NO: 9397926 - DNA, 22 bp, Homo sapiens
gttattgaggtggagtctcact

SEQ ID NO: 9397927 - DNA, 22 bp, Homo sapiens
cagcttctaccatcaggaaatt

SEQ ID NO: 9397928 - DNA, 22 bp, Homo sapiens
cagcttggcgaatgtaggtatg

SEQ ID NO: 9397929 - DNA, 20 bp, Homo sapiens
cagcttggatgagaggctga

SEQ ID NO: 9397930 - DNA, 21 bp, Homo sapiens
cagcttctgaaggtgtaggaa

SEQ ID NO: 9397931 - DNA, 21 bp, Homo sapiens
cagcttctgaaggtgtaggaa

SEQ ID NO: 9397932 - DNA, 22 bp, Homo sapiens
cagcttctgctatcgaacatct

SEQ ID NO: 9397933 - DNA, 22 bp, Homo sapiens
cagcttctgagcaagccagggg

SEQ ID NO: 9397934 - DNA, 22 bp, Homo sapiens
cagcttctgagcaagccagggg

SEQ ID NO: 9397935 - DNA, 22 bp, Homo sapiens
cagcttctccattcttctggct

SEQ ID NO: 9397936 - DNA, 22 bp, Homo sapiens
cagcttctccggcctggtgcgg

SEQ ID NO: 9397937 - DNA, 22 bp, Homo sapiens
cagcttctccggcctggtgcgg

SEQ ID NO: 9397938 - DNA, 22 bp, Homo sapiens
cagcttctcgggagcgcatgtg

SEQ ID NO: 9397939 - DNA, 22 bp, Homo sapiens
cagcttctcgggagcgcatgtg

SEQ ID NO: 9397940 - DNA, 22 bp, Homo sapiens
cagcttctagcatcggctttga

SEQ ID NO: 9397941 - DNA, 22 bp, Homo sapiens
cagcttctatttatctttgtgt

SEQ ID NO: 9397942 - DNA, 22 bp, Homo sapiens
cagcttctatttatctttgtgt

SEQ ID NO: 9397943 - DNA, 22 bp, Homo sapiens
cagcttctatttatctttgtgt

SEQ ID NO: 9397944 - DNA, 22 bp, Homo sapiens
cagcttctccagatgaccctca

SEQ ID NO: 9397945 - DNA, 22 bp, Homo sapiens
cagcttctcagaaagctgaggt

SEQ ID NO: 9397946 - DNA, 22 bp, Homo sapiens
cagcttctcagaaagctgaggt

SEQ ID NO: 9397947 - DNA, 22 bp, Homo sapiens
cagctggggagagacatggcag

SEQ ID NO: 9397948 - DNA, 22 bp, Homo sapiens
cagctggggagagacatggcag

SEQ ID NO: 9397949 - DNA, 22 bp, Homo sapiens
cagctgggctaagagtagaggc

SEQ ID NO: 9397950 - DNA, 22 bp, Homo sapiens
cagctgggcctcctgagccctg

SEQ ID NO: 9397951 - DNA, 22 bp, Homo sapiens
cagctgggcctcctgagccctg

SEQ ID NO: 9397952 - DNA, 22 bp, Homo sapiens
cagctgggcctcctgagccctg

SEQ ID NO: 9397953 - DNA, 22 bp, Homo sapiens
cagctgggagctccattagata

SEQ ID NO: 9397954 - DNA, 22 bp, Homo sapiens
cagctgggtgatcttgggcagg

SEQ ID NO: 9397955 - DNA, 22 bp, Homo sapiens
cagctgggtgatcttgggcagg

SEQ ID NO: 9397956 - DNA, 22 bp, Homo sapiens
cagctggggcagccacgtgcgg

SEQ ID NO: 9397957 - DNA, 22 bp, Homo sapiens
cagctggggagagacatggcag

SEQ ID NO: 9397958 - DNA, 22 bp, Homo sapiens
cagctggggagagacatggcag

SEQ ID NO: 9397959 - DNA, 22 bp, Homo sapiens
cagctggggcagccacgtgcgg

SEQ ID NO: 9397960 - DNA, 22 bp, Homo sapiens
cagctgggtgatcttgggcagg

SEQ ID NO: 9397961 - DNA, 22 bp, Homo sapiens
cagctgtctaagttgagcagga

SEQ ID NO: 9397962 - DNA, 22 bp, Homo sapiens
cagctgtgagcagccagttgcc

SEQ ID NO: 9397963 - DNA, 22 bp, Homo sapiens
cagctgtgacagccagttgatg

SEQ ID NO: 9397964 - DNA, 17 bp, Homo sapiens
cagctgtgagagcctta

SEQ ID NO: 9397965 - DNA, 22 bp, Homo sapiens
gtgtgcctttcacacactggga

SEQ ID NO: 9397966 - DNA, 22 bp, Homo sapiens
gtgtgctcaagggcaggaacct

SEQ ID NO: 9397967 - DNA, 22 bp, Homo sapiens
gtgtgctgagtgactgtcatca

SEQ ID NO: 9397968 - DNA, 22 bp, Homo sapiens
gtgtggaaagagtggcctctca

SEQ ID NO: 9397969 - DNA, 22 bp, Homo sapiens
gtgtggaaagagtggcctctca

SEQ ID NO: 9397970 - DNA, 22 bp, Homo sapiens
gtgtgctgcccaactcgcagat

SEQ ID NO: 9397971 - DNA, 21 bp, Homo sapiens
gtgtgctgatacattggagaa

SEQ ID NO: 9397972 - DNA, 22 bp, Homo sapiens
gtgtggccgtgtatccatggct

SEQ ID NO: 9397973 - DNA, 22 bp, Homo sapiens
cagctggctgcggtgaggggac

SEQ ID NO: 9397974 - DNA, 22 bp, Homo sapiens
gtgtggccgtgtatccatggct

SEQ ID NO: 9397975 - DNA, 22 bp, Homo sapiens
cagctggctgcggtgaggggac

SEQ ID NO: 9397976 - DNA, 22 bp, Homo sapiens
cagctggctggtcagtgcacaa

SEQ ID NO: 9397977 - DNA, 22 bp, Homo sapiens
cagctggctggtcagtgcacaa

SEQ ID NO: 9397978 - DNA, 22 bp, Homo sapiens
cagctggctggtcagtgcacaa

SEQ ID NO: 9397979 - DNA, 22 bp, Homo sapiens
cagctgggagctccattagata

SEQ ID NO: 9397980 - DNA, 22 bp, Homo sapiens
cagctgggagctccattagata

SEQ ID NO: 9397981 - DNA, 22 bp, Homo sapiens
cagctggcttgtttgttcttga

SEQ ID NO: 9397982 - DNA, 22 bp, Homo sapiens
gtgtatgtgccttacattttat

SEQ ID NO: 9397983 - DNA, 22 bp, Homo sapiens
gtgtatgttctacttaatatta

SEQ ID NO: 9397984 - DNA, 22 bp, Homo sapiens
gtgtatgttctacttaatatta

SEQ ID NO: 9397985 - DNA, 22 bp, Homo sapiens
gtgtatgttctacttaatatta

SEQ ID NO: 9397986 - DNA, 19 bp, Homo sapiens
gtgtatgtaagttgtgagg

SEQ ID NO: 9397987 - DNA, 19 bp, Homo sapiens
gtgtatgtaagttgtgagg

SEQ ID NO: 9397988 - DNA, 22 bp, Homo sapiens
gtgtatgtgccttacattttat

SEQ ID NO: 9397989 - DNA, 22 bp, Homo sapiens
gtgtatgtgccttacattttat

SEQ ID NO: 9397990 - DNA, 22 bp, Homo sapiens
gtgtcaaatccactcctctttt

SEQ ID NO: 9397991 - DNA, 22 bp, Homo sapiens
gtgtctggaacgggtggtactc

SEQ ID NO: 9397992 - DNA, 22 bp, Homo sapiens
gtgtctggaacgggtggtactc

SEQ ID NO: 9397993 - DNA, 22 bp, Homo sapiens
gtgtctggcttatgggaactgg

SEQ ID NO: 9397994 - DNA, 20 bp, Homo sapiens
gtgtctggagtactagagag

SEQ ID NO: 9397995 - DNA, 22 bp, Homo sapiens
gtgtctttattcctctatgttt

SEQ ID NO: 9397996 - DNA, 22 bp, Homo sapiens
gtgtgaaagttcctaagactat

SEQ ID NO: 9397997 - DNA, 22 bp, Homo sapiens
gtgtcttttgaggctgaccagt

SEQ ID NO: 9397998 - DNA, 20 bp, Homo sapiens
gtgtgaagccctcaggagga

SEQ ID NO: 9397999 - DNA, 22 bp, Homo sapiens
gtgtgacccaaggacactctct

SEQ ID NO: 9398000 - DNA, 22 bp, Homo sapiens
gtgtgagcagaaaccatgagta

SEQ ID NO: 9398001 - DNA, 22 bp, Homo sapiens
gtgtgagcatcaaagcctgtca

SEQ ID NO: 9398002 - DNA, 22 bp, Homo sapiens
gtgtgagcaggtttgacctaag

SEQ ID NO: 9398003 - DNA, 22 bp, Homo sapiens
gtgtgagcagaaaccatgagta

SEQ ID NO: 9398004 - DNA, 22 bp, Homo sapiens
gtgggtggattccagcaacgct

SEQ ID NO: 9398005 - DNA, 22 bp, Homo sapiens
gtgggtggattccagcaacgct

SEQ ID NO: 9398006 - DNA, 22 bp, Homo sapiens
gtgggtggggagctctctggag

SEQ ID NO: 9398007 - DNA, 22 bp, Homo sapiens
gtgggtggggagctctctggag

SEQ ID NO: 9398008 - DNA, 22 bp, Homo sapiens
gtgggtggggagctctctggag

SEQ ID NO: 9398009 - DNA, 22 bp, Homo sapiens
gtgggtggggagctctctggag

SEQ ID NO: 9398010 - DNA, 22 bp, Homo sapiens
gtgggtggggagctctctggag

SEQ ID NO: 9398011 - DNA, 22 bp, Homo sapiens
gtgggtggggagctctctggag

SEQ ID NO: 9398012 - DNA, 22 bp, Homo sapiens
gtgggtgtggaactgtgagacc

SEQ ID NO: 9398013 - DNA, 22 bp, Homo sapiens
gtgggttcgtggtctcgctggc

SEQ ID NO: 9398014 - DNA, 22 bp, Homo sapiens
gtgtataatcctgcaaagggag

SEQ ID NO: 9398015 - DNA, 22 bp, Homo sapiens
gtgtataataatgtgagctaaa

SEQ ID NO: 9398016 - DNA, 22 bp, Homo sapiens
gtgtataactatctatctagta

SEQ ID NO: 9398017 - DNA, 22 bp, Homo sapiens
gtgtataactatctatctagta

SEQ ID NO: 9398018 - DNA, 22 bp, Homo sapiens
gtgtataatgctttgaagatta

SEQ ID NO: 9398019 - DNA, 22 bp, Homo sapiens
gtgtataatgctgtttgtacat

SEQ ID NO: 9398020 - DNA, 22 bp, Homo sapiens
gtgtatccttattcacacacat

SEQ ID NO: 9398021 - DNA, 22 bp, Homo sapiens
gtgtatctcatgttcttctctg

SEQ ID NO: 9398022 - DNA, 22 bp, Homo sapiens
gtgtataacccaaatatgctgc

SEQ ID NO: 9398023 - DNA, 22 bp, Homo sapiens
gtgtataacccaaatatgctgc

SEQ ID NO: 9398024 - DNA, 19 bp, Homo sapiens
gtgtagctattggtcaaaa

SEQ ID NO: 9398025 - DNA, 22 bp, Homo sapiens
cagctgccacaggactttctga

SEQ ID NO: 9398026 - DNA, 22 bp, Homo sapiens
cagctgccacttgctctcggct

SEQ ID NO: 9398027 - DNA, 22 bp, Homo sapiens
cagctgccaagaatcttttcta

SEQ ID NO: 9398028 - DNA, 22 bp, Homo sapiens
cagctgcaggctgtgcaggaag

SEQ ID NO: 9398029 - DNA, 22 bp, Homo sapiens
cagctgcccctccagggctggg

SEQ ID NO: 9398030 - DNA, 22 bp, Homo sapiens
cagctgcccctccagggctggg

SEQ ID NO: 9398031 - DNA, 22 bp, Homo sapiens
cagctgcctatgacctagcctc

SEQ ID NO: 9398032 - DNA, 22 bp, Homo sapiens
cagctgcctatgacctagcctc

SEQ ID NO: 9398033 - DNA, 22 bp, Homo sapiens
cagctgcctatgacctagcctc

SEQ ID NO: 9398034 - DNA, 22 bp, Homo sapiens
cagctgcctatgacctagcctc

SEQ ID NO: 9398035 - DNA, 22 bp, Homo sapiens
cagctgcctgtattgtcctcat

SEQ ID NO: 9398036 - DNA, 22 bp, Homo sapiens
cagctgcctgtattgtcctcat

SEQ ID NO: 9398037 - DNA, 20 bp, Homo sapiens
cagctgcctggctctgggat

SEQ ID NO: 9398038 - DNA, 22 bp, Homo sapiens
cagctgcctgcaacacaagctt

SEQ ID NO: 9398039 - DNA, 22 bp, Homo sapiens
cagctgcctgcaacacaagctt

SEQ ID NO: 9398040 - DNA, 20 bp, Homo sapiens
cagctgcctggctctgggat

SEQ ID NO: 9398041 - DNA, 22 bp, Homo sapiens
gtggggcatgcacgctgctcct

SEQ ID NO: 9398042 - DNA, 22 bp, Homo sapiens
gtggggcatgcacgctgctcct

SEQ ID NO: 9398043 - DNA, 22 bp, Homo sapiens
gtggggcggcagatgctccctg

SEQ ID NO: 9398044 - DNA, 22 bp, Homo sapiens
gtggggcagtggcctgggagca

SEQ ID NO: 9398045 - DNA, 22 bp, Homo sapiens
gtggggcagtggcctgggagca

SEQ ID NO: 9398046 - DNA, 22 bp, Homo sapiens
gtggggctgagtggagccagaa

SEQ ID NO: 9398047 - DNA, 22 bp, Homo sapiens
gtggggctgcttaggctgcgca

SEQ ID NO: 9398048 - DNA, 22 bp, Homo sapiens
cagctgcaggagaaacagaggc

SEQ ID NO: 9398049 - DNA, 22 bp, Homo sapiens
cagctgctgagaagcctccctt

SEQ ID NO: 9398050 - DNA, 22 bp, Homo sapiens
cagctgctgaggaaggggttgg

SEQ ID NO: 9398051 - DNA, 22 bp, Homo sapiens
cagctgctcttctggcctgtca

SEQ ID NO: 9398052 - DNA, 22 bp, Homo sapiens
cagctgctctggtggtctctcc

SEQ ID NO: 9398053 - DNA, 22 bp, Homo sapiens
cagctgctctggtggtctctcc

SEQ ID NO: 9398054 - DNA, 22 bp, Homo sapiens
cagctgctgatggcctgacaga

SEQ ID NO: 9398055 - DNA, 22 bp, Homo sapiens
cagctgccttctgcgggaagtc

SEQ ID NO: 9398056 - DNA, 22 bp, Homo sapiens
cagctgctctggtggtctctcc

SEQ ID NO: 9398057 - DNA, 22 bp, Homo sapiens
cagctgcctgtattgtcctcat

SEQ ID NO: 9398058 - DNA, 22 bp, Homo sapiens
cagctgcctgtctggaggcaat

SEQ ID NO: 9398059 - DNA, 22 bp, Homo sapiens
cagctgcctgtattgtcctcat

SEQ ID NO: 9398060 - DNA, 22 bp, Homo sapiens
cagctgctgttactgcttatta

SEQ ID NO: 9398061 - DNA, 22 bp, Homo sapiens
cagctggccaatcagggcgccc

SEQ ID NO: 9398062 - DNA, 22 bp, Homo sapiens
cagctggccaatcagggcgccc

SEQ ID NO: 9398063 - DNA, 22 bp, Homo sapiens
cagctgcttctcctccagagct

SEQ ID NO: 9398064 - DNA, 22 bp, Homo sapiens
cagctgctgttcagttttgttt

SEQ ID NO: 9398065 - DNA, 22 bp, Homo sapiens
cagctgctgttcagttttgttt

SEQ ID NO: 9398066 - DNA, 22 bp, Homo sapiens
gtgggtggaggcgtcgagggca

SEQ ID NO: 9398067 - DNA, 22 bp, Homo sapiens
gtgggtggatcacctgaggtca

SEQ ID NO: 9398068 - DNA, 22 bp, Homo sapiens
gtgggtggatcacctgaggtca

SEQ ID NO: 9398069 - DNA, 22 bp, Homo sapiens
cagctggctccacctctgggct

SEQ ID NO: 9398070 - DNA, 22 bp, Homo sapiens
cagctggctgcatgatgccaaa

SEQ ID NO: 9398071 - DNA, 22 bp, Homo sapiens
cagctggctgcatgatgccaaa

SEQ ID NO: 9398072 - DNA, 22 bp, Homo sapiens
cagctggctgcatgatgccaaa

SEQ ID NO: 9398073 - DNA, 22 bp, Homo sapiens
cagctggctccacctctgggct

SEQ ID NO: 9398074 - DNA, 22 bp, Homo sapiens
gtgggtggatcatgaggtcagg

SEQ ID NO: 9398075 - DNA, 22 bp, Homo sapiens
gtgggtggatcatgaggtcagg

SEQ ID NO: 9398076 - DNA, 22 bp, Homo sapiens
gtgggtggatcacctgaggtca

SEQ ID NO: 9398077 - DNA, 22 bp, Homo sapiens
gtgggtggatcacctgaggtca

SEQ ID NO: 9398078 - DNA, 22 bp, Homo sapiens
gtgggtggatcacctgaggtca

SEQ ID NO: 9398079 - DNA, 22 bp, Homo sapiens
gtgggtggatcatgaggtcagg

SEQ ID NO: 9398080 - DNA, 22 bp, Homo sapiens
cagctggcgcctggggaccaga

SEQ ID NO: 9398081 - DNA, 22 bp, Homo sapiens
cagctggcgactctcctcgatg

SEQ ID NO: 9398082 - DNA, 22 bp, Homo sapiens
cagctggcgactctcctcgatg

SEQ ID NO: 9398083 - DNA, 22 bp, Homo sapiens
cagctggcgcctggggaccaga

SEQ ID NO: 9398084 - DNA, 22 bp, Homo sapiens
cagctggcgggcagagccgcca

SEQ ID NO: 9398085 - DNA, 22 bp, Homo sapiens
cagctggcgcctggggaccaga

SEQ ID NO: 9398086 - DNA, 22 bp, Homo sapiens
cagctggcgtggagtgattgca

SEQ ID NO: 9398087 - DNA, 22 bp, Homo sapiens
cagctggctccacctctgggct

SEQ ID NO: 9398088 - DNA, 22 bp, Homo sapiens
cagctggcgggcagagccgcca

SEQ ID NO: 9398089 - DNA, 22 bp, Homo sapiens
cagctggcgggcagagccgcca

SEQ ID NO: 9398090 - DNA, 22 bp, Homo sapiens
cagctggccctttggtagcctt

SEQ ID NO: 9398091 - DNA, 22 bp, Homo sapiens
cagctggccctttggtagcctt

SEQ ID NO: 9398092 - DNA, 22 bp, Homo sapiens
cagctggcctgatccctgtggc

SEQ ID NO: 9398093 - DNA, 22 bp, Homo sapiens
cagctggcctgatccctgtggc

SEQ ID NO: 9398094 - DNA, 22 bp, Homo sapiens
cagctggcctgatccctgtggc

SEQ ID NO: 9398095 - DNA, 22 bp, Homo sapiens
cagctggcctgagcggtggcgg

SEQ ID NO: 9398096 - DNA, 22 bp, Homo sapiens
cagctggccccacagtagaggc

SEQ ID NO: 9398097 - DNA, 22 bp, Homo sapiens
cagctggccctttggtagcctt

SEQ ID NO: 9398098 - DNA, 22 bp, Homo sapiens
cagctggccaatcagggcgccc

SEQ ID NO: 9398099 - DNA, 22 bp, Homo sapiens
gtgggaagaacttcaagtggct

SEQ ID NO: 9398100 - DNA, 22 bp, Homo sapiens
gtgggaagaacttcaagtggct

SEQ ID NO: 9398101 - DNA, 22 bp, Homo sapiens
gtgggaagaacttcaagtggct

SEQ ID NO: 9398102 - DNA, 22 bp, Homo sapiens
gtgggaagtctctcggaggaag

SEQ ID NO: 9398103 - DNA, 22 bp, Homo sapiens
gtgggaagtctctcggaggaag

SEQ ID NO: 9398104 - DNA, 22 bp, Homo sapiens
gtggcttggaccagtcacagtg

SEQ ID NO: 9398105 - DNA, 22 bp, Homo sapiens
gtggcttcttctgccagaagga

SEQ ID NO: 9398106 - DNA, 22 bp, Homo sapiens
gtgggaagaacttcaagtggct

SEQ ID NO: 9398107 - DNA, 22 bp, Homo sapiens
gtggcttgtgtgggaagtgcag

SEQ ID NO: 9398108 - DNA, 22 bp, Homo sapiens
gtggctagttggcagagaacag

SEQ ID NO: 9398109 - DNA, 22 bp, Homo sapiens
gtggctagggacacagattgct

SEQ ID NO: 9398110 - DNA, 22 bp, Homo sapiens
gtggcttctgcggtgtgcgcag

SEQ ID NO: 9398111 - DNA, 22 bp, Homo sapiens
gtggctagaaaaatatgggtgc

SEQ ID NO: 9398112 - DNA, 22 bp, Homo sapiens
gtggctaggcccaacggcagga

SEQ ID NO: 9398113 - DNA, 22 bp, Homo sapiens
gtggctaggcccaacggcagga

SEQ ID NO: 9398114 - DNA, 22 bp, Homo sapiens
gtggcgtgatctcggctcactg

SEQ ID NO: 9398115 - DNA, 22 bp, Homo sapiens
gtggcgcagagggtggcagaga

SEQ ID NO: 9398116 - DNA, 22 bp, Homo sapiens
gtggccttttcaagtagggtat

SEQ ID NO: 9398117 - DNA, 22 bp, Homo sapiens
gtggccttttagaataaactct

SEQ ID NO: 9398118 - DNA, 22 bp, Homo sapiens
gtggcgcagagggtggcagaga

SEQ ID NO: 9398119 - DNA, 22 bp, Homo sapiens
gtggccttgctcacatgtccag

SEQ ID NO: 9398120 - DNA, 22 bp, Homo sapiens
gtggccttggcttctaccctga

SEQ ID NO: 9398121 - DNA, 22 bp, Homo sapiens
gtggccttgggcactgaccttg

SEQ ID NO: 9398122 - DNA, 22 bp, Homo sapiens
gtggcctttcttgggctacaga

SEQ ID NO: 9398123 - DNA, 22 bp, Homo sapiens
gtgggcaggtaggcaccagcta

SEQ ID NO: 9398124 - DNA, 22 bp, Homo sapiens
gtgggcaggtaggcaccagcta

SEQ ID NO: 9398125 - DNA, 22 bp, Homo sapiens
gtgggcagggttgctttctccg

SEQ ID NO: 9398126 - DNA, 22 bp, Homo sapiens
gtgggcagtgcctgacggatga

SEQ ID NO: 9398127 - DNA, 22 bp, Homo sapiens
gtgggcagtcatgaaatctaga

SEQ ID NO: 9398128 - DNA, 22 bp, Homo sapiens
gtgggcagtgcctgacggatga

SEQ ID NO: 9398129 - DNA, 22 bp, Homo sapiens
gtgggcagtggggtcttctgcc

SEQ ID NO: 9398130 - DNA, 22 bp, Homo sapiens
gtgggcagtggggtcttctgcc

SEQ ID NO: 9398131 - DNA, 22 bp, Homo sapiens
gtggggagggagatgctgaagt

SEQ ID NO: 9398132 - DNA, 22 bp, Homo sapiens
gtggggagggagatgctgaagt

SEQ ID NO: 9398133 - DNA, 22 bp, Homo sapiens
gtgggcaggccccaaagcaggg

SEQ ID NO: 9398134 - DNA, 22 bp, Homo sapiens
gtgggcaggccctaggcgattt

SEQ ID NO: 9398135 - DNA, 22 bp, Homo sapiens
gtgggcaggccctaggcgattt

SEQ ID NO: 9398136 - DNA, 22 bp, Homo sapiens
gtgggcaggccctaggcgattt

SEQ ID NO: 9398137 - DNA, 22 bp, Homo sapiens
gtgggacagcggggtgggacag

SEQ ID NO: 9398138 - DNA, 22 bp, Homo sapiens
gtgggacagcggggtgggacag

SEQ ID NO: 9398139 - DNA, 22 bp, Homo sapiens
gtgggacagctggagggtccct

SEQ ID NO: 9398140 - DNA, 22 bp, Homo sapiens
gtgggcaggaggccctgccctg

SEQ ID NO: 9398141 - DNA, 22 bp, Homo sapiens
cagctgagtttccaagtctgcc

SEQ ID NO: 9398142 - DNA, 22 bp, Homo sapiens
cagctgagtggaccctagaggc

SEQ ID NO: 9398143 - DNA, 22 bp, Homo sapiens
cagctgagtttccaagtctgcc

SEQ ID NO: 9398144 - DNA, 22 bp, Homo sapiens
gtggcctgtcagaagccgtggg

SEQ ID NO: 9398145 - DNA, 22 bp, Homo sapiens
gtggccttattatgtacaaaat

SEQ ID NO: 9398146 - DNA, 22 bp, Homo sapiens
gtggccttaagaaacaaacaac

SEQ ID NO: 9398147 - DNA, 22 bp, Homo sapiens
gtggcctgtgctgtctccccaa

SEQ ID NO: 9398148 - DNA, 20 bp, Homo sapiens
gtggcctgtcctgttgtggg

SEQ ID NO: 9398149 - DNA, 20 bp, Homo sapiens
gtggcctgtcctgttgtggg

SEQ ID NO: 9398150 - DNA, 22 bp, Homo sapiens
cagctgagctcccaggccatca

SEQ ID NO: 9398151 - DNA, 22 bp, Homo sapiens
cagctgagctgccagactactg

SEQ ID NO: 9398152 - DNA, 22 bp, Homo sapiens
cagctgagcatcactagtctgg

SEQ ID NO: 9398153 - DNA, 22 bp, Homo sapiens
cagctgagctcccaggccatca

SEQ ID NO: 9398154 - DNA, 22 bp, Homo sapiens
cagctgagcatcactagtctgg

SEQ ID NO: 9398155 - DNA, 23 bp, Homo sapiens
cagctgaagcagcctgggctgga

SEQ ID NO: 9398156 - DNA, 22 bp, Homo sapiens
cagctgaagagaggtgctgagt

SEQ ID NO: 9398157 - DNA, 22 bp, Homo sapiens
cagctgaggaatactagatgta

SEQ ID NO: 9398158 - DNA, 22 bp, Homo sapiens
cagctgagctgccagactactg

SEQ ID NO: 9398159 - DNA, 22 bp, Homo sapiens
cagctgaggtcaaagaagcagg

SEQ ID NO: 9398160 - DNA, 22 bp, Homo sapiens
cagctgaggtcaaagaagcagg

SEQ ID NO: 9398161 - DNA, 22 bp, Homo sapiens
cagctctgttcatagatggtgc

SEQ ID NO: 9398162 - DNA, 22 bp, Homo sapiens
cagctctgttcatagatggtgc

SEQ ID NO: 9398163 - DNA, 22 bp, Homo sapiens
cagctctgttcaaactatccag

SEQ ID NO: 9398164 - DNA, 22 bp, Homo sapiens
cagctcttaacacagcttgtat

SEQ ID NO: 9398165 - DNA, 22 bp, Homo sapiens
cagctctgttgccctggaaacg

SEQ ID NO: 9398166 - DNA, 22 bp, Homo sapiens
cagctctgttgccaaagtgggc

SEQ ID NO: 9398167 - DNA, 22 bp, Homo sapiens
cagctctgttgccaaagtgggc

SEQ ID NO: 9398168 - DNA, 22 bp, Homo sapiens
cagctcttagagggagacagac

SEQ ID NO: 9398169 - DNA, 22 bp, Homo sapiens
cagctcttaacacagcttgtat

SEQ ID NO: 9398170 - DNA, 22 bp, Homo sapiens
cagctcttcagagtgagcaatg

SEQ ID NO: 9398171 - DNA, 22 bp, Homo sapiens
cagctcttcagtgcctgagata

SEQ ID NO: 9398172 - DNA, 22 bp, Homo sapiens
cagctcttcctaccctagttgg

SEQ ID NO: 9398173 - DNA, 22 bp, Homo sapiens
cagctcttccctcttcttgtag

SEQ ID NO: 9398174 - DNA, 22 bp, Homo sapiens
cagctcttcctagccatgccac

SEQ ID NO: 9398175 - DNA, 22 bp, Homo sapiens
cagctcttcctagccatgccac

SEQ ID NO: 9398176 - DNA, 22 bp, Homo sapiens
cagctcttggagcctccagtaa

SEQ ID NO: 9398177 - DNA, 22 bp, Homo sapiens
cagctcttggagcctccagtaa

SEQ ID NO: 9398178 - DNA, 22 bp, Homo sapiens
cagctgaaagaaggaagtgtca

SEQ ID NO: 9398179 - DNA, 22 bp, Homo sapiens
cagctgaacatgtagagcatct

SEQ ID NO: 9398180 - DNA, 22 bp, Homo sapiens
cagctgaagaaagagtggttag

SEQ ID NO: 9398181 - DNA, 22 bp, Homo sapiens
gtggcagaagagtaggatgggc

SEQ ID NO: 9398182 - DNA, 22 bp, Homo sapiens
gtggcagaagagtaggatgggc

SEQ ID NO: 9398183 - DNA, 22 bp, Homo sapiens
gtggcagaaatgggactttgag

SEQ ID NO: 9398184 - DNA, 22 bp, Homo sapiens
gtggcagagaacaaggagaggt

SEQ ID NO: 9398185 - DNA, 22 bp, Homo sapiens
gtggcagagaacaaggagaggt

SEQ ID NO: 9398186 - DNA, 22 bp, Homo sapiens
gtggcagagaacaaggagaggt

SEQ ID NO: 9398187 - DNA, 22 bp, Homo sapiens
gtggcagagcaggagacaggac

SEQ ID NO: 9398188 - DNA, 22 bp, Homo sapiens
gtggcagagcaggagacaggac

SEQ ID NO: 9398189 - DNA, 22 bp, Homo sapiens
gtggcaggttataagcatctca

SEQ ID NO: 9398190 - DNA, 22 bp, Homo sapiens
gtggcaggttataagcatctca

SEQ ID NO: 9398191 - DNA, 22 bp, Homo sapiens
gtggcaggttataagcatctca

SEQ ID NO: 9398192 - DNA, 22 bp, Homo sapiens
gtggcaggttataagcatctca

SEQ ID NO: 9398193 - DNA, 22 bp, Homo sapiens
gtggcaggtggagcctcctgca

SEQ ID NO: 9398194 - DNA, 22 bp, Homo sapiens
gtggcaggtggagcctcctgca

SEQ ID NO: 9398195 - DNA, 22 bp, Homo sapiens
gtggcaggttataagcatctca

SEQ ID NO: 9398196 - DNA, 22 bp, Homo sapiens
gtggcaggttataagcatctca

SEQ ID NO: 9398197 - DNA, 22 bp, Homo sapiens
gtggcaggtcccattggagcag

SEQ ID NO: 9398198 - DNA, 22 bp, Homo sapiens
gtggcaggtcccattggagcag

SEQ ID NO: 9398199 - DNA, 22 bp, Homo sapiens
gtggcaggtcccattggagcag

SEQ ID NO: 9398200 - DNA, 22 bp, Homo sapiens
gtggcagggtgctcatcatgca

SEQ ID NO: 9398201 - DNA, 22 bp, Homo sapiens
gtggcaggtcccattggagcag

SEQ ID NO: 9398202 - DNA, 22 bp, Homo sapiens
gtggcagagccaaggctggagc

SEQ ID NO: 9398203 - DNA, 22 bp, Homo sapiens
gtggcagagccaaggctggagc

SEQ ID NO: 9398204 - DNA, 22 bp, Homo sapiens
gtggcagggtgctcatcatgca

SEQ ID NO: 9398205 - DNA, 22 bp, Homo sapiens
gtggcagggtgctcatcatgca

SEQ ID NO: 9398206 - DNA, 22 bp, Homo sapiens
gtggcagggtgctcatcatgca

SEQ ID NO: 9398207 - DNA, 22 bp, Homo sapiens
gtggcagaaactggcagaggag

SEQ ID NO: 9398208 - DNA, 22 bp, Homo sapiens
gtggcagaaactggcagaggag

SEQ ID NO: 9398209 - DNA, 22 bp, Homo sapiens
gtggcactgggtgagtgagtga

SEQ ID NO: 9398210 - DNA, 22 bp, Homo sapiens
gtggcactgggtgagtgagtga

SEQ ID NO: 9398211 - DNA, 22 bp, Homo sapiens
gtggcactggggtctagctggc

SEQ ID NO: 9398212 - DNA, 22 bp, Homo sapiens
gtggcactgtttcccacggaag

SEQ ID NO: 9398213 - DNA, 22 bp, Homo sapiens
gtggcactggtagttttaagat

SEQ ID NO: 9398214 - DNA, 22 bp, Homo sapiens
gtggcactgatagtttcactct

SEQ ID NO: 9398215 - DNA, 22 bp, Homo sapiens
gtggagccctgccttgctcatg

SEQ ID NO: 9398216 - DNA, 22 bp, Homo sapiens
gtggcactcacctgtagtttca

SEQ ID NO: 9398217 - DNA, 22 bp, Homo sapiens
gtggagccaggggctgtaggta

SEQ ID NO: 9398218 - DNA, 22 bp, Homo sapiens
cagcccaggccgacagttcctc

SEQ ID NO: 9398219 - DNA, 22 bp, Homo sapiens
cagcccagccgagggcctggct

SEQ ID NO: 9398220 - DNA, 22 bp, Homo sapiens
cagcccagccgagggcctggct

SEQ ID NO: 9398221 - DNA, 22 bp, Homo sapiens
cagcccagcgcaaacaactggc

SEQ ID NO: 9398222 - DNA, 22 bp, Homo sapiens
cagcccagccgagggcctggct

SEQ ID NO: 9398223 - DNA, 21 bp, Homo sapiens
cagcccagcttcttccccagt

SEQ ID NO: 9398224 - DNA, 22 bp, Homo sapiens
cagctctgtgcaggcctgggga

SEQ ID NO: 9398225 - DNA, 22 bp, Homo sapiens
cagctctgtgcaggcctgggga

SEQ ID NO: 9398226 - DNA, 22 bp, Homo sapiens
cagctctgtgtattttccccac

SEQ ID NO: 9398227 - DNA, 22 bp, Homo sapiens
cagctctgtgggagcgtatgtg

SEQ ID NO: 9398228 - DNA, 22 bp, Homo sapiens
cagctctgggagtcccacccct

SEQ ID NO: 9398229 - DNA, 22 bp, Homo sapiens
cagctctgtgcaggcctgggga

SEQ ID NO: 9398230 - DNA, 20 bp, Homo sapiens
cagctctgggaaagaggcca

SEQ ID NO: 9398231 - DNA, 22 bp, Homo sapiens
cagctctggctattgaggacca

SEQ ID NO: 9398232 - DNA, 22 bp, Homo sapiens
cagctctggctattgaggacca

SEQ ID NO: 9398233 - DNA, 22 bp, Homo sapiens
cagctctggctttggggagctt

SEQ ID NO: 9398234 - DNA, 22 bp, Homo sapiens
cagctctggcgtcagggagcga

SEQ ID NO: 9398235 - DNA, 22 bp, Homo sapiens
cagctctggccagatctatcct

SEQ ID NO: 9398236 - DNA, 22 bp, Homo sapiens
cagctctggcgtcagggagcga

SEQ ID NO: 9398237 - DNA, 22 bp, Homo sapiens
cagctctgcttccttgtacagg

SEQ ID NO: 9398238 - DNA, 22 bp, Homo sapiens
cagctctggcagagcccaaccc

SEQ ID NO: 9398239 - DNA, 22 bp, Homo sapiens
cagctctggcagagcccaaccc

SEQ ID NO: 9398240 - DNA, 22 bp, Homo sapiens
cagctctggcagagcccaaccc

SEQ ID NO: 9398241 - DNA, 22 bp, Homo sapiens
cagctctgcttccttgtacagg

SEQ ID NO: 9398242 - DNA, 22 bp, Homo sapiens
cagctctgcttccttgtacagg

SEQ ID NO: 9398243 - DNA, 22 bp, Homo sapiens
cagctctgctggtggtgccagg

SEQ ID NO: 9398244 - DNA, 22 bp, Homo sapiens
cagctctgctggtggtgccagg

SEQ ID NO: 9398245 - DNA, 22 bp, Homo sapiens
gtggccattttttcctagcaca

SEQ ID NO: 9398246 - DNA, 22 bp, Homo sapiens
gtggccagtcccgatgcttgtt

SEQ ID NO: 9398247 - DNA, 22 bp, Homo sapiens
gtggccaggtcagggacttgtg

SEQ ID NO: 9398248 - DNA, 22 bp, Homo sapiens
gtggccaggtcagggacttgtg

SEQ ID NO: 9398249 - DNA, 22 bp, Homo sapiens
gtggccagggcccacaggatga

SEQ ID NO: 9398250 - DNA, 22 bp, Homo sapiens
gtggccagggcccacaggatga

SEQ ID NO: 9398251 - DNA, 22 bp, Homo sapiens
gtggccaggtcagggacttgtg

SEQ ID NO: 9398252 - DNA, 22 bp, Homo sapiens
gtggccagggcccacaggatga

SEQ ID NO: 9398253 - DNA, 22 bp, Homo sapiens
gtggccagtgggaatgggctca

SEQ ID NO: 9398254 - DNA, 22 bp, Homo sapiens
gtggccagtgggaatgggctca

SEQ ID NO: 9398255 - DNA, 22 bp, Homo sapiens
gtggccagtgggaatgggctca

SEQ ID NO: 9398256 - DNA, 21 bp, Homo sapiens
gtggccagtgactacttattg

SEQ ID NO: 9398257 - DNA, 22 bp, Homo sapiens
gtggccagtgggaatgggctca

SEQ ID NO: 9398258 - DNA, 22 bp, Homo sapiens
gtggccagtgggaatgggctca

SEQ ID NO: 9398259 - DNA, 22 bp, Homo sapiens
gtggccagtggtgggcgccctg

SEQ ID NO: 9398260 - DNA, 22 bp, Homo sapiens
gtggccatttggaaggcaagta

SEQ ID NO: 9398261 - DNA, 22 bp, Homo sapiens
gtggccatctttggccctgact

SEQ ID NO: 9398262 - DNA, 22 bp, Homo sapiens
gtggccatgtgcttgcagggta

SEQ ID NO: 9398263 - DNA, 22 bp, Homo sapiens
gtggccaggccgactgccaggc

SEQ ID NO: 9398264 - DNA, 22 bp, Homo sapiens
gtggccaggcgtccgcgcggct

SEQ ID NO: 9398265 - DNA, 19 bp, Homo sapiens
gtggccagggcaggggctg

SEQ ID NO: 9398266 - DNA, 19 bp, Homo sapiens
gtggccagggcaggggctg

SEQ ID NO: 9398267 - DNA, 19 bp, Homo sapiens
gtggccagggcaggggctg

SEQ ID NO: 9398268 - DNA, 19 bp, Homo sapiens
gtggccagggcaggggctg

SEQ ID NO: 9398269 - DNA, 22 bp, Homo sapiens
gtggcaggttccgtagacagca

SEQ ID NO: 9398270 - DNA, 22 bp, Homo sapiens
caggaggaagaactctgcaaca

SEQ ID NO: 9398271 - DNA, 22 bp, Homo sapiens
caggaggaacaagaggttctgg

SEQ ID NO: 9398272 - DNA, 22 bp, Homo sapiens
caggaggaagaactctgcaaca

SEQ ID NO: 9398273 - DNA, 22 bp, Homo sapiens
caggaggaagaactctgcaaca

SEQ ID NO: 9398274 - DNA, 22 bp, Homo sapiens
caggaggattgcttgaggccag

SEQ ID NO: 9398275 - DNA, 22 bp, Homo sapiens
caggaggattgcttgaggccag

SEQ ID NO: 9398276 - DNA, 20 bp, Homo sapiens
caggaggcaaggtcaaggtc

SEQ ID NO: 9398277 - DNA, 22 bp, Homo sapiens
caggaggcagaggatgcccagt

SEQ ID NO: 9398278 - DNA, 22 bp, Homo sapiens
caggaggaaagttccactcaac

SEQ ID NO: 9398279 - DNA, 22 bp, Homo sapiens
caggaggaaatgtgaccctgct

SEQ ID NO: 9398280 - DNA, 22 bp, Homo sapiens
caggaggaaagttccactcaac

SEQ ID NO: 9398281 - DNA, 22 bp, Homo sapiens
caggaggaacaagaggttctgg

SEQ ID NO: 9398282 - DNA, 22 bp, Homo sapiens
caggaggaaatgtgaccctgct

SEQ ID NO: 9398283 - DNA, 22 bp, Homo sapiens
caggaggaaatgtgaccctgct

SEQ ID NO: 9398284 - DNA, 22 bp, Homo sapiens
caggaggcagaggatgcccagt

SEQ ID NO: 9398285 - DNA, 22 bp, Homo sapiens
caggaggcagaggttgcagcga

SEQ ID NO: 9398286 - DNA, 22 bp, Homo sapiens
caggaggcagaggttgcagcga

SEQ ID NO: 9398287 - DNA, 22 bp, Homo sapiens
caggagctgggtctggaagcag

SEQ ID NO: 9398288 - DNA, 22 bp, Homo sapiens
caggagcttctgcccatggcca

SEQ ID NO: 9398289 - DNA, 22 bp, Homo sapiens
caggaggaaactggattcactt

SEQ ID NO: 9398290 - DNA, 22 bp, Homo sapiens
caggaggaaactggattcactt

SEQ ID NO: 9398291 - DNA, 21 bp, Homo sapiens
taaatgtgagcagggctgggc

SEQ ID NO: 9398292 - DNA, 22 bp, Homo sapiens
taaatgtaccttctgccttact

SEQ ID NO: 9398293 - DNA, 22 bp, Homo sapiens
taaatgtactgaggcaacagga

SEQ ID NO: 9398294 - DNA, 22 bp, Homo sapiens
taaatgtagtcaaaggagcctc

SEQ ID NO: 9398295 - DNA, 22 bp, Homo sapiens
taaatgtactgaggcaacagga

SEQ ID NO: 9398296 - DNA, 22 bp, Homo sapiens
taaatgtaaatggcgtcttgcg

SEQ ID NO: 9398297 - DNA, 22 bp, Homo sapiens
taaatgtaaatggcgtcttgcg

SEQ ID NO: 9398298 - DNA, 22 bp, Homo sapiens
taaatgtataggcactaaacct

SEQ ID NO: 9398299 - DNA, 22 bp, Homo sapiens
taaatgtataggcactaaacct

SEQ ID NO: 9398300 - DNA, 22 bp, Homo sapiens
taaatgtataggcactaaacct

SEQ ID NO: 9398301 - DNA, 22 bp, Homo sapiens
taaatgtagtcaaaggagcctc

SEQ ID NO: 9398302 - DNA, 22 bp, Homo sapiens
caggagtttctattgttccaaa

SEQ ID NO: 9398303 - DNA, 22 bp, Homo sapiens
caggagttcaaggttgcagtga

SEQ ID NO: 9398304 - DNA, 22 bp, Homo sapiens
caggagttcaaggttgcagtga

SEQ ID NO: 9398305 - DNA, 22 bp, Homo sapiens
caggagtgttgattgctcagga

SEQ ID NO: 9398306 - DNA, 22 bp, Homo sapiens
caggagtgtcgggtcactaggt

SEQ ID NO: 9398307 - DNA, 22 bp, Homo sapiens
caggagtgtcgggtcactaggt

SEQ ID NO: 9398308 - DNA, 22 bp, Homo sapiens
caggagtggtgtgagggactcc

SEQ ID NO: 9398309 - DNA, 22 bp, Homo sapiens
caggagtggtgtgagggactcc

SEQ ID NO: 9398310 - DNA, 22 bp, Homo sapiens
caggagtggtgtgagggactcc

SEQ ID NO: 9398311 - DNA, 22 bp, Homo sapiens
caggagtgtctccacacagcaa

SEQ ID NO: 9398312 - DNA, 22 bp, Homo sapiens
caggagtgtctccacacagcaa

SEQ ID NO: 9398313 - DNA, 22 bp, Homo sapiens
caggagtggtgtgagggactcc

SEQ ID NO: 9398314 - DNA, 22 bp, Homo sapiens
caggagtgaaatgaggcccagg

SEQ ID NO: 9398315 - DNA, 22 bp, Homo sapiens
caggagtgagttggggtctaca

SEQ ID NO: 9398316 - DNA, 22 bp, Homo sapiens
caggagggggtggagtttcgcc

SEQ ID NO: 9398317 - DNA, 22 bp, Homo sapiens
caggagggcccgagactcttcc

SEQ ID NO: 9398318 - DNA, 22 bp, Homo sapiens
caggaggcatcatggagcggac

SEQ ID NO: 9398319 - DNA, 22 bp, Homo sapiens
caggaggcccaaagggcgcaga

SEQ ID NO: 9398320 - DNA, 22 bp, Homo sapiens
caggagagcccgggtccgggct

SEQ ID NO: 9398321 - DNA, 22 bp, Homo sapiens
caggagagcccgggtccgggct

SEQ ID NO: 9398322 - DNA, 22 bp, Homo sapiens
caggagagcccgggtccgggct

SEQ ID NO: 9398323 - DNA, 22 bp, Homo sapiens
caggagagatatgagtccccac

SEQ ID NO: 9398324 - DNA, 22 bp, Homo sapiens
caggagactcagcatccaggat

SEQ ID NO: 9398325 - DNA, 19 bp, Homo sapiens
caggagagcatgcactttg

SEQ ID NO: 9398326 - DNA, 22 bp, Homo sapiens
caggagatcttaggaattctta

SEQ ID NO: 9398327 - DNA, 22 bp, Homo sapiens
caggagataaaagagatgcttt

SEQ ID NO: 9398328 - DNA, 22 bp, Homo sapiens
caggagataaaagagatgcttt

SEQ ID NO: 9398329 - DNA, 22 bp, Homo sapiens
caggagataaaagagatgcttt

SEQ ID NO: 9398330 - DNA, 22 bp, Homo sapiens
caggagatgacagggaagaacc

SEQ ID NO: 9398331 - DNA, 22 bp, Homo sapiens
caggagatgcggtgtttgctct

SEQ ID NO: 9398332 - DNA, 23 bp, Homo sapiens
caggagatggctgctgtgtcagc

SEQ ID NO: 9398333 - DNA, 22 bp, Homo sapiens
caggagatgtaagacttctgtt

SEQ ID NO: 9398334 - DNA, 22 bp, Homo sapiens
caggagatgtaagacttctgtt

SEQ ID NO: 9398335 - DNA, 22 bp, Homo sapiens
caggagatgtacctgtttttga

SEQ ID NO: 9398336 - DNA, 22 bp, Homo sapiens
caggagcccgttgctccggcgg

SEQ ID NO: 9398337 - DNA, 22 bp, Homo sapiens
caggagccccaggctgacaata

SEQ ID NO: 9398338 - DNA, 22 bp, Homo sapiens
caggagcccgttgctccggcgg

SEQ ID NO: 9398339 - DNA, 22 bp, Homo sapiens
caggagctcagatgacatctca

SEQ ID NO: 9398340 - DNA, 22 bp, Homo sapiens
caggagctactcaggttgggtt

SEQ ID NO: 9398341 - DNA, 22 bp, Homo sapiens
taaagcagtgtggttgtgtccc

SEQ ID NO: 9398342 - DNA, 22 bp, Homo sapiens
caggagctggatctccttgcgg

SEQ ID NO: 9398343 - DNA, 22 bp, Homo sapiens
taaagcagtgcaaaagcgtttt

SEQ ID NO: 9398344 - DNA, 22 bp, Homo sapiens
taaagcataatgaatatctaga

SEQ ID NO: 9398345 - DNA, 22 bp, Homo sapiens
taaagcagtgttgggtcggacg

SEQ ID NO: 9398346 - DNA, 22 bp, Homo sapiens
taaagcataatgaatatctaga

SEQ ID NO: 9398347 - DNA, 22 bp, Homo sapiens
caggagctcttaaggatgtgat

SEQ ID NO: 9398348 - DNA, 22 bp, Homo sapiens
caggagctctcatcgtcagggc

SEQ ID NO: 9398349 - DNA, 22 bp, Homo sapiens
caggagctcttaaggatgtgat

SEQ ID NO: 9398350 - DNA, 22 bp, Homo sapiens
taaatatcacctggaattgtta

SEQ ID NO: 9398351 - DNA, 22 bp, Homo sapiens
taaatatcacctggaattgtta

SEQ ID NO: 9398352 - DNA, 22 bp, Homo sapiens
taaatatcagtccagctcttcc

SEQ ID NO: 9398353 - DNA, 22 bp, Homo sapiens
taaatatcagtccagctcttcc

SEQ ID NO: 9398354 - DNA, 22 bp, Homo sapiens
taaatatgcatgtatccttatc

SEQ ID NO: 9398355 - DNA, 22 bp, Homo sapiens
taaatagaatctaaactgctca

SEQ ID NO: 9398356 - DNA, 22 bp, Homo sapiens
taaatagaatctaaactgctca

SEQ ID NO: 9398357 - DNA, 22 bp, Homo sapiens
taaatagagaatcagcttggag

SEQ ID NO: 9398358 - DNA, 22 bp, Homo sapiens
taaatagagaatcagcttggag

SEQ ID NO: 9398359 - DNA, 18 bp, Homo sapiens
taaatatatttccccctt

SEQ ID NO: 9398360 - DNA, 18 bp, Homo sapiens
taaatatatttccccctt

SEQ ID NO: 9398361 - DNA, 17 bp, Homo sapiens
taaagccagtcaagtca

SEQ ID NO: 9398362 - DNA, 22 bp, Homo sapiens
taaagccacgctggaaatcagg

SEQ ID NO: 9398363 - DNA, 22 bp, Homo sapiens
taaagccacttcattctagtct

SEQ ID NO: 9398364 - DNA, 22 bp, Homo sapiens
taaagcatttttgaaattatga

SEQ ID NO: 9398365 - DNA, 22 bp, Homo sapiens
taaagtcatctttacatctttg

SEQ ID NO: 9398366 - DNA, 22 bp, Homo sapiens
taaagtcatctttaaacatgcc

SEQ ID NO: 9398367 - DNA, 22 bp, Homo sapiens
taaagtcatctttaaacatgcc

SEQ ID NO: 9398368 - DNA, 22 bp, Homo sapiens
taaagtcacagagcaggtgcaa

SEQ ID NO: 9398369 - DNA, 23 bp, Homo sapiens
taaagtcacatattagagtgagc

SEQ ID NO: 9398370 - DNA, 22 bp, Homo sapiens
taaagtcagagatccttggctt

SEQ ID NO: 9398371 - DNA, 22 bp, Homo sapiens
taaagtcagggagattgaggct

SEQ ID NO: 9398372 - DNA, 22 bp, Homo sapiens
taaagtcataagagtggatccg

SEQ ID NO: 9398373 - DNA, 22 bp, Homo sapiens
taaagtcagatatctgggttga

SEQ ID NO: 9398374 - DNA, 22 bp, Homo sapiens
caggaagcatctggctagctaa

SEQ ID NO: 9398375 - DNA, 22 bp, Homo sapiens
caggaagccacaggacaggtag

SEQ ID NO: 9398376 - DNA, 22 bp, Homo sapiens
caggaagccacaggacaggtag

SEQ ID NO: 9398377 - DNA, 22 bp, Homo sapiens
caggaagccacaggacaggtag

SEQ ID NO: 9398378 - DNA, 22 bp, Homo sapiens
caggaagctcttagcagtcacc

SEQ ID NO: 9398379 - DNA, 22 bp, Homo sapiens
caggaagctcttagcagtcacc

SEQ ID NO: 9398380 - DNA, 22 bp, Homo sapiens
caggaagctagattttgttgct

SEQ ID NO: 9398381 - DNA, 22 bp, Homo sapiens
caggaagccttccttgtctgct

SEQ ID NO: 9398382 - DNA, 22 bp, Homo sapiens
gtttgtatgaatgttttatgct

SEQ ID NO: 9398383 - DNA, 22 bp, Homo sapiens
caggaagcagtagaacttttcc

SEQ ID NO: 9398384 - DNA, 23 bp, Homo sapiens
caggaagcagatggggtagaaga

SEQ ID NO: 9398385 - DNA, 23 bp, Homo sapiens
caggaagcagatggggtagaaga

SEQ ID NO: 9398386 - DNA, 21 bp, Homo sapiens
gtttggaacagaccctgggga

SEQ ID NO: 9398387 - DNA, 22 bp, Homo sapiens
caggaagctgatgtctagtcat

SEQ ID NO: 9398388 - DNA, 22 bp, Homo sapiens
caggaagctgagctgcactgca

SEQ ID NO: 9398389 - DNA, 22 bp, Homo sapiens
caggaagctgagctgcactgca

SEQ ID NO: 9398390 - DNA, 22 bp, Homo sapiens
caggaagctggtcagatcctgt

SEQ ID NO: 9398391 - DNA, 22 bp, Homo sapiens
caggaagctgggtttccataca

SEQ ID NO: 9398392 - DNA, 22 bp, Homo sapiens
caggaagctgccggtgagcgag

SEQ ID NO: 9398393 - DNA, 22 bp, Homo sapiens
caggaagctgccggtgagcgag

SEQ ID NO: 9398394 - DNA, 22 bp, Homo sapiens
caggaagctgccggtgagcgag

SEQ ID NO: 9398395 - DNA, 22 bp, Homo sapiens
caggaagggggatccttggaag

SEQ ID NO: 9398396 - DNA, 22 bp, Homo sapiens
caggaagctgtgaaggagacgg

SEQ ID NO: 9398397 - DNA, 22 bp, Homo sapiens
caggaagctgtgaaggagacgg

SEQ ID NO: 9398398 - DNA, 22 bp, Homo sapiens
caggaaggaaagggtgtggaga

SEQ ID NO: 9398399 - DNA, 22 bp, Homo sapiens
caggaatgacccaacagtttca

SEQ ID NO: 9398400 - DNA, 22 bp, Homo sapiens
caggaatgaaaggtcagggttg

SEQ ID NO: 9398401 - DNA, 22 bp, Homo sapiens
caggaatgaaaggtcagggttg

SEQ ID NO: 9398402 - DNA, 22 bp, Homo sapiens
caggaatgactgcagatggggc

SEQ ID NO: 9398403 - DNA, 22 bp, Homo sapiens
caggaagtgtgcctgagcacct

SEQ ID NO: 9398404 - DNA, 22 bp, Homo sapiens
caggaagttgtgtgttcgaggc

SEQ ID NO: 9398405 - DNA, 22 bp, Homo sapiens
caggaagtcgcagagctggggg

SEQ ID NO: 9398406 - DNA, 22 bp, Homo sapiens
caggaagtgctcgctgtgggga

SEQ ID NO: 9398407 - DNA, 22 bp, Homo sapiens
caggaagtgcctggtgagagga

SEQ ID NO: 9398408 - DNA, 22 bp, Homo sapiens
caggaagtggctgggctgggtt

SEQ ID NO: 9398409 - DNA, 22 bp, Homo sapiens
caggaagtgtgagggtggtgta

SEQ ID NO: 9398410 - DNA, 22 bp, Homo sapiens
caggaagtgtgagggtggtgta

SEQ ID NO: 9398411 - DNA, 18 bp, Homo sapiens
caggaatggatgggattt

SEQ ID NO: 9398412 - DNA, 22 bp, Homo sapiens
caggaatggaggcatttatgaa

SEQ ID NO: 9398413 - DNA, 22 bp, Homo sapiens
caggaatgccttcttcagccat

SEQ ID NO: 9398414 - DNA, 22 bp, Homo sapiens
caggaatgccaaccagtgcatg

SEQ ID NO: 9398415 - DNA, 22 bp, Homo sapiens
caggaatgggtgacagtcagct

SEQ ID NO: 9398416 - DNA, 22 bp, Homo sapiens
caggaatgtatgatacagtggt

SEQ ID NO: 9398417 - DNA, 22 bp, Homo sapiens
caggaatgtagcagcgatggaa

SEQ ID NO: 9398418 - DNA, 22 bp, Homo sapiens
caggaatggttgggactatgtt

SEQ ID NO: 9398419 - DNA, 22 bp, Homo sapiens
caggaatggttaatctaaagtg

SEQ ID NO: 9398420 - DNA, 22 bp, Homo sapiens
caggaatgagttctggtgctct

SEQ ID NO: 9398421 - DNA, 22 bp, Homo sapiens
caggaatgagttctggtgctct

SEQ ID NO: 9398422 - DNA, 22 bp, Homo sapiens
caggaatgaggtcgtaagtgtc

SEQ ID NO: 9398423 - DNA, 19 bp, Homo sapiens
caggaatgaggtaatggct

SEQ ID NO: 9398424 - DNA, 22 bp, Homo sapiens
caggaatgatctgctgagtgat

SEQ ID NO: 9398425 - DNA, 22 bp, Homo sapiens
caggaatgatattcgaggagat

SEQ ID NO: 9398426 - DNA, 22 bp, Homo sapiens
caggaatgcattctagaatggc

SEQ ID NO: 9398427 - DNA, 22 bp, Homo sapiens
caggaatgccaaccagtgcatg

SEQ ID NO: 9398428 - DNA, 22 bp, Homo sapiens
caggaatgtcccatccccttca

SEQ ID NO: 9398429 - DNA, 22 bp, Homo sapiens
caggaatgtccttgtcatttca

SEQ ID NO: 9398430 - DNA, 22 bp, Homo sapiens
caggaatgtgagggttccctgc

SEQ ID NO: 9398431 - DNA, 22 bp, Homo sapiens
caggaatgttgcatgtgatctt

SEQ ID NO: 9398432 - DNA, 22 bp, Homo sapiens
caggaatgtttgtgctccttta

SEQ ID NO: 9398433 - DNA, 22 bp, Homo sapiens
caggaattcatagcattgttct

SEQ ID NO: 9398434 - DNA, 22 bp, Homo sapiens
caggacaaagccctttgagaaa

SEQ ID NO: 9398435 - DNA, 22 bp, Homo sapiens
caggacacagggtgtggctgat

SEQ ID NO: 9398436 - DNA, 22 bp, Homo sapiens
caggacagctgggccaccacca

SEQ ID NO: 9398437 - DNA, 22 bp, Homo sapiens
caggacagctcaacacctcctc

SEQ ID NO: 9398438 - DNA, 22 bp, Homo sapiens
caggacacttgttcttctctgc

SEQ ID NO: 9398439 - DNA, 22 bp, Homo sapiens
caggacacttgttcttctctgc

SEQ ID NO: 9398440 - DNA, 22 bp, Homo sapiens
caggacaggccctgtggggtct

SEQ ID NO: 9398441 - DNA, 22 bp, Homo sapiens
caggacaggccctgtggggtct

SEQ ID NO: 9398442 - DNA, 22 bp, Homo sapiens
caggacaggagtggggtcaaag

SEQ ID NO: 9398443 - DNA, 22 bp, Homo sapiens
caggacaggtgttctagatcag

SEQ ID NO: 9398444 - DNA, 22 bp, Homo sapiens
caggacaggccctgtggggtct

SEQ ID NO: 9398445 - DNA, 22 bp, Homo sapiens
caggacagtgcaggtccatcct

SEQ ID NO: 9398446 - DNA, 22 bp, Homo sapiens
caggacagtgcaggtccatcct

SEQ ID NO: 9398447 - DNA, 22 bp, Homo sapiens
gttttccactggattgtttgga

SEQ ID NO: 9398448 - DNA, 22 bp, Homo sapiens
gttttccaggtaccttggtatt

SEQ ID NO: 9398449 - DNA, 22 bp, Homo sapiens
gttttccaggtaccttggtatt

SEQ ID NO: 9398450 - DNA, 22 bp, Homo sapiens
gttttccatggaggtctgacct

SEQ ID NO: 9398451 - DNA, 18 bp, Homo sapiens
gttttccatttgttcctc

SEQ ID NO: 9398452 - DNA, 22 bp, Homo sapiens
gttttcctgaaactgatggtgt

SEQ ID NO: 9398453 - DNA, 22 bp, Homo sapiens
taaaaaacattactctgtcctg

SEQ ID NO: 9398454 - DNA, 22 bp, Homo sapiens
gttttctggcagttattcctta

SEQ ID NO: 9398455 - DNA, 22 bp, Homo sapiens
gttttctgtttcttaacggcat

SEQ ID NO: 9398456 - DNA, 19 bp, Homo sapiens
taaaaactgaaggaagcag

SEQ ID NO: 9398457 - DNA, 22 bp, Homo sapiens
taaaaagcagctgagattttct

SEQ ID NO: 9398458 - DNA, 22 bp, Homo sapiens
taaaaagcagctgagattttct

SEQ ID NO: 9398459 - DNA, 22 bp, Homo sapiens
taaaaagtagtgagaatggcgc

SEQ ID NO: 9398460 - DNA, 19 bp, Homo sapiens
gttttctgatcttgccccc

SEQ ID NO: 9398461 - DNA, 22 bp, Homo sapiens
gttttctgccggtggtgggctc

SEQ ID NO: 9398462 - DNA, 22 bp, Homo sapiens
gttttctgcctgaaggtgacca

SEQ ID NO: 9398463 - DNA, 22 bp, Homo sapiens
gttttctgattagcaaatctga

SEQ ID NO: 9398464 - DNA, 22 bp, Homo sapiens
gttttctcatctcctcaatggt

SEQ ID NO: 9398465 - DNA, 22 bp, Homo sapiens
gttttctcatctcctcaatggt

SEQ ID NO: 9398466 - DNA, 22 bp, Homo sapiens
gttttcctgagcccagagatgc

SEQ ID NO: 9398467 - DNA, 22 bp, Homo sapiens
gttttccttctcagccattgcc

SEQ ID NO: 9398468 - DNA, 22 bp, Homo sapiens
taaaatagcatgtgcagtgaaa

SEQ ID NO: 9398469 - DNA, 22 bp, Homo sapiens
taaaatagcttatgtcttttga

SEQ ID NO: 9398470 - DNA, 22 bp, Homo sapiens
taaaatagcttatgtcttttga

SEQ ID NO: 9398471 - DNA, 22 bp, Homo sapiens
taaaaatcttatgaatggcaag

SEQ ID NO: 9398472 - DNA, 22 bp, Homo sapiens
taaaaatcttatgaatggcaag

SEQ ID NO: 9398473 - DNA, 22 bp, Homo sapiens
taaaaagtagtgagaatggcgc

SEQ ID NO: 9398474 - DNA, 22 bp, Homo sapiens
taaaatcaccaaaagcaggtgg

SEQ ID NO: 9398475 - DNA, 22 bp, Homo sapiens
taaaatagcttatgtcttttga

SEQ ID NO: 9398476 - DNA, 22 bp, Homo sapiens
taaaatcatgacagattgacat

SEQ ID NO: 9398477 - DNA, 22 bp, Homo sapiens
taaaatcatgacagattgacat

SEQ ID NO: 9398478 - DNA, 22 bp, Homo sapiens
taaaatcagccgaccatggtgg

SEQ ID NO: 9398479 - DNA, 22 bp, Homo sapiens
taaaatcattctggtgtcagta

SEQ ID NO: 9398480 - DNA, 22 bp, Homo sapiens
taaaatcattctggtgtcagta

SEQ ID NO: 9398481 - DNA, 22 bp, Homo sapiens
taaaatcattctggtgtcagta

SEQ ID NO: 9398482 - DNA, 22 bp, Homo sapiens
taaaatgacttcctccaacatc

SEQ ID NO: 9398483 - DNA, 22 bp, Homo sapiens
taaacatttgttattcttgttt

SEQ ID NO: 9398484 - DNA, 22 bp, Homo sapiens
taaaatgacttcctccaacatc

SEQ ID NO: 9398485 - DNA, 22 bp, Homo sapiens
taaaatgacttcctccaacatc

SEQ ID NO: 9398486 - DNA, 22 bp, Homo sapiens
taaaatgatctctcatgttctt

SEQ ID NO: 9398487 - DNA, 18 bp, Homo sapiens
taaaccagatgacagttg

SEQ ID NO: 9398488 - DNA, 22 bp, Homo sapiens
taaaccatccatcccacctgtg

SEQ ID NO: 9398489 - DNA, 22 bp, Homo sapiens
taaaccatgcagacagctccat

SEQ ID NO: 9398490 - DNA, 22 bp, Homo sapiens
taaaccatccatcccacctgtg

SEQ ID NO: 9398491 - DNA, 22 bp, Homo sapiens
taaaccattcacatcccagaaa

SEQ ID NO: 9398492 - DNA, 22 bp, Homo sapiens
taaaccatgcagacagctccat

SEQ ID NO: 9398493 - DNA, 22 bp, Homo sapiens
taaaccattcagactgaaccac

SEQ ID NO: 9398494 - DNA, 22 bp, Homo sapiens
taaaccattcagactgaaccac

SEQ ID NO: 9398495 - DNA, 22 bp, Homo sapiens
taaactatctgtgtttgaagtt

SEQ ID NO: 9398496 - DNA, 22 bp, Homo sapiens
taaactatctgtgtttgaagtt

SEQ ID NO: 9398497 - DNA, 22 bp, Homo sapiens
caggacagtgcaggtccatcct

SEQ ID NO: 9398498 - DNA, 22 bp, Homo sapiens
caggacagtgcaggtccatcct

SEQ ID NO: 9398499 - DNA, 22 bp, Homo sapiens
caggacagttggcatctgctgc

SEQ ID NO: 9398500 - DNA, 22 bp, Homo sapiens
caggacagtgcaggtccatcct

SEQ ID NO: 9398501 - DNA, 22 bp, Homo sapiens
caggaccaggcgttctgggctg

SEQ ID NO: 9398502 - DNA, 22 bp, Homo sapiens
caggacatcgtcatcatgggga

SEQ ID NO: 9398503 - DNA, 19 bp, Homo sapiens
caggacagtttgccaagaa

SEQ ID NO: 9398504 - DNA, 22 bp, Homo sapiens
caggacagttggcatctgctgc

SEQ ID NO: 9398505 - DNA, 19 bp, Homo sapiens
caggacagtttgccaagaa

SEQ ID NO: 9398506 - DNA, 19 bp, Homo sapiens
caggacagtttgccaagaa

SEQ ID NO: 9398507 - DNA, 19 bp, Homo sapiens
caggacagtttgccaagaa

SEQ ID NO: 9398508 - DNA, 22 bp, Homo sapiens
caggagaaggtttggagtgcag

SEQ ID NO: 9398509 - DNA, 22 bp, Homo sapiens
caggagaaggtttggagtgcag

SEQ ID NO: 9398510 - DNA, 22 bp, Homo sapiens
caggagaaggtttggagtgcag

SEQ ID NO: 9398511 - DNA, 22 bp, Homo sapiens
caggagaagtctctagggggtg

SEQ ID NO: 9398512 - DNA, 22 bp, Homo sapiens
caggagaagtctctagggggtg

SEQ ID NO: 9398513 - DNA, 22 bp, Homo sapiens
caggagaagtctctagggggtg

SEQ ID NO: 9398514 - DNA, 22 bp, Homo sapiens
caggagaaggtttggagtgcag

SEQ ID NO: 9398515 - DNA, 22 bp, Homo sapiens
caggagacaagttagcagctga

SEQ ID NO: 9398516 - DNA, 22 bp, Homo sapiens
caggagacaagttagcagctga

SEQ ID NO: 9398517 - DNA, 22 bp, Homo sapiens
taacacttcagatgattttgtt

SEQ ID NO: 9398518 - DNA, 22 bp, Homo sapiens
taacaatacccattctaattac

SEQ ID NO: 9398519 - DNA, 22 bp, Homo sapiens
taacagaaacagataagtgtaa

SEQ ID NO: 9398520 - DNA, 22 bp, Homo sapiens
taacagaaaggctcaggtgctc

SEQ ID NO: 9398521 - DNA, 22 bp, Homo sapiens
taacagaaaagaactgagtttg

SEQ ID NO: 9398522 - DNA, 22 bp, Homo sapiens
taacactttggattaaaattct

SEQ ID NO: 9398523 - DNA, 22 bp, Homo sapiens
taacaagagcacctgggaatgg

SEQ ID NO: 9398524 - DNA, 22 bp, Homo sapiens
taacaactgctgaggtatttga

SEQ ID NO: 9398525 - DNA, 22 bp, Homo sapiens
taacaagtcattttaaattatg

SEQ ID NO: 9398526 - DNA, 22 bp, Homo sapiens
taacaagtcattttaaattatg

SEQ ID NO: 9398527 - DNA, 21 bp, Homo sapiens
taacaagtctgcatacattca

SEQ ID NO: 9398528 - DNA, 22 bp, Homo sapiens
taacaagtcattttatcagcag

SEQ ID NO: 9398529 - DNA, 21 bp, Homo sapiens
taacaagtctgcatacattca

SEQ ID NO: 9398530 - DNA, 22 bp, Homo sapiens
taacaagtttcatttatagaat

SEQ ID NO: 9398531 - DNA, 22 bp, Homo sapiens
taacaagtttcatttatagaat

SEQ ID NO: 9398532 - DNA, 22 bp, Homo sapiens
taacattgtcagttcaactgct

SEQ ID NO: 9398533 - DNA, 22 bp, Homo sapiens
taacattaggtagacataagcc

SEQ ID NO: 9398534 - DNA, 22 bp, Homo sapiens
taacattaggtagacataagcc

SEQ ID NO: 9398535 - DNA, 22 bp, Homo sapiens
taacagaagttgttcattgtgg

SEQ ID NO: 9398536 - DNA, 22 bp, Homo sapiens
taacagaagatgaaacttcttt

SEQ ID NO: 9398537 - DNA, 22 bp, Homo sapiens
caggatgaagggcaaaggcaag

SEQ ID NO: 9398538 - DNA, 22 bp, Homo sapiens
caggatgaggtagaggcagata

SEQ ID NO: 9398539 - DNA, 18 bp, Homo sapiens
caggatgagtgatgggga

SEQ ID NO: 9398540 - DNA, 18 bp, Homo sapiens
caggatgagtgatgggga

SEQ ID NO: 9398541 - DNA, 19 bp, Homo sapiens
caggatgatcccatgacac

SEQ ID NO: 9398542 - DNA, 22 bp, Homo sapiens
caggatgaggtagaggcagata

SEQ ID NO: 9398543 - DNA, 22 bp, Homo sapiens
caggatgagaggcccagggaag

SEQ ID NO: 9398544 - DNA, 22 bp, Homo sapiens
caggatgaagggcaaaggcaag

SEQ ID NO: 9398545 - DNA, 21 bp, Homo sapiens
caggatgatgggaaggtggtg

SEQ ID NO: 9398546 - DNA, 22 bp, Homo sapiens
caggatgatgagtagagtgtga

SEQ ID NO: 9398547 - DNA, 22 bp, Homo sapiens
caggatggtctcgatctcctga

SEQ ID NO: 9398548 - DNA, 22 bp, Homo sapiens
caggatgctgaaaacacgagga

SEQ ID NO: 9398549 - DNA, 22 bp, Homo sapiens
caggatgctgaaaacacgagga

SEQ ID NO: 9398550 - DNA, 22 bp, Homo sapiens
caggatggtcttcatttggctc

SEQ ID NO: 9398551 - DNA, 22 bp, Homo sapiens
caggatggtggcatgatcagaa

SEQ ID NO: 9398552 - DNA, 22 bp, Homo sapiens
caggatggtcttcatttggctc

SEQ ID NO: 9398553 - DNA, 22 bp, Homo sapiens
caggatggtcttcatttggctc

SEQ ID NO: 9398554 - DNA, 22 bp, Homo sapiens
caggatggtctcgatctcctga

SEQ ID NO: 9398555 - DNA, 22 bp, Homo sapiens
caggatggtctcgatctcctga

SEQ ID NO: 9398556 - DNA, 22 bp, Homo sapiens
taacatttagaaagtgtccatt

SEQ ID NO: 9398557 - DNA, 22 bp, Homo sapiens
taacatttaaatttttcacata

SEQ ID NO: 9398558 - DNA, 22 bp, Homo sapiens
taacatttgctgtctcctatgt

SEQ ID NO: 9398559 - DNA, 22 bp, Homo sapiens
taacatttcggtgacagtggga

SEQ ID NO: 9398560 - DNA, 16 bp, Homo sapiens
taacatttttaaaagg

SEQ ID NO: 9398561 - DNA, 16 bp, Homo sapiens
taacatttttaaaagg

SEQ ID NO: 9398562 - DNA, 22 bp, Homo sapiens
taactttgagaactttctggtg

SEQ ID NO: 9398563 - DNA, 22 bp, Homo sapiens
taaggcagccgctcagagaggt

SEQ ID NO: 9398564 - DNA, 19 bp, Homo sapiens
taaggcagcagtgacaggc

SEQ ID NO: 9398565 - DNA, 19 bp, Homo sapiens
taaggcagcagtgacaggc

SEQ ID NO: 9398566 - DNA, 22 bp, Homo sapiens
caggcactttgctgggggcgca

SEQ ID NO: 9398567 - DNA, 22 bp, Homo sapiens
caggcagaaattttgtttcatt

SEQ ID NO: 9398568 - DNA, 22 bp, Homo sapiens
caggcacggtggctcatgcctg

SEQ ID NO: 9398569 - DNA, 22 bp, Homo sapiens
caggcactcagtctggatccct

SEQ ID NO: 9398570 - DNA, 22 bp, Homo sapiens
taaggcacgcggtgaatgccaa

SEQ ID NO: 9398571 - DNA, 22 bp, Homo sapiens
taaggcacttcaatgtttagaa

SEQ ID NO: 9398572 - DNA, 22 bp, Homo sapiens
taaggcagaaatatgagcaggg

SEQ ID NO: 9398573 - DNA, 22 bp, Homo sapiens
taaggcagaaatatgagcaggg

SEQ ID NO: 9398574 - DNA, 22 bp, Homo sapiens
taaggcacccttctgagtagag

SEQ ID NO: 9398575 - DNA, 22 bp, Homo sapiens
taaggcacccgtgagctgccag

SEQ ID NO: 9398576 - DNA, 22 bp, Homo sapiens
taaggcacctgtccaggctggg

SEQ ID NO: 9398577 - DNA, 22 bp, Homo sapiens
taaggcacgcataagagggggc

SEQ ID NO: 9398578 - DNA, 22 bp, Homo sapiens
taaggcaccataatatatttaa

SEQ ID NO: 9398579 - DNA, 22 bp, Homo sapiens
taaggcacccatgttcatacag

SEQ ID NO: 9398580 - DNA, 22 bp, Homo sapiens
taaggcacacagttgctgcatg

SEQ ID NO: 9398581 - DNA, 22 bp, Homo sapiens
taagcaacaaatggtttctgat

SEQ ID NO: 9398582 - DNA, 22 bp, Homo sapiens
taagatttttaaaatgtcctca

SEQ ID NO: 9398583 - DNA, 22 bp, Homo sapiens
taagattacagtgagaaataaa

SEQ ID NO: 9398584 - DNA, 22 bp, Homo sapiens
taagattacagtgagaaataaa

SEQ ID NO: 9398585 - DNA, 22 bp, Homo sapiens
taagcaaaggattttgatcttt

SEQ ID NO: 9398586 - DNA, 22 bp, Homo sapiens
taagcaaagtttataaggctct

SEQ ID NO: 9398587 - DNA, 22 bp, Homo sapiens
taagacacatgcgtacaagata

SEQ ID NO: 9398588 - DNA, 22 bp, Homo sapiens
caggcacagtggggtcctctct

SEQ ID NO: 9398589 - DNA, 22 bp, Homo sapiens
caggcacagtgttgctgttcaa

SEQ ID NO: 9398590 - DNA, 22 bp, Homo sapiens
caggcacagtggggtcctctct

SEQ ID NO: 9398591 - DNA, 22 bp, Homo sapiens
caggcacagttccaagcatttt

SEQ ID NO: 9398592 - DNA, 22 bp, Homo sapiens
caggcacatgggagctcatcat

SEQ ID NO: 9398593 - DNA, 22 bp, Homo sapiens
caggcacatgggagctcatcat

SEQ ID NO: 9398594 - DNA, 17 bp, Homo sapiens
caggcacatgaagccag

SEQ ID NO: 9398595 - DNA, 17 bp, Homo sapiens
caggcacatgaagccag

SEQ ID NO: 9398596 - DNA, 22 bp, Homo sapiens
caggcacatgggagctcatcat

SEQ ID NO: 9398597 - DNA, 22 bp, Homo sapiens
caggcaccaacttcctggggag

SEQ ID NO: 9398598 - DNA, 22 bp, Homo sapiens
caggcaccaacttcctggggag

SEQ ID NO: 9398599 - DNA, 22 bp, Homo sapiens
caggcaccaacttcctggggag

SEQ ID NO: 9398600 - DNA, 22 bp, Homo sapiens
caggcacaatgagcgccatctt

SEQ ID NO: 9398601 - DNA, 22 bp, Homo sapiens
caggcacaagatcggctagata

SEQ ID NO: 9398602 - DNA, 22 bp, Homo sapiens
caggcacaagatcggctagata

SEQ ID NO: 9398603 - DNA, 22 bp, Homo sapiens
caggcacaagatcggctagata

SEQ ID NO: 9398604 - DNA, 22 bp, Homo sapiens
caggcacaagatcggctagata

SEQ ID NO: 9398605 - DNA, 22 bp, Homo sapiens
caggcacagctaagactggcca

SEQ ID NO: 9398606 - DNA, 22 bp, Homo sapiens
caggcacagctaagactggcca

SEQ ID NO: 9398607 - DNA, 22 bp, Homo sapiens
caggcacagctaagactggcca

SEQ ID NO: 9398608 - DNA, 22 bp, Homo sapiens
caggcacaggggaatgtctttt

SEQ ID NO: 9398609 - DNA, 22 bp, Homo sapiens
caggcacagtggggtcctctct

SEQ ID NO: 9398610 - DNA, 22 bp, Homo sapiens
caggcacagctgggcaattgcg

SEQ ID NO: 9398611 - DNA, 22 bp, Homo sapiens
caggcacaggggaatgtctttt

SEQ ID NO: 9398612 - DNA, 22 bp, Homo sapiens
caggcaagattagagatgagca

SEQ ID NO: 9398613 - DNA, 22 bp, Homo sapiens
caggcaagattagagatgagca

SEQ ID NO: 9398614 - DNA, 22 bp, Homo sapiens
caggcaagcaaggggtcttgaa

SEQ ID NO: 9398615 - DNA, 22 bp, Homo sapiens
caggcaagcaaggggtcttgaa

SEQ ID NO: 9398616 - DNA, 22 bp, Homo sapiens
caggcaagcaaggggtcttgaa

SEQ ID NO: 9398617 - DNA, 22 bp, Homo sapiens
caggcaaggagctggctcaagt

SEQ ID NO: 9398618 - DNA, 22 bp, Homo sapiens
caggcaaggaggcactgaggga

SEQ ID NO: 9398619 - DNA, 22 bp, Homo sapiens
caggcaagcaaggggtcttgaa

SEQ ID NO: 9398620 - DNA, 22 bp, Homo sapiens
caggcaagcacggtgaacctgg

SEQ ID NO: 9398621 - DNA, 22 bp, Homo sapiens
caggcaaggactctggtaattt

SEQ ID NO: 9398622 - DNA, 22 bp, Homo sapiens
caggcaaggaggcactgaggga

SEQ ID NO: 9398623 - DNA, 22 bp, Homo sapiens
caggcaaggaggcactgaggga

SEQ ID NO: 9398624 - DNA, 22 bp, Homo sapiens
caggcaaggaggcactgaggga

SEQ ID NO: 9398625 - DNA, 22 bp, Homo sapiens
caggcacaaatttctagataag

SEQ ID NO: 9398626 - DNA, 22 bp, Homo sapiens
caggcacaaatttctagataag

SEQ ID NO: 9398627 - DNA, 22 bp, Homo sapiens
caggcaagttcatttccaggca

SEQ ID NO: 9398628 - DNA, 22 bp, Homo sapiens
caggcacaaaaggaccccagca

SEQ ID NO: 9398629 - DNA, 22 bp, Homo sapiens
caggatggtggcatgatcagaa

SEQ ID NO: 9398630 - DNA, 22 bp, Homo sapiens
caggatggtgtgagtgtgagga

SEQ ID NO: 9398631 - DNA, 22 bp, Homo sapiens
caggatggtgtgagtgtgagga

SEQ ID NO: 9398632 - DNA, 22 bp, Homo sapiens
caggatggtgtgagtgtgagga

SEQ ID NO: 9398633 - DNA, 22 bp, Homo sapiens
caggcaagatccagaggctgct

SEQ ID NO: 9398634 - DNA, 22 bp, Homo sapiens
caggcaagatccagaggctgct

SEQ ID NO: 9398635 - DNA, 22 bp, Homo sapiens
caggcaagattagagatgagca

SEQ ID NO: 9398636 - DNA, 22 bp, Homo sapiens
caggcaagatccagaggctgct

SEQ ID NO: 9398637 - DNA, 22 bp, Homo sapiens
caggcaagatccagaggctgct

SEQ ID NO: 9398638 - DNA, 22 bp, Homo sapiens
caggattgagcaaatggattat

SEQ ID NO: 9398639 - DNA, 19 bp, Homo sapiens
caggattgtttaaagcttt

SEQ ID NO: 9398640 - DNA, 22 bp, Homo sapiens
caggatttcatacatctttact

SEQ ID NO: 9398641 - DNA, 22 bp, Homo sapiens
caggcagctctaatggaaagtg

SEQ ID NO: 9398642 - DNA, 22 bp, Homo sapiens
caggcagcctgagggatctggg

SEQ ID NO: 9398643 - DNA, 22 bp, Homo sapiens
caggcagcctgagggatctggg

SEQ ID NO: 9398644 - DNA, 22 bp, Homo sapiens
caggcagctgactgtcagatat

SEQ ID NO: 9398645 - DNA, 22 bp, Homo sapiens
caggcagctctaatggaaagtg

SEQ ID NO: 9398646 - DNA, 22 bp, Homo sapiens
caggcagctctgcttttcctaa

SEQ ID NO: 9398647 - DNA, 22 bp, Homo sapiens
caggcagcaggagccctgctcg

SEQ ID NO: 9398648 - DNA, 22 bp, Homo sapiens
caggcagcaggagccctgctcg

SEQ ID NO: 9398649 - DNA, 22 bp, Homo sapiens
caggcagcaggagccctgctcg

SEQ ID NO: 9398650 - DNA, 22 bp, Homo sapiens
caggcagcagccactctggtat

SEQ ID NO: 9398651 - DNA, 22 bp, Homo sapiens
caggcagcagccactctggtat

SEQ ID NO: 9398652 - DNA, 22 bp, Homo sapiens
caggcagcatcagtctgctgta

SEQ ID NO: 9398653 - DNA, 22 bp, Homo sapiens
caggcagcatttactctgatga

SEQ ID NO: 9398654 - DNA, 22 bp, Homo sapiens
caggcagccaggggacctgtcc

SEQ ID NO: 9398655 - DNA, 22 bp, Homo sapiens
caggcaggagacatttggttgg

SEQ ID NO: 9398656 - DNA, 22 bp, Homo sapiens
caggcaggagaggaggatttct

SEQ ID NO: 9398657 - DNA, 22 bp, Homo sapiens
caggcaggagaggaggatttct

SEQ ID NO: 9398658 - DNA, 22 bp, Homo sapiens
caggcaggagaggaggatttct

SEQ ID NO: 9398659 - DNA, 22 bp, Homo sapiens
caggcaggagaggaggatttct

SEQ ID NO: 9398660 - DNA, 23 bp, Homo sapiens
caggcaggatgaggactacactc

SEQ ID NO: 9398661 - DNA, 22 bp, Homo sapiens
caggcaggagccagggattcca

SEQ ID NO: 9398662 - DNA, 22 bp, Homo sapiens
caggcaggagccagggattcca

SEQ ID NO: 9398663 - DNA, 22 bp, Homo sapiens
caggcaggagccagggattcca

SEQ ID NO: 9398664 - DNA, 23 bp, Homo sapiens
caggcaggatgaggactacactc

SEQ ID NO: 9398665 - DNA, 23 bp, Homo sapiens
caggcaggatgaggactacactc

SEQ ID NO: 9398666 - DNA, 22 bp, Homo sapiens
caggcaggctgctttttgttca

SEQ ID NO: 9398667 - DNA, 22 bp, Homo sapiens
caggcagggagccactgtataa

SEQ ID NO: 9398668 - DNA, 22 bp, Homo sapiens
caggcagggagccactgtataa

SEQ ID NO: 9398669 - DNA, 22 bp, Homo sapiens
caggcagggagccactgtataa

SEQ ID NO: 9398670 - DNA, 22 bp, Homo sapiens
caggcagctgcgacaagagagc

SEQ ID NO: 9398671 - DNA, 22 bp, Homo sapiens
caggcagctgaggactttgcta

SEQ ID NO: 9398672 - DNA, 22 bp, Homo sapiens
caggcagctgaggactttgcta

SEQ ID NO: 9398673 - DNA, 22 bp, Homo sapiens
caggcagctgggtcaccgtccc

SEQ ID NO: 9398674 - DNA, 22 bp, Homo sapiens
caggcagctgggtcaccgtccc

SEQ ID NO: 9398675 - DNA, 22 bp, Homo sapiens
caggcaggagacatttggttgg

SEQ ID NO: 9398676 - DNA, 22 bp, Homo sapiens
caggcagctgctgggttcagcc

SEQ ID NO: 9398677 - DNA, 22 bp, Homo sapiens
caggcagctgctgggttcagcc

SEQ ID NO: 9398678 - DNA, 22 bp, Homo sapiens
caggcagctgctgggttcagcc

SEQ ID NO: 9398679 - DNA, 22 bp, Homo sapiens
caggcagaaattttgtttcatt

SEQ ID NO: 9398680 - DNA, 22 bp, Homo sapiens
caggcagaaattttgtttcatt

SEQ ID NO: 9398681 - DNA, 22 bp, Homo sapiens
caggcagaagaagtggaaggac

SEQ ID NO: 9398682 - DNA, 22 bp, Homo sapiens
caggcagaatgagattacttca

SEQ ID NO: 9398683 - DNA, 22 bp, Homo sapiens
caggcagaatgaccgacctcgc

SEQ ID NO: 9398684 - DNA, 22 bp, Homo sapiens
caggcagaaggaagtaccaggc

SEQ ID NO: 9398685 - DNA, 22 bp, Homo sapiens
caggcagaaggaagtaccaggc

SEQ ID NO: 9398686 - DNA, 22 bp, Homo sapiens
caggcagaaggaagtaccaggc

SEQ ID NO: 9398687 - DNA, 22 bp, Homo sapiens
caggcagagaccctctcctaaa

SEQ ID NO: 9398688 - DNA, 22 bp, Homo sapiens
caggcagagacgtcagtgtagg

SEQ ID NO: 9398689 - DNA, 22 bp, Homo sapiens
caggcagagaggagcatttaat

SEQ ID NO: 9398690 - DNA, 22 bp, Homo sapiens
caggcagagcaactggtccaga

SEQ ID NO: 9398691 - DNA, 22 bp, Homo sapiens
caggcagagaggagcatttaat

SEQ ID NO: 9398692 - DNA, 22 bp, Homo sapiens
caggcagactttgagaatgatg

SEQ ID NO: 9398693 - DNA, 17 bp, Homo sapiens
caggcagacatgtaagc

SEQ ID NO: 9398694 - DNA, 17 bp, Homo sapiens
caggcagacatgtaagc

SEQ ID NO: 9398695 - DNA, 22 bp, Homo sapiens
taatttacagagatacagtcag

SEQ ID NO: 9398696 - DNA, 22 bp, Homo sapiens
taatttacagagatacagtcag

SEQ ID NO: 9398697 - DNA, 22 bp, Homo sapiens
taatttacttgcaaataacaat

SEQ ID NO: 9398698 - DNA, 22 bp, Homo sapiens
taatttaattccatggattcta

SEQ ID NO: 9398699 - DNA, 22 bp, Homo sapiens
taatttaattccatggattcta

SEQ ID NO: 9398700 - DNA, 22 bp, Homo sapiens
taattgtatggagaaggctgca

SEQ ID NO: 9398701 - DNA, 22 bp, Homo sapiens
taattgtggctggatttgagaa

SEQ ID NO: 9398702 - DNA, 22 bp, Homo sapiens
taattgtgggaaggcttttaat

SEQ ID NO: 9398703 - DNA, 22 bp, Homo sapiens
caggcagagcaactggtccaga

SEQ ID NO: 9398704 - DNA, 22 bp, Homo sapiens
caggcagagcaactggtccaga

SEQ ID NO: 9398705 - DNA, 22 bp, Homo sapiens
caggcagagcaactggtccaga

SEQ ID NO: 9398706 - DNA, 22 bp, Homo sapiens
taatgttagtatgtaatcttat

SEQ ID NO: 9398707 - DNA, 22 bp, Homo sapiens
taatgttagtatgtaatcttat

SEQ ID NO: 9398708 - DNA, 22 bp, Homo sapiens
taatgttagtatgtaatcttat

SEQ ID NO: 9398709 - DNA, 22 bp, Homo sapiens
caggcagagccaatcgtggggt

SEQ ID NO: 9398710 - DNA, 22 bp, Homo sapiens
tacagggtataggtacagatga

SEQ ID NO: 9398711 - DNA, 22 bp, Homo sapiens
tacaggtaaaattatcagaaac

SEQ ID NO: 9398712 - DNA, 22 bp, Homo sapiens
tacaggtaaatgcaaacagctc

SEQ ID NO: 9398713 - DNA, 22 bp, Homo sapiens
tacaggtagaaatgaagccaga

SEQ ID NO: 9398714 - DNA, 22 bp, Homo sapiens
tacagggattgttttaatcacc

SEQ ID NO: 9398715 - DNA, 20 bp, Homo sapiens
tacaatacacatgcatatga

SEQ ID NO: 9398716 - DNA, 21 bp, Homo sapiens
tacaagttgcttttgaagtcc

SEQ ID NO: 9398717 - DNA, 21 bp, Homo sapiens
tacaagttgcttttgaagtcc

SEQ ID NO: 9398718 - DNA, 22 bp, Homo sapiens
tacaagttgcagaaagttgttt

SEQ ID NO: 9398719 - DNA, 22 bp, Homo sapiens
tacaagttccattttgaaagtg

SEQ ID NO: 9398720 - DNA, 20 bp, Homo sapiens
tacaagtacattatagttat

SEQ ID NO: 9398721 - DNA, 22 bp, Homo sapiens
tacaagggagattattcatatt

SEQ ID NO: 9398722 - DNA, 22 bp, Homo sapiens
tacaagtaaattgtagatacca

SEQ ID NO: 9398723 - DNA, 22 bp, Homo sapiens
tacaagtatgttttaaaatgtt

SEQ ID NO: 9398724 - DNA, 22 bp, Homo sapiens
tacaagtgctagcagatattgt

SEQ ID NO: 9398725 - DNA, 22 bp, Homo sapiens
tacaagtgtaagcttgtgagac

SEQ ID NO: 9398726 - DNA, 22 bp, Homo sapiens
tacaagtggagttaggaagttt

SEQ ID NO: 9398727 - DNA, 22 bp, Homo sapiens
tacaagtgtgcaccaccatgtc

SEQ ID NO: 9398728 - DNA, 22 bp, Homo sapiens
tacaagtgtgcaccaccatgtc

SEQ ID NO: 9398729 - DNA, 22 bp, Homo sapiens
tacaagtgtggctcctctgtct

SEQ ID NO: 9398730 - DNA, 16 bp, Homo sapiens
tacaagtgttagggaa

SEQ ID NO: 9398731 - DNA, 22 bp, Homo sapiens
tacaagtgtttgagaggtggac

SEQ ID NO: 9398732 - DNA, 22 bp, Homo sapiens
tacaagttccattttgaaagtg

SEQ ID NO: 9398733 - DNA, 22 bp, Homo sapiens
tacaagttgcagaaagttgttt

SEQ ID NO: 9398734 - DNA, 22 bp, Homo sapiens
tacaaatgggttaaaatatagt

SEQ ID NO: 9398735 - DNA, 22 bp, Homo sapiens
tacaaatgtattttattttggt

SEQ ID NO: 9398736 - DNA, 22 bp, Homo sapiens
tacaaattaatgggcatgttta

SEQ ID NO: 9398737 - DNA, 20 bp, Homo sapiens
tacaaattttccatgtttcc

SEQ ID NO: 9398738 - DNA, 22 bp, Homo sapiens
tacaagcttttgtgtataaatg

SEQ ID NO: 9398739 - DNA, 19 bp, Homo sapiens
tacaagcttttttggcagg

SEQ ID NO: 9398740 - DNA, 22 bp, Homo sapiens
tacaaggaaaatcttgaagtac

SEQ ID NO: 9398741 - DNA, 22 bp, Homo sapiens
tacaaggaaaattttatagtaa

SEQ ID NO: 9398742 - DNA, 22 bp, Homo sapiens
tacaaggcaaatccatgatgtc

SEQ ID NO: 9398743 - DNA, 22 bp, Homo sapiens
tacaaatgagttgtatgaacca

SEQ ID NO: 9398744 - DNA, 22 bp, Homo sapiens
caggcagggagccactgtataa

SEQ ID NO: 9398745 - DNA, 22 bp, Homo sapiens
tacaaactaacatgtctcatcc

SEQ ID NO: 9398746 - DNA, 22 bp, Homo sapiens
tacaaatgaaccaactttgatg

SEQ ID NO: 9398747 - DNA, 22 bp, Homo sapiens
tacatattcaacgttcagtatt

SEQ ID NO: 9398748 - DNA, 22 bp, Homo sapiens
tacatatttgtctttgtactgt

SEQ ID NO: 9398749 - DNA, 22 bp, Homo sapiens
tacatattgtccatagttgctt

SEQ ID NO: 9398750 - DNA, 22 bp, Homo sapiens
tacatatgagttcgttctatgc

SEQ ID NO: 9398751 - DNA, 22 bp, Homo sapiens
tacatatgtaaacatgtataaa

SEQ ID NO: 9398752 - DNA, 22 bp, Homo sapiens
tacatatgtaaacatgtataaa

SEQ ID NO: 9398753 - DNA, 22 bp, Homo sapiens
tacatatgtaaacatgtataaa

SEQ ID NO: 9398754 - DNA, 22 bp, Homo sapiens
tacatatgtatttgtgtatacg

SEQ ID NO: 9398755 - DNA, 22 bp, Homo sapiens
tacatgtggagttttctagtca

SEQ ID NO: 9398756 - DNA, 22 bp, Homo sapiens
tacatgtggccagaaatttgag

SEQ ID NO: 9398757 - DNA, 22 bp, Homo sapiens
tacatgtggagttttctagtca

SEQ ID NO: 9398758 - DNA, 22 bp, Homo sapiens
tacatgtggagttttctagtca

SEQ ID NO: 9398759 - DNA, 22 bp, Homo sapiens
tacatgtgctatttgttttgta

SEQ ID NO: 9398760 - DNA, 22 bp, Homo sapiens
tacatgtgctgggttcttggcc

SEQ ID NO: 9398761 - DNA, 22 bp, Homo sapiens
tacatgtggagataactgaagc

SEQ ID NO: 9398762 - DNA, 22 bp, Homo sapiens
tacatgtgcacgtgtgactttg

SEQ ID NO: 9398763 - DNA, 22 bp, Homo sapiens
tacatgtgatcagaaagtgaaa

SEQ ID NO: 9398764 - DNA, 22 bp, Homo sapiens
tacatgtgatcagaaagtgaaa

SEQ ID NO: 9398765 - DNA, 22 bp, Homo sapiens
tacatgtgatcagaaagtgaaa

SEQ ID NO: 9398766 - DNA, 21 bp, Homo sapiens
tacatcatgctacttctctga

SEQ ID NO: 9398767 - DNA, 22 bp, Homo sapiens
tacatcatgaaagcatacatca

SEQ ID NO: 9398768 - DNA, 22 bp, Homo sapiens
tacatcatgaaagcatacatca

SEQ ID NO: 9398769 - DNA, 22 bp, Homo sapiens
tacatcatgaaagcatacatca

SEQ ID NO: 9398770 - DNA, 22 bp, Homo sapiens
tacatatttgtctttgtactgt

SEQ ID NO: 9398771 - DNA, 22 bp, Homo sapiens
caggccctggcagggctgagtc

SEQ ID NO: 9398772 - DNA, 19 bp, Homo sapiens
caggccctggacccatctg

SEQ ID NO: 9398773 - DNA, 22 bp, Homo sapiens
caggccctggcagggctgagtc

SEQ ID NO: 9398774 - DNA, 22 bp, Homo sapiens
caggccctggcagggctgagtc

SEQ ID NO: 9398775 - DNA, 22 bp, Homo sapiens
caggccctggcagggctgagtc

SEQ ID NO: 9398776 - DNA, 22 bp, Homo sapiens
caggccctgggcaggatcagcc

SEQ ID NO: 9398777 - DNA, 22 bp, Homo sapiens
caggccctgggcaggatcagcc

SEQ ID NO: 9398778 - DNA, 22 bp, Homo sapiens
caggccctgggcaggatcagcc

SEQ ID NO: 9398779 - DNA, 22 bp, Homo sapiens
caggccctgggcaggcacagag

SEQ ID NO: 9398780 - DNA, 22 bp, Homo sapiens
caggccctgggcaggcacagag

SEQ ID NO: 9398781 - DNA, 18 bp, Homo sapiens
caggccctgtctggcctc

SEQ ID NO: 9398782 - DNA, 18 bp, Homo sapiens
caggccctgtctggcctc

SEQ ID NO: 9398783 - DNA, 18 bp, Homo sapiens
caggccctgtctggcctc

SEQ ID NO: 9398784 - DNA, 18 bp, Homo sapiens
caggccctgtctggcctc

SEQ ID NO: 9398785 - DNA, 22 bp, Homo sapiens
caggccctgggcaggcacagag

SEQ ID NO: 9398786 - DNA, 18 bp, Homo sapiens
caggccctgtctggcctc

SEQ ID NO: 9398787 - DNA, 22 bp, Homo sapiens
caggccctttcctgggcatagg

SEQ ID NO: 9398788 - DNA, 22 bp, Homo sapiens
caggccctttcctgggcatagg

SEQ ID NO: 9398789 - DNA, 22 bp, Homo sapiens
caggccctttcctgggcatagg

SEQ ID NO: 9398790 - DNA, 22 bp, Homo sapiens
caggccctttcctgggcatagg

SEQ ID NO: 9398791 - DNA, 22 bp, Homo sapiens
caggccctgtgctgggtgatgt

SEQ ID NO: 9398792 - DNA, 22 bp, Homo sapiens
tacagtttgttacattgttagt

SEQ ID NO: 9398793 - DNA, 22 bp, Homo sapiens
tacagtttgttacattgttagt

SEQ ID NO: 9398794 - DNA, 22 bp, Homo sapiens
caggccggccggccccagctct

SEQ ID NO: 9398795 - DNA, 22 bp, Homo sapiens
tacaggtggtaaaaatattgtt

SEQ ID NO: 9398796 - DNA, 22 bp, Homo sapiens
tacaggttacacttttaaaagt

SEQ ID NO: 9398797 - DNA, 22 bp, Homo sapiens
tacaggtgctctacagacagga

SEQ ID NO: 9398798 - DNA, 22 bp, Homo sapiens
tacaggtggatcactagtatag

SEQ ID NO: 9398799 - DNA, 22 bp, Homo sapiens
tacaggtggatcactagtatag

SEQ ID NO: 9398800 - DNA, 22 bp, Homo sapiens
tacaggtgctctacagacagga

SEQ ID NO: 9398801 - DNA, 22 bp, Homo sapiens
tacagtaaatgtggtagaaact

SEQ ID NO: 9398802 - DNA, 22 bp, Homo sapiens
tacagtaaagctgctatgaatt

SEQ ID NO: 9398803 - DNA, 22 bp, Homo sapiens
tacagtaacatgttgtacaagc

SEQ ID NO: 9398804 - DNA, 22 bp, Homo sapiens
caggccctggcagggctgagtc

SEQ ID NO: 9398805 - DNA, 19 bp, Homo sapiens
caggccctggacccatctg

SEQ ID NO: 9398806 - DNA, 19 bp, Homo sapiens
caggccctggacccatctg

SEQ ID NO: 9398807 - DNA, 22 bp, Homo sapiens
caggccctgctgctgagacctt

SEQ ID NO: 9398808 - DNA, 22 bp, Homo sapiens
caggccctgctgctgagacctt

SEQ ID NO: 9398809 - DNA, 22 bp, Homo sapiens
caggccctgctgctgagacctt

SEQ ID NO: 9398810 - DNA, 22 bp, Homo sapiens
ccaaatattaacaaagtaattt

SEQ ID NO: 9398811 - DNA, 22 bp, Homo sapiens
ccaaatattaacaaagtaattt

SEQ ID NO: 9398812 - DNA, 22 bp, Homo sapiens
ccaaagtgtgggagaagaggta

SEQ ID NO: 9398813 - DNA, 22 bp, Homo sapiens
ccaaataatatttcagaaccat

SEQ ID NO: 9398814 - DNA, 23 bp, Homo sapiens
tcctcccaaatttcagcctcatt

SEQ ID NO: 9398815 - DNA, 23 bp, Homo sapiens
tcctcccaaatttcagcctcatt

SEQ ID NO: 9398816 - DNA, 23 bp, Homo sapiens
tcctcccaaatttcagcctcatt

SEQ ID NO: 9398817 - DNA, 22 bp, Homo sapiens
tcctccccaaagcccagcctgg

SEQ ID NO: 9398818 - DNA, 22 bp, Homo sapiens
tcctccccaaagcccagcctgg

SEQ ID NO: 9398819 - DNA, 17 bp, Homo sapiens
tcctccccgcagttgca

SEQ ID NO: 9398820 - DNA, 20 bp, Homo sapiens
tcctcccccacctttgcagc

SEQ ID NO: 9398821 - DNA, 20 bp, Homo sapiens
tcctcccccacctttgcagc

SEQ ID NO: 9398822 - DNA, 22 bp, Homo sapiens
tcctcccaacttttccatctca

SEQ ID NO: 9398823 - DNA, 22 bp, Homo sapiens
tcctcccaacttttccatctca

SEQ ID NO: 9398824 - DNA, 22 bp, Homo sapiens
tcctcccaacttttccatctca

SEQ ID NO: 9398825 - DNA, 22 bp, Homo sapiens
tcctcccaacttttccatctca

SEQ ID NO: 9398826 - DNA, 22 bp, Homo sapiens
tcctcccaacttttccatctca

SEQ ID NO: 9398827 - DNA, 22 bp, Homo sapiens
tcctcccacataggacaatggg

SEQ ID NO: 9398828 - DNA, 22 bp, Homo sapiens
tcctcccacataggacaatggg

SEQ ID NO: 9398829 - DNA, 22 bp, Homo sapiens
ccacacagggggatgagttatt

SEQ ID NO: 9398830 - DNA, 22 bp, Homo sapiens
tcctgcagtgtgtctcctgcac

SEQ ID NO: 9398831 - DNA, 22 bp, Homo sapiens
tcctgcagtgtgtctcctgcac

SEQ ID NO: 9398832 - DNA, 22 bp, Homo sapiens
tcctgcagtctgcactctgcct

SEQ ID NO: 9398833 - DNA, 22 bp, Homo sapiens
tcctgcagtgtgtctcctgcac

SEQ ID NO: 9398834 - DNA, 22 bp, Homo sapiens
tcctgcagttacatcccagcca

SEQ ID NO: 9398835 - DNA, 22 bp, Homo sapiens
tcctgcagttacatcccagcca

SEQ ID NO: 9398836 - DNA, 22 bp, Homo sapiens
ccacaaaactgtgtgtcaaaga

SEQ ID NO: 9398837 - DNA, 22 bp, Homo sapiens
ccacaaagaatgggggaagcat

SEQ ID NO: 9398838 - DNA, 19 bp, Homo sapiens
ccacaaaattattttagtt

SEQ ID NO: 9398839 - DNA, 22 bp, Homo sapiens
ccacaagactctgtcagcataa

SEQ ID NO: 9398840 - DNA, 22 bp, Homo sapiens
ccaagggcgcctccgttccccc

SEQ ID NO: 9398841 - DNA, 22 bp, Homo sapiens
ccacagctgaaagcagaggctc

SEQ ID NO: 9398842 - DNA, 23 bp, Homo sapiens
ccacagctatagggtagtgcagt

SEQ ID NO: 9398843 - DNA, 23 bp, Homo sapiens
ccacagctatagggtagtgcagt

SEQ ID NO: 9398844 - DNA, 22 bp, Homo sapiens
ccacagctagggcaatctgatt

SEQ ID NO: 9398845 - DNA, 19 bp, Homo sapiens
ccacagcctgctgtcttcc

SEQ ID NO: 9398846 - DNA, 17 bp, Homo sapiens
ccacagcctggcacttg

SEQ ID NO: 9398847 - DNA, 22 bp, Homo sapiens
ccacagccattccagggaggct

SEQ ID NO: 9398848 - DNA, 22 bp, Homo sapiens
ccacagccattccagggaggct

SEQ ID NO: 9398849 - DNA, 18 bp, Homo sapiens
ccacagcagagttcttac

SEQ ID NO: 9398850 - DNA, 22 bp, Homo sapiens
ccacagcatgcaggcctgacac

SEQ ID NO: 9398851 - DNA, 22 bp, Homo sapiens
ccacagattatttctaaacagg

SEQ ID NO: 9398852 - DNA, 22 bp, Homo sapiens
ccacagagttacaaaacagtca

SEQ ID NO: 9398853 - DNA, 22 bp, Homo sapiens
tcctgccagcaggaggtggcag

SEQ ID NO: 9398854 - DNA, 22 bp, Homo sapiens
tcctgccaggagatggtagcca

SEQ ID NO: 9398855 - DNA, 22 bp, Homo sapiens
tcctgcccacagctgctggaca

SEQ ID NO: 9398856 - DNA, 22 bp, Homo sapiens
tcctgcccacagctgctggaca

SEQ ID NO: 9398857 - DNA, 20 bp, Homo sapiens
tcctgcagttcctaggaggg

SEQ ID NO: 9398858 - DNA, 20 bp, Homo sapiens
tcctgcagttcctaggaggg

SEQ ID NO: 9398859 - DNA, 17 bp, Homo sapiens
tcctgccacctgtcagg

SEQ ID NO: 9398860 - DNA, 20 bp, Homo sapiens
ccacagaggacagggctgtg

SEQ ID NO: 9398861 - DNA, 22 bp, Homo sapiens
ccacagagtcttccttctcttc

SEQ ID NO: 9398862 - DNA, 20 bp, Homo sapiens
ccacagaggacagggctgtg

SEQ ID NO: 9398863 - DNA, 22 bp, Homo sapiens
ccacagaggacaactgcctggc

SEQ ID NO: 9398864 - DNA, 22 bp, Homo sapiens
ccacagaggacaactgcctggc

SEQ ID NO: 9398865 - DNA, 22 bp, Homo sapiens
ccacagaggacaactgcctggc

SEQ ID NO: 9398866 - DNA, 19 bp, Homo sapiens
tcctgcccaccagccaggg

SEQ ID NO: 9398867 - DNA, 22 bp, Homo sapiens
ccacagaatcgctagtggagca

SEQ ID NO: 9398868 - DNA, 19 bp, Homo sapiens
tcctgcccaccagccaggg

SEQ ID NO: 9398869 - DNA, 22 bp, Homo sapiens
tcccagggggatgaacactgcc

SEQ ID NO: 9398870 - DNA, 22 bp, Homo sapiens
tcccagggtcagtggtgaggcc

SEQ ID NO: 9398871 - DNA, 22 bp, Homo sapiens
catttctcactccagcaacttt

SEQ ID NO: 9398872 - DNA, 22 bp, Homo sapiens
tcccagggggatgaacactgcc

SEQ ID NO: 9398873 - DNA, 22 bp, Homo sapiens
tcccagggcttttctcatgctt

SEQ ID NO: 9398874 - DNA, 22 bp, Homo sapiens
tcccagggcttttctcatgctt

SEQ ID NO: 9398875 - DNA, 22 bp, Homo sapiens
tcccagggctctagagtgctgg

SEQ ID NO: 9398876 - DNA, 22 bp, Homo sapiens
tcccagggctctagagtgctgg

SEQ ID NO: 9398877 - DNA, 22 bp, Homo sapiens
tcccagggcttttctcatgctt

SEQ ID NO: 9398878 - DNA, 22 bp, Homo sapiens
tcccagggcagctgtccagaag

SEQ ID NO: 9398879 - DNA, 22 bp, Homo sapiens
tcccagggcactcaccctccct

SEQ ID NO: 9398880 - DNA, 22 bp, Homo sapiens
tcccagggccgcaaacgagttt

SEQ ID NO: 9398881 - DNA, 21 bp, Homo sapiens
tcccagggccaggtgccatca

SEQ ID NO: 9398882 - DNA, 21 bp, Homo sapiens
tcccagggccaggtgccatca

SEQ ID NO: 9398883 - DNA, 21 bp, Homo sapiens
tcccagggccaggtgccatca

SEQ ID NO: 9398884 - DNA, 21 bp, Homo sapiens
tcccagggccaggtgccatca

SEQ ID NO: 9398885 - DNA, 22 bp, Homo sapiens
catttatataaaatgtccagaa

SEQ ID NO: 9398886 - DNA, 22 bp, Homo sapiens
catttatataaaatgtccagaa

SEQ ID NO: 9398887 - DNA, 22 bp, Homo sapiens
catttatataaaatgtccagaa

SEQ ID NO: 9398888 - DNA, 22 bp, Homo sapiens
tcccagggcactcaccctccct

SEQ ID NO: 9398889 - DNA, 22 bp, Homo sapiens
catttattagttagttcgatgt

SEQ ID NO: 9398890 - DNA, 22 bp, Homo sapiens
catttattagttagttcgatgt

SEQ ID NO: 9398891 - DNA, 22 bp, Homo sapiens
catttagagaagattacaagga

SEQ ID NO: 9398892 - DNA, 19 bp, Homo sapiens
catttagaagtacatatta

SEQ ID NO: 9398893 - DNA, 20 bp, Homo sapiens
catttagaaattggcatgga

SEQ ID NO: 9398894 - DNA, 19 bp, Homo sapiens
catttagaagtacatatta

SEQ ID NO: 9398895 - DNA, 22 bp, Homo sapiens
catttagttttgcagtagcagg

SEQ ID NO: 9398896 - DNA, 22 bp, Homo sapiens
catttagttatactaaaacatt

SEQ ID NO: 9398897 - DNA, 22 bp, Homo sapiens
catttagttatactaaaacatt

SEQ ID NO: 9398898 - DNA, 22 bp, Homo sapiens
catttagtcaaggacacgtggc

SEQ ID NO: 9398899 - DNA, 22 bp, Homo sapiens
tccaggcacagagttggtcagt

SEQ ID NO: 9398900 - DNA, 20 bp, Homo sapiens
tccaggcagacagctatggg

SEQ ID NO: 9398901 - DNA, 22 bp, Homo sapiens
catttacacttctaaccacaag

SEQ ID NO: 9398902 - DNA, 17 bp, Homo sapiens
tccaggcagcaactgag

SEQ ID NO: 9398903 - DNA, 17 bp, Homo sapiens
tccaggcagcaactgag

SEQ ID NO: 9398904 - DNA, 22 bp, Homo sapiens
catttacagcagactgatgaaa

SEQ ID NO: 9398905 - DNA, 22 bp, Homo sapiens
catttagaaaatgataaccctt

SEQ ID NO: 9398906 - DNA, 22 bp, Homo sapiens
tccctgcttgctctcagccctt

SEQ ID NO: 9398907 - DNA, 22 bp, Homo sapiens
tccctgcttgctctcagccctt

SEQ ID NO: 9398908 - DNA, 15 bp, Homo sapiens
tccctgctggtcaaa

SEQ ID NO: 9398909 - DNA, 22 bp, Homo sapiens
tccctgctgcactcacacctac

SEQ ID NO: 9398910 - DNA, 22 bp, Homo sapiens
tccctgctgggagatgacctta

SEQ ID NO: 9398911 - DNA, 21 bp, Homo sapiens
tccctgctttctggcccagtc

SEQ ID NO: 9398912 - DNA, 22 bp, Homo sapiens
tccctgcttggaatgaccctta

SEQ ID NO: 9398913 - DNA, 22 bp, Homo sapiens
tccctgcttggaatgaccctta

SEQ ID NO: 9398914 - DNA, 22 bp, Homo sapiens
tccctgctaattggaatgtata

SEQ ID NO: 9398915 - DNA, 22 bp, Homo sapiens
tccctgctcagctcacctggca

SEQ ID NO: 9398916 - DNA, 22 bp, Homo sapiens
tccctgctgagagtgctctccc

SEQ ID NO: 9398917 - DNA, 22 bp, Homo sapiens
tccctgctcagctcacctggca

SEQ ID NO: 9398918 - DNA, 22 bp, Homo sapiens
tccctgctgagagtgctctccc

SEQ ID NO: 9398919 - DNA, 22 bp, Homo sapiens
tccctgctgagagtgctctccc

SEQ ID NO: 9398920 - DNA, 22 bp, Homo sapiens
tccctgctgagagtgctctccc

SEQ ID NO: 9398921 - DNA, 22 bp, Homo sapiens
tccctgctgcactcacacctac

SEQ ID NO: 9398922 - DNA, 22 bp, Homo sapiens
tccctgctgcactcacacctac

SEQ ID NO: 9398923 - DNA, 21 bp, Homo sapiens
tccctgctttctggcccagtc

SEQ ID NO: 9398924 - DNA, 22 bp, Homo sapiens
ccaaaagcagctgtctgtgaat

SEQ ID NO: 9398925 - DNA, 22 bp, Homo sapiens
ccaaagtgatatgtgctgtaag

SEQ ID NO: 9398926 - DNA, 22 bp, Homo sapiens
catttgatcctcacaacaatct

SEQ ID NO: 9398927 - DNA, 22 bp, Homo sapiens
catttgaattgttctgtgggaa

SEQ ID NO: 9398928 - DNA, 22 bp, Homo sapiens
catttgattactaaagataatt

SEQ ID NO: 9398929 - DNA, 22 bp, Homo sapiens
catttgaacctggatgttctta

SEQ ID NO: 9398930 - DNA, 22 bp, Homo sapiens
catttctcataatattagcact

SEQ ID NO: 9398931 - DNA, 22 bp, Homo sapiens
catttgaactaataactgtgct

SEQ ID NO: 9398932 - DNA, 22 bp, Homo sapiens
catttgctctgtgtcagtggca

SEQ ID NO: 9398933 - DNA, 22 bp, Homo sapiens
catttgctagcaggccttttat

SEQ ID NO: 9398934 - DNA, 22 bp, Homo sapiens
catttgctctgtgtcagtggca

SEQ ID NO: 9398935 - DNA, 22 bp, Homo sapiens
catttgctgaggccttcagagg

SEQ ID NO: 9398936 - DNA, 22 bp, Homo sapiens
tccctgcctgacagcacccacc

SEQ ID NO: 9398937 - DNA, 22 bp, Homo sapiens
tccctgcctgacagcacccacc

SEQ ID NO: 9398938 - DNA, 22 bp, Homo sapiens
tccctgcctgacagcacccacc

SEQ ID NO: 9398939 - DNA, 22 bp, Homo sapiens
catttgctgtattttcagattc

SEQ ID NO: 9398940 - DNA, 22 bp, Homo sapiens
tccctgcctctcagacttcctt

SEQ ID NO: 9398941 - DNA, 22 bp, Homo sapiens
ccagaggtgctctttggaagtg

SEQ ID NO: 9398942 - DNA, 22 bp, Homo sapiens
ccagatccctgtttgcctctgg

SEQ ID NO: 9398943 - DNA, 17 bp, Homo sapiens
ccagatcccagtcctta

SEQ ID NO: 9398944 - DNA, 22 bp, Homo sapiens
ccagatatcactgccgtgttgt

SEQ ID NO: 9398945 - DNA, 21 bp, Homo sapiens
ccagatcctgcttcctcaccc

SEQ ID NO: 9398946 - DNA, 22 bp, Homo sapiens
ccagatcttcttttcagtgtct

SEQ ID NO: 9398947 - DNA, 22 bp, Homo sapiens
ccagatggtttgcatgggaggg

SEQ ID NO: 9398948 - DNA, 19 bp, Homo sapiens
tctctctgtacattagata

SEQ ID NO: 9398949 - DNA, 19 bp, Homo sapiens
tctctctgtacattagata

SEQ ID NO: 9398950 - DNA, 22 bp, Homo sapiens
ccagatggtccagagtctagcc

SEQ ID NO: 9398951 - DNA, 22 bp, Homo sapiens
ccagatggtgcctgtcagaagg

SEQ ID NO: 9398952 - DNA, 22 bp, Homo sapiens
ccagatggtgcctgtcagaagg

SEQ ID NO: 9398953 - DNA, 22 bp, Homo sapiens
ccagatggtatagtagggagag

SEQ ID NO: 9398954 - DNA, 22 bp, Homo sapiens
ccagatggtccagagtctagcc

SEQ ID NO: 9398955 - DNA, 22 bp, Homo sapiens
ccagatgggttacttcaagcaa

SEQ ID NO: 9398956 - DNA, 22 bp, Homo sapiens
ccagatgggctttagcaaatga

SEQ ID NO: 9398957 - DNA, 22 bp, Homo sapiens
ccagatgggccaggggtttgtt

SEQ ID NO: 9398958 - DNA, 22 bp, Homo sapiens
ccagatgggccaggggtttgtt

SEQ ID NO: 9398959 - DNA, 22 bp, Homo sapiens
ccagatggaaatgatgttctca

SEQ ID NO: 9398960 - DNA, 22 bp, Homo sapiens
ccagatggaaatgatgttctca

SEQ ID NO: 9398961 - DNA, 22 bp, Homo sapiens
ccagaggacttgggggctgaat

SEQ ID NO: 9398962 - DNA, 22 bp, Homo sapiens
ccagaggacttgggggctgaat

SEQ ID NO: 9398963 - DNA, 22 bp, Homo sapiens
ccagaggacttgggggctgaat

SEQ ID NO: 9398964 - DNA, 22 bp, Homo sapiens
ccagaggagcaggctggctcca

SEQ ID NO: 9398965 - DNA, 22 bp, Homo sapiens
ccagaggagatgcctcctctgt

SEQ ID NO: 9398966 - DNA, 22 bp, Homo sapiens
ccagaggagggctctgatgagg

SEQ ID NO: 9398967 - DNA, 22 bp, Homo sapiens
ccagaggagcatggccttgaga

SEQ ID NO: 9398968 - DNA, 22 bp, Homo sapiens
ccagaggagggctctgatgagg

SEQ ID NO: 9398969 - DNA, 22 bp, Homo sapiens
ccagaggagttgaggctttggg

SEQ ID NO: 9398970 - DNA, 22 bp, Homo sapiens
ccagaggagttgaggctttggg

SEQ ID NO: 9398971 - DNA, 22 bp, Homo sapiens
ccagaggaggggggtctttctg

SEQ ID NO: 9398972 - DNA, 22 bp, Homo sapiens
tctctacaaaaattagcatgca

SEQ ID NO: 9398973 - DNA, 22 bp, Homo sapiens
tctctaattcaaccagacactt

SEQ ID NO: 9398974 - DNA, 19 bp, Homo sapiens
ccagaggactgttaatgaa

SEQ ID NO: 9398975 - DNA, 19 bp, Homo sapiens
ccagaggactgttaatgaa

SEQ ID NO: 9398976 - DNA, 22 bp, Homo sapiens
ccagaggacttgggggctgaat

SEQ ID NO: 9398977 - DNA, 22 bp, Homo sapiens
tctctacataacctcaatactc

SEQ ID NO: 9398978 - DNA, 18 bp, Homo sapiens
tctctaccagaagtgacg

SEQ ID NO: 9398979 - DNA, 22 bp, Homo sapiens
ccagaggaattgggaaacatgt

SEQ ID NO: 9398980 - DNA, 22 bp, Homo sapiens
ccagaggaattgggaaacatgt

SEQ ID NO: 9398981 - DNA, 22 bp, Homo sapiens
ccagaggaaaaatatctcccta

SEQ ID NO: 9398982 - DNA, 19 bp, Homo sapiens
tctccagttgctttcaggg

SEQ ID NO: 9398983 - DNA, 21 bp, Homo sapiens
tctcccaaggaggtcctgagg

SEQ ID NO: 9398984 - DNA, 21 bp, Homo sapiens
tctcccaaggaggtcctgagg

SEQ ID NO: 9398985 - DNA, 22 bp, Homo sapiens
tctcctgggaggacaaggaagg

SEQ ID NO: 9398986 - DNA, 22 bp, Homo sapiens
tctcctgggaggacaaggaagg

SEQ ID NO: 9398987 - DNA, 22 bp, Homo sapiens
tctcccaagtgaccaggaaaga

SEQ ID NO: 9398988 - DNA, 22 bp, Homo sapiens
tctcccaaggcacagaaagagt

SEQ ID NO: 9398989 - DNA, 22 bp, Homo sapiens
tctctaaagatatttatggcaa

SEQ ID NO: 9398990 - DNA, 22 bp, Homo sapiens
tctctaaatacagatgtcatgg

SEQ ID NO: 9398991 - DNA, 22 bp, Homo sapiens
tctctaaatacagatgtcatgg

SEQ ID NO: 9398992 - DNA, 22 bp, Homo sapiens
tctctaaatctggttcacttgc

SEQ ID NO: 9398993 - DNA, 20 bp, Homo sapiens
ccagacagcacctgcctggt

SEQ ID NO: 9398994 - DNA, 22 bp, Homo sapiens
ccagacagcagttaaaggacat

SEQ ID NO: 9398995 - DNA, 22 bp, Homo sapiens
ccagacagcagttaaaggacat

SEQ ID NO: 9398996 - DNA, 20 bp, Homo sapiens
ccagacagcacctgcctggt

SEQ ID NO: 9398997 - DNA, 22 bp, Homo sapiens
ccagagcctgctgagccccatt

SEQ ID NO: 9398998 - DNA, 22 bp, Homo sapiens
ccagagctgatgggcccagggt

SEQ ID NO: 9398999 - DNA, 22 bp, Homo sapiens
ccagagctgatgggcccagggt

SEQ ID NO: 9399000 - DNA, 22 bp, Homo sapiens
ccagacaggaacacacatctcc

SEQ ID NO: 9399001 - DNA, 22 bp, Homo sapiens
ccagacaggggctgttcctgct

SEQ ID NO: 9399002 - DNA, 22 bp, Homo sapiens
ccagagcctgctgagccccatt

SEQ ID NO: 9399003 - DNA, 22 bp, Homo sapiens
ccagagcttcggggcggctgta

SEQ ID NO: 9399004 - DNA, 22 bp, Homo sapiens
ccagagcttgacgtgcaacgga

SEQ ID NO: 9399005 - DNA, 22 bp, Homo sapiens
ccagagcttgacgtgcaacgga

SEQ ID NO: 9399006 - DNA, 18 bp, Homo sapiens
ccagagctggctcctcgc

SEQ ID NO: 9399007 - DNA, 22 bp, Homo sapiens
ccagagctgattcctgggactt

SEQ ID NO: 9399008 - DNA, 22 bp, Homo sapiens
ccagagctgattcctgggactt

SEQ ID NO: 9399009 - DNA, 22 bp, Homo sapiens
ccagagctgcatccagcaggtt

SEQ ID NO: 9399010 - DNA, 22 bp, Homo sapiens
ccagagctgcatccagcaggtt

SEQ ID NO: 9399011 - DNA, 22 bp, Homo sapiens
ccagagctgcatccagcaggtt

SEQ ID NO: 9399012 - DNA, 22 bp, Homo sapiens
ccagagctgcatccagcaggtt

SEQ ID NO: 9399013 - DNA, 21 bp, Homo sapiens
ccactgagcattgttatgaag

SEQ ID NO: 9399014 - DNA, 22 bp, Homo sapiens
ccactgaggggtcatggtggga

SEQ ID NO: 9399015 - DNA, 22 bp, Homo sapiens
ccactgaggttttgtggttatg

SEQ ID NO: 9399016 - DNA, 19 bp, Homo sapiens
ccactgaggcttggttctt

SEQ ID NO: 9399017 - DNA, 22 bp, Homo sapiens
ccactgccagccgcccggaggc

SEQ ID NO: 9399018 - DNA, 22 bp, Homo sapiens
ccactgcacttcagcctgggtg

SEQ ID NO: 9399019 - DNA, 22 bp, Homo sapiens
ccactgcactccagccttggca

SEQ ID NO: 9399020 - DNA, 22 bp, Homo sapiens
ccactgagtacccgatggctgc

SEQ ID NO: 9399021 - DNA, 22 bp, Homo sapiens
ccagaaaactctacatgcttgt

SEQ ID NO: 9399022 - DNA, 22 bp, Homo sapiens
ccactgccagctttgtcctccc

SEQ ID NO: 9399023 - DNA, 22 bp, Homo sapiens
ccactgccatgggctaggcatg

SEQ ID NO: 9399024 - DNA, 22 bp, Homo sapiens
ccactgccccctgaagaccagg

SEQ ID NO: 9399025 - DNA, 22 bp, Homo sapiens
ccactgcccaccccgacgtcta

SEQ ID NO: 9399026 - DNA, 22 bp, Homo sapiens
ccactgcccaccccgacgtcta

SEQ ID NO: 9399027 - DNA, 22 bp, Homo sapiens
ccactgccgatgttccatcttg

SEQ ID NO: 9399028 - DNA, 22 bp, Homo sapiens
ccactgccgtgggccttgggga

SEQ ID NO: 9399029 - DNA, 20 bp, Homo sapiens
ccagaaggtaggatggaaca

SEQ ID NO: 9399030 - DNA, 22 bp, Homo sapiens
ccagaagtcaagtaagatgaag

SEQ ID NO: 9399031 - DNA, 22 bp, Homo sapiens
ccagaagtgtctatcaagatgt

SEQ ID NO: 9399032 - DNA, 22 bp, Homo sapiens
ccagaatctcaatacctttcaa

SEQ ID NO: 9399033 - DNA, 22 bp, Homo sapiens
ccagaatctcaatacctttcaa

SEQ ID NO: 9399034 - DNA, 22 bp, Homo sapiens
ccagaataggagtaataaaacc

SEQ ID NO: 9399035 - DNA, 23 bp, Homo sapiens
ccagaaggagccacactccttgc

SEQ ID NO: 9399036 - DNA, 22 bp, Homo sapiens
ccagaaggcggagattgcagtg

SEQ ID NO: 9399037 - DNA, 22 bp, Homo sapiens
ccagaagcttctacacaggaga

SEQ ID NO: 9399038 - DNA, 22 bp, Homo sapiens
ccagaagcttcaaggagattct

SEQ ID NO: 9399039 - DNA, 21 bp, Homo sapiens
ccagaagctgcttgcaggcta

SEQ ID NO: 9399040 - DNA, 21 bp, Homo sapiens
ccagaagctgcttgcaggcta

SEQ ID NO: 9399041 - DNA, 22 bp, Homo sapiens
ccagaagcagagcctgaggcag

SEQ ID NO: 9399042 - DNA, 22 bp, Homo sapiens
ccagaagccctttgtttgttgt

SEQ ID NO: 9399043 - DNA, 22 bp, Homo sapiens
ccagaagctatgttttagataa

SEQ ID NO: 9399044 - DNA, 22 bp, Homo sapiens
ccagaagcaaaacagacagttt

SEQ ID NO: 9399045 - DNA, 20 bp, Homo sapiens
ccagaagcactcttcatgtt

SEQ ID NO: 9399046 - DNA, 22 bp, Homo sapiens
ccagaagcacctccttttgtgc

SEQ ID NO: 9399047 - DNA, 20 bp, Homo sapiens
ccagaagcactcttcatgtt

SEQ ID NO: 9399048 - DNA, 22 bp, Homo sapiens
ccagaagcacctccttttgtgc

SEQ ID NO: 9399049 - DNA, 22 bp, Homo sapiens
ccacagggtcagccactctgca

SEQ ID NO: 9399050 - DNA, 18 bp, Homo sapiens
tcctggtggagaagtggt

SEQ ID NO: 9399051 - DNA, 22 bp, Homo sapiens
tcctggtgcttgtatttgaagt

SEQ ID NO: 9399052 - DNA, 18 bp, Homo sapiens
tcctggtggagaagtggt

SEQ ID NO: 9399053 - DNA, 22 bp, Homo sapiens
ccacagggtgtcatcagcttga

SEQ ID NO: 9399054 - DNA, 22 bp, Homo sapiens
ccacagggtgtcatcagcttga

SEQ ID NO: 9399055 - DNA, 22 bp, Homo sapiens
ccacaggtacggattgaggacc

SEQ ID NO: 9399056 - DNA, 22 bp, Homo sapiens
ccacagggtgtcatcagcttga

SEQ ID NO: 9399057 - DNA, 19 bp, Homo sapiens
tcctggtgcttgacactga

SEQ ID NO: 9399058 - DNA, 22 bp, Homo sapiens
tcctggtgaggctagaagtgtc

SEQ ID NO: 9399059 - DNA, 22 bp, Homo sapiens
tcctggtgaggctagaagtgtc

SEQ ID NO: 9399060 - DNA, 22 bp, Homo sapiens
tcctggtctacactgcattggg

SEQ ID NO: 9399061 - DNA, 23 bp, Homo sapiens
tcctggtgacatgcctgagcatc

SEQ ID NO: 9399062 - DNA, 23 bp, Homo sapiens
ccactctcccaccatatctgtat

SEQ ID NO: 9399063 - DNA, 23 bp, Homo sapiens
ccactctcccaccatatctgtat

SEQ ID NO: 9399064 - DNA, 22 bp, Homo sapiens
ccactctgattggtcacctctg

SEQ ID NO: 9399065 - DNA, 22 bp, Homo sapiens
ccactgacacagacaaggcctg

SEQ ID NO: 9399066 - DNA, 22 bp, Homo sapiens
ccactcttgaatcaagagctca

SEQ ID NO: 9399067 - DNA, 22 bp, Homo sapiens
ccacagtgagttctgtactctg

SEQ ID NO: 9399068 - DNA, 16 bp, Homo sapiens
ccacctgcagctctca

SEQ ID NO: 9399069 - DNA, 22 bp, Homo sapiens
ccacagtgacacgggctggccc

SEQ ID NO: 9399070 - DNA, 22 bp, Homo sapiens
ccacagtgagtgtcatacttgg

SEQ ID NO: 9399071 - DNA, 22 bp, Homo sapiens
ccagctgcttgggaaaatgtct

SEQ ID NO: 9399072 - DNA, 22 bp, Homo sapiens
ccagctgcttgggaaaatgtct

SEQ ID NO: 9399073 - DNA, 22 bp, Homo sapiens
ccagctgctttttgtcacatgg

SEQ ID NO: 9399074 - DNA, 22 bp, Homo sapiens
ccagctgggattaagggaaaat

SEQ ID NO: 9399075 - DNA, 22 bp, Homo sapiens
ccagctggtaagtgatggagcc

SEQ ID NO: 9399076 - DNA, 22 bp, Homo sapiens
ccagctggtaagtgatggagcc

SEQ ID NO: 9399077 - DNA, 22 bp, Homo sapiens
ccagctggggaagtggggcata

SEQ ID NO: 9399078 - DNA, 22 bp, Homo sapiens
ccagctggggaagtggggcata

SEQ ID NO: 9399079 - DNA, 22 bp, Homo sapiens
ccagctgggtccctgctggggc

SEQ ID NO: 9399080 - DNA, 22 bp, Homo sapiens
ccagctggtctgtgctcatgtt

SEQ ID NO: 9399081 - DNA, 22 bp, Homo sapiens
ccagctggtctgtgctcatgtt

SEQ ID NO: 9399082 - DNA, 22 bp, Homo sapiens
ccagctggtctgtgctcatgtt

SEQ ID NO: 9399083 - DNA, 22 bp, Homo sapiens
ccagctggtgggtctttctctg

SEQ ID NO: 9399084 - DNA, 22 bp, Homo sapiens
ccagctggtgttccttaggacc

SEQ ID NO: 9399085 - DNA, 22 bp, Homo sapiens
ccagctggtgacatccccaacc

SEQ ID NO: 9399086 - DNA, 22 bp, Homo sapiens
ccagctggtgttccttaggacc

SEQ ID NO: 9399087 - DNA, 22 bp, Homo sapiens
ccagctggttaaaatagagaaa

SEQ ID NO: 9399088 - DNA, 22 bp, Homo sapiens
ccagctggttaaaatagagaaa

SEQ ID NO: 9399089 - DNA, 22 bp, Homo sapiens
ccagctggttaaaatagagaaa

SEQ ID NO: 9399090 - DNA, 22 bp, Homo sapiens
ccagctggtgttccttaggacc

SEQ ID NO: 9399091 - DNA, 21 bp, Homo sapiens
tctggagccctaagctgagaa

SEQ ID NO: 9399092 - DNA, 22 bp, Homo sapiens
tctgcgttgctcacgctgggag

SEQ ID NO: 9399093 - DNA, 22 bp, Homo sapiens
tctgccttttcactgccactaa

SEQ ID NO: 9399094 - DNA, 22 bp, Homo sapiens
tctgcgcgctgctggtaccgaa

SEQ ID NO: 9399095 - DNA, 22 bp, Homo sapiens
tctgcggtccccttctcgccct

SEQ ID NO: 9399096 - DNA, 22 bp, Homo sapiens
tctgccttgtttgagctttgac

SEQ ID NO: 9399097 - DNA, 22 bp, Homo sapiens
tctgccttgttgcaggcgctat

SEQ ID NO: 9399098 - DNA, 22 bp, Homo sapiens
tctgcctttcacacagacggcc

SEQ ID NO: 9399099 - DNA, 22 bp, Homo sapiens
tctgcctttcccaggctactgt

SEQ ID NO: 9399100 - DNA, 22 bp, Homo sapiens
tctgcctttctcaagggcaaaa

SEQ ID NO: 9399101 - DNA, 22 bp, Homo sapiens
tctgcctttgctttggctgtca

SEQ ID NO: 9399102 - DNA, 22 bp, Homo sapiens
tctgcctttgctttggctgtca

SEQ ID NO: 9399103 - DNA, 22 bp, Homo sapiens
tctgcctttgtggtcgggagaa

SEQ ID NO: 9399104 - DNA, 22 bp, Homo sapiens
tctgccttttactagctggatg

SEQ ID NO: 9399105 - DNA, 19 bp, Homo sapiens
tctgcctctggtcaggctc

SEQ ID NO: 9399106 - DNA, 22 bp, Homo sapiens
tctgccttggaaatttcaacag

SEQ ID NO: 9399107 - DNA, 22 bp, Homo sapiens
tctgccttggcaaccacagctt

SEQ ID NO: 9399108 - DNA, 22 bp, Homo sapiens
tctgccttgccgaattccaggc

SEQ ID NO: 9399109 - DNA, 22 bp, Homo sapiens
tctgccttgccgaattccaggc

SEQ ID NO: 9399110 - DNA, 22 bp, Homo sapiens
tctgcctgaaccactcttggag

SEQ ID NO: 9399111 - DNA, 22 bp, Homo sapiens
tctgcctgaaccactcttggag

SEQ ID NO: 9399112 - DNA, 22 bp, Homo sapiens
tctgcctgaaccactcttggag

SEQ ID NO: 9399113 - DNA, 22 bp, Homo sapiens
tctgcctgaaccactcttggag

SEQ ID NO: 9399114 - DNA, 22 bp, Homo sapiens
tctgcctgaatctcttagaaca

SEQ ID NO: 9399115 - DNA, 22 bp, Homo sapiens
ccagcttaaaaccatttattta

SEQ ID NO: 9399116 - DNA, 22 bp, Homo sapiens
ccagctgtttctgatgctaggc

SEQ ID NO: 9399117 - DNA, 22 bp, Homo sapiens
ccagctgtttctgatgctaggc

SEQ ID NO: 9399118 - DNA, 22 bp, Homo sapiens
tctggcttctgcaggattacta

SEQ ID NO: 9399119 - DNA, 22 bp, Homo sapiens
tctggcttgtctcagggtctga

SEQ ID NO: 9399120 - DNA, 22 bp, Homo sapiens
ccagctggtttatattccccac

SEQ ID NO: 9399121 - DNA, 22 bp, Homo sapiens
tctggctgttgttaggttcctg

SEQ ID NO: 9399122 - DNA, 22 bp, Homo sapiens
tctggctgttaggcctgacctt

SEQ ID NO: 9399123 - DNA, 22 bp, Homo sapiens
tctggctgttttagatgagctc

SEQ ID NO: 9399124 - DNA, 22 bp, Homo sapiens
tctggctgttgttaggttcctg

SEQ ID NO: 9399125 - DNA, 22 bp, Homo sapiens
tctggcttcaagtcccagctct

SEQ ID NO: 9399126 - DNA, 22 bp, Homo sapiens
tctggcttcgcagctcccagcc

SEQ ID NO: 9399127 - DNA, 22 bp, Homo sapiens
tctggcttctcctagagcaatg

SEQ ID NO: 9399128 - DNA, 22 bp, Homo sapiens
tctggcttcagtagggttcact

SEQ ID NO: 9399129 - DNA, 23 bp, Homo sapiens
tctggcttccagtgggttcaacc

SEQ ID NO: 9399130 - DNA, 22 bp, Homo sapiens
tctggaggcaggctgccaggat

SEQ ID NO: 9399131 - DNA, 22 bp, Homo sapiens
tctggctcataggaaggccatt

SEQ ID NO: 9399132 - DNA, 22 bp, Homo sapiens
tctggctcatacaagcctgcaa

SEQ ID NO: 9399133 - DNA, 22 bp, Homo sapiens
tctggctcatacaagcctgcaa

SEQ ID NO: 9399134 - DNA, 22 bp, Homo sapiens
tctggagcttgtttcagatggt

SEQ ID NO: 9399135 - DNA, 22 bp, Homo sapiens
tctggagcttgaagctttggtt

SEQ ID NO: 9399136 - DNA, 22 bp, Homo sapiens
tctggagcttgtttcagatggt

SEQ ID NO: 9399137 - DNA, 22 bp, Homo sapiens
tctggagcttgtttcagatggt

SEQ ID NO: 9399138 - DNA, 21 bp, Homo sapiens
tctggagctgcaggctgggca

SEQ ID NO: 9399139 - DNA, 19 bp, Homo sapiens
tctggagctgatgcaggtg

SEQ ID NO: 9399140 - DNA, 19 bp, Homo sapiens
tctggagctgatgcaggtg

SEQ ID NO: 9399141 - DNA, 22 bp, Homo sapiens
tctggagcttcctcatttacag

SEQ ID NO: 9399142 - DNA, 22 bp, Homo sapiens
tctggagctggagggcaaggca

SEQ ID NO: 9399143 - DNA, 22 bp, Homo sapiens
ccagcttcggcaagcagacttt

SEQ ID NO: 9399144 - DNA, 22 bp, Homo sapiens
ccagcttctccttatgtcctca

SEQ ID NO: 9399145 - DNA, 22 bp, Homo sapiens
ccaggaagaaacagtctttata

SEQ ID NO: 9399146 - DNA, 22 bp, Homo sapiens
ccaggaagaaacagtctttata

SEQ ID NO: 9399147 - DNA, 22 bp, Homo sapiens
ccaggaagacacatgctcatcc

SEQ ID NO: 9399148 - DNA, 22 bp, Homo sapiens
ccaggaagacacatgctcatcc

SEQ ID NO: 9399149 - DNA, 22 bp, Homo sapiens
ccaggaagacacatgctcatcc

SEQ ID NO: 9399150 - DNA, 22 bp, Homo sapiens
ccaggaaatagtgctgtgatct

SEQ ID NO: 9399151 - DNA, 22 bp, Homo sapiens
ccaggaagcctcagatgctgag

SEQ ID NO: 9399152 - DNA, 22 bp, Homo sapiens
ccaggaagcctgtgtctctgga

SEQ ID NO: 9399153 - DNA, 22 bp, Homo sapiens
ccaggaagcctgtgtctctgga

SEQ ID NO: 9399154 - DNA, 22 bp, Homo sapiens
ccaggaagcctgtgtctctgga

SEQ ID NO: 9399155 - DNA, 22 bp, Homo sapiens
ccaggaagcctcagatgctgag

SEQ ID NO: 9399156 - DNA, 22 bp, Homo sapiens
ccaggaagcctcagatgctgag

SEQ ID NO: 9399157 - DNA, 22 bp, Homo sapiens
ccaggaagcataatgtagtggg

SEQ ID NO: 9399158 - DNA, 22 bp, Homo sapiens
ccaggaagcctcagatgctgag

SEQ ID NO: 9399159 - DNA, 23 bp, Homo sapiens
ccaggaagaggccatccacagtc

SEQ ID NO: 9399160 - DNA, 23 bp, Homo sapiens
ccaggaagaggccatccacagtc

SEQ ID NO: 9399161 - DNA, 22 bp, Homo sapiens
ccaggaagatttattttggctt

SEQ ID NO: 9399162 - DNA, 22 bp, Homo sapiens
ccaggaagatttattttggctt

SEQ ID NO: 9399163 - DNA, 22 bp, Homo sapiens
ccaggaagcataatgtagtggg

SEQ ID NO: 9399164 - DNA, 22 bp, Homo sapiens
ccaggaggcaatatcaagtcca

SEQ ID NO: 9399165 - DNA, 22 bp, Homo sapiens
ccaggaggcaatatcaagtcca

SEQ ID NO: 9399166 - DNA, 22 bp, Homo sapiens
ccaggaggcagaagttgcagtg

SEQ ID NO: 9399167 - DNA, 22 bp, Homo sapiens
ccaggaggcagaagttgcagtg

SEQ ID NO: 9399168 - DNA, 21 bp, Homo sapiens
ccaggaaggactgagctccct

SEQ ID NO: 9399169 - DNA, 21 bp, Homo sapiens
ccaggaaggactgagctccct

SEQ ID NO: 9399170 - DNA, 22 bp, Homo sapiens
ccaggagcgcgtgaacaggctg

SEQ ID NO: 9399171 - DNA, 21 bp, Homo sapiens
ccaggaaggactgagctccct

SEQ ID NO: 9399172 - DNA, 22 bp, Homo sapiens
ccaggaagcggtgagggctgcc

SEQ ID NO: 9399173 - DNA, 22 bp, Homo sapiens
ccaggaagcctttttctttgac

SEQ ID NO: 9399174 - DNA, 22 bp, Homo sapiens
ccaggaagcctttttctttgac

SEQ ID NO: 9399175 - DNA, 22 bp, Homo sapiens
ccaggaagcggtgagggctgcc

SEQ ID NO: 9399176 - DNA, 22 bp, Homo sapiens
ccaggaagcggtgagggctgcc

SEQ ID NO: 9399177 - DNA, 22 bp, Homo sapiens
ccaggaagctctgctccacggg

SEQ ID NO: 9399178 - DNA, 22 bp, Homo sapiens
ccaggaagctctgctccacggg

SEQ ID NO: 9399179 - DNA, 22 bp, Homo sapiens
ccaggaagctgtctgatatgaa

SEQ ID NO: 9399180 - DNA, 22 bp, Homo sapiens
ccaggaagctgtctgatatgaa

SEQ ID NO: 9399181 - DNA, 22 bp, Homo sapiens
ccaggaaggaagcaggggtttc

SEQ ID NO: 9399182 - DNA, 22 bp, Homo sapiens
ccaggaaggaagcaggggtttc

SEQ ID NO: 9399183 - DNA, 22 bp, Homo sapiens
ccaggaagctgtgagattccaa

SEQ ID NO: 9399184 - DNA, 22 bp, Homo sapiens
ccaggaaggaagcaggggtttc

SEQ ID NO: 9399185 - DNA, 22 bp, Homo sapiens
ccaggaagctgtgagattccaa

SEQ ID NO: 9399186 - DNA, 22 bp, Homo sapiens
tctgtcttggccagccatctgg

SEQ ID NO: 9399187 - DNA, 23 bp, Homo sapiens
tctgtcttgtttaggccactgtt

SEQ ID NO: 9399188 - DNA, 22 bp, Homo sapiens
tctgtcttctgtagctaataat

SEQ ID NO: 9399189 - DNA, 19 bp, Homo sapiens
tctgtggcacctgggaggg

SEQ ID NO: 9399190 - DNA, 22 bp, Homo sapiens
tctgtggcacgattgcactgca

SEQ ID NO: 9399191 - DNA, 22 bp, Homo sapiens
tctgtggcaaacacagtgacca

SEQ ID NO: 9399192 - DNA, 22 bp, Homo sapiens
tctgtggcaaacacagtgacca

SEQ ID NO: 9399193 - DNA, 19 bp, Homo sapiens
tctgtggcacctgggaggg

SEQ ID NO: 9399194 - DNA, 21 bp, Homo sapiens
tctgtggcagcatgatgaggt

SEQ ID NO: 9399195 - DNA, 20 bp, Homo sapiens
tctgtggcaggtggcgcttg

SEQ ID NO: 9399196 - DNA, 18 bp, Homo sapiens
tctgtggcagcagtgcac

SEQ ID NO: 9399197 - DNA, 18 bp, Homo sapiens
tctgtggcagcagtgcac

SEQ ID NO: 9399198 - DNA, 22 bp, Homo sapiens
tctgtcttagccatctcaggct

SEQ ID NO: 9399199 - DNA, 23 bp, Homo sapiens
tctgtctgtgtatgtgcagaaag

SEQ ID NO: 9399200 - DNA, 18 bp, Homo sapiens
tctgtctgtgttgtcttt

SEQ ID NO: 9399201 - DNA, 18 bp, Homo sapiens
tctgtctgtgttgtcttt

SEQ ID NO: 9399202 - DNA, 22 bp, Homo sapiens
tctgtcatccaggctggaatat

SEQ ID NO: 9399203 - DNA, 22 bp, Homo sapiens
tctgtcatcaaatatgctttct

SEQ ID NO: 9399204 - DNA, 17 bp, Homo sapiens
tctgtctgtggtccact

SEQ ID NO: 9399205 - DNA, 22 bp, Homo sapiens
ccaggaggcagaggttacagtg

SEQ ID NO: 9399206 - DNA, 22 bp, Homo sapiens
ccaggaggcagaagttgcagtg

SEQ ID NO: 9399207 - DNA, 22 bp, Homo sapiens
ccaggaggcagaggttgtagtg

SEQ ID NO: 9399208 - DNA, 22 bp, Homo sapiens
ccaggaggcggaaggtacagtg

SEQ ID NO: 9399209 - DNA, 22 bp, Homo sapiens
ccaggaggcggaaggtacagtg

SEQ ID NO: 9399210 - DNA, 22 bp, Homo sapiens
ccaggaggcggaaggtacagtg

SEQ ID NO: 9399211 - DNA, 22 bp, Homo sapiens
ccaggaggcggaaggtacagtg

SEQ ID NO: 9399212 - DNA, 22 bp, Homo sapiens
ccaggaggcggaggttgcagcg

SEQ ID NO: 9399213 - DNA, 22 bp, Homo sapiens
tctgtcacccaggctggagtgc

SEQ ID NO: 9399214 - DNA, 22 bp, Homo sapiens
tctgtcacccgagcaggcgaga

SEQ ID NO: 9399215 - DNA, 22 bp, Homo sapiens
tctgtcaccgagggcatccaaa

SEQ ID NO: 9399216 - DNA, 23 bp, Homo sapiens
tctgtcacctatggctgctcttc

SEQ ID NO: 9399217 - DNA, 22 bp, Homo sapiens
tctgtcagcccctcagctgtca

SEQ ID NO: 9399218 - DNA, 23 bp, Homo sapiens
tctgtcactttctgctgtggagt

SEQ ID NO: 9399219 - DNA, 23 bp, Homo sapiens
ccagctccgtgagcctcgggctc

SEQ ID NO: 9399220 - DNA, 22 bp, Homo sapiens
ccagctcctcttcccagtgtca

SEQ ID NO: 9399221 - DNA, 22 bp, Homo sapiens
ccagctccaggactgggagctg

SEQ ID NO: 9399222 - DNA, 22 bp, Homo sapiens
ccagctcctcttgtctctagca

SEQ ID NO: 9399223 - DNA, 22 bp, Homo sapiens
ccagctcctcttgtctctagca

SEQ ID NO: 9399224 - DNA, 22 bp, Homo sapiens
ccagctccttctgtctgtggag

SEQ ID NO: 9399225 - DNA, 22 bp, Homo sapiens
ccagctccttctgtctgtggag

SEQ ID NO: 9399226 - DNA, 22 bp, Homo sapiens
ccagctctaaacggctctgtgg

SEQ ID NO: 9399227 - DNA, 22 bp, Homo sapiens
ccagctctaaacggctctgtgg

SEQ ID NO: 9399228 - DNA, 22 bp, Homo sapiens
ccagctctcagcgggagactca

SEQ ID NO: 9399229 - DNA, 22 bp, Homo sapiens
ccagctctcagcgggagactca

SEQ ID NO: 9399230 - DNA, 22 bp, Homo sapiens
ccagctctagccccatgtggct

SEQ ID NO: 9399231 - DNA, 22 bp, Homo sapiens
tctgccagcaccatgatccttc

SEQ ID NO: 9399232 - DNA, 22 bp, Homo sapiens
tctgccagacctgactcagtag

SEQ ID NO: 9399233 - DNA, 22 bp, Homo sapiens
tctgccagacctgactcagtag

SEQ ID NO: 9399234 - DNA, 22 bp, Homo sapiens
tctgccagaagttctgagagta

SEQ ID NO: 9399235 - DNA, 22 bp, Homo sapiens
tctgccactgtgatgcatgata

SEQ ID NO: 9399236 - DNA, 20 bp, Homo sapiens
tctgccactgcactctgccc

SEQ ID NO: 9399237 - DNA, 22 bp, Homo sapiens
tctgccactgtgatgcatgata

SEQ ID NO: 9399238 - DNA, 22 bp, Homo sapiens
tctgcctcctgcttgtcccgac

SEQ ID NO: 9399239 - DNA, 22 bp, Homo sapiens
tctgccaggaagaaagcacaat

SEQ ID NO: 9399240 - DNA, 22 bp, Homo sapiens
tctgcctcgctaacagcagcca

SEQ ID NO: 9399241 - DNA, 19 bp, Homo sapiens
tctgcctctggtcaggctc

SEQ ID NO: 9399242 - DNA, 22 bp, Homo sapiens
tctgcctcgctaacagcagcca

SEQ ID NO: 9399243 - DNA, 22 bp, Homo sapiens
tctgagtgatgttgagtcagaa

SEQ ID NO: 9399244 - DNA, 22 bp, Homo sapiens
tctgagtgagtgtaggcctgac

SEQ ID NO: 9399245 - DNA, 22 bp, Homo sapiens
tctgataagtggtgtatactgt

SEQ ID NO: 9399246 - DNA, 23 bp, Homo sapiens
tctgataagggagagggaagcag

SEQ ID NO: 9399247 - DNA, 22 bp, Homo sapiens
tctgataactctggccccaggc

SEQ ID NO: 9399248 - DNA, 20 bp, Homo sapiens
tctgataactggttgtgatt

SEQ ID NO: 9399249 - DNA, 22 bp, Homo sapiens
tctgataagacagctgatttga

SEQ ID NO: 9399250 - DNA, 22 bp, Homo sapiens
tctgataaataacatttggaaa

SEQ ID NO: 9399251 - DNA, 20 bp, Homo sapiens
tctgataaaaactactccat

SEQ ID NO: 9399252 - DNA, 22 bp, Homo sapiens
tctgataacaaccatgtctggc

SEQ ID NO: 9399253 - DNA, 22 bp, Homo sapiens
tctgataaataacatttggaaa

SEQ ID NO: 9399254 - DNA, 22 bp, Homo sapiens
tctgataaatgccatctttttg

SEQ ID NO: 9399255 - DNA, 22 bp, Homo sapiens
ccagcctggagggcagtggtgg

SEQ ID NO: 9399256 - DNA, 22 bp, Homo sapiens
tctgataatggacttctcatct

SEQ ID NO: 9399257 - DNA, 22 bp, Homo sapiens
tctgataggtggtagaaggagg

SEQ ID NO: 9399258 - DNA, 22 bp, Homo sapiens
tctgatactgcaaaaatgtagg

SEQ ID NO: 9399259 - DNA, 22 bp, Homo sapiens
tctgataatgtgcttcgtgacc

SEQ ID NO: 9399260 - DNA, 22 bp, Homo sapiens
ccagcctcatcatattcctgct

SEQ ID NO: 9399261 - DNA, 23 bp, Homo sapiens
ccagctcatccattacctctctt

SEQ ID NO: 9399262 - DNA, 23 bp, Homo sapiens
ccagctcatccattacctctctt

SEQ ID NO: 9399263 - DNA, 22 bp, Homo sapiens
ccagctccactgtcagatgaga

SEQ ID NO: 9399264 - DNA, 22 bp, Homo sapiens
ccagctccagcatagccaccat

SEQ ID NO: 9399265 - DNA, 22 bp, Homo sapiens
ccagctccagcatagccaccat

SEQ ID NO: 9399266 - DNA, 21 bp, Homo sapiens
ccagctccaggaccttggatc

SEQ ID NO: 9399267 - DNA, 22 bp, Homo sapiens
ccagccttgactgccccagcac

SEQ ID NO: 9399268 - DNA, 22 bp, Homo sapiens
ccagccttgcaccgagccagcc

SEQ ID NO: 9399269 - DNA, 22 bp, Homo sapiens
ccagccttgcaccgagccagcc

SEQ ID NO: 9399270 - DNA, 23 bp, Homo sapiens
ccagcgctcactcagagcatgtt

SEQ ID NO: 9399271 - DNA, 23 bp, Homo sapiens
ccagcgctcactcagagcatgtt

SEQ ID NO: 9399272 - DNA, 23 bp, Homo sapiens
ccagcgctcactcagagcatgtt

SEQ ID NO: 9399273 - DNA, 23 bp, Homo sapiens
ccagcgctcactcagagcatgtt

SEQ ID NO: 9399274 - DNA, 22 bp, Homo sapiens
ccagcctggggaggcagcttct

SEQ ID NO: 9399275 - DNA, 22 bp, Homo sapiens
ccagcctgggtgttagaagaca

SEQ ID NO: 9399276 - DNA, 22 bp, Homo sapiens
ccagcctggttcagaattggct

SEQ ID NO: 9399277 - DNA, 22 bp, Homo sapiens
ccagccttcacctgctctggtc

SEQ ID NO: 9399278 - DNA, 22 bp, Homo sapiens
ccagccttctgagctgcctgga

SEQ ID NO: 9399279 - DNA, 22 bp, Homo sapiens
ccagccttctgagctgcctgga

SEQ ID NO: 9399280 - DNA, 22 bp, Homo sapiens
tctcttaataagtaaatactga

SEQ ID NO: 9399281 - DNA, 22 bp, Homo sapiens
tctcttctttggggtgggctca

SEQ ID NO: 9399282 - DNA, 22 bp, Homo sapiens
tctcttggaggttcttcctgtt

SEQ ID NO: 9399283 - DNA, 22 bp, Homo sapiens
tctcttggacatgtggctctgc

SEQ ID NO: 9399284 - DNA, 22 bp, Homo sapiens
tctcttggaggttcttcctgtt

SEQ ID NO: 9399285 - DNA, 22 bp, Homo sapiens
tctcttggaacacttgctctta

SEQ ID NO: 9399286 - DNA, 18 bp, Homo sapiens
tctcttgcatcttctgta

SEQ ID NO: 9399287 - DNA, 22 bp, Homo sapiens
tctcttggaacacttgctctta

SEQ ID NO: 9399288 - DNA, 22 bp, Homo sapiens
tctctcttcaacccttaactag

SEQ ID NO: 9399289 - DNA, 22 bp, Homo sapiens
tctctcttcaacccttaactag

SEQ ID NO: 9399290 - DNA, 23 bp, Homo sapiens
tctctcttagctatgcttatggc

SEQ ID NO: 9399291 - DNA, 23 bp, Homo sapiens
tctctcttagctatgcttatggc

SEQ ID NO: 9399292 - DNA, 22 bp, Homo sapiens
tctctcttgaagtattagctag

SEQ ID NO: 9399293 - DNA, 22 bp, Homo sapiens
tctctcttgaagtattagctag

SEQ ID NO: 9399294 - DNA, 22 bp, Homo sapiens
tctctcttctttgttaagaatg

SEQ ID NO: 9399295 - DNA, 22 bp, Homo sapiens
tctctcttcagagataccttgc

SEQ ID NO: 9399296 - DNA, 22 bp, Homo sapiens
tctcttggggaaagagaagaat

SEQ ID NO: 9399297 - DNA, 22 bp, Homo sapiens
tctcttggtgatagtctttctt

SEQ ID NO: 9399298 - DNA, 22 bp, Homo sapiens
tctcttggtacacagatgatca

SEQ ID NO: 9399299 - DNA, 22 bp, Homo sapiens
tctgaaataggaaagcaaatgg

SEQ ID NO: 9399300 - DNA, 22 bp, Homo sapiens
tctgaaatattggtaatacttt

SEQ ID NO: 9399301 - DNA, 22 bp, Homo sapiens
tctgaaataggagccatgtaga

SEQ ID NO: 9399302 - DNA, 22 bp, Homo sapiens
tctgaaataggcttcttttggt

SEQ ID NO: 9399303 - DNA, 22 bp, Homo sapiens
tctgaaatatattttgagtgtt

SEQ ID NO: 9399304 - DNA, 22 bp, Homo sapiens
tctgaaatctaatgctctgtgg

SEQ ID NO: 9399305 - DNA, 22 bp, Homo sapiens
tctgaaatcctttatcttggct

SEQ ID NO: 9399306 - DNA, 22 bp, Homo sapiens
tctgaaatcctttatcttggct

SEQ ID NO: 9399307 - DNA, 22 bp, Homo sapiens
tctgaaatctgtaagcactagc

SEQ ID NO: 9399308 - DNA, 22 bp, Homo sapiens
tctgaaatctgtaagcactagc

SEQ ID NO: 9399309 - DNA, 22 bp, Homo sapiens
ccagccactgggccactgccag

SEQ ID NO: 9399310 - DNA, 22 bp, Homo sapiens
ccagccagtccagcattggtgt

SEQ ID NO: 9399311 - DNA, 22 bp, Homo sapiens
ccagccagtcccgcatgaccgc

SEQ ID NO: 9399312 - DNA, 22 bp, Homo sapiens
ccagccagtcccgcatgaccgc

SEQ ID NO: 9399313 - DNA, 22 bp, Homo sapiens
ccagccataaacccagatgact

SEQ ID NO: 9399314 - DNA, 22 bp, Homo sapiens
ccagccataaacccagatgact

SEQ ID NO: 9399315 - DNA, 22 bp, Homo sapiens
tctgaggcataacctgttctgc

SEQ ID NO: 9399316 - DNA, 22 bp, Homo sapiens
tctgaggcatacccaggccccc

SEQ ID NO: 9399317 - DNA, 22 bp, Homo sapiens
tctgaggcatttaattatgacc

SEQ ID NO: 9399318 - DNA, 22 bp, Homo sapiens
tctgaggcatacccaggccccc

SEQ ID NO: 9399319 - DNA, 22 bp, Homo sapiens
tctgaggcccagttcaactctt

SEQ ID NO: 9399320 - DNA, 22 bp, Homo sapiens
tctgaggttgaactttgcaaag

SEQ ID NO: 9399321 - DNA, 22 bp, Homo sapiens
tctgaggttttcatgttttctg

SEQ ID NO: 9399322 - DNA, 22 bp, Homo sapiens
tctgaggcccctgggcaggatg

SEQ ID NO: 9399323 - DNA, 22 bp, Homo sapiens
tctgaggccccagccctgcaca

SEQ ID NO: 9399324 - DNA, 22 bp, Homo sapiens
tctgagagtctctgaggcagat

SEQ ID NO: 9399325 - DNA, 22 bp, Homo sapiens
tctgagagtctctgaggcagat

SEQ ID NO: 9399326 - DNA, 22 bp, Homo sapiens
ccagccctacagtatcacctgt

SEQ ID NO: 9399327 - DNA, 22 bp, Homo sapiens
ccagccctcactgaggcctctc

SEQ ID NO: 9399328 - DNA, 22 bp, Homo sapiens
tctgaggacagtgctgtgcctg

SEQ ID NO: 9399329 - DNA, 22 bp, Homo sapiens
tctgaggagttgggccagtgct

SEQ ID NO: 9399330 - DNA, 22 bp, Homo sapiens
tctgaggacctactgaagagtt

SEQ ID NO: 9399331 - DNA, 22 bp, Homo sapiens
tctgaggcagcttgccactcta

SEQ ID NO: 9399332 - DNA, 22 bp, Homo sapiens
tctgaggcaaacagaggagtgt

SEQ ID NO: 9399333 - DNA, 22 bp, Homo sapiens
ccagcccaaacaagccgccttc

SEQ ID NO: 9399334 - DNA, 19 bp, Homo sapiens
ccagcccatagtccatcac

SEQ ID NO: 9399335 - DNA, 21 bp, Homo sapiens
ccagcccagcctccttctctt

SEQ ID NO: 9399336 - DNA, 22 bp, Homo sapiens
ccagcccctatcctcgctccac

SEQ ID NO: 9399337 - DNA, 22 bp, Homo sapiens
ccagccccgggccttaccgtgc

SEQ ID NO: 9399338 - DNA, 22 bp, Homo sapiens
ccagccccgggaacctggccgt

SEQ ID NO: 9399339 - DNA, 22 bp, Homo sapiens
ccagccccgggaacctggccgt

SEQ ID NO: 9399340 - DNA, 22 bp, Homo sapiens
ccagcccgaatccctaaagcaa

SEQ ID NO: 9399341 - DNA, 22 bp, Homo sapiens
ccagcccgaatccctggccagg

SEQ ID NO: 9399342 - DNA, 22 bp, Homo sapiens
ccagcccctatcctcgctccac

SEQ ID NO: 9399343 - DNA, 22 bp, Homo sapiens
ccagcccctatcctcgctccac

SEQ ID NO: 9399344 - DNA, 22 bp, Homo sapiens
ccagccccgggaacctggccgt

SEQ ID NO: 9399345 - DNA, 22 bp, Homo sapiens
ccagcccatgcccttatagcat

SEQ ID NO: 9399346 - DNA, 19 bp, Homo sapiens
ccagcccatagtccatcac

SEQ ID NO: 9399347 - DNA, 22 bp, Homo sapiens
tcagggcccagtctgtgcatct

SEQ ID NO: 9399348 - DNA, 22 bp, Homo sapiens
tcagggccatcttttgcctcaa

SEQ ID NO: 9399349 - DNA, 22 bp, Homo sapiens
tcagggccatcttttgcctcaa

SEQ ID NO: 9399350 - DNA, 22 bp, Homo sapiens
tcagggcccagagctcaggcaa

SEQ ID NO: 9399351 - DNA, 22 bp, Homo sapiens
tcagggcccagagctcaggcaa

SEQ ID NO: 9399352 - DNA, 19 bp, Homo sapiens
tcagggccatgagcgccac

SEQ ID NO: 9399353 - DNA, 22 bp, Homo sapiens
catatgtatttctcataattag

SEQ ID NO: 9399354 - DNA, 22 bp, Homo sapiens
catatgtactgtttgctttcaa

SEQ ID NO: 9399355 - DNA, 22 bp, Homo sapiens
catatgtatttctcataattag

SEQ ID NO: 9399356 - DNA, 20 bp, Homo sapiens
tcagggcatgggacagcccc

SEQ ID NO: 9399357 - DNA, 22 bp, Homo sapiens
tcagggcatggctgcacttggc

SEQ ID NO: 9399358 - DNA, 22 bp, Homo sapiens
tcagggcatggctgcacttggc

SEQ ID NO: 9399359 - DNA, 22 bp, Homo sapiens
tcagggcatggctgcacttggc

SEQ ID NO: 9399360 - DNA, 20 bp, Homo sapiens
tcagggcatgggacagcccc

SEQ ID NO: 9399361 - DNA, 20 bp, Homo sapiens
tcagggcatgggacagcccc

SEQ ID NO: 9399362 - DNA, 20 bp, Homo sapiens
tcagggcatgggacagcccc

SEQ ID NO: 9399363 - DNA, 22 bp, Homo sapiens
tcagggcatgtatgtttcttta

SEQ ID NO: 9399364 - DNA, 22 bp, Homo sapiens
tcagggcattcaagaggcctgg

SEQ ID NO: 9399365 - DNA, 22 bp, Homo sapiens
tcagggcatgtatgtttcttta

SEQ ID NO: 9399366 - DNA, 22 bp, Homo sapiens
tcagggcattcaagaggcctgg

SEQ ID NO: 9399367 - DNA, 22 bp, Homo sapiens
tcagggcattcaagaggcctgg

SEQ ID NO: 9399368 - DNA, 22 bp, Homo sapiens
catccagggcagccatggcctg

SEQ ID NO: 9399369 - DNA, 22 bp, Homo sapiens
catccatagattgagagatggt

SEQ ID NO: 9399370 - DNA, 22 bp, Homo sapiens
catccagtggtcagggaagttg

SEQ ID NO: 9399371 - DNA, 22 bp, Homo sapiens
catccagggcagccatggcctg

SEQ ID NO: 9399372 - DNA, 23 bp, Homo sapiens
catccaggagctgagtctgactg

SEQ ID NO: 9399373 - DNA, 22 bp, Homo sapiens
catccagaccgtgccatgctgc

SEQ ID NO: 9399374 - DNA, 22 bp, Homo sapiens
catccactagaatgacagagtt

SEQ ID NO: 9399375 - DNA, 22 bp, Homo sapiens
catcatcttgaatgactgtgat

SEQ ID NO: 9399376 - DNA, 22 bp, Homo sapiens
catcatcttgaatgactgtgat

SEQ ID NO: 9399377 - DNA, 22 bp, Homo sapiens
catcatctggcttttagaaaaa

SEQ ID NO: 9399378 - DNA, 22 bp, Homo sapiens
catcatctggcttttagaaaaa

SEQ ID NO: 9399379 - DNA, 22 bp, Homo sapiens
catcacagggggctagaagtct

SEQ ID NO: 9399380 - DNA, 22 bp, Homo sapiens
catcacagggggctagaagtct

SEQ ID NO: 9399381 - DNA, 22 bp, Homo sapiens
catcacatgcctatcatgagct

SEQ ID NO: 9399382 - DNA, 19 bp, Homo sapiens
catcacatggtctgatgaa

SEQ ID NO: 9399383 - DNA, 22 bp, Homo sapiens
catcacatgcctatcatgagct

SEQ ID NO: 9399384 - DNA, 22 bp, Homo sapiens
catcacatcaaacctactctca

SEQ ID NO: 9399385 - DNA, 22 bp, Homo sapiens
catcacatcagtgtgaacagtt

SEQ ID NO: 9399386 - DNA, 22 bp, Homo sapiens
catcacatgtaggcagcatcac

SEQ ID NO: 9399387 - DNA, 22 bp, Homo sapiens
catcacatgcctatcatgagct

SEQ ID NO: 9399388 - DNA, 22 bp, Homo sapiens
catcacatgtaggcagcatcac

SEQ ID NO: 9399389 - DNA, 19 bp, Homo sapiens
catcacatggtctgatgaa

SEQ ID NO: 9399390 - DNA, 22 bp, Homo sapiens
catcacatgtaggcagcatcac

SEQ ID NO: 9399391 - DNA, 22 bp, Homo sapiens
catcatcacctgctatacgatc

SEQ ID NO: 9399392 - DNA, 22 bp, Homo sapiens
catagacaaagatcagaagagt

SEQ ID NO: 9399393 - DNA, 22 bp, Homo sapiens
catagaatggattgacaagatt

SEQ ID NO: 9399394 - DNA, 22 bp, Homo sapiens
catagaatggattgacaagatt

SEQ ID NO: 9399395 - DNA, 22 bp, Homo sapiens
catataaatacaacatgtgtta

SEQ ID NO: 9399396 - DNA, 19 bp, Homo sapiens
tcaggaagttgatgaggtg

SEQ ID NO: 9399397 - DNA, 19 bp, Homo sapiens
tcaggaagttgatgaggtg

SEQ ID NO: 9399398 - DNA, 19 bp, Homo sapiens
tcaggaagttgatgaggtg

SEQ ID NO: 9399399 - DNA, 22 bp, Homo sapiens
catataatgtttgaagatgtgg

SEQ ID NO: 9399400 - DNA, 22 bp, Homo sapiens
catataatgtttgaagatgtgg

SEQ ID NO: 9399401 - DNA, 22 bp, Homo sapiens
catatacacttccacctctgtg

SEQ ID NO: 9399402 - DNA, 22 bp, Homo sapiens
catataattacctaccagctgg

SEQ ID NO: 9399403 - DNA, 22 bp, Homo sapiens
tcaggaagtgcctaggctggcc

SEQ ID NO: 9399404 - DNA, 22 bp, Homo sapiens
tcaggaagtgctgaggctgctt

SEQ ID NO: 9399405 - DNA, 22 bp, Homo sapiens
tcaggaagtgctgaggctgctt

SEQ ID NO: 9399406 - DNA, 22 bp, Homo sapiens
tcaggaagtgcctaggctggcc

SEQ ID NO: 9399407 - DNA, 22 bp, Homo sapiens
tcaggaagtctcaattagctac

SEQ ID NO: 9399408 - DNA, 22 bp, Homo sapiens
tcaggaagtctcaattagctac

SEQ ID NO: 9399409 - DNA, 22 bp, Homo sapiens
tcaggaagttgaggcgtagaga

SEQ ID NO: 9399410 - DNA, 22 bp, Homo sapiens
tcaggaagttgaggcgtagaga

SEQ ID NO: 9399411 - DNA, 22 bp, Homo sapiens
tcaggaagtggtaaaggatgtt

SEQ ID NO: 9399412 - DNA, 22 bp, Homo sapiens
tcaggaagtggtaaaggatgtt

SEQ ID NO: 9399413 - DNA, 22 bp, Homo sapiens
tcaggaagtgctgaggctgctt

SEQ ID NO: 9399414 - DNA, 22 bp, Homo sapiens
tcaggaagtgctgaggctgctt

SEQ ID NO: 9399415 - DNA, 22 bp, Homo sapiens
catatcatttgcttataaatct

SEQ ID NO: 9399416 - DNA, 22 bp, Homo sapiens
catatattctggttttcactgg

SEQ ID NO: 9399417 - DNA, 22 bp, Homo sapiens
catatattctggttttcactgg

SEQ ID NO: 9399418 - DNA, 22 bp, Homo sapiens
catatattatggactgcagaat

SEQ ID NO: 9399419 - DNA, 22 bp, Homo sapiens
catatatgtagatgtatgtgaa

SEQ ID NO: 9399420 - DNA, 22 bp, Homo sapiens
catatatgtgcagaccacttga

SEQ ID NO: 9399421 - DNA, 22 bp, Homo sapiens
catatatgtagatgtatgtgaa

SEQ ID NO: 9399422 - DNA, 20 bp, Homo sapiens
catatatacctagaagtgga

SEQ ID NO: 9399423 - DNA, 20 bp, Homo sapiens
catatatacctagaagtgga

SEQ ID NO: 9399424 - DNA, 20 bp, Homo sapiens
catatatacctagaagtgga

SEQ ID NO: 9399425 - DNA, 20 bp, Homo sapiens
catatatacctagaagtgga

SEQ ID NO: 9399426 - DNA, 20 bp, Homo sapiens
catatatacctagaagtgga

SEQ ID NO: 9399427 - DNA, 22 bp, Homo sapiens
catatactgcatacatatgtgt

SEQ ID NO: 9399428 - DNA, 22 bp, Homo sapiens
catatacttttctatagctttc

SEQ ID NO: 9399429 - DNA, 22 bp, Homo sapiens
tcagcccgaggtcaggatgggg

SEQ ID NO: 9399430 - DNA, 22 bp, Homo sapiens
tcagccccacggggtcagccaa

SEQ ID NO: 9399431 - DNA, 22 bp, Homo sapiens
tcagccccacggggtcagccaa

SEQ ID NO: 9399432 - DNA, 22 bp, Homo sapiens
tcagccctgggacccagggatg

SEQ ID NO: 9399433 - DNA, 22 bp, Homo sapiens
tcagccctggcactgtctccca

SEQ ID NO: 9399434 - DNA, 22 bp, Homo sapiens
tcagccctagcctcagtccagg

SEQ ID NO: 9399435 - DNA, 22 bp, Homo sapiens
tcagcccgggttcgcaaacact

SEQ ID NO: 9399436 - DNA, 22 bp, Homo sapiens
tcagccctgaggacagaggcag

SEQ ID NO: 9399437 - DNA, 20 bp, Homo sapiens
tcagccctgagtccaggctg

SEQ ID NO: 9399438 - DNA, 22 bp, Homo sapiens
tcagccctgaggacagaggcag

SEQ ID NO: 9399439 - DNA, 22 bp, Homo sapiens
tcagctgcactgttctgaccca

SEQ ID NO: 9399440 - DNA, 22 bp, Homo sapiens
tcagctgagctccagctcatag

SEQ ID NO: 9399441 - DNA, 22 bp, Homo sapiens
tcagctcttaaccctctggcct

SEQ ID NO: 9399442 - DNA, 22 bp, Homo sapiens
tcagctcttccccccagccagg

SEQ ID NO: 9399443 - DNA, 22 bp, Homo sapiens
tcagctcttaaccctctggcct

SEQ ID NO: 9399444 - DNA, 20 bp, Homo sapiens
tcagctctgtgcctgggatg

SEQ ID NO: 9399445 - DNA, 22 bp, Homo sapiens
tcagcccttcctggagctttta

SEQ ID NO: 9399446 - DNA, 19 bp, Homo sapiens
tcagctctggggtcagtgg

SEQ ID NO: 9399447 - DNA, 22 bp, Homo sapiens
tcagccctgggcttcctcatgg

SEQ ID NO: 9399448 - DNA, 22 bp, Homo sapiens
catacattgctcattcagtatc

SEQ ID NO: 9399449 - DNA, 22 bp, Homo sapiens
catacattttgcatatttacca

SEQ ID NO: 9399450 - DNA, 22 bp, Homo sapiens
catacatttatacacatctatg

SEQ ID NO: 9399451 - DNA, 22 bp, Homo sapiens
cataatttttttaagtcagaac

SEQ ID NO: 9399452 - DNA, 22 bp, Homo sapiens
cataatttttttaagtcagaac

SEQ ID NO: 9399453 - DNA, 22 bp, Homo sapiens
cataatttttttaagtcagaac

SEQ ID NO: 9399454 - DNA, 22 bp, Homo sapiens
cataatttttttaagtcagaac

SEQ ID NO: 9399455 - DNA, 22 bp, Homo sapiens
tcagctgcagtttcacaagcac

SEQ ID NO: 9399456 - DNA, 22 bp, Homo sapiens
tcagctgcagtttcacaagcac

SEQ ID NO: 9399457 - DNA, 22 bp, Homo sapiens
tcaggaagtataatcagattca

SEQ ID NO: 9399458 - DNA, 22 bp, Homo sapiens
tcaggaagtataatcagattca

SEQ ID NO: 9399459 - DNA, 22 bp, Homo sapiens
catacattttgcatatttacca

SEQ ID NO: 9399460 - DNA, 22 bp, Homo sapiens
catactattactaggagcagga

SEQ ID NO: 9399461 - DNA, 19 bp, Homo sapiens
tcagcccaggctgggaagc

SEQ ID NO: 9399462 - DNA, 22 bp, Homo sapiens
tcagcccaggaatgagccttct

SEQ ID NO: 9399463 - DNA, 22 bp, Homo sapiens
cagtttcttaagactgagatct

SEQ ID NO: 9399464 - DNA, 22 bp, Homo sapiens
cagtttctgttttaaatagcag

SEQ ID NO: 9399465 - DNA, 22 bp, Homo sapiens
cagtttcttagtgacacaaatc

SEQ ID NO: 9399466 - DNA, 22 bp, Homo sapiens
cagtttcttcaattcagacact

SEQ ID NO: 9399467 - DNA, 22 bp, Homo sapiens
cagtttcttcaattcagacact

SEQ ID NO: 9399468 - DNA, 22 bp, Homo sapiens
cagtttcttcaattcagacact

SEQ ID NO: 9399469 - DNA, 22 bp, Homo sapiens
cagtttcttcatcagttaagca

SEQ ID NO: 9399470 - DNA, 22 bp, Homo sapiens
cagtttcttctattttgaacta

SEQ ID NO: 9399471 - DNA, 22 bp, Homo sapiens
cagtttctgagccctgtcattt

SEQ ID NO: 9399472 - DNA, 22 bp, Homo sapiens
cagtttctgaggttccaggttt

SEQ ID NO: 9399473 - DNA, 22 bp, Homo sapiens
cagtttctctcatacatatttg

SEQ ID NO: 9399474 - DNA, 22 bp, Homo sapiens
cagtttatatgagggtatcaag

SEQ ID NO: 9399475 - DNA, 22 bp, Homo sapiens
cagtttatatgtcagagctgta

SEQ ID NO: 9399476 - DNA, 22 bp, Homo sapiens
cagtttctgtggtctcttttca

SEQ ID NO: 9399477 - DNA, 22 bp, Homo sapiens
cagtttctgggcgttcacaggt

SEQ ID NO: 9399478 - DNA, 22 bp, Homo sapiens
tcagaagtactgtgctacaata

SEQ ID NO: 9399479 - DNA, 22 bp, Homo sapiens
tcagaaggtttttagcaaagga

SEQ ID NO: 9399480 - DNA, 22 bp, Homo sapiens
tcagaagggaaacacaagtgac

SEQ ID NO: 9399481 - DNA, 22 bp, Homo sapiens
cagtttatatataagcacattg

SEQ ID NO: 9399482 - DNA, 22 bp, Homo sapiens
catgatctggtcctactgtggg

SEQ ID NO: 9399483 - DNA, 23 bp, Homo sapiens
catgatgttaactttgttatgct

SEQ ID NO: 9399484 - DNA, 23 bp, Homo sapiens
catgatgttaactttgttatgct

SEQ ID NO: 9399485 - DNA, 22 bp, Homo sapiens
catgatgttaggcaggatacta

SEQ ID NO: 9399486 - DNA, 22 bp, Homo sapiens
catgatataaagtagtagataa

SEQ ID NO: 9399487 - DNA, 20 bp, Homo sapiens
catgatacttggaagggctt

SEQ ID NO: 9399488 - DNA, 22 bp, Homo sapiens
catgatacttgaatttggaagg

SEQ ID NO: 9399489 - DNA, 22 bp, Homo sapiens
catgatacttgacatttgcgat

SEQ ID NO: 9399490 - DNA, 22 bp, Homo sapiens
catgagaatgaagaagacttaa

SEQ ID NO: 9399491 - DNA, 22 bp, Homo sapiens
tcagtttatttcttgttccaca

SEQ ID NO: 9399492 - DNA, 22 bp, Homo sapiens
catgagaaggttttggcatata

SEQ ID NO: 9399493 - DNA, 22 bp, Homo sapiens
tcagtttataaattgtatttag

SEQ ID NO: 9399494 - DNA, 22 bp, Homo sapiens
tcagtttataaattgtatttag

SEQ ID NO: 9399495 - DNA, 22 bp, Homo sapiens
tcagtttatggtctagttcatg

SEQ ID NO: 9399496 - DNA, 22 bp, Homo sapiens
tcagtttaatacccagatgcct

SEQ ID NO: 9399497 - DNA, 22 bp, Homo sapiens
tcagtttagagttatttaatct

SEQ ID NO: 9399498 - DNA, 22 bp, Homo sapiens
tcagtttagatgcatttgtcgt

SEQ ID NO: 9399499 - DNA, 22 bp, Homo sapiens
tcagtttagatgcatttgtcgt

SEQ ID NO: 9399500 - DNA, 22 bp, Homo sapiens
tcagtttaatacccagatgcct

SEQ ID NO: 9399501 - DNA, 22 bp, Homo sapiens
tcagtttaagatgactaacaat

SEQ ID NO: 9399502 - DNA, 22 bp, Homo sapiens
tcatttgttctcattctctact

SEQ ID NO: 9399503 - DNA, 22 bp, Homo sapiens
tcatgtcagtttcttctataaa

SEQ ID NO: 9399504 - DNA, 18 bp, Homo sapiens
tcatgtcactgtgctccc

SEQ ID NO: 9399505 - DNA, 19 bp, Homo sapiens
tcatgtctctcatctgtga

SEQ ID NO: 9399506 - DNA, 22 bp, Homo sapiens
tcatttatttgactttggagtg

SEQ ID NO: 9399507 - DNA, 22 bp, Homo sapiens
tcatttcaagttctgacagcta

SEQ ID NO: 9399508 - DNA, 22 bp, Homo sapiens
tcatggttggagattgagggca

SEQ ID NO: 9399509 - DNA, 22 bp, Homo sapiens
tcatggttcatgagtgtccttt

SEQ ID NO: 9399510 - DNA, 22 bp, Homo sapiens
tcatggttcatgagtgtccttt

SEQ ID NO: 9399511 - DNA, 22 bp, Homo sapiens
tcatgtatttgtgatagatgac

SEQ ID NO: 9399512 - DNA, 22 bp, Homo sapiens
tcatggggtgacagaagggagg

SEQ ID NO: 9399513 - DNA, 22 bp, Homo sapiens
catctttaacaatttacaatgt

SEQ ID NO: 9399514 - DNA, 22 bp, Homo sapiens
catctttaacaatttacaatgt

SEQ ID NO: 9399515 - DNA, 22 bp, Homo sapiens
catctttaaaatgggaacaaca

SEQ ID NO: 9399516 - DNA, 22 bp, Homo sapiens
tcaggtgggtctacaattagtt

SEQ ID NO: 9399517 - DNA, 22 bp, Homo sapiens
tcaggtgggcgttccggtgcgg

SEQ ID NO: 9399518 - DNA, 22 bp, Homo sapiens
tcaggtggtcctaagtgccatc

SEQ ID NO: 9399519 - DNA, 22 bp, Homo sapiens
tcaggtggtcctaagtgccatc

SEQ ID NO: 9399520 - DNA, 22 bp, Homo sapiens
tcaggtgtaggttgttcagttt

SEQ ID NO: 9399521 - DNA, 22 bp, Homo sapiens
tcaggtgtaggttgttcagttt

SEQ ID NO: 9399522 - DNA, 22 bp, Homo sapiens
tcaggtgtaggttgttcagttt

SEQ ID NO: 9399523 - DNA, 22 bp, Homo sapiens
tcaggtggtcctaagtgccatc

SEQ ID NO: 9399524 - DNA, 22 bp, Homo sapiens
tcaggtgggtctacaattagtt

SEQ ID NO: 9399525 - DNA, 22 bp, Homo sapiens
tcaggtgggagtagaatgctag

SEQ ID NO: 9399526 - DNA, 22 bp, Homo sapiens
tcaggtgggagtagaatgctag

SEQ ID NO: 9399527 - DNA, 22 bp, Homo sapiens
tcaggtgggcgttccggtgcgg

SEQ ID NO: 9399528 - DNA, 22 bp, Homo sapiens
tcaggtgggcgttccggtgcgg

SEQ ID NO: 9399529 - DNA, 22 bp, Homo sapiens
tcaggtgggcagtgggttgagc

SEQ ID NO: 9399530 - DNA, 22 bp, Homo sapiens
tcaggtgggcagtgggttgagc

SEQ ID NO: 9399531 - DNA, 22 bp, Homo sapiens
catccccagagcagttccacta

SEQ ID NO: 9399532 - DNA, 22 bp, Homo sapiens
catcccctgatgctcttgagta

SEQ ID NO: 9399533 - DNA, 22 bp, Homo sapiens
catccccagagcagttccacta

SEQ ID NO: 9399534 - DNA, 22 bp, Homo sapiens
catccatagcttgatctgttcc

SEQ ID NO: 9399535 - DNA, 22 bp, Homo sapiens
catccatagcctcaataaatag

SEQ ID NO: 9399536 - DNA, 22 bp, Homo sapiens
catccatcacaagtttgttcat

SEQ ID NO: 9399537 - DNA, 22 bp, Homo sapiens
catccatatgaggcacattggt

SEQ ID NO: 9399538 - DNA, 22 bp, Homo sapiens
tcaggtggctggttgctggcta

SEQ ID NO: 9399539 - DNA, 22 bp, Homo sapiens
tcaggtggctggttgctggcta

SEQ ID NO: 9399540 - DNA, 22 bp, Homo sapiens
catccctgtcgtcaagtctctg

SEQ ID NO: 9399541 - DNA, 22 bp, Homo sapiens
tcaggtggctggttgctggcta

SEQ ID NO: 9399542 - DNA, 22 bp, Homo sapiens
tcaggtggctggttgctggcta

SEQ ID NO: 9399543 - DNA, 22 bp, Homo sapiens
catccctgggcgggacactctt

SEQ ID NO: 9399544 - DNA, 22 bp, Homo sapiens
catccctgccctcatgcctata

SEQ ID NO: 9399545 - DNA, 22 bp, Homo sapiens
tcaggtggcttggagggggacg

SEQ ID NO: 9399546 - DNA, 22 bp, Homo sapiens
tcaggtggcttcggggagtggc

SEQ ID NO: 9399547 - DNA, 22 bp, Homo sapiens
tcaggtggcttcggggagtggc

SEQ ID NO: 9399548 - DNA, 22 bp, Homo sapiens
tcaggtggcttcggggagtggc

SEQ ID NO: 9399549 - DNA, 22 bp, Homo sapiens
tcaggtgggacctgctaggaca

SEQ ID NO: 9399550 - DNA, 22 bp, Homo sapiens
tcaggtgggacctgctaggaca

SEQ ID NO: 9399551 - DNA, 22 bp, Homo sapiens
tcaggtggcttggagggggacg

SEQ ID NO: 9399552 - DNA, 22 bp, Homo sapiens
catctttagggaccattattct

SEQ ID NO: 9399553 - DNA, 22 bp, Homo sapiens
catctttagggaccattattct

SEQ ID NO: 9399554 - DNA, 22 bp, Homo sapiens
catctttaacagaatggatttg

SEQ ID NO: 9399555 - DNA, 22 bp, Homo sapiens
catctttagttattgaatatag

SEQ ID NO: 9399556 - DNA, 22 bp, Homo sapiens
catctttagttattgaatatag

SEQ ID NO: 9399557 - DNA, 22 bp, Homo sapiens
catctttatttatatagacagg

SEQ ID NO: 9399558 - DNA, 22 bp, Homo sapiens
catctttatttatatagacagg

SEQ ID NO: 9399559 - DNA, 22 bp, Homo sapiens
catctttatttatatagacagg

SEQ ID NO: 9399560 - DNA, 22 bp, Homo sapiens
catctttagttattgaatatag

SEQ ID NO: 9399561 - DNA, 21 bp, Homo sapiens
tcagttgccaaagtgatgtca

SEQ ID NO: 9399562 - DNA, 22 bp, Homo sapiens
tcagttgctaaatggtgtagtg

SEQ ID NO: 9399563 - DNA, 20 bp, Homo sapiens
tcagtttaaatcctggcttt

SEQ ID NO: 9399564 - DNA, 22 bp, Homo sapiens
tcagttctttatttcacagtga

SEQ ID NO: 9399565 - DNA, 22 bp, Homo sapiens
tcagttcttgggctgctaggac

SEQ ID NO: 9399566 - DNA, 22 bp, Homo sapiens
catgtcttatttatgcttctta

SEQ ID NO: 9399567 - DNA, 22 bp, Homo sapiens
catgtgaattccaaagctaggt

SEQ ID NO: 9399568 - DNA, 22 bp, Homo sapiens
catgtctttgttatgctcacca

SEQ ID NO: 9399569 - DNA, 19 bp, Homo sapiens
catgtgcacatgtgaatgc

SEQ ID NO: 9399570 - DNA, 22 bp, Homo sapiens
catgtgcagactctgacaggct

SEQ ID NO: 9399571 - DNA, 22 bp, Homo sapiens
catgtgagaaacagtgatgtcg

SEQ ID NO: 9399572 - DNA, 22 bp, Homo sapiens
catgtgattacactaagaaggt

SEQ ID NO: 9399573 - DNA, 22 bp, Homo sapiens
catgtgcagtgtaagacatgct

SEQ ID NO: 9399574 - DNA, 22 bp, Homo sapiens
catgtgcagtgtaagacatgct

SEQ ID NO: 9399575 - DNA, 19 bp, Homo sapiens
catgtgcatgagcacagga

SEQ ID NO: 9399576 - DNA, 22 bp, Homo sapiens
tccaggcaaagtgctgggctgc

SEQ ID NO: 9399577 - DNA, 22 bp, Homo sapiens
tccaggcaaagtgctgggctgc

SEQ ID NO: 9399578 - DNA, 22 bp, Homo sapiens
tccagcccacacctgaagctgg

SEQ ID NO: 9399579 - DNA, 22 bp, Homo sapiens
tccagccattcattatgacacc

SEQ ID NO: 9399580 - DNA, 22 bp, Homo sapiens
tccagcccacacctgaagctgg

SEQ ID NO: 9399581 - DNA, 22 bp, Homo sapiens
tccagccatatcttgtagccct

SEQ ID NO: 9399582 - DNA, 22 bp, Homo sapiens
tccagccacttgcacagttaaa

SEQ ID NO: 9399583 - DNA, 22 bp, Homo sapiens
tccagccaggatggcccaggga

SEQ ID NO: 9399584 - DNA, 22 bp, Homo sapiens
catgggagctatctccatcact

SEQ ID NO: 9399585 - DNA, 22 bp, Homo sapiens
catgtcttatatcctgtcttca

SEQ ID NO: 9399586 - DNA, 23 bp, Homo sapiens
catgtctgctttcatgctacaac

SEQ ID NO: 9399587 - DNA, 22 bp, Homo sapiens
catgtacatgcctactatcaat

SEQ ID NO: 9399588 - DNA, 22 bp, Homo sapiens
tccagcccagctcctctcagaa

SEQ ID NO: 9399589 - DNA, 22 bp, Homo sapiens
tccagcccagctcctctcagaa

SEQ ID NO: 9399590 - DNA, 22 bp, Homo sapiens
catgtacatgcctactatcaat

SEQ ID NO: 9399591 - DNA, 22 bp, Homo sapiens
catgtacatgcctactatcaat

SEQ ID NO: 9399592 - DNA, 22 bp, Homo sapiens
tccagcccagctcctctcagaa

SEQ ID NO: 9399593 - DNA, 20 bp, Homo sapiens
tccagcccagcagcctgaca

SEQ ID NO: 9399594 - DNA, 18 bp, Homo sapiens
tccagcccacattttctg

SEQ ID NO: 9399595 - DNA, 20 bp, Homo sapiens
tccagcccagcagcctgaca

SEQ ID NO: 9399596 - DNA, 22 bp, Homo sapiens
catggctttccagtcctccact

SEQ ID NO: 9399597 - DNA, 22 bp, Homo sapiens
catggctttccagtcctccact

SEQ ID NO: 9399598 - DNA, 20 bp, Homo sapiens
catggctgtgagcccacagg

SEQ ID NO: 9399599 - DNA, 20 bp, Homo sapiens
catggctgtgagcccacagg

SEQ ID NO: 9399600 - DNA, 20 bp, Homo sapiens
catggctgtgagcccacagg

SEQ ID NO: 9399601 - DNA, 22 bp, Homo sapiens
catggctggccagtgggagtgg

SEQ ID NO: 9399602 - DNA, 22 bp, Homo sapiens
catggctgggagacggctgagg

SEQ ID NO: 9399603 - DNA, 22 bp, Homo sapiens
catggctggccagtgggagtgg

SEQ ID NO: 9399604 - DNA, 22 bp, Homo sapiens
catggctggccagtgggagtgg

SEQ ID NO: 9399605 - DNA, 22 bp, Homo sapiens
catggctggcacacagcaacca

SEQ ID NO: 9399606 - DNA, 22 bp, Homo sapiens
catggctggtgcacctctggga

SEQ ID NO: 9399607 - DNA, 22 bp, Homo sapiens
catggctgggagacggctgagg

SEQ ID NO: 9399608 - DNA, 22 bp, Homo sapiens
catggctggtgcacctctggga

SEQ ID NO: 9399609 - DNA, 22 bp, Homo sapiens
catggctggtgcacctctggga

SEQ ID NO: 9399610 - DNA, 19 bp, Homo sapiens
catggctgctgcttgggag

SEQ ID NO: 9399611 - DNA, 19 bp, Homo sapiens
catggctgctgcttgggag

SEQ ID NO: 9399612 - DNA, 22 bp, Homo sapiens
catggctgctggctcggtccct

SEQ ID NO: 9399613 - DNA, 19 bp, Homo sapiens
catggctgctgcttgggag

SEQ ID NO: 9399614 - DNA, 22 bp, Homo sapiens
catggctgcattggaatgggtt

SEQ ID NO: 9399615 - DNA, 19 bp, Homo sapiens
catggctgccccatatagc

SEQ ID NO: 9399616 - DNA, 22 bp, Homo sapiens
catggctgcattggaatgggtt

SEQ ID NO: 9399617 - DNA, 23 bp, Homo sapiens
catggctgatttcaagctaccac

SEQ ID NO: 9399618 - DNA, 22 bp, Homo sapiens
catggctgcgagaagagtgggt

SEQ ID NO: 9399619 - DNA, 22 bp, Homo sapiens
catggctgcctgtggacactgc

SEQ ID NO: 9399620 - DNA, 22 bp, Homo sapiens
catggctgcgagaagagtgggt

SEQ ID NO: 9399621 - DNA, 22 bp, Homo sapiens
catggccagccctgaggttcag

SEQ ID NO: 9399622 - DNA, 22 bp, Homo sapiens
catggctgaggcagaggactga

SEQ ID NO: 9399623 - DNA, 22 bp, Homo sapiens
catggctgaggcagaggactga

SEQ ID NO: 9399624 - DNA, 22 bp, Homo sapiens
catggccagccctgaggttcag

SEQ ID NO: 9399625 - DNA, 22 bp, Homo sapiens
catggccagcccccagttcctc

SEQ ID NO: 9399626 - DNA, 22 bp, Homo sapiens
catgcacacacagttctaatta

SEQ ID NO: 9399627 - DNA, 22 bp, Homo sapiens
catgcacaagggatgatgaaat

SEQ ID NO: 9399628 - DNA, 22 bp, Homo sapiens
catgcacaacatactcaagagg

SEQ ID NO: 9399629 - DNA, 22 bp, Homo sapiens
catgcacaaaggtaagatgcgt

SEQ ID NO: 9399630 - DNA, 22 bp, Homo sapiens
catgcaaacacgtaaacattca

SEQ ID NO: 9399631 - DNA, 22 bp, Homo sapiens
catgattttgtcttgtgttaat

SEQ ID NO: 9399632 - DNA, 22 bp, Homo sapiens
catgcaaaggtcaagatcagga

SEQ ID NO: 9399633 - DNA, 22 bp, Homo sapiens
tcattttggggtttgtcatctt

SEQ ID NO: 9399634 - DNA, 22 bp, Homo sapiens
tcattttggggtttgtcatctt

SEQ ID NO: 9399635 - DNA, 18 bp, Homo sapiens
tcattttgtctgcctttg

SEQ ID NO: 9399636 - DNA, 18 bp, Homo sapiens
tcattttgtctgcctttg

SEQ ID NO: 9399637 - DNA, 22 bp, Homo sapiens
tcattttgtgccttatgaccgc

SEQ ID NO: 9399638 - DNA, 22 bp, Homo sapiens
tcattttgtgccttatgaccgc

SEQ ID NO: 9399639 - DNA, 16 bp, Homo sapiens
tcattttgagtgacag

SEQ ID NO: 9399640 - DNA, 22 bp, Homo sapiens
tcattttgcagagctgaggaac

SEQ ID NO: 9399641 - DNA, 22 bp, Homo sapiens
tcattttgcctgccatttgagt

SEQ ID NO: 9399642 - DNA, 22 bp, Homo sapiens
tcattttggccatgatacagac

SEQ ID NO: 9399643 - DNA, 22 bp, Homo sapiens
tcattttgcctgccatttgagt

SEQ ID NO: 9399644 - DNA, 22 bp, Homo sapiens
tcattttcacacataaatagca

SEQ ID NO: 9399645 - DNA, 22 bp, Homo sapiens
tcattttcaagtttgaacagga

SEQ ID NO: 9399646 - DNA, 22 bp, Homo sapiens
tcattttcaagtttgaacagga

SEQ ID NO: 9399647 - DNA, 22 bp, Homo sapiens
tatgtttttaagagaatgcatt

SEQ ID NO: 9399648 - DNA, 22 bp, Homo sapiens
tatgtttttaagagaatgcatt

SEQ ID NO: 9399649 - DNA, 22 bp, Homo sapiens
tatgtttgttatcacaactagg

SEQ ID NO: 9399650 - DNA, 22 bp, Homo sapiens
tatgtgtccctgctactcaaca

SEQ ID NO: 9399651 - DNA, 22 bp, Homo sapiens
tatgtgtcaaaccattcatctg

SEQ ID NO: 9399652 - DNA, 22 bp, Homo sapiens
tatgtgtccctgctactcaaca

SEQ ID NO: 9399653 - DNA, 22 bp, Homo sapiens
tatgtgtcccttggtgtagcaa

SEQ ID NO: 9399654 - DNA, 22 bp, Homo sapiens
tatgtgtcctaagcaatcatcc

SEQ ID NO: 9399655 - DNA, 22 bp, Homo sapiens
tatgtgtcaaaccattcatctg

SEQ ID NO: 9399656 - DNA, 22 bp, Homo sapiens
tatgtgtatttagttctataca

SEQ ID NO: 9399657 - DNA, 22 bp, Homo sapiens
tatgtgtattgagcattgttac

SEQ ID NO: 9399658 - DNA, 22 bp, Homo sapiens
tatgtgtatgtacatacataca

SEQ ID NO: 9399659 - DNA, 19 bp, Homo sapiens
tatgtgtatatgtatctgt

SEQ ID NO: 9399660 - DNA, 19 bp, Homo sapiens
tatgtgtatatgtatctgt

SEQ ID NO: 9399661 - DNA, 22 bp, Homo sapiens
tatgtgtatgtacatacataca

SEQ ID NO: 9399662 - DNA, 22 bp, Homo sapiens
tatgtgtatgtacatacataca

SEQ ID NO: 9399663 - DNA, 22 bp, Homo sapiens
tatgtgtatgttcattcatgca

SEQ ID NO: 9399664 - DNA, 22 bp, Homo sapiens
tatgtgtatgttcattcatgca

SEQ ID NO: 9399665 - DNA, 19 bp, Homo sapiens
tatgtgcatgtgtgcatat

SEQ ID NO: 9399666 - DNA, 22 bp, Homo sapiens
tatgtgcattatctagttcatt

SEQ ID NO: 9399667 - DNA, 22 bp, Homo sapiens
tatgtgtactcgttaaatattt

SEQ ID NO: 9399668 - DNA, 22 bp, Homo sapiens
tatgtgtatacctatacatgtg

SEQ ID NO: 9399669 - DNA, 22 bp, Homo sapiens
tatgtgtatatctgtatgtgca

SEQ ID NO: 9399670 - DNA, 22 bp, Homo sapiens
tatgtgtatacctatacatgtg

SEQ ID NO: 9399671 - DNA, 22 bp, Homo sapiens
tatgtgtaagctgtttatcttt

SEQ ID NO: 9399672 - DNA, 22 bp, Homo sapiens
tatgtgtaaccttgtgatttat

SEQ ID NO: 9399673 - DNA, 22 bp, Homo sapiens
tatgtggccttttatgtctgac

SEQ ID NO: 9399674 - DNA, 22 bp, Homo sapiens
tatgtgtaatcatatctgatac

SEQ ID NO: 9399675 - DNA, 22 bp, Homo sapiens
tatgtgtaatcaaacacatgct

SEQ ID NO: 9399676 - DNA, 22 bp, Homo sapiens
tatgtgtaatcaaacacatgct

SEQ ID NO: 9399677 - DNA, 22 bp, Homo sapiens
tattgctgaggattgaggcttg

SEQ ID NO: 9399678 - DNA, 22 bp, Homo sapiens
tattgctggaaaatggtgtgat

SEQ ID NO: 9399679 - DNA, 22 bp, Homo sapiens
tattgctcctacagtcaatttc

SEQ ID NO: 9399680 - DNA, 22 bp, Homo sapiens
tattgcgaatgtggtgataaat

SEQ ID NO: 9399681 - DNA, 22 bp, Homo sapiens
tattggaaggaagcaagagagg

SEQ ID NO: 9399682 - DNA, 22 bp, Homo sapiens
tattgctttcagttgctttgag

SEQ ID NO: 9399683 - DNA, 22 bp, Homo sapiens
tattcctcctttctgctcagcc

SEQ ID NO: 9399684 - DNA, 22 bp, Homo sapiens
tattaaatatatctgttagttg

SEQ ID NO: 9399685 - DNA, 22 bp, Homo sapiens
tattaaatatatctgttagttg

SEQ ID NO: 9399686 - DNA, 22 bp, Homo sapiens
tattaaatatatctgttagttg

SEQ ID NO: 9399687 - DNA, 22 bp, Homo sapiens
tatgtttttcaagtgcacacta

SEQ ID NO: 9399688 - DNA, 22 bp, Homo sapiens
tattaaagggaagttatgcatg

SEQ ID NO: 9399689 - DNA, 22 bp, Homo sapiens
tatctgacaaaccctgtgccca

SEQ ID NO: 9399690 - DNA, 22 bp, Homo sapiens
tatctcattttattgcaaatgt

SEQ ID NO: 9399691 - DNA, 22 bp, Homo sapiens
tatctctgtaaaagaaatcaca

SEQ ID NO: 9399692 - DNA, 22 bp, Homo sapiens
tatctctagcgcacagaagaaa

SEQ ID NO: 9399693 - DNA, 22 bp, Homo sapiens
tatctctaggctgccacttaaa

SEQ ID NO: 9399694 - DNA, 22 bp, Homo sapiens
tatggcaattgtctaagtttta

SEQ ID NO: 9399695 - DNA, 22 bp, Homo sapiens
tatggcagaggagaggcactag

SEQ ID NO: 9399696 - DNA, 22 bp, Homo sapiens
tatggcagttacccttgatgat

SEQ ID NO: 9399697 - DNA, 19 bp, Homo sapiens
tatggcaggccgaggcact

SEQ ID NO: 9399698 - DNA, 22 bp, Homo sapiens
tatggcaatatgtatcaagatc

SEQ ID NO: 9399699 - DNA, 22 bp, Homo sapiens
tatggcaagagaatcaactgaa

SEQ ID NO: 9399700 - DNA, 22 bp, Homo sapiens
tatggcaaaactctttatccaa

SEQ ID NO: 9399701 - DNA, 22 bp, Homo sapiens
tatggcaagatgacatgttctc

SEQ ID NO: 9399702 - DNA, 22 bp, Homo sapiens
tatggagattcaaaagcatctt

SEQ ID NO: 9399703 - DNA, 22 bp, Homo sapiens
tatggataggtttcaagaatgc

SEQ ID NO: 9399704 - DNA, 22 bp, Homo sapiens
tatctggttcctttgaggagat

SEQ ID NO: 9399705 - DNA, 22 bp, Homo sapiens
tatgcacacatgtatgcatgtg

SEQ ID NO: 9399706 - DNA, 22 bp, Homo sapiens
caggtctgtttccatcagtgct

SEQ ID NO: 9399707 - DNA, 22 bp, Homo sapiens
caggtctgtttccatcagtgct

SEQ ID NO: 9399708 - DNA, 22 bp, Homo sapiens
caggtctgtttccatcagtgct

SEQ ID NO: 9399709 - DNA, 18 bp, Homo sapiens
caggtctgtctgcctccc

SEQ ID NO: 9399710 - DNA, 22 bp, Homo sapiens
caggtctgtattaacagagggt

SEQ ID NO: 9399711 - DNA, 22 bp, Homo sapiens
caggtctgtattaacagagggt

SEQ ID NO: 9399712 - DNA, 22 bp, Homo sapiens
caggtctgtattaacagagggt

SEQ ID NO: 9399713 - DNA, 22 bp, Homo sapiens
caggtctgttttcaaggtcagt

SEQ ID NO: 9399714 - DNA, 22 bp, Homo sapiens
tatgtacatgttaaagggcaaa

SEQ ID NO: 9399715 - DNA, 22 bp, Homo sapiens
tatggctactacgaataatgct

SEQ ID NO: 9399716 - DNA, 22 bp, Homo sapiens
tatggctaattctttactgacc

SEQ ID NO: 9399717 - DNA, 22 bp, Homo sapiens
tatggcatttagaaatgtcaga

SEQ ID NO: 9399718 - DNA, 22 bp, Homo sapiens
tatggctgtggtgatctcattt

SEQ ID NO: 9399719 - DNA, 17 bp, Homo sapiens
tatggctgtgtttgtgc

SEQ ID NO: 9399720 - DNA, 22 bp, Homo sapiens
tatggctgttacagctgggaga

SEQ ID NO: 9399721 - DNA, 15 bp, Homo sapiens
tatggctgtaaagct

SEQ ID NO: 9399722 - DNA, 22 bp, Homo sapiens
tatggctgtattctatgttact

SEQ ID NO: 9399723 - DNA, 22 bp, Homo sapiens
tatggctgaggcctccgtggcc

SEQ ID NO: 9399724 - DNA, 22 bp, Homo sapiens
tatggctggaatactgaaaggc

SEQ ID NO: 9399725 - DNA, 22 bp, Homo sapiens
tatggctgctgttttgctacaa

SEQ ID NO: 9399726 - DNA, 22 bp, Homo sapiens
caggtctggtgagagaacagtt

SEQ ID NO: 9399727 - DNA, 21 bp, Homo sapiens
caggtctggtgaacactctca

SEQ ID NO: 9399728 - DNA, 21 bp, Homo sapiens
caggtctggtgaacactctca

SEQ ID NO: 9399729 - DNA, 22 bp, Homo sapiens
caggggcaggtgtgagatcatc

SEQ ID NO: 9399730 - DNA, 22 bp, Homo sapiens
caggggccaagggtccagacct

SEQ ID NO: 9399731 - DNA, 22 bp, Homo sapiens
caggggccggctgtccgtgccc

SEQ ID NO: 9399732 - DNA, 22 bp, Homo sapiens
caggggcctggctgtctaggaa

SEQ ID NO: 9399733 - DNA, 22 bp, Homo sapiens
caggggccaggctgtctgctgt

SEQ ID NO: 9399734 - DNA, 22 bp, Homo sapiens
caggggccaggctgtctgctgt

SEQ ID NO: 9399735 - DNA, 22 bp, Homo sapiens
cagggtcttggcgccatcaccc

SEQ ID NO: 9399736 - DNA, 22 bp, Homo sapiens
cagggtcttataaggccaattt

SEQ ID NO: 9399737 - DNA, 22 bp, Homo sapiens
cagggtctgctacacttggcaa

SEQ ID NO: 9399738 - DNA, 22 bp, Homo sapiens
caggggcctggctgtctaggaa

SEQ ID NO: 9399739 - DNA, 22 bp, Homo sapiens
cagggtggaagctgtagagtgg

SEQ ID NO: 9399740 - DNA, 22 bp, Homo sapiens
cagggtggaacaggcaatactt

SEQ ID NO: 9399741 - DNA, 22 bp, Homo sapiens
cagggtggaaaagctagttgga

SEQ ID NO: 9399742 - DNA, 22 bp, Homo sapiens
tagttttagtcccattttacag

SEQ ID NO: 9399743 - DNA, 22 bp, Homo sapiens
tacatgtgttctgtttcaagtt

SEQ ID NO: 9399744 - DNA, 22 bp, Homo sapiens
tacatgttatttcactattggt

SEQ ID NO: 9399745 - DNA, 17 bp, Homo sapiens
tacatgtgtatctgatt

SEQ ID NO: 9399746 - DNA, 22 bp, Homo sapiens
tacatgtgttctgtttcaagtt

SEQ ID NO: 9399747 - DNA, 22 bp, Homo sapiens
tacatgtggtagggagggcagt

SEQ ID NO: 9399748 - DNA, 22 bp, Homo sapiens
tacatgtgggttaaaaacactc

SEQ ID NO: 9399749 - DNA, 22 bp, Homo sapiens
tacatgtggccagaaatttgag

SEQ ID NO: 9399750 - DNA, 17 bp, Homo sapiens
tacatgtgtatctgatt

SEQ ID NO: 9399751 - DNA, 22 bp, Homo sapiens
tataagaaacaaggcaaatttt

SEQ ID NO: 9399752 - DNA, 22 bp, Homo sapiens
tataatattccttgttgtaggt

SEQ ID NO: 9399753 - DNA, 22 bp, Homo sapiens
tataatattccttgttgtaggt

SEQ ID NO: 9399754 - DNA, 22 bp, Homo sapiens
tataatccattcattgatttct

SEQ ID NO: 9399755 - DNA, 22 bp, Homo sapiens
tataatctggttttattaagag

SEQ ID NO: 9399756 - DNA, 22 bp, Homo sapiens
tataagtgacagattatccaaa

SEQ ID NO: 9399757 - DNA, 22 bp, Homo sapiens
tataagtggagattagggaaca

SEQ ID NO: 9399758 - DNA, 22 bp, Homo sapiens
tataagtagttgttgaagactt

SEQ ID NO: 9399759 - DNA, 22 bp, Homo sapiens
tataagtctggcatatgtatgc

SEQ ID NO: 9399760 - DNA, 22 bp, Homo sapiens
tataagcacatccttgactgat

SEQ ID NO: 9399761 - DNA, 22 bp, Homo sapiens
caggtccagaaaccaaaggatt

SEQ ID NO: 9399762 - DNA, 22 bp, Homo sapiens
caggtctccagctcagggtcca

SEQ ID NO: 9399763 - DNA, 22 bp, Homo sapiens
caggtctccagctcagggtcca

SEQ ID NO: 9399764 - DNA, 22 bp, Homo sapiens
caggtctcccatcccctctgtt

SEQ ID NO: 9399765 - DNA, 22 bp, Homo sapiens
caggtctcgggttcagcagtga

SEQ ID NO: 9399766 - DNA, 22 bp, Homo sapiens
caggtctcccatcccctctgtt

SEQ ID NO: 9399767 - DNA, 22 bp, Homo sapiens
caggtccaccatgcctcaagcc

SEQ ID NO: 9399768 - DNA, 22 bp, Homo sapiens
caggtccacggcgcccaggggt

SEQ ID NO: 9399769 - DNA, 22 bp, Homo sapiens
caggtccagaaaccaaaggatt

SEQ ID NO: 9399770 - DNA, 22 bp, Homo sapiens
caggtctcgggttcagcagtga

SEQ ID NO: 9399771 - DNA, 22 bp, Homo sapiens
caggtctcgggttcagcagtga

SEQ ID NO: 9399772 - DNA, 22 bp, Homo sapiens
caggtctctcccaagctacaat

SEQ ID NO: 9399773 - DNA, 22 bp, Homo sapiens
caggtctcttttgtcacaccac

SEQ ID NO: 9399774 - DNA, 22 bp, Homo sapiens
caggtctcttttgtcacaccac

SEQ ID NO: 9399775 - DNA, 22 bp, Homo sapiens
caggtctctgcagcccctctgt

SEQ ID NO: 9399776 - DNA, 22 bp, Homo sapiens
caggtctgaagagtcacatgcc

SEQ ID NO: 9399777 - DNA, 22 bp, Homo sapiens
caggtctgaagagtcacatgcc

SEQ ID NO: 9399778 - DNA, 22 bp, Homo sapiens
caggtctcttttgtcacaccac

SEQ ID NO: 9399779 - DNA, 22 bp, Homo sapiens
caggtctgaagagtcacatgcc

SEQ ID NO: 9399780 - DNA, 17 bp, Homo sapiens
caggtctgaggccaggc

SEQ ID NO: 9399781 - DNA, 17 bp, Homo sapiens
caggtctgaggccaggc

SEQ ID NO: 9399782 - DNA, 22 bp, Homo sapiens
caggtctgaagagtcacatgcc

SEQ ID NO: 9399783 - DNA, 17 bp, Homo sapiens
caggtctgaggccaggc

SEQ ID NO: 9399784 - DNA, 22 bp, Homo sapiens
caggtctgcaggctggagtcca

SEQ ID NO: 9399785 - DNA, 22 bp, Homo sapiens
caggtctggcatcagctgtgtg

SEQ ID NO: 9399786 - DNA, 22 bp, Homo sapiens
caggtctgcagacagggccatg

SEQ ID NO: 9399787 - DNA, 22 bp, Homo sapiens
caggtctggcatcagctgtgtg

SEQ ID NO: 9399788 - DNA, 22 bp, Homo sapiens
caggtctggcatcagctgtgtg

SEQ ID NO: 9399789 - DNA, 22 bp, Homo sapiens
caggtctggcatcagctgtgtg

SEQ ID NO: 9399790 - DNA, 22 bp, Homo sapiens
tatctataatgttttacttcct

SEQ ID NO: 9399791 - DNA, 22 bp, Homo sapiens
tatctatgtgctctgacctctc

SEQ ID NO: 9399792 - DNA, 22 bp, Homo sapiens
tatctatgtgctctgacctctc

SEQ ID NO: 9399793 - DNA, 22 bp, Homo sapiens
tatctatgtggtgatcttattt

SEQ ID NO: 9399794 - DNA, 22 bp, Homo sapiens
cagggtggcacatcacagcatt

SEQ ID NO: 9399795 - DNA, 22 bp, Homo sapiens
cagggtggcacatcacagcatt

SEQ ID NO: 9399796 - DNA, 22 bp, Homo sapiens
cagggtggaatggaatgctggc

SEQ ID NO: 9399797 - DNA, 22 bp, Homo sapiens
cagggtggcacatcacagcatt

SEQ ID NO: 9399798 - DNA, 22 bp, Homo sapiens
cagggtggcactcagcgcatct

SEQ ID NO: 9399799 - DNA, 22 bp, Homo sapiens
cagggtggcactcagcgcatct

SEQ ID NO: 9399800 - DNA, 22 bp, Homo sapiens
cagggtggcactcagcgcatct

SEQ ID NO: 9399801 - DNA, 22 bp, Homo sapiens
tatacagatggaaagatacaca

SEQ ID NO: 9399802 - DNA, 22 bp, Homo sapiens
tatacagatggaaagatacaca

SEQ ID NO: 9399803 - DNA, 22 bp, Homo sapiens
tatacagatatctaagatgtaa

SEQ ID NO: 9399804 - DNA, 22 bp, Homo sapiens
tatacagatggaaagatacaca

SEQ ID NO: 9399805 - DNA, 23 bp, Homo sapiens
tatacagtctccaggcagtcctt

SEQ ID NO: 9399806 - DNA, 22 bp, Homo sapiens
tatacagtatcttttgaaggca

SEQ ID NO: 9399807 - DNA, 22 bp, Homo sapiens
tatacagatggaaagatacaca

SEQ ID NO: 9399808 - DNA, 22 bp, Homo sapiens
tatacagattaacagatttaaa

SEQ ID NO: 9399809 - DNA, 22 bp, Homo sapiens
tatacagattaacagatttaaa

SEQ ID NO: 9399810 - DNA, 22 bp, Homo sapiens
cagtctacctttcagacattga

SEQ ID NO: 9399811 - DNA, 22 bp, Homo sapiens
cagtctcaccctggaggcccca

SEQ ID NO: 9399812 - DNA, 20 bp, Homo sapiens
cagtgaggaggtgctggggg

SEQ ID NO: 9399813 - DNA, 20 bp, Homo sapiens
cagtgaggaggtgctggggg

SEQ ID NO: 9399814 - DNA, 20 bp, Homo sapiens
cagtgaggaggtgctggggg

SEQ ID NO: 9399815 - DNA, 22 bp, Homo sapiens
cagtctccaaatcagtctgaat

SEQ ID NO: 9399816 - DNA, 22 bp, Homo sapiens
cagtctccaaatcagtctgaat

SEQ ID NO: 9399817 - DNA, 22 bp, Homo sapiens
cagtctccgccagctcctcaca

SEQ ID NO: 9399818 - DNA, 22 bp, Homo sapiens
cagtgagggcccccttccaggt

SEQ ID NO: 9399819 - DNA, 22 bp, Homo sapiens
cagtgaggtggatggatggcct

SEQ ID NO: 9399820 - DNA, 22 bp, Homo sapiens
cagtgagtgtgggaagtctctg

SEQ ID NO: 9399821 - DNA, 22 bp, Homo sapiens
cagtgagttgtgctgaggacca

SEQ ID NO: 9399822 - DNA, 17 bp, Homo sapiens
cagtgatcattacatta

SEQ ID NO: 9399823 - DNA, 22 bp, Homo sapiens
cagtgagtaagtagacagctta

SEQ ID NO: 9399824 - DNA, 22 bp, Homo sapiens
cagtgagtaagtagacagctta

SEQ ID NO: 9399825 - DNA, 22 bp, Homo sapiens
cagtgaggtggatggatggcct

SEQ ID NO: 9399826 - DNA, 22 bp, Homo sapiens
cagtgcagacgtggagggggca

SEQ ID NO: 9399827 - DNA, 22 bp, Homo sapiens
cagtgcagaggccagggaggat

SEQ ID NO: 9399828 - DNA, 17 bp, Homo sapiens
cagtgcagagccctttc

SEQ ID NO: 9399829 - DNA, 22 bp, Homo sapiens
cagtgcagacgtggagggggca

SEQ ID NO: 9399830 - DNA, 22 bp, Homo sapiens
cagtgcagacgtggagggggca

SEQ ID NO: 9399831 - DNA, 22 bp, Homo sapiens
cagtgcagaacacatggaaaat

SEQ ID NO: 9399832 - DNA, 22 bp, Homo sapiens
cagtgcacgggccagtcctgcc

SEQ ID NO: 9399833 - DNA, 22 bp, Homo sapiens
cagtgcaattacaagctaattc

SEQ ID NO: 9399834 - DNA, 22 bp, Homo sapiens
cagtgcaacttttgcctcccgg

SEQ ID NO: 9399835 - DNA, 20 bp, Homo sapiens
cagtgcaactgaagaactga

SEQ ID NO: 9399836 - DNA, 22 bp, Homo sapiens
cagtgcaacagattcgagaagc

SEQ ID NO: 9399837 - DNA, 22 bp, Homo sapiens
cagtgcaaactccctgaggtgg

SEQ ID NO: 9399838 - DNA, 22 bp, Homo sapiens
cagtgatttttacagtaaggaa

SEQ ID NO: 9399839 - DNA, 22 bp, Homo sapiens
cagtgattcagactcatcattt

SEQ ID NO: 9399840 - DNA, 22 bp, Homo sapiens
cagtgattcaggtctccagttt

SEQ ID NO: 9399841 - DNA, 22 bp, Homo sapiens
cagtgattgtactgttgtgcct

SEQ ID NO: 9399842 - DNA, 22 bp, Homo sapiens
cagtgatttcagaatggattat

SEQ ID NO: 9399843 - DNA, 22 bp, Homo sapiens
cagtgattcaggtgcctgttgg

SEQ ID NO: 9399844 - DNA, 22 bp, Homo sapiens
cagtgattttctcagaacttga

SEQ ID NO: 9399845 - DNA, 22 bp, Homo sapiens
cagtgattttggtctgccttag

SEQ ID NO: 9399846 - DNA, 22 bp, Homo sapiens
cagtgattttaaactatggatg

SEQ ID NO: 9399847 - DNA, 22 bp, Homo sapiens
cagtgattttaaactatggatg

SEQ ID NO: 9399848 - DNA, 22 bp, Homo sapiens
cagtgatggatatggagaagtc

SEQ ID NO: 9399849 - DNA, 22 bp, Homo sapiens
cagtgatgtttctgcatcagag

SEQ ID NO: 9399850 - DNA, 22 bp, Homo sapiens
cagtgattaagatacccaggct

SEQ ID NO: 9399851 - DNA, 19 bp, Homo sapiens
cagtgattaattcatctta

SEQ ID NO: 9399852 - DNA, 22 bp, Homo sapiens
cagtgattaaaacatgacagcc

SEQ ID NO: 9399853 - DNA, 22 bp, Homo sapiens
cagtgattattgattgcattca

SEQ ID NO: 9399854 - DNA, 22 bp, Homo sapiens
cagtgattactgtgcttttggt

SEQ ID NO: 9399855 - DNA, 22 bp, Homo sapiens
cagtgattcacgcccttgggcc

SEQ ID NO: 9399856 - DNA, 22 bp, Homo sapiens
cagtcctgggtgcagcaggaaa

SEQ ID NO: 9399857 - DNA, 22 bp, Homo sapiens
cagtcctctctgtgtctgcacc

SEQ ID NO: 9399858 - DNA, 22 bp, Homo sapiens
cagtcctgggcacagccctggg

SEQ ID NO: 9399859 - DNA, 22 bp, Homo sapiens
cagtcctctcactcaggccttt

SEQ ID NO: 9399860 - DNA, 22 bp, Homo sapiens
cagtcctctcactcaggccttt

SEQ ID NO: 9399861 - DNA, 22 bp, Homo sapiens
cagtcctctcactcaggccttt

SEQ ID NO: 9399862 - DNA, 22 bp, Homo sapiens
cagtcctgggcaggtcaggcca

SEQ ID NO: 9399863 - DNA, 22 bp, Homo sapiens
cagtcctgtgtcccttggtggg

SEQ ID NO: 9399864 - DNA, 22 bp, Homo sapiens
tatttagttatctttcataaaa

SEQ ID NO: 9399865 - DNA, 22 bp, Homo sapiens
tatttagatgcatttggattgc

SEQ ID NO: 9399866 - DNA, 22 bp, Homo sapiens
tatttagaatgcgtgtacgtgt

SEQ ID NO: 9399867 - DNA, 22 bp, Homo sapiens
tatttactgtatttgaagttga

SEQ ID NO: 9399868 - DNA, 22 bp, Homo sapiens
tatttactgtatttgaagttga

SEQ ID NO: 9399869 - DNA, 22 bp, Homo sapiens
tatttacctagagccctctatc

SEQ ID NO: 9399870 - DNA, 22 bp, Homo sapiens
tatttaccctggcagctgtagc

SEQ ID NO: 9399871 - DNA, 22 bp, Homo sapiens
tatttacttttaaattgagaac

SEQ ID NO: 9399872 - DNA, 19 bp, Homo sapiens
tatttacttcttgattgca

SEQ ID NO: 9399873 - DNA, 20 bp, Homo sapiens
tatttacaacttagagcctc

SEQ ID NO: 9399874 - DNA, 20 bp, Homo sapiens
tatttacaacttagagcctc

SEQ ID NO: 9399875 - DNA, 20 bp, Homo sapiens
tatttacaacttagagcctc

SEQ ID NO: 9399876 - DNA, 20 bp, Homo sapiens
tatttacaacttagagcctc

SEQ ID NO: 9399877 - DNA, 20 bp, Homo sapiens
tatttacaacttagagcctc

SEQ ID NO: 9399878 - DNA, 20 bp, Homo sapiens
tatttacaacttagagcctc

SEQ ID NO: 9399879 - DNA, 22 bp, Homo sapiens
tattggagttggtaagaagtca

SEQ ID NO: 9399880 - DNA, 22 bp, Homo sapiens
tattggagtactgcgagctgcc

SEQ ID NO: 9399881 - DNA, 22 bp, Homo sapiens
tattggaggaaaccaagaagaa

SEQ ID NO: 9399882 - DNA, 22 bp, Homo sapiens
tattggagaggtcttgggtaga

SEQ ID NO: 9399883 - DNA, 22 bp, Homo sapiens
tcaccagggagcttgtcctctg

SEQ ID NO: 9399884 - DNA, 22 bp, Homo sapiens
tcaccatcaggataaaatctca

SEQ ID NO: 9399885 - DNA, 22 bp, Homo sapiens
tcaccatacataaattacattg

SEQ ID NO: 9399886 - DNA, 22 bp, Homo sapiens
tcaccataggaacacagtcaga

SEQ ID NO: 9399887 - DNA, 22 bp, Homo sapiens
cagtgctgttgtaagctcattg

SEQ ID NO: 9399888 - DNA, 22 bp, Homo sapiens
cagtgctgttgtaagctcattg

SEQ ID NO: 9399889 - DNA, 22 bp, Homo sapiens
tcacattgaatggaagaataga

SEQ ID NO: 9399890 - DNA, 22 bp, Homo sapiens
tcacattgaatggaagaataga

SEQ ID NO: 9399891 - DNA, 22 bp, Homo sapiens
tcaccaggctggaatgcagtgg

SEQ ID NO: 9399892 - DNA, 22 bp, Homo sapiens
tcaccaggctcctgttaagatg

SEQ ID NO: 9399893 - DNA, 22 bp, Homo sapiens
tcaccaggctggagtgcagtgg

SEQ ID NO: 9399894 - DNA, 22 bp, Homo sapiens
cagtgctgtgtttgctgcctgg

SEQ ID NO: 9399895 - DNA, 18 bp, Homo sapiens
cagtgctgttaacagtga

SEQ ID NO: 9399896 - DNA, 22 bp, Homo sapiens
cagtgctgttgggcccagagag

SEQ ID NO: 9399897 - DNA, 22 bp, Homo sapiens
cagtgctgttgggcccagagag

SEQ ID NO: 9399898 - DNA, 19 bp, Homo sapiens
cagtgctgttcattcagtg

SEQ ID NO: 9399899 - DNA, 23 bp, Homo sapiens
cagtgctggttctgcctgtgggg

SEQ ID NO: 9399900 - DNA, 22 bp, Homo sapiens
cagtgctgtgctggaagctgtt

SEQ ID NO: 9399901 - DNA, 22 bp, Homo sapiens
cagtgctggtgtaggctgacca

SEQ ID NO: 9399902 - DNA, 23 bp, Homo sapiens
cagtgctggttctgcctgtgggg

SEQ ID NO: 9399903 - DNA, 23 bp, Homo sapiens
cagtgctggttctgcctgtgggg

SEQ ID NO: 9399904 - DNA, 22 bp, Homo sapiens
cagtgctgtgctggaagctgtt

SEQ ID NO: 9399905 - DNA, 22 bp, Homo sapiens
cagtgctgtgctggaagctgtt

SEQ ID NO: 9399906 - DNA, 22 bp, Homo sapiens
cagtgctgtgtttgctgcctgg

SEQ ID NO: 9399907 - DNA, 22 bp, Homo sapiens
cagtgcagaggccagggaggat

SEQ ID NO: 9399908 - DNA, 22 bp, Homo sapiens
cagtgcagaggccagggaggat

SEQ ID NO: 9399909 - DNA, 22 bp, Homo sapiens
cagtgcccaagatgtgccatgc

SEQ ID NO: 9399910 - DNA, 19 bp, Homo sapiens
cagtgcccgacgcaggtct

SEQ ID NO: 9399911 - DNA, 22 bp, Homo sapiens
cagtgctcctgatgtacccttg

SEQ ID NO: 9399912 - DNA, 22 bp, Homo sapiens
cagtgctgagagcctggccagg

SEQ ID NO: 9399913 - DNA, 22 bp, Homo sapiens
cagtgctgcaggcgcctgcggt

SEQ ID NO: 9399914 - DNA, 22 bp, Homo sapiens
cagtgctgagagcctggccagg

SEQ ID NO: 9399915 - DNA, 22 bp, Homo sapiens
cagtgctgagagcctggccagg

SEQ ID NO: 9399916 - DNA, 22 bp, Homo sapiens
cagtgctgcatctccatgccag

SEQ ID NO: 9399917 - DNA, 22 bp, Homo sapiens
cagtgctgcaggcgcctgcggt

SEQ ID NO: 9399918 - DNA, 21 bp, Homo sapiens
cagtgctgcctaatagggagt

SEQ ID NO: 9399919 - DNA, 22 bp, Homo sapiens
cagtgctggaggctggagggaa

SEQ ID NO: 9399920 - DNA, 22 bp, Homo sapiens
cagtgctggaggggtgcttgca

SEQ ID NO: 9399921 - DNA, 22 bp, Homo sapiens
cagtgctggaggggtgcttgca

SEQ ID NO: 9399922 - DNA, 22 bp, Homo sapiens
cagtgctggaggggtgcttgca

SEQ ID NO: 9399923 - DNA, 22 bp, Homo sapiens
cagtgctggtgtaggctgacca

SEQ ID NO: 9399924 - DNA, 22 bp, Homo sapiens
tcactcaatggtatcaggaggt

SEQ ID NO: 9399925 - DNA, 22 bp, Homo sapiens
tcactcaagcatctacagggat

SEQ ID NO: 9399926 - DNA, 22 bp, Homo sapiens
tcactcaatatcccagtggggc

SEQ ID NO: 9399927 - DNA, 22 bp, Homo sapiens
tcacccagactgtctgactctt

SEQ ID NO: 9399928 - DNA, 22 bp, Homo sapiens
tcagaaagtgaactgttgacat

SEQ ID NO: 9399929 - DNA, 22 bp, Homo sapiens
tcagaaaggttgagtcatgtgc

SEQ ID NO: 9399930 - DNA, 22 bp, Homo sapiens
tcacttcccagacggggtggca

SEQ ID NO: 9399931 - DNA, 22 bp, Homo sapiens
tcactccatctttgctactggt

SEQ ID NO: 9399932 - DNA, 22 bp, Homo sapiens
tcactccatctttgctactggt

SEQ ID NO: 9399933 - DNA, 22 bp, Homo sapiens
tcactcctcaggctagcatcat

SEQ ID NO: 9399934 - DNA, 22 bp, Homo sapiens
tcactcaggttcatgtctttgt

SEQ ID NO: 9399935 - DNA, 18 bp, Homo sapiens
tcactcatagacatctat

SEQ ID NO: 9399936 - DNA, 22 bp, Homo sapiens
tcactccatagcttaactcttt

SEQ ID NO: 9399937 - DNA, 22 bp, Homo sapiens
tcactcatattatctctccaca

SEQ ID NO: 9399938 - DNA, 22 bp, Homo sapiens
tcactccatagcttaactcttt

SEQ ID NO: 9399939 - DNA, 22 bp, Homo sapiens
tcagaagctgggtctcagaagc

SEQ ID NO: 9399940 - DNA, 22 bp, Homo sapiens
tcagaagctggtgtcctttgaa

SEQ ID NO: 9399941 - DNA, 19 bp, Homo sapiens
tcagaaggcaggagaggcc

SEQ ID NO: 9399942 - DNA, 22 bp, Homo sapiens
tcagaaggaagttagagtatgg

SEQ ID NO: 9399943 - DNA, 23 bp, Homo sapiens
tcagaacaatgccttaggggcat

SEQ ID NO: 9399944 - DNA, 23 bp, Homo sapiens
tcagaacaatgccttaggggcat

SEQ ID NO: 9399945 - DNA, 21 bp, Homo sapiens
tcagaacaattccatgcctcc

SEQ ID NO: 9399946 - DNA, 22 bp, Homo sapiens
tcagaagctaaatttgatattt

SEQ ID NO: 9399947 - DNA, 22 bp, Homo sapiens
tcagaaataatgaatgatgggg

SEQ ID NO: 9399948 - DNA, 22 bp, Homo sapiens
tcagaaatgatcgttattcatt

SEQ ID NO: 9399949 - DNA, 22 bp, Homo sapiens
tctttacacaagacaagaataa

SEQ ID NO: 9399950 - DNA, 23 bp, Homo sapiens
tctttacagcagcaggatttgga

SEQ ID NO: 9399951 - DNA, 22 bp, Homo sapiens
tctttacatcacaattgtatgg

SEQ ID NO: 9399952 - DNA, 22 bp, Homo sapiens
tctttacatagtgtggactact

SEQ ID NO: 9399953 - DNA, 23 bp, Homo sapiens
tctttacatactgatgagttctc

SEQ ID NO: 9399954 - DNA, 23 bp, Homo sapiens
tctttacatactgatgagttctc

SEQ ID NO: 9399955 - DNA, 22 bp, Homo sapiens
tctttagaaacttttcttcatg

SEQ ID NO: 9399956 - DNA, 23 bp, Homo sapiens
tctttagaagaacatcagaaatg

SEQ ID NO: 9399957 - DNA, 22 bp, Homo sapiens
tctttacatcacaattgtatgg

SEQ ID NO: 9399958 - DNA, 22 bp, Homo sapiens
tctttacatcacaattgtatgg

SEQ ID NO: 9399959 - DNA, 22 bp, Homo sapiens
tctttactggaatggaactttc

SEQ ID NO: 9399960 - DNA, 22 bp, Homo sapiens
tctttacaagtcacattttctg

SEQ ID NO: 9399961 - DNA, 21 bp, Homo sapiens
tcttggggaggagggctgcac

SEQ ID NO: 9399962 - DNA, 22 bp, Homo sapiens
tcttgggcctcaccccagacat

SEQ ID NO: 9399963 - DNA, 22 bp, Homo sapiens
tcttgggctagaatagcaggag

SEQ ID NO: 9399964 - DNA, 22 bp, Homo sapiens
tcttgggcatgtgtttgatttc

SEQ ID NO: 9399965 - DNA, 22 bp, Homo sapiens
tcttgggcatgtgtttgatttc

SEQ ID NO: 9399966 - DNA, 22 bp, Homo sapiens
tcttgggatagtgtctcatggc

SEQ ID NO: 9399967 - DNA, 22 bp, Homo sapiens
tcttgggatcacctcctggctt

SEQ ID NO: 9399968 - DNA, 22 bp, Homo sapiens
tcttgggcaatttctctagagg

SEQ ID NO: 9399969 - DNA, 22 bp, Homo sapiens
tcttgggcacgatgggaggctt

SEQ ID NO: 9399970 - DNA, 22 bp, Homo sapiens
tcttgggaaatgtttgcgagct

SEQ ID NO: 9399971 - DNA, 22 bp, Homo sapiens
tcttgggaaataaacagattga

SEQ ID NO: 9399972 - DNA, 22 bp, Homo sapiens
tcttgggaagcccatttccacc

SEQ ID NO: 9399973 - DNA, 21 bp, Homo sapiens
tcttgggataaacttcaagaa

SEQ ID NO: 9399974 - DNA, 22 bp, Homo sapiens
tcttggctgcgtcctggctgtg

SEQ ID NO: 9399975 - DNA, 22 bp, Homo sapiens
tcttggcaggcagtggggtaag

SEQ ID NO: 9399976 - DNA, 22 bp, Homo sapiens
tcttggccccacctgtgccagc

SEQ ID NO: 9399977 - DNA, 22 bp, Homo sapiens
tcttggccccaaccctctattt

SEQ ID NO: 9399978 - DNA, 22 bp, Homo sapiens
tcttggactagtcctaaatcca

SEQ ID NO: 9399979 - DNA, 22 bp, Homo sapiens
tcttggagactcttgtatattt

SEQ ID NO: 9399980 - DNA, 22 bp, Homo sapiens
tcttgagaagcggctgtctcag

SEQ ID NO: 9399981 - DNA, 22 bp, Homo sapiens
tcttgaaagtatcttattttgt

SEQ ID NO: 9399982 - DNA, 22 bp, Homo sapiens
tcttgaaagtatcttattttgt

SEQ ID NO: 9399983 - DNA, 22 bp, Homo sapiens
tcttgaacttctgcacactcag

SEQ ID NO: 9399984 - DNA, 22 bp, Homo sapiens
tcttgaattgtactcccataag

SEQ ID NO: 9399985 - DNA, 22 bp, Homo sapiens
tcttgaattgtactcccataag

SEQ ID NO: 9399986 - DNA, 22 bp, Homo sapiens
tcttgaattgtactcccataag

SEQ ID NO: 9399987 - DNA, 22 bp, Homo sapiens
tcttgaataagtttcatgagct

SEQ ID NO: 9399988 - DNA, 20 bp, Homo sapiens
tcttgagaacaatttctggc

SEQ ID NO: 9399989 - DNA, 20 bp, Homo sapiens
tcttgagaacaatttctggc

SEQ ID NO: 9399990 - DNA, 22 bp, Homo sapiens
tctttgaatcctttacatctga

SEQ ID NO: 9399991 - DNA, 22 bp, Homo sapiens
tctttgaattcaaactgttcaa

SEQ ID NO: 9399992 - DNA, 22 bp, Homo sapiens
tctttgatttagaaggaaatga

SEQ ID NO: 9399993 - DNA, 22 bp, Homo sapiens
tctttgaatttctgactgtctt

SEQ ID NO: 9399994 - DNA, 22 bp, Homo sapiens
tctttcttattagccattgttc

SEQ ID NO: 9399995 - DNA, 22 bp, Homo sapiens
tctttcttacaaagaaaacggt

SEQ ID NO: 9399996 - DNA, 22 bp, Homo sapiens
tctttcttaaataggtggattg

SEQ ID NO: 9399997 - DNA, 22 bp, Homo sapiens
tctttctggttatgtatagaga

SEQ ID NO: 9399998 - DNA, 22 bp, Homo sapiens
tctttctggttatgtatagaga

SEQ ID NO: 9399999 - DNA, 22 bp, Homo sapiens
tctttgaacttggctgatctct

SEQ ID NO: 9400000 - DNA, 22 bp, Homo sapiens
tctttgaactctgtgtattaac

SEQ ID NO: 9400001 - DNA, 22 bp, Homo sapiens
tctttgaaagctgttctagagt

SEQ ID NO: 9400002 - DNA, 22 bp, Homo sapiens
tctttctctctaatcaagcaca

SEQ ID NO: 9400003 - DNA, 22 bp, Homo sapiens
tctttctctctaatcaagcaca

SEQ ID NO: 9400004 - DNA, 22 bp, Homo sapiens
tctttcctctgagctcctgtag

SEQ ID NO: 9400005 - DNA, 22 bp, Homo sapiens
tctttcctctgagctcctgtag

SEQ ID NO: 9400006 - DNA, 22 bp, Homo sapiens
tctttcctctgagctcctgtag

SEQ ID NO: 9400007 - DNA, 21 bp, Homo sapiens
tctttcctgcccagttgccct

SEQ ID NO: 9400008 - DNA, 22 bp, Homo sapiens
tctttctacatcatttgcttct

SEQ ID NO: 9400009 - DNA, 22 bp, Homo sapiens
tctttccctgtgttagcctgta

SEQ ID NO: 9400010 - DNA, 22 bp, Homo sapiens
tctttcccttagaacattaaca

SEQ ID NO: 9400011 - DNA, 23 bp, Homo sapiens
tctttcctaatgaaacagtgaaa

SEQ ID NO: 9400012 - DNA, 23 bp, Homo sapiens
tctttcctaatgaaacagtgaaa

SEQ ID NO: 9400013 - DNA, 22 bp, Homo sapiens
tctttcctaggtgatatgcaat

SEQ ID NO: 9400014 - DNA, 22 bp, Homo sapiens
tctttcctaggtgatatgcaat

SEQ ID NO: 9400015 - DNA, 22 bp, Homo sapiens
tctttcctagaggctgatgagt

SEQ ID NO: 9400016 - DNA, 22 bp, Homo sapiens
tctttcctactttattgtgaac

SEQ ID NO: 9400017 - DNA, 22 bp, Homo sapiens
tctttccatggccacacagtct

SEQ ID NO: 9400018 - DNA, 22 bp, Homo sapiens
tctttccagaggaatttttaga

SEQ ID NO: 9400019 - DNA, 22 bp, Homo sapiens
tctttccagaggaatttttaga

SEQ ID NO: 9400020 - DNA, 22 bp, Homo sapiens
tctttccagaggaatttttaga

SEQ ID NO: 9400021 - DNA, 22 bp, Homo sapiens
tctttccaagtaatacttccca

SEQ ID NO: 9400022 - DNA, 21 bp, Homo sapiens
tctttccaatattcatgtctc

SEQ ID NO: 9400023 - DNA, 22 bp, Homo sapiens
tctttccaaggactctgtagca

SEQ ID NO: 9400024 - DNA, 22 bp, Homo sapiens
tctttccacattctctgtttag

SEQ ID NO: 9400025 - DNA, 22 bp, Homo sapiens
tctttccacagcatgtccatgc

SEQ ID NO: 9400026 - DNA, 22 bp, Homo sapiens
tctttccacactgtatgcccat

SEQ ID NO: 9400027 - DNA, 22 bp, Homo sapiens
tctttattgctactggtttgtc

SEQ ID NO: 9400028 - DNA, 22 bp, Homo sapiens
tctttatttaagtctgttgtaa

SEQ ID NO: 9400029 - DNA, 22 bp, Homo sapiens
tctttatttaagtctgttgtaa

SEQ ID NO: 9400030 - DNA, 22 bp, Homo sapiens
tctttatttaagtctgttgtaa

SEQ ID NO: 9400031 - DNA, 19 bp, Homo sapiens
tctttcatttctagctctg

SEQ ID NO: 9400032 - DNA, 19 bp, Homo sapiens
tctttcatttctagctctg

SEQ ID NO: 9400033 - DNA, 22 bp, Homo sapiens
tctttagagcctttcctcccga

SEQ ID NO: 9400034 - DNA, 22 bp, Homo sapiens
tctttagacatccagtttctct

SEQ ID NO: 9400035 - DNA, 22 bp, Homo sapiens
tctttagagcacgggaaaaaca

SEQ ID NO: 9400036 - DNA, 22 bp, Homo sapiens
tctttagagttaacaataatga

SEQ ID NO: 9400037 - DNA, 22 bp, Homo sapiens
tctttagagctcagaaatacag

SEQ ID NO: 9400038 - DNA, 22 bp, Homo sapiens
tctttagatgtttagaggaaga

SEQ ID NO: 9400039 - DNA, 20 bp, Homo sapiens
tctttagatttatcttatgt

SEQ ID NO: 9400040 - DNA, 20 bp, Homo sapiens
tctttagatttatcttatgt

SEQ ID NO: 9400041 - DNA, 22 bp, Homo sapiens
tctttattgctactggtttgtc

SEQ ID NO: 9400042 - DNA, 22 bp, Homo sapiens
tctttattgctactggtttgtc

SEQ ID NO: 9400043 - DNA, 22 bp, Homo sapiens
tctttatctggctcagagacac

SEQ ID NO: 9400044 - DNA, 22 bp, Homo sapiens
tctttatcaagtctgttctttg

SEQ ID NO: 9400045 - DNA, 22 bp, Homo sapiens
tcttcctccctacagagctcag

SEQ ID NO: 9400046 - DNA, 22 bp, Homo sapiens
tcttcctctagatctgaggccc

SEQ ID NO: 9400047 - DNA, 22 bp, Homo sapiens
tcttcctctagatctgaggccc

SEQ ID NO: 9400048 - DNA, 22 bp, Homo sapiens
tcttcctcttctgctgagaagt

SEQ ID NO: 9400049 - DNA, 22 bp, Homo sapiens
tcttcctctagatctgaggccc

SEQ ID NO: 9400050 - DNA, 22 bp, Homo sapiens
tcttcctctctaattgatcaga

SEQ ID NO: 9400051 - DNA, 23 bp, Homo sapiens
tcttcctgaactatcaggcacat

SEQ ID NO: 9400052 - DNA, 23 bp, Homo sapiens
tcttcctgaactatcaggcacat

SEQ ID NO: 9400053 - DNA, 22 bp, Homo sapiens
tcttcctgaaaccctgttccag

SEQ ID NO: 9400054 - DNA, 23 bp, Homo sapiens
tcttcctgaactatcaggcacat

SEQ ID NO: 9400055 - DNA, 22 bp, Homo sapiens
tcttcctgaaaccctgttccag

SEQ ID NO: 9400056 - DNA, 22 bp, Homo sapiens
tcttccagggagcctcaaacct

SEQ ID NO: 9400057 - DNA, 21 bp, Homo sapiens
tcttcctccacagcgtgccac

SEQ ID NO: 9400058 - DNA, 21 bp, Homo sapiens
tcttcctccacagcgtgccac

SEQ ID NO: 9400059 - DNA, 22 bp, Homo sapiens
tcttcctccctacagagctcag

SEQ ID NO: 9400060 - DNA, 22 bp, Homo sapiens
tcttcctccctacagagctcag

SEQ ID NO: 9400061 - DNA, 22 bp, Homo sapiens
tcttccaggccctgccacagct

SEQ ID NO: 9400062 - DNA, 22 bp, Homo sapiens
tcttccaggagggtgggcaaac

SEQ ID NO: 9400063 - DNA, 20 bp, Homo sapiens
tcttccagcttctggtagaa

SEQ ID NO: 9400064 - DNA, 22 bp, Homo sapiens
tcttccttctttgatgacaagg

SEQ ID NO: 9400065 - DNA, 22 bp, Homo sapiens
tcttccttcgcccttgctgttt

SEQ ID NO: 9400066 - DNA, 22 bp, Homo sapiens
tcttccttaaatgtttggtaga

SEQ ID NO: 9400067 - DNA, 22 bp, Homo sapiens
tcttcctgtcaatgagaattaa

SEQ ID NO: 9400068 - DNA, 22 bp, Homo sapiens
tcttcctggtttctgggccatc

SEQ ID NO: 9400069 - DNA, 22 bp, Homo sapiens
tcttcctgctttggtgaggctt

SEQ ID NO: 9400070 - DNA, 22 bp, Homo sapiens
tcttcctggatgggggttgatg

SEQ ID NO: 9400071 - DNA, 21 bp, Homo sapiens
tcttcctgctccacactcccc

SEQ ID NO: 9400072 - DNA, 21 bp, Homo sapiens
tcttcctgctccacactcccc

SEQ ID NO: 9400073 - DNA, 22 bp, Homo sapiens
tcttccttgctccttgtcactt

SEQ ID NO: 9400074 - DNA, 22 bp, Homo sapiens
tcttccttgccttgcttcatca

SEQ ID NO: 9400075 - DNA, 22 bp, Homo sapiens
tcttctatcctcagcccctgcc

SEQ ID NO: 9400076 - DNA, 22 bp, Homo sapiens
tcttctagtaggccaagaagct

SEQ ID NO: 9400077 - DNA, 22 bp, Homo sapiens
tcttcgggaatcggtgcatttc

SEQ ID NO: 9400078 - DNA, 22 bp, Homo sapiens
tcttccttttgtaccttctgaa

SEQ ID NO: 9400079 - DNA, 22 bp, Homo sapiens
tcttcttcccatccctcaaatg

SEQ ID NO: 9400080 - DNA, 22 bp, Homo sapiens
tcttcttcctccacagggccca

SEQ ID NO: 9400081 - DNA, 22 bp, Homo sapiens
tcttctgttttagattgcatac

SEQ ID NO: 9400082 - DNA, 22 bp, Homo sapiens
tcttctgttttagattgcatac

SEQ ID NO: 9400083 - DNA, 20 bp, Homo sapiens
tcttctgttgccttgttctg

SEQ ID NO: 9400084 - DNA, 20 bp, Homo sapiens
tcttctgttgccttgttctg

SEQ ID NO: 9400085 - DNA, 22 bp, Homo sapiens
tcttctgttaccacagcgatga

SEQ ID NO: 9400086 - DNA, 22 bp, Homo sapiens
tcttctttgaatcatagtgacc

SEQ ID NO: 9400087 - DNA, 22 bp, Homo sapiens
tcttgaaagcatgagatggaca

SEQ ID NO: 9400088 - DNA, 22 bp, Homo sapiens
tcttctctacaccagcagcccc

SEQ ID NO: 9400089 - DNA, 22 bp, Homo sapiens
tcttctctacaccagcagcccc

SEQ ID NO: 9400090 - DNA, 22 bp, Homo sapiens
tcttctcctttgccatgtgttt

SEQ ID NO: 9400091 - DNA, 22 bp, Homo sapiens
tcttctcctttgccatgtgttt

SEQ ID NO: 9400092 - DNA, 22 bp, Homo sapiens
tcttctcctttgccatgtgttt

SEQ ID NO: 9400093 - DNA, 22 bp, Homo sapiens
tcttctctcatgtaggagggaa

SEQ ID NO: 9400094 - DNA, 22 bp, Homo sapiens
tcttctgttaccacagcgatga

SEQ ID NO: 9400095 - DNA, 22 bp, Homo sapiens
tcttctgttaccacagcgatga

SEQ ID NO: 9400096 - DNA, 22 bp, Homo sapiens
tcttctgtgatctatgtgtttt

SEQ ID NO: 9400097 - DNA, 22 bp, Homo sapiens
tcttctgtattgttaactcagg

SEQ ID NO: 9400098 - DNA, 22 bp, Homo sapiens
tcttctgtgagaattcaagcaa

SEQ ID NO: 9400099 - DNA, 22 bp, Homo sapiens
tcttctgtcctaagtcaaagca

SEQ ID NO: 9400100 - DNA, 22 bp, Homo sapiens
tcttctccataatcaacactct

SEQ ID NO: 9400101 - DNA, 22 bp, Homo sapiens
tcttctccagttcatcctacca

SEQ ID NO: 9400102 - DNA, 22 bp, Homo sapiens
tcttctccataatcaacactct

SEQ ID NO: 9400103 - DNA, 22 bp, Homo sapiens
tcttctccataatcaacactct

SEQ ID NO: 9400104 - DNA, 22 bp, Homo sapiens
tcttctcccagggtcgcccaag

SEQ ID NO: 9400105 - DNA, 22 bp, Homo sapiens
tcttctcccagggtcgcccaag

SEQ ID NO: 9400106 - DNA, 22 bp, Homo sapiens
tcttctcccatctccaggcagg

SEQ ID NO: 9400107 - DNA, 22 bp, Homo sapiens
tcttctcccatctccaggcagg

SEQ ID NO: 9400108 - DNA, 22 bp, Homo sapiens
tcttctcccatctccaggcagg

SEQ ID NO: 9400109 - DNA, 22 bp, Homo sapiens
tcttctcccatctccaggcagg

SEQ ID NO: 9400110 - DNA, 22 bp, Homo sapiens
tcttctcccatcggccgcaggg

SEQ ID NO: 9400111 - DNA, 22 bp, Homo sapiens
tcttctcccatcggccgcaggg

SEQ ID NO: 9400112 - DNA, 22 bp, Homo sapiens
tcttctcccatcggccgcaggg

SEQ ID NO: 9400113 - DNA, 22 bp, Homo sapiens
tcttctccagtgcttctgcaca

SEQ ID NO: 9400114 - DNA, 22 bp, Homo sapiens
tcttctccagtgcttctgcaca

SEQ ID NO: 9400115 - DNA, 22 bp, Homo sapiens
tcttctccagttcatcctacca

SEQ ID NO: 9400116 - DNA, 22 bp, Homo sapiens
tcttctccagttcatcctacca

SEQ ID NO: 9400117 - DNA, 22 bp, Homo sapiens
tcttctccagttcatcctacca

SEQ ID NO: 9400118 - DNA, 22 bp, Homo sapiens
tcttctccagtgcttctgcaca

SEQ ID NO: 9400119 - DNA, 22 bp, Homo sapiens
tcttctccagtgcttctgcaca

SEQ ID NO: 9400120 - DNA, 22 bp, Homo sapiens
tcttctccagtgcttctgcaca

SEQ ID NO: 9400121 - DNA, 22 bp, Homo sapiens
tcttcacagtcctggtcagtgg

SEQ ID NO: 9400122 - DNA, 23 bp, Homo sapiens
tcttcacagggcttcccatgtgc

SEQ ID NO: 9400123 - DNA, 22 bp, Homo sapiens
tcttcacatattccttgagcta

SEQ ID NO: 9400124 - DNA, 22 bp, Homo sapiens
tcttcacatgaccttcatgtct

SEQ ID NO: 9400125 - DNA, 22 bp, Homo sapiens
tcttcacatgaccttcatgtct

SEQ ID NO: 9400126 - DNA, 22 bp, Homo sapiens
tcttcaagaatatattgctgtc

SEQ ID NO: 9400127 - DNA, 22 bp, Homo sapiens
tcttcacacacagtcctctttc

SEQ ID NO: 9400128 - DNA, 22 bp, Homo sapiens
tcttcacacacagtcctctttc

SEQ ID NO: 9400129 - DNA, 22 bp, Homo sapiens
tcttcaatgcattctcttgttt

SEQ ID NO: 9400130 - DNA, 22 bp, Homo sapiens
tcttcaattagatttaccaatt

SEQ ID NO: 9400131 - DNA, 22 bp, Homo sapiens
tcttcaattagatttaccaatt

SEQ ID NO: 9400132 - DNA, 22 bp, Homo sapiens
tcttcaaaaaatatccatcagt

SEQ ID NO: 9400133 - DNA, 22 bp, Homo sapiens
tcttattttttaatgacagaga

SEQ ID NO: 9400134 - DNA, 22 bp, Homo sapiens
tcttattttttaatgacagaga

SEQ ID NO: 9400135 - DNA, 22 bp, Homo sapiens
tcttcaaagcatatgcaggcat

SEQ ID NO: 9400136 - DNA, 22 bp, Homo sapiens
tcttattttgttagatgctgta

SEQ ID NO: 9400137 - DNA, 22 bp, Homo sapiens
tcttatttgcaactggctcaga

SEQ ID NO: 9400138 - DNA, 22 bp, Homo sapiens
tcttatttgcaactggctcaga

SEQ ID NO: 9400139 - DNA, 22 bp, Homo sapiens
tcttattttttaatgacagaga

SEQ ID NO: 9400140 - DNA, 22 bp, Homo sapiens
tcttattgtgatgatgaagaac

SEQ ID NO: 9400141 - DNA, 20 bp, Homo sapiens
tcttattgtcttgaggagtt

SEQ ID NO: 9400142 - DNA, 20 bp, Homo sapiens
tcttattgtcttgaggagtt

SEQ ID NO: 9400143 - DNA, 22 bp, Homo sapiens
tcttattggataaaaggaaacc

SEQ ID NO: 9400144 - DNA, 22 bp, Homo sapiens
tcttattggtaatgatggcatt

SEQ ID NO: 9400145 - DNA, 19 bp, Homo sapiens
tcttattgagcagctgagg

SEQ ID NO: 9400146 - DNA, 22 bp, Homo sapiens
tcttccagccaatagcgtcctt

SEQ ID NO: 9400147 - DNA, 18 bp, Homo sapiens
tcttccaacactgacacc

SEQ ID NO: 9400148 - DNA, 22 bp, Homo sapiens
tcttcatgttgcttattctggg

SEQ ID NO: 9400149 - DNA, 22 bp, Homo sapiens
tcttcatgttgcttattctggg

SEQ ID NO: 9400150 - DNA, 22 bp, Homo sapiens
tcttcatgttgcttattctggg

SEQ ID NO: 9400151 - DNA, 18 bp, Homo sapiens
tcttccaacactgacacc

SEQ ID NO: 9400152 - DNA, 22 bp, Homo sapiens
tcttccacttgcaagtttatgg

SEQ ID NO: 9400153 - DNA, 22 bp, Homo sapiens
tcttcaggaagggaaatcatcc

SEQ ID NO: 9400154 - DNA, 22 bp, Homo sapiens
tcttcagcagggcctctctgag

SEQ ID NO: 9400155 - DNA, 22 bp, Homo sapiens
tcttcagctccctgttcagtac

SEQ ID NO: 9400156 - DNA, 22 bp, Homo sapiens
tcttcagctgtagtcattgttc

SEQ ID NO: 9400157 - DNA, 22 bp, Homo sapiens
tcttcagtgaatggcaagatct

SEQ ID NO: 9400158 - DNA, 22 bp, Homo sapiens
tcttcagtgcacctgatgtctt

SEQ ID NO: 9400159 - DNA, 22 bp, Homo sapiens
tcttcatctcagattaacagga

SEQ ID NO: 9400160 - DNA, 22 bp, Homo sapiens
tcttcatgaatgaatctttgac

SEQ ID NO: 9400161 - DNA, 22 bp, Homo sapiens
tcttcatgaatgaatctttgac

SEQ ID NO: 9400162 - DNA, 22 bp, Homo sapiens
tcttcatgacctctgtgtttta

SEQ ID NO: 9400163 - DNA, 22 bp, Homo sapiens
tcttcatgataccctaagccac

SEQ ID NO: 9400164 - DNA, 22 bp, Homo sapiens
tcttcatctcagattaacagga

SEQ ID NO: 9400165 - DNA, 22 bp, Homo sapiens
tcttcatctcagattaacagga

SEQ ID NO: 9400166 - DNA, 22 bp, Homo sapiens
tcttcatgaaattgattgctta

SEQ ID NO: 9400167 - DNA, 22 bp, Homo sapiens
tcttcatgttgctgtagggaga

SEQ ID NO: 9400168 - DNA, 22 bp, Homo sapiens
tcttcatgttagttgggttttc

SEQ ID NO: 9400169 - DNA, 22 bp, Homo sapiens
tcttcatgtcatggtatattga

SEQ ID NO: 9400170 - DNA, 22 bp, Homo sapiens
tcttcatgtctctgcttgagtc

SEQ ID NO: 9400171 - DNA, 22 bp, Homo sapiens
tcttcatgtatttgacaaccat

SEQ ID NO: 9400172 - DNA, 22 bp, Homo sapiens
tcttcatgtatactcatggtac

SEQ ID NO: 9400173 - DNA, 22 bp, Homo sapiens
tcttcatgccaaatgagttttg

SEQ ID NO: 9400174 - DNA, 22 bp, Homo sapiens
tcttcatgcacctcacagctag

SEQ ID NO: 9400175 - DNA, 22 bp, Homo sapiens
tcttcatgccaaatgagttttg

SEQ ID NO: 9400176 - DNA, 22 bp, Homo sapiens
tcttcatgccaaatgagttttg

SEQ ID NO: 9400177 - DNA, 23 bp, Homo sapiens
tcttcatggccatctggttcttc

SEQ ID NO: 9400178 - DNA, 23 bp, Homo sapiens
tcttcatgcccaggccttggtgc

SEQ ID NO: 9400179 - DNA, 22 bp, Homo sapiens
tcttcatggtctggttctccag

SEQ ID NO: 9400180 - DNA, 22 bp, Homo sapiens
tctgggtgaccctgggcaaggc

SEQ ID NO: 9400181 - DNA, 22 bp, Homo sapiens
tctgggtgatgaaatgcactgt

SEQ ID NO: 9400182 - DNA, 22 bp, Homo sapiens
tctgggtgagctgcctcgggtc

SEQ ID NO: 9400183 - DNA, 22 bp, Homo sapiens
tctgggtgccctttgctctgtt

SEQ ID NO: 9400184 - DNA, 22 bp, Homo sapiens
tctgggtgctacaaacagtatt

SEQ ID NO: 9400185 - DNA, 22 bp, Homo sapiens
tctgggtgccctttgctctgtt

SEQ ID NO: 9400186 - DNA, 22 bp, Homo sapiens
tctgggtgccactgtctgtaca

SEQ ID NO: 9400187 - DNA, 21 bp, Homo sapiens
tctgggtgctagtgtttgctt

SEQ ID NO: 9400188 - DNA, 22 bp, Homo sapiens
tctgggtggcagtgatggcgtg

SEQ ID NO: 9400189 - DNA, 21 bp, Homo sapiens
tctgggtgtaaatcttatttg

SEQ ID NO: 9400190 - DNA, 22 bp, Homo sapiens
tctgggtggtgtcttccaagac

SEQ ID NO: 9400191 - DNA, 22 bp, Homo sapiens
tctgggtgggcccgagaaatct

SEQ ID NO: 9400192 - DNA, 22 bp, Homo sapiens
tctgggtggcttcagaggccac

SEQ ID NO: 9400193 - DNA, 22 bp, Homo sapiens
tctgggtggctgccaatctgcc

SEQ ID NO: 9400194 - DNA, 22 bp, Homo sapiens
tctgggtgtggtatcttagcca

SEQ ID NO: 9400195 - DNA, 22 bp, Homo sapiens
tctgggtgtcactcctgcctgc

SEQ ID NO: 9400196 - DNA, 22 bp, Homo sapiens
tctgggtgtcactcctgcctgc

SEQ ID NO: 9400197 - DNA, 22 bp, Homo sapiens
tctgggtgtagggcctggcaac

SEQ ID NO: 9400198 - DNA, 22 bp, Homo sapiens
tctgggttcttcgattcttccc

SEQ ID NO: 9400199 - DNA, 23 bp, Homo sapiens
tctgggttctaatcatgtgtgat

SEQ ID NO: 9400200 - DNA, 22 bp, Homo sapiens
tctgggttattatgatggctac

SEQ ID NO: 9400201 - DNA, 22 bp, Homo sapiens
tctgggttcaaggggagtctgc

SEQ ID NO: 9400202 - DNA, 22 bp, Homo sapiens
tctgggttgaattggataaaca

SEQ ID NO: 9400203 - DNA, 22 bp, Homo sapiens
tctgggttgggagaaaagaggg

SEQ ID NO: 9400204 - DNA, 20 bp, Homo sapiens
tctgggttgaaatcaagatc

SEQ ID NO: 9400205 - DNA, 22 bp, Homo sapiens
tctgggttcttgatgctacctt

SEQ ID NO: 9400206 - DNA, 22 bp, Homo sapiens
tctgggttgggttcctggaatt

SEQ ID NO: 9400207 - DNA, 18 bp, Homo sapiens
tctggtttctaggggagt

SEQ ID NO: 9400208 - DNA, 22 bp, Homo sapiens
tctgtaaaacttctttgtaaat

SEQ ID NO: 9400209 - DNA, 20 bp, Homo sapiens
tctggggtgaagcccaggaa

SEQ ID NO: 9400210 - DNA, 20 bp, Homo sapiens
tctggggtgaagcccaggaa

SEQ ID NO: 9400211 - DNA, 22 bp, Homo sapiens
tctggggtgaggcctggttatc

SEQ ID NO: 9400212 - DNA, 22 bp, Homo sapiens
tctggggtgcagcctaggcatc

SEQ ID NO: 9400213 - DNA, 22 bp, Homo sapiens
tctggggtgcagcctaggcatc

SEQ ID NO: 9400214 - DNA, 22 bp, Homo sapiens
tctggggtcacctggggtgctt

SEQ ID NO: 9400215 - DNA, 22 bp, Homo sapiens
tctggggtcacctggggtgctt

SEQ ID NO: 9400216 - DNA, 18 bp, Homo sapiens
tctggggtgtgctgtgta

SEQ ID NO: 9400217 - DNA, 18 bp, Homo sapiens
tctggggtgtgctgtgta

SEQ ID NO: 9400218 - DNA, 22 bp, Homo sapiens
tctggggtgtgacctgagcatg

SEQ ID NO: 9400219 - DNA, 19 bp, Homo sapiens
tctggggtgtggcctggca

SEQ ID NO: 9400220 - DNA, 22 bp, Homo sapiens
tctggggttaagcccaggaatg

SEQ ID NO: 9400221 - DNA, 22 bp, Homo sapiens
tctggggtgtgacctgagcatg

SEQ ID NO: 9400222 - DNA, 22 bp, Homo sapiens
tctggggtgtgacctgagcatg

SEQ ID NO: 9400223 - DNA, 22 bp, Homo sapiens
tctggggtggagccctggagtc

SEQ ID NO: 9400224 - DNA, 22 bp, Homo sapiens
tctggggtgcagcctggacata

SEQ ID NO: 9400225 - DNA, 22 bp, Homo sapiens
tctggggtgcagcctggacata

SEQ ID NO: 9400226 - DNA, 22 bp, Homo sapiens
tctggggtggagccctggagtc

SEQ ID NO: 9400227 - DNA, 22 bp, Homo sapiens
tctggggtggagccctggagtc

SEQ ID NO: 9400228 - DNA, 22 bp, Homo sapiens
tctggggttttcacgctgtctc

SEQ ID NO: 9400229 - DNA, 22 bp, Homo sapiens
tctggggtttgtggttcttctg

SEQ ID NO: 9400230 - DNA, 22 bp, Homo sapiens
tctggggttggtgcttacacca

SEQ ID NO: 9400231 - DNA, 22 bp, Homo sapiens
tctggggttgagtctgggtcag

SEQ ID NO: 9400232 - DNA, 22 bp, Homo sapiens
tctggggttaagcccaggaatg

SEQ ID NO: 9400233 - DNA, 22 bp, Homo sapiens
tctggggttgagtctgggtcag

SEQ ID NO: 9400234 - DNA, 22 bp, Homo sapiens
tctgggtctggctgctggtgca

SEQ ID NO: 9400235 - DNA, 22 bp, Homo sapiens
tctgggtctggctgctggtgca

SEQ ID NO: 9400236 - DNA, 22 bp, Homo sapiens
tctgggtctcagagtgaccatg

SEQ ID NO: 9400237 - DNA, 22 bp, Homo sapiens
tctgggtgaccctgggcaaggc

SEQ ID NO: 9400238 - DNA, 22 bp, Homo sapiens
tctgggtctatcccatgccttt

SEQ ID NO: 9400239 - DNA, 22 bp, Homo sapiens
tctgggtctattcctactgtga

SEQ ID NO: 9400240 - DNA, 22 bp, Homo sapiens
tctgggtccgggactgtggatg

SEQ ID NO: 9400241 - DNA, 22 bp, Homo sapiens
tctggggatgagtgatgtcgta

SEQ ID NO: 9400242 - DNA, 22 bp, Homo sapiens
tctgggctttgtaatgggaggt

SEQ ID NO: 9400243 - DNA, 22 bp, Homo sapiens
tctgggctttgtaatgggaggt

SEQ ID NO: 9400244 - DNA, 22 bp, Homo sapiens
tctgggctttgtaatgggaggt

SEQ ID NO: 9400245 - DNA, 22 bp, Homo sapiens
tctgggctttgtaatgggaggt

SEQ ID NO: 9400246 - DNA, 22 bp, Homo sapiens
tctgggcttttccatgcctgtg

SEQ ID NO: 9400247 - DNA, 22 bp, Homo sapiens
tctgggcttttccatgcctgtg

SEQ ID NO: 9400248 - DNA, 22 bp, Homo sapiens
tctggggcagttactggggcct

SEQ ID NO: 9400249 - DNA, 22 bp, Homo sapiens
tctggggcagttactggggcct

SEQ ID NO: 9400250 - DNA, 22 bp, Homo sapiens
tctggggcagttactggggcct

SEQ ID NO: 9400251 - DNA, 22 bp, Homo sapiens
tctgggctttacactgtgctta

SEQ ID NO: 9400252 - DNA, 22 bp, Homo sapiens
tctgggctttacactgtgctta

SEQ ID NO: 9400253 - DNA, 22 bp, Homo sapiens
tctgggctttacactgtgctta

SEQ ID NO: 9400254 - DNA, 22 bp, Homo sapiens
tctgggctttacactgtgctta

SEQ ID NO: 9400255 - DNA, 22 bp, Homo sapiens
tctgggctttaagaactctgtt

SEQ ID NO: 9400256 - DNA, 22 bp, Homo sapiens
tctgggctttagtttgttatct

SEQ ID NO: 9400257 - DNA, 22 bp, Homo sapiens
tctgggctttagtttgttatct

SEQ ID NO: 9400258 - DNA, 21 bp, Homo sapiens
tctgggctttcttataaggca

SEQ ID NO: 9400259 - DNA, 21 bp, Homo sapiens
tctgggctttcttataaggca

SEQ ID NO: 9400260 - DNA, 21 bp, Homo sapiens
tctgggctttcttataaggca

SEQ ID NO: 9400261 - DNA, 22 bp, Homo sapiens
tctgggctttgtaatgggaggt

SEQ ID NO: 9400262 - DNA, 22 bp, Homo sapiens
tctgggctttgtaatgggaggt

SEQ ID NO: 9400263 - DNA, 22 bp, Homo sapiens
tctgggctttaagaactctgtt

SEQ ID NO: 9400264 - DNA, 22 bp, Homo sapiens
tctgggcttggttagggctgtt

SEQ ID NO: 9400265 - DNA, 22 bp, Homo sapiens
tctgggctttaagaactctgtt

SEQ ID NO: 9400266 - DNA, 22 bp, Homo sapiens
tctgggctttaagaactctgtt

SEQ ID NO: 9400267 - DNA, 22 bp, Homo sapiens
tctgggcttggttagggctgtt

SEQ ID NO: 9400268 - DNA, 22 bp, Homo sapiens
tctgggcttggttagggctgtt

SEQ ID NO: 9400269 - DNA, 22 bp, Homo sapiens
tctgggcttggattggctctgc

SEQ ID NO: 9400270 - DNA, 22 bp, Homo sapiens
tctgggcttggattggctctgc

SEQ ID NO: 9400271 - DNA, 22 bp, Homo sapiens
tctgggcttgggtagaaatcac

SEQ ID NO: 9400272 - DNA, 22 bp, Homo sapiens
tctgggcttgggtagaaatcac

SEQ ID NO: 9400273 - DNA, 22 bp, Homo sapiens
tctgggctgcttcagccttcgc

SEQ ID NO: 9400274 - DNA, 23 bp, Homo sapiens
tctgggctgcttaaggatcaagg

SEQ ID NO: 9400275 - DNA, 22 bp, Homo sapiens
tctgggctgcttcagccttcgc

SEQ ID NO: 9400276 - DNA, 22 bp, Homo sapiens
tctgggctgcttcagccttcgc

SEQ ID NO: 9400277 - DNA, 22 bp, Homo sapiens
tctgggctggctttatgctgac

SEQ ID NO: 9400278 - DNA, 22 bp, Homo sapiens
tctgggctggctttatgctgac

SEQ ID NO: 9400279 - DNA, 22 bp, Homo sapiens
tctgggctgggagcgtgtggac

SEQ ID NO: 9400280 - DNA, 22 bp, Homo sapiens
tctgggctgggcttaggaaccc

SEQ ID NO: 9400281 - DNA, 22 bp, Homo sapiens
tctgggctgggagcgtgtggac

SEQ ID NO: 9400282 - DNA, 22 bp, Homo sapiens
tctgggctggttgtgcttgctt

SEQ ID NO: 9400283 - DNA, 22 bp, Homo sapiens
tctgggctggttgtgcttgctt

SEQ ID NO: 9400284 - DNA, 22 bp, Homo sapiens
tctgggctggttgtgcttgctt

SEQ ID NO: 9400285 - DNA, 22 bp, Homo sapiens
tctgggctgggcttaggaaccc

SEQ ID NO: 9400286 - DNA, 22 bp, Homo sapiens
tctgggctggtgctcatgaatt

SEQ ID NO: 9400287 - DNA, 22 bp, Homo sapiens
tctgggctggtgctcatgaatt

SEQ ID NO: 9400288 - DNA, 22 bp, Homo sapiens
tctgggctgtctacaggttggc

SEQ ID NO: 9400289 - DNA, 22 bp, Homo sapiens
tctgggctgtctacaggttggc

SEQ ID NO: 9400290 - DNA, 15 bp, Homo sapiens
tctgggctgtgagca

SEQ ID NO: 9400291 - DNA, 15 bp, Homo sapiens
tctgggctgtgagca

SEQ ID NO: 9400292 - DNA, 20 bp, Homo sapiens
tctgggcttcccccagctcc

SEQ ID NO: 9400293 - DNA, 20 bp, Homo sapiens
tctgggcttcccccagctcc

SEQ ID NO: 9400294 - DNA, 18 bp, Homo sapiens
tctgggcttcccgaggct

SEQ ID NO: 9400295 - DNA, 18 bp, Homo sapiens
tctgggcttcccgaggct

SEQ ID NO: 9400296 - DNA, 18 bp, Homo sapiens
tctgggcttcccgaggct

SEQ ID NO: 9400297 - DNA, 22 bp, Homo sapiens
tctgggcttggattggctctgc

SEQ ID NO: 9400298 - DNA, 22 bp, Homo sapiens
tctgggcttgcctggttgtgca

SEQ ID NO: 9400299 - DNA, 22 bp, Homo sapiens
tctgggcttgcctggttgtgca

SEQ ID NO: 9400300 - DNA, 22 bp, Homo sapiens
tctgggcttgcctggttgtgca

SEQ ID NO: 9400301 - DNA, 17 bp, Homo sapiens
tctgggcttcagtggtc

SEQ ID NO: 9400302 - DNA, 22 bp, Homo sapiens
tctgggctgtggttccactccg

SEQ ID NO: 9400303 - DNA, 22 bp, Homo sapiens
tctgggctgtggttccactccg

SEQ ID NO: 9400304 - DNA, 22 bp, Homo sapiens
tctgggctgtgggaattcaaca

SEQ ID NO: 9400305 - DNA, 22 bp, Homo sapiens
tctgggctgtgccaaagctctt

SEQ ID NO: 9400306 - DNA, 22 bp, Homo sapiens
tctgggctgtgggaattcaaca

SEQ ID NO: 9400307 - DNA, 22 bp, Homo sapiens
tctgggctgtgccaaagctctt

SEQ ID NO: 9400308 - DNA, 17 bp, Homo sapiens
tctgggcttcagtggtc

SEQ ID NO: 9400309 - DNA, 17 bp, Homo sapiens
tctgggcttcagtggtc

SEQ ID NO: 9400310 - DNA, 22 bp, Homo sapiens
tctgtccagctctcaggagaca

SEQ ID NO: 9400311 - DNA, 22 bp, Homo sapiens
tctgtccagctctggggctcac

SEQ ID NO: 9400312 - DNA, 22 bp, Homo sapiens
tctgtccagaacgtacatcttg

SEQ ID NO: 9400313 - DNA, 18 bp, Homo sapiens
tctgtccaccctgtgctg

SEQ ID NO: 9400314 - DNA, 23 bp, Homo sapiens
tctgtccaccgcatgcagcggcc

SEQ ID NO: 9400315 - DNA, 22 bp, Homo sapiens
tctgtcattttgtatctacatg

SEQ ID NO: 9400316 - DNA, 22 bp, Homo sapiens
tctgtcattttgtatctacatg

SEQ ID NO: 9400317 - DNA, 22 bp, Homo sapiens
tctgtcatgccacaggacttgg

SEQ ID NO: 9400318 - DNA, 22 bp, Homo sapiens
tctgtcatgccacaggacttgg

SEQ ID NO: 9400319 - DNA, 22 bp, Homo sapiens
tctgtcatctgttcagtgctca

SEQ ID NO: 9400320 - DNA, 22 bp, Homo sapiens
tctgtcacccaggctggagtgc

SEQ ID NO: 9400321 - DNA, 21 bp, Homo sapiens
tctgtcatttgttagatgcaa

SEQ ID NO: 9400322 - DNA, 19 bp, Homo sapiens
tctgtcatttcttctgtac

SEQ ID NO: 9400323 - DNA, 21 bp, Homo sapiens
tctgtcatttgttagatgcaa

SEQ ID NO: 9400324 - DNA, 22 bp, Homo sapiens
tctgtcattagccttgactgta

SEQ ID NO: 9400325 - DNA, 22 bp, Homo sapiens
tctgtcatgtttccattacatg

SEQ ID NO: 9400326 - DNA, 22 bp, Homo sapiens
tctgtccggcaggcaggcaagt

SEQ ID NO: 9400327 - DNA, 22 bp, Homo sapiens
tctgtcctccggagctcccagt

SEQ ID NO: 9400328 - DNA, 22 bp, Homo sapiens
tctgtcctccggagctcccagt

SEQ ID NO: 9400329 - DNA, 22 bp, Homo sapiens
tctgtcctctccctgaccacaa

SEQ ID NO: 9400330 - DNA, 22 bp, Homo sapiens
tctgtccctgagagctcaggag

SEQ ID NO: 9400331 - DNA, 22 bp, Homo sapiens
tctgtccatgcttttctctcac

SEQ ID NO: 9400332 - DNA, 22 bp, Homo sapiens
tctgtccatgcctggaggagag

SEQ ID NO: 9400333 - DNA, 22 bp, Homo sapiens
tctgtccattcagccatccatc

SEQ ID NO: 9400334 - DNA, 22 bp, Homo sapiens
tctgtctcctcagatgactcca

SEQ ID NO: 9400335 - DNA, 22 bp, Homo sapiens
tctgtctcaagttcttgcactc

SEQ ID NO: 9400336 - DNA, 22 bp, Homo sapiens
tctgtctcctcagatgactcca

SEQ ID NO: 9400337 - DNA, 22 bp, Homo sapiens
tctgtctcctctgaggtgccag

SEQ ID NO: 9400338 - DNA, 22 bp, Homo sapiens
tctgtctcctctgaggtgccag

SEQ ID NO: 9400339 - DNA, 22 bp, Homo sapiens
tctgtctcaagttcttgcactc

SEQ ID NO: 9400340 - DNA, 22 bp, Homo sapiens
tctgtctcaagttcttgcactc

SEQ ID NO: 9400341 - DNA, 22 bp, Homo sapiens
tctgtctcaagttcttgcactc

SEQ ID NO: 9400342 - DNA, 22 bp, Homo sapiens
tctgtctcaagttcttgcactc

SEQ ID NO: 9400343 - DNA, 22 bp, Homo sapiens
tctgtctcaagttcttgcactc

SEQ ID NO: 9400344 - DNA, 22 bp, Homo sapiens
tctgtctcaagttcttgcactc

SEQ ID NO: 9400345 - DNA, 18 bp, Homo sapiens
tctgtccttccattcttc

SEQ ID NO: 9400346 - DNA, 22 bp, Homo sapiens
tctgtcctgtttcctcctgaca

SEQ ID NO: 9400347 - DNA, 22 bp, Homo sapiens
tctgtcctgtttcctcctgaca

SEQ ID NO: 9400348 - DNA, 22 bp, Homo sapiens
tctgtcctgtttcctcctgaca

SEQ ID NO: 9400349 - DNA, 22 bp, Homo sapiens
tctgtctcctgccagtgcctct

SEQ ID NO: 9400350 - DNA, 22 bp, Homo sapiens
tctgtctcctctgaggtgccag

SEQ ID NO: 9400351 - DNA, 22 bp, Homo sapiens
tctgtctcctgccagtgcctct

SEQ ID NO: 9400352 - DNA, 21 bp, Homo sapiens
tctgtctctccactgccctgc

SEQ ID NO: 9400353 - DNA, 21 bp, Homo sapiens
tctgtctctccactgccctgc

SEQ ID NO: 9400354 - DNA, 22 bp, Homo sapiens
tctgtctctcaagggccgtcct

SEQ ID NO: 9400355 - DNA, 18 bp, Homo sapiens
tctgtctctgtccttgct

SEQ ID NO: 9400356 - DNA, 18 bp, Homo sapiens
tctgtctctgtccttgct

SEQ ID NO: 9400357 - DNA, 18 bp, Homo sapiens
tctgtctctgtccttgct

SEQ ID NO: 9400358 - DNA, 18 bp, Homo sapiens
tctgtctctgtccttgct

SEQ ID NO: 9400359 - DNA, 22 bp, Homo sapiens
tctgtctctttgttctgtgagt

SEQ ID NO: 9400360 - DNA, 22 bp, Homo sapiens
tctgtctgactaccatgaggca

SEQ ID NO: 9400361 - DNA, 22 bp, Homo sapiens
tctgtacatttgtgttgtgaat

SEQ ID NO: 9400362 - DNA, 22 bp, Homo sapiens
tctgtacctcacatgcaccatc

SEQ ID NO: 9400363 - DNA, 22 bp, Homo sapiens
tctgtacatttggggaccccag

SEQ ID NO: 9400364 - DNA, 22 bp, Homo sapiens
tctgtacatttgtgttgtgaat

SEQ ID NO: 9400365 - DNA, 22 bp, Homo sapiens
tctgtacatgagttgagaatca

SEQ ID NO: 9400366 - DNA, 21 bp, Homo sapiens
tctgtactttgcttccatgct

SEQ ID NO: 9400367 - DNA, 22 bp, Homo sapiens
tctgtacttttattttggcact

SEQ ID NO: 9400368 - DNA, 20 bp, Homo sapiens
tctgtactggagacctttat

SEQ ID NO: 9400369 - DNA, 22 bp, Homo sapiens
tctgtactttacatgcagtgct

SEQ ID NO: 9400370 - DNA, 22 bp, Homo sapiens
tctgtagtaggttgtagttctt

SEQ ID NO: 9400371 - DNA, 22 bp, Homo sapiens
tctgtaggggccggcggagccc

SEQ ID NO: 9400372 - DNA, 22 bp, Homo sapiens
tctgtatcgtaatcatgtctgg

SEQ ID NO: 9400373 - DNA, 22 bp, Homo sapiens
tctgtatatattaatgaaattc

SEQ ID NO: 9400374 - DNA, 22 bp, Homo sapiens
tctgtattgagaaagccggaca

SEQ ID NO: 9400375 - DNA, 22 bp, Homo sapiens
tctgtataaggacaaacattta

SEQ ID NO: 9400376 - DNA, 22 bp, Homo sapiens
tctgtcacaagtaatccttttc

SEQ ID NO: 9400377 - DNA, 22 bp, Homo sapiens
tctgtaaagactccaaaagcca

SEQ ID NO: 9400378 - DNA, 22 bp, Homo sapiens
tctgtaaagactccaaaagcca

SEQ ID NO: 9400379 - DNA, 22 bp, Homo sapiens
tctgtaaacaccatgttagagt

SEQ ID NO: 9400380 - DNA, 20 bp, Homo sapiens
tctgtaaagactccagaagc

SEQ ID NO: 9400381 - DNA, 22 bp, Homo sapiens
tctgtaagggaaggtgatttgc

SEQ ID NO: 9400382 - DNA, 22 bp, Homo sapiens
tctgtaatcaagatatttgaga

SEQ ID NO: 9400383 - DNA, 22 bp, Homo sapiens
tctgtacaaaggctatttggag

SEQ ID NO: 9400384 - DNA, 23 bp, Homo sapiens
tctgtacacatcagcatctccca

SEQ ID NO: 9400385 - DNA, 22 bp, Homo sapiens
tctgtacaacaaagggatgaga

SEQ ID NO: 9400386 - DNA, 22 bp, Homo sapiens
tctgtacaacaaagggatgaga

SEQ ID NO: 9400387 - DNA, 22 bp, Homo sapiens
tctgtacaccaggggccattct

SEQ ID NO: 9400388 - DNA, 20 bp, Homo sapiens
tctgtacactcatcttctgc

SEQ ID NO: 9400389 - DNA, 20 bp, Homo sapiens
tctgtacactcatcttctgc

SEQ ID NO: 9400390 - DNA, 20 bp, Homo sapiens
tctgtacactcatcttctgc

SEQ ID NO: 9400391 - DNA, 22 bp, Homo sapiens
tctgtacagtaccagatagtaa

SEQ ID NO: 9400392 - DNA, 22 bp, Homo sapiens
tctgtacagtaccagatagtaa

SEQ ID NO: 9400393 - DNA, 21 bp, Homo sapiens
tctgtacatcattgagtcccc

SEQ ID NO: 9400394 - DNA, 22 bp, Homo sapiens
tctgttcttggtgcagctggga

SEQ ID NO: 9400395 - DNA, 22 bp, Homo sapiens
tctgttatgcataagcatcagt

SEQ ID NO: 9400396 - DNA, 20 bp, Homo sapiens
tctgttattattacattgcc

SEQ ID NO: 9400397 - DNA, 22 bp, Homo sapiens
tctgttgcaatgtgcatggtga

SEQ ID NO: 9400398 - DNA, 22 bp, Homo sapiens
tctgttgcatatgctgctgggt

SEQ ID NO: 9400399 - DNA, 22 bp, Homo sapiens
tctgttggagcctaggatgaca

SEQ ID NO: 9400400 - DNA, 22 bp, Homo sapiens
tctgttgtctgcaattctggga

SEQ ID NO: 9400401 - DNA, 22 bp, Homo sapiens
tctgtgtgttgtcaggaggatt

SEQ ID NO: 9400402 - DNA, 22 bp, Homo sapiens
tctgtgtttgccatccttgctc

SEQ ID NO: 9400403 - DNA, 22 bp, Homo sapiens
tctgtgttttaaacagtagaaa

SEQ ID NO: 9400404 - DNA, 22 bp, Homo sapiens
tctgttatatagataatgtgtg

SEQ ID NO: 9400405 - DNA, 22 bp, Homo sapiens
tctgtgtgggatagtttgagga

SEQ ID NO: 9400406 - DNA, 22 bp, Homo sapiens
tctgtgtgatttcagggaagtc

SEQ ID NO: 9400407 - DNA, 22 bp, Homo sapiens
tctgtgtgatttcagggaagtc

SEQ ID NO: 9400408 - DNA, 22 bp, Homo sapiens
tctgtgtgaccataagccagct

SEQ ID NO: 9400409 - DNA, 22 bp, Homo sapiens
tctgtgtgaccataagccagct

SEQ ID NO: 9400410 - DNA, 22 bp, Homo sapiens
tcttaactgacagtttaatggg

SEQ ID NO: 9400411 - DNA, 22 bp, Homo sapiens
tcttaactgacagtttaatggg

SEQ ID NO: 9400412 - DNA, 22 bp, Homo sapiens
tcttaagcagagaagaagttga

SEQ ID NO: 9400413 - DNA, 22 bp, Homo sapiens
tcttaagtacctcctttatcac

SEQ ID NO: 9400414 - DNA, 22 bp, Homo sapiens
tcttagaattgaagtcagaggg

SEQ ID NO: 9400415 - DNA, 22 bp, Homo sapiens
tcttaaatgactgataagagga

SEQ ID NO: 9400416 - DNA, 20 bp, Homo sapiens
tcttaaatccccagggccat

SEQ ID NO: 9400417 - DNA, 22 bp, Homo sapiens
tcttaactatcatttgaacacc

SEQ ID NO: 9400418 - DNA, 22 bp, Homo sapiens
tcttagcaaattttctttgcct

SEQ ID NO: 9400419 - DNA, 22 bp, Homo sapiens
tcttagcatttcataacaactg

SEQ ID NO: 9400420 - DNA, 22 bp, Homo sapiens
tcttaggtgtatgtcattaggg

SEQ ID NO: 9400421 - DNA, 22 bp, Homo sapiens
tcttatcaataatgactgttga

SEQ ID NO: 9400422 - DNA, 22 bp, Homo sapiens
tcttatatgcacatacattggg

SEQ ID NO: 9400423 - DNA, 22 bp, Homo sapiens
tctgttttgtaccagatacagc

SEQ ID NO: 9400424 - DNA, 22 bp, Homo sapiens
tctgttttgtaccagatacagc

SEQ ID NO: 9400425 - DNA, 22 bp, Homo sapiens
tctgttttggtcacctttatat

SEQ ID NO: 9400426 - DNA, 22 bp, Homo sapiens
tctgtttttgaggctatcttct

SEQ ID NO: 9400427 - DNA, 22 bp, Homo sapiens
tctgtttttgaggctatcttct

SEQ ID NO: 9400428 - DNA, 17 bp, Homo sapiens
tctgtttctcctttctt

SEQ ID NO: 9400429 - DNA, 22 bp, Homo sapiens
tctgtttctccaacattgtgag

SEQ ID NO: 9400430 - DNA, 22 bp, Homo sapiens
tctgtttctccaacattgtgag

SEQ ID NO: 9400431 - DNA, 22 bp, Homo sapiens
tctgtttcctcttgtgtaaagt

SEQ ID NO: 9400432 - DNA, 22 bp, Homo sapiens
tctgtttcttggctagcctctt

SEQ ID NO: 9400433 - DNA, 22 bp, Homo sapiens
tctgttttagataagaaaggct

SEQ ID NO: 9400434 - DNA, 22 bp, Homo sapiens
tctgttttgcataatgttcttt

SEQ ID NO: 9400435 - DNA, 22 bp, Homo sapiens
tctgtgcactgtgtcattaggt

SEQ ID NO: 9400436 - DNA, 22 bp, Homo sapiens
tctgtgcagaactcacagaagg

SEQ ID NO: 9400437 - DNA, 22 bp, Homo sapiens
tctgtgcagaatcaaggagctt

SEQ ID NO: 9400438 - DNA, 22 bp, Homo sapiens
tctgtgcaggaagtcattatga

SEQ ID NO: 9400439 - DNA, 22 bp, Homo sapiens
tctgtgcagatgtagaccagtt

SEQ ID NO: 9400440 - DNA, 22 bp, Homo sapiens
tctgtgcagggaccccaagagt

SEQ ID NO: 9400441 - DNA, 20 bp, Homo sapiens
tctgtgcagtggaggggcag

SEQ ID NO: 9400442 - DNA, 22 bp, Homo sapiens
tctgtgcagttcttgtcttgac

SEQ ID NO: 9400443 - DNA, 22 bp, Homo sapiens
tctgtgccaagcttatatctgt

SEQ ID NO: 9400444 - DNA, 22 bp, Homo sapiens
tctgtgcatttcaggacctgaa

SEQ ID NO: 9400445 - DNA, 20 bp, Homo sapiens
tctgtgcattgcctgctggt

SEQ ID NO: 9400446 - DNA, 22 bp, Homo sapiens
tctgtgcctccgtaacacacca

SEQ ID NO: 9400447 - DNA, 22 bp, Homo sapiens
tctgtgcctgcttccccaccca

SEQ ID NO: 9400448 - DNA, 21 bp, Homo sapiens
tctgtgcctcaaccctcatct

SEQ ID NO: 9400449 - DNA, 22 bp, Homo sapiens
tctgtgcctcatctggttcagg

SEQ ID NO: 9400450 - DNA, 22 bp, Homo sapiens
tctgtgcctttaagaagctcat

SEQ ID NO: 9400451 - DNA, 22 bp, Homo sapiens
tctgtgctaatgcttcacaata

SEQ ID NO: 9400452 - DNA, 23 bp, Homo sapiens
tctgtgccagtttccatgtctgt

SEQ ID NO: 9400453 - DNA, 22 bp, Homo sapiens
tctgtgccacctctccagtgtc

SEQ ID NO: 9400454 - DNA, 22 bp, Homo sapiens
tctgtgccacctctccagtgtc

SEQ ID NO: 9400455 - DNA, 22 bp, Homo sapiens
tctgtgccagcagcctcctgga

SEQ ID NO: 9400456 - DNA, 23 bp, Homo sapiens
tctgtgccagtttccatgtctgt

SEQ ID NO: 9400457 - DNA, 22 bp, Homo sapiens
tctgtgccatcagtctccagag

SEQ ID NO: 9400458 - DNA, 22 bp, Homo sapiens
tctgtgccatgcccgtctacca

SEQ ID NO: 9400459 - DNA, 22 bp, Homo sapiens
tctgtgccctcggtgctgggcc

SEQ ID NO: 9400460 - DNA, 22 bp, Homo sapiens
tctgtgccgcgccggagaccct

SEQ ID NO: 9400461 - DNA, 22 bp, Homo sapiens
tctgtgccctcggtgctgggcc

SEQ ID NO: 9400462 - DNA, 22 bp, Homo sapiens
tctgtctttgagatctcagcct

SEQ ID NO: 9400463 - DNA, 22 bp, Homo sapiens
tctgtctgctcatttacctcag

SEQ ID NO: 9400464 - DNA, 22 bp, Homo sapiens
tctgtctgcttcacttgcattt

SEQ ID NO: 9400465 - DNA, 22 bp, Homo sapiens
tctgtctgcttcacttgcattt

SEQ ID NO: 9400466 - DNA, 22 bp, Homo sapiens
tctgtctgagggagtgacattt

SEQ ID NO: 9400467 - DNA, 22 bp, Homo sapiens
tctgtctgcctgtgtccccacc

SEQ ID NO: 9400468 - DNA, 22 bp, Homo sapiens
tctgtctgccttgtgagggcac

SEQ ID NO: 9400469 - DNA, 22 bp, Homo sapiens
tctgtgcaccagaatgatattt

SEQ ID NO: 9400470 - DNA, 22 bp, Homo sapiens
tctgtgcacaataggcattttt

SEQ ID NO: 9400471 - DNA, 22 bp, Homo sapiens
tctgtgcactaacattcctggt

SEQ ID NO: 9400472 - DNA, 22 bp, Homo sapiens
tctgtgcaccttctaatgagta

SEQ ID NO: 9400473 - DNA, 20 bp, Homo sapiens
tctgtgcacctgctacaagg

SEQ ID NO: 9400474 - DNA, 20 bp, Homo sapiens
tctgtgcacctgctacaagg

SEQ ID NO: 9400475 - DNA, 22 bp, Homo sapiens
tctgtgcaagtatttgacattt

SEQ ID NO: 9400476 - DNA, 22 bp, Homo sapiens
tctgtgcaagaccaactttcaa

SEQ ID NO: 9400477 - DNA, 22 bp, Homo sapiens
tctgtgacttacaagaagggac

SEQ ID NO: 9400478 - DNA, 22 bp, Homo sapiens
tctgtgtcctgctagctgtctt

SEQ ID NO: 9400479 - DNA, 22 bp, Homo sapiens
tctgtgtcagcagcactcagcc

SEQ ID NO: 9400480 - DNA, 22 bp, Homo sapiens
tctgtgtcagaagatatcatgg

SEQ ID NO: 9400481 - DNA, 22 bp, Homo sapiens
tctgtgtcactgaggcctgtgt

SEQ ID NO: 9400482 - DNA, 22 bp, Homo sapiens
tctgtgtctgttacttcactgc

SEQ ID NO: 9400483 - DNA, 22 bp, Homo sapiens
tctgtgtctggttgggccagta

SEQ ID NO: 9400484 - DNA, 22 bp, Homo sapiens
tctgtgtctgcagaagttcagc

SEQ ID NO: 9400485 - DNA, 22 bp, Homo sapiens
tctgtgtctgggcctccgcctg

SEQ ID NO: 9400486 - DNA, 22 bp, Homo sapiens
tctgtgtctcaatcccatgctg

SEQ ID NO: 9400487 - DNA, 22 bp, Homo sapiens
tctgtgtctcaatcccatgctg

SEQ ID NO: 9400488 - DNA, 22 bp, Homo sapiens
tctgtgtcgttctgtgctctgg

SEQ ID NO: 9400489 - DNA, 22 bp, Homo sapiens
tctgtgtcgttctgtgctctgg

SEQ ID NO: 9400490 - DNA, 22 bp, Homo sapiens
tctgtgggcatttataatctgg

SEQ ID NO: 9400491 - DNA, 22 bp, Homo sapiens
tctgtggggagcaggagccggg

SEQ ID NO: 9400492 - DNA, 22 bp, Homo sapiens
tctgtggcttctatttaacttt

SEQ ID NO: 9400493 - DNA, 22 bp, Homo sapiens
tctgtggcttcctatttcttgg

SEQ ID NO: 9400494 - DNA, 22 bp, Homo sapiens
tctgtggcttgggcctgcctgt

SEQ ID NO: 9400495 - DNA, 22 bp, Homo sapiens
tctgtggctttcgtgtaagatg

SEQ ID NO: 9400496 - DNA, 22 bp, Homo sapiens
tctgtggctttcttatgttgta

SEQ ID NO: 9400497 - DNA, 22 bp, Homo sapiens
tctgtgggttttgcagagttgc

SEQ ID NO: 9400498 - DNA, 22 bp, Homo sapiens
tctgtgggtgcctccagcagtg

SEQ ID NO: 9400499 - DNA, 22 bp, Homo sapiens
tctgtgggtttcagggggctgt

SEQ ID NO: 9400500 - DNA, 22 bp, Homo sapiens
tctgtgggtttcagggggctgt

SEQ ID NO: 9400501 - DNA, 22 bp, Homo sapiens
tctgtgctcatgcatgtgaatt

SEQ ID NO: 9400502 - DNA, 20 bp, Homo sapiens
tctgtgctacactccagatt

SEQ ID NO: 9400503 - DNA, 22 bp, Homo sapiens
tctgtgctgcccaacttctcaa

SEQ ID NO: 9400504 - DNA, 21 bp, Homo sapiens
tctgtgctgccgtcaacatcc

SEQ ID NO: 9400505 - DNA, 22 bp, Homo sapiens
tctgtgcttaactactcacccc

SEQ ID NO: 9400506 - DNA, 18 bp, Homo sapiens
tctgtggagagggcagtt

SEQ ID NO: 9400507 - DNA, 22 bp, Homo sapiens
tctgtggctgtgctgggccaga

SEQ ID NO: 9400508 - DNA, 19 bp, Homo sapiens
tctgtggctgtggggagga

SEQ ID NO: 9400509 - DNA, 22 bp, Homo sapiens
tctgtggctgttatctttatat

SEQ ID NO: 9400510 - DNA, 22 bp, Homo sapiens
tctgtggctgtctttccagagg

SEQ ID NO: 9400511 - DNA, 22 bp, Homo sapiens
tctgtggctggagaacttgtct

SEQ ID NO: 9400512 - DNA, 22 bp, Homo sapiens
tctgtggctggtaattgcatgt

SEQ ID NO: 9400513 - DNA, 23 bp, Homo sapiens
tctgtggctccttcaggctgctg

SEQ ID NO: 9400514 - DNA, 23 bp, Homo sapiens
tctggccccattctttcccatgt

SEQ ID NO: 9400515 - DNA, 22 bp, Homo sapiens
tctggcccatgatcctgctaac

SEQ ID NO: 9400516 - DNA, 22 bp, Homo sapiens
tctggcccatcttctgccacca

SEQ ID NO: 9400517 - DNA, 22 bp, Homo sapiens
tctggccccggtcttcacagct

SEQ ID NO: 9400518 - DNA, 22 bp, Homo sapiens
tctggccccggtcttcacagct

SEQ ID NO: 9400519 - DNA, 22 bp, Homo sapiens
tctggcccctggcagtcctgga

SEQ ID NO: 9400520 - DNA, 22 bp, Homo sapiens
tctggccccggtcttcacagct

SEQ ID NO: 9400521 - DNA, 20 bp, Homo sapiens
tctggccccttcctgtcctg

SEQ ID NO: 9400522 - DNA, 21 bp, Homo sapiens
tctggccctaggttgggcctc

SEQ ID NO: 9400523 - DNA, 20 bp, Homo sapiens
tctggccccttcctgtcctg

SEQ ID NO: 9400524 - DNA, 22 bp, Homo sapiens
tctggccctatggcatgtacct

SEQ ID NO: 9400525 - DNA, 22 bp, Homo sapiens
tctggcccctggtctctggtgt

SEQ ID NO: 9400526 - DNA, 22 bp, Homo sapiens
tctggcccctggtctctggtgt

SEQ ID NO: 9400527 - DNA, 22 bp, Homo sapiens
tctggcccctggcagtcctgga

SEQ ID NO: 9400528 - DNA, 21 bp, Homo sapiens
tctggccctcacagtcacacc

SEQ ID NO: 9400529 - DNA, 21 bp, Homo sapiens
tctggccctcacagtcacacc

SEQ ID NO: 9400530 - DNA, 21 bp, Homo sapiens
tctggccctcacagtcacacc

SEQ ID NO: 9400531 - DNA, 22 bp, Homo sapiens
tctggccctatggcatgtacct

SEQ ID NO: 9400532 - DNA, 22 bp, Homo sapiens
tctggccctatggcatgtacct

SEQ ID NO: 9400533 - DNA, 22 bp, Homo sapiens
tctggctcccagcctgctctca

SEQ ID NO: 9400534 - DNA, 22 bp, Homo sapiens
tctggctcccagcctgctctca

SEQ ID NO: 9400535 - DNA, 22 bp, Homo sapiens
tctggctccgtgtccgctccca

SEQ ID NO: 9400536 - DNA, 22 bp, Homo sapiens
tctggctcctgagtccatgctc

SEQ ID NO: 9400537 - DNA, 22 bp, Homo sapiens
tctggctgaaaggggctgtgcc

SEQ ID NO: 9400538 - DNA, 22 bp, Homo sapiens
tctggctgaaaggggctgtgcc

SEQ ID NO: 9400539 - DNA, 22 bp, Homo sapiens
tctggctgaaattagaaggttc

SEQ ID NO: 9400540 - DNA, 22 bp, Homo sapiens
tctggctgaattagccttgggt

SEQ ID NO: 9400541 - DNA, 22 bp, Homo sapiens
tctggctgaagcttttgcagct

SEQ ID NO: 9400542 - DNA, 22 bp, Homo sapiens
tctggctctctcatcacccaat

SEQ ID NO: 9400543 - DNA, 22 bp, Homo sapiens
tctggctctgtgtccccaccca

SEQ ID NO: 9400544 - DNA, 22 bp, Homo sapiens
tctggctctggagtccacctgc

SEQ ID NO: 9400545 - DNA, 22 bp, Homo sapiens
tctggctctgtgtcctcaccca

SEQ ID NO: 9400546 - DNA, 22 bp, Homo sapiens
tctggctctcatactcgccagt

SEQ ID NO: 9400547 - DNA, 22 bp, Homo sapiens
tctggctctataactcctagct

SEQ ID NO: 9400548 - DNA, 23 bp, Homo sapiens
tctggctctatgtgacagctctc

SEQ ID NO: 9400549 - DNA, 22 bp, Homo sapiens
tctggctcggatttgtctagca

SEQ ID NO: 9400550 - DNA, 22 bp, Homo sapiens
tctggctcggatttgtctagca

SEQ ID NO: 9400551 - DNA, 22 bp, Homo sapiens
tctggctcggatttgtctagca

SEQ ID NO: 9400552 - DNA, 22 bp, Homo sapiens
tctggctctaactaggcatcag

SEQ ID NO: 9400553 - DNA, 22 bp, Homo sapiens
tctggctctaactaggcatcag

SEQ ID NO: 9400554 - DNA, 19 bp, Homo sapiens
tctggctcctgccaggctg

SEQ ID NO: 9400555 - DNA, 19 bp, Homo sapiens
tctggctcctgccaggctg

SEQ ID NO: 9400556 - DNA, 22 bp, Homo sapiens
tctggctgtcattggaggcccc

SEQ ID NO: 9400557 - DNA, 22 bp, Homo sapiens
tctggctgtgtaaggtagcacc

SEQ ID NO: 9400558 - DNA, 22 bp, Homo sapiens
tctggctgtgtaaggtagcacc

SEQ ID NO: 9400559 - DNA, 22 bp, Homo sapiens
tctggctgggaagggggcccga

SEQ ID NO: 9400560 - DNA, 22 bp, Homo sapiens
tctggctgggctgacattgaac

SEQ ID NO: 9400561 - DNA, 22 bp, Homo sapiens
tctggctgggctgacattgaac

SEQ ID NO: 9400562 - DNA, 23 bp, Homo sapiens
tctggctgtaatatgaaagttag

SEQ ID NO: 9400563 - DNA, 23 bp, Homo sapiens
tctggctgtaatatgaaagttag

SEQ ID NO: 9400564 - DNA, 22 bp, Homo sapiens
tctggctgggtgagagcttctc

SEQ ID NO: 9400565 - DNA, 22 bp, Homo sapiens
tctggctttcctggagcaagaa

SEQ ID NO: 9400566 - DNA, 22 bp, Homo sapiens
tctggctgtgtaatatgtgtag

SEQ ID NO: 9400567 - DNA, 22 bp, Homo sapiens
tctggctgtgtatgagagtttt

SEQ ID NO: 9400568 - DNA, 22 bp, Homo sapiens
tctggctgtgtatgagagtttt

SEQ ID NO: 9400569 - DNA, 23 bp, Homo sapiens
tctggctttcacgggtattctta

SEQ ID NO: 9400570 - DNA, 23 bp, Homo sapiens
tctggctttcacgggtattctta

SEQ ID NO: 9400571 - DNA, 22 bp, Homo sapiens
tctggctgctgcgtgagtgctt

SEQ ID NO: 9400572 - DNA, 23 bp, Homo sapiens
tctggctgctcctttcaatgctc

SEQ ID NO: 9400573 - DNA, 22 bp, Homo sapiens
tctggctgctgcgtgagtgctt

SEQ ID NO: 9400574 - DNA, 22 bp, Homo sapiens
tctggctggcagtgatggtgtg

SEQ ID NO: 9400575 - DNA, 22 bp, Homo sapiens
tctggctggctcggccgggagt

SEQ ID NO: 9400576 - DNA, 22 bp, Homo sapiens
tctggctggcagtgatggtgtg

SEQ ID NO: 9400577 - DNA, 22 bp, Homo sapiens
tctggctgcaccattatagtag

SEQ ID NO: 9400578 - DNA, 22 bp, Homo sapiens
tctggctgcaccattatagtag

SEQ ID NO: 9400579 - DNA, 19 bp, Homo sapiens
tctggctgccaaggattga

SEQ ID NO: 9400580 - DNA, 22 bp, Homo sapiens
tctggctgattccctgggactg

SEQ ID NO: 9400581 - DNA, 22 bp, Homo sapiens
tctggctgccaccatcctcccc

SEQ ID NO: 9400582 - DNA, 22 bp, Homo sapiens
tctggctgcgtggcctttagca

SEQ ID NO: 9400583 - DNA, 22 bp, Homo sapiens
tctggctgacatcctgtatgag

SEQ ID NO: 9400584 - DNA, 22 bp, Homo sapiens
tctggctgacatcctgtatgag

SEQ ID NO: 9400585 - DNA, 22 bp, Homo sapiens
tctggcttttatgggatgagag

SEQ ID NO: 9400586 - DNA, 22 bp, Homo sapiens
tctggctttggatttgaagggt

SEQ ID NO: 9400587 - DNA, 22 bp, Homo sapiens
tctggctttctgactctacaac

SEQ ID NO: 9400588 - DNA, 22 bp, Homo sapiens
tctgggaaatggctacttgtca

SEQ ID NO: 9400589 - DNA, 22 bp, Homo sapiens
tctgggaacagcctggctgtgt

SEQ ID NO: 9400590 - DNA, 22 bp, Homo sapiens
tctgggaacactttgtgagctc

SEQ ID NO: 9400591 - DNA, 22 bp, Homo sapiens
tctgggaaatggctacttgtca

SEQ ID NO: 9400592 - DNA, 22 bp, Homo sapiens
tctgggaaatgggcagcttcgc

SEQ ID NO: 9400593 - DNA, 22 bp, Homo sapiens
tctgggaacacacgtcacttca

SEQ ID NO: 9400594 - DNA, 21 bp, Homo sapiens
tctgggaaattgggaaagaag

SEQ ID NO: 9400595 - DNA, 22 bp, Homo sapiens
tctgggaactatatctggtggt

SEQ ID NO: 9400596 - DNA, 22 bp, Homo sapiens
tctgggaactctgtcatttccc

SEQ ID NO: 9400597 - DNA, 22 bp, Homo sapiens
tctgggaactatatctggtggt

SEQ ID NO: 9400598 - DNA, 22 bp, Homo sapiens
tctgggaaccattggtggggat

SEQ ID NO: 9400599 - DNA, 22 bp, Homo sapiens
tctgggaaccattggtggggat

SEQ ID NO: 9400600 - DNA, 22 bp, Homo sapiens
tctgggaaccagtgcggctggg

SEQ ID NO: 9400601 - DNA, 22 bp, Homo sapiens
tctgggaaggctctgcagatat

SEQ ID NO: 9400602 - DNA, 22 bp, Homo sapiens
tctgggaagctgcgtgcctgtt

SEQ ID NO: 9400603 - DNA, 19 bp, Homo sapiens
tctgggaagccgggctcca

SEQ ID NO: 9400604 - DNA, 22 bp, Homo sapiens
tctgggaagcctgtatgcagaa

SEQ ID NO: 9400605 - DNA, 22 bp, Homo sapiens
tctgggagagtcacaggcattg

SEQ ID NO: 9400606 - DNA, 22 bp, Homo sapiens
tctgggagggagcctcagaatc

SEQ ID NO: 9400607 - DNA, 22 bp, Homo sapiens
tctgggagggagcctcagaatc

SEQ ID NO: 9400608 - DNA, 22 bp, Homo sapiens
tctgggagagtagataaaggaa

SEQ ID NO: 9400609 - DNA, 22 bp, Homo sapiens
tctgggagagtcacaggcattg

SEQ ID NO: 9400610 - DNA, 22 bp, Homo sapiens
tctgggagggagcctcagaatc

SEQ ID NO: 9400611 - DNA, 22 bp, Homo sapiens
tctgggaggggctgccattgct

SEQ ID NO: 9400612 - DNA, 22 bp, Homo sapiens
tctgggaggggctgccattgct

SEQ ID NO: 9400613 - DNA, 22 bp, Homo sapiens
tctgggaggtactgggaggtgt

SEQ ID NO: 9400614 - DNA, 22 bp, Homo sapiens
tctgggaggtcacattggtctt

SEQ ID NO: 9400615 - DNA, 22 bp, Homo sapiens
tctgggaggtggcagggtgcat

SEQ ID NO: 9400616 - DNA, 22 bp, Homo sapiens
tctgggaggtcacattggtctt

SEQ ID NO: 9400617 - DNA, 22 bp, Homo sapiens
tctgggaggtcacattggtctt

SEQ ID NO: 9400618 - DNA, 22 bp, Homo sapiens
tctgggaggtaaccatgctgat

SEQ ID NO: 9400619 - DNA, 22 bp, Homo sapiens
tctgggaggtaaccatgctgat

SEQ ID NO: 9400620 - DNA, 22 bp, Homo sapiens
tctgggaggtaaccatgctgat

SEQ ID NO: 9400621 - DNA, 22 bp, Homo sapiens
tctgggagtaaggcctaggcat

SEQ ID NO: 9400622 - DNA, 22 bp, Homo sapiens
tctgggagtgaagcaacagatg

SEQ ID NO: 9400623 - DNA, 22 bp, Homo sapiens
tctgggagtgaagcaacagatg

SEQ ID NO: 9400624 - DNA, 22 bp, Homo sapiens
tctgggaggtggcagggtgcat

SEQ ID NO: 9400625 - DNA, 22 bp, Homo sapiens
tctgggaggtggcagggtgcat

SEQ ID NO: 9400626 - DNA, 22 bp, Homo sapiens
tctgggaggtgttttgagaact

SEQ ID NO: 9400627 - DNA, 22 bp, Homo sapiens
tctgggagttagaatacatggg

SEQ ID NO: 9400628 - DNA, 22 bp, Homo sapiens
tctgggagttgtagtccggtgg

SEQ ID NO: 9400629 - DNA, 21 bp, Homo sapiens
tctgggagtgggaaaatggtc

SEQ ID NO: 9400630 - DNA, 22 bp, Homo sapiens
tctgggagtgggtccaaggaat

SEQ ID NO: 9400631 - DNA, 22 bp, Homo sapiens
tctgggagtgtgtctggccatc

SEQ ID NO: 9400632 - DNA, 22 bp, Homo sapiens
tctgggagagctgctgtcagag

SEQ ID NO: 9400633 - DNA, 22 bp, Homo sapiens
tctgggagagcacgtggctgac

SEQ ID NO: 9400634 - DNA, 22 bp, Homo sapiens
tctgggagagcacgtggctgac

SEQ ID NO: 9400635 - DNA, 22 bp, Homo sapiens
tctgggagagcacgtggctgac

SEQ ID NO: 9400636 - DNA, 22 bp, Homo sapiens
tctgggagagggaaagaagact

SEQ ID NO: 9400637 - DNA, 22 bp, Homo sapiens
tctgggagagggaaagaagact

SEQ ID NO: 9400638 - DNA, 22 bp, Homo sapiens
tctgggagagctgctgtcagag

SEQ ID NO: 9400639 - DNA, 22 bp, Homo sapiens
tctgggagagctgctgtcagag

SEQ ID NO: 9400640 - DNA, 22 bp, Homo sapiens
tctgggagagcacgtggctgac

SEQ ID NO: 9400641 - DNA, 22 bp, Homo sapiens
tctgggagagcacgtggctgac

SEQ ID NO: 9400642 - DNA, 22 bp, Homo sapiens
tctgggagagcacgtggctgac

SEQ ID NO: 9400643 - DNA, 22 bp, Homo sapiens
tctgggagacgtgtgttgtcag

SEQ ID NO: 9400644 - DNA, 22 bp, Homo sapiens
tctgggagagagttgataaagg

SEQ ID NO: 9400645 - DNA, 22 bp, Homo sapiens
tctgggagacgtgtgttgtcag

SEQ ID NO: 9400646 - DNA, 22 bp, Homo sapiens
tctgggagacgtgtgttgtcag

SEQ ID NO: 9400647 - DNA, 22 bp, Homo sapiens
tctgggagaagctgatgtgaag

SEQ ID NO: 9400648 - DNA, 22 bp, Homo sapiens
tctgggaatgaggcttgggcaa

SEQ ID NO: 9400649 - DNA, 19 bp, Homo sapiens
tctgggaatgatgccagca

SEQ ID NO: 9400650 - DNA, 19 bp, Homo sapiens
tctgggaatgatgccagca

SEQ ID NO: 9400651 - DNA, 22 bp, Homo sapiens
tctgggaagttggcagccagct

SEQ ID NO: 9400652 - DNA, 22 bp, Homo sapiens
tctgggaagtcctctgtcatgc

SEQ ID NO: 9400653 - DNA, 22 bp, Homo sapiens
tctgggaatacacactgattta

SEQ ID NO: 9400654 - DNA, 22 bp, Homo sapiens
tctgggaatacacactgattta

SEQ ID NO: 9400655 - DNA, 22 bp, Homo sapiens
tctgggaataaaactagggact

SEQ ID NO: 9400656 - DNA, 22 bp, Homo sapiens
tctgggaagttggcagccagct

SEQ ID NO: 9400657 - DNA, 23 bp, Homo sapiens
tctgggctgagacttggaaggtc

SEQ ID NO: 9400658 - DNA, 23 bp, Homo sapiens
tctgggctgagctcgagtgtaga

SEQ ID NO: 9400659 - DNA, 23 bp, Homo sapiens
tctgggctgagctcgagtgtaga

SEQ ID NO: 9400660 - DNA, 23 bp, Homo sapiens
tctgggctgagctcgagtgtaga

SEQ ID NO: 9400661 - DNA, 23 bp, Homo sapiens
tctgggctgagctcgagtgtaga

SEQ ID NO: 9400662 - DNA, 22 bp, Homo sapiens
tctgggctgctatgaggcagag

SEQ ID NO: 9400663 - DNA, 22 bp, Homo sapiens
tctgggctgaaatgaaggcctt

SEQ ID NO: 9400664 - DNA, 22 bp, Homo sapiens
tctgggctgaaatgaaggcctt

SEQ ID NO: 9400665 - DNA, 23 bp, Homo sapiens
tctgggctgagacttggaaggtc

SEQ ID NO: 9400666 - DNA, 23 bp, Homo sapiens
tctgggctgagacttggaaggtc

SEQ ID NO: 9400667 - DNA, 22 bp, Homo sapiens
tctgggctgctatgaggcagag

SEQ ID NO: 9400668 - DNA, 22 bp, Homo sapiens
tctgggctgctatgaggcagag

SEQ ID NO: 9400669 - DNA, 22 bp, Homo sapiens
tctgggctgctatgaggcagag

SEQ ID NO: 9400670 - DNA, 22 bp, Homo sapiens
tctgggctgctatgaggcagag

SEQ ID NO: 9400671 - DNA, 21 bp, Homo sapiens
tctgggctgctgctgcccatc

SEQ ID NO: 9400672 - DNA, 21 bp, Homo sapiens
tctgggctgctgctgcccatc

SEQ ID NO: 9400673 - DNA, 22 bp, Homo sapiens
tctgggctgctgtgcagtgacc

SEQ ID NO: 9400674 - DNA, 23 bp, Homo sapiens
tctgggctgcttaaggatcaagg

SEQ ID NO: 9400675 - DNA, 22 bp, Homo sapiens
tctgggctgctgtgcagtgacc

SEQ ID NO: 9400676 - DNA, 22 bp, Homo sapiens
tctgggccagatctagggatct

SEQ ID NO: 9400677 - DNA, 22 bp, Homo sapiens
tctgggcccactcaacttcact

SEQ ID NO: 9400678 - DNA, 23 bp, Homo sapiens
tctgggccacttgtctgcacttc

SEQ ID NO: 9400679 - DNA, 23 bp, Homo sapiens
tctgggccacttgtctgcacttc

SEQ ID NO: 9400680 - DNA, 22 bp, Homo sapiens
tctgggccaacccttccatggg

SEQ ID NO: 9400681 - DNA, 21 bp, Homo sapiens
tctgggcccatgctgcctcac

SEQ ID NO: 9400682 - DNA, 22 bp, Homo sapiens
tctgggcccactcaacttcact

SEQ ID NO: 9400683 - DNA, 21 bp, Homo sapiens
tctgggcccatgctgcctcac

SEQ ID NO: 9400684 - DNA, 22 bp, Homo sapiens
tctgggccctaaaccagctcta

SEQ ID NO: 9400685 - DNA, 22 bp, Homo sapiens
tctgggctcttagtgtaccctc

SEQ ID NO: 9400686 - DNA, 22 bp, Homo sapiens
tctgggctcttagtgtaccctc

SEQ ID NO: 9400687 - DNA, 22 bp, Homo sapiens
tctgggcactgctgagcctgta

SEQ ID NO: 9400688 - DNA, 22 bp, Homo sapiens
tctgggcactgctgagcctgta

SEQ ID NO: 9400689 - DNA, 18 bp, Homo sapiens
tctgggcaatctcagtat

SEQ ID NO: 9400690 - DNA, 22 bp, Homo sapiens
tctgggcaatggatgcactcac

SEQ ID NO: 9400691 - DNA, 22 bp, Homo sapiens
tctgggatgagatcagagacac

SEQ ID NO: 9400692 - DNA, 22 bp, Homo sapiens
tctgggatgagatcagagacac

SEQ ID NO: 9400693 - DNA, 22 bp, Homo sapiens
tctgggatgagatcagagacac

SEQ ID NO: 9400694 - DNA, 22 bp, Homo sapiens
tctgggattttatagacatgct

SEQ ID NO: 9400695 - DNA, 22 bp, Homo sapiens
tctgggatttttgacactgaag

SEQ ID NO: 9400696 - DNA, 22 bp, Homo sapiens
tctgggatgcaaacagaatctg

SEQ ID NO: 9400697 - DNA, 22 bp, Homo sapiens
tctgggattttatagacatgct

SEQ ID NO: 9400698 - DNA, 22 bp, Homo sapiens
tctgggagtttctgtgggagct

SEQ ID NO: 9400699 - DNA, 22 bp, Homo sapiens
tctgggatgaagccagaaactt

SEQ ID NO: 9400700 - DNA, 22 bp, Homo sapiens
tctgggatagggccagaacatg

SEQ ID NO: 9400701 - DNA, 20 bp, Homo sapiens
tctgggcagggcacatggaa

SEQ ID NO: 9400702 - DNA, 22 bp, Homo sapiens
tctgggcagcctcaggccaggg

SEQ ID NO: 9400703 - DNA, 22 bp, Homo sapiens
tctgggcagcctcaggccaggg

SEQ ID NO: 9400704 - DNA, 22 bp, Homo sapiens
tctgggcagagggtcttagtca

SEQ ID NO: 9400705 - DNA, 22 bp, Homo sapiens
tctgggcagaagcagtgcaaag

SEQ ID NO: 9400706 - DNA, 22 bp, Homo sapiens
tctgggcagcagcagctagtag

SEQ ID NO: 9400707 - DNA, 21 bp, Homo sapiens
tctgggcagcccagtcctgag

SEQ ID NO: 9400708 - DNA, 22 bp, Homo sapiens
tctggcccagcccctgatccca

SEQ ID NO: 9400709 - DNA, 22 bp, Homo sapiens
tctggcccatcttctgccacca

SEQ ID NO: 9400710 - DNA, 22 bp, Homo sapiens
tctggccatggcaagccgagtg

SEQ ID NO: 9400711 - DNA, 22 bp, Homo sapiens
tctggcccaagttttcggtgag

SEQ ID NO: 9400712 - DNA, 22 bp, Homo sapiens
tctggcccaagttttcggtgag

SEQ ID NO: 9400713 - DNA, 22 bp, Homo sapiens
tctggccaggatggcaagacca

SEQ ID NO: 9400714 - DNA, 22 bp, Homo sapiens
tctggccagtgaaatgcagaat

SEQ ID NO: 9400715 - DNA, 22 bp, Homo sapiens
tctggccactaataggtctcac

SEQ ID NO: 9400716 - DNA, 22 bp, Homo sapiens
tctggccacccgaggcccctgc

SEQ ID NO: 9400717 - DNA, 22 bp, Homo sapiens
tctggccagaaagacttgatgt

SEQ ID NO: 9400718 - DNA, 22 bp, Homo sapiens
tctggcagtgatttctgtgatc

SEQ ID NO: 9400719 - DNA, 22 bp, Homo sapiens
tctggcagtgatttctgtgatc

SEQ ID NO: 9400720 - DNA, 22 bp, Homo sapiens
tctggcagtggatgagggcagc

SEQ ID NO: 9400721 - DNA, 22 bp, Homo sapiens
tctggcagtggatgagggcagc

SEQ ID NO: 9400722 - DNA, 21 bp, Homo sapiens
tctggcagtggtctttcaaat

SEQ ID NO: 9400723 - DNA, 21 bp, Homo sapiens
tctggcagtggtctttcaaat

SEQ ID NO: 9400724 - DNA, 22 bp, Homo sapiens
tctggcagtggatgagggcagc

SEQ ID NO: 9400725 - DNA, 22 bp, Homo sapiens
tctggcagtggatgagggcagc

SEQ ID NO: 9400726 - DNA, 22 bp, Homo sapiens
tctggcagttccttgttgatat

SEQ ID NO: 9400727 - DNA, 22 bp, Homo sapiens
tctggcagttgccgcttcagtc

SEQ ID NO: 9400728 - DNA, 22 bp, Homo sapiens
tctggcagttgccgcttcagtc

SEQ ID NO: 9400729 - DNA, 22 bp, Homo sapiens
tctggcagtttgagaaaggcta

SEQ ID NO: 9400730 - DNA, 22 bp, Homo sapiens
tctggcagttccttgttgatat

SEQ ID NO: 9400731 - DNA, 22 bp, Homo sapiens
tctggcagttgccgcttcagtc

SEQ ID NO: 9400732 - DNA, 22 bp, Homo sapiens
tctggcagtttgagaaaggcta

SEQ ID NO: 9400733 - DNA, 22 bp, Homo sapiens
tctggcatagtgagagctttta

SEQ ID NO: 9400734 - DNA, 22 bp, Homo sapiens
tctggcatctgttttcatattt

SEQ ID NO: 9400735 - DNA, 22 bp, Homo sapiens
tctggcatcactcgcaagagca

SEQ ID NO: 9400736 - DNA, 22 bp, Homo sapiens
tctggcatggatttgagtgtct

SEQ ID NO: 9400737 - DNA, 22 bp, Homo sapiens
tctggcattttggctgggaaac

SEQ ID NO: 9400738 - DNA, 22 bp, Homo sapiens
tctggccaaccctcaagttgta

SEQ ID NO: 9400739 - DNA, 22 bp, Homo sapiens
tctggccaatgttgtgatcaca

SEQ ID NO: 9400740 - DNA, 20 bp, Homo sapiens
tctggcaggtgaacgagctg

SEQ ID NO: 9400741 - DNA, 20 bp, Homo sapiens
tctggcaggtgaacgagctg

SEQ ID NO: 9400742 - DNA, 22 bp, Homo sapiens
tctggcaggtcaatcattcttt

SEQ ID NO: 9400743 - DNA, 22 bp, Homo sapiens
tctggcaggtcaatcattcttt

SEQ ID NO: 9400744 - DNA, 19 bp, Homo sapiens
tctggcaggtaattaggga

SEQ ID NO: 9400745 - DNA, 22 bp, Homo sapiens
tctggcaggtcaatcattcttt

SEQ ID NO: 9400746 - DNA, 19 bp, Homo sapiens
tctggcaggtaattaggga

SEQ ID NO: 9400747 - DNA, 22 bp, Homo sapiens
tctggcagggtgtgtatttaca

SEQ ID NO: 9400748 - DNA, 22 bp, Homo sapiens
tctggcagggtcagggcccagg

SEQ ID NO: 9400749 - DNA, 22 bp, Homo sapiens
tctggcagcaagataacaatgg

SEQ ID NO: 9400750 - DNA, 22 bp, Homo sapiens
tctggcagggtgtgtatttaca

SEQ ID NO: 9400751 - DNA, 22 bp, Homo sapiens
tctggcagggtcagggcccagg

SEQ ID NO: 9400752 - DNA, 22 bp, Homo sapiens
tctggcagagtgataggataag

SEQ ID NO: 9400753 - DNA, 22 bp, Homo sapiens
tctggcagatcttcccacgttt

SEQ ID NO: 9400754 - DNA, 22 bp, Homo sapiens
tctggcagcaagataacaatgg

SEQ ID NO: 9400755 - DNA, 22 bp, Homo sapiens
tctggcagatcttcccacgttt

SEQ ID NO: 9400756 - DNA, 22 bp, Homo sapiens
tctggcagtaataggggagaga

SEQ ID NO: 9400757 - DNA, 22 bp, Homo sapiens
tctggcaggttcccatgttatg

SEQ ID NO: 9400758 - DNA, 20 bp, Homo sapiens
tctggcaggtgaacgagctg

SEQ ID NO: 9400759 - DNA, 22 bp, Homo sapiens
tctggcaggttcccatgttatg

SEQ ID NO: 9400760 - DNA, 20 bp, Homo sapiens
tctggcaggtgaacgagctg

SEQ ID NO: 9400761 - DNA, 22 bp, Homo sapiens
tctggcagtgagcaacttgaca

SEQ ID NO: 9400762 - DNA, 22 bp, Homo sapiens
tctggcagtgagcaacttgaca

SEQ ID NO: 9400763 - DNA, 22 bp, Homo sapiens
tctggcagtaataggggagaga

SEQ ID NO: 9400764 - DNA, 22 bp, Homo sapiens
tctggcagtgaagtcatgaggt

SEQ ID NO: 9400765 - DNA, 22 bp, Homo sapiens
tctggcagtgaagtcatgaggt

SEQ ID NO: 9400766 - DNA, 22 bp, Homo sapiens
tctggcagtgaagtcatgaggt

SEQ ID NO: 9400767 - DNA, 22 bp, Homo sapiens
tctggcagagtgataggataag

SEQ ID NO: 9400768 - DNA, 22 bp, Homo sapiens
tctggcagagtcagtgcacaca

SEQ ID NO: 9400769 - DNA, 22 bp, Homo sapiens
tctggcagagtcagtgcacaca

SEQ ID NO: 9400770 - DNA, 22 bp, Homo sapiens
tctggcagaggaaggaggcctg

SEQ ID NO: 9400771 - DNA, 22 bp, Homo sapiens
tctggcagagtcagtgcacaca

SEQ ID NO: 9400772 - DNA, 22 bp, Homo sapiens
tctggcagagtcagtgcacaca

SEQ ID NO: 9400773 - DNA, 22 bp, Homo sapiens
tctggcagagatatccatccca

SEQ ID NO: 9400774 - DNA, 22 bp, Homo sapiens
tctggcagaggaaggaggcctg

SEQ ID NO: 9400775 - DNA, 22 bp, Homo sapiens
tctggcagagatatccatccca

SEQ ID NO: 9400776 - DNA, 22 bp, Homo sapiens
tctggcagaagtgctgtcagta

SEQ ID NO: 9400777 - DNA, 22 bp, Homo sapiens
tctggcaccactgagtctgcag

SEQ ID NO: 9400778 - DNA, 22 bp, Homo sapiens
tctggcacttaaatgagaattt

SEQ ID NO: 9400779 - DNA, 22 bp, Homo sapiens
tctggcagaaggcagaaattca

SEQ ID NO: 9400780 - DNA, 22 bp, Homo sapiens
tctggcagaagtgctgtcagta

SEQ ID NO: 9400781 - DNA, 22 bp, Homo sapiens
tctggcagaaggcagaaattca

SEQ ID NO: 9400782 - DNA, 22 bp, Homo sapiens
tctggcacactaggtctcaggt

SEQ ID NO: 9400783 - DNA, 22 bp, Homo sapiens
tctggcacatagcagggtctct

SEQ ID NO: 9400784 - DNA, 20 bp, Homo sapiens
tctggcacactgagaagctc

SEQ ID NO: 9400785 - DNA, 22 bp, Homo sapiens
tctggagtgtccagttctactc

SEQ ID NO: 9400786 - DNA, 22 bp, Homo sapiens
tctggagtgggactttgcatct

SEQ ID NO: 9400787 - DNA, 22 bp, Homo sapiens
tctggagtggaggtgccttggg

SEQ ID NO: 9400788 - DNA, 22 bp, Homo sapiens
tctggagtggcagtcatctgaa

SEQ ID NO: 9400789 - DNA, 22 bp, Homo sapiens
tctggagtgtgtgtattcagct

SEQ ID NO: 9400790 - DNA, 22 bp, Homo sapiens
tctggagtgtttctaattactg

SEQ ID NO: 9400791 - DNA, 22 bp, Homo sapiens
tctggagtgtttctaattactg

SEQ ID NO: 9400792 - DNA, 22 bp, Homo sapiens
tctggagttagttataatggtt

SEQ ID NO: 9400793 - DNA, 22 bp, Homo sapiens
tctggagttactgctggctttg

SEQ ID NO: 9400794 - DNA, 22 bp, Homo sapiens
tctggagttgcatgttttggct

SEQ ID NO: 9400795 - DNA, 22 bp, Homo sapiens
tctggagttgtgcagtggacct

SEQ ID NO: 9400796 - DNA, 22 bp, Homo sapiens
tctggagttcctgcaggctgtg

SEQ ID NO: 9400797 - DNA, 22 bp, Homo sapiens
tctggagttgagagtgtgcgag

SEQ ID NO: 9400798 - DNA, 22 bp, Homo sapiens
tctggagttgaagttcttcccc

SEQ ID NO: 9400799 - DNA, 22 bp, Homo sapiens
tctggagtttgagcacttcaat

SEQ ID NO: 9400800 - DNA, 22 bp, Homo sapiens
tctggagtttgaggacaagctt

SEQ ID NO: 9400801 - DNA, 22 bp, Homo sapiens
tctggagttttttctgtctgtg

SEQ ID NO: 9400802 - DNA, 17 bp, Homo sapiens
tctggatgtcatggaag

SEQ ID NO: 9400803 - DNA, 17 bp, Homo sapiens
tctggatgtcatggaag

SEQ ID NO: 9400804 - DNA, 22 bp, Homo sapiens
tctggattcacctttagtacct

SEQ ID NO: 9400805 - DNA, 22 bp, Homo sapiens
tctggattcaagtccctgtttt

SEQ ID NO: 9400806 - DNA, 22 bp, Homo sapiens
tctggattagatgctttcaaga

SEQ ID NO: 9400807 - DNA, 22 bp, Homo sapiens
tctggattaactgctgtttatt

SEQ ID NO: 9400808 - DNA, 22 bp, Homo sapiens
tctggatgttgcggagtacaga

SEQ ID NO: 9400809 - DNA, 22 bp, Homo sapiens
tctggattctaaggtgtttact

SEQ ID NO: 9400810 - DNA, 22 bp, Homo sapiens
tctggattctgtactgtaaagt

SEQ ID NO: 9400811 - DNA, 22 bp, Homo sapiens
tctggatttcagttctaaatct

SEQ ID NO: 9400812 - DNA, 22 bp, Homo sapiens
tctggatttgagctcagttgta

SEQ ID NO: 9400813 - DNA, 22 bp, Homo sapiens
tctggatttgtggaaaatctgc

SEQ ID NO: 9400814 - DNA, 22 bp, Homo sapiens
tctggatgatatgtgaacttga

SEQ ID NO: 9400815 - DNA, 22 bp, Homo sapiens
tctggatgacagaatggtcata

SEQ ID NO: 9400816 - DNA, 22 bp, Homo sapiens
tctggatgggatgaggcaacaa

SEQ ID NO: 9400817 - DNA, 23 bp, Homo sapiens
tctggatgccaccacatactaac

SEQ ID NO: 9400818 - DNA, 22 bp, Homo sapiens
tctggagtctaaagaaccaaaa

SEQ ID NO: 9400819 - DNA, 22 bp, Homo sapiens
tctggagtctgagatctgagga

SEQ ID NO: 9400820 - DNA, 22 bp, Homo sapiens
tctggagtcctggaatcagcta

SEQ ID NO: 9400821 - DNA, 22 bp, Homo sapiens
tctggagtccagatccatttgg

SEQ ID NO: 9400822 - DNA, 22 bp, Homo sapiens
tctggagtggacccagagcact

SEQ ID NO: 9400823 - DNA, 22 bp, Homo sapiens
tctggagtggagctgatcattt

SEQ ID NO: 9400824 - DNA, 22 bp, Homo sapiens
tctggagtgaatgaagtagtgt

SEQ ID NO: 9400825 - DNA, 22 bp, Homo sapiens
tctggagtctggtggttatggt

SEQ ID NO: 9400826 - DNA, 22 bp, Homo sapiens
tctggagtgccctgctctgccc

SEQ ID NO: 9400827 - DNA, 22 bp, Homo sapiens
tctggagtagggtctgggaatt

SEQ ID NO: 9400828 - DNA, 22 bp, Homo sapiens
tctggagtatgtccctggtgaa

SEQ ID NO: 9400829 - DNA, 22 bp, Homo sapiens
tctggagtatgtgtgaacggtg

SEQ ID NO: 9400830 - DNA, 21 bp, Homo sapiens
tctggagtcatctttaccata

SEQ ID NO: 9400831 - DNA, 22 bp, Homo sapiens
tctggagtaactctgtttctgg

SEQ ID NO: 9400832 - DNA, 20 bp, Homo sapiens
tctggagtagagcacaggca

SEQ ID NO: 9400833 - DNA, 22 bp, Homo sapiens
tctggagtaattacagtgactg

SEQ ID NO: 9400834 - DNA, 22 bp, Homo sapiens
tctggagtaggacctgaaaata

SEQ ID NO: 9400835 - DNA, 22 bp, Homo sapiens
tctggagtaggacctgaaaata

SEQ ID NO: 9400836 - DNA, 22 bp, Homo sapiens
tctggagatcatgtggggtgga

SEQ ID NO: 9400837 - DNA, 22 bp, Homo sapiens
tctggagatcatgtggggtgga

SEQ ID NO: 9400838 - DNA, 22 bp, Homo sapiens
tctggagcaacagagcaggaca

SEQ ID NO: 9400839 - DNA, 22 bp, Homo sapiens
tctggaggctctgagggtgagt

SEQ ID NO: 9400840 - DNA, 22 bp, Homo sapiens
tctggaggctctgagggtgagt

SEQ ID NO: 9400841 - DNA, 22 bp, Homo sapiens
tctggaggctctgagggtgagt

SEQ ID NO: 9400842 - DNA, 22 bp, Homo sapiens
tctggagggcccacatccacaa

SEQ ID NO: 9400843 - DNA, 22 bp, Homo sapiens
tctggaggggtttagagggaca

SEQ ID NO: 9400844 - DNA, 22 bp, Homo sapiens
tctggaggggtttagagggaca

SEQ ID NO: 9400845 - DNA, 22 bp, Homo sapiens
tctgctgctgcagctacactat

SEQ ID NO: 9400846 - DNA, 22 bp, Homo sapiens
tctgctggaaaaccagggaatt

SEQ ID NO: 9400847 - DNA, 22 bp, Homo sapiens
tctgctgtacttttggtctgtt

SEQ ID NO: 9400848 - DNA, 22 bp, Homo sapiens
tctgctgtaaagaatttctgcc

SEQ ID NO: 9400849 - DNA, 22 bp, Homo sapiens
tctgctggttccgaattaggcc

SEQ ID NO: 9400850 - DNA, 22 bp, Homo sapiens
tctgctggttccgaattaggcc

SEQ ID NO: 9400851 - DNA, 22 bp, Homo sapiens
tctgctggtgatgacctcataa

SEQ ID NO: 9400852 - DNA, 22 bp, Homo sapiens
tctgctggtcaaggctgggtcc

SEQ ID NO: 9400853 - DNA, 22 bp, Homo sapiens
tctggaagaacggggcatgctg

SEQ ID NO: 9400854 - DNA, 22 bp, Homo sapiens
tctggaagaacggggcatgctg

SEQ ID NO: 9400855 - DNA, 21 bp, Homo sapiens
tctggaagaaaaaagtattat

SEQ ID NO: 9400856 - DNA, 22 bp, Homo sapiens
tctgctgtgtccctggtctcct

SEQ ID NO: 9400857 - DNA, 22 bp, Homo sapiens
tctgctgtgtccctggtctcct

SEQ ID NO: 9400858 - DNA, 22 bp, Homo sapiens
tctgctgttcattcttttagct

SEQ ID NO: 9400859 - DNA, 22 bp, Homo sapiens
tctgctgttcattcttttagct

SEQ ID NO: 9400860 - DNA, 22 bp, Homo sapiens
tctgctgtgtccctggtctcct

SEQ ID NO: 9400861 - DNA, 22 bp, Homo sapiens
tctgctgtgaaaggtgaatatt

SEQ ID NO: 9400862 - DNA, 22 bp, Homo sapiens
tctgctgtgattctactagtgt

SEQ ID NO: 9400863 - DNA, 22 bp, Homo sapiens
tctgctgtgggtctatatttta

SEQ ID NO: 9400864 - DNA, 22 bp, Homo sapiens
tctgctgtgatttgctacctgt

SEQ ID NO: 9400865 - DNA, 22 bp, Homo sapiens
tctgctgtgatttgctacctgt

SEQ ID NO: 9400866 - DNA, 22 bp, Homo sapiens
tctgctgtctgattcccacttc

SEQ ID NO: 9400867 - DNA, 22 bp, Homo sapiens
tctgctgtctgattcccacttc

SEQ ID NO: 9400868 - DNA, 22 bp, Homo sapiens
tctgctgtcactcatttgcttc

SEQ ID NO: 9400869 - DNA, 22 bp, Homo sapiens
tctgctgtattaggttgaactg

SEQ ID NO: 9400870 - DNA, 22 bp, Homo sapiens
tctgctgtacttttggtctgtt

SEQ ID NO: 9400871 - DNA, 22 bp, Homo sapiens
tctgctgccatgcagagcagta

SEQ ID NO: 9400872 - DNA, 22 bp, Homo sapiens
tctgctgaacttgctgcccaga

SEQ ID NO: 9400873 - DNA, 22 bp, Homo sapiens
tctgctctgtggcttcagctaa

SEQ ID NO: 9400874 - DNA, 22 bp, Homo sapiens
tctgctctgtggcttcagctaa

SEQ ID NO: 9400875 - DNA, 22 bp, Homo sapiens
tctgctctgtactgcactggcc

SEQ ID NO: 9400876 - DNA, 22 bp, Homo sapiens
tctgctctgtactgcactggcc

SEQ ID NO: 9400877 - DNA, 22 bp, Homo sapiens
tctgctctgtggcttcagctaa

SEQ ID NO: 9400878 - DNA, 17 bp, Homo sapiens
tctgctctgccaatcca

SEQ ID NO: 9400879 - DNA, 22 bp, Homo sapiens
tctgctctgagagggccatcag

SEQ ID NO: 9400880 - DNA, 22 bp, Homo sapiens
tctgctctgggccagctattaa

SEQ ID NO: 9400881 - DNA, 22 bp, Homo sapiens
tctgctctgtactgcactggcc

SEQ ID NO: 9400882 - DNA, 22 bp, Homo sapiens
tctgctctgtactgcactggcc

SEQ ID NO: 9400883 - DNA, 22 bp, Homo sapiens
tctgctctagttgcttcctgcc

SEQ ID NO: 9400884 - DNA, 22 bp, Homo sapiens
tctgctctagttgcttcctgcc

SEQ ID NO: 9400885 - DNA, 22 bp, Homo sapiens
tctgctctccatacttccgcac

SEQ ID NO: 9400886 - DNA, 22 bp, Homo sapiens
tctgctctccatacttccgcac

SEQ ID NO: 9400887 - DNA, 22 bp, Homo sapiens
tctgctctgagagggccatcag

SEQ ID NO: 9400888 - DNA, 23 bp, Homo sapiens
tctgctctgaagttcggctgagc

SEQ ID NO: 9400889 - DNA, 22 bp, Homo sapiens
tctggactaatattctggctgc

SEQ ID NO: 9400890 - DNA, 22 bp, Homo sapiens
tctggactcgggtgggtgacac

SEQ ID NO: 9400891 - DNA, 22 bp, Homo sapiens
tctggacatcctggagaatgac

SEQ ID NO: 9400892 - DNA, 22 bp, Homo sapiens
tctggacagagcttcaggagct

SEQ ID NO: 9400893 - DNA, 22 bp, Homo sapiens
tctggacagtagagcaatgatt

SEQ ID NO: 9400894 - DNA, 22 bp, Homo sapiens
tctggaattgctgtgtgagttc

SEQ ID NO: 9400895 - DNA, 22 bp, Homo sapiens
tctggaattctcaagtcctgga

SEQ ID NO: 9400896 - DNA, 22 bp, Homo sapiens
tctggaattaaactcaggagac

SEQ ID NO: 9400897 - DNA, 23 bp, Homo sapiens
tctggaatggtactcactggagt

SEQ ID NO: 9400898 - DNA, 22 bp, Homo sapiens
tctggaataggtcctgagtatt

SEQ ID NO: 9400899 - DNA, 16 bp, Homo sapiens
tctggaagtggagggg

SEQ ID NO: 9400900 - DNA, 22 bp, Homo sapiens
tctggaagtgatgttcatagtg

SEQ ID NO: 9400901 - DNA, 22 bp, Homo sapiens
tctggaagtgatgttcatagtg

SEQ ID NO: 9400902 - DNA, 22 bp, Homo sapiens
tctggaagtcccttgatgccag

SEQ ID NO: 9400903 - DNA, 19 bp, Homo sapiens
tctggaagtgggggattgc

SEQ ID NO: 9400904 - DNA, 19 bp, Homo sapiens
tctggaagtgggggattgc

SEQ ID NO: 9400905 - DNA, 22 bp, Homo sapiens
tctggaagttagaggaggaaag

SEQ ID NO: 9400906 - DNA, 22 bp, Homo sapiens
tctggaagttagaggaggaaag

SEQ ID NO: 9400907 - DNA, 22 bp, Homo sapiens
tctggaataggacaaaaccaaa

SEQ ID NO: 9400908 - DNA, 22 bp, Homo sapiens
tctggaaggaacccttagagga

SEQ ID NO: 9400909 - DNA, 22 bp, Homo sapiens
tctggaagctggagtccaggaa

SEQ ID NO: 9400910 - DNA, 22 bp, Homo sapiens
tctggaagctggagtccaggaa

SEQ ID NO: 9400911 - DNA, 22 bp, Homo sapiens
tctggaagctggagtccaggaa

SEQ ID NO: 9400912 - DNA, 22 bp, Homo sapiens
tctggaagacagtgagcccgct

SEQ ID NO: 9400913 - DNA, 22 bp, Homo sapiens
tctggaagaggtgggttgggag

SEQ ID NO: 9400914 - DNA, 22 bp, Homo sapiens
tctggaagacattaatttggtt

SEQ ID NO: 9400915 - DNA, 22 bp, Homo sapiens
tctggaaggaagagctgagtcc

SEQ ID NO: 9400916 - DNA, 22 bp, Homo sapiens
tctggaaggaacccttagagga

SEQ ID NO: 9400917 - DNA, 22 bp, Homo sapiens
tctggaaggttggctcccagtt

SEQ ID NO: 9400918 - DNA, 22 bp, Homo sapiens
tctggaagtcaccttagttcct

SEQ ID NO: 9400919 - DNA, 22 bp, Homo sapiens
tctggaagtcaccttagttcct

SEQ ID NO: 9400920 - DNA, 22 bp, Homo sapiens
tctggaaggggatctgtggtca

SEQ ID NO: 9400921 - DNA, 22 bp, Homo sapiens
tctggaaggcttcaaggtctaa

SEQ ID NO: 9400922 - DNA, 22 bp, Homo sapiens
tctggaaggggatctgtggtca

SEQ ID NO: 9400923 - DNA, 22 bp, Homo sapiens
tctggaaggggatctgtggtca

SEQ ID NO: 9400924 - DNA, 22 bp, Homo sapiens
tctggagaagcccagggagctg

SEQ ID NO: 9400925 - DNA, 22 bp, Homo sapiens
tctggagaagcccagggagctg

SEQ ID NO: 9400926 - DNA, 22 bp, Homo sapiens
tctggagaagcagtgagagtca

SEQ ID NO: 9400927 - DNA, 22 bp, Homo sapiens
tctggagaatctgtcagtgtgg

SEQ ID NO: 9400928 - DNA, 22 bp, Homo sapiens
tctggagaaggaagagtctttg

SEQ ID NO: 9400929 - DNA, 22 bp, Homo sapiens
tctggagaaggaagagtctttg

SEQ ID NO: 9400930 - DNA, 22 bp, Homo sapiens
tctggagaagaaacttgctctg

SEQ ID NO: 9400931 - DNA, 22 bp, Homo sapiens
tctggagaacttgcaagaggat

SEQ ID NO: 9400932 - DNA, 22 bp, Homo sapiens
tctggagaacttgcaagaggat

SEQ ID NO: 9400933 - DNA, 22 bp, Homo sapiens
tctggagaagaaacttgctctg

SEQ ID NO: 9400934 - DNA, 22 bp, Homo sapiens
tctggagaagcagtgagagtca

SEQ ID NO: 9400935 - DNA, 22 bp, Homo sapiens
tctggagaaagttgagtttgtg

SEQ ID NO: 9400936 - DNA, 22 bp, Homo sapiens
tctggagaaagttgagtttgtg

SEQ ID NO: 9400937 - DNA, 22 bp, Homo sapiens
tctggactttcggtgcaagagt

SEQ ID NO: 9400938 - DNA, 22 bp, Homo sapiens
tctggagataagcagcaatgaa

SEQ ID NO: 9400939 - DNA, 22 bp, Homo sapiens
tctggagataagcagcaatgaa

SEQ ID NO: 9400940 - DNA, 22 bp, Homo sapiens
tctggagataagacagacagat

SEQ ID NO: 9400941 - DNA, 22 bp, Homo sapiens
tctggagagtcacagtgccaga

SEQ ID NO: 9400942 - DNA, 22 bp, Homo sapiens
tctggagaggggcctagaattt

SEQ ID NO: 9400943 - DNA, 22 bp, Homo sapiens
tctggagagtcctgctcacgtc

SEQ ID NO: 9400944 - DNA, 22 bp, Homo sapiens
tctggagagtcacagtgccaga

SEQ ID NO: 9400945 - DNA, 22 bp, Homo sapiens
tctggagagtcacagtgccaga

SEQ ID NO: 9400946 - DNA, 22 bp, Homo sapiens
tctggagaggggcctagaattt

SEQ ID NO: 9400947 - DNA, 22 bp, Homo sapiens
tctggagaggaggatgtggaca

SEQ ID NO: 9400948 - DNA, 22 bp, Homo sapiens
tctggagaggaggatgtggaca

SEQ ID NO: 9400949 - DNA, 22 bp, Homo sapiens
tctggagagcagatgcctctgg

SEQ ID NO: 9400950 - DNA, 22 bp, Homo sapiens
tctggagacctagccctgttgt

SEQ ID NO: 9400951 - DNA, 22 bp, Homo sapiens
tctggagacctgcatttatatt

SEQ ID NO: 9400952 - DNA, 22 bp, Homo sapiens
tctggagagatcttccacaaca

SEQ ID NO: 9400953 - DNA, 23 bp, Homo sapiens
tctgcaagataatgaagatgata

SEQ ID NO: 9400954 - DNA, 22 bp, Homo sapiens
tctgcaagatcattaaagcaga

SEQ ID NO: 9400955 - DNA, 23 bp, Homo sapiens
tctgcaagataatgaagatgata

SEQ ID NO: 9400956 - DNA, 22 bp, Homo sapiens
tctgcaagagcttcaaggtaga

SEQ ID NO: 9400957 - DNA, 22 bp, Homo sapiens
tctgcaacagtgccctgtaaat

SEQ ID NO: 9400958 - DNA, 22 bp, Homo sapiens
tctgcaacattcctctccccac

SEQ ID NO: 9400959 - DNA, 22 bp, Homo sapiens
tctgcaagctcagttctgactt

SEQ ID NO: 9400960 - DNA, 22 bp, Homo sapiens
tctgcaagctaaggaagcatct

SEQ ID NO: 9400961 - DNA, 22 bp, Homo sapiens
tctgcaagatggtcttagaggt

SEQ ID NO: 9400962 - DNA, 22 bp, Homo sapiens
tctgcaagcgtcacatgattct

SEQ ID NO: 9400963 - DNA, 22 bp, Homo sapiens
tctgcaaaagtgttcataaaga

SEQ ID NO: 9400964 - DNA, 22 bp, Homo sapiens
tctgatttctcttgtggatgct

SEQ ID NO: 9400965 - DNA, 22 bp, Homo sapiens
tctgcaaatattagcttagaca

SEQ ID NO: 9400966 - DNA, 22 bp, Homo sapiens
tctgattccagtgaccctagga

SEQ ID NO: 9400967 - DNA, 22 bp, Homo sapiens
tctgattcattcatgtgcacca

SEQ ID NO: 9400968 - DNA, 22 bp, Homo sapiens
tctgatgttgtgacatcacttc

SEQ ID NO: 9400969 - DNA, 22 bp, Homo sapiens
tctgatgttgtgacatcacttc

SEQ ID NO: 9400970 - DNA, 21 bp, Homo sapiens
tctgatgtgtttaatggtggg

SEQ ID NO: 9400971 - DNA, 22 bp, Homo sapiens
tctgatgtgtttaagaaagaag

SEQ ID NO: 9400972 - DNA, 22 bp, Homo sapiens
tctgatgtctgaaatgctcttg

SEQ ID NO: 9400973 - DNA, 22 bp, Homo sapiens
tctgatgtggcagctgcatcta

SEQ ID NO: 9400974 - DNA, 22 bp, Homo sapiens
tctgatgttgtgacatcacttc

SEQ ID NO: 9400975 - DNA, 22 bp, Homo sapiens
tctgatgttgcttctgcagaac

SEQ ID NO: 9400976 - DNA, 23 bp, Homo sapiens
tctgatgttctcttatgctgtag

SEQ ID NO: 9400977 - DNA, 21 bp, Homo sapiens
tctgatggtagatgagatgtg

SEQ ID NO: 9400978 - DNA, 21 bp, Homo sapiens
tctgatggtagatgagatgtg

SEQ ID NO: 9400979 - DNA, 21 bp, Homo sapiens
tctgatggtagatgagatgtg

SEQ ID NO: 9400980 - DNA, 22 bp, Homo sapiens
tctgaggttaatcctgctgcat

SEQ ID NO: 9400981 - DNA, 22 bp, Homo sapiens
tctgatgcaatgtaagtcttgg

SEQ ID NO: 9400982 - DNA, 22 bp, Homo sapiens
tctgaggtcattccaaggacat

SEQ ID NO: 9400983 - DNA, 22 bp, Homo sapiens
tctgaggtcagtgctgcagtta

SEQ ID NO: 9400984 - DNA, 22 bp, Homo sapiens
tctgaggtctatgactttgctt

SEQ ID NO: 9400985 - DNA, 22 bp, Homo sapiens
tctgaggtcctgtgatttctct

SEQ ID NO: 9400986 - DNA, 23 bp, Homo sapiens
tctgaggtccaccagtttgcaga

SEQ ID NO: 9400987 - DNA, 22 bp, Homo sapiens
tctgaggtctcatgacttgcat

SEQ ID NO: 9400988 - DNA, 17 bp, Homo sapiens
tctgaggtgaggatgca

SEQ ID NO: 9400989 - DNA, 19 bp, Homo sapiens
tctgaggtggaactggggg

SEQ ID NO: 9400990 - DNA, 22 bp, Homo sapiens
tctgaggtggacgatggagcct

SEQ ID NO: 9400991 - DNA, 22 bp, Homo sapiens
tctgaggtgtagctgggcttca

SEQ ID NO: 9400992 - DNA, 23 bp, Homo sapiens
tctgaggtggctcttgctttgaa

SEQ ID NO: 9400993 - DNA, 22 bp, Homo sapiens
tctgaggcctgaagcagcagag

SEQ ID NO: 9400994 - DNA, 22 bp, Homo sapiens
tctgaggccttcagcatgaatc

SEQ ID NO: 9400995 - DNA, 22 bp, Homo sapiens
tctgaggccctgcaggcagtgt

SEQ ID NO: 9400996 - DNA, 22 bp, Homo sapiens
tctgaggcctagagaggggctt

SEQ ID NO: 9400997 - DNA, 17 bp, Homo sapiens
tctgaggcctctaggag

SEQ ID NO: 9400998 - DNA, 22 bp, Homo sapiens
tctgaggccttggcagctaagg

SEQ ID NO: 9400999 - DNA, 22 bp, Homo sapiens
tctgaggccttgggacagaagt

SEQ ID NO: 9401000 - DNA, 22 bp, Homo sapiens
tctgaggctaagagacagaggc

SEQ ID NO: 9401001 - DNA, 22 bp, Homo sapiens
tctgaggctaagagacagaggc

SEQ ID NO: 9401002 - DNA, 22 bp, Homo sapiens
tctgaggccctaccctgagcct

SEQ ID NO: 9401003 - DNA, 22 bp, Homo sapiens
tctgaggaattctgcagtgaga

SEQ ID NO: 9401004 - DNA, 22 bp, Homo sapiens
tctgaggacaaactgcatgctg

SEQ ID NO: 9401005 - DNA, 18 bp, Homo sapiens
tctgaggaatggaagagc

SEQ ID NO: 9401006 - DNA, 18 bp, Homo sapiens
tctgaggaatggaagagc

SEQ ID NO: 9401007 - DNA, 22 bp, Homo sapiens
tctgaggaataagaaggaagtg

SEQ ID NO: 9401008 - DNA, 22 bp, Homo sapiens
tctgaggaatcttgacacattt

SEQ ID NO: 9401009 - DNA, 22 bp, Homo sapiens
tctgaggaaaagttcttgtcac

SEQ ID NO: 9401010 - DNA, 22 bp, Homo sapiens
tctgaggaaagagagtgggatg

SEQ ID NO: 9401011 - DNA, 22 bp, Homo sapiens
tctgaggaaaagaggaggtagc

SEQ ID NO: 9401012 - DNA, 22 bp, Homo sapiens
tctgaggaagcagcaggaagtg

SEQ ID NO: 9401013 - DNA, 22 bp, Homo sapiens
tctgaggaaagagagtgggatg

SEQ ID NO: 9401014 - DNA, 22 bp, Homo sapiens
tctgaggaaagagagtgggatg

SEQ ID NO: 9401015 - DNA, 22 bp, Homo sapiens
tctgagcttctgcctgctgcaa

SEQ ID NO: 9401016 - DNA, 22 bp, Homo sapiens
tctgagctttagctgggatttt

SEQ ID NO: 9401017 - DNA, 22 bp, Homo sapiens
tctgagctttagctgggatttt

SEQ ID NO: 9401018 - DNA, 22 bp, Homo sapiens
tctgagctttcttgtgctcaag

SEQ ID NO: 9401019 - DNA, 22 bp, Homo sapiens
tctgagctttcttgtgctcaag

SEQ ID NO: 9401020 - DNA, 22 bp, Homo sapiens
tctgagcttttattatcaacct

SEQ ID NO: 9401021 - DNA, 22 bp, Homo sapiens
tctgaggctgtctctgggctcc

SEQ ID NO: 9401022 - DNA, 22 bp, Homo sapiens
tctgaggcttcagactgtactg

SEQ ID NO: 9401023 - DNA, 19 bp, Homo sapiens
tctgaggcttctccccttg

SEQ ID NO: 9401024 - DNA, 19 bp, Homo sapiens
tctgagggagcacgaaggc

SEQ ID NO: 9401025 - DNA, 22 bp, Homo sapiens
tctgaggctgaatggactccgt

SEQ ID NO: 9401026 - DNA, 22 bp, Homo sapiens
tctgaggctatgttcaggctaa

SEQ ID NO: 9401027 - DNA, 20 bp, Homo sapiens
tctgaggctgagcccagcgt

SEQ ID NO: 9401028 - DNA, 20 bp, Homo sapiens
tctgaggctgagctctactt

SEQ ID NO: 9401029 - DNA, 22 bp, Homo sapiens
tctgaggctgcatctatgtgac

SEQ ID NO: 9401030 - DNA, 22 bp, Homo sapiens
tctgaggctgcatctatgtgac

SEQ ID NO: 9401031 - DNA, 22 bp, Homo sapiens
tctgaggtcacagatttcaaga

SEQ ID NO: 9401032 - DNA, 22 bp, Homo sapiens
tctgaggtaccagctggtttat

SEQ ID NO: 9401033 - DNA, 22 bp, Homo sapiens
tctgagggttgtagagagggac

SEQ ID NO: 9401034 - DNA, 22 bp, Homo sapiens
tctgagggtgggagaaggagct

SEQ ID NO: 9401035 - DNA, 22 bp, Homo sapiens
tctgaggggctggaagggctgc

SEQ ID NO: 9401036 - DNA, 19 bp, Homo sapiens
tctgagggtccagatgcat

SEQ ID NO: 9401037 - DNA, 22 bp, Homo sapiens
tctgagggctgtactatgcacg

SEQ ID NO: 9401038 - DNA, 22 bp, Homo sapiens
tctgacattagattaattggaa

SEQ ID NO: 9401039 - DNA, 22 bp, Homo sapiens
tctgacattagattaattggaa

SEQ ID NO: 9401040 - DNA, 22 bp, Homo sapiens
tctgacagttatataagcacca

SEQ ID NO: 9401041 - DNA, 22 bp, Homo sapiens
tctgacagggccaaacatgaca

SEQ ID NO: 9401042 - DNA, 22 bp, Homo sapiens
tctgaattttgatgtgcattga

SEQ ID NO: 9401043 - DNA, 19 bp, Homo sapiens
tctgacagccccagtcaac

SEQ ID NO: 9401044 - DNA, 22 bp, Homo sapiens
tctgacagctccaggcagcaat

SEQ ID NO: 9401045 - DNA, 22 bp, Homo sapiens
tctgacttggcgctcttgtctt

SEQ ID NO: 9401046 - DNA, 22 bp, Homo sapiens
tctgacttcctccacatctgtt

SEQ ID NO: 9401047 - DNA, 22 bp, Homo sapiens
tctgacttatttgtccttggtg

SEQ ID NO: 9401048 - DNA, 22 bp, Homo sapiens
tctgactcccatattccacttc

SEQ ID NO: 9401049 - DNA, 22 bp, Homo sapiens
tctgaccaggctcagccaaggc

SEQ ID NO: 9401050 - DNA, 22 bp, Homo sapiens
tctgacattttgagaatgacat

SEQ ID NO: 9401051 - DNA, 22 bp, Homo sapiens
tctgaccacagacaacctgcta

SEQ ID NO: 9401052 - DNA, 17 bp, Homo sapiens
tctgagaaaggagaatc

SEQ ID NO: 9401053 - DNA, 22 bp, Homo sapiens
tctgagaagctagaggacaaag

SEQ ID NO: 9401054 - DNA, 22 bp, Homo sapiens
tctgagaagggtaggctccatt

SEQ ID NO: 9401055 - DNA, 22 bp, Homo sapiens
tctgagaaggaagctctgtgta

SEQ ID NO: 9401056 - DNA, 22 bp, Homo sapiens
tctgagaagcgtgtctctgttt

SEQ ID NO: 9401057 - DNA, 22 bp, Homo sapiens
tctgagaagctagaggacaaag

SEQ ID NO: 9401058 - DNA, 22 bp, Homo sapiens
tctgagccacagatgtcctgtt

SEQ ID NO: 9401059 - DNA, 22 bp, Homo sapiens
tctgagccacctgccagtgctg

SEQ ID NO: 9401060 - DNA, 22 bp, Homo sapiens
tctgagcccagtgagtctcgca

SEQ ID NO: 9401061 - DNA, 22 bp, Homo sapiens
tctgagccataagagtacagga

SEQ ID NO: 9401062 - DNA, 22 bp, Homo sapiens
tctgagcactgggcagtcggtg

SEQ ID NO: 9401063 - DNA, 22 bp, Homo sapiens
tctgagctgctaggtatgcatt

SEQ ID NO: 9401064 - DNA, 22 bp, Homo sapiens
tctgagctgggcacagaaggcg

SEQ ID NO: 9401065 - DNA, 22 bp, Homo sapiens
tctgagctgggggcctggcatg

SEQ ID NO: 9401066 - DNA, 22 bp, Homo sapiens
tctgagctgtaagtagacaagg

SEQ ID NO: 9401067 - DNA, 22 bp, Homo sapiens
tctgagctgggtcttgacagct

SEQ ID NO: 9401068 - DNA, 22 bp, Homo sapiens
tctgagctgggtcttgacagct

SEQ ID NO: 9401069 - DNA, 22 bp, Homo sapiens
tctgagctgtggccattcttcc

SEQ ID NO: 9401070 - DNA, 22 bp, Homo sapiens
tctgagctgtggccattcttcc

SEQ ID NO: 9401071 - DNA, 22 bp, Homo sapiens
tctgagctgtaagtagacaagg

SEQ ID NO: 9401072 - DNA, 23 bp, Homo sapiens
tctgagctgtcttttcagcagaa

SEQ ID NO: 9401073 - DNA, 22 bp, Homo sapiens
tctgagctgtgagttgcttagg

SEQ ID NO: 9401074 - DNA, 23 bp, Homo sapiens
tctgagctgtcttttcagcagaa

SEQ ID NO: 9401075 - DNA, 22 bp, Homo sapiens
tctgagcttactcagggataca

SEQ ID NO: 9401076 - DNA, 22 bp, Homo sapiens
tctgagcttactcagggataca

SEQ ID NO: 9401077 - DNA, 22 bp, Homo sapiens
tctgagcttccctctgaggcag

SEQ ID NO: 9401078 - DNA, 21 bp, Homo sapiens
tctgagctgagtcctctaggt

SEQ ID NO: 9401079 - DNA, 19 bp, Homo sapiens
tctgagctgatatgacatt

SEQ ID NO: 9401080 - DNA, 22 bp, Homo sapiens
tctgagctgcagagtggggtgg

SEQ ID NO: 9401081 - DNA, 22 bp, Homo sapiens
tctgagctgcccctttactttg

SEQ ID NO: 9401082 - DNA, 22 bp, Homo sapiens
tctgagctctatctgtgggaat

SEQ ID NO: 9401083 - DNA, 22 bp, Homo sapiens
tctgagctctatctgtgggaat

SEQ ID NO: 9401084 - DNA, 21 bp, Homo sapiens
tctgagctgagtcctctaggt

SEQ ID NO: 9401085 - DNA, 22 bp, Homo sapiens
tctgagctcaagtgacagttag

SEQ ID NO: 9401086 - DNA, 22 bp, Homo sapiens
tctgagctacgatgcctgtcac

SEQ ID NO: 9401087 - DNA, 22 bp, Homo sapiens
tctgagctatgtaagacttgga

SEQ ID NO: 9401088 - DNA, 22 bp, Homo sapiens
tctgagctatccagatagtatt

SEQ ID NO: 9401089 - DNA, 22 bp, Homo sapiens
tctgagctagtgatttataaga

SEQ ID NO: 9401090 - DNA, 23 bp, Homo sapiens
tctgccagtgtgtgccaggagcc

SEQ ID NO: 9401091 - DNA, 22 bp, Homo sapiens
tctgccagtgccagagtacata

SEQ ID NO: 9401092 - DNA, 22 bp, Homo sapiens
tctgccagtattcacggcccgt

SEQ ID NO: 9401093 - DNA, 22 bp, Homo sapiens
tctgccagtattcacggcccgt

SEQ ID NO: 9401094 - DNA, 22 bp, Homo sapiens
tctgccaggcctgcttccgggg

SEQ ID NO: 9401095 - DNA, 22 bp, Homo sapiens
tctgccaggcttggtgctagat

SEQ ID NO: 9401096 - DNA, 22 bp, Homo sapiens
tctgccaggtggggagaggcca

SEQ ID NO: 9401097 - DNA, 16 bp, Homo sapiens
tctgccagggacaggc

SEQ ID NO: 9401098 - DNA, 22 bp, Homo sapiens
tctgccaggccacacagggcac

SEQ ID NO: 9401099 - DNA, 22 bp, Homo sapiens
tctgccaggccacacagggcac

SEQ ID NO: 9401100 - DNA, 22 bp, Homo sapiens
tctgccatcaagatgctctggc

SEQ ID NO: 9401101 - DNA, 22 bp, Homo sapiens
tctgccagtttatagacaagcc

SEQ ID NO: 9401102 - DNA, 22 bp, Homo sapiens
tctgccagtttatagacaagcc

SEQ ID NO: 9401103 - DNA, 22 bp, Homo sapiens
tctgccagtttatagacaagcc

SEQ ID NO: 9401104 - DNA, 23 bp, Homo sapiens
tctgccagttccttgatcatgga

SEQ ID NO: 9401105 - DNA, 22 bp, Homo sapiens
tctgccagttagaaactggtta

SEQ ID NO: 9401106 - DNA, 18 bp, Homo sapiens
tctgccatgtgaggacac

SEQ ID NO: 9401107 - DNA, 19 bp, Homo sapiens
tctgcccacaagaaaggga

SEQ ID NO: 9401108 - DNA, 22 bp, Homo sapiens
tctgcccaaggctgtcactaga

SEQ ID NO: 9401109 - DNA, 22 bp, Homo sapiens
tctgcccacagcctcctgtcca

SEQ ID NO: 9401110 - DNA, 21 bp, Homo sapiens
tctgcccacactggccactgc

SEQ ID NO: 9401111 - DNA, 22 bp, Homo sapiens
tctgcaggctctagatgaggtt

SEQ ID NO: 9401112 - DNA, 22 bp, Homo sapiens
tctgcaggctgtacaggaagca

SEQ ID NO: 9401113 - DNA, 22 bp, Homo sapiens
tctgcaggcttataggatgggt

SEQ ID NO: 9401114 - DNA, 22 bp, Homo sapiens
tctgcaggcttggagtggcagc

SEQ ID NO: 9401115 - DNA, 22 bp, Homo sapiens
tctgcagggatgtgaggggtga

SEQ ID NO: 9401116 - DNA, 22 bp, Homo sapiens
tctgcaggcttggagtggcagc

SEQ ID NO: 9401117 - DNA, 22 bp, Homo sapiens
tctgcaggcttggagtggcagc

SEQ ID NO: 9401118 - DNA, 22 bp, Homo sapiens
tctgcaggcttataggatgggt

SEQ ID NO: 9401119 - DNA, 22 bp, Homo sapiens
tctgcagggtcccagcctcagc

SEQ ID NO: 9401120 - DNA, 22 bp, Homo sapiens
tctgcaggtagagctcaggaat

SEQ ID NO: 9401121 - DNA, 22 bp, Homo sapiens
tctgcagggtcccagcctcagc

SEQ ID NO: 9401122 - DNA, 22 bp, Homo sapiens
tctgcaggtaagcgttcttgga

SEQ ID NO: 9401123 - DNA, 22 bp, Homo sapiens
tctgcagggcccttggctcctg

SEQ ID NO: 9401124 - DNA, 17 bp, Homo sapiens
tctgcagggggccgtgt

SEQ ID NO: 9401125 - DNA, 17 bp, Homo sapiens
tctgcagggggccgtgt

SEQ ID NO: 9401126 - DNA, 22 bp, Homo sapiens
tctgcagggcccttggctcctg

SEQ ID NO: 9401127 - DNA, 22 bp, Homo sapiens
tctgcagggcccttggctcctg

SEQ ID NO: 9401128 - DNA, 22 bp, Homo sapiens
tctgcagggatgtgaggggtga

SEQ ID NO: 9401129 - DNA, 22 bp, Homo sapiens
tctgcaggtcacgctccagcct

SEQ ID NO: 9401130 - DNA, 22 bp, Homo sapiens
tctgcaggtcacgctccagcct

SEQ ID NO: 9401131 - DNA, 22 bp, Homo sapiens
tctgcaggtgggcccctagaat

SEQ ID NO: 9401132 - DNA, 22 bp, Homo sapiens
tctgcaggtcacgctccagcct

SEQ ID NO: 9401133 - DNA, 22 bp, Homo sapiens
tctgcaggtgttggaagggtca

SEQ ID NO: 9401134 - DNA, 22 bp, Homo sapiens
tctgcatgatgaacaaatgagc

SEQ ID NO: 9401135 - DNA, 22 bp, Homo sapiens
tctgcatgatgaacaaatgagc

SEQ ID NO: 9401136 - DNA, 19 bp, Homo sapiens
tctgcatggcaggaagaga

SEQ ID NO: 9401137 - DNA, 22 bp, Homo sapiens
tctgcattacatgccatagaca

SEQ ID NO: 9401138 - DNA, 22 bp, Homo sapiens
tctgcatggagaggagatgcta

SEQ ID NO: 9401139 - DNA, 22 bp, Homo sapiens
tctgcactgggagcatgtctgg

SEQ ID NO: 9401140 - DNA, 22 bp, Homo sapiens
tctgcactcctgtttcacctgg

SEQ ID NO: 9401141 - DNA, 18 bp, Homo sapiens
tctgcactcctgagagag

SEQ ID NO: 9401142 - DNA, 21 bp, Homo sapiens
tctgcaccccagcctgagtga

SEQ ID NO: 9401143 - DNA, 22 bp, Homo sapiens
tctgcagatttatcagcagctg

SEQ ID NO: 9401144 - DNA, 20 bp, Homo sapiens
tctgcagcacttgacaatgt

SEQ ID NO: 9401145 - DNA, 22 bp, Homo sapiens
tctgcagccagaggcatgaaaa

SEQ ID NO: 9401146 - DNA, 22 bp, Homo sapiens
tctgcaagtgacccgggcccag

SEQ ID NO: 9401147 - DNA, 19 bp, Homo sapiens
tctgcaagtgtcagaggcg

SEQ ID NO: 9401148 - DNA, 22 bp, Homo sapiens
tctgcaagtttatcacttggga

SEQ ID NO: 9401149 - DNA, 22 bp, Homo sapiens
tctgcaagggcacagccaaccc

SEQ ID NO: 9401150 - DNA, 22 bp, Homo sapiens
tctgcaagtagatgacagtgag

SEQ ID NO: 9401151 - DNA, 22 bp, Homo sapiens
tctgcaaggttcaggaaacctt

SEQ ID NO: 9401152 - DNA, 22 bp, Homo sapiens
tctgcaaggggttctttaggcc

SEQ ID NO: 9401153 - DNA, 22 bp, Homo sapiens
tctgcacaaaactgtcgcagaa

SEQ ID NO: 9401154 - DNA, 22 bp, Homo sapiens
tctgcacaggcgtaggttgact

SEQ ID NO: 9401155 - DNA, 22 bp, Homo sapiens
tctgcacatgtagtaaatatta

SEQ ID NO: 9401156 - DNA, 22 bp, Homo sapiens
tctgcacattttaccaatactc

SEQ ID NO: 9401157 - DNA, 22 bp, Homo sapiens
tctgcaggaaaaaagtgcctgg

SEQ ID NO: 9401158 - DNA, 22 bp, Homo sapiens
tctgcagcttcttgccagagag

SEQ ID NO: 9401159 - DNA, 22 bp, Homo sapiens
tctgcagcttactttcacatga

SEQ ID NO: 9401160 - DNA, 22 bp, Homo sapiens
tctgcagcttgcacaggcaggc

SEQ ID NO: 9401161 - DNA, 18 bp, Homo sapiens
tctgcaggacctcagggc

SEQ ID NO: 9401162 - DNA, 22 bp, Homo sapiens
tctgcaggaagctggcggctga

SEQ ID NO: 9401163 - DNA, 22 bp, Homo sapiens
tctgcaggagagtgccctagag

SEQ ID NO: 9401164 - DNA, 22 bp, Homo sapiens
tctgcaggagagtgccctagag

SEQ ID NO: 9401165 - DNA, 18 bp, Homo sapiens
tctgcaggacctcagggc

SEQ ID NO: 9401166 - DNA, 22 bp, Homo sapiens
tctgcaggactgaggcctgttt

SEQ ID NO: 9401167 - DNA, 22 bp, Homo sapiens
tctgcaggagcagggcgtggag

SEQ ID NO: 9401168 - DNA, 22 bp, Homo sapiens
tctgcaggagcagggcgtggag

SEQ ID NO: 9401169 - DNA, 22 bp, Homo sapiens
tctgcaggaggctggctgcagg

SEQ ID NO: 9401170 - DNA, 22 bp, Homo sapiens
tctgcaggaggctggctgcagg

SEQ ID NO: 9401171 - DNA, 22 bp, Homo sapiens
tctgcaggaggctggctgcagg

SEQ ID NO: 9401172 - DNA, 22 bp, Homo sapiens
tctgcaggatcagagccagagg

SEQ ID NO: 9401173 - DNA, 22 bp, Homo sapiens
tctgcaggatcagagccagagg

SEQ ID NO: 9401174 - DNA, 22 bp, Homo sapiens
tctgcaggatggatgctcagaa

SEQ ID NO: 9401175 - DNA, 22 bp, Homo sapiens
tctgcaggcctcgacaaggcca

SEQ ID NO: 9401176 - DNA, 22 bp, Homo sapiens
tctgcaggctctagatgaggtt

SEQ ID NO: 9401177 - DNA, 22 bp, Homo sapiens
tctgcaggatggatgctcagaa

SEQ ID NO: 9401178 - DNA, 22 bp, Homo sapiens
tctgcaggcatttttggttgtc

SEQ ID NO: 9401179 - DNA, 22 bp, Homo sapiens
tctgcaggatgcaaagtgtaca

SEQ ID NO: 9401180 - DNA, 22 bp, Homo sapiens
tctgcaggatgcaaagtgtaca

SEQ ID NO: 9401181 - DNA, 22 bp, Homo sapiens
tctgctcagtgcttatctctaa

SEQ ID NO: 9401182 - DNA, 22 bp, Homo sapiens
tctgctcaggttacctagctag

SEQ ID NO: 9401183 - DNA, 22 bp, Homo sapiens
tctgctctagttgcttcctgcc

SEQ ID NO: 9401184 - DNA, 22 bp, Homo sapiens
tctgctcataccccatggtttc

SEQ ID NO: 9401185 - DNA, 22 bp, Homo sapiens
tctgctcaggttacctagctag

SEQ ID NO: 9401186 - DNA, 22 bp, Homo sapiens
tctgctcaggttacctagctag

SEQ ID NO: 9401187 - DNA, 22 bp, Homo sapiens
tctgctcagccgatctgctccg

SEQ ID NO: 9401188 - DNA, 22 bp, Homo sapiens
tctgctcagccgatctgctccg

SEQ ID NO: 9401189 - DNA, 22 bp, Homo sapiens
tctgctcagggagggtcactac

SEQ ID NO: 9401190 - DNA, 22 bp, Homo sapiens
tctgctcagggagggtcactac

SEQ ID NO: 9401191 - DNA, 22 bp, Homo sapiens
tctgctcagcatccctctgaga

SEQ ID NO: 9401192 - DNA, 20 bp, Homo sapiens
tctgctcagccctcagtggc

SEQ ID NO: 9401193 - DNA, 22 bp, Homo sapiens
tctgctcacgtgtattctccat

SEQ ID NO: 9401194 - DNA, 22 bp, Homo sapiens
tctgctcaccctcagctgatgc

SEQ ID NO: 9401195 - DNA, 22 bp, Homo sapiens
tctgctcagcatccctctgaga

SEQ ID NO: 9401196 - DNA, 22 bp, Homo sapiens
tctgccttgatggcattgagaa

SEQ ID NO: 9401197 - DNA, 22 bp, Homo sapiens
tctgccttgaggtcctcagctc

SEQ ID NO: 9401198 - DNA, 22 bp, Homo sapiens
tctgccttgaggtcctcagctc

SEQ ID NO: 9401199 - DNA, 22 bp, Homo sapiens
tctgccttcttttagtcatctt

SEQ ID NO: 9401200 - DNA, 22 bp, Homo sapiens
tctgccttctatcttttgtctg

SEQ ID NO: 9401201 - DNA, 22 bp, Homo sapiens
tctgccttcgctgctccctgaa

SEQ ID NO: 9401202 - DNA, 22 bp, Homo sapiens
tctgccttcgctgctccctgaa

SEQ ID NO: 9401203 - DNA, 22 bp, Homo sapiens
tctgcctgttcaagtcttctag

SEQ ID NO: 9401204 - DNA, 22 bp, Homo sapiens
tctgcctgttcaagtcttctag

SEQ ID NO: 9401205 - DNA, 22 bp, Homo sapiens
tctgcctgtggtggaggaagtt

SEQ ID NO: 9401206 - DNA, 22 bp, Homo sapiens
tctgcctgtggtggaggaagtt

SEQ ID NO: 9401207 - DNA, 22 bp, Homo sapiens
tctgcctgtggatacatgctct

SEQ ID NO: 9401208 - DNA, 22 bp, Homo sapiens
tctgcctgtgctgtgttttcat

SEQ ID NO: 9401209 - DNA, 22 bp, Homo sapiens
tctgccttcgctgctccctgaa

SEQ ID NO: 9401210 - DNA, 22 bp, Homo sapiens
tctgccttccccataatctgat

SEQ ID NO: 9401211 - DNA, 22 bp, Homo sapiens
tctgccttccccataatctgat

SEQ ID NO: 9401212 - DNA, 20 bp, Homo sapiens
tctgccttagggggagcctc

SEQ ID NO: 9401213 - DNA, 22 bp, Homo sapiens
tctgccttagcaattgtcaagg

SEQ ID NO: 9401214 - DNA, 20 bp, Homo sapiens
tctgccttatgaccttcgcc

SEQ ID NO: 9401215 - DNA, 22 bp, Homo sapiens
tctgcctgttcccgattccatg

SEQ ID NO: 9401216 - DNA, 22 bp, Homo sapiens
tctgcctggcggactcccggaa

SEQ ID NO: 9401217 - DNA, 22 bp, Homo sapiens
tctgcctggctcatggcagtga

SEQ ID NO: 9401218 - DNA, 22 bp, Homo sapiens
tctgcctggctcatggcagtga

SEQ ID NO: 9401219 - DNA, 22 bp, Homo sapiens
tctgcctgtagtcccacacctc

SEQ ID NO: 9401220 - DNA, 22 bp, Homo sapiens
tctgcctgtaatatttggagaa

SEQ ID NO: 9401221 - DNA, 22 bp, Homo sapiens
tctgcctgggtgtggagcagag

SEQ ID NO: 9401222 - DNA, 22 bp, Homo sapiens
tctgcctggcctggagggcaca

SEQ ID NO: 9401223 - DNA, 22 bp, Homo sapiens
tctgcctggcctggagggcaca

SEQ ID NO: 9401224 - DNA, 22 bp, Homo sapiens
tctgcctggattccattctcca

SEQ ID NO: 9401225 - DNA, 22 bp, Homo sapiens
tctgcctggattccattctcca

SEQ ID NO: 9401226 - DNA, 22 bp, Homo sapiens
tctgcctggatgatggcagggc

SEQ ID NO: 9401227 - DNA, 22 bp, Homo sapiens
tctgcctgcggctgcaggtggc

SEQ ID NO: 9401228 - DNA, 22 bp, Homo sapiens
tctgcctgctaactcctgcacc

SEQ ID NO: 9401229 - DNA, 22 bp, Homo sapiens
tctgcctgctaactcctgcacc

SEQ ID NO: 9401230 - DNA, 19 bp, Homo sapiens
tctgcctgcttgtaggggc

SEQ ID NO: 9401231 - DNA, 19 bp, Homo sapiens
tctgcctgcttgtaggggc

SEQ ID NO: 9401232 - DNA, 22 bp, Homo sapiens
tctgcctggatgatggcagggc

SEQ ID NO: 9401233 - DNA, 22 bp, Homo sapiens
tctgcctggagagttcttctct

SEQ ID NO: 9401234 - DNA, 22 bp, Homo sapiens
tctgcctggagagttcttctct

SEQ ID NO: 9401235 - DNA, 22 bp, Homo sapiens
tctgcctggaccctggtgagct

SEQ ID NO: 9401236 - DNA, 22 bp, Homo sapiens
tctgcctgccgagaacacctac

SEQ ID NO: 9401237 - DNA, 22 bp, Homo sapiens
tctgcctgcgctcacggggccg

SEQ ID NO: 9401238 - DNA, 22 bp, Homo sapiens
tctgcctgcagtgtggcagggc

SEQ ID NO: 9401239 - DNA, 22 bp, Homo sapiens
tctgcctgcagtgtggcagggc

SEQ ID NO: 9401240 - DNA, 22 bp, Homo sapiens
tctgcctgccagtctggtcctc

SEQ ID NO: 9401241 - DNA, 22 bp, Homo sapiens
tctgcctgagggagctgaggaa

SEQ ID NO: 9401242 - DNA, 18 bp, Homo sapiens
tctgcctgcagggcatct

SEQ ID NO: 9401243 - DNA, 18 bp, Homo sapiens
tctgcctgcagggcatct

SEQ ID NO: 9401244 - DNA, 22 bp, Homo sapiens
tctgcctgagggagctgaggaa

SEQ ID NO: 9401245 - DNA, 22 bp, Homo sapiens
tctgcctgagggagctgaggaa

SEQ ID NO: 9401246 - DNA, 22 bp, Homo sapiens
tctgcctgaggactgacaccag

SEQ ID NO: 9401247 - DNA, 22 bp, Homo sapiens
tctgcctgaggactgacaccag

SEQ ID NO: 9401248 - DNA, 22 bp, Homo sapiens
tctgcccttggctctcttgttg

SEQ ID NO: 9401249 - DNA, 22 bp, Homo sapiens
tctgccctggggtcagcctcca

SEQ ID NO: 9401250 - DNA, 18 bp, Homo sapiens
tctgccctgccattcact

SEQ ID NO: 9401251 - DNA, 22 bp, Homo sapiens
tctgccctggggtcagcctcca

SEQ ID NO: 9401252 - DNA, 22 bp, Homo sapiens
tctgccctgccattcactggaa

SEQ ID NO: 9401253 - DNA, 22 bp, Homo sapiens
tctgccgtgcgaggtcccacca

SEQ ID NO: 9401254 - DNA, 22 bp, Homo sapiens
tctgccgtgcgaggtcccacca

SEQ ID NO: 9401255 - DNA, 21 bp, Homo sapiens
tctgcctgagactttgctggt

SEQ ID NO: 9401256 - DNA, 22 bp, Homo sapiens
tctgcccagggacccacaggga

SEQ ID NO: 9401257 - DNA, 22 bp, Homo sapiens
tctgcccagggacccacaggga

SEQ ID NO: 9401258 - DNA, 22 bp, Homo sapiens
tctgcccaggaggtcccatggg

SEQ ID NO: 9401259 - DNA, 22 bp, Homo sapiens
tctgcccaggacacctgccact

SEQ ID NO: 9401260 - DNA, 22 bp, Homo sapiens
tctgcccagccagacccaaggt

SEQ ID NO: 9401261 - DNA, 22 bp, Homo sapiens
tctgcccagccagacccaaggt

SEQ ID NO: 9401262 - DNA, 22 bp, Homo sapiens
tctgcccaggacacctgccact

SEQ ID NO: 9401263 - DNA, 22 bp, Homo sapiens
tctgcccactgctctgctgccc

SEQ ID NO: 9401264 - DNA, 20 bp, Homo sapiens
tctgcccaccccggctccca

SEQ ID NO: 9401265 - DNA, 22 bp, Homo sapiens
tctgccctcattgctgcctgga

SEQ ID NO: 9401266 - DNA, 22 bp, Homo sapiens
tctgccctcattgctgcctgga

SEQ ID NO: 9401267 - DNA, 21 bp, Homo sapiens
tctgccctccaggagctcata

SEQ ID NO: 9401268 - DNA, 21 bp, Homo sapiens
tctgccctccaggagctcata

SEQ ID NO: 9401269 - DNA, 22 bp, Homo sapiens
tctgccctaattcagtgcttag

SEQ ID NO: 9401270 - DNA, 18 bp, Homo sapiens
tctgccccagccgcactg

SEQ ID NO: 9401271 - DNA, 22 bp, Homo sapiens
tctccgtgccgtgggaggctcc

SEQ ID NO: 9401272 - DNA, 22 bp, Homo sapiens
tctcctaaggctgaatatctct

SEQ ID NO: 9401273 - DNA, 22 bp, Homo sapiens
tctccctcattcctgcttccat

SEQ ID NO: 9401274 - DNA, 22 bp, Homo sapiens
tctccctcattcctgcttccat

SEQ ID NO: 9401275 - DNA, 22 bp, Homo sapiens
tctccctcattcctgcttccat

SEQ ID NO: 9401276 - DNA, 23 bp, Homo sapiens
tctccctcatgcctaggcctggg

SEQ ID NO: 9401277 - DNA, 19 bp, Homo sapiens
tctcccggcactcctgccc

SEQ ID NO: 9401278 - DNA, 19 bp, Homo sapiens
tctcccggcactcctgccc

SEQ ID NO: 9401279 - DNA, 18 bp, Homo sapiens
tctcccggtcaccttcac

SEQ ID NO: 9401280 - DNA, 22 bp, Homo sapiens
tctcccggctaagagcttcccg

SEQ ID NO: 9401281 - DNA, 23 bp, Homo sapiens
tctccctcatgcctaggcctggg

SEQ ID NO: 9401282 - DNA, 23 bp, Homo sapiens
tctccctcatgcctaggcctggg

SEQ ID NO: 9401283 - DNA, 22 bp, Homo sapiens
tctccccaggggtatgggtatt

SEQ ID NO: 9401284 - DNA, 22 bp, Homo sapiens
tctccccaggggtatgggtatt

SEQ ID NO: 9401285 - DNA, 21 bp, Homo sapiens
tctccccattcttattcccat

SEQ ID NO: 9401286 - DNA, 22 bp, Homo sapiens
tctccccagtatggattctctg

SEQ ID NO: 9401287 - DNA, 22 bp, Homo sapiens
tctccccaaccatggcactcac

SEQ ID NO: 9401288 - DNA, 22 bp, Homo sapiens
tctccccaaccatggcactcac

SEQ ID NO: 9401289 - DNA, 22 bp, Homo sapiens
tctccccaaaggactcactctc

SEQ ID NO: 9401290 - DNA, 22 bp, Homo sapiens
tctccccaaaggactcactctc

SEQ ID NO: 9401291 - DNA, 22 bp, Homo sapiens
tctccccaggggtatgggtatt

SEQ ID NO: 9401292 - DNA, 22 bp, Homo sapiens
tctccccagctgagctgccctt

SEQ ID NO: 9401293 - DNA, 22 bp, Homo sapiens
tctccccagctgagctgccctt

SEQ ID NO: 9401294 - DNA, 22 bp, Homo sapiens
tctccccagaccctggacataa

SEQ ID NO: 9401295 - DNA, 22 bp, Homo sapiens
tctccccagaccctggacataa

SEQ ID NO: 9401296 - DNA, 22 bp, Homo sapiens
tctccccagctgagctgccctt

SEQ ID NO: 9401297 - DNA, 22 bp, Homo sapiens
tctccccagctgagctgccctt

SEQ ID NO: 9401298 - DNA, 19 bp, Homo sapiens
tctcccatgcctgtgtcta

SEQ ID NO: 9401299 - DNA, 19 bp, Homo sapiens
tctcccatgcctgtgtcta

SEQ ID NO: 9401300 - DNA, 22 bp, Homo sapiens
tctcccatgaggctgcggtcaa

SEQ ID NO: 9401301 - DNA, 22 bp, Homo sapiens
tctccccaaaggactcactctc

SEQ ID NO: 9401302 - DNA, 22 bp, Homo sapiens
tctcccagtgtctggcagtcag

SEQ ID NO: 9401303 - DNA, 22 bp, Homo sapiens
tctcccagtgtctggcagtcag

SEQ ID NO: 9401304 - DNA, 22 bp, Homo sapiens
tctcccaggctggagtgcagtg

SEQ ID NO: 9401305 - DNA, 22 bp, Homo sapiens
tctcccaggctggagtgcagtg

SEQ ID NO: 9401306 - DNA, 22 bp, Homo sapiens
tctcccaggtcatacacagaga

SEQ ID NO: 9401307 - DNA, 22 bp, Homo sapiens
tctcccaggtcatacacagaga

SEQ ID NO: 9401308 - DNA, 22 bp, Homo sapiens
tctcccaggtgggtgcctggag

SEQ ID NO: 9401309 - DNA, 22 bp, Homo sapiens
tctcccaggtgggtgcctggag

SEQ ID NO: 9401310 - DNA, 22 bp, Homo sapiens
tctcccaggtgggtgcctggag

SEQ ID NO: 9401311 - DNA, 22 bp, Homo sapiens
tctcccaggtgggtgcctggag

SEQ ID NO: 9401312 - DNA, 22 bp, Homo sapiens
tctcccaggtgggtgcctggag

SEQ ID NO: 9401313 - DNA, 22 bp, Homo sapiens
tctcccaggtgggtgcctggag

SEQ ID NO: 9401314 - DNA, 22 bp, Homo sapiens
tctcccagtggtgcagaaagca

SEQ ID NO: 9401315 - DNA, 22 bp, Homo sapiens
tctcccagtggtgcagaaagca

SEQ ID NO: 9401316 - DNA, 22 bp, Homo sapiens
tctcccagtggtgcagaaagca

SEQ ID NO: 9401317 - DNA, 22 bp, Homo sapiens
tctcccaggcaggagtgcagtg

SEQ ID NO: 9401318 - DNA, 20 bp, Homo sapiens
tctcccaggctcagggaaga

SEQ ID NO: 9401319 - DNA, 19 bp, Homo sapiens
tctcccagctgagaagggc

SEQ ID NO: 9401320 - DNA, 22 bp, Homo sapiens
tctcccagaggatcccagtgga

SEQ ID NO: 9401321 - DNA, 22 bp, Homo sapiens
tctcccaggcaggagtgcagtg

SEQ ID NO: 9401322 - DNA, 19 bp, Homo sapiens
tctcccagctgagaagggc

SEQ ID NO: 9401323 - DNA, 19 bp, Homo sapiens
tctcccagctgagaagggc

SEQ ID NO: 9401324 - DNA, 22 bp, Homo sapiens
tctcccaggctgccctgtggac

SEQ ID NO: 9401325 - DNA, 20 bp, Homo sapiens
tctcccaggctcagggaaga

SEQ ID NO: 9401326 - DNA, 22 bp, Homo sapiens
tctcccagaagtcctcagtaca

SEQ ID NO: 9401327 - DNA, 22 bp, Homo sapiens
tctcccagaagtcctcagtaca

SEQ ID NO: 9401328 - DNA, 22 bp, Homo sapiens
tctcccactggccttgtatgat

SEQ ID NO: 9401329 - DNA, 22 bp, Homo sapiens
tctcccagaggatcccagtgga

SEQ ID NO: 9401330 - DNA, 22 bp, Homo sapiens
tctcccagaggatcccagtgga

SEQ ID NO: 9401331 - DNA, 22 bp, Homo sapiens
tctcccacggtacaggataaac

SEQ ID NO: 9401332 - DNA, 22 bp, Homo sapiens
tctccaggtggggtcacctttt

SEQ ID NO: 9401333 - DNA, 22 bp, Homo sapiens
tctccaggtggggtcacctttt

SEQ ID NO: 9401334 - DNA, 22 bp, Homo sapiens
tctccaggttcagtcgatggaa

SEQ ID NO: 9401335 - DNA, 22 bp, Homo sapiens
tctccaggtggggtcacctttt

SEQ ID NO: 9401336 - DNA, 22 bp, Homo sapiens
tctccaggtggggtcacctttt

SEQ ID NO: 9401337 - DNA, 22 bp, Homo sapiens
tctccaggtgctaagtgtgcct

SEQ ID NO: 9401338 - DNA, 22 bp, Homo sapiens
tctccaggtggcttgggcttct

SEQ ID NO: 9401339 - DNA, 22 bp, Homo sapiens
tctccaggtgctaagtgtgcct

SEQ ID NO: 9401340 - DNA, 19 bp, Homo sapiens
tctccaggtgccccaaaca

SEQ ID NO: 9401341 - DNA, 22 bp, Homo sapiens
tctccaggtgaaacttgcaggg

SEQ ID NO: 9401342 - DNA, 22 bp, Homo sapiens
tctccaggtagatatgtcagga

SEQ ID NO: 9401343 - DNA, 22 bp, Homo sapiens
tctccaggtgactctgatgtat

SEQ ID NO: 9401344 - DNA, 22 bp, Homo sapiens
tctccaggtgaaacttgcaggg

SEQ ID NO: 9401345 - DNA, 22 bp, Homo sapiens
tctccaggtgaaacttgcaggg

SEQ ID NO: 9401346 - DNA, 22 bp, Homo sapiens
tctccaggggcagggtctggag

SEQ ID NO: 9401347 - DNA, 22 bp, Homo sapiens
tctccaggggctgctgtgccac

SEQ ID NO: 9401348 - DNA, 22 bp, Homo sapiens
tctccagggcccccgagcgttg

SEQ ID NO: 9401349 - DNA, 22 bp, Homo sapiens
tctccaggtaaatggcatcctg

SEQ ID NO: 9401350 - DNA, 22 bp, Homo sapiens
tctccaggtaaatggcatcctg

SEQ ID NO: 9401351 - DNA, 22 bp, Homo sapiens
tctccagggtgagctaggccag

SEQ ID NO: 9401352 - DNA, 22 bp, Homo sapiens
tctccaggggctgctgtgccac

SEQ ID NO: 9401353 - DNA, 22 bp, Homo sapiens
tctccaggggctgctgtgccac

SEQ ID NO: 9401354 - DNA, 22 bp, Homo sapiens
tctccagggaggtagcccagtg

SEQ ID NO: 9401355 - DNA, 22 bp, Homo sapiens
tctccagggactgaggctggag

SEQ ID NO: 9401356 - DNA, 22 bp, Homo sapiens
tctccagggacatgtttctgga

SEQ ID NO: 9401357 - DNA, 22 bp, Homo sapiens
tctccaggcttaatctcagctt

SEQ ID NO: 9401358 - DNA, 22 bp, Homo sapiens
tctccaggcttaatctcagctt

SEQ ID NO: 9401359 - DNA, 22 bp, Homo sapiens
tctccaggcctttcccatctta

SEQ ID NO: 9401360 - DNA, 22 bp, Homo sapiens
tctccaggcctttcccatctta

SEQ ID NO: 9401361 - DNA, 22 bp, Homo sapiens
tctcctcaccaccagcagcaga

SEQ ID NO: 9401362 - DNA, 22 bp, Homo sapiens
tctcctactcactcaaggcttg

SEQ ID NO: 9401363 - DNA, 22 bp, Homo sapiens
tctcctactcactcaaggcttg

SEQ ID NO: 9401364 - DNA, 22 bp, Homo sapiens
tctcctcccaggctcttccagg

SEQ ID NO: 9401365 - DNA, 22 bp, Homo sapiens
tctcctcccaggctcttccagg

SEQ ID NO: 9401366 - DNA, 22 bp, Homo sapiens
tctcctccagaggctgtgggga

SEQ ID NO: 9401367 - DNA, 22 bp, Homo sapiens
tctcctcccaggctcttccagg

SEQ ID NO: 9401368 - DNA, 23 bp, Homo sapiens
tctcctcctagatacagtcatgg

SEQ ID NO: 9401369 - DNA, 22 bp, Homo sapiens
tctcctctactgggtctgcaga

SEQ ID NO: 9401370 - DNA, 22 bp, Homo sapiens
tctcctctactgggtctgcaga

SEQ ID NO: 9401371 - DNA, 22 bp, Homo sapiens
tctcctccttttttcaacatag

SEQ ID NO: 9401372 - DNA, 23 bp, Homo sapiens
tctcctcctagatacagtcatgg

SEQ ID NO: 9401373 - DNA, 23 bp, Homo sapiens
tctcctcctagatacagtcatgg

SEQ ID NO: 9401374 - DNA, 23 bp, Homo sapiens
tctcctcctagatacagtcatgg

SEQ ID NO: 9401375 - DNA, 22 bp, Homo sapiens
tctcctctgtgccacagcttgg

SEQ ID NO: 9401376 - DNA, 22 bp, Homo sapiens
tctcctgaagtttatgaaaact

SEQ ID NO: 9401377 - DNA, 22 bp, Homo sapiens
tctcctgaagaccatgtgcact

SEQ ID NO: 9401378 - DNA, 22 bp, Homo sapiens
tctcctgacatgtctggaggaa

SEQ ID NO: 9401379 - DNA, 22 bp, Homo sapiens
tctcctctatttctgtatgtat

SEQ ID NO: 9401380 - DNA, 22 bp, Homo sapiens
tctcctctcctttcatgttgtt

SEQ ID NO: 9401381 - DNA, 22 bp, Homo sapiens
tctcctctcttacctggtacaa

SEQ ID NO: 9401382 - DNA, 22 bp, Homo sapiens
tctcctctcttacctggtacaa

SEQ ID NO: 9401383 - DNA, 22 bp, Homo sapiens
tctcctctgcgcggcagtgccc

SEQ ID NO: 9401384 - DNA, 22 bp, Homo sapiens
tctcctctgcgcggcagtgccc

SEQ ID NO: 9401385 - DNA, 22 bp, Homo sapiens
tctcctggatggaccttctctt

SEQ ID NO: 9401386 - DNA, 22 bp, Homo sapiens
tctcctggatggaccttctctt

SEQ ID NO: 9401387 - DNA, 22 bp, Homo sapiens
tctcctggcatttggttgagta

SEQ ID NO: 9401388 - DNA, 22 bp, Homo sapiens
tctcctggcatgtgggtcatct

SEQ ID NO: 9401389 - DNA, 22 bp, Homo sapiens
tctcctggcatttggttgagta

SEQ ID NO: 9401390 - DNA, 22 bp, Homo sapiens
tctcctggcatttggttgagta

SEQ ID NO: 9401391 - DNA, 22 bp, Homo sapiens
tctcctggatagatactatcca

SEQ ID NO: 9401392 - DNA, 22 bp, Homo sapiens
tctcctggagcccagatgctgg

SEQ ID NO: 9401393 - DNA, 22 bp, Homo sapiens
tctcctggatagatactatcca

SEQ ID NO: 9401394 - DNA, 22 bp, Homo sapiens
tctcctggatagatactatcca

SEQ ID NO: 9401395 - DNA, 22 bp, Homo sapiens
tctcctggagcccagatgctgg

SEQ ID NO: 9401396 - DNA, 22 bp, Homo sapiens
tctcctggagcccagatgctgg

SEQ ID NO: 9401397 - DNA, 22 bp, Homo sapiens
tctcctggagcaggaaggtggg

SEQ ID NO: 9401398 - DNA, 22 bp, Homo sapiens
tctcctggagcaggaaggtggg

SEQ ID NO: 9401399 - DNA, 22 bp, Homo sapiens
tctcctggagcaggaaggtggg

SEQ ID NO: 9401400 - DNA, 22 bp, Homo sapiens
tctcctggagcccagatgctgg

SEQ ID NO: 9401401 - DNA, 22 bp, Homo sapiens
tctcctggagcaggaaggtggg

SEQ ID NO: 9401402 - DNA, 22 bp, Homo sapiens
tctcctgcagtcagcagtctca

SEQ ID NO: 9401403 - DNA, 22 bp, Homo sapiens
tctcctgccactgcttcccatt

SEQ ID NO: 9401404 - DNA, 22 bp, Homo sapiens
tctcctgcagtcagcagtctca

SEQ ID NO: 9401405 - DNA, 22 bp, Homo sapiens
tctcctgccactgcttcccatt

SEQ ID NO: 9401406 - DNA, 22 bp, Homo sapiens
tctcctgccactgcttcccatt

SEQ ID NO: 9401407 - DNA, 22 bp, Homo sapiens
tctcctgctcagaacagcctca

SEQ ID NO: 9401408 - DNA, 22 bp, Homo sapiens
tctcctgctcagaacagcctca

SEQ ID NO: 9401409 - DNA, 22 bp, Homo sapiens
tctcctggaagaataccacact

SEQ ID NO: 9401410 - DNA, 22 bp, Homo sapiens
tctcctggaagtgattcccctg

SEQ ID NO: 9401411 - DNA, 22 bp, Homo sapiens
tctcctggaagtgattcccctg

SEQ ID NO: 9401412 - DNA, 22 bp, Homo sapiens
tctcctgctcccaactgctgca

SEQ ID NO: 9401413 - DNA, 22 bp, Homo sapiens
tctcctgcttcaactgatggac

SEQ ID NO: 9401414 - DNA, 22 bp, Homo sapiens
tctcctgcttcaactgatggac

SEQ ID NO: 9401415 - DNA, 22 bp, Homo sapiens
tctcggtggcatttggcacagt

SEQ ID NO: 9401416 - DNA, 16 bp, Homo sapiens
tctcggtgtgtagagt

SEQ ID NO: 9401417 - DNA, 22 bp, Homo sapiens
tctcgctctgtcgcccaggctg

SEQ ID NO: 9401418 - DNA, 22 bp, Homo sapiens
tctcgctctgtcgcccaggctg

SEQ ID NO: 9401419 - DNA, 22 bp, Homo sapiens
tctcgctctgtcgcccaggctg

SEQ ID NO: 9401420 - DNA, 22 bp, Homo sapiens
tctcgctctgtcgcccaggctg

SEQ ID NO: 9401421 - DNA, 22 bp, Homo sapiens
tctctagtctcctttaacctga

SEQ ID NO: 9401422 - DNA, 22 bp, Homo sapiens
tctctagtctcctttaacctga

SEQ ID NO: 9401423 - DNA, 22 bp, Homo sapiens
tctctagtattaagctccattt

SEQ ID NO: 9401424 - DNA, 22 bp, Homo sapiens
tctctaaacttatatgaactat

SEQ ID NO: 9401425 - DNA, 21 bp, Homo sapiens
tctctaaaaagattctatttg

SEQ ID NO: 9401426 - DNA, 21 bp, Homo sapiens
tctcgttgtatggtcttgggg

SEQ ID NO: 9401427 - DNA, 22 bp, Homo sapiens
tctccttgacaggcaggcagac

SEQ ID NO: 9401428 - DNA, 22 bp, Homo sapiens
tctccttgacaggcaggcagac

SEQ ID NO: 9401429 - DNA, 22 bp, Homo sapiens
tctccttgctacccagtatgtc

SEQ ID NO: 9401430 - DNA, 22 bp, Homo sapiens
tctcgatctcctgaccttgtga

SEQ ID NO: 9401431 - DNA, 22 bp, Homo sapiens
tctcgatctcctgaccttgtga

SEQ ID NO: 9401432 - DNA, 22 bp, Homo sapiens
tctcctttcttttaaaatgtca

SEQ ID NO: 9401433 - DNA, 22 bp, Homo sapiens
tctcctggtacccttcctagca

SEQ ID NO: 9401434 - DNA, 22 bp, Homo sapiens
tctcctggtacccttcctagca

SEQ ID NO: 9401435 - DNA, 22 bp, Homo sapiens
tctcctggtacccttcctagca

SEQ ID NO: 9401436 - DNA, 22 bp, Homo sapiens
tctcctggtatgtatgcacctg

SEQ ID NO: 9401437 - DNA, 22 bp, Homo sapiens
tctcctggtatgtatgcacctg

SEQ ID NO: 9401438 - DNA, 22 bp, Homo sapiens
tctcctgggtgctttatcagaa

SEQ ID NO: 9401439 - DNA, 22 bp, Homo sapiens
tctcctggtacccttcctagca

SEQ ID NO: 9401440 - DNA, 22 bp, Homo sapiens
tctcctggtacccttcctagca

SEQ ID NO: 9401441 - DNA, 22 bp, Homo sapiens
tctcctgggtaaaagggttgat

SEQ ID NO: 9401442 - DNA, 18 bp, Homo sapiens
tctcctgggtaggggcct

SEQ ID NO: 9401443 - DNA, 21 bp, Homo sapiens
tctcctgggtccaacccatgc

SEQ ID NO: 9401444 - DNA, 18 bp, Homo sapiens
tctcctgggtaggggcct

SEQ ID NO: 9401445 - DNA, 22 bp, Homo sapiens
tctcctggccctgtcgccatct

SEQ ID NO: 9401446 - DNA, 22 bp, Homo sapiens
tctcctgggcttggttgaagtt

SEQ ID NO: 9401447 - DNA, 22 bp, Homo sapiens
tctcctgggtaaaagggttgat

SEQ ID NO: 9401448 - DNA, 22 bp, Homo sapiens
tctcctgggtaaaagggttgat

SEQ ID NO: 9401449 - DNA, 18 bp, Homo sapiens
tctccttccaaatcttca

SEQ ID NO: 9401450 - DNA, 22 bp, Homo sapiens
tctccttcgaggcccagctccc

SEQ ID NO: 9401451 - DNA, 22 bp, Homo sapiens
tctccttccaacaaaaggtcac

SEQ ID NO: 9401452 - DNA, 18 bp, Homo sapiens
tctccttccaaatcttca

SEQ ID NO: 9401453 - DNA, 22 bp, Homo sapiens
tctcctgtgcaccctccctgtg

SEQ ID NO: 9401454 - DNA, 23 bp, Homo sapiens
tctcctgtcctaattaccacccc

SEQ ID NO: 9401455 - DNA, 22 bp, Homo sapiens
tctcctgtatgggactggcgag

SEQ ID NO: 9401456 - DNA, 22 bp, Homo sapiens
tctcctgtatgggactggcgag

SEQ ID NO: 9401457 - DNA, 22 bp, Homo sapiens
tctcctgtgcaccctccctgtg

SEQ ID NO: 9401458 - DNA, 22 bp, Homo sapiens
tctcctgtcttctcagcacccc

SEQ ID NO: 9401459 - DNA, 22 bp, Homo sapiens
tctcctggtttgttaaataatt

SEQ ID NO: 9401460 - DNA, 20 bp, Homo sapiens
tctcctggtgacagtaccca

SEQ ID NO: 9401461 - DNA, 22 bp, Homo sapiens
tctcctggtcacctcagaagtc

SEQ ID NO: 9401462 - DNA, 22 bp, Homo sapiens
tctcctggtcacctcagaagtc

SEQ ID NO: 9401463 - DNA, 20 bp, Homo sapiens
tctcctggtctggtccgtgc

SEQ ID NO: 9401464 - DNA, 20 bp, Homo sapiens
tctcctggtctggtccgtgc

SEQ ID NO: 9401465 - DNA, 22 bp, Homo sapiens
tctccaggaagccctccctgac

SEQ ID NO: 9401466 - DNA, 17 bp, Homo sapiens
tctccaggacgagctca

SEQ ID NO: 9401467 - DNA, 22 bp, Homo sapiens
tctccaggactgagctccagcc

SEQ ID NO: 9401468 - DNA, 22 bp, Homo sapiens
tctccaggactgagctccagcc

SEQ ID NO: 9401469 - DNA, 22 bp, Homo sapiens
tctccaggagcaagtcacccag

SEQ ID NO: 9401470 - DNA, 22 bp, Homo sapiens
tctccaggagcaagtcacccag

SEQ ID NO: 9401471 - DNA, 22 bp, Homo sapiens
tctccaggagcaagtcacccag

SEQ ID NO: 9401472 - DNA, 22 bp, Homo sapiens
tctccaggagcaagtcacccag

SEQ ID NO: 9401473 - DNA, 22 bp, Homo sapiens
tctccaggcacttggctgctac

SEQ ID NO: 9401474 - DNA, 22 bp, Homo sapiens
tctccaggcactacctgggtaa

SEQ ID NO: 9401475 - DNA, 19 bp, Homo sapiens
tctccaggcaggtgagcga

SEQ ID NO: 9401476 - DNA, 23 bp, Homo sapiens
tctccaggccttactccaggcct

SEQ ID NO: 9401477 - DNA, 22 bp, Homo sapiens
tctccaggcacttggctgctac

SEQ ID NO: 9401478 - DNA, 22 bp, Homo sapiens
tctccaggcacttggctgctac

SEQ ID NO: 9401479 - DNA, 19 bp, Homo sapiens
tctccaggcaggtgagcga

SEQ ID NO: 9401480 - DNA, 19 bp, Homo sapiens
tctccaggcaggtgagcga

SEQ ID NO: 9401481 - DNA, 22 bp, Homo sapiens
tctcatttgcctcatctataaa

SEQ ID NO: 9401482 - DNA, 23 bp, Homo sapiens
tctcatttcccttgatctatctt

SEQ ID NO: 9401483 - DNA, 23 bp, Homo sapiens
tctcatttcccttgatctatctt

SEQ ID NO: 9401484 - DNA, 22 bp, Homo sapiens
tctcatttgtgtgcaattcaga

SEQ ID NO: 9401485 - DNA, 22 bp, Homo sapiens
tctcatgtattgccctggtgtg

SEQ ID NO: 9401486 - DNA, 22 bp, Homo sapiens
tctcatggtttgtgattcaaat

SEQ ID NO: 9401487 - DNA, 22 bp, Homo sapiens
tctcatggcttgtaggaggtga

SEQ ID NO: 9401488 - DNA, 22 bp, Homo sapiens
tctcatgtgattcccgtgcatg

SEQ ID NO: 9401489 - DNA, 22 bp, Homo sapiens
tctcatgttttacctgtcctca

SEQ ID NO: 9401490 - DNA, 22 bp, Homo sapiens
tctcatgtgaagaaagaatttc

SEQ ID NO: 9401491 - DNA, 22 bp, Homo sapiens
tctcatgttttacctgtcctca

SEQ ID NO: 9401492 - DNA, 22 bp, Homo sapiens
tctcattcataccctacatgct

SEQ ID NO: 9401493 - DNA, 22 bp, Homo sapiens
tctcattcatccaaggatttat

SEQ ID NO: 9401494 - DNA, 20 bp, Homo sapiens
tctcagggttcagcaaagta

SEQ ID NO: 9401495 - DNA, 22 bp, Homo sapiens
tctcaggtggcccccatgagtg

SEQ ID NO: 9401496 - DNA, 22 bp, Homo sapiens
tctcaggtttcaagacaggaaa

SEQ ID NO: 9401497 - DNA, 22 bp, Homo sapiens
tctcaggtctcatgccaggcct

SEQ ID NO: 9401498 - DNA, 22 bp, Homo sapiens
tctcaggtctcatgccaggcct

SEQ ID NO: 9401499 - DNA, 22 bp, Homo sapiens
tctcaggtctcatgccaggcct

SEQ ID NO: 9401500 - DNA, 22 bp, Homo sapiens
tctcagggcgcagtgaggcagt

SEQ ID NO: 9401501 - DNA, 22 bp, Homo sapiens
tctcagggctcagagctcaggc

SEQ ID NO: 9401502 - DNA, 22 bp, Homo sapiens
tctcagggctcagagctcaggc

SEQ ID NO: 9401503 - DNA, 22 bp, Homo sapiens
tctcagtgatggcccatttgga

SEQ ID NO: 9401504 - DNA, 22 bp, Homo sapiens
tctcagtgactgctgggtcccc

SEQ ID NO: 9401505 - DNA, 22 bp, Homo sapiens
tctcagtgcagcaaggaattta

SEQ ID NO: 9401506 - DNA, 22 bp, Homo sapiens
tctcagtgcagcttgacagaga

SEQ ID NO: 9401507 - DNA, 23 bp, Homo sapiens
tctcagtgaatctcagaattcgc

SEQ ID NO: 9401508 - DNA, 17 bp, Homo sapiens
tctcagtgactgatagc

SEQ ID NO: 9401509 - DNA, 22 bp, Homo sapiens
tctcatctagactctgcccttg

SEQ ID NO: 9401510 - DNA, 22 bp, Homo sapiens
tctcatctagactctgcccttg

SEQ ID NO: 9401511 - DNA, 22 bp, Homo sapiens
tctcatctcaaattgtaatccc

SEQ ID NO: 9401512 - DNA, 19 bp, Homo sapiens
tctcatccagcattcaaga

SEQ ID NO: 9401513 - DNA, 22 bp, Homo sapiens
tctcatcacttaacatctgctt

SEQ ID NO: 9401514 - DNA, 22 bp, Homo sapiens
tctcatcacttaacatctgctt

SEQ ID NO: 9401515 - DNA, 22 bp, Homo sapiens
tctcataattaggtaagtcaga

SEQ ID NO: 9401516 - DNA, 22 bp, Homo sapiens
tctcatacgtttccaggtgtca

SEQ ID NO: 9401517 - DNA, 22 bp, Homo sapiens
tctcatacatgtttgcagaaag

SEQ ID NO: 9401518 - DNA, 22 bp, Homo sapiens
tctcataaggtcagatttcaca

SEQ ID NO: 9401519 - DNA, 22 bp, Homo sapiens
tctcagtggacgtgtctgtctt

SEQ ID NO: 9401520 - DNA, 22 bp, Homo sapiens
tctcatctgcgagctctgccag

SEQ ID NO: 9401521 - DNA, 22 bp, Homo sapiens
tctcatctgcgagctctgccag

SEQ ID NO: 9401522 - DNA, 22 bp, Homo sapiens
tctcatctgcgagctctgccag

SEQ ID NO: 9401523 - DNA, 21 bp, Homo sapiens
tctcatctcctgacctgtgcc

SEQ ID NO: 9401524 - DNA, 22 bp, Homo sapiens
tctcatctcggatcagaagtga

SEQ ID NO: 9401525 - DNA, 22 bp, Homo sapiens
tctcatctcggatcagaagtga

SEQ ID NO: 9401526 - DNA, 22 bp, Homo sapiens
tctcatcttcattgtctcccat

SEQ ID NO: 9401527 - DNA, 22 bp, Homo sapiens
tctcatcttgttcatctaccct

SEQ ID NO: 9401528 - DNA, 22 bp, Homo sapiens
tctcatcttgttcatctaccct

SEQ ID NO: 9401529 - DNA, 22 bp, Homo sapiens
tctcatggagtcaggagcagaa

SEQ ID NO: 9401530 - DNA, 19 bp, Homo sapiens
tctcacagtttccttgcct

SEQ ID NO: 9401531 - DNA, 22 bp, Homo sapiens
tctcacccaacgtgcaatgagt

SEQ ID NO: 9401532 - DNA, 22 bp, Homo sapiens
tctcaccatggtgcttgcttat

SEQ ID NO: 9401533 - DNA, 22 bp, Homo sapiens
tctcagaaaaaggagaaactgg

SEQ ID NO: 9401534 - DNA, 22 bp, Homo sapiens
tctcactgggtcacagcagagg

SEQ ID NO: 9401535 - DNA, 22 bp, Homo sapiens
tctcactgggtataaatgagta

SEQ ID NO: 9401536 - DNA, 22 bp, Homo sapiens
tctcactgggtcacagcagagg

SEQ ID NO: 9401537 - DNA, 22 bp, Homo sapiens
tctcactttgttgcccagactt

SEQ ID NO: 9401538 - DNA, 21 bp, Homo sapiens
tctcactgtctgctttgttta

SEQ ID NO: 9401539 - DNA, 22 bp, Homo sapiens
tctcactgggtataaatgagta

SEQ ID NO: 9401540 - DNA, 22 bp, Homo sapiens
tctcactgggtataaatgagta

SEQ ID NO: 9401541 - DNA, 22 bp, Homo sapiens
tctcactgggtcacagcagagg

SEQ ID NO: 9401542 - DNA, 22 bp, Homo sapiens
tctcactcatttcctaggtctt

SEQ ID NO: 9401543 - DNA, 22 bp, Homo sapiens
tctcactgatttgagaccaagg

SEQ ID NO: 9401544 - DNA, 22 bp, Homo sapiens
tctcactgatttgagaccaagg

SEQ ID NO: 9401545 - DNA, 22 bp, Homo sapiens
tctcactgcaaatattatgtat

SEQ ID NO: 9401546 - DNA, 22 bp, Homo sapiens
tctcagagaggggccgggcctt

SEQ ID NO: 9401547 - DNA, 22 bp, Homo sapiens
tctcagagatctttctgcatgt

SEQ ID NO: 9401548 - DNA, 22 bp, Homo sapiens
tctcagagatgtcaagagtcta

SEQ ID NO: 9401549 - DNA, 22 bp, Homo sapiens
tctcagagatgttagggaagag

SEQ ID NO: 9401550 - DNA, 22 bp, Homo sapiens
tctcagagagctgtgttttcct

SEQ ID NO: 9401551 - DNA, 22 bp, Homo sapiens
tctcagagagatgaaacttcca

SEQ ID NO: 9401552 - DNA, 22 bp, Homo sapiens
tctcagagcatcattttcttag

SEQ ID NO: 9401553 - DNA, 19 bp, Homo sapiens
tctcagagccctagaggcc

SEQ ID NO: 9401554 - DNA, 19 bp, Homo sapiens
tctcagagccctagaggcc

SEQ ID NO: 9401555 - DNA, 22 bp, Homo sapiens
tctcagagattcagggagaagt

SEQ ID NO: 9401556 - DNA, 22 bp, Homo sapiens
tctcagagattttgtttccctt

SEQ ID NO: 9401557 - DNA, 22 bp, Homo sapiens
tctcagagatttatggaaaact

SEQ ID NO: 9401558 - DNA, 19 bp, Homo sapiens
tctcagaggaaaaattgct

SEQ ID NO: 9401559 - DNA, 23 bp, Homo sapiens
tctcagaggattcctgggccttg

SEQ ID NO: 9401560 - DNA, 18 bp, Homo sapiens
tctcagaggccatcctag

SEQ ID NO: 9401561 - DNA, 22 bp, Homo sapiens
tctcagagcttcagaaagcacc

SEQ ID NO: 9401562 - DNA, 22 bp, Homo sapiens
tctcagagcttcagttattttc

SEQ ID NO: 9401563 - DNA, 22 bp, Homo sapiens
tctcagagctcacacctcctgg

SEQ ID NO: 9401564 - DNA, 22 bp, Homo sapiens
tctcagagcctaactaacctaa

SEQ ID NO: 9401565 - DNA, 22 bp, Homo sapiens
tctcaggcttcctggtgctgtg

SEQ ID NO: 9401566 - DNA, 22 bp, Homo sapiens
tctcagggagagctgctggcat

SEQ ID NO: 9401567 - DNA, 22 bp, Homo sapiens
tctcagggagggcgagtcagcg

SEQ ID NO: 9401568 - DNA, 22 bp, Homo sapiens
tctcaggcttcctggtgctgtg

SEQ ID NO: 9401569 - DNA, 22 bp, Homo sapiens
tctcaggctgtgtgtggaggac

SEQ ID NO: 9401570 - DNA, 19 bp, Homo sapiens
tctcaggctgggcggctgc

SEQ ID NO: 9401571 - DNA, 19 bp, Homo sapiens
tctcaggctgggcggctgc

SEQ ID NO: 9401572 - DNA, 22 bp, Homo sapiens
tctcaggctcttggaacctgtt

SEQ ID NO: 9401573 - DNA, 22 bp, Homo sapiens
tctcaggctgacattgggactc

SEQ ID NO: 9401574 - DNA, 22 bp, Homo sapiens
tctcagggcgcagtgaggcagt

SEQ ID NO: 9401575 - DNA, 22 bp, Homo sapiens
tctcagggcagcaaggaagcat

SEQ ID NO: 9401576 - DNA, 22 bp, Homo sapiens
tctcagggcagcaaggaagcat

SEQ ID NO: 9401577 - DNA, 22 bp, Homo sapiens
tctcagggcagcaaggaagcat

SEQ ID NO: 9401578 - DNA, 22 bp, Homo sapiens
tctcagggccccaaaggctagt

SEQ ID NO: 9401579 - DNA, 22 bp, Homo sapiens
tctcagggagttgaggctgcct

SEQ ID NO: 9401580 - DNA, 22 bp, Homo sapiens
tctcagctcatggcagccttga

SEQ ID NO: 9401581 - DNA, 22 bp, Homo sapiens
tctcagctcagcttccacagag

SEQ ID NO: 9401582 - DNA, 22 bp, Homo sapiens
tctcagcctcacctctatggag

SEQ ID NO: 9401583 - DNA, 22 bp, Homo sapiens
tctcagctcttttttcacagaa

SEQ ID NO: 9401584 - DNA, 20 bp, Homo sapiens
tctcaggccccagttttctt

SEQ ID NO: 9401585 - DNA, 22 bp, Homo sapiens
tctcagctgactgctttcctcg

SEQ ID NO: 9401586 - DNA, 22 bp, Homo sapiens
tctcagctgcctgccctgctcc

SEQ ID NO: 9401587 - DNA, 22 bp, Homo sapiens
tctcagctgcctgccctgctcc

SEQ ID NO: 9401588 - DNA, 20 bp, Homo sapiens
tctcaggccccctccttgct

SEQ ID NO: 9401589 - DNA, 20 bp, Homo sapiens
tctcaggccccctccttgct

SEQ ID NO: 9401590 - DNA, 21 bp, Homo sapiens
tctcaggcgagaattctttta

SEQ ID NO: 9401591 - DNA, 22 bp, Homo sapiens
tctcaggcccctgagtttctct

SEQ ID NO: 9401592 - DNA, 22 bp, Homo sapiens
tctcaggctaccttgcacaagg

SEQ ID NO: 9401593 - DNA, 22 bp, Homo sapiens
tctcaggctagtaaaagatggg

SEQ ID NO: 9401594 - DNA, 22 bp, Homo sapiens
tctcaggctcctgacatatatg

SEQ ID NO: 9401595 - DNA, 22 bp, Homo sapiens
tctcagcaaggaaagaggcagg

SEQ ID NO: 9401596 - DNA, 22 bp, Homo sapiens
tctcagatgcccttgcatcacc

SEQ ID NO: 9401597 - DNA, 23 bp, Homo sapiens
tctcagattcagagatccctaaa

SEQ ID NO: 9401598 - DNA, 22 bp, Homo sapiens
tctcagcaacgatccggagtaa

SEQ ID NO: 9401599 - DNA, 20 bp, Homo sapiens
tctcagcataagaacccttc

SEQ ID NO: 9401600 - DNA, 22 bp, Homo sapiens
tctcagcagggccatcctgagc

SEQ ID NO: 9401601 - DNA, 22 bp, Homo sapiens
tctcagcacgttgttttcattg

SEQ ID NO: 9401602 - DNA, 22 bp, Homo sapiens
tctcagcacgttgttttcattg

SEQ ID NO: 9401603 - DNA, 22 bp, Homo sapiens
tctcagcagccagatccagagc

SEQ ID NO: 9401604 - DNA, 22 bp, Homo sapiens
tctcagagtttagagctgagcc

SEQ ID NO: 9401605 - DNA, 22 bp, Homo sapiens
tctcagagtttacggggctgaa

SEQ ID NO: 9401606 - DNA, 22 bp, Homo sapiens
tctcagagtttttttccaggac

SEQ ID NO: 9401607 - DNA, 22 bp, Homo sapiens
tctcagagtttagagctgagcc

SEQ ID NO: 9401608 - DNA, 22 bp, Homo sapiens
tctcagagtttgaatctggagt

SEQ ID NO: 9401609 - DNA, 22 bp, Homo sapiens
tctcagaggtcttcagcctctg

SEQ ID NO: 9401610 - DNA, 22 bp, Homo sapiens
tctcagagggaaaggccaattt

SEQ ID NO: 9401611 - DNA, 22 bp, Homo sapiens
tctcagagggaggattactgcc

SEQ ID NO: 9401612 - DNA, 22 bp, Homo sapiens
tctcagaggcccgacgttctcc

SEQ ID NO: 9401613 - DNA, 22 bp, Homo sapiens
tctcagagggaaacatgagtga

SEQ ID NO: 9401614 - DNA, 22 bp, Homo sapiens
tctcagagggaaacatgagtga

SEQ ID NO: 9401615 - DNA, 22 bp, Homo sapiens
tctcagaggtgccctggcatct

SEQ ID NO: 9401616 - DNA, 22 bp, Homo sapiens
tctcagagtaattctttaaggt

SEQ ID NO: 9401617 - DNA, 22 bp, Homo sapiens
tctcagagtgacaatgagaatt

SEQ ID NO: 9401618 - DNA, 22 bp, Homo sapiens
tctcagagttcctctggagtcc

SEQ ID NO: 9401619 - DNA, 22 bp, Homo sapiens
tctcagagtggtggtccctctg

SEQ ID NO: 9401620 - DNA, 17 bp, Homo sapiens
tctctttccctttctgc

SEQ ID NO: 9401621 - DNA, 19 bp, Homo sapiens
tctctttcatggggctagt

SEQ ID NO: 9401622 - DNA, 17 bp, Homo sapiens
tctctttccctttctgc

SEQ ID NO: 9401623 - DNA, 17 bp, Homo sapiens
tctctttccctttctgc

SEQ ID NO: 9401624 - DNA, 22 bp, Homo sapiens
tctctttctattgcaccatgct

SEQ ID NO: 9401625 - DNA, 22 bp, Homo sapiens
tctctttctattgcaccatgct

SEQ ID NO: 9401626 - DNA, 18 bp, Homo sapiens
tctctttcctcagtggag

SEQ ID NO: 9401627 - DNA, 18 bp, Homo sapiens
tctctttcctcagtggag

SEQ ID NO: 9401628 - DNA, 22 bp, Homo sapiens
tctctttctatatgtgagtctt

SEQ ID NO: 9401629 - DNA, 21 bp, Homo sapiens
tctctttctggaagcttccct

SEQ ID NO: 9401630 - DNA, 21 bp, Homo sapiens
tctctttctggaagcttccct

SEQ ID NO: 9401631 - DNA, 22 bp, Homo sapiens
tctctttctcagatggtggaga

SEQ ID NO: 9401632 - DNA, 21 bp, Homo sapiens
tctctttctggaagcttccct

SEQ ID NO: 9401633 - DNA, 22 bp, Homo sapiens
tctctttctcaaaatgtaagca

SEQ ID NO: 9401634 - DNA, 22 bp, Homo sapiens
tctctttgaccctttagctcca

SEQ ID NO: 9401635 - DNA, 22 bp, Homo sapiens
tctctttgaccctttagctcca

SEQ ID NO: 9401636 - DNA, 22 bp, Homo sapiens
tctctttctttgtatgtctatt

SEQ ID NO: 9401637 - DNA, 22 bp, Homo sapiens
tctcttcttgtgttttcctgcc

SEQ ID NO: 9401638 - DNA, 22 bp, Homo sapiens
tctcttcttgtgttttcctgcc

SEQ ID NO: 9401639 - DNA, 22 bp, Homo sapiens
tctcttcttgtgttttcctgcc

SEQ ID NO: 9401640 - DNA, 22 bp, Homo sapiens
tctcttcttgtgttttcctgcc

SEQ ID NO: 9401641 - DNA, 17 bp, Homo sapiens
tctcttgttcactgctg

SEQ ID NO: 9401642 - DNA, 22 bp, Homo sapiens
tctcttctttggggtgggctca

SEQ ID NO: 9401643 - DNA, 22 bp, Homo sapiens
tctctttaaaaatagtgaaata

SEQ ID NO: 9401644 - DNA, 22 bp, Homo sapiens
tctctttaaaaatagtgaaata

SEQ ID NO: 9401645 - DNA, 22 bp, Homo sapiens
tctctttaagtataatcttata

SEQ ID NO: 9401646 - DNA, 22 bp, Homo sapiens
tctctttactttcaccaatttg

SEQ ID NO: 9401647 - DNA, 22 bp, Homo sapiens
tctctttactttcaccaatttg

SEQ ID NO: 9401648 - DNA, 23 bp, Homo sapiens
tctctttcaagagcttaatgtgc

SEQ ID NO: 9401649 - DNA, 22 bp, Homo sapiens
tctctttagtgcttagacgtct

SEQ ID NO: 9401650 - DNA, 22 bp, Homo sapiens
tctctttaagtataatcttata

SEQ ID NO: 9401651 - DNA, 22 bp, Homo sapiens
tctctttaagtataatcttata

SEQ ID NO: 9401652 - DNA, 22 bp, Homo sapiens
tctctttgtctgctcttagttg

SEQ ID NO: 9401653 - DNA, 22 bp, Homo sapiens
tctctttgtctgctcttagttg

SEQ ID NO: 9401654 - DNA, 22 bp, Homo sapiens
tctctttgtggccaggagagga

SEQ ID NO: 9401655 - DNA, 18 bp, Homo sapiens
tctcttttcccctcattg

SEQ ID NO: 9401656 - DNA, 22 bp, Homo sapiens
tctcttttatgtacaccctgac

SEQ ID NO: 9401657 - DNA, 20 bp, Homo sapiens
tctcttttagcttacagctg

SEQ ID NO: 9401658 - DNA, 22 bp, Homo sapiens
tctgaaagaaagattttgtttc

SEQ ID NO: 9401659 - DNA, 22 bp, Homo sapiens
tctgaaagaaagattttgtttc

SEQ ID NO: 9401660 - DNA, 22 bp, Homo sapiens
tctgaaagagagtacatacagt

SEQ ID NO: 9401661 - DNA, 22 bp, Homo sapiens
tctgaaatagaagtgtctttct

SEQ ID NO: 9401662 - DNA, 22 bp, Homo sapiens
tctgaaatactgcaggttctct

SEQ ID NO: 9401663 - DNA, 22 bp, Homo sapiens
tctgaaataagggagaagggaa

SEQ ID NO: 9401664 - DNA, 22 bp, Homo sapiens
tctgaaatactgcaggttctct

SEQ ID NO: 9401665 - DNA, 22 bp, Homo sapiens
tctgaaatactgcaggttctct

SEQ ID NO: 9401666 - DNA, 22 bp, Homo sapiens
tctgaaataactgatgccagat

SEQ ID NO: 9401667 - DNA, 22 bp, Homo sapiens
tctgaaataaatgcactgttag

SEQ ID NO: 9401668 - DNA, 22 bp, Homo sapiens
tctgaaagtatctggatctttt

SEQ ID NO: 9401669 - DNA, 22 bp, Homo sapiens
tctgaaagtctgaaacagtgtc

SEQ ID NO: 9401670 - DNA, 22 bp, Homo sapiens
tctgaaagctagaaaatgctct

SEQ ID NO: 9401671 - DNA, 22 bp, Homo sapiens
tctgaaagccctagtttgtaat

SEQ ID NO: 9401672 - DNA, 22 bp, Homo sapiens
tctgaaagccctagtttgtaat

SEQ ID NO: 9401673 - DNA, 22 bp, Homo sapiens
tctgaaagccctagtttgtaat

SEQ ID NO: 9401674 - DNA, 22 bp, Homo sapiens
tctgaaattcacagttgagtca

SEQ ID NO: 9401675 - DNA, 22 bp, Homo sapiens
tctgaaatgttctcttgttttg

SEQ ID NO: 9401676 - DNA, 22 bp, Homo sapiens
tctgaaatgttctcttgttttg

SEQ ID NO: 9401677 - DNA, 22 bp, Homo sapiens
tctgaaattgttagtaaaaatg

SEQ ID NO: 9401678 - DNA, 22 bp, Homo sapiens
tctgaaattccttccagacttt

SEQ ID NO: 9401679 - DNA, 22 bp, Homo sapiens
tctgaaattttagttatagaaa

SEQ ID NO: 9401680 - DNA, 22 bp, Homo sapiens
tctgaaatggcagcgggaatga

SEQ ID NO: 9401681 - DNA, 22 bp, Homo sapiens
tctgaaatgcaggcaatttgct

SEQ ID NO: 9401682 - DNA, 22 bp, Homo sapiens
tctgaaatggcgatggccgttg

SEQ ID NO: 9401683 - DNA, 22 bp, Homo sapiens
tctgaaatggggctgaagcact

SEQ ID NO: 9401684 - DNA, 22 bp, Homo sapiens
tctgaaatgcaaatttgactga

SEQ ID NO: 9401685 - DNA, 22 bp, Homo sapiens
tctgaagaataggatgttgtgt

SEQ ID NO: 9401686 - DNA, 22 bp, Homo sapiens
tctgaacagaaaagatgcacaa

SEQ ID NO: 9401687 - DNA, 22 bp, Homo sapiens
tctgaacagaaaagatgcacaa

SEQ ID NO: 9401688 - DNA, 22 bp, Homo sapiens
tctgaacatcctacaacatttt

SEQ ID NO: 9401689 - DNA, 17 bp, Homo sapiens
tctgaagccagtctgct

SEQ ID NO: 9401690 - DNA, 21 bp, Homo sapiens
tctgaaggcattttccaaggt

SEQ ID NO: 9401691 - DNA, 22 bp, Homo sapiens
tctgaaggtgctagagaaagct

SEQ ID NO: 9401692 - DNA, 22 bp, Homo sapiens
tctgaaggtctgagaaccagga

SEQ ID NO: 9401693 - DNA, 22 bp, Homo sapiens
tctgaagggctgagtggaggag

SEQ ID NO: 9401694 - DNA, 22 bp, Homo sapiens
tctgaaggtctgagaaccagga

SEQ ID NO: 9401695 - DNA, 22 bp, Homo sapiens
tctgaagagtcttgcaagaaag

SEQ ID NO: 9401696 - DNA, 22 bp, Homo sapiens
tctgaagagtcttgcaagaaag

SEQ ID NO: 9401697 - DNA, 19 bp, Homo sapiens
tctcttctccctggtttta

SEQ ID NO: 9401698 - DNA, 22 bp, Homo sapiens
tctcttctctagtgagcaactg

SEQ ID NO: 9401699 - DNA, 22 bp, Homo sapiens
tctcttctctagtgagcaactg

SEQ ID NO: 9401700 - DNA, 22 bp, Homo sapiens
tctcttctatttgagactattt

SEQ ID NO: 9401701 - DNA, 22 bp, Homo sapiens
tctcttctatttgagactattt

SEQ ID NO: 9401702 - DNA, 22 bp, Homo sapiens
tctcttctatttgagactattt

SEQ ID NO: 9401703 - DNA, 22 bp, Homo sapiens
tctcttctatttgagactattt

SEQ ID NO: 9401704 - DNA, 22 bp, Homo sapiens
tctcttctaattttcccgagta

SEQ ID NO: 9401705 - DNA, 22 bp, Homo sapiens
tctcttctaattttcccgagta

SEQ ID NO: 9401706 - DNA, 22 bp, Homo sapiens
tctcttctaattttcccgagta

SEQ ID NO: 9401707 - DNA, 22 bp, Homo sapiens
tctcttctaacactagaaattc

SEQ ID NO: 9401708 - DNA, 22 bp, Homo sapiens
tctcttctaattagggtccatg

SEQ ID NO: 9401709 - DNA, 22 bp, Homo sapiens
tctcttctaattagggtccatg

SEQ ID NO: 9401710 - DNA, 22 bp, Homo sapiens
tctcttctagcttcttgtggtt

SEQ ID NO: 9401711 - DNA, 22 bp, Homo sapiens
tctcttctagcttcttgtggtt

SEQ ID NO: 9401712 - DNA, 22 bp, Homo sapiens
tctcttctatttgagactattt

SEQ ID NO: 9401713 - DNA, 22 bp, Homo sapiens
tctcttcttgattttcactgga

SEQ ID NO: 9401714 - DNA, 22 bp, Homo sapiens
tctcttcttgattttcactgga

SEQ ID NO: 9401715 - DNA, 18 bp, Homo sapiens
tctcttcttggcagtcaa

SEQ ID NO: 9401716 - DNA, 22 bp, Homo sapiens
tctcttctgaaacctgtcttta

SEQ ID NO: 9401717 - DNA, 22 bp, Homo sapiens
tctcttctgaaacctgtcttta

SEQ ID NO: 9401718 - DNA, 20 bp, Homo sapiens
tctcttctggggagataaaa

SEQ ID NO: 9401719 - DNA, 20 bp, Homo sapiens
tctcttctggggagataaaa

SEQ ID NO: 9401720 - DNA, 22 bp, Homo sapiens
tctcttctgacctagccttgga

SEQ ID NO: 9401721 - DNA, 22 bp, Homo sapiens
tctcttctgacctagccttgga

SEQ ID NO: 9401722 - DNA, 22 bp, Homo sapiens
tctcttctgacctagccttgga

SEQ ID NO: 9401723 - DNA, 21 bp, Homo sapiens
tctcttcctccgcgccgccgc

SEQ ID NO: 9401724 - DNA, 22 bp, Homo sapiens
tctcttctaacactagaaattc

SEQ ID NO: 9401725 - DNA, 22 bp, Homo sapiens
tctcttctaacactagaaattc

SEQ ID NO: 9401726 - DNA, 22 bp, Homo sapiens
tctcttccatgtttcagcccca

SEQ ID NO: 9401727 - DNA, 22 bp, Homo sapiens
tctcttccatgtttcagcccca

SEQ ID NO: 9401728 - DNA, 22 bp, Homo sapiens
tctcttcccggataaagtaagt

SEQ ID NO: 9401729 - DNA, 21 bp, Homo sapiens
tctcttcccatcaggacacta

SEQ ID NO: 9401730 - DNA, 23 bp, Homo sapiens
tctctgtgtgcctcagtttcttc

SEQ ID NO: 9401731 - DNA, 22 bp, Homo sapiens
tctcttaatccggtgctttctg

SEQ ID NO: 9401732 - DNA, 23 bp, Homo sapiens
tctctgtgtgcctcagtttcttc

SEQ ID NO: 9401733 - DNA, 21 bp, Homo sapiens
tctctgtgtctttaagctgga

SEQ ID NO: 9401734 - DNA, 21 bp, Homo sapiens
tctctgtgtctttaagctgga

SEQ ID NO: 9401735 - DNA, 20 bp, Homo sapiens
tctcttcaggaggtccatgt

SEQ ID NO: 9401736 - DNA, 20 bp, Homo sapiens
tctcttcaggaggtccatgt

SEQ ID NO: 9401737 - DNA, 22 bp, Homo sapiens
tctcttcacatgcttgctccaa

SEQ ID NO: 9401738 - DNA, 22 bp, Homo sapiens
tctcttcacatgcttgctccaa

SEQ ID NO: 9401739 - DNA, 22 bp, Homo sapiens
tctcttattttgcctttgacaa

SEQ ID NO: 9401740 - DNA, 22 bp, Homo sapiens
tctcttcacactacccctgtgt

SEQ ID NO: 9401741 - DNA, 22 bp, Homo sapiens
tctctgtctgcacccaatcaat

SEQ ID NO: 9401742 - DNA, 22 bp, Homo sapiens
tctctgtctttgttgtcttcac

SEQ ID NO: 9401743 - DNA, 22 bp, Homo sapiens
tctctgtctgagcctggcagac

SEQ ID NO: 9401744 - DNA, 22 bp, Homo sapiens
tctctgtccctaggagccttgc

SEQ ID NO: 9401745 - DNA, 22 bp, Homo sapiens
tctctgtctcccgtgtgtccgg

SEQ ID NO: 9401746 - DNA, 22 bp, Homo sapiens
tctctgtctcccgtgtgtccgg

SEQ ID NO: 9401747 - DNA, 22 bp, Homo sapiens
tctctggtggctccatcagtag

SEQ ID NO: 9401748 - DNA, 22 bp, Homo sapiens
tctctgtcacacaatctacaca

SEQ ID NO: 9401749 - DNA, 21 bp, Homo sapiens
tctctggttctgaaatggttt

SEQ ID NO: 9401750 - DNA, 21 bp, Homo sapiens
tctctggttctgaaatggttt

SEQ ID NO: 9401751 - DNA, 22 bp, Homo sapiens
tctctggttattaactaactcc

SEQ ID NO: 9401752 - DNA, 22 bp, Homo sapiens
tctctggttatgtcattaagca

SEQ ID NO: 9401753 - DNA, 22 bp, Homo sapiens
tctctgggtttttgtcctgtac

SEQ ID NO: 9401754 - DNA, 22 bp, Homo sapiens
tctctgggtttttgtcctgtac

SEQ ID NO: 9401755 - DNA, 22 bp, Homo sapiens
tctctgggtttttgtcctgtac

SEQ ID NO: 9401756 - DNA, 22 bp, Homo sapiens
tctctgtgagatgccttcctga

SEQ ID NO: 9401757 - DNA, 22 bp, Homo sapiens
tctctgtgagatgccttcctga

SEQ ID NO: 9401758 - DNA, 22 bp, Homo sapiens
tctctgtgagatgccttcctga

SEQ ID NO: 9401759 - DNA, 22 bp, Homo sapiens
tctctgtgacatttctgagcct

SEQ ID NO: 9401760 - DNA, 22 bp, Homo sapiens
tctctgtgacatttctgagcct

SEQ ID NO: 9401761 - DNA, 22 bp, Homo sapiens
tctctgtgacatttctgagcct

SEQ ID NO: 9401762 - DNA, 22 bp, Homo sapiens
tctctgtgactgcagctttgca

SEQ ID NO: 9401763 - DNA, 22 bp, Homo sapiens
tctctgtgaatggcgtcacctg

SEQ ID NO: 9401764 - DNA, 22 bp, Homo sapiens
tctctgtgaatggcgtcacctg

SEQ ID NO: 9401765 - DNA, 22 bp, Homo sapiens
tctctgtgaagctcccgttagg

SEQ ID NO: 9401766 - DNA, 22 bp, Homo sapiens
tctctgtgacagctgggtatgt

SEQ ID NO: 9401767 - DNA, 22 bp, Homo sapiens
tctctgtgagatttgtattaag

SEQ ID NO: 9401768 - DNA, 22 bp, Homo sapiens
tctctgtgagatttgtattaag

SEQ ID NO: 9401769 - DNA, 22 bp, Homo sapiens
tctctgtgagccaggtcctagt

SEQ ID NO: 9401770 - DNA, 22 bp, Homo sapiens
tctctgtgagatttgtattaag

SEQ ID NO: 9401771 - DNA, 22 bp, Homo sapiens
tctctgtgagccaggtcctagt

SEQ ID NO: 9401772 - DNA, 22 bp, Homo sapiens
tctctgtgcaggatgctgagtt

SEQ ID NO: 9401773 - DNA, 22 bp, Homo sapiens
tctctgtgcaggatgctgagtt

SEQ ID NO: 9401774 - DNA, 22 bp, Homo sapiens
tctctgtgcaggatgctgagtt

SEQ ID NO: 9401775 - DNA, 22 bp, Homo sapiens
tctctgtgagtggaaggcaccc

SEQ ID NO: 9401776 - DNA, 22 bp, Homo sapiens
tctctgtgagtggaaggcaccc

SEQ ID NO: 9401777 - DNA, 22 bp, Homo sapiens
tctctgtgcaggatgctgagtt

SEQ ID NO: 9401778 - DNA, 22 bp, Homo sapiens
tctctgtggtatgtcatagcaa

SEQ ID NO: 9401779 - DNA, 22 bp, Homo sapiens
tctctgtggtatgtcatagcaa

SEQ ID NO: 9401780 - DNA, 22 bp, Homo sapiens
tctctgtggtatgtcatagcaa

SEQ ID NO: 9401781 - DNA, 22 bp, Homo sapiens
tctctgtggtgggaggctgagt

SEQ ID NO: 9401782 - DNA, 21 bp, Homo sapiens
tctctgtggtccaatcccagc

SEQ ID NO: 9401783 - DNA, 22 bp, Homo sapiens
tctctgtggtgggaggctgagt

SEQ ID NO: 9401784 - DNA, 22 bp, Homo sapiens
tctctgtgggtttcaccagcgc

SEQ ID NO: 9401785 - DNA, 22 bp, Homo sapiens
tctctgtgggtttcaccagcgc

SEQ ID NO: 9401786 - DNA, 22 bp, Homo sapiens
tctctgtggtactgagagtcta

SEQ ID NO: 9401787 - DNA, 22 bp, Homo sapiens
tctctgtggtatgtcatagcaa

SEQ ID NO: 9401788 - DNA, 22 bp, Homo sapiens
tctctgtgtctcatgttcctat

SEQ ID NO: 9401789 - DNA, 22 bp, Homo sapiens
tctctgtgtctcatgttcctat

SEQ ID NO: 9401790 - DNA, 22 bp, Homo sapiens
tctctgtgtcttagtgaaggga

SEQ ID NO: 9401791 - DNA, 22 bp, Homo sapiens
tctctgtgtcttagtgaaggga

SEQ ID NO: 9401792 - DNA, 19 bp, Homo sapiens
tctctgtgtctctgtttat

SEQ ID NO: 9401793 - DNA, 21 bp, Homo sapiens
tctctgtgtacagtctcaccc

SEQ ID NO: 9401794 - DNA, 22 bp, Homo sapiens
tctctgtggtttgagagccggg

SEQ ID NO: 9401795 - DNA, 21 bp, Homo sapiens
tctctgtgtacagtctcaccc

SEQ ID NO: 9401796 - DNA, 22 bp, Homo sapiens
tctctgtgtcctgaaatgaagg

SEQ ID NO: 9401797 - DNA, 22 bp, Homo sapiens
tctctgtgcccagtagttctct

SEQ ID NO: 9401798 - DNA, 22 bp, Homo sapiens
tctctgtgcccagtagttctct

SEQ ID NO: 9401799 - DNA, 22 bp, Homo sapiens
tctctgtgcttgactttcccat

SEQ ID NO: 9401800 - DNA, 22 bp, Homo sapiens
tctctgtggcaactacttagct

SEQ ID NO: 9401801 - DNA, 22 bp, Homo sapiens
tctctgtggcaacaattcacta

SEQ ID NO: 9401802 - DNA, 22 bp, Homo sapiens
tctctgtggagcagtgtgttca

SEQ ID NO: 9401803 - DNA, 22 bp, Homo sapiens
tctctgtggagcagtgtgttca

SEQ ID NO: 9401804 - DNA, 21 bp, Homo sapiens
tctctgtggcctaccctctac

SEQ ID NO: 9401805 - DNA, 22 bp, Homo sapiens
tctctgtggcatccactcaact

SEQ ID NO: 9401806 - DNA, 22 bp, Homo sapiens
tctctgtggcatccactcaact

SEQ ID NO: 9401807 - DNA, 22 bp, Homo sapiens
tctctgtgggctttggacttga

SEQ ID NO: 9401808 - DNA, 22 bp, Homo sapiens
tctctgtgggctttggacttga

SEQ ID NO: 9401809 - DNA, 21 bp, Homo sapiens
tctctgtggcctaccctctac

SEQ ID NO: 9401810 - DNA, 22 bp, Homo sapiens
tctctgtggcaagcatgctgct

SEQ ID NO: 9401811 - DNA, 22 bp, Homo sapiens
tctctgtggcaactacttagct

SEQ ID NO: 9401812 - DNA, 22 bp, Homo sapiens
tctctgtggcaactacttagct

SEQ ID NO: 9401813 - DNA, 22 bp, Homo sapiens
tctctgtggcaagcatgctgct

SEQ ID NO: 9401814 - DNA, 22 bp, Homo sapiens
tctctgtggcaagcatgctgct

SEQ ID NO: 9401815 - DNA, 22 bp, Homo sapiens
tctctgtggcaagcatgctgct

SEQ ID NO: 9401816 - DNA, 22 bp, Homo sapiens
tctctcagcattactcttacta

SEQ ID NO: 9401817 - DNA, 22 bp, Homo sapiens
tctctcagatggggcactagta

SEQ ID NO: 9401818 - DNA, 22 bp, Homo sapiens
tctctcagaggccagggtcctg

SEQ ID NO: 9401819 - DNA, 22 bp, Homo sapiens
tctctcagctttgagacctgct

SEQ ID NO: 9401820 - DNA, 22 bp, Homo sapiens
tctctccaacatggtggtgctg

SEQ ID NO: 9401821 - DNA, 22 bp, Homo sapiens
tctctcatagagaaaaatatat

SEQ ID NO: 9401822 - DNA, 22 bp, Homo sapiens
tctctcagaaagcccatgtctg

SEQ ID NO: 9401823 - DNA, 22 bp, Homo sapiens
tctctcagaaagcccatgtctg

SEQ ID NO: 9401824 - DNA, 22 bp, Homo sapiens
tctctcactggtgcctctgttg

SEQ ID NO: 9401825 - DNA, 22 bp, Homo sapiens
tctctcactggtgcctctgttg

SEQ ID NO: 9401826 - DNA, 22 bp, Homo sapiens
tctctcagaactgcagctgcag

SEQ ID NO: 9401827 - DNA, 22 bp, Homo sapiens
tctctcagaactgcagctgcag

SEQ ID NO: 9401828 - DNA, 22 bp, Homo sapiens
tctctatattatatgtagtttg

SEQ ID NO: 9401829 - DNA, 20 bp, Homo sapiens
tctctatgaagtcaacagga

SEQ ID NO: 9401830 - DNA, 22 bp, Homo sapiens
tctctatttgcctaggcttgtg

SEQ ID NO: 9401831 - DNA, 20 bp, Homo sapiens
tctctcacgggttggtttct

SEQ ID NO: 9401832 - DNA, 19 bp, Homo sapiens
tctctcaattgcttcaatt

SEQ ID NO: 9401833 - DNA, 22 bp, Homo sapiens
tctctcactggtgcctctgttg

SEQ ID NO: 9401834 - DNA, 18 bp, Homo sapiens
tctctccatctatttgtt

SEQ ID NO: 9401835 - DNA, 22 bp, Homo sapiens
tctctcccaaatctgcagatag

SEQ ID NO: 9401836 - DNA, 22 bp, Homo sapiens
tctctccctttccttatcagtt

SEQ ID NO: 9401837 - DNA, 22 bp, Homo sapiens
tctctcctaatttcaggtgctt

SEQ ID NO: 9401838 - DNA, 22 bp, Homo sapiens
tctctcctaatttcaggtgctt

SEQ ID NO: 9401839 - DNA, 21 bp, Homo sapiens
tctctcctcaagctcgacccc

SEQ ID NO: 9401840 - DNA, 21 bp, Homo sapiens
tctctcctcaagctcgacccc

SEQ ID NO: 9401841 - DNA, 22 bp, Homo sapiens
tctctcctgcactgaattatgt

SEQ ID NO: 9401842 - DNA, 22 bp, Homo sapiens
tctctcctgtgttctgatgttt

SEQ ID NO: 9401843 - DNA, 22 bp, Homo sapiens
tctctcctgtgttctgatgttt

SEQ ID NO: 9401844 - DNA, 22 bp, Homo sapiens
tctctcctgtgttctgatgttt

SEQ ID NO: 9401845 - DNA, 18 bp, Homo sapiens
tctctctgaagagttccc

SEQ ID NO: 9401846 - DNA, 22 bp, Homo sapiens
tctctctcagccattacagaac

SEQ ID NO: 9401847 - DNA, 22 bp, Homo sapiens
tctctctcctagtttttagtgg

SEQ ID NO: 9401848 - DNA, 22 bp, Homo sapiens
tctctctcctagtttttagtgg

SEQ ID NO: 9401849 - DNA, 22 bp, Homo sapiens
tctctctcctagtttttagtgg

SEQ ID NO: 9401850 - DNA, 18 bp, Homo sapiens
tctctctgaagagttccc

SEQ ID NO: 9401851 - DNA, 18 bp, Homo sapiens
tctctctgaagagttccc

SEQ ID NO: 9401852 - DNA, 22 bp, Homo sapiens
tctctctgagttgagcaggagt

SEQ ID NO: 9401853 - DNA, 22 bp, Homo sapiens
tctctctgagccctgctttttc

SEQ ID NO: 9401854 - DNA, 22 bp, Homo sapiens
tctctctgagttgagcaggagt

SEQ ID NO: 9401855 - DNA, 22 bp, Homo sapiens
tctctctcagccattacagaac

SEQ ID NO: 9401856 - DNA, 22 bp, Homo sapiens
tctctctaggcatctattttca

SEQ ID NO: 9401857 - DNA, 22 bp, Homo sapiens
tctctctatatgtcaacagggg

SEQ ID NO: 9401858 - DNA, 22 bp, Homo sapiens
tctctccttatcattgtgttta

SEQ ID NO: 9401859 - DNA, 22 bp, Homo sapiens
tctctctactggggcactagga

SEQ ID NO: 9401860 - DNA, 22 bp, Homo sapiens
tctctcctgtgttctgatgttt

SEQ ID NO: 9401861 - DNA, 22 bp, Homo sapiens
tctctcctgtgttctgatgttt

SEQ ID NO: 9401862 - DNA, 21 bp, Homo sapiens
tctctgagacactctggagcc

SEQ ID NO: 9401863 - DNA, 22 bp, Homo sapiens
tctctgagacagtagcctctgc

SEQ ID NO: 9401864 - DNA, 22 bp, Homo sapiens
tctctgagcatgccatattgct

SEQ ID NO: 9401865 - DNA, 22 bp, Homo sapiens
tctctgagcccagtgtccccct

SEQ ID NO: 9401866 - DNA, 22 bp, Homo sapiens
tctctgagcccaatgtagcaat

SEQ ID NO: 9401867 - DNA, 22 bp, Homo sapiens
tctctgagcccctgcctctttc

SEQ ID NO: 9401868 - DNA, 22 bp, Homo sapiens
tctctgagctcaggagctgcag

SEQ ID NO: 9401869 - DNA, 22 bp, Homo sapiens
tctctgagcgcattcctccggc

SEQ ID NO: 9401870 - DNA, 22 bp, Homo sapiens
tctctgagggagatggcctgcc

SEQ ID NO: 9401871 - DNA, 20 bp, Homo sapiens
tctctgagcttctcttgggg

SEQ ID NO: 9401872 - DNA, 20 bp, Homo sapiens
tctctgagcttctcttgggg

SEQ ID NO: 9401873 - DNA, 22 bp, Homo sapiens
tctctgagctgcttcttgcata

SEQ ID NO: 9401874 - DNA, 22 bp, Homo sapiens
tctctgagcttaaggtgtttca

SEQ ID NO: 9401875 - DNA, 22 bp, Homo sapiens
tctctgagctgcttcttgcata

SEQ ID NO: 9401876 - DNA, 22 bp, Homo sapiens
tctctgagttctcctccagccc

SEQ ID NO: 9401877 - DNA, 22 bp, Homo sapiens
tctctgagtatcctgaactgcc

SEQ ID NO: 9401878 - DNA, 22 bp, Homo sapiens
tctctgagtatcctgaactgcc

SEQ ID NO: 9401879 - DNA, 22 bp, Homo sapiens
tctctgagtaagtgacagttca

SEQ ID NO: 9401880 - DNA, 22 bp, Homo sapiens
tctctgaggttgtttccagcac

SEQ ID NO: 9401881 - DNA, 22 bp, Homo sapiens
tctctgaggttgtttccagcac

SEQ ID NO: 9401882 - DNA, 22 bp, Homo sapiens
tctctgacatgcctaagacttt

SEQ ID NO: 9401883 - DNA, 22 bp, Homo sapiens
tctctgagaagttcctttgtga

SEQ ID NO: 9401884 - DNA, 18 bp, Homo sapiens
tctctgaatattttatgt

SEQ ID NO: 9401885 - DNA, 22 bp, Homo sapiens
tctctgaattctgatgcaagtg

SEQ ID NO: 9401886 - DNA, 22 bp, Homo sapiens
tctctgaattgtttaagttatt

SEQ ID NO: 9401887 - DNA, 22 bp, Homo sapiens
tctctgacatgcctaagacttt

SEQ ID NO: 9401888 - DNA, 22 bp, Homo sapiens
tctctgaaggctgtgttgatgg

SEQ ID NO: 9401889 - DNA, 22 bp, Homo sapiens
tctctctttttaatcatgtaat

SEQ ID NO: 9401890 - DNA, 22 bp, Homo sapiens
tctctgaagagtcagacataac

SEQ ID NO: 9401891 - DNA, 22 bp, Homo sapiens
tctctgaagatatttattatta

SEQ ID NO: 9401892 - DNA, 22 bp, Homo sapiens
tctctgaagctcaattgagata

SEQ ID NO: 9401893 - DNA, 22 bp, Homo sapiens
tctctcttgtcaccccatctgc

SEQ ID NO: 9401894 - DNA, 23 bp, Homo sapiens
tctctctggcaaatttcacatat

SEQ ID NO: 9401895 - DNA, 22 bp, Homo sapiens
tctctctttttaatcatgtaat

SEQ ID NO: 9401896 - DNA, 22 bp, Homo sapiens
tctctctttttaatcatgtaat

SEQ ID NO: 9401897 - DNA, 21 bp, Homo sapiens
tctctgggccctcctgtgggg

SEQ ID NO: 9401898 - DNA, 21 bp, Homo sapiens
tctctgggccctcctgtgggg

SEQ ID NO: 9401899 - DNA, 21 bp, Homo sapiens
tctctgggccctcctgtgggg

SEQ ID NO: 9401900 - DNA, 22 bp, Homo sapiens
tctctgggatcgttttgggctc

SEQ ID NO: 9401901 - DNA, 22 bp, Homo sapiens
tctctgggaaatggagaatttt

SEQ ID NO: 9401902 - DNA, 22 bp, Homo sapiens
tctctggctggcaccccaggga

SEQ ID NO: 9401903 - DNA, 19 bp, Homo sapiens
tctctggcttgtctgcctg

SEQ ID NO: 9401904 - DNA, 19 bp, Homo sapiens
tctctggcttgtctgcctg

SEQ ID NO: 9401905 - DNA, 22 bp, Homo sapiens
tctctggggaaaaggctgatac

SEQ ID NO: 9401906 - DNA, 19 bp, Homo sapiens
tctctggggacactttcac

SEQ ID NO: 9401907 - DNA, 22 bp, Homo sapiens
tctctggggatgcttattcttg

SEQ ID NO: 9401908 - DNA, 22 bp, Homo sapiens
tctctggggatgcttattcttg

SEQ ID NO: 9401909 - DNA, 22 bp, Homo sapiens
tctctgggcctgttttctcatc

SEQ ID NO: 9401910 - DNA, 22 bp, Homo sapiens
tctctgggctaaaatcaaggtg

SEQ ID NO: 9401911 - DNA, 22 bp, Homo sapiens
tctctgggctaaaatcaaggtg

SEQ ID NO: 9401912 - DNA, 22 bp, Homo sapiens
tctctgggctaaaatcaaggtg

SEQ ID NO: 9401913 - DNA, 22 bp, Homo sapiens
tctctgggctcaggagcccggc

SEQ ID NO: 9401914 - DNA, 22 bp, Homo sapiens
tctctgggcctgttttctcatc

SEQ ID NO: 9401915 - DNA, 22 bp, Homo sapiens
tctctgggcctccctttccaag

SEQ ID NO: 9401916 - DNA, 22 bp, Homo sapiens
tctctgggcctccctttccaag

SEQ ID NO: 9401917 - DNA, 22 bp, Homo sapiens
tctctgggcctccctttccaag

SEQ ID NO: 9401918 - DNA, 22 bp, Homo sapiens
tctctgggcctccctttccaag

SEQ ID NO: 9401919 - DNA, 22 bp, Homo sapiens
tctctgggtgatggcagggcac

SEQ ID NO: 9401920 - DNA, 22 bp, Homo sapiens
tctctgggtgatggcagggcac

SEQ ID NO: 9401921 - DNA, 22 bp, Homo sapiens
tctctgggttgagaactaggac

SEQ ID NO: 9401922 - DNA, 22 bp, Homo sapiens
tctctgggttgagaactaggac

SEQ ID NO: 9401923 - DNA, 20 bp, Homo sapiens
tctctgggttctcactcagc

SEQ ID NO: 9401924 - DNA, 20 bp, Homo sapiens
tctctgggttctcactcagc

SEQ ID NO: 9401925 - DNA, 22 bp, Homo sapiens
tctctgggttctcactcagcac

SEQ ID NO: 9401926 - DNA, 22 bp, Homo sapiens
tctctggggtagggcccaggac

SEQ ID NO: 9401927 - DNA, 22 bp, Homo sapiens
tctctgggtaaagttctctcat

SEQ ID NO: 9401928 - DNA, 22 bp, Homo sapiens
tctctgggtaaagttctctcat

SEQ ID NO: 9401929 - DNA, 22 bp, Homo sapiens
tctctgggtattcactgccttc

SEQ ID NO: 9401930 - DNA, 22 bp, Homo sapiens
tctctgggtattcactgccttc

SEQ ID NO: 9401931 - DNA, 22 bp, Homo sapiens
tctctgggtcctggcaagctca

SEQ ID NO: 9401932 - DNA, 22 bp, Homo sapiens
tctctggggcctttctacatca

SEQ ID NO: 9401933 - DNA, 22 bp, Homo sapiens
tctctggggcctttctacatca

SEQ ID NO: 9401934 - DNA, 22 bp, Homo sapiens
tctctggggatggacctgggag

SEQ ID NO: 9401935 - DNA, 22 bp, Homo sapiens
tctctgggggtagaactcaggc

SEQ ID NO: 9401936 - DNA, 22 bp, Homo sapiens
tctctgggggtagaactcaggc

SEQ ID NO: 9401937 - DNA, 22 bp, Homo sapiens
tctctgggggtagaactcaggc

SEQ ID NO: 9401938 - DNA, 22 bp, Homo sapiens
tctctgggggtagaactcaggc

SEQ ID NO: 9401939 - DNA, 22 bp, Homo sapiens
tctctggggtagggcccaggac

SEQ ID NO: 9401940 - DNA, 22 bp, Homo sapiens
tctctggcagactggctgggct

SEQ ID NO: 9401941 - DNA, 22 bp, Homo sapiens
tctctggcagactggctgggct

SEQ ID NO: 9401942 - DNA, 22 bp, Homo sapiens
tctctggcacataataaggtct

SEQ ID NO: 9401943 - DNA, 20 bp, Homo sapiens
tctctggcaagaagctgcag

SEQ ID NO: 9401944 - DNA, 20 bp, Homo sapiens
tctctggcaagaagctgcag

SEQ ID NO: 9401945 - DNA, 19 bp, Homo sapiens
tctctggatgacagacact

SEQ ID NO: 9401946 - DNA, 21 bp, Homo sapiens
tctctggagttagcagagaga

SEQ ID NO: 9401947 - DNA, 21 bp, Homo sapiens
tctctggagttagcagagaga

SEQ ID NO: 9401948 - DNA, 22 bp, Homo sapiens
tctctggccccatggctgagct

SEQ ID NO: 9401949 - DNA, 20 bp, Homo sapiens
tctctggccagaaacaacag

SEQ ID NO: 9401950 - DNA, 22 bp, Homo sapiens
tctctggccccatggctgagct

SEQ ID NO: 9401951 - DNA, 22 bp, Homo sapiens
tctctggccccatggctgagct

SEQ ID NO: 9401952 - DNA, 19 bp, Homo sapiens
tctctggcatagactcaat

SEQ ID NO: 9401953 - DNA, 19 bp, Homo sapiens
tctctggcagttcagagca

SEQ ID NO: 9401954 - DNA, 22 bp, Homo sapiens
tctctggccgagagtccctggg

SEQ ID NO: 9401955 - DNA, 23 bp, Homo sapiens
tctctggcctttgatcaggttga

SEQ ID NO: 9401956 - DNA, 22 bp, Homo sapiens
tctctggctgatattcctctgc

SEQ ID NO: 9401957 - DNA, 22 bp, Homo sapiens
tctctggctggcaccccaggga

SEQ ID NO: 9401958 - DNA, 19 bp, Homo sapiens
tctctgccgatcagggccc

SEQ ID NO: 9401959 - DNA, 22 bp, Homo sapiens
tctctgagttcctgtggatttt

SEQ ID NO: 9401960 - DNA, 22 bp, Homo sapiens
tctctgagttctcctccagccc

SEQ ID NO: 9401961 - DNA, 22 bp, Homo sapiens
tctctgctaagattgtgtctag

SEQ ID NO: 9401962 - DNA, 22 bp, Homo sapiens
tctctgctaagattgtgtctag

SEQ ID NO: 9401963 - DNA, 22 bp, Homo sapiens
tctctgctctgtgcctcagttt

SEQ ID NO: 9401964 - DNA, 22 bp, Homo sapiens
tctctgctcaggcaccagccct

SEQ ID NO: 9401965 - DNA, 22 bp, Homo sapiens
tctctgctcaggcaccagccct

SEQ ID NO: 9401966 - DNA, 22 bp, Homo sapiens
tctctgctctgtgcctcagttt

SEQ ID NO: 9401967 - DNA, 22 bp, Homo sapiens
tctctgctctgtgcctcagttt

SEQ ID NO: 9401968 - DNA, 22 bp, Homo sapiens
tctctgctctgtgcctcagttt

SEQ ID NO: 9401969 - DNA, 20 bp, Homo sapiens
tctctgctgtccacatttgc

SEQ ID NO: 9401970 - DNA, 19 bp, Homo sapiens
tctctgcttctcttggcat

SEQ ID NO: 9401971 - DNA, 19 bp, Homo sapiens
tctctgcttctcttggcat

SEQ ID NO: 9401972 - DNA, 19 bp, Homo sapiens
tctctgcttctcttggcat

SEQ ID NO: 9401973 - DNA, 23 bp, Homo sapiens
tctctggaactggagagtacggt

SEQ ID NO: 9401974 - DNA, 21 bp, Homo sapiens
tctctggaattagaccatgtt

SEQ ID NO: 9401975 - DNA, 22 bp, Homo sapiens
tctctggaattggctgaggcaa

SEQ ID NO: 9401976 - DNA, 22 bp, Homo sapiens
tctctggagggctccaggcggg

SEQ ID NO: 9401977 - DNA, 22 bp, Homo sapiens
tctctggagctgcagatccagg

SEQ ID NO: 9401978 - DNA, 22 bp, Homo sapiens
tctctggacttccacctctatt

SEQ ID NO: 9401979 - DNA, 22 bp, Homo sapiens
tctctggaattttgagagtgac

SEQ ID NO: 9401980 - DNA, 22 bp, Homo sapiens
tctctggagggctccaggcggg

SEQ ID NO: 9401981 - DNA, 22 bp, Homo sapiens
tctctggagtataaccagggat

SEQ ID NO: 9401982 - DNA, 22 bp, Homo sapiens
tcctgtctaaagacctgcaggc

SEQ ID NO: 9401983 - DNA, 22 bp, Homo sapiens
tcctgtctaaagacctgcaggc

SEQ ID NO: 9401984 - DNA, 22 bp, Homo sapiens
tcctgtctaaagacctgcaggc

SEQ ID NO: 9401985 - DNA, 22 bp, Homo sapiens
tcctgtcagtgaggcagatgaa

SEQ ID NO: 9401986 - DNA, 22 bp, Homo sapiens
tcctggttgttgttatagtata

SEQ ID NO: 9401987 - DNA, 22 bp, Homo sapiens
tcctggttctggaatgtttaag

SEQ ID NO: 9401988 - DNA, 22 bp, Homo sapiens
tcctggttcttgaggagccatg

SEQ ID NO: 9401989 - DNA, 18 bp, Homo sapiens
tcctggttctgtggccac

SEQ ID NO: 9401990 - DNA, 22 bp, Homo sapiens
tcctggtttacagagtaaacca

SEQ ID NO: 9401991 - DNA, 22 bp, Homo sapiens
tcctggtttatagcttagggaa

SEQ ID NO: 9401992 - DNA, 22 bp, Homo sapiens
tcctggtttatagactgatggc

SEQ ID NO: 9401993 - DNA, 22 bp, Homo sapiens
tcctggtgtaatggtaagcatg

SEQ ID NO: 9401994 - DNA, 22 bp, Homo sapiens
tcctggtgggacagaaaacctc

SEQ ID NO: 9401995 - DNA, 22 bp, Homo sapiens
tcctggttagagctctctgggg

SEQ ID NO: 9401996 - DNA, 22 bp, Homo sapiens
tcctggttaccaagcagctctc

SEQ ID NO: 9401997 - DNA, 22 bp, Homo sapiens
tcctggtgtcgcctggtcagtt

SEQ ID NO: 9401998 - DNA, 22 bp, Homo sapiens
tcctggtgtaatggtaagcatg

SEQ ID NO: 9401999 - DNA, 22 bp, Homo sapiens
tcctggtgtcgcctggtcagtt

SEQ ID NO: 9402000 - DNA, 22 bp, Homo sapiens
tcctggtgtcgcctggtcagtt

SEQ ID NO: 9402001 - DNA, 22 bp, Homo sapiens
tcctgtgaccagcttccatgct

SEQ ID NO: 9402002 - DNA, 21 bp, Homo sapiens
tcctgtgaggacctgtcagtg

SEQ ID NO: 9402003 - DNA, 22 bp, Homo sapiens
tcctgtgcctccacctgctccg

SEQ ID NO: 9402004 - DNA, 22 bp, Homo sapiens
tcctgtctgctcacagagctgg

SEQ ID NO: 9402005 - DNA, 22 bp, Homo sapiens
tcctgtctaaagacctgcaggc

SEQ ID NO: 9402006 - DNA, 22 bp, Homo sapiens
tcctgtctgtctttggtccctt

SEQ ID NO: 9402007 - DNA, 22 bp, Homo sapiens
tcctgtctgtctttggtccctt

SEQ ID NO: 9402008 - DNA, 22 bp, Homo sapiens
tcctgtctgctcacagagctgg

SEQ ID NO: 9402009 - DNA, 22 bp, Homo sapiens
tcctgtggagaggactggaggt

SEQ ID NO: 9402010 - DNA, 22 bp, Homo sapiens
tcctgtgctttggatgcttaga

SEQ ID NO: 9402011 - DNA, 22 bp, Homo sapiens
tcctgtgctttggatgcttaga

SEQ ID NO: 9402012 - DNA, 22 bp, Homo sapiens
tcctgtggaagacagtgttggg

SEQ ID NO: 9402013 - DNA, 22 bp, Homo sapiens
tcctgtgctttggaggatgttc

SEQ ID NO: 9402014 - DNA, 22 bp, Homo sapiens
tcctgtgctgttaatagtgata

SEQ ID NO: 9402015 - DNA, 22 bp, Homo sapiens
tcctgtggtatgggagtgatgt

SEQ ID NO: 9402016 - DNA, 22 bp, Homo sapiens
tcctgtggggaaaagcctatct

SEQ ID NO: 9402017 - DNA, 17 bp, Homo sapiens
tcctgtgggtgcagcag

SEQ ID NO: 9402018 - DNA, 22 bp, Homo sapiens
tcctgtggcttccacgacctaa

SEQ ID NO: 9402019 - DNA, 22 bp, Homo sapiens
tcctgtggcttccacgacctaa

SEQ ID NO: 9402020 - DNA, 22 bp, Homo sapiens
tcctgtgggctctcggcctcca

SEQ ID NO: 9402021 - DNA, 22 bp, Homo sapiens
tcctgtggggaaaagcctatct

SEQ ID NO: 9402022 - DNA, 22 bp, Homo sapiens
tcctggggtttagagggaagtg

SEQ ID NO: 9402023 - DNA, 22 bp, Homo sapiens
tcctggggtcctgactgcttcc

SEQ ID NO: 9402024 - DNA, 22 bp, Homo sapiens
tcctggggttttggccgcagct

SEQ ID NO: 9402025 - DNA, 22 bp, Homo sapiens
tcctgggtagcctgtccaagat

SEQ ID NO: 9402026 - DNA, 22 bp, Homo sapiens
tcctgggtagcctgtccaagat

SEQ ID NO: 9402027 - DNA, 22 bp, Homo sapiens
tcctgggtagcctgtccaagat

SEQ ID NO: 9402028 - DNA, 22 bp, Homo sapiens
tcctgggtaaacactgaccttt

SEQ ID NO: 9402029 - DNA, 22 bp, Homo sapiens
tcctgggtaaacactgaccttt

SEQ ID NO: 9402030 - DNA, 22 bp, Homo sapiens
tcctgggtagagacctgatgaa

SEQ ID NO: 9402031 - DNA, 18 bp, Homo sapiens
tcctggtattgcaagcac

SEQ ID NO: 9402032 - DNA, 22 bp, Homo sapiens
tcctggtcagctttgaggttgt

SEQ ID NO: 9402033 - DNA, 22 bp, Homo sapiens
tcctggtggctctttgggaagg

SEQ ID NO: 9402034 - DNA, 22 bp, Homo sapiens
tcctggtggctctttgggaagg

SEQ ID NO: 9402035 - DNA, 22 bp, Homo sapiens
tcctgggttaattatgattcac

SEQ ID NO: 9402036 - DNA, 22 bp, Homo sapiens
tcctgggtgtgatattcataga

SEQ ID NO: 9402037 - DNA, 22 bp, Homo sapiens
tcctgggtgtgatattcataga

SEQ ID NO: 9402038 - DNA, 23 bp, Homo sapiens
tcctgggtttgaattctagtctt

SEQ ID NO: 9402039 - DNA, 23 bp, Homo sapiens
tcctgggtttgaattctagtctt

SEQ ID NO: 9402040 - DNA, 22 bp, Homo sapiens
tcctgggttcatgtcctggtgc

SEQ ID NO: 9402041 - DNA, 22 bp, Homo sapiens
tcctgggtcccgcacatctgtc

SEQ ID NO: 9402042 - DNA, 22 bp, Homo sapiens
tcctgggtccatggcagccgaa

SEQ ID NO: 9402043 - DNA, 22 bp, Homo sapiens
tcctgggtcccgcacatctgtc

SEQ ID NO: 9402044 - DNA, 22 bp, Homo sapiens
tcctgggtctcttccttagttc

SEQ ID NO: 9402045 - DNA, 22 bp, Homo sapiens
tcctgggtcctgggaagccctg

SEQ ID NO: 9402046 - DNA, 22 bp, Homo sapiens
tcctgggtcctgggaagccctg

SEQ ID NO: 9402047 - DNA, 22 bp, Homo sapiens
tcctgggtctgggtgtctgagg

SEQ ID NO: 9402048 - DNA, 22 bp, Homo sapiens
tcctgggtctgggtgtctgagg

SEQ ID NO: 9402049 - DNA, 22 bp, Homo sapiens
tcctgggtgaaagaacaggcag

SEQ ID NO: 9402050 - DNA, 22 bp, Homo sapiens
tcctgggtggtggtaggagcag

SEQ ID NO: 9402051 - DNA, 22 bp, Homo sapiens
tcctgggtggtggtaggagcag

SEQ ID NO: 9402052 - DNA, 22 bp, Homo sapiens
tcctgggtgaaagaacaggcag

SEQ ID NO: 9402053 - DNA, 22 bp, Homo sapiens
tcctgggtggctctgcccggct

SEQ ID NO: 9402054 - DNA, 22 bp, Homo sapiens
tcctggggctctgagcgagaca

SEQ ID NO: 9402055 - DNA, 22 bp, Homo sapiens
tcctggggccaggcacctctgg

SEQ ID NO: 9402056 - DNA, 19 bp, Homo sapiens
tcctggggatgtggtcacc

SEQ ID NO: 9402057 - DNA, 19 bp, Homo sapiens
tcctggggatgtggtcacc

SEQ ID NO: 9402058 - DNA, 22 bp, Homo sapiens
tcctggggccagcactggtgga

SEQ ID NO: 9402059 - DNA, 22 bp, Homo sapiens
tcctggggctgcaaggcctgtc

SEQ ID NO: 9402060 - DNA, 20 bp, Homo sapiens
tcctggggtaagccatggtc

SEQ ID NO: 9402061 - DNA, 20 bp, Homo sapiens
tcctggggtaagccatggtc

SEQ ID NO: 9402062 - DNA, 22 bp, Homo sapiens
tcctggggctctttgatgtgat

SEQ ID NO: 9402063 - DNA, 22 bp, Homo sapiens
tcctggggctgcaaggcctgtc

SEQ ID NO: 9402064 - DNA, 22 bp, Homo sapiens
tcctggggctgcaaggcctgtc

SEQ ID NO: 9402065 - DNA, 22 bp, Homo sapiens
tcctggggctgcaaggcctgtc

SEQ ID NO: 9402066 - DNA, 22 bp, Homo sapiens
tcctggggaggtcgaggctgag

SEQ ID NO: 9402067 - DNA, 19 bp, Homo sapiens
tcctgggctgggccaggtc

SEQ ID NO: 9402068 - DNA, 22 bp, Homo sapiens
tcctgggctgtgtgccactctg

SEQ ID NO: 9402069 - DNA, 22 bp, Homo sapiens
tcctgggcggttatgtgatctg

SEQ ID NO: 9402070 - DNA, 22 bp, Homo sapiens
tcctgggcggttatgtgatctg

SEQ ID NO: 9402071 - DNA, 22 bp, Homo sapiens
tcctgggcgattttctgaatat

SEQ ID NO: 9402072 - DNA, 22 bp, Homo sapiens
tcctgggctgcagggaagagca

SEQ ID NO: 9402073 - DNA, 22 bp, Homo sapiens
tcctgggctgcagggaagagca

SEQ ID NO: 9402074 - DNA, 19 bp, Homo sapiens
tcctgggctgcgtcttgcc

SEQ ID NO: 9402075 - DNA, 19 bp, Homo sapiens
tcctgggctgggccaggtc

SEQ ID NO: 9402076 - DNA, 22 bp, Homo sapiens
tcctgggcagcgggacgctcag

SEQ ID NO: 9402077 - DNA, 22 bp, Homo sapiens
tcctgggccaagggctgtgagg

SEQ ID NO: 9402078 - DNA, 22 bp, Homo sapiens
tcctgggccaagggctgtgagg

SEQ ID NO: 9402079 - DNA, 22 bp, Homo sapiens
tcctgggcccaggctgccaggg

SEQ ID NO: 9402080 - DNA, 22 bp, Homo sapiens
tcctgggcccaggctgccaggg

SEQ ID NO: 9402081 - DNA, 22 bp, Homo sapiens
tcctgggcccaggctgccaggg

SEQ ID NO: 9402082 - DNA, 22 bp, Homo sapiens
tcctgggcgagtggtggtacac

SEQ ID NO: 9402083 - DNA, 22 bp, Homo sapiens
tcctgggcgagtggtggtacac

SEQ ID NO: 9402084 - DNA, 22 bp, Homo sapiens
tcctgggcgaggtactggggct

SEQ ID NO: 9402085 - DNA, 22 bp, Homo sapiens
tcctgggcgaggtactggggct

SEQ ID NO: 9402086 - DNA, 22 bp, Homo sapiens
tcctgggccctccggatcaggt

SEQ ID NO: 9402087 - DNA, 22 bp, Homo sapiens
tcctgggcctgtactccatccg

SEQ ID NO: 9402088 - DNA, 22 bp, Homo sapiens
tcctgggcctgtactccatccg

SEQ ID NO: 9402089 - DNA, 22 bp, Homo sapiens
tcctgggccctccggatcaggt

SEQ ID NO: 9402090 - DNA, 22 bp, Homo sapiens
tcctgggccctccggatcaggt

SEQ ID NO: 9402091 - DNA, 22 bp, Homo sapiens
tcctgggcaaagaggggcagtg

SEQ ID NO: 9402092 - DNA, 22 bp, Homo sapiens
tcctgggcaaagaggggcagtg

SEQ ID NO: 9402093 - DNA, 22 bp, Homo sapiens
tcctgggcaaaagtatctgtga

SEQ ID NO: 9402094 - DNA, 22 bp, Homo sapiens
tcctgggattaaggtggtgatt

SEQ ID NO: 9402095 - DNA, 22 bp, Homo sapiens
tcctgggattaaggtggtgatt

SEQ ID NO: 9402096 - DNA, 22 bp, Homo sapiens
tcctgggatgcataaaatatgt

SEQ ID NO: 9402097 - DNA, 22 bp, Homo sapiens
tcctgggcacaagtgagtctcc

SEQ ID NO: 9402098 - DNA, 22 bp, Homo sapiens
tcctgggcagaatgggatggct

SEQ ID NO: 9402099 - DNA, 22 bp, Homo sapiens
tcctgggcagaatgggatggct

SEQ ID NO: 9402100 - DNA, 22 bp, Homo sapiens
tcctgggcacaagtgagtctcc

SEQ ID NO: 9402101 - DNA, 22 bp, Homo sapiens
tcctgggcagcctctctggaag

SEQ ID NO: 9402102 - DNA, 22 bp, Homo sapiens
tcctgggcagcctctctggaag

SEQ ID NO: 9402103 - DNA, 22 bp, Homo sapiens
tcctgggcagcctctctggaag

SEQ ID NO: 9402104 - DNA, 22 bp, Homo sapiens
tcctgggcagaatgggatggct

SEQ ID NO: 9402105 - DNA, 22 bp, Homo sapiens
tcctgggatcaagtgatcctcc

SEQ ID NO: 9402106 - DNA, 22 bp, Homo sapiens
tcctgggagtggccatgtaatg

SEQ ID NO: 9402107 - DNA, 22 bp, Homo sapiens
tcctgggagtggccatgtaatg

SEQ ID NO: 9402108 - DNA, 22 bp, Homo sapiens
tcctgggatactaagaaatttt

SEQ ID NO: 9402109 - DNA, 22 bp, Homo sapiens
tcctgggatgcataaaatatgt

SEQ ID NO: 9402110 - DNA, 22 bp, Homo sapiens
tcctgggatgaggaaacaagga

SEQ ID NO: 9402111 - DNA, 22 bp, Homo sapiens
tcctgggatgaggaaacaagga

SEQ ID NO: 9402112 - DNA, 22 bp, Homo sapiens
tcctgggatcaagtgatcctcc

SEQ ID NO: 9402113 - DNA, 22 bp, Homo sapiens
tcctgggagtaattgagtcatg

SEQ ID NO: 9402114 - DNA, 22 bp, Homo sapiens
tcctgggagtaattgagtcatg

SEQ ID NO: 9402115 - DNA, 22 bp, Homo sapiens
tcctgggagtaaaagctgccct

SEQ ID NO: 9402116 - DNA, 22 bp, Homo sapiens
tcctgggagtaaaagctgccct

SEQ ID NO: 9402117 - DNA, 22 bp, Homo sapiens
tcctgggaggtaaaccagcatc

SEQ ID NO: 9402118 - DNA, 22 bp, Homo sapiens
tcctgggagtaattgagtcatg

SEQ ID NO: 9402119 - DNA, 21 bp, Homo sapiens
tcctgggagtctgagatcctg

SEQ ID NO: 9402120 - DNA, 21 bp, Homo sapiens
tcctgggagtctgagatcctg

SEQ ID NO: 9402121 - DNA, 22 bp, Homo sapiens
tcctgggaggcaggaccccttt

SEQ ID NO: 9402122 - DNA, 22 bp, Homo sapiens
tcctgggaggcaggaccccttt

SEQ ID NO: 9402123 - DNA, 22 bp, Homo sapiens
tcctgggaggcggaggttgcag

SEQ ID NO: 9402124 - DNA, 22 bp, Homo sapiens
tcctgggaggctgtgcctggct

SEQ ID NO: 9402125 - DNA, 22 bp, Homo sapiens
tcctgggaggctgtgcctggct

SEQ ID NO: 9402126 - DNA, 22 bp, Homo sapiens
tcctgggactcaacttagaagg

SEQ ID NO: 9402127 - DNA, 22 bp, Homo sapiens
tcctgggactctgcctcaggct

SEQ ID NO: 9402128 - DNA, 22 bp, Homo sapiens
tcctgggactctgcctcaggct

SEQ ID NO: 9402129 - DNA, 22 bp, Homo sapiens
tcctgggaccctgggtgcagag

SEQ ID NO: 9402130 - DNA, 22 bp, Homo sapiens
tcctgggaccctgggtgcagag

SEQ ID NO: 9402131 - DNA, 22 bp, Homo sapiens
tcctgggaccgagggaagagct

SEQ ID NO: 9402132 - DNA, 22 bp, Homo sapiens
tcctgggaccgagggaagagct

SEQ ID NO: 9402133 - DNA, 22 bp, Homo sapiens
tcctgggacaagccgtggaagt

SEQ ID NO: 9402134 - DNA, 22 bp, Homo sapiens
tcctgggacaccccaatatgag

SEQ ID NO: 9402135 - DNA, 22 bp, Homo sapiens
tcctgggacaccccaatatgag

SEQ ID NO: 9402136 - DNA, 22 bp, Homo sapiens
tcctgggaccaggcacctactg

SEQ ID NO: 9402137 - DNA, 22 bp, Homo sapiens
tcctgggaagttgcatcaccgt

SEQ ID NO: 9402138 - DNA, 22 bp, Homo sapiens
tcctgggaagtggctggctgag

SEQ ID NO: 9402139 - DNA, 22 bp, Homo sapiens
tcctgggaagtggctggctgag

SEQ ID NO: 9402140 - DNA, 22 bp, Homo sapiens
tcctgggaagagacctgagcat

SEQ ID NO: 9402141 - DNA, 22 bp, Homo sapiens
tcctgggaagagacctgagcat

SEQ ID NO: 9402142 - DNA, 22 bp, Homo sapiens
tcctgggaagcgccggcctgcg

SEQ ID NO: 9402143 - DNA, 22 bp, Homo sapiens
tcctgggaagtggctggctgag

SEQ ID NO: 9402144 - DNA, 21 bp, Homo sapiens
tcctgggaagcactggggtgg

SEQ ID NO: 9402145 - DNA, 22 bp, Homo sapiens
tcctgggaagcgccggcctgcg

SEQ ID NO: 9402146 - DNA, 22 bp, Homo sapiens
tcctgggaagcgccggcctgcg

SEQ ID NO: 9402147 - DNA, 22 bp, Homo sapiens
tcctgggaagactgtgaggaca

SEQ ID NO: 9402148 - DNA, 22 bp, Homo sapiens
tcctgggaagagacctgagcat

SEQ ID NO: 9402149 - DNA, 22 bp, Homo sapiens
tcctgggaactcggaaagctct

SEQ ID NO: 9402150 - DNA, 18 bp, Homo sapiens
tcctgggaaaggcataca

SEQ ID NO: 9402151 - DNA, 18 bp, Homo sapiens
tcctgggaaaggcataca

SEQ ID NO: 9402152 - DNA, 18 bp, Homo sapiens
tcctgggaacttgctagc

SEQ ID NO: 9402153 - DNA, 21 bp, Homo sapiens
tcctggctttatgctacctct

SEQ ID NO: 9402154 - DNA, 18 bp, Homo sapiens
tcctgggaaaggcataca

SEQ ID NO: 9402155 - DNA, 22 bp, Homo sapiens
tcctggcttttcttggctcatc

SEQ ID NO: 9402156 - DNA, 22 bp, Homo sapiens
tcctggcttccactcctctgtt

SEQ ID NO: 9402157 - DNA, 22 bp, Homo sapiens
tcctggcttaggtttccagaac

SEQ ID NO: 9402158 - DNA, 22 bp, Homo sapiens
tcctggcttccacacctgtcat

SEQ ID NO: 9402159 - DNA, 22 bp, Homo sapiens
tcctggctgttagagaggcaag

SEQ ID NO: 9402160 - DNA, 22 bp, Homo sapiens
tcctggctgttagagaggcaag

SEQ ID NO: 9402161 - DNA, 22 bp, Homo sapiens
tcctggctgagttcccaagtcg

SEQ ID NO: 9402162 - DNA, 22 bp, Homo sapiens
tcctggctcttctgagttttct

SEQ ID NO: 9402163 - DNA, 22 bp, Homo sapiens
tcctggctgcaccagtgaccct

SEQ ID NO: 9402164 - DNA, 22 bp, Homo sapiens
tcctggctggaatttctcactc

SEQ ID NO: 9402165 - DNA, 22 bp, Homo sapiens
tcctggctggaatttctcactc

SEQ ID NO: 9402166 - DNA, 22 bp, Homo sapiens
tcctggcccggccgggcctgct

SEQ ID NO: 9402167 - DNA, 22 bp, Homo sapiens
tcctggcccggccgggcctgct

SEQ ID NO: 9402168 - DNA, 22 bp, Homo sapiens
tcctggcccggccgggcctgct

SEQ ID NO: 9402169 - DNA, 22 bp, Homo sapiens
tcctggcccggccgggcctgct

SEQ ID NO: 9402170 - DNA, 16 bp, Homo sapiens
tcctggcccctatgga

SEQ ID NO: 9402171 - DNA, 22 bp, Homo sapiens
tcctggcccgatccctgtgaag

SEQ ID NO: 9402172 - DNA, 22 bp, Homo sapiens
tcctggcccgatccctgtgaag

SEQ ID NO: 9402173 - DNA, 22 bp, Homo sapiens
tcctggcccgatccctgtgaag

SEQ ID NO: 9402174 - DNA, 22 bp, Homo sapiens
tcctggcccgatccctgtgaag

SEQ ID NO: 9402175 - DNA, 22 bp, Homo sapiens
tcctggcccactcctagcttct

SEQ ID NO: 9402176 - DNA, 22 bp, Homo sapiens
tcctggcccactcctagcttct

SEQ ID NO: 9402177 - DNA, 22 bp, Homo sapiens
tcctggcccactatgccagcat

SEQ ID NO: 9402178 - DNA, 22 bp, Homo sapiens
tcctggcccactatgccagcat

SEQ ID NO: 9402179 - DNA, 22 bp, Homo sapiens
tcctggcccactatgccagcat

SEQ ID NO: 9402180 - DNA, 22 bp, Homo sapiens
tcctggccctgtggcctgcagt

SEQ ID NO: 9402181 - DNA, 22 bp, Homo sapiens
tcctggccctgtggcctgcagt

SEQ ID NO: 9402182 - DNA, 22 bp, Homo sapiens
tcctggccgccgcgtggggccg

SEQ ID NO: 9402183 - DNA, 22 bp, Homo sapiens
tcctggccgccgcgtggggccg

SEQ ID NO: 9402184 - DNA, 22 bp, Homo sapiens
tcctggcctagctcaccctgga

SEQ ID NO: 9402185 - DNA, 22 bp, Homo sapiens
tcctggcctagctcaccctgga

SEQ ID NO: 9402186 - DNA, 22 bp, Homo sapiens
tcctggcctcacagtcctgggt

SEQ ID NO: 9402187 - DNA, 22 bp, Homo sapiens
tcctggcctcacagtcctgggt

SEQ ID NO: 9402188 - DNA, 22 bp, Homo sapiens
tcctggccgctggcccctgaga

SEQ ID NO: 9402189 - DNA, 22 bp, Homo sapiens
tcctggccgctggcccctgaga

SEQ ID NO: 9402190 - DNA, 22 bp, Homo sapiens
tcctggcctagctcaccctgga

SEQ ID NO: 9402191 - DNA, 17 bp, Homo sapiens
tcctggctctgccactg

SEQ ID NO: 9402192 - DNA, 22 bp, Homo sapiens
tcctggctctgctgcctcctag

SEQ ID NO: 9402193 - DNA, 22 bp, Homo sapiens
tcctggctctgctgcctcctag

SEQ ID NO: 9402194 - DNA, 22 bp, Homo sapiens
tcctggctctaagtcctgagtg

SEQ ID NO: 9402195 - DNA, 23 bp, Homo sapiens
tcctggctctgcacttgctaatg

SEQ ID NO: 9402196 - DNA, 22 bp, Homo sapiens
tcctggctcctggagacctgct

SEQ ID NO: 9402197 - DNA, 22 bp, Homo sapiens
tcctggctcggcttggggactt

SEQ ID NO: 9402198 - DNA, 22 bp, Homo sapiens
tcctggctctaagtcctgagtg

SEQ ID NO: 9402199 - DNA, 22 bp, Homo sapiens
tcctggctctaagtcctgagtg

SEQ ID NO: 9402200 - DNA, 22 bp, Homo sapiens
tcctggctcctggagacctgct

SEQ ID NO: 9402201 - DNA, 22 bp, Homo sapiens
tcctggcctctgagtcaagaac

SEQ ID NO: 9402202 - DNA, 22 bp, Homo sapiens
tcctggcctcgctgtccacctt

SEQ ID NO: 9402203 - DNA, 22 bp, Homo sapiens
tcctggcctcgctgtccacctt

SEQ ID NO: 9402204 - DNA, 20 bp, Homo sapiens
tcctggcctccctggggctc

SEQ ID NO: 9402205 - DNA, 20 bp, Homo sapiens
tcctggcctccctggggctc

SEQ ID NO: 9402206 - DNA, 20 bp, Homo sapiens
tcctggcctccctggggctc

SEQ ID NO: 9402207 - DNA, 20 bp, Homo sapiens
tcctggcctccctggggctc

SEQ ID NO: 9402208 - DNA, 22 bp, Homo sapiens
tcctggcctccgttctctgcat

SEQ ID NO: 9402209 - DNA, 18 bp, Homo sapiens
tcctggccacactacctt

SEQ ID NO: 9402210 - DNA, 18 bp, Homo sapiens
tcctggccacactacctt

SEQ ID NO: 9402211 - DNA, 22 bp, Homo sapiens
tcctggccaggatgacctaaca

SEQ ID NO: 9402212 - DNA, 21 bp, Homo sapiens
tcctggccagggcactaggca

SEQ ID NO: 9402213 - DNA, 21 bp, Homo sapiens
tcctggccagggcactaggca

SEQ ID NO: 9402214 - DNA, 21 bp, Homo sapiens
tcctggccagggcactaggca

SEQ ID NO: 9402215 - DNA, 21 bp, Homo sapiens
tcctggccagggcactaggca

SEQ ID NO: 9402216 - DNA, 22 bp, Homo sapiens
tcctggccatgcaagatgagga

SEQ ID NO: 9402217 - DNA, 22 bp, Homo sapiens
tcctggcccaatctgcccatga

SEQ ID NO: 9402218 - DNA, 19 bp, Homo sapiens
tcctggcatttgtaggaaa

SEQ ID NO: 9402219 - DNA, 19 bp, Homo sapiens
tcctggcatttgtaggaaa

SEQ ID NO: 9402220 - DNA, 22 bp, Homo sapiens
tcctggcattgtgcagggtgtg

SEQ ID NO: 9402221 - DNA, 22 bp, Homo sapiens
tcctggcattgtgcagggtgtg

SEQ ID NO: 9402222 - DNA, 22 bp, Homo sapiens
tcctggcatttacaaacccacc

SEQ ID NO: 9402223 - DNA, 22 bp, Homo sapiens
tcctggcatttacaaacccacc

SEQ ID NO: 9402224 - DNA, 22 bp, Homo sapiens
tcctggccaagttactctctgc

SEQ ID NO: 9402225 - DNA, 22 bp, Homo sapiens
tcctggccaagtagatgtggcg

SEQ ID NO: 9402226 - DNA, 22 bp, Homo sapiens
tcctggccaagttactctctgc

SEQ ID NO: 9402227 - DNA, 22 bp, Homo sapiens
tcctggcagttcagccccctaa

SEQ ID NO: 9402228 - DNA, 22 bp, Homo sapiens
tcctggcataatggctttgctc

SEQ ID NO: 9402229 - DNA, 22 bp, Homo sapiens
tcctggcattgtgcagggtgtg

SEQ ID NO: 9402230 - DNA, 22 bp, Homo sapiens
tcctggcattgtgcagggtgtg

SEQ ID NO: 9402231 - DNA, 22 bp, Homo sapiens
tcctggcatccgtgggtctgtg

SEQ ID NO: 9402232 - DNA, 19 bp, Homo sapiens
tcctggcatcttcctccct

SEQ ID NO: 9402233 - DNA, 22 bp, Homo sapiens
tcctggcacccttgggttggag

SEQ ID NO: 9402234 - DNA, 17 bp, Homo sapiens
tcctggcagtcccctgg

SEQ ID NO: 9402235 - DNA, 17 bp, Homo sapiens
tcctggcagtcccctgg

SEQ ID NO: 9402236 - DNA, 22 bp, Homo sapiens
tcctggcagttcagccccctaa

SEQ ID NO: 9402237 - DNA, 22 bp, Homo sapiens
tcctggcagtgcttgttttgga

SEQ ID NO: 9402238 - DNA, 20 bp, Homo sapiens
tcctggagtctggtttggct

SEQ ID NO: 9402239 - DNA, 20 bp, Homo sapiens
tcctggagtctggtttggct

SEQ ID NO: 9402240 - DNA, 20 bp, Homo sapiens
tcctggagtctggtttggct

SEQ ID NO: 9402241 - DNA, 22 bp, Homo sapiens
tcctggagtatttctgtggtgt

SEQ ID NO: 9402242 - DNA, 22 bp, Homo sapiens
tcctggagtatttctgtggtgt

SEQ ID NO: 9402243 - DNA, 22 bp, Homo sapiens
tcctggagtatttctgtggtgt

SEQ ID NO: 9402244 - DNA, 22 bp, Homo sapiens
tcctggagttgtctgtactcat

SEQ ID NO: 9402245 - DNA, 22 bp, Homo sapiens
tcctggagttgtctgtactcat

SEQ ID NO: 9402246 - DNA, 22 bp, Homo sapiens
tcctggagttgtctgtactcat

SEQ ID NO: 9402247 - DNA, 22 bp, Homo sapiens
tcctggagtggagtctgttgtt

SEQ ID NO: 9402248 - DNA, 22 bp, Homo sapiens
tcctggagtggagtctgttgtt

SEQ ID NO: 9402249 - DNA, 22 bp, Homo sapiens
tcctggagtgtcttccccaagg

SEQ ID NO: 9402250 - DNA, 22 bp, Homo sapiens
tcctggagtgtcttccccaagg

SEQ ID NO: 9402251 - DNA, 22 bp, Homo sapiens
tcctggagttgtgcagtgcaca

SEQ ID NO: 9402252 - DNA, 22 bp, Homo sapiens
tcctggagttgtgcagtgcaca

SEQ ID NO: 9402253 - DNA, 22 bp, Homo sapiens
tcctggagttgtgcagtgcaca

SEQ ID NO: 9402254 - DNA, 22 bp, Homo sapiens
tcctggagttgtgcagtgcaca

SEQ ID NO: 9402255 - DNA, 22 bp, Homo sapiens
tcctggagttgtgcagtgcaca

SEQ ID NO: 9402256 - DNA, 22 bp, Homo sapiens
tcctggagttgtgcagtgcaca

SEQ ID NO: 9402257 - DNA, 22 bp, Homo sapiens
tcctggagtttgtggtgatatg

SEQ ID NO: 9402258 - DNA, 22 bp, Homo sapiens
tcctggagtttgtggtgatatg

SEQ ID NO: 9402259 - DNA, 22 bp, Homo sapiens
tcctggagtttgtggtgatatg

SEQ ID NO: 9402260 - DNA, 22 bp, Homo sapiens
tcctggagtttgtaaggtgagc

SEQ ID NO: 9402261 - DNA, 22 bp, Homo sapiens
tcctggagtttgtaaggtgagc

SEQ ID NO: 9402262 - DNA, 20 bp, Homo sapiens
tcctggcaagccgtacctcc

SEQ ID NO: 9402263 - DNA, 22 bp, Homo sapiens
tcctggcaatggcaggttcagg

SEQ ID NO: 9402264 - DNA, 22 bp, Homo sapiens
tcctggcacaaccctttaccag

SEQ ID NO: 9402265 - DNA, 22 bp, Homo sapiens
tcctggcacaaccctttaccag

SEQ ID NO: 9402266 - DNA, 19 bp, Homo sapiens
tcctggcacagtggaacca

SEQ ID NO: 9402267 - DNA, 22 bp, Homo sapiens
tcctggcacattgcaggggctc

SEQ ID NO: 9402268 - DNA, 19 bp, Homo sapiens
tcctggcacagtggaacca

SEQ ID NO: 9402269 - DNA, 19 bp, Homo sapiens
tcctggcacagtggaacca

SEQ ID NO: 9402270 - DNA, 22 bp, Homo sapiens
tcctggcaaagatgttggtgtt

SEQ ID NO: 9402271 - DNA, 22 bp, Homo sapiens
tcctggatttagaagagcctcc

SEQ ID NO: 9402272 - DNA, 22 bp, Homo sapiens
tcctggcaaagatgttggtgtt

SEQ ID NO: 9402273 - DNA, 22 bp, Homo sapiens
tcctggcaaagcaagttatgaa

SEQ ID NO: 9402274 - DNA, 20 bp, Homo sapiens
tcctggcaagccgtacctcc

SEQ ID NO: 9402275 - DNA, 22 bp, Homo sapiens
tcctggatttagaagagcctcc

SEQ ID NO: 9402276 - DNA, 22 bp, Homo sapiens
tcctggatttaaccctggctct

SEQ ID NO: 9402277 - DNA, 22 bp, Homo sapiens
tcctggatttaaccctggctct

SEQ ID NO: 9402278 - DNA, 22 bp, Homo sapiens
tcctggattctgccctgaaggc

SEQ ID NO: 9402279 - DNA, 22 bp, Homo sapiens
tcctggattaatagggagctgt

SEQ ID NO: 9402280 - DNA, 22 bp, Homo sapiens
tcctggatggagctgccctcgc

SEQ ID NO: 9402281 - DNA, 22 bp, Homo sapiens
tcctggatatttgcttaaggtt

SEQ ID NO: 9402282 - DNA, 22 bp, Homo sapiens
tcctggagtttgtggtgatatg

SEQ ID NO: 9402283 - DNA, 17 bp, Homo sapiens
tcctggatccatggtgg

SEQ ID NO: 9402284 - DNA, 17 bp, Homo sapiens
tcctggatccatggtgg

SEQ ID NO: 9402285 - DNA, 17 bp, Homo sapiens
tcctggatccatggtgg

SEQ ID NO: 9402286 - DNA, 22 bp, Homo sapiens
tcctggactggctcagcaccct

SEQ ID NO: 9402287 - DNA, 22 bp, Homo sapiens
tcctggactcaggaccacagga

SEQ ID NO: 9402288 - DNA, 19 bp, Homo sapiens
tcctgctttctactctgct

SEQ ID NO: 9402289 - DNA, 22 bp, Homo sapiens
tcctggaacatggataaagaat

SEQ ID NO: 9402290 - DNA, 22 bp, Homo sapiens
tcctggaactgggctgggcgga

SEQ ID NO: 9402291 - DNA, 22 bp, Homo sapiens
tcctggagaagaggggcttgga

SEQ ID NO: 9402292 - DNA, 22 bp, Homo sapiens
tcctggagaagaggggcttgga

SEQ ID NO: 9402293 - DNA, 22 bp, Homo sapiens
tcctggagaactgattcgcggg

SEQ ID NO: 9402294 - DNA, 22 bp, Homo sapiens
tcctggagaactgattcgcggg

SEQ ID NO: 9402295 - DNA, 22 bp, Homo sapiens
tcctggagaagaggggcttgga

SEQ ID NO: 9402296 - DNA, 22 bp, Homo sapiens
tcctggagaaactcagagatct

SEQ ID NO: 9402297 - DNA, 23 bp, Homo sapiens
tcctggagaaaagaaacatttct

SEQ ID NO: 9402298 - DNA, 23 bp, Homo sapiens
tcctggagaaaagaaacatttct

SEQ ID NO: 9402299 - DNA, 22 bp, Homo sapiens
tcctggagaaactcagagatct

SEQ ID NO: 9402300 - DNA, 22 bp, Homo sapiens
tcctggagaaactcagagatct

SEQ ID NO: 9402301 - DNA, 22 bp, Homo sapiens
tcctggagaatggacaatgcac

SEQ ID NO: 9402302 - DNA, 22 bp, Homo sapiens
tcctggagagaggcctggaaga

SEQ ID NO: 9402303 - DNA, 22 bp, Homo sapiens
tcctggagagaggcctggaaga

SEQ ID NO: 9402304 - DNA, 22 bp, Homo sapiens
tcctggagagaggcctggaaga

SEQ ID NO: 9402305 - DNA, 22 bp, Homo sapiens
tcctggagagaggcctggaaga

SEQ ID NO: 9402306 - DNA, 22 bp, Homo sapiens
tcctggagagaggcctggaaga

SEQ ID NO: 9402307 - DNA, 22 bp, Homo sapiens
tcctggagaatcctgccacctg

SEQ ID NO: 9402308 - DNA, 22 bp, Homo sapiens
tcctggagaagaggggcttgga

SEQ ID NO: 9402309 - DNA, 22 bp, Homo sapiens
tcctggagaagaggggcttgga

SEQ ID NO: 9402310 - DNA, 22 bp, Homo sapiens
tcctggagaatggacaatgcac

SEQ ID NO: 9402311 - DNA, 22 bp, Homo sapiens
tcctggagaatcctgccacctg

SEQ ID NO: 9402312 - DNA, 22 bp, Homo sapiens
tcctggagagtgggcgagcaca

SEQ ID NO: 9402313 - DNA, 22 bp, Homo sapiens
tcctggagagtgggcgagcaca

SEQ ID NO: 9402314 - DNA, 22 bp, Homo sapiens
tcctggagagtgggcgagcaca

SEQ ID NO: 9402315 - DNA, 22 bp, Homo sapiens
tcctggagataattgcagtgaa

SEQ ID NO: 9402316 - DNA, 22 bp, Homo sapiens
tcctggagataattgcagtgaa

SEQ ID NO: 9402317 - DNA, 22 bp, Homo sapiens
tcctggagataattgcagtgaa

SEQ ID NO: 9402318 - DNA, 22 bp, Homo sapiens
tcctggagataattgcagtgaa

SEQ ID NO: 9402319 - DNA, 22 bp, Homo sapiens
tcctggagataattgcagtgaa

SEQ ID NO: 9402320 - DNA, 20 bp, Homo sapiens
tcctggagtattccatgctt

SEQ ID NO: 9402321 - DNA, 20 bp, Homo sapiens
tcctggagtattccatgctt

SEQ ID NO: 9402322 - DNA, 20 bp, Homo sapiens
tcctggagtattccatgctt

SEQ ID NO: 9402323 - DNA, 22 bp, Homo sapiens
tcctggagtaggccttagccat

SEQ ID NO: 9402324 - DNA, 20 bp, Homo sapiens
tcctggagtattccatgctt

SEQ ID NO: 9402325 - DNA, 22 bp, Homo sapiens
tcctggagtaggccttagccat

SEQ ID NO: 9402326 - DNA, 22 bp, Homo sapiens
tcctggagtaggccttagccat

SEQ ID NO: 9402327 - DNA, 22 bp, Homo sapiens
tcctggaggggacagcatgggc

SEQ ID NO: 9402328 - DNA, 22 bp, Homo sapiens
tcctggaggggacagcatgggc

SEQ ID NO: 9402329 - DNA, 22 bp, Homo sapiens
tcctggagtaggccttagccat

SEQ ID NO: 9402330 - DNA, 22 bp, Homo sapiens
tcctggaggggacagcatgggc

SEQ ID NO: 9402331 - DNA, 22 bp, Homo sapiens
tcctggagggctcacaggcggc

SEQ ID NO: 9402332 - DNA, 22 bp, Homo sapiens
tcctggagggctcacaggcggc

SEQ ID NO: 9402333 - DNA, 22 bp, Homo sapiens
tcctggagggctcacaggcggc

SEQ ID NO: 9402334 - DNA, 22 bp, Homo sapiens
tcctggagggctcacaggcggc

SEQ ID NO: 9402335 - DNA, 22 bp, Homo sapiens
tcctggagggctcacaggcggc

SEQ ID NO: 9402336 - DNA, 22 bp, Homo sapiens
tcctggagggaggcggtgctac

SEQ ID NO: 9402337 - DNA, 22 bp, Homo sapiens
tcctggagggaggcggtgctac

SEQ ID NO: 9402338 - DNA, 22 bp, Homo sapiens
tcctggaggggacagcatgggc

SEQ ID NO: 9402339 - DNA, 22 bp, Homo sapiens
tcctggagggctcacaggcggc

SEQ ID NO: 9402340 - DNA, 22 bp, Homo sapiens
tcctggagggctcacaggcggc

SEQ ID NO: 9402341 - DNA, 22 bp, Homo sapiens
tcctggaggggacagcatgggc

SEQ ID NO: 9402342 - DNA, 22 bp, Homo sapiens
tcctggaggggacagcatgggc

SEQ ID NO: 9402343 - DNA, 22 bp, Homo sapiens
tcctggaggggacagcatgggc

SEQ ID NO: 9402344 - DNA, 22 bp, Homo sapiens
tcctggaggcactcgctggggc

SEQ ID NO: 9402345 - DNA, 22 bp, Homo sapiens
tcctggaggcactcgctggggc

SEQ ID NO: 9402346 - DNA, 22 bp, Homo sapiens
tcctggaggcactcgctggggc

SEQ ID NO: 9402347 - DNA, 22 bp, Homo sapiens
tcctggaggcactcgctggggc

SEQ ID NO: 9402348 - DNA, 22 bp, Homo sapiens
tcctggaggcaaatgagcacat

SEQ ID NO: 9402349 - DNA, 22 bp, Homo sapiens
tcctggaggcaaatgagcacat

SEQ ID NO: 9402350 - DNA, 20 bp, Homo sapiens
tcctggaggcttcatccata

SEQ ID NO: 9402351 - DNA, 20 bp, Homo sapiens
tcctggaggcttcatccata

SEQ ID NO: 9402352 - DNA, 22 bp, Homo sapiens
tcctggagggaggcggtgctac

SEQ ID NO: 9402353 - DNA, 22 bp, Homo sapiens
tcctggagggaggcggtgctac

SEQ ID NO: 9402354 - DNA, 22 bp, Homo sapiens
tcctggaggcaaatgaagactc

SEQ ID NO: 9402355 - DNA, 22 bp, Homo sapiens
tcctggaggcaaatgaagactc

SEQ ID NO: 9402356 - DNA, 22 bp, Homo sapiens
tcctggaggcaaatgaagactc

SEQ ID NO: 9402357 - DNA, 22 bp, Homo sapiens
tcctggaggcaaatgagcacat

SEQ ID NO: 9402358 - DNA, 22 bp, Homo sapiens
tcctggagccaatgtgctgctg

SEQ ID NO: 9402359 - DNA, 22 bp, Homo sapiens
tcctggaggagatccaatctga

SEQ ID NO: 9402360 - DNA, 22 bp, Homo sapiens
tcctggagccaatgtgctgctg

SEQ ID NO: 9402361 - DNA, 22 bp, Homo sapiens
tcctggagccaatgtgctgctg

SEQ ID NO: 9402362 - DNA, 22 bp, Homo sapiens
tcctggagccaatgtgctgctg

SEQ ID NO: 9402363 - DNA, 22 bp, Homo sapiens
tcctggaggagatccaatctga

SEQ ID NO: 9402364 - DNA, 19 bp, Homo sapiens
tcctgctgtgtgaagggga

SEQ ID NO: 9402365 - DNA, 19 bp, Homo sapiens
tcctgctgtgtgaagggga

SEQ ID NO: 9402366 - DNA, 22 bp, Homo sapiens
tcctgctgggtctaactctggt

SEQ ID NO: 9402367 - DNA, 22 bp, Homo sapiens
tcctgcttgaaactctgccttc

SEQ ID NO: 9402368 - DNA, 22 bp, Homo sapiens
tcctgcttgaaactctgccttc

SEQ ID NO: 9402369 - DNA, 22 bp, Homo sapiens
tcctgcttgaaactctgccttc

SEQ ID NO: 9402370 - DNA, 22 bp, Homo sapiens
taagaatattgggaatggatgg

SEQ ID NO: 9402371 - DNA, 18 bp, Homo sapiens
taagaattgagagtttac

SEQ ID NO: 9402372 - DNA, 22 bp, Homo sapiens
taagaattatctcatggataat

SEQ ID NO: 9402373 - DNA, 22 bp, Homo sapiens
taagaacattttcggaaagata

SEQ ID NO: 9402374 - DNA, 22 bp, Homo sapiens
taagaagtacaaaaattttctg

SEQ ID NO: 9402375 - DNA, 22 bp, Homo sapiens
taagaagtgctgaattgaatat

SEQ ID NO: 9402376 - DNA, 22 bp, Homo sapiens
taagaagtgttgcctaatgcaa

SEQ ID NO: 9402377 - DNA, 22 bp, Homo sapiens
taagaacagtagaacagtaggt

SEQ ID NO: 9402378 - DNA, 22 bp, Homo sapiens
taagaacagataaagtttcccc

SEQ ID NO: 9402379 - DNA, 22 bp, Homo sapiens
taagaacagtgtctgtctcaca

SEQ ID NO: 9402380 - DNA, 22 bp, Homo sapiens
taagaacagtgtctgtctcaca

SEQ ID NO: 9402381 - DNA, 21 bp, Homo sapiens
tctcacaatatgatgccagat

SEQ ID NO: 9402382 - DNA, 22 bp, Homo sapiens
tctcacagcatcattgctcatg

SEQ ID NO: 9402383 - DNA, 19 bp, Homo sapiens
tctcacagctctactatgt

SEQ ID NO: 9402384 - DNA, 22 bp, Homo sapiens
tctcaagttttctcataatctc

SEQ ID NO: 9402385 - DNA, 22 bp, Homo sapiens
tctcaagttatgtaacagctgt

SEQ ID NO: 9402386 - DNA, 22 bp, Homo sapiens
tctcaaatggcaaatgtgggtc

SEQ ID NO: 9402387 - DNA, 22 bp, Homo sapiens
tctcaaatggacaatattgtgg

SEQ ID NO: 9402388 - DNA, 22 bp, Homo sapiens
tctcaaatcaaactttgagctt

SEQ ID NO: 9402389 - DNA, 23 bp, Homo sapiens
tctcaaatctttgcgttgtatct

SEQ ID NO: 9402390 - DNA, 21 bp, Homo sapiens
tctcacaatatgatgccagat

SEQ ID NO: 9402391 - DNA, 22 bp, Homo sapiens
tctatttaccaaatgtagttcc

SEQ ID NO: 9402392 - DNA, 22 bp, Homo sapiens
tctatttaggagaccctggttc

SEQ ID NO: 9402393 - DNA, 22 bp, Homo sapiens
tctatttaccaaatgtagttcc

SEQ ID NO: 9402394 - DNA, 22 bp, Homo sapiens
tctattgtccaatctttcacct

SEQ ID NO: 9402395 - DNA, 22 bp, Homo sapiens
tctattcaggcagagtgcagca

SEQ ID NO: 9402396 - DNA, 22 bp, Homo sapiens
tctattgggactctgcggtgag

SEQ ID NO: 9402397 - DNA, 22 bp, Homo sapiens
tctattggtaggggctgaggca

SEQ ID NO: 9402398 - DNA, 22 bp, Homo sapiens
tctattttatactcaaatcttc

SEQ ID NO: 9402399 - DNA, 22 bp, Homo sapiens
tctattttatactcaaatcttc

SEQ ID NO: 9402400 - DNA, 22 bp, Homo sapiens
tctattttatactcaaatcttc

SEQ ID NO: 9402401 - DNA, 22 bp, Homo sapiens
tctattttatactcaaatcttc

SEQ ID NO: 9402402 - DNA, 22 bp, Homo sapiens
tctattttcttgccaaaactgc

SEQ ID NO: 9402403 - DNA, 22 bp, Homo sapiens
tctattttcttgccaaaactgc

SEQ ID NO: 9402404 - DNA, 22 bp, Homo sapiens
tctatttttatagttgaagtgc

SEQ ID NO: 9402405 - DNA, 23 bp, Homo sapiens
tctcaaatatgatctgggtcatc

SEQ ID NO: 9402406 - DNA, 22 bp, Homo sapiens
tctcaaatatttggagagagga

SEQ ID NO: 9402407 - DNA, 22 bp, Homo sapiens
tctcaaataggccttggtcctg

SEQ ID NO: 9402408 - DNA, 22 bp, Homo sapiens
tctatttttatagttgaagtgc

SEQ ID NO: 9402409 - DNA, 22 bp, Homo sapiens
tctatctgggagttccccatta

SEQ ID NO: 9402410 - DNA, 22 bp, Homo sapiens
tctatgaatgacacagataata

SEQ ID NO: 9402411 - DNA, 22 bp, Homo sapiens
tctataaagggccagatagtag

SEQ ID NO: 9402412 - DNA, 22 bp, Homo sapiens
tctatattccagatacagatta

SEQ ID NO: 9402413 - DNA, 22 bp, Homo sapiens
tctatattccagatacagatta

SEQ ID NO: 9402414 - DNA, 22 bp, Homo sapiens
tctatattccagatacagatta

SEQ ID NO: 9402415 - DNA, 22 bp, Homo sapiens
tctatcattcgcactcctactt

SEQ ID NO: 9402416 - DNA, 22 bp, Homo sapiens
tctatattttgaaaggtattta

SEQ ID NO: 9402417 - DNA, 22 bp, Homo sapiens
tctatctgaggaggtgacattt

SEQ ID NO: 9402418 - DNA, 22 bp, Homo sapiens
tctatctcccttattcctggcc

SEQ ID NO: 9402419 - DNA, 21 bp, Homo sapiens
tctatctctagtccgctgcac

SEQ ID NO: 9402420 - DNA, 22 bp, Homo sapiens
tctatctcccttattcctggcc

SEQ ID NO: 9402421 - DNA, 22 bp, Homo sapiens
tctatgtaaagccatattgata

SEQ ID NO: 9402422 - DNA, 22 bp, Homo sapiens
tctatgtaaatgtgagttggtg

SEQ ID NO: 9402423 - DNA, 22 bp, Homo sapiens
tctatgcttgagacagatgggg

SEQ ID NO: 9402424 - DNA, 22 bp, Homo sapiens
tctatggggcctcacaggcact

SEQ ID NO: 9402425 - DNA, 21 bp, Homo sapiens
tctatgtacgcatctatgcct

SEQ ID NO: 9402426 - DNA, 22 bp, Homo sapiens
tctatgtaggagagagcttgac

SEQ ID NO: 9402427 - DNA, 22 bp, Homo sapiens
tctatgtagtgccagctagtat

SEQ ID NO: 9402428 - DNA, 22 bp, Homo sapiens
tctatgtcaaccttgcagtgca

SEQ ID NO: 9402429 - DNA, 22 bp, Homo sapiens
tctatgtatggaccttttctgt

SEQ ID NO: 9402430 - DNA, 22 bp, Homo sapiens
tctatgtgccctttgtgtgatg

SEQ ID NO: 9402431 - DNA, 22 bp, Homo sapiens
tctatgtgccctttgtgtgatg

SEQ ID NO: 9402432 - DNA, 22 bp, Homo sapiens
tctattacttaccactaattca

SEQ ID NO: 9402433 - DNA, 22 bp, Homo sapiens
tctattatggtacttatcatga

SEQ ID NO: 9402434 - DNA, 22 bp, Homo sapiens
tctagtcatattttttcagtat

SEQ ID NO: 9402435 - DNA, 22 bp, Homo sapiens
tctagtcctaggagaggagtca

SEQ ID NO: 9402436 - DNA, 22 bp, Homo sapiens
tctaggtattgtagttgctaat

SEQ ID NO: 9402437 - DNA, 22 bp, Homo sapiens
tctagggttgaggccacaggga

SEQ ID NO: 9402438 - DNA, 22 bp, Homo sapiens
tctaggcccaggcctgcggctg

SEQ ID NO: 9402439 - DNA, 22 bp, Homo sapiens
tctagttctagatccctgagga

SEQ ID NO: 9402440 - DNA, 22 bp, Homo sapiens
tctagttctagatccctgagga

SEQ ID NO: 9402441 - DNA, 22 bp, Homo sapiens
tctagtgttttggaacatggaa

SEQ ID NO: 9402442 - DNA, 22 bp, Homo sapiens
tctagtttaagatctgttagtc

SEQ ID NO: 9402443 - DNA, 22 bp, Homo sapiens
tctagtttaagatctgttagtc

SEQ ID NO: 9402444 - DNA, 22 bp, Homo sapiens
tctagttttagcttgagttgca

SEQ ID NO: 9402445 - DNA, 22 bp, Homo sapiens
tctagttttctcaaatgacttg

SEQ ID NO: 9402446 - DNA, 19 bp, Homo sapiens
tctagttttgagagacttc

SEQ ID NO: 9402447 - DNA, 15 bp, Homo sapiens
tctagttttgaagac

SEQ ID NO: 9402448 - DNA, 22 bp, Homo sapiens
tctagttttctcaaatgacttg

SEQ ID NO: 9402449 - DNA, 22 bp, Homo sapiens
tctagttttggtatgagatgca

SEQ ID NO: 9402450 - DNA, 22 bp, Homo sapiens
tctagttttggtatgagatgca

SEQ ID NO: 9402451 - DNA, 22 bp, Homo sapiens
tctataaagggccagatagtag

SEQ ID NO: 9402452 - DNA, 22 bp, Homo sapiens
tctataaaactcaagagcaatt

SEQ ID NO: 9402453 - DNA, 22 bp, Homo sapiens
tctataaagggccagatagtag

SEQ ID NO: 9402454 - DNA, 22 bp, Homo sapiens
tctataaaactcaagagcaatt

SEQ ID NO: 9402455 - DNA, 22 bp, Homo sapiens
tctataaaactcaagagcaatt

SEQ ID NO: 9402456 - DNA, 22 bp, Homo sapiens
tctataaaactcaagagcaatt

SEQ ID NO: 9402457 - DNA, 22 bp, Homo sapiens
tctactatgtttcttaaataga

SEQ ID NO: 9402458 - DNA, 22 bp, Homo sapiens
tctactgccacttaagacattt

SEQ ID NO: 9402459 - DNA, 22 bp, Homo sapiens
tctactctactgtctgtgccta

SEQ ID NO: 9402460 - DNA, 17 bp, Homo sapiens
tctactcctgaaggaag

SEQ ID NO: 9402461 - DNA, 22 bp, Homo sapiens
tctactgcactggtgtctcatc

SEQ ID NO: 9402462 - DNA, 22 bp, Homo sapiens
tctactgcactggtgtctcatc

SEQ ID NO: 9402463 - DNA, 22 bp, Homo sapiens
tctaccctgcggtcttggggca

SEQ ID NO: 9402464 - DNA, 23 bp, Homo sapiens
tctacccacactgctctagaagg

SEQ ID NO: 9402465 - DNA, 22 bp, Homo sapiens
tctaccagggtcacagaggccc

SEQ ID NO: 9402466 - DNA, 22 bp, Homo sapiens
tctaccactttgacctctctgt

SEQ ID NO: 9402467 - DNA, 22 bp, Homo sapiens
tctacattttctttatgtacat

SEQ ID NO: 9402468 - DNA, 22 bp, Homo sapiens
tctactttataagtatataagt

SEQ ID NO: 9402469 - DNA, 22 bp, Homo sapiens
tctagagatacattggtcattt

SEQ ID NO: 9402470 - DNA, 22 bp, Homo sapiens
tctagaggccagggacactgct

SEQ ID NO: 9402471 - DNA, 22 bp, Homo sapiens
tctagagaaaaaactcaagtga

SEQ ID NO: 9402472 - DNA, 22 bp, Homo sapiens
tctagagactataatgtgtcct

SEQ ID NO: 9402473 - DNA, 22 bp, Homo sapiens
tctagatgaatgtgaggatatc

SEQ ID NO: 9402474 - DNA, 22 bp, Homo sapiens
tctagcaagctcgtgctcaagg

SEQ ID NO: 9402475 - DNA, 22 bp, Homo sapiens
tctagcaggtggcggccagcga

SEQ ID NO: 9402476 - DNA, 22 bp, Homo sapiens
tctagcatgggaaaatcacagc

SEQ ID NO: 9402477 - DNA, 22 bp, Homo sapiens
tctagcaggcaaaagctcggca

SEQ ID NO: 9402478 - DNA, 22 bp, Homo sapiens
tctagcagagggaagaggcttt

SEQ ID NO: 9402479 - DNA, 20 bp, Homo sapiens
tctaggcaggcaggctcgtg

SEQ ID NO: 9402480 - DNA, 22 bp, Homo sapiens
tctaggagaaccatcagggagg

SEQ ID NO: 9402481 - DNA, 17 bp, Homo sapiens
tctaggagagcagagct

SEQ ID NO: 9402482 - DNA, 22 bp, Homo sapiens
tctaggaacctgacatctctca

SEQ ID NO: 9402483 - DNA, 22 bp, Homo sapiens
tctaggaagtaaggagggacta

SEQ ID NO: 9402484 - DNA, 22 bp, Homo sapiens
tctaggaatttcatctagttct

SEQ ID NO: 9402485 - DNA, 22 bp, Homo sapiens
tctaggaatgttcttagggatt

SEQ ID NO: 9402486 - DNA, 22 bp, Homo sapiens
tctagctctgcttatcatggct

SEQ ID NO: 9402487 - DNA, 22 bp, Homo sapiens
tctagctctgcttatcatggct

SEQ ID NO: 9402488 - DNA, 22 bp, Homo sapiens
tctaggaaagcctttcacaact

SEQ ID NO: 9402489 - DNA, 22 bp, Homo sapiens
tctaggaaataatgactcatcc

SEQ ID NO: 9402490 - DNA, 22 bp, Homo sapiens
tctaggaaattgttactatatt

SEQ ID NO: 9402491 - DNA, 22 bp, Homo sapiens
tctaggaaattgttactatatt

SEQ ID NO: 9402492 - DNA, 22 bp, Homo sapiens
tctacaaagaagaattaatgtc

SEQ ID NO: 9402493 - DNA, 23 bp, Homo sapiens
tctacaaagctgtgtcaggaccc

SEQ ID NO: 9402494 - DNA, 22 bp, Homo sapiens
tctacaaagaagaattaatgtc

SEQ ID NO: 9402495 - DNA, 22 bp, Homo sapiens
tctaattttggcattttaacct

SEQ ID NO: 9402496 - DNA, 22 bp, Homo sapiens
tctaattttggcattttaacct

SEQ ID NO: 9402497 - DNA, 20 bp, Homo sapiens
tctaattaaaattgtctagt

SEQ ID NO: 9402498 - DNA, 22 bp, Homo sapiens
tctaatgcttgactgggggctt

SEQ ID NO: 9402499 - DNA, 22 bp, Homo sapiens
tctaatgcttcctctcatccca

SEQ ID NO: 9402500 - DNA, 22 bp, Homo sapiens
tctaacttgaactcatgactgt

SEQ ID NO: 9402501 - DNA, 22 bp, Homo sapiens
tctaactatacaaagaaaacat

SEQ ID NO: 9402502 - DNA, 22 bp, Homo sapiens
tctaacttagggaatactttag

SEQ ID NO: 9402503 - DNA, 22 bp, Homo sapiens
tctaactaactacagtaagagg

SEQ ID NO: 9402504 - DNA, 22 bp, Homo sapiens
tctaaattcagtttattttgat

SEQ ID NO: 9402505 - DNA, 22 bp, Homo sapiens
tctaaatcccaacatgatatca

SEQ ID NO: 9402506 - DNA, 22 bp, Homo sapiens
tctaaatcccaacatgatatca

SEQ ID NO: 9402507 - DNA, 22 bp, Homo sapiens
tctacagccattttgagcagtg

SEQ ID NO: 9402508 - DNA, 22 bp, Homo sapiens
tctacactgtagaattataagg

SEQ ID NO: 9402509 - DNA, 22 bp, Homo sapiens
tctacaaataaattactatgta

SEQ ID NO: 9402510 - DNA, 22 bp, Homo sapiens
tctacaagtttaattccactta

SEQ ID NO: 9402511 - DNA, 22 bp, Homo sapiens
tctacaagtcaagtctatcaag

SEQ ID NO: 9402512 - DNA, 22 bp, Homo sapiens
tctacatgcagcgaggggactt

SEQ ID NO: 9402513 - DNA, 22 bp, Homo sapiens
tctacatatgtgatttctaagt

SEQ ID NO: 9402514 - DNA, 21 bp, Homo sapiens
tctacatatcaatatgtaatt

SEQ ID NO: 9402515 - DNA, 21 bp, Homo sapiens
tctacatatcaatatgtaatt

SEQ ID NO: 9402516 - DNA, 22 bp, Homo sapiens
tctacattccttttataatatc

SEQ ID NO: 9402517 - DNA, 22 bp, Homo sapiens
tctacattccttttataatatc

SEQ ID NO: 9402518 - DNA, 22 bp, Homo sapiens
tctacattttaacaagatgccc

SEQ ID NO: 9402519 - DNA, 22 bp, Homo sapiens
tctacaggtggggcctggcaat

SEQ ID NO: 9402520 - DNA, 22 bp, Homo sapiens
tctacagggtcagagtttcatg

SEQ ID NO: 9402521 - DNA, 22 bp, Homo sapiens
tctacagctgaacagtgtctca

SEQ ID NO: 9402522 - DNA, 22 bp, Homo sapiens
tctacagggtaaggggcttgcc

SEQ ID NO: 9402523 - DNA, 22 bp, Homo sapiens
tctacagtagaaagatcccagt

SEQ ID NO: 9402524 - DNA, 22 bp, Homo sapiens
tctacaggtggggcctggcaat

SEQ ID NO: 9402525 - DNA, 22 bp, Homo sapiens
tctacagtgtttggtttgagga

SEQ ID NO: 9402526 - DNA, 22 bp, Homo sapiens
tctacataaaaattcagaaggc

SEQ ID NO: 9402527 - DNA, 22 bp, Homo sapiens
tctacagtgtcaatgtgtcttg

SEQ ID NO: 9402528 - DNA, 22 bp, Homo sapiens
tctacagtgtcaatgtgtcttg

SEQ ID NO: 9402529 - DNA, 17 bp, Homo sapiens
tcgttttctgaacaaag

SEQ ID NO: 9402530 - DNA, 22 bp, Homo sapiens
tcgtgaggctctgcatcgcaca

SEQ ID NO: 9402531 - DNA, 21 bp, Homo sapiens
tcgtgcagcagctgaggcttg

SEQ ID NO: 9402532 - DNA, 22 bp, Homo sapiens
tcgtgatctgtccacctcggcc

SEQ ID NO: 9402533 - DNA, 22 bp, Homo sapiens
tcgtggagaggccatgtggagg

SEQ ID NO: 9402534 - DNA, 22 bp, Homo sapiens
tcgtggaatatggatgcttgtc

SEQ ID NO: 9402535 - DNA, 22 bp, Homo sapiens
tcgcaccattgcactccagcca

SEQ ID NO: 9402536 - DNA, 22 bp, Homo sapiens
tcgcaccattgcactccagcca

SEQ ID NO: 9402537 - DNA, 22 bp, Homo sapiens
tcgcatttgttaaagcatgttg

SEQ ID NO: 9402538 - DNA, 22 bp, Homo sapiens
tcgccagggatgctgtaaggaa

SEQ ID NO: 9402539 - DNA, 22 bp, Homo sapiens
tcgcatggtgtgccttaacatt

SEQ ID NO: 9402540 - DNA, 22 bp, Homo sapiens
tcgtgaggctctgcatcgcaca

SEQ ID NO: 9402541 - DNA, 22 bp, Homo sapiens
tcgtctgtgaaattgggataag

SEQ ID NO: 9402542 - DNA, 22 bp, Homo sapiens
tcgtctgtgaaattgggataag

SEQ ID NO: 9402543 - DNA, 22 bp, Homo sapiens
tcgcccaggctggaagtgcagt

SEQ ID NO: 9402544 - DNA, 22 bp, Homo sapiens
tctaaagatgtttattgacata

SEQ ID NO: 9402545 - DNA, 23 bp, Homo sapiens
tctaaaattcatcatttacgttc

SEQ ID NO: 9402546 - DNA, 22 bp, Homo sapiens
tctaaaatgcagatctactggt

SEQ ID NO: 9402547 - DNA, 22 bp, Homo sapiens
tctaaaaaagtctgttcacttg

SEQ ID NO: 9402548 - DNA, 22 bp, Homo sapiens
tctaaacactaagtcttgatgc

SEQ ID NO: 9402549 - DNA, 22 bp, Homo sapiens
tctaaacagcctcttaccaact

SEQ ID NO: 9402550 - DNA, 22 bp, Homo sapiens
tctaaacagtttcactcttaat

SEQ ID NO: 9402551 - DNA, 22 bp, Homo sapiens
tccttttgagctcctatgtggg

SEQ ID NO: 9402552 - DNA, 22 bp, Homo sapiens
tccttttctcttccccagagta

SEQ ID NO: 9402553 - DNA, 22 bp, Homo sapiens
tccttttctctagtaagcttta

SEQ ID NO: 9402554 - DNA, 22 bp, Homo sapiens
tccttttccctgaaggtattta

SEQ ID NO: 9402555 - DNA, 22 bp, Homo sapiens
tcgaatggcaaggaaagaggct

SEQ ID NO: 9402556 - DNA, 22 bp, Homo sapiens
tcgaggcagtgcgctggctgtt

SEQ ID NO: 9402557 - DNA, 22 bp, Homo sapiens
tcgagctgggcaagcttccata

SEQ ID NO: 9402558 - DNA, 22 bp, Homo sapiens
tcgagctctggagccaaggatg

SEQ ID NO: 9402559 - DNA, 22 bp, Homo sapiens
tcgcaccattgcactccagcca

SEQ ID NO: 9402560 - DNA, 19 bp, Homo sapiens
tcgagtcaagacactaggc

SEQ ID NO: 9402561 - DNA, 22 bp, Homo sapiens
tccttgggaaacatcatgtaat

SEQ ID NO: 9402562 - DNA, 22 bp, Homo sapiens
tccttggctagtactggccagc

SEQ ID NO: 9402563 - DNA, 23 bp, Homo sapiens
tccttgggcctgcccagagtggt

SEQ ID NO: 9402564 - DNA, 21 bp, Homo sapiens
tccttgggcagtgcccagctt

SEQ ID NO: 9402565 - DNA, 22 bp, Homo sapiens
tcctttccatgcttctagaggc

SEQ ID NO: 9402566 - DNA, 20 bp, Homo sapiens
tcctttcctccttctaaatg

SEQ ID NO: 9402567 - DNA, 22 bp, Homo sapiens
tcctttctccagctggcattgt

SEQ ID NO: 9402568 - DNA, 19 bp, Homo sapiens
tcctttctgttcctgagat

SEQ ID NO: 9402569 - DNA, 22 bp, Homo sapiens
tcctttcttcttctgcccatgg

SEQ ID NO: 9402570 - DNA, 17 bp, Homo sapiens
tcctttctttacctgtt

SEQ ID NO: 9402571 - DNA, 17 bp, Homo sapiens
tcctttctttacctgtt

SEQ ID NO: 9402572 - DNA, 22 bp, Homo sapiens
tcctttctccttccgacttcat

SEQ ID NO: 9402573 - DNA, 18 bp, Homo sapiens
tcctttctccctcatctt

SEQ ID NO: 9402574 - DNA, 18 bp, Homo sapiens
tcctttctccctcatctt

SEQ ID NO: 9402575 - DNA, 22 bp, Homo sapiens
tcctttctgtctttactctgga

SEQ ID NO: 9402576 - DNA, 22 bp, Homo sapiens
tcctttctgtctttactctgga

SEQ ID NO: 9402577 - DNA, 22 bp, Homo sapiens
tccttcctggggtctctgctgc

SEQ ID NO: 9402578 - DNA, 22 bp, Homo sapiens
tccttcctggggtctctgctgc

SEQ ID NO: 9402579 - DNA, 22 bp, Homo sapiens
tccttcctggggtctctgctgc

SEQ ID NO: 9402580 - DNA, 22 bp, Homo sapiens
tccttcctggggtctctgctgc

SEQ ID NO: 9402581 - DNA, 19 bp, Homo sapiens
tccttcagtcagatctggg

SEQ ID NO: 9402582 - DNA, 19 bp, Homo sapiens
tccttcagtcagatctggg

SEQ ID NO: 9402583 - DNA, 22 bp, Homo sapiens
tccttctacactgcctctgaga

SEQ ID NO: 9402584 - DNA, 21 bp, Homo sapiens
tccttccttgaggtcctttcc

SEQ ID NO: 9402585 - DNA, 23 bp, Homo sapiens
tccttcctttgagaggctccatc

SEQ ID NO: 9402586 - DNA, 23 bp, Homo sapiens
tccttcctttgagaggctccatc

SEQ ID NO: 9402587 - DNA, 22 bp, Homo sapiens
tccttccttcctgaaattttag

SEQ ID NO: 9402588 - DNA, 21 bp, Homo sapiens
tccttccttgaggtcctttcc

SEQ ID NO: 9402589 - DNA, 22 bp, Homo sapiens
tccttctctacaaatccaggca

SEQ ID NO: 9402590 - DNA, 22 bp, Homo sapiens
tccttctcctccttgagtgaca

SEQ ID NO: 9402591 - DNA, 22 bp, Homo sapiens
tccttctcctccttgagtgaca

SEQ ID NO: 9402592 - DNA, 22 bp, Homo sapiens
tccttctcctccttgagtgaca

SEQ ID NO: 9402593 - DNA, 22 bp, Homo sapiens
tccttctctggtttttactgta

SEQ ID NO: 9402594 - DNA, 21 bp, Homo sapiens
tccttctctatgattgtctga

SEQ ID NO: 9402595 - DNA, 19 bp, Homo sapiens
tccttctccggccaccccg

SEQ ID NO: 9402596 - DNA, 19 bp, Homo sapiens
tccttctccggccaccccg

SEQ ID NO: 9402597 - DNA, 19 bp, Homo sapiens
tccttctccggccaccccg

SEQ ID NO: 9402598 - DNA, 22 bp, Homo sapiens
tccttctcctccttgagtgaca

SEQ ID NO: 9402599 - DNA, 20 bp, Homo sapiens
tccttctgaggtgaggagga

SEQ ID NO: 9402600 - DNA, 20 bp, Homo sapiens
tccttctgaggtgaggagga

SEQ ID NO: 9402601 - DNA, 22 bp, Homo sapiens
tccttctgaaaaatgcacacga

SEQ ID NO: 9402602 - DNA, 22 bp, Homo sapiens
tccttctgaaaaatgcacacga

SEQ ID NO: 9402603 - DNA, 22 bp, Homo sapiens
tccttctgtagtccctgtccct

SEQ ID NO: 9402604 - DNA, 22 bp, Homo sapiens
tccttctggaggctctaagggg

SEQ ID NO: 9402605 - DNA, 22 bp, Homo sapiens
tccttctggaggctctaagggg

SEQ ID NO: 9402606 - DNA, 22 bp, Homo sapiens
tccttctggaggctgtaaagga

SEQ ID NO: 9402607 - DNA, 22 bp, Homo sapiens
tccttctgtagtccctgtccct

SEQ ID NO: 9402608 - DNA, 22 bp, Homo sapiens
tccttctgtagtccctgtccct

SEQ ID NO: 9402609 - DNA, 22 bp, Homo sapiens
tccttcttcatgaagatatatg

SEQ ID NO: 9402610 - DNA, 22 bp, Homo sapiens
tccttctttccccctagtcatt

SEQ ID NO: 9402611 - DNA, 22 bp, Homo sapiens
tccttgagccgtggccagggcc

SEQ ID NO: 9402612 - DNA, 22 bp, Homo sapiens
tccttgaggaggtgacactgga

SEQ ID NO: 9402613 - DNA, 22 bp, Homo sapiens
tccttgagaggacagagccata

SEQ ID NO: 9402614 - DNA, 22 bp, Homo sapiens
tccttgagaggacagagccata

SEQ ID NO: 9402615 - DNA, 22 bp, Homo sapiens
tccttgaagcttgtatctaata

SEQ ID NO: 9402616 - DNA, 22 bp, Homo sapiens
tccttggaaatttcatcagaca

SEQ ID NO: 9402617 - DNA, 21 bp, Homo sapiens
tccttgctattttcctcagct

SEQ ID NO: 9402618 - DNA, 21 bp, Homo sapiens
tccttgctattttcctcagct

SEQ ID NO: 9402619 - DNA, 22 bp, Homo sapiens
tccttggagcccaggagtagca

SEQ ID NO: 9402620 - DNA, 22 bp, Homo sapiens
tccttgcacattatctgggaaa

SEQ ID NO: 9402621 - DNA, 21 bp, Homo sapiens
tccttgctattttcctcagct

SEQ ID NO: 9402622 - DNA, 22 bp, Homo sapiens
tccttggaggtcaacgggacgg

SEQ ID NO: 9402623 - DNA, 22 bp, Homo sapiens
tccttggagtcatgatggaggt

SEQ ID NO: 9402624 - DNA, 22 bp, Homo sapiens
tccttggcatgccgtcttctcc

SEQ ID NO: 9402625 - DNA, 22 bp, Homo sapiens
tccttggcaagctgcaatggga

SEQ ID NO: 9402626 - DNA, 22 bp, Homo sapiens
tccttggcaagctgcaatggga

SEQ ID NO: 9402627 - DNA, 22 bp, Homo sapiens
tccttagagacaagaccagttt

SEQ ID NO: 9402628 - DNA, 22 bp, Homo sapiens
tccttagagatactgtcttgaa

SEQ ID NO: 9402629 - DNA, 22 bp, Homo sapiens
tccttaaatgtgatctagattt

SEQ ID NO: 9402630 - DNA, 22 bp, Homo sapiens
tccttacaacttgttatttttc

SEQ ID NO: 9402631 - DNA, 22 bp, Homo sapiens
tccttaggaaaatgatgagggg

SEQ ID NO: 9402632 - DNA, 22 bp, Homo sapiens
tccttaggcaatttgggagagt

SEQ ID NO: 9402633 - DNA, 22 bp, Homo sapiens
tccttagggatttttccagtca

SEQ ID NO: 9402634 - DNA, 22 bp, Homo sapiens
tccttaggtatttagcatgaat

SEQ ID NO: 9402635 - DNA, 22 bp, Homo sapiens
tccttaggcaatttgggagagt

SEQ ID NO: 9402636 - DNA, 22 bp, Homo sapiens
tccttaggcaatttgggagagt

SEQ ID NO: 9402637 - DNA, 22 bp, Homo sapiens
tccttaggcaatttgggagagt

SEQ ID NO: 9402638 - DNA, 22 bp, Homo sapiens
tccttcaagatgccacagcttt

SEQ ID NO: 9402639 - DNA, 22 bp, Homo sapiens
tccttcaagtgcagtacctgag

SEQ ID NO: 9402640 - DNA, 22 bp, Homo sapiens
tccttcaactttttacttgccc

SEQ ID NO: 9402641 - DNA, 22 bp, Homo sapiens
tccttcaactttttacttgccc

SEQ ID NO: 9402642 - DNA, 22 bp, Homo sapiens
tccttcagggggccgcctgcac

SEQ ID NO: 9402643 - DNA, 22 bp, Homo sapiens
tccttcagggggccgcctgcac

SEQ ID NO: 9402644 - DNA, 23 bp, Homo sapiens
tccttcaggctcttcccctggac

SEQ ID NO: 9402645 - DNA, 22 bp, Homo sapiens
tccttcaggcctcattctcata

SEQ ID NO: 9402646 - DNA, 22 bp, Homo sapiens
tccttcaggcctcattctcata

SEQ ID NO: 9402647 - DNA, 22 bp, Homo sapiens
tccttcaggcctcattctcata

SEQ ID NO: 9402648 - DNA, 22 bp, Homo sapiens
tccttcagcctcccagctcaaa

SEQ ID NO: 9402649 - DNA, 22 bp, Homo sapiens
tccttcagccatgggctctcca

SEQ ID NO: 9402650 - DNA, 22 bp, Homo sapiens
tccttcagctactcagtttcca

SEQ ID NO: 9402651 - DNA, 22 bp, Homo sapiens
tccttcagctactcagtttcca

SEQ ID NO: 9402652 - DNA, 22 bp, Homo sapiens
tccttcagcttatttcttagga

SEQ ID NO: 9402653 - DNA, 22 bp, Homo sapiens
tccttcagcttgttagagtgac

SEQ ID NO: 9402654 - DNA, 22 bp, Homo sapiens
tccttcagctctctatttagat

SEQ ID NO: 9402655 - DNA, 22 bp, Homo sapiens
tccttcagctgctaggaaatga

SEQ ID NO: 9402656 - DNA, 22 bp, Homo sapiens
tccttcagaggataaggaagaa

SEQ ID NO: 9402657 - DNA, 22 bp, Homo sapiens
tccttcagattcctgcttctgg

SEQ ID NO: 9402658 - DNA, 23 bp, Homo sapiens
tccttcagagcctccctccaagc

SEQ ID NO: 9402659 - DNA, 23 bp, Homo sapiens
tccttcagagcctccctccaagc

SEQ ID NO: 9402660 - DNA, 20 bp, Homo sapiens
tccttcagactttggagttg

SEQ ID NO: 9402661 - DNA, 20 bp, Homo sapiens
tccttcagacgacaagcaag

SEQ ID NO: 9402662 - DNA, 22 bp, Homo sapiens
tccttcagaaaacctcagtctt

SEQ ID NO: 9402663 - DNA, 22 bp, Homo sapiens
tccttcaccttagccctcctag

SEQ ID NO: 9402664 - DNA, 22 bp, Homo sapiens
tccttcaagtgcagtacctgag

SEQ ID NO: 9402665 - DNA, 22 bp, Homo sapiens
tgattaagttcaaaatatagaa

SEQ ID NO: 9402666 - DNA, 22 bp, Homo sapiens
tgattacaattgtcttagattt

SEQ ID NO: 9402667 - DNA, 23 bp, Homo sapiens
tgattacaagggccaaagaaagg

SEQ ID NO: 9402668 - DNA, 22 bp, Homo sapiens
tgattcacgtaataagaaaaag

SEQ ID NO: 9402669 - DNA, 22 bp, Homo sapiens
tgattcatcagaataggagttt

SEQ ID NO: 9402670 - DNA, 22 bp, Homo sapiens
tgattcagtctcttcaggagaa

SEQ ID NO: 9402671 - DNA, 22 bp, Homo sapiens
tgattcagtctcttcaggagaa

SEQ ID NO: 9402672 - DNA, 22 bp, Homo sapiens
tgattcagttggttttgttcag

SEQ ID NO: 9402673 - DNA, 23 bp, Homo sapiens
tgattcagcaagtccacttctgg

SEQ ID NO: 9402674 - DNA, 22 bp, Homo sapiens
tgattcagacctgtcagacttc

SEQ ID NO: 9402675 - DNA, 22 bp, Homo sapiens
tgatgttattagatacaaacca

SEQ ID NO: 9402676 - DNA, 22 bp, Homo sapiens
tgattaaaatttaacttagtta

SEQ ID NO: 9402677 - DNA, 22 bp, Homo sapiens
tgatggtgggtctgatctcata

SEQ ID NO: 9402678 - DNA, 22 bp, Homo sapiens
tgatggttgattataaatcagt

SEQ ID NO: 9402679 - DNA, 22 bp, Homo sapiens
tgatggttttattaataggacc

SEQ ID NO: 9402680 - DNA, 22 bp, Homo sapiens
tgatgtcctcatgtcaagctcc

SEQ ID NO: 9402681 - DNA, 22 bp, Homo sapiens
tgatgtacacaatgaaattatg

SEQ ID NO: 9402682 - DNA, 22 bp, Homo sapiens
tgatgtaagagatacacttgat

SEQ ID NO: 9402683 - DNA, 22 bp, Homo sapiens
tgatgtctgccagggtcctggg

SEQ ID NO: 9402684 - DNA, 22 bp, Homo sapiens
tgattctatctaggtagaactg

SEQ ID NO: 9402685 - DNA, 22 bp, Homo sapiens
tgattctctgatggagaaagac

SEQ ID NO: 9402686 - DNA, 23 bp, Homo sapiens
tgattctgctttgagaatcatgg

SEQ ID NO: 9402687 - DNA, 22 bp, Homo sapiens
tgattctgccccttggctctgg

SEQ ID NO: 9402688 - DNA, 22 bp, Homo sapiens
tgattctgatcatcatcatggt

SEQ ID NO: 9402689 - DNA, 22 bp, Homo sapiens
tgattccactctgaggatcgta

SEQ ID NO: 9402690 - DNA, 22 bp, Homo sapiens
tgattcatcagaataggagttt

SEQ ID NO: 9402691 - DNA, 22 bp, Homo sapiens
tgattcctaggcactcttctcc

SEQ ID NO: 9402692 - DNA, 22 bp, Homo sapiens
tgattctgtaaacatgtcttta

SEQ ID NO: 9402693 - DNA, 23 bp, Homo sapiens
tgattgaaatgaggagtatttgt

SEQ ID NO: 9402694 - DNA, 22 bp, Homo sapiens
tgattgtatgattgaaatattt

SEQ ID NO: 9402695 - DNA, 22 bp, Homo sapiens
tgattggtcaggctgtggtgac

SEQ ID NO: 9402696 - DNA, 22 bp, Homo sapiens
tgattggtcaggctgtggtgac

SEQ ID NO: 9402697 - DNA, 18 bp, Homo sapiens
tgatggaggagggctggt

SEQ ID NO: 9402698 - DNA, 22 bp, Homo sapiens
tgatggatgtggctctggagct

SEQ ID NO: 9402699 - DNA, 22 bp, Homo sapiens
tgatggcttatggagagagcaa

SEQ ID NO: 9402700 - DNA, 22 bp, Homo sapiens
tgatggcttcggacctgggcag

SEQ ID NO: 9402701 - DNA, 22 bp, Homo sapiens
tgatggcttagtggcagggcga

SEQ ID NO: 9402702 - DNA, 22 bp, Homo sapiens
tgatggctgtgctgatgttagg

SEQ ID NO: 9402703 - DNA, 22 bp, Homo sapiens
tgatggctggaagttcaaaaat

SEQ ID NO: 9402704 - DNA, 19 bp, Homo sapiens
tgatggctggaactatact

SEQ ID NO: 9402705 - DNA, 22 bp, Homo sapiens
tgatggctgtagggtccggggc

SEQ ID NO: 9402706 - DNA, 22 bp, Homo sapiens
tgatggctcatgtttggggatg

SEQ ID NO: 9402707 - DNA, 22 bp, Homo sapiens
tgatggctcccatgggcatatg

SEQ ID NO: 9402708 - DNA, 22 bp, Homo sapiens
tgatggctatccctggaagggc

SEQ ID NO: 9402709 - DNA, 22 bp, Homo sapiens
tgatggctccttcattatgggt

SEQ ID NO: 9402710 - DNA, 22 bp, Homo sapiens
tgatggctccttcattatgggt

SEQ ID NO: 9402711 - DNA, 22 bp, Homo sapiens
tgatggcttttaggcttttaag

SEQ ID NO: 9402712 - DNA, 22 bp, Homo sapiens
tgatgggaaaatgaggcctggg

SEQ ID NO: 9402713 - DNA, 22 bp, Homo sapiens
tgatgggactgccagctgctga

SEQ ID NO: 9402714 - DNA, 22 bp, Homo sapiens
tgatgggactgccagctgctga

SEQ ID NO: 9402715 - DNA, 22 bp, Homo sapiens
tgatgggaggtgctgcaggacc

SEQ ID NO: 9402716 - DNA, 23 bp, Homo sapiens
tgatggaaatgatctgggtctgt

SEQ ID NO: 9402717 - DNA, 22 bp, Homo sapiens
tgatggaaatattgacaccaca

SEQ ID NO: 9402718 - DNA, 22 bp, Homo sapiens
tgatggaacagcctttgccaaa

SEQ ID NO: 9402719 - DNA, 22 bp, Homo sapiens
tgatggaaatttgggaagcttt

SEQ ID NO: 9402720 - DNA, 22 bp, Homo sapiens
tgatggaaatgttctgtatctg

SEQ ID NO: 9402721 - DNA, 22 bp, Homo sapiens
tgatggaaaataaatcttattc

SEQ ID NO: 9402722 - DNA, 21 bp, Homo sapiens
tgatggaaaggattttgggtc

SEQ ID NO: 9402723 - DNA, 22 bp, Homo sapiens
tgatggaaacttgggtaagtca

SEQ ID NO: 9402724 - DNA, 22 bp, Homo sapiens
tgatggaaatatgtaatctggt

SEQ ID NO: 9402725 - DNA, 22 bp, Homo sapiens
tgatggaaataaaagcatagct

SEQ ID NO: 9402726 - DNA, 19 bp, Homo sapiens
tgatggaatttgacattcc

SEQ ID NO: 9402727 - DNA, 22 bp, Homo sapiens
tgatggaaggtttctcggtgat

SEQ ID NO: 9402728 - DNA, 22 bp, Homo sapiens
tgatggaagagctaacaatatc

SEQ ID NO: 9402729 - DNA, 22 bp, Homo sapiens
tgatggaatataccttcgggag

SEQ ID NO: 9402730 - DNA, 22 bp, Homo sapiens
tgatggaagtgactgtcagttc

SEQ ID NO: 9402731 - DNA, 22 bp, Homo sapiens
tgatggaagtgactgtcagttc

SEQ ID NO: 9402732 - DNA, 22 bp, Homo sapiens
tgatggaatggaggacatgtgg

SEQ ID NO: 9402733 - DNA, 22 bp, Homo sapiens
tgatgaaagttcagtagtgaat

SEQ ID NO: 9402734 - DNA, 22 bp, Homo sapiens
tgatgaatgtcatacataatga

SEQ ID NO: 9402735 - DNA, 22 bp, Homo sapiens
tgatgaatcctctatgcctttt

SEQ ID NO: 9402736 - DNA, 22 bp, Homo sapiens
tgatgaataaccttgagcatat

SEQ ID NO: 9402737 - DNA, 22 bp, Homo sapiens
tgatgaataaacttgagagtca

SEQ ID NO: 9402738 - DNA, 18 bp, Homo sapiens
tgatctttgagtataatg

SEQ ID NO: 9402739 - DNA, 22 bp, Homo sapiens
tgatctttttggtcatttgggt

SEQ ID NO: 9402740 - DNA, 22 bp, Homo sapiens
tgatgcctatgaattgtaatgt

SEQ ID NO: 9402741 - DNA, 22 bp, Homo sapiens
tgatgctgctgggagtggtgct

SEQ ID NO: 9402742 - DNA, 21 bp, Homo sapiens
tgagtcttttgcacaaggaat

SEQ ID NO: 9402743 - DNA, 22 bp, Homo sapiens
tgagtgaggctgggcagtccct

SEQ ID NO: 9402744 - DNA, 22 bp, Homo sapiens
tgagtgagacatcctgtcttaa

SEQ ID NO: 9402745 - DNA, 22 bp, Homo sapiens
tgagtgagacaccaaaggctgt

SEQ ID NO: 9402746 - DNA, 22 bp, Homo sapiens
tgagtgaggtgcttagggcaca

SEQ ID NO: 9402747 - DNA, 22 bp, Homo sapiens
tgagtgaggctgggcagtccct

SEQ ID NO: 9402748 - DNA, 20 bp, Homo sapiens
tgagtgagtttgtggcagga

SEQ ID NO: 9402749 - DNA, 22 bp, Homo sapiens
tgagtgagttttcacggtcagc

SEQ ID NO: 9402750 - DNA, 20 bp, Homo sapiens
tgagtgagtttgtggcagga

SEQ ID NO: 9402751 - DNA, 22 bp, Homo sapiens
tgagtgctaagaataatctgca

SEQ ID NO: 9402752 - DNA, 19 bp, Homo sapiens
tgagtgggagcccaggtat

SEQ ID NO: 9402753 - DNA, 19 bp, Homo sapiens
tgagtgggagcccaggtat

SEQ ID NO: 9402754 - DNA, 16 bp, Homo sapiens
tgagtgggagaagggg

SEQ ID NO: 9402755 - DNA, 22 bp, Homo sapiens
tgagtgggattaaatgaggtga

SEQ ID NO: 9402756 - DNA, 16 bp, Homo sapiens
tgagtgggagaagggg

SEQ ID NO: 9402757 - DNA, 22 bp, Homo sapiens
tgagtgggacctgcgtgtgtca

SEQ ID NO: 9402758 - DNA, 22 bp, Homo sapiens
tgagtggagtagtgaatgcatt

SEQ ID NO: 9402759 - DNA, 22 bp, Homo sapiens
tgagtggagaacagaggctctc

SEQ ID NO: 9402760 - DNA, 22 bp, Homo sapiens
tgagtggacacctgcttcttta

SEQ ID NO: 9402761 - DNA, 22 bp, Homo sapiens
tgagtggacacctgcttcttta

SEQ ID NO: 9402762 - DNA, 22 bp, Homo sapiens
tgagtgctgcattagcagatat

SEQ ID NO: 9402763 - DNA, 22 bp, Homo sapiens
tgagtgctgtctgtctagcctc

SEQ ID NO: 9402764 - DNA, 23 bp, Homo sapiens
tgagtgtgttccctgtgagattt

SEQ ID NO: 9402765 - DNA, 22 bp, Homo sapiens
tgagttatctaaaatagtcaaa

SEQ ID NO: 9402766 - DNA, 22 bp, Homo sapiens
tgagttccacacctaggaagtc

SEQ ID NO: 9402767 - DNA, 22 bp, Homo sapiens
tgagtgtggggaatgtcatgag

SEQ ID NO: 9402768 - DNA, 23 bp, Homo sapiens
tgagtgtggggacagtggtttgc

SEQ ID NO: 9402769 - DNA, 22 bp, Homo sapiens
tgagtgtgctaggtgtctcggt

SEQ ID NO: 9402770 - DNA, 19 bp, Homo sapiens
tgagtgggcccctgcagac

SEQ ID NO: 9402771 - DNA, 22 bp, Homo sapiens
tgagtgggattaaatgaggtga

SEQ ID NO: 9402772 - DNA, 22 bp, Homo sapiens
tgagtgggttatcaggaaaggt

SEQ ID NO: 9402773 - DNA, 19 bp, Homo sapiens
tgagtgggcccctgcagac

SEQ ID NO: 9402774 - DNA, 19 bp, Homo sapiens
tgagtgggcccctgcagac

SEQ ID NO: 9402775 - DNA, 20 bp, Homo sapiens
tgatatattactcaggggaa

SEQ ID NO: 9402776 - DNA, 22 bp, Homo sapiens
tgatatgtccctcgacatcagg

SEQ ID NO: 9402777 - DNA, 22 bp, Homo sapiens
tgatatgtaactactccttata

SEQ ID NO: 9402778 - DNA, 22 bp, Homo sapiens
tgatatgggaaaagggctcgga

SEQ ID NO: 9402779 - DNA, 20 bp, Homo sapiens
tgatatggtttggctgtgtt

SEQ ID NO: 9402780 - DNA, 22 bp, Homo sapiens
tgatatgtgaagctattagttc

SEQ ID NO: 9402781 - DNA, 22 bp, Homo sapiens
tgatatgtgaagctattagttc

SEQ ID NO: 9402782 - DNA, 22 bp, Homo sapiens
tgatatgtttggatttaggttt

SEQ ID NO: 9402783 - DNA, 22 bp, Homo sapiens
tgatatttgctgactgcattgt

SEQ ID NO: 9402784 - DNA, 22 bp, Homo sapiens
tgatatttaagcaaaaatatgg

SEQ ID NO: 9402785 - DNA, 22 bp, Homo sapiens
tgatagaaaggaaattaattgg

SEQ ID NO: 9402786 - DNA, 22 bp, Homo sapiens
tgatactttggagacttgagta

SEQ ID NO: 9402787 - DNA, 22 bp, Homo sapiens
tgatacttttcttttagactaa

SEQ ID NO: 9402788 - DNA, 23 bp, Homo sapiens
tgagttctaggcttaaaactagc

SEQ ID NO: 9402789 - DNA, 22 bp, Homo sapiens
tgagttctaggcttaaaactaa

SEQ ID NO: 9402790 - DNA, 22 bp, Homo sapiens
tgatattttatgagctttcata

SEQ ID NO: 9402791 - DNA, 22 bp, Homo sapiens
tgatattttatgagctttcata

SEQ ID NO: 9402792 - DNA, 22 bp, Homo sapiens
tgatattttatgagctttcata

SEQ ID NO: 9402793 - DNA, 22 bp, Homo sapiens
tgatcaaaacattactccacca

SEQ ID NO: 9402794 - DNA, 22 bp, Homo sapiens
tgatcaaaacattactccacca

SEQ ID NO: 9402795 - DNA, 22 bp, Homo sapiens
tgatcagcatcttcccagctcg

SEQ ID NO: 9402796 - DNA, 21 bp, Homo sapiens
tgatcatttgtgtaaaggaga

SEQ ID NO: 9402797 - DNA, 21 bp, Homo sapiens
tgatcatttgtgtaaaggaga

SEQ ID NO: 9402798 - DNA, 22 bp, Homo sapiens
tgatcatccagtttcttgtcca

SEQ ID NO: 9402799 - DNA, 22 bp, Homo sapiens
tgatcagtaaccaatcacatca

SEQ ID NO: 9402800 - DNA, 22 bp, Homo sapiens
tgatctggtcctactgtgggca

SEQ ID NO: 9402801 - DNA, 22 bp, Homo sapiens
tgatctggaattccctgtggta

SEQ ID NO: 9402802 - DNA, 22 bp, Homo sapiens
tgatctggtcctactgtgggca

SEQ ID NO: 9402803 - DNA, 22 bp, Homo sapiens
tgatccccttcccagtaagcct

SEQ ID NO: 9402804 - DNA, 22 bp, Homo sapiens
tgatctcctgaccttgtaatcc

SEQ ID NO: 9402805 - DNA, 22 bp, Homo sapiens
tgatctaggttggcttcaactg

SEQ ID NO: 9402806 - DNA, 22 bp, Homo sapiens
tgcaattactgggaggttttat

SEQ ID NO: 9402807 - DNA, 22 bp, Homo sapiens
tgcaattaatttacatgcttaa

SEQ ID NO: 9402808 - DNA, 22 bp, Homo sapiens
tgcaatctcggcactttgggag

SEQ ID NO: 9402809 - DNA, 22 bp, Homo sapiens
tgcaatctcggcactttgggag

SEQ ID NO: 9402810 - DNA, 22 bp, Homo sapiens
tgcaatttcaggcatatattgt

SEQ ID NO: 9402811 - DNA, 22 bp, Homo sapiens
tgcaatttgacgtcagcacagt

SEQ ID NO: 9402812 - DNA, 22 bp, Homo sapiens
tgcaattatgggcaatttttaa

SEQ ID NO: 9402813 - DNA, 22 bp, Homo sapiens
tgcacacacacgtagagaaaag

SEQ ID NO: 9402814 - DNA, 22 bp, Homo sapiens
tgcacacaaatgtgaacgtgcc

SEQ ID NO: 9402815 - DNA, 22 bp, Homo sapiens
tgcacacaagttggagaatgaa

SEQ ID NO: 9402816 - DNA, 22 bp, Homo sapiens
tgcacaaatttgtgtatgctca

SEQ ID NO: 9402817 - DNA, 22 bp, Homo sapiens
tgcacaaaggctccctgctgag

SEQ ID NO: 9402818 - DNA, 22 bp, Homo sapiens
tgcaatttttccatgacctaga

SEQ ID NO: 9402819 - DNA, 22 bp, Homo sapiens
tgcaatttttatcaattcagca

SEQ ID NO: 9402820 - DNA, 22 bp, Homo sapiens
tgcacaaagcattctagacgca

SEQ ID NO: 9402821 - DNA, 22 bp, Homo sapiens
tgcacaaacttgtgtcccaggg

SEQ ID NO: 9402822 - DNA, 22 bp, Homo sapiens
tgcacacacaggagtctcctcc

SEQ ID NO: 9402823 - DNA, 22 bp, Homo sapiens
tgcacacacaggagtctcctcc

SEQ ID NO: 9402824 - DNA, 22 bp, Homo sapiens
tgcacacacatgaagtagcatg

SEQ ID NO: 9402825 - DNA, 22 bp, Homo sapiens
tgcacacacatgaagtagcatg

SEQ ID NO: 9402826 - DNA, 20 bp, Homo sapiens
tgcacacaccctgtcctcca

SEQ ID NO: 9402827 - DNA, 22 bp, Homo sapiens
tgcacacacatgcagagggaga

SEQ ID NO: 9402828 - DNA, 20 bp, Homo sapiens
tgcacacaccctgtcctcca

SEQ ID NO: 9402829 - DNA, 20 bp, Homo sapiens
tgcacacaccctgtcctcca

SEQ ID NO: 9402830 - DNA, 22 bp, Homo sapiens
tgcacacaccgtgcttcactga

SEQ ID NO: 9402831 - DNA, 22 bp, Homo sapiens
tgcacacacgcggcacatctgt

SEQ ID NO: 9402832 - DNA, 22 bp, Homo sapiens
tgcacacaccgtgcttcactga

SEQ ID NO: 9402833 - DNA, 22 bp, Homo sapiens
tgcacacacggagataggcttt

SEQ ID NO: 9402834 - DNA, 22 bp, Homo sapiens
tgcacacacgcggcacatctgt

SEQ ID NO: 9402835 - DNA, 22 bp, Homo sapiens
tgcacacacgcggcacatctgt

SEQ ID NO: 9402836 - DNA, 20 bp, Homo sapiens
tgcacacagaaatttgcatt

SEQ ID NO: 9402837 - DNA, 22 bp, Homo sapiens
tgcacacactctgcatatactt

SEQ ID NO: 9402838 - DNA, 20 bp, Homo sapiens
tgcacacagaaatttgcatt

SEQ ID NO: 9402839 - DNA, 19 bp, Homo sapiens
tgcacacagataagtatct

SEQ ID NO: 9402840 - DNA, 19 bp, Homo sapiens
tgcacacagataagtatct

SEQ ID NO: 9402841 - DNA, 22 bp, Homo sapiens
tgcacacactctgcatatactt

SEQ ID NO: 9402842 - DNA, 22 bp, Homo sapiens
tgcacacactcgtgtatatgag

SEQ ID NO: 9402843 - DNA, 22 bp, Homo sapiens
tgcacacactcgtgtatatgag

SEQ ID NO: 9402844 - DNA, 22 bp, Homo sapiens
tgcacacactctgcatatactt

SEQ ID NO: 9402845 - DNA, 22 bp, Homo sapiens
tgcacacagccagtgagtggca

SEQ ID NO: 9402846 - DNA, 22 bp, Homo sapiens
tgcacacagctgggcctggctg

SEQ ID NO: 9402847 - DNA, 22 bp, Homo sapiens
tgcacacagatggtacatgcat

SEQ ID NO: 9402848 - DNA, 22 bp, Homo sapiens
tgcacacagatggtacatgcat

SEQ ID NO: 9402849 - DNA, 22 bp, Homo sapiens
tgcacacaggtctaggacatgg

SEQ ID NO: 9402850 - DNA, 22 bp, Homo sapiens
tgcacacaggtctaggacatgg

SEQ ID NO: 9402851 - DNA, 22 bp, Homo sapiens
tgcacacaggtctaggacatgg

SEQ ID NO: 9402852 - DNA, 22 bp, Homo sapiens
tgcacacaggtctaggacatgg

SEQ ID NO: 9402853 - DNA, 22 bp, Homo sapiens
tgcacacagtggacaagtcttg

SEQ ID NO: 9402854 - DNA, 22 bp, Homo sapiens
tgcacacagtggacaagtcttg

SEQ ID NO: 9402855 - DNA, 22 bp, Homo sapiens
tgcaacctgacccagccagccc

SEQ ID NO: 9402856 - DNA, 22 bp, Homo sapiens
tgcaaatttctttagtacataa

SEQ ID NO: 9402857 - DNA, 22 bp, Homo sapiens
tgcaagataacctgcttcttcc

SEQ ID NO: 9402858 - DNA, 22 bp, Homo sapiens
tgcaagagcccagggccaggaa

SEQ ID NO: 9402859 - DNA, 22 bp, Homo sapiens
tgcaagaggaattctagaagca

SEQ ID NO: 9402860 - DNA, 22 bp, Homo sapiens
tgcaagacgtgaaattgagaca

SEQ ID NO: 9402861 - DNA, 22 bp, Homo sapiens
tgcaagcttggctgatgttgat

SEQ ID NO: 9402862 - DNA, 22 bp, Homo sapiens
tgcaagctgacatccagagaga

SEQ ID NO: 9402863 - DNA, 22 bp, Homo sapiens
tgcaagattttgacactcgtct

SEQ ID NO: 9402864 - DNA, 22 bp, Homo sapiens
tgcaagatcacggtgttgagag

SEQ ID NO: 9402865 - DNA, 22 bp, Homo sapiens
tgcaagatcttgtctctgccac

SEQ ID NO: 9402866 - DNA, 22 bp, Homo sapiens
tgcaagatattatctttgctgc

SEQ ID NO: 9402867 - DNA, 22 bp, Homo sapiens
tgcaagcaagtttttgaagtgg

SEQ ID NO: 9402868 - DNA, 19 bp, Homo sapiens
tgcaagctttttcttgtta

SEQ ID NO: 9402869 - DNA, 22 bp, Homo sapiens
tgcaagcttggctgatgttgat

SEQ ID NO: 9402870 - DNA, 19 bp, Homo sapiens
tgcaagctttttcttgtta

SEQ ID NO: 9402871 - DNA, 22 bp, Homo sapiens
tgcaagggcttagggggctgtg

SEQ ID NO: 9402872 - DNA, 22 bp, Homo sapiens
tgcaaggctgcctctgaggacc

SEQ ID NO: 9402873 - DNA, 22 bp, Homo sapiens
tgcaaggcccagacaagagctc

SEQ ID NO: 9402874 - DNA, 22 bp, Homo sapiens
tgcaaggcccagacaagagctc

SEQ ID NO: 9402875 - DNA, 22 bp, Homo sapiens
tgcaaggtgctttttggtgtca

SEQ ID NO: 9402876 - DNA, 22 bp, Homo sapiens
tgcaaggtgctccaagggcgct

SEQ ID NO: 9402877 - DNA, 22 bp, Homo sapiens
tgcaaggtcttctctctggagg

SEQ ID NO: 9402878 - DNA, 22 bp, Homo sapiens
tgcaaggtccagtataacttaa

SEQ ID NO: 9402879 - DNA, 21 bp, Homo sapiens
tgcaatccagcctgggcgaca

SEQ ID NO: 9402880 - DNA, 19 bp, Homo sapiens
tgcaagggtggtctcctgg

SEQ ID NO: 9402881 - DNA, 22 bp, Homo sapiens
tgcaagggtagaagtgatggca

SEQ ID NO: 9402882 - DNA, 22 bp, Homo sapiens
tgcaaggggtttatgcagatga

SEQ ID NO: 9402883 - DNA, 22 bp, Homo sapiens
tgcaaaatgacttctgaaaaga

SEQ ID NO: 9402884 - DNA, 17 bp, Homo sapiens
tgcaaacaatcacatat

SEQ ID NO: 9402885 - DNA, 22 bp, Homo sapiens
tgcaaacaatttcctataaagt

SEQ ID NO: 9402886 - DNA, 22 bp, Homo sapiens
tgcaaacacttcaacgtgcatc

SEQ ID NO: 9402887 - DNA, 22 bp, Homo sapiens
tgcaaacacttcaacgtgcatc

SEQ ID NO: 9402888 - DNA, 22 bp, Homo sapiens
tgcaaacagaaagtttattgtg

SEQ ID NO: 9402889 - DNA, 20 bp, Homo sapiens
tgcaaacacagagtgtatga

SEQ ID NO: 9402890 - DNA, 22 bp, Homo sapiens
tgcaaacatccgactgaaagcc

SEQ ID NO: 9402891 - DNA, 22 bp, Homo sapiens
tgcaaacatcaatggcctgagc

SEQ ID NO: 9402892 - DNA, 19 bp, Homo sapiens
tgcaaatgctgttgagaat

SEQ ID NO: 9402893 - DNA, 22 bp, Homo sapiens
tgcaaatgagttgcagatcagg

SEQ ID NO: 9402894 - DNA, 22 bp, Homo sapiens
tgcaaagatatgagaagctgta

SEQ ID NO: 9402895 - DNA, 22 bp, Homo sapiens
tgcaaagaagcaacatccttgt

SEQ ID NO: 9402896 - DNA, 22 bp, Homo sapiens
tgcaaatgggtgagggttagga

SEQ ID NO: 9402897 - DNA, 22 bp, Homo sapiens
tgcaaattgcatgatgtgtatc

SEQ ID NO: 9402898 - DNA, 22 bp, Homo sapiens
tgcaaattgcgatttttattag

SEQ ID NO: 9402899 - DNA, 22 bp, Homo sapiens
tgatttatgaccaagttagaat

SEQ ID NO: 9402900 - DNA, 22 bp, Homo sapiens
tgatttatgcattatactgttg

SEQ ID NO: 9402901 - DNA, 22 bp, Homo sapiens
tgatttaggaaacagctacagg

SEQ ID NO: 9402902 - DNA, 17 bp, Homo sapiens
tgatttagtaagctgcc

SEQ ID NO: 9402903 - DNA, 22 bp, Homo sapiens
tgatttacttctggataaatcc

SEQ ID NO: 9402904 - DNA, 22 bp, Homo sapiens
tgatttacttcccagctgggtt

SEQ ID NO: 9402905 - DNA, 22 bp, Homo sapiens
tgatttactcccacttagagcc

SEQ ID NO: 9402906 - DNA, 22 bp, Homo sapiens
tgatttacccgtccaggcccta

SEQ ID NO: 9402907 - DNA, 22 bp, Homo sapiens
tgatttacccgtaactatttct

SEQ ID NO: 9402908 - DNA, 22 bp, Homo sapiens
tgatttaccagttactatcttg

SEQ ID NO: 9402909 - DNA, 22 bp, Homo sapiens
tgatttacacatcaaagcagca

SEQ ID NO: 9402910 - DNA, 22 bp, Homo sapiens
tgatttacagtagtgtctaaac

SEQ ID NO: 9402911 - DNA, 22 bp, Homo sapiens
tgatttacacacctatgattta

SEQ ID NO: 9402912 - DNA, 22 bp, Homo sapiens
tgatttacaattgtaaaagttt

SEQ ID NO: 9402913 - DNA, 22 bp, Homo sapiens
tgatttaaaagaaacattgtct

SEQ ID NO: 9402914 - DNA, 22 bp, Homo sapiens
tgatttacaattgtaaaagttt

SEQ ID NO: 9402915 - DNA, 22 bp, Homo sapiens
tgatttatgcattatactgttg

SEQ ID NO: 9402916 - DNA, 21 bp, Homo sapiens
tgatttatgcccaagtccctg

SEQ ID NO: 9402917 - DNA, 22 bp, Homo sapiens
tgatttcaagtagtgacatgct

SEQ ID NO: 9402918 - DNA, 22 bp, Homo sapiens
tgatttcaggaatgtcttagca

SEQ ID NO: 9402919 - DNA, 22 bp, Homo sapiens
tgatttccccagtcttgctgct

SEQ ID NO: 9402920 - DNA, 21 bp, Homo sapiens
tgatttccatcttaaaataaa

SEQ ID NO: 9402921 - DNA, 22 bp, Homo sapiens
tgatttccacgtgcacccaggt

SEQ ID NO: 9402922 - DNA, 22 bp, Homo sapiens
tgcaaaatgacttctgaaaaga

SEQ ID NO: 9402923 - DNA, 22 bp, Homo sapiens
tgcaaaatgacttctgaaaaga

SEQ ID NO: 9402924 - DNA, 22 bp, Homo sapiens
tgattttattggtgaggaaatt

SEQ ID NO: 9402925 - DNA, 22 bp, Homo sapiens
tgatttcctctactagcaatta

SEQ ID NO: 9402926 - DNA, 20 bp, Homo sapiens
tgattttctgaaacagcaca

SEQ ID NO: 9402927 - DNA, 22 bp, Homo sapiens
tgattttgaggtttcaggtctt

SEQ ID NO: 9402928 - DNA, 22 bp, Homo sapiens
tgatttttagctattctgaaga

SEQ ID NO: 9402929 - DNA, 22 bp, Homo sapiens
tgatttttagctattctgaaga

SEQ ID NO: 9402930 - DNA, 22 bp, Homo sapiens
tgatttttaaaattctccttgc

SEQ ID NO: 9402931 - DNA, 22 bp, Homo sapiens
tgatttttggatctgagctgca

SEQ ID NO: 9402932 - DNA, 22 bp, Homo sapiens
tgatttttggatctgagctgca

SEQ ID NO: 9402933 - DNA, 22 bp, Homo sapiens
tgcagctgaccagcaagtcctg

SEQ ID NO: 9402934 - DNA, 21 bp, Homo sapiens
tgcagctgacactggtatgcc

SEQ ID NO: 9402935 - DNA, 22 bp, Homo sapiens
tgcagctgaggccagctatgcc

SEQ ID NO: 9402936 - DNA, 22 bp, Homo sapiens
tgcagctgacccactccagtcc

SEQ ID NO: 9402937 - DNA, 22 bp, Homo sapiens
tgcagctgaacctagagtctgt

SEQ ID NO: 9402938 - DNA, 21 bp, Homo sapiens
tgcagctgacactggtatgcc

SEQ ID NO: 9402939 - DNA, 22 bp, Homo sapiens
tgcagcctttagaagttcagat

SEQ ID NO: 9402940 - DNA, 22 bp, Homo sapiens
tgcagcctttagaagttcagat

SEQ ID NO: 9402941 - DNA, 22 bp, Homo sapiens
tgcagcgaaacatgagtttaat

SEQ ID NO: 9402942 - DNA, 22 bp, Homo sapiens
tgcagctggaacttagaggaga

SEQ ID NO: 9402943 - DNA, 22 bp, Homo sapiens
tgcagctggaacttagaggaga

SEQ ID NO: 9402944 - DNA, 22 bp, Homo sapiens
tgcagctgggtctgccctggct

SEQ ID NO: 9402945 - DNA, 22 bp, Homo sapiens
tgcagctggtttagaactagat

SEQ ID NO: 9402946 - DNA, 22 bp, Homo sapiens
tgcagctggtttagaactagat

SEQ ID NO: 9402947 - DNA, 17 bp, Homo sapiens
tgcagctgatggggaaa

SEQ ID NO: 9402948 - DNA, 22 bp, Homo sapiens
tgcagctgaggccagctatgcc

SEQ ID NO: 9402949 - DNA, 22 bp, Homo sapiens
tgcagctgataattacatgttc

SEQ ID NO: 9402950 - DNA, 22 bp, Homo sapiens
tgcagctgctggcccaggtgct

SEQ ID NO: 9402951 - DNA, 22 bp, Homo sapiens
tgcagctgctggtggctgaaag

SEQ ID NO: 9402952 - DNA, 22 bp, Homo sapiens
tgcagctgctggtggctgaaag

SEQ ID NO: 9402953 - DNA, 21 bp, Homo sapiens
tgcagcctctgcccagcagtg

SEQ ID NO: 9402954 - DNA, 22 bp, Homo sapiens
tgcagccctgtgcacatcccct

SEQ ID NO: 9402955 - DNA, 22 bp, Homo sapiens
tgcagcccttccttcctctggg

SEQ ID NO: 9402956 - DNA, 22 bp, Homo sapiens
tgcagcctcacgcatccgcatt

SEQ ID NO: 9402957 - DNA, 22 bp, Homo sapiens
tgcagccccccagatggccgta

SEQ ID NO: 9402958 - DNA, 19 bp, Homo sapiens
tgcagcccctaccacattc

SEQ ID NO: 9402959 - DNA, 22 bp, Homo sapiens
tgcagcccaggcgtcaggtggt

SEQ ID NO: 9402960 - DNA, 22 bp, Homo sapiens
tgcagcccctgaaaatggcagc

SEQ ID NO: 9402961 - DNA, 22 bp, Homo sapiens
tgcagcccctatcgcggacagg

SEQ ID NO: 9402962 - DNA, 19 bp, Homo sapiens
tgcagcccctaccacattc

SEQ ID NO: 9402963 - DNA, 23 bp, Homo sapiens
tgcagcagggtggtctacttctc

SEQ ID NO: 9402964 - DNA, 19 bp, Homo sapiens
tgcagccacgtgagagact

SEQ ID NO: 9402965 - DNA, 22 bp, Homo sapiens
tgcagcaggtatggcaagctcc

SEQ ID NO: 9402966 - DNA, 22 bp, Homo sapiens
tgcagcaggtatggcaagctcc

SEQ ID NO: 9402967 - DNA, 22 bp, Homo sapiens
tgcagccatctttcttggagga

SEQ ID NO: 9402968 - DNA, 22 bp, Homo sapiens
tgcagcccagccccagaacctt

SEQ ID NO: 9402969 - DNA, 22 bp, Homo sapiens
tgcagcccagccccagaacctt

SEQ ID NO: 9402970 - DNA, 22 bp, Homo sapiens
tgcagcagcagggaggaggctc

SEQ ID NO: 9402971 - DNA, 21 bp, Homo sapiens
tgcagcagatttgggggaaga

SEQ ID NO: 9402972 - DNA, 21 bp, Homo sapiens
tgcagcagagtaagcagggga

SEQ ID NO: 9402973 - DNA, 21 bp, Homo sapiens
tgcagcagagtaagcagggga

SEQ ID NO: 9402974 - DNA, 21 bp, Homo sapiens
tgcagcagagtaagcagggga

SEQ ID NO: 9402975 - DNA, 22 bp, Homo sapiens
tgcagcagacataatgtggatt

SEQ ID NO: 9402976 - DNA, 22 bp, Homo sapiens
tgcagcagcagggaggaggctc

SEQ ID NO: 9402977 - DNA, 22 bp, Homo sapiens
tgcagcagcctcatctggtttc

SEQ ID NO: 9402978 - DNA, 22 bp, Homo sapiens
tgcagcaggagccaggcctggt

SEQ ID NO: 9402979 - DNA, 22 bp, Homo sapiens
tgcagcagggcccaggcacaga

SEQ ID NO: 9402980 - DNA, 22 bp, Homo sapiens
tgcagcagggcccaggcacaga

SEQ ID NO: 9402981 - DNA, 22 bp, Homo sapiens
tgcagcagggcccaggcacaga

SEQ ID NO: 9402982 - DNA, 22 bp, Homo sapiens
tgcagcaggcacaggacggaag

SEQ ID NO: 9402983 - DNA, 21 bp, Homo sapiens
tgcaggctacttctgactcta

SEQ ID NO: 9402984 - DNA, 21 bp, Homo sapiens
tgcaggctacttctgactcta

SEQ ID NO: 9402985 - DNA, 22 bp, Homo sapiens
tgcaggcctggactgatgtggt

SEQ ID NO: 9402986 - DNA, 22 bp, Homo sapiens
tgcaggctcatctcaagagtag

SEQ ID NO: 9402987 - DNA, 22 bp, Homo sapiens
tgcaggcagctgaaaggtgcct

SEQ ID NO: 9402988 - DNA, 22 bp, Homo sapiens
tgcaggcaccattctgcctctc

SEQ ID NO: 9402989 - DNA, 21 bp, Homo sapiens
tgcaggattccaggtcagtat

SEQ ID NO: 9402990 - DNA, 22 bp, Homo sapiens
tgcaggcaccattctgcctctc

SEQ ID NO: 9402991 - DNA, 22 bp, Homo sapiens
tgcaggagttcccctctgcctg

SEQ ID NO: 9402992 - DNA, 21 bp, Homo sapiens
tgcaggagtgtaatgtgaccc

SEQ ID NO: 9402993 - DNA, 21 bp, Homo sapiens
tgcaggagtgtaatgtgaccc

SEQ ID NO: 9402994 - DNA, 22 bp, Homo sapiens
tgcaggagttaagtgctctcct

SEQ ID NO: 9402995 - DNA, 21 bp, Homo sapiens
tgcaggagtgtaatgtgaccc

SEQ ID NO: 9402996 - DNA, 18 bp, Homo sapiens
tgcaggagtgaccccggc

SEQ ID NO: 9402997 - DNA, 19 bp, Homo sapiens
tgcaggaggactgagcaga

SEQ ID NO: 9402998 - DNA, 22 bp, Homo sapiens
tgcaggagcttggctctgtccc

SEQ ID NO: 9402999 - DNA, 22 bp, Homo sapiens
tgcaggagcttggctctgtccc

SEQ ID NO: 9403000 - DNA, 22 bp, Homo sapiens
tgcaggagctgtgcggtgaggg

SEQ ID NO: 9403001 - DNA, 22 bp, Homo sapiens
tgcaggagcccttgggctctgg

SEQ ID NO: 9403002 - DNA, 22 bp, Homo sapiens
tgcaggagccttggacttgaaa

SEQ ID NO: 9403003 - DNA, 22 bp, Homo sapiens
tgcaggagctgctgtcctgctc

SEQ ID NO: 9403004 - DNA, 22 bp, Homo sapiens
tgcaggagtccaatcaggagac

SEQ ID NO: 9403005 - DNA, 22 bp, Homo sapiens
tgcaggagggagggttacagtt

SEQ ID NO: 9403006 - DNA, 21 bp, Homo sapiens
tgcaggagtctgtgagtcagg

SEQ ID NO: 9403007 - DNA, 21 bp, Homo sapiens
tgcaggagtctgtgagtcagg

SEQ ID NO: 9403008 - DNA, 22 bp, Homo sapiens
tgcaggagtccaatcaggagac

SEQ ID NO: 9403009 - DNA, 22 bp, Homo sapiens
tgcaggaggattttgtggagct

SEQ ID NO: 9403010 - DNA, 22 bp, Homo sapiens
tgcaggaggattttgtggagct

SEQ ID NO: 9403011 - DNA, 22 bp, Homo sapiens
tgcaggaggctttattcaggat

SEQ ID NO: 9403012 - DNA, 22 bp, Homo sapiens
tgcaggaggctttattcaggat

SEQ ID NO: 9403013 - DNA, 22 bp, Homo sapiens
tgcaggagggagggttacagtt

SEQ ID NO: 9403014 - DNA, 22 bp, Homo sapiens
tgcaggaggccccatggaaccg

SEQ ID NO: 9403015 - DNA, 22 bp, Homo sapiens
tgcagctgtgcctgaaaagtac

SEQ ID NO: 9403016 - DNA, 22 bp, Homo sapiens
tgcagctgtgaaagggaaccaa

SEQ ID NO: 9403017 - DNA, 22 bp, Homo sapiens
tgcagctgtgaaagggaaccaa

SEQ ID NO: 9403018 - DNA, 22 bp, Homo sapiens
tgcagctgtgggagaatctctg

SEQ ID NO: 9403019 - DNA, 22 bp, Homo sapiens
tgcagctgtaacagaggcctca

SEQ ID NO: 9403020 - DNA, 22 bp, Homo sapiens
tgcagctgtaacagaggcctca

SEQ ID NO: 9403021 - DNA, 19 bp, Homo sapiens
tgcagctgtatgagcttaa

SEQ ID NO: 9403022 - DNA, 20 bp, Homo sapiens
tgcagcttctcatcttcaaa

SEQ ID NO: 9403023 - DNA, 22 bp, Homo sapiens
tgcagcttctccaaatattaca

SEQ ID NO: 9403024 - DNA, 22 bp, Homo sapiens
tgcagcttccacatccacactc

SEQ ID NO: 9403025 - DNA, 22 bp, Homo sapiens
tgcagcttccacatccacactc

SEQ ID NO: 9403026 - DNA, 22 bp, Homo sapiens
tgcagcttcaaagaacctttcc

SEQ ID NO: 9403027 - DNA, 20 bp, Homo sapiens
tgcagcttcacctgtgtcat

SEQ ID NO: 9403028 - DNA, 20 bp, Homo sapiens
tgcagcttcacctgtgtcat

SEQ ID NO: 9403029 - DNA, 22 bp, Homo sapiens
tgcagcttaaatcagggtttct

SEQ ID NO: 9403030 - DNA, 22 bp, Homo sapiens
tgcaggaaaaccaacacgcctt

SEQ ID NO: 9403031 - DNA, 22 bp, Homo sapiens
tgcaggaaacagaggctcaaat

SEQ ID NO: 9403032 - DNA, 22 bp, Homo sapiens
tgcaggaaacagaggctcaaat

SEQ ID NO: 9403033 - DNA, 22 bp, Homo sapiens
tgcaggaaaacacctatcaccc

SEQ ID NO: 9403034 - DNA, 22 bp, Homo sapiens
tgcaggaaaaataaatagtgtt

SEQ ID NO: 9403035 - DNA, 22 bp, Homo sapiens
tgcaggaaaaataaatagtgtt

SEQ ID NO: 9403036 - DNA, 22 bp, Homo sapiens
tgcagctttaagctttcatcag

SEQ ID NO: 9403037 - DNA, 22 bp, Homo sapiens
tgcagctttgctctggtcccca

SEQ ID NO: 9403038 - DNA, 21 bp, Homo sapiens
tgcaggaagtatggtgcctat

SEQ ID NO: 9403039 - DNA, 21 bp, Homo sapiens
tgcaggaagtatggtgcctat

SEQ ID NO: 9403040 - DNA, 22 bp, Homo sapiens
tgcaggaagcaaccaggtccaa

SEQ ID NO: 9403041 - DNA, 22 bp, Homo sapiens
tgcaggaagacttcccaagcca

SEQ ID NO: 9403042 - DNA, 22 bp, Homo sapiens
tgcaggaagcaaccaggtccaa

SEQ ID NO: 9403043 - DNA, 22 bp, Homo sapiens
tgcaggagacataatagggact

SEQ ID NO: 9403044 - DNA, 22 bp, Homo sapiens
tgcaggagacataatagggact

SEQ ID NO: 9403045 - DNA, 21 bp, Homo sapiens
tgcaggaaagtgctgcgaccc

SEQ ID NO: 9403046 - DNA, 21 bp, Homo sapiens
tgcaggaaagtgctgcgaccc

SEQ ID NO: 9403047 - DNA, 21 bp, Homo sapiens
tgcaggaaagtgctgcgaccc

SEQ ID NO: 9403048 - DNA, 22 bp, Homo sapiens
tgcaggaaattccagggtggcc

SEQ ID NO: 9403049 - DNA, 22 bp, Homo sapiens
tgcaggaacagaactcactccc

SEQ ID NO: 9403050 - DNA, 22 bp, Homo sapiens
tgcaggaacataggttccttgg

SEQ ID NO: 9403051 - DNA, 22 bp, Homo sapiens
tgcaggaacataggttccttgg

SEQ ID NO: 9403052 - DNA, 22 bp, Homo sapiens
tgcaggaacttggttttactca

SEQ ID NO: 9403053 - DNA, 22 bp, Homo sapiens
tgcaggaactcgaaaactatag

SEQ ID NO: 9403054 - DNA, 22 bp, Homo sapiens
tgcaggaactgggagggatagt

SEQ ID NO: 9403055 - DNA, 22 bp, Homo sapiens
tgcaggagcccttgggctctgg

SEQ ID NO: 9403056 - DNA, 22 bp, Homo sapiens
tgcaggagcagagatggctgga

SEQ ID NO: 9403057 - DNA, 22 bp, Homo sapiens
tgcaggagcaccagctcaccct

SEQ ID NO: 9403058 - DNA, 22 bp, Homo sapiens
tgcaggagagctggtctggccc

SEQ ID NO: 9403059 - DNA, 22 bp, Homo sapiens
tgcaggagataatggtgcttag

SEQ ID NO: 9403060 - DNA, 22 bp, Homo sapiens
tgcaggagataatggtgcttag

SEQ ID NO: 9403061 - DNA, 22 bp, Homo sapiens
tgcaggagagtgagtcagtagg

SEQ ID NO: 9403062 - DNA, 21 bp, Homo sapiens
tgcacagggcccaggagagcc

SEQ ID NO: 9403063 - DNA, 21 bp, Homo sapiens
tgcacagggcccaggagagcc

SEQ ID NO: 9403064 - DNA, 22 bp, Homo sapiens
tgcacagggagggggccagctc

SEQ ID NO: 9403065 - DNA, 22 bp, Homo sapiens
tgcacaggccttgaagggagag

SEQ ID NO: 9403066 - DNA, 22 bp, Homo sapiens
tgcacaggccttgaagggagag

SEQ ID NO: 9403067 - DNA, 22 bp, Homo sapiens
tgcacaggtgagactcaggaag

SEQ ID NO: 9403068 - DNA, 22 bp, Homo sapiens
tgcacaggtgagactcaggaag

SEQ ID NO: 9403069 - DNA, 22 bp, Homo sapiens
tgcacaggtatgcaaagcatgt

SEQ ID NO: 9403070 - DNA, 20 bp, Homo sapiens
tgcacagggtgggaagcaac

SEQ ID NO: 9403071 - DNA, 20 bp, Homo sapiens
tgcacagggtgggaagcaac

SEQ ID NO: 9403072 - DNA, 22 bp, Homo sapiens
tgcacacatacatgggaagtgc

SEQ ID NO: 9403073 - DNA, 22 bp, Homo sapiens
tgcacacagttctcaggaaaga

SEQ ID NO: 9403074 - DNA, 22 bp, Homo sapiens
tgcacagcgggtgtctgtcagg

SEQ ID NO: 9403075 - DNA, 21 bp, Homo sapiens
tgcacagccataccctccttg

SEQ ID NO: 9403076 - DNA, 21 bp, Homo sapiens
tgcacagccataccctccttg

SEQ ID NO: 9403077 - DNA, 22 bp, Homo sapiens
tgcacaggaggctgtggagaag

SEQ ID NO: 9403078 - DNA, 22 bp, Homo sapiens
tgcacaggaggctgtggagaag

SEQ ID NO: 9403079 - DNA, 20 bp, Homo sapiens
tgcacagctgtgaataggat

SEQ ID NO: 9403080 - DNA, 22 bp, Homo sapiens
tgcacagctgcctcctctctgc

SEQ ID NO: 9403081 - DNA, 22 bp, Homo sapiens
tgcacagctggctctccttttc

SEQ ID NO: 9403082 - DNA, 22 bp, Homo sapiens
tgcacagctgcctcctctctgc

SEQ ID NO: 9403083 - DNA, 22 bp, Homo sapiens
tgcaccttccacaagaactacc

SEQ ID NO: 9403084 - DNA, 21 bp, Homo sapiens
tgcacctgtgccccatccttc

SEQ ID NO: 9403085 - DNA, 22 bp, Homo sapiens
tgcacctgagaggtctctgagg

SEQ ID NO: 9403086 - DNA, 22 bp, Homo sapiens
tgcaccattaatttatgtgaga

SEQ ID NO: 9403087 - DNA, 22 bp, Homo sapiens
tgcaccattttgtcaggctact

SEQ ID NO: 9403088 - DNA, 22 bp, Homo sapiens
tgcaccattaatttatgtgaga

SEQ ID NO: 9403089 - DNA, 19 bp, Homo sapiens
tgcacccatgtatgcatgc

SEQ ID NO: 9403090 - DNA, 22 bp, Homo sapiens
tgcacccatagcacacactcct

SEQ ID NO: 9403091 - DNA, 22 bp, Homo sapiens
tgcacccacttagctgaagttc

SEQ ID NO: 9403092 - DNA, 22 bp, Homo sapiens
tgcacccacttagctgaagttc

SEQ ID NO: 9403093 - DNA, 20 bp, Homo sapiens
tgcacccagagcctgaagat

SEQ ID NO: 9403094 - DNA, 22 bp, Homo sapiens
tgcaccctcatcagtcaaatgg

SEQ ID NO: 9403095 - DNA, 22 bp, Homo sapiens
tgcacaggtggtccatctgcac

SEQ ID NO: 9403096 - DNA, 22 bp, Homo sapiens
tgcacagtgacccctggtgact

SEQ ID NO: 9403097 - DNA, 22 bp, Homo sapiens
tgcacatggcaatgctgctccc

SEQ ID NO: 9403098 - DNA, 22 bp, Homo sapiens
tgcacattagtgtttgagatgc

SEQ ID NO: 9403099 - DNA, 22 bp, Homo sapiens
tgcacattagtgtttgagatgc

SEQ ID NO: 9403100 - DNA, 22 bp, Homo sapiens
tgcacattcacttaggtattgt

SEQ ID NO: 9403101 - DNA, 22 bp, Homo sapiens
tgcagaaacaagccatcattca

SEQ ID NO: 9403102 - DNA, 22 bp, Homo sapiens
tgcacttttatatcactctggc

SEQ ID NO: 9403103 - DNA, 22 bp, Homo sapiens
tgcactactgtgatacacagcc

SEQ ID NO: 9403104 - DNA, 21 bp, Homo sapiens
tgcactttgggggacaggctg

SEQ ID NO: 9403105 - DNA, 22 bp, Homo sapiens
tgcacgtgtgagcattcacatg

SEQ ID NO: 9403106 - DNA, 22 bp, Homo sapiens
tgcacgtgggctctctgctctt

SEQ ID NO: 9403107 - DNA, 22 bp, Homo sapiens
tgcacgtgggctctctgctctt

SEQ ID NO: 9403108 - DNA, 22 bp, Homo sapiens
tgcacgtgggctctctgctctt

SEQ ID NO: 9403109 - DNA, 22 bp, Homo sapiens
tgcagaaattcagaaagcataa

SEQ ID NO: 9403110 - DNA, 22 bp, Homo sapiens
tgcagaaataactcatattgca

SEQ ID NO: 9403111 - DNA, 22 bp, Homo sapiens
tgcagaaagcattgactcttcc

SEQ ID NO: 9403112 - DNA, 22 bp, Homo sapiens
tgcagaagaaaacagctgtgtg

SEQ ID NO: 9403113 - DNA, 22 bp, Homo sapiens
tgcagaagaaaacagctgtgtg

SEQ ID NO: 9403114 - DNA, 22 bp, Homo sapiens
tgcagaagaaaacagctgtgtg

SEQ ID NO: 9403115 - DNA, 20 bp, Homo sapiens
tgcagaagaacgttctggtt

SEQ ID NO: 9403116 - DNA, 22 bp, Homo sapiens
tgcagaagaatgagcttggagt

SEQ ID NO: 9403117 - DNA, 22 bp, Homo sapiens
tgcagaagaatgtaggcataag

SEQ ID NO: 9403118 - DNA, 22 bp, Homo sapiens
tgcagaagacacaaggtaacgt

SEQ ID NO: 9403119 - DNA, 22 bp, Homo sapiens
tgcagaagaatgtaggcataag

SEQ ID NO: 9403120 - DNA, 19 bp, Homo sapiens
tgcagaagacacagtggtg

SEQ ID NO: 9403121 - DNA, 19 bp, Homo sapiens
tgcagaagacacagtggtg

SEQ ID NO: 9403122 - DNA, 22 bp, Homo sapiens
tgcagaagacacaaggtaacgt

SEQ ID NO: 9403123 - DNA, 22 bp, Homo sapiens
tgcagaagctgcaggtcagtgg

SEQ ID NO: 9403124 - DNA, 22 bp, Homo sapiens
tgcagaaggaggaggaaatcca

SEQ ID NO: 9403125 - DNA, 22 bp, Homo sapiens
tgcagaaggcctgacattgcac

SEQ ID NO: 9403126 - DNA, 22 bp, Homo sapiens
tgcagaaggaggaggaaatcca

SEQ ID NO: 9403127 - DNA, 22 bp, Homo sapiens
tgcagaagtattccaggcccca

SEQ ID NO: 9403128 - DNA, 22 bp, Homo sapiens
tgcagaagtgagtcatgaggaa

SEQ ID NO: 9403129 - DNA, 22 bp, Homo sapiens
tgcagaagatggtctgagcacc

SEQ ID NO: 9403130 - DNA, 22 bp, Homo sapiens
tgcagaagaccttccagggctg

SEQ ID NO: 9403131 - DNA, 22 bp, Homo sapiens
tgcagaagatggtctgagcacc

SEQ ID NO: 9403132 - DNA, 22 bp, Homo sapiens
tgcagaagcagagccggtggcc

SEQ ID NO: 9403133 - DNA, 22 bp, Homo sapiens
tgcagaagcagagagttgccaa

SEQ ID NO: 9403134 - DNA, 22 bp, Homo sapiens
tgcagaggagctggaaggctgg

SEQ ID NO: 9403135 - DNA, 22 bp, Homo sapiens
tgcagaggagctggaaggctgg

SEQ ID NO: 9403136 - DNA, 22 bp, Homo sapiens
tgcagaggagtcagcctgggca

SEQ ID NO: 9403137 - DNA, 21 bp, Homo sapiens
tgcagaggcacaaacaagccc

SEQ ID NO: 9403138 - DNA, 21 bp, Homo sapiens
tgcagaggcacaaacaagccc

SEQ ID NO: 9403139 - DNA, 22 bp, Homo sapiens
tgcagaggctggctcgccgggt

SEQ ID NO: 9403140 - DNA, 22 bp, Homo sapiens
tgcagaggctggctcgccgggt

SEQ ID NO: 9403141 - DNA, 22 bp, Homo sapiens
tgcagaggcgccgtgggtgggg

SEQ ID NO: 9403142 - DNA, 23 bp, Homo sapiens
tgcagaggcatgatcactgctca

SEQ ID NO: 9403143 - DNA, 23 bp, Homo sapiens
tgcagaggcatgatcactgctca

SEQ ID NO: 9403144 - DNA, 22 bp, Homo sapiens
tgcagaggagctggaaggctgg

SEQ ID NO: 9403145 - DNA, 20 bp, Homo sapiens
tgcagagctggctggctcct

SEQ ID NO: 9403146 - DNA, 22 bp, Homo sapiens
tgcagaggaccattgtcctgga

SEQ ID NO: 9403147 - DNA, 22 bp, Homo sapiens
tgcagagattgaacaagaagga

SEQ ID NO: 9403148 - DNA, 22 bp, Homo sapiens
tgcagagctcttggcacttcag

SEQ ID NO: 9403149 - DNA, 22 bp, Homo sapiens
tgcagagcagcaactgcgtgcg

SEQ ID NO: 9403150 - DNA, 22 bp, Homo sapiens
tgcagagcagcaactgcgtgcg

SEQ ID NO: 9403151 - DNA, 22 bp, Homo sapiens
tgcagaatttagggaggcagca

SEQ ID NO: 9403152 - DNA, 22 bp, Homo sapiens
tgcagaatgtggacagtgggtt

SEQ ID NO: 9403153 - DNA, 22 bp, Homo sapiens
tgcagacctcccatggctgcct

SEQ ID NO: 9403154 - DNA, 21 bp, Homo sapiens
tgcagcagaagtctctgtgtc

SEQ ID NO: 9403155 - DNA, 22 bp, Homo sapiens
tgcagcagaatatggctgcagg

SEQ ID NO: 9403156 - DNA, 22 bp, Homo sapiens
tgcagcagaatatggctgcagg

SEQ ID NO: 9403157 - DNA, 22 bp, Homo sapiens
tgcagcaccgtcccactggcta

SEQ ID NO: 9403158 - DNA, 22 bp, Homo sapiens
tgcagcacctatggacacttgt

SEQ ID NO: 9403159 - DNA, 20 bp, Homo sapiens
tgcagcacgggccctttcca

SEQ ID NO: 9403160 - DNA, 22 bp, Homo sapiens
tgcagatggggatcagtggctc

SEQ ID NO: 9403161 - DNA, 22 bp, Homo sapiens
tgcagatgagggatgaaaatga

SEQ ID NO: 9403162 - DNA, 22 bp, Homo sapiens
tgcagattcaaatgaaatgcaa

SEQ ID NO: 9403163 - DNA, 22 bp, Homo sapiens
tgcagcaaacaggccttcaggg

SEQ ID NO: 9403164 - DNA, 22 bp, Homo sapiens
tgcagcaatggtccctgccctc

SEQ ID NO: 9403165 - DNA, 22 bp, Homo sapiens
tgcagcaagtaaccatcttcct

SEQ ID NO: 9403166 - DNA, 22 bp, Homo sapiens
tgcagcaagaaggcactgtctg

SEQ ID NO: 9403167 - DNA, 22 bp, Homo sapiens
tgcagcaaatggggcccgtcct

SEQ ID NO: 9403168 - DNA, 22 bp, Homo sapiens
tgcagatagcgtcattcttgct

SEQ ID NO: 9403169 - DNA, 22 bp, Homo sapiens
tgcagataatactagaacttac

SEQ ID NO: 9403170 - DNA, 22 bp, Homo sapiens
tgcagagttgctttgatagtcc

SEQ ID NO: 9403171 - DNA, 22 bp, Homo sapiens
tgcagataatactagaacttac

SEQ ID NO: 9403172 - DNA, 23 bp, Homo sapiens
tgcagagtgtcacttgaaaacca

SEQ ID NO: 9403173 - DNA, 22 bp, Homo sapiens
tgcagagtggattctgtatacc

SEQ ID NO: 9403174 - DNA, 19 bp, Homo sapiens
tgcagagggtaggaaggcc

SEQ ID NO: 9403175 - DNA, 19 bp, Homo sapiens
tgcagagggtaggaaggcc

SEQ ID NO: 9403176 - DNA, 22 bp, Homo sapiens
tgcagagtagtgaggggacaga

SEQ ID NO: 9403177 - DNA, 19 bp, Homo sapiens
tgcagagggtaggaaggcc

SEQ ID NO: 9403178 - DNA, 22 bp, Homo sapiens
tgcagagggagtgacggttcac

SEQ ID NO: 9403179 - DNA, 23 bp, Homo sapiens
tgcagagggactgaagccagctt

SEQ ID NO: 9403180 - DNA, 22 bp, Homo sapiens
tgcagagggacagccacagctc

SEQ ID NO: 9403181 - DNA, 22 bp, Homo sapiens
tgcagagggacagccacagctc

SEQ ID NO: 9403182 - DNA, 22 bp, Homo sapiens
tgcatggtgaatacagttcatt

SEQ ID NO: 9403183 - DNA, 22 bp, Homo sapiens
tgcatggttatatactactagt

SEQ ID NO: 9403184 - DNA, 22 bp, Homo sapiens
tgcatggtttgtgaattatacc

SEQ ID NO: 9403185 - DNA, 22 bp, Homo sapiens
tgcatggtttgtgaattatacc

SEQ ID NO: 9403186 - DNA, 23 bp, Homo sapiens
tgcatggggctatactgctgttc

SEQ ID NO: 9403187 - DNA, 22 bp, Homo sapiens
tgcatggtaaccaggatgtcta

SEQ ID NO: 9403188 - DNA, 23 bp, Homo sapiens
tgcatgtgaattcatacttgttt

SEQ ID NO: 9403189 - DNA, 23 bp, Homo sapiens
tgcatgtgaattcatacttgttt

SEQ ID NO: 9403190 - DNA, 23 bp, Homo sapiens
tgcatgtgaattcatacttgttt

SEQ ID NO: 9403191 - DNA, 22 bp, Homo sapiens
tgcatgtatttaaagttgcaat

SEQ ID NO: 9403192 - DNA, 17 bp, Homo sapiens
tgcatgtcctttgttcc

SEQ ID NO: 9403193 - DNA, 17 bp, Homo sapiens
tgcatgtcctttgttcc

SEQ ID NO: 9403194 - DNA, 22 bp, Homo sapiens
tgcatgtgtttgccacagtgag

SEQ ID NO: 9403195 - DNA, 22 bp, Homo sapiens
tgcatgttatagaattttaact

SEQ ID NO: 9403196 - DNA, 22 bp, Homo sapiens
tgcatgttattgtggcaagaat

SEQ ID NO: 9403197 - DNA, 22 bp, Homo sapiens
tgcatgttatagaattttaact

SEQ ID NO: 9403198 - DNA, 22 bp, Homo sapiens
tgcatgtttctgtatgttaatg

SEQ ID NO: 9403199 - DNA, 22 bp, Homo sapiens
tgcatgtgtcgggcctgtgcta

SEQ ID NO: 9403200 - DNA, 22 bp, Homo sapiens
tgcatgtggatcatatgtccta

SEQ ID NO: 9403201 - DNA, 22 bp, Homo sapiens
tgcatgtgtgtgtatttataaa

SEQ ID NO: 9403202 - DNA, 22 bp, Homo sapiens
tgcatctttctgcatatgtaaa

SEQ ID NO: 9403203 - DNA, 22 bp, Homo sapiens
tgcatgcacgtatctgcgtgtg

SEQ ID NO: 9403204 - DNA, 22 bp, Homo sapiens
tgcatgcacgtatctgcgtgtg

SEQ ID NO: 9403205 - DNA, 22 bp, Homo sapiens
tgcatgcagcatatgaggcctc

SEQ ID NO: 9403206 - DNA, 22 bp, Homo sapiens
tgcatgcacttggctggcacgt

SEQ ID NO: 9403207 - DNA, 22 bp, Homo sapiens
tgcatgcacgtgctatgtatga

SEQ ID NO: 9403208 - DNA, 22 bp, Homo sapiens
tgcatgatagagatggtattag

SEQ ID NO: 9403209 - DNA, 22 bp, Homo sapiens
tgcatgatgactaaggtggtga

SEQ ID NO: 9403210 - DNA, 22 bp, Homo sapiens
tgcatgatggtttagatggggt

SEQ ID NO: 9403211 - DNA, 22 bp, Homo sapiens
tgcatgatgttaaacatcaggt

SEQ ID NO: 9403212 - DNA, 22 bp, Homo sapiens
tgcatgcaacaattcttctata

SEQ ID NO: 9403213 - DNA, 22 bp, Homo sapiens
tgcatgcataaatgtacacaca

SEQ ID NO: 9403214 - DNA, 22 bp, Homo sapiens
tgcatgcatgatgtttggtagc

SEQ ID NO: 9403215 - DNA, 22 bp, Homo sapiens
tgcatgcatgctactgggaggt

SEQ ID NO: 9403216 - DNA, 22 bp, Homo sapiens
tgcatgcatgtttttacccaca

SEQ ID NO: 9403217 - DNA, 22 bp, Homo sapiens
tgcatgcatgtgagcatgcata

SEQ ID NO: 9403218 - DNA, 21 bp, Homo sapiens
tgcatgctatgtttttatttc

SEQ ID NO: 9403219 - DNA, 22 bp, Homo sapiens
tgcatgctaagaaatagcagct

SEQ ID NO: 9403220 - DNA, 22 bp, Homo sapiens
tgcatgctttcagaaatagggc

SEQ ID NO: 9403221 - DNA, 22 bp, Homo sapiens
tgcatgcttcctgtaagtacct

SEQ ID NO: 9403222 - DNA, 22 bp, Homo sapiens
tgcatcatttataatgtctttg

SEQ ID NO: 9403223 - DNA, 22 bp, Homo sapiens
tgcatcattaaggtacagttgg

SEQ ID NO: 9403224 - DNA, 22 bp, Homo sapiens
tgcatcattaaggtacagttgg

SEQ ID NO: 9403225 - DNA, 22 bp, Homo sapiens
tgcatcagtgactgaatatgag

SEQ ID NO: 9403226 - DNA, 22 bp, Homo sapiens
tgcatcagtgactgggagataa

SEQ ID NO: 9403227 - DNA, 22 bp, Homo sapiens
tgcatctggcctttgctggcta

SEQ ID NO: 9403228 - DNA, 22 bp, Homo sapiens
tgcatacacacatcaaatgttt

SEQ ID NO: 9403229 - DNA, 22 bp, Homo sapiens
tgcatacataaagtgctatcat

SEQ ID NO: 9403230 - DNA, 22 bp, Homo sapiens
tgcatacataaagtgctatcat

SEQ ID NO: 9403231 - DNA, 19 bp, Homo sapiens
tgcataaattatatacttt

SEQ ID NO: 9403232 - DNA, 22 bp, Homo sapiens
tgcatagttctccttcctcctc

SEQ ID NO: 9403233 - DNA, 20 bp, Homo sapiens
tgcatagttgctgcagttga

SEQ ID NO: 9403234 - DNA, 22 bp, Homo sapiens
tgcatatacccgcatttacata

SEQ ID NO: 9403235 - DNA, 22 bp, Homo sapiens
tgcataaagtgccatagtatta

SEQ ID NO: 9403236 - DNA, 22 bp, Homo sapiens
tgcataaacagatacttcatgt

SEQ ID NO: 9403237 - DNA, 22 bp, Homo sapiens
tgcataaaatatgagaaatgta

SEQ ID NO: 9403238 - DNA, 22 bp, Homo sapiens
tgcataaaacatgatttctgct

SEQ ID NO: 9403239 - DNA, 22 bp, Homo sapiens
tgcattgggagagattagggca

SEQ ID NO: 9403240 - DNA, 22 bp, Homo sapiens
tgcattgggagtcagtgctgaa

SEQ ID NO: 9403241 - DNA, 22 bp, Homo sapiens
tgcattgggttgacatactaaa

SEQ ID NO: 9403242 - DNA, 22 bp, Homo sapiens
tgcattggtcatttgaaaatat

SEQ ID NO: 9403243 - DNA, 22 bp, Homo sapiens
tgcattggtcttaatcttcagg

SEQ ID NO: 9403244 - DNA, 22 bp, Homo sapiens
tgcattggtaaaatacatacac

SEQ ID NO: 9403245 - DNA, 22 bp, Homo sapiens
tgcattggtcatttagaaaata

SEQ ID NO: 9403246 - DNA, 22 bp, Homo sapiens
tgcattggaaaactatggctca

SEQ ID NO: 9403247 - DNA, 22 bp, Homo sapiens
tgcattggaaactcagcagcac

SEQ ID NO: 9403248 - DNA, 22 bp, Homo sapiens
tgcatttaagaaaacatgagtc

SEQ ID NO: 9403249 - DNA, 20 bp, Homo sapiens
tgcatttacagtgtggatac

SEQ ID NO: 9403250 - DNA, 22 bp, Homo sapiens
tgcatttaatagatgctccctg

SEQ ID NO: 9403251 - DNA, 22 bp, Homo sapiens
tgcatttaactagaatattaat

SEQ ID NO: 9403252 - DNA, 22 bp, Homo sapiens
tgcatttaactagaatattaat

SEQ ID NO: 9403253 - DNA, 22 bp, Homo sapiens
tgcatttaagaaaacatgagtc

SEQ ID NO: 9403254 - DNA, 22 bp, Homo sapiens
tgcattgttgatgagttgaata

SEQ ID NO: 9403255 - DNA, 21 bp, Homo sapiens
tgcatttaacagaaacaggaa

SEQ ID NO: 9403256 - DNA, 21 bp, Homo sapiens
tgcatttaacagaaacaggaa

SEQ ID NO: 9403257 - DNA, 22 bp, Homo sapiens
tgcattgtttgataggtgaatt

SEQ ID NO: 9403258 - DNA, 17 bp, Homo sapiens
tgcattgttggaaattt

SEQ ID NO: 9403259 - DNA, 22 bp, Homo sapiens
tgcatttacctggaggtcattt

SEQ ID NO: 9403260 - DNA, 20 bp, Homo sapiens
tgcatttacagtgtggatac

SEQ ID NO: 9403261 - DNA, 22 bp, Homo sapiens
tgcatttacggtacaacagcag

SEQ ID NO: 9403262 - DNA, 22 bp, Homo sapiens
tgcatttacctggaggtcattt

SEQ ID NO: 9403263 - DNA, 22 bp, Homo sapiens
tgcatttacggtacaacagcag

SEQ ID NO: 9403264 - DNA, 22 bp, Homo sapiens
tgcatttagttatgagaaaaac

SEQ ID NO: 9403265 - DNA, 22 bp, Homo sapiens
tgcatttagttatgagaaaaac

SEQ ID NO: 9403266 - DNA, 18 bp, Homo sapiens
tgcatttagtacatctag

SEQ ID NO: 9403267 - DNA, 18 bp, Homo sapiens
tgcatttagtacatctag

SEQ ID NO: 9403268 - DNA, 22 bp, Homo sapiens
tgcatttattaccaggctttca

SEQ ID NO: 9403269 - DNA, 22 bp, Homo sapiens
tgcatttatgtctcccaccagc

SEQ ID NO: 9403270 - DNA, 22 bp, Homo sapiens
tgcatttatgtctcccaccagc

SEQ ID NO: 9403271 - DNA, 22 bp, Homo sapiens
tgcatttatttgaattgatcta

SEQ ID NO: 9403272 - DNA, 22 bp, Homo sapiens
tgcatttattaccaggctttca

SEQ ID NO: 9403273 - DNA, 22 bp, Homo sapiens
tgcatttatttgaattgatcta

SEQ ID NO: 9403274 - DNA, 22 bp, Homo sapiens
tgcatttatggagttacctcat

SEQ ID NO: 9403275 - DNA, 22 bp, Homo sapiens
tgcatttatggagcaaggcagt

SEQ ID NO: 9403276 - DNA, 22 bp, Homo sapiens
tgcatttatggagcaaggcagt

SEQ ID NO: 9403277 - DNA, 22 bp, Homo sapiens
tgcatttagttttaataaagga

SEQ ID NO: 9403278 - DNA, 22 bp, Homo sapiens
tgcatttagttttaataaagga

SEQ ID NO: 9403279 - DNA, 22 bp, Homo sapiens
tgcatttataaaatgttcgtgg

SEQ ID NO: 9403280 - DNA, 22 bp, Homo sapiens
tgcatttgagttgggagcaggc

SEQ ID NO: 9403281 - DNA, 22 bp, Homo sapiens
tgcatttgctggggatgtgatt

SEQ ID NO: 9403282 - DNA, 22 bp, Homo sapiens
tgcatttcagaagaaaattcgg

SEQ ID NO: 9403283 - DNA, 22 bp, Homo sapiens
tgcatttccagatttctggagt

SEQ ID NO: 9403284 - DNA, 22 bp, Homo sapiens
tgcatttcttttgagtatatgc

SEQ ID NO: 9403285 - DNA, 22 bp, Homo sapiens
tgcatttccagatttctggagt

SEQ ID NO: 9403286 - DNA, 22 bp, Homo sapiens
tgcatttccagatttctggagt

SEQ ID NO: 9403287 - DNA, 22 bp, Homo sapiens
tgcatttgttcagtgaaatgtt

SEQ ID NO: 9403288 - DNA, 22 bp, Homo sapiens
tgcatttttaacaaggctaatt

SEQ ID NO: 9403289 - DNA, 19 bp, Homo sapiens
tgccaaatccatgcccagg

SEQ ID NO: 9403290 - DNA, 22 bp, Homo sapiens
tgcatttttgaggttaactcaa

SEQ ID NO: 9403291 - DNA, 22 bp, Homo sapiens
tgccaccctggcggcagcctgc

SEQ ID NO: 9403292 - DNA, 23 bp, Homo sapiens
tgccacccttctcttcccagctt

SEQ ID NO: 9403293 - DNA, 22 bp, Homo sapiens
tgccacccctctgcaccctcag

SEQ ID NO: 9403294 - DNA, 22 bp, Homo sapiens
tgccacccctctgcaccctcag

SEQ ID NO: 9403295 - DNA, 22 bp, Homo sapiens
tgccacccctctgcaccctcag

SEQ ID NO: 9403296 - DNA, 22 bp, Homo sapiens
tgccaccctctctgctacccgc

SEQ ID NO: 9403297 - DNA, 22 bp, Homo sapiens
tgccagaagtgctttataagtg

SEQ ID NO: 9403298 - DNA, 22 bp, Homo sapiens
tgccagagaagacccagtcact

SEQ ID NO: 9403299 - DNA, 22 bp, Homo sapiens
tgccaaattgaattacataatt

SEQ ID NO: 9403300 - DNA, 22 bp, Homo sapiens
tgccaaattgccctataaatga

SEQ ID NO: 9403301 - DNA, 22 bp, Homo sapiens
tgccacaggcaatccctgcacg

SEQ ID NO: 9403302 - DNA, 17 bp, Homo sapiens
tgccaagaagagcagag

SEQ ID NO: 9403303 - DNA, 22 bp, Homo sapiens
tgccacagggtcctcaggccag

SEQ ID NO: 9403304 - DNA, 22 bp, Homo sapiens
tgccacatggtgcatttcctag

SEQ ID NO: 9403305 - DNA, 22 bp, Homo sapiens
tgccaccatctggctgtgttga

SEQ ID NO: 9403306 - DNA, 22 bp, Homo sapiens
tgccaccccggaccccgaagtg

SEQ ID NO: 9403307 - DNA, 22 bp, Homo sapiens
tgccagagagtggctgggtgtc

SEQ ID NO: 9403308 - DNA, 22 bp, Homo sapiens
tgccagagatttcacactgcta

SEQ ID NO: 9403309 - DNA, 23 bp, Homo sapiens
tgccagaggcagtcacagtggtg

SEQ ID NO: 9403310 - DNA, 23 bp, Homo sapiens
tgccagaggcagtcacagtggtg

SEQ ID NO: 9403311 - DNA, 22 bp, Homo sapiens
tgccagcacttctggctgtctg

SEQ ID NO: 9403312 - DNA, 22 bp, Homo sapiens
tgccagcacttctggctgtctg

SEQ ID NO: 9403313 - DNA, 22 bp, Homo sapiens
tgccagcacaagttaagagatc

SEQ ID NO: 9403314 - DNA, 23 bp, Homo sapiens
tgccagaggcagtcacagtggtg

SEQ ID NO: 9403315 - DNA, 22 bp, Homo sapiens
tgccagattgtggcatggcact

SEQ ID NO: 9403316 - DNA, 22 bp, Homo sapiens
tgccagccaggttctgaggcta

SEQ ID NO: 9403317 - DNA, 22 bp, Homo sapiens
tgccagccagggaagctcaccc

SEQ ID NO: 9403318 - DNA, 22 bp, Homo sapiens
tgccagcccaccttggggcctc

SEQ ID NO: 9403319 - DNA, 22 bp, Homo sapiens
tgccagccaggttctgaggcta

SEQ ID NO: 9403320 - DNA, 21 bp, Homo sapiens
tgccagcattaaacagtcatt

SEQ ID NO: 9403321 - DNA, 20 bp, Homo sapiens
tgcaggtgttggagaaggta

SEQ ID NO: 9403322 - DNA, 22 bp, Homo sapiens
tgcagtggtgtccaggtgtact

SEQ ID NO: 9403323 - DNA, 22 bp, Homo sapiens
tgcagtggtggtaaagatgctc

SEQ ID NO: 9403324 - DNA, 22 bp, Homo sapiens
tgcagtgggccggaggccaggg

SEQ ID NO: 9403325 - DNA, 22 bp, Homo sapiens
tgcagtggttgagagcccagac

SEQ ID NO: 9403326 - DNA, 22 bp, Homo sapiens
tgcagtgtgacctgtagcgagc

SEQ ID NO: 9403327 - DNA, 22 bp, Homo sapiens
tgcagtgtttttcagggcatat

SEQ ID NO: 9403328 - DNA, 22 bp, Homo sapiens
tgcaggtgtctccagggcaggt

SEQ ID NO: 9403329 - DNA, 22 bp, Homo sapiens
tgcaggtgtctccagggcaggt

SEQ ID NO: 9403330 - DNA, 22 bp, Homo sapiens
tgcaggtgtctccagggcaggt

SEQ ID NO: 9403331 - DNA, 22 bp, Homo sapiens
tgcaggtgtaaattttcaagag

SEQ ID NO: 9403332 - DNA, 22 bp, Homo sapiens
tgcaggtgtagagttgggctcc

SEQ ID NO: 9403333 - DNA, 22 bp, Homo sapiens
tgcaggtgtagagttgggctcc

SEQ ID NO: 9403334 - DNA, 22 bp, Homo sapiens
tgcaggtgtagagttgggctcc

SEQ ID NO: 9403335 - DNA, 22 bp, Homo sapiens
tgcaggtgtaaattttcaagag

SEQ ID NO: 9403336 - DNA, 22 bp, Homo sapiens
tgcaggtggtttggacactgct

SEQ ID NO: 9403337 - DNA, 22 bp, Homo sapiens
tgcaggtggtttggacactgct

SEQ ID NO: 9403338 - DNA, 22 bp, Homo sapiens
tgcaggtggtccttcctctgct

SEQ ID NO: 9403339 - DNA, 22 bp, Homo sapiens
tgcaggtggtccttcctctgct

SEQ ID NO: 9403340 - DNA, 22 bp, Homo sapiens
tgcaggtggtccttcctctgct

SEQ ID NO: 9403341 - DNA, 22 bp, Homo sapiens
tgcaggtggtccttcctctgct

SEQ ID NO: 9403342 - DNA, 22 bp, Homo sapiens
tgcaggtggtccatttgggaac

SEQ ID NO: 9403343 - DNA, 22 bp, Homo sapiens
tgcaggtggtccatttgggaac

SEQ ID NO: 9403344 - DNA, 22 bp, Homo sapiens
tgcaggtggtacttctttttct

SEQ ID NO: 9403345 - DNA, 22 bp, Homo sapiens
tgcaggtggtacttctttttct

SEQ ID NO: 9403346 - DNA, 20 bp, Homo sapiens
tgcaggtgggcccttctggg

SEQ ID NO: 9403347 - DNA, 20 bp, Homo sapiens
tgcaggtgggcccttctggg

SEQ ID NO: 9403348 - DNA, 20 bp, Homo sapiens
tgcaggtgggcccttctggg

SEQ ID NO: 9403349 - DNA, 20 bp, Homo sapiens
tgcaggtgggcccttctggg

SEQ ID NO: 9403350 - DNA, 22 bp, Homo sapiens
tgcaggtgtgggcaggggagca

SEQ ID NO: 9403351 - DNA, 22 bp, Homo sapiens
tgcaggtgtgggcaggggagca

SEQ ID NO: 9403352 - DNA, 22 bp, Homo sapiens
tgcaggtgtgggcaggggagca

SEQ ID NO: 9403353 - DNA, 22 bp, Homo sapiens
tgcaggtgtgggcaggggagca

SEQ ID NO: 9403354 - DNA, 23 bp, Homo sapiens
tgcaggtgtgcagagggctcttg

SEQ ID NO: 9403355 - DNA, 22 bp, Homo sapiens
tgcaggtgtctctgtctagcgt

SEQ ID NO: 9403356 - DNA, 22 bp, Homo sapiens
tgcaggtgtctctgtctagcgt

SEQ ID NO: 9403357 - DNA, 22 bp, Homo sapiens
tgcaggtgtctgggggcaacag

SEQ ID NO: 9403358 - DNA, 23 bp, Homo sapiens
tgcaggtgtgcagagggctcttg

SEQ ID NO: 9403359 - DNA, 22 bp, Homo sapiens
tgcaggtgtctgggggcaacag

SEQ ID NO: 9403360 - DNA, 22 bp, Homo sapiens
tgcaggtgtctgggggcaacag

SEQ ID NO: 9403361 - DNA, 20 bp, Homo sapiens
tgcaggtgttggagaaggta

SEQ ID NO: 9403362 - DNA, 22 bp, Homo sapiens
tgcaggtgtgtgcaagggaggg

SEQ ID NO: 9403363 - DNA, 22 bp, Homo sapiens
tgcaggtgtgtgcaagggaggg

SEQ ID NO: 9403364 - DNA, 20 bp, Homo sapiens
tgcaggtgtgtccaagcact

SEQ ID NO: 9403365 - DNA, 20 bp, Homo sapiens
tgcaggtgtgtccaagcact

SEQ ID NO: 9403366 - DNA, 22 bp, Homo sapiens
tgcaggtgtggttcctcagcca

SEQ ID NO: 9403367 - DNA, 22 bp, Homo sapiens
tgcaggtgtggttcctcagcca

SEQ ID NO: 9403368 - DNA, 22 bp, Homo sapiens
tgcaggtgtggttcctcagcca

SEQ ID NO: 9403369 - DNA, 22 bp, Homo sapiens
tgcaggggcttgtctgggcctg

SEQ ID NO: 9403370 - DNA, 22 bp, Homo sapiens
tgcaggggcttgtctgggcctg

SEQ ID NO: 9403371 - DNA, 22 bp, Homo sapiens
tgcagggtagacaggtgaggtc

SEQ ID NO: 9403372 - DNA, 22 bp, Homo sapiens
tgcaggggcttgtctgggcctg

SEQ ID NO: 9403373 - DNA, 22 bp, Homo sapiens
tgcaggggcttgtctgggcctg

SEQ ID NO: 9403374 - DNA, 22 bp, Homo sapiens
tgcagggtagatgcaggctgtg

SEQ ID NO: 9403375 - DNA, 22 bp, Homo sapiens
tgcagggtagatgcaggctgtg

SEQ ID NO: 9403376 - DNA, 22 bp, Homo sapiens
tgcagggtatccttgtctctgc

SEQ ID NO: 9403377 - DNA, 22 bp, Homo sapiens
tgcagggtcccgaagggaagac

SEQ ID NO: 9403378 - DNA, 22 bp, Homo sapiens
tgcagggtggtttgaagggtct

SEQ ID NO: 9403379 - DNA, 22 bp, Homo sapiens
tgcagggtggagcggaagcgga

SEQ ID NO: 9403380 - DNA, 22 bp, Homo sapiens
tgcagggtgcacagtggggtgc

SEQ ID NO: 9403381 - DNA, 19 bp, Homo sapiens
tgcagggctgcgcctgggg

SEQ ID NO: 9403382 - DNA, 19 bp, Homo sapiens
tgcagggctgcgcctgggg

SEQ ID NO: 9403383 - DNA, 19 bp, Homo sapiens
tgcagggctgcgcctgggg

SEQ ID NO: 9403384 - DNA, 20 bp, Homo sapiens
tgcagggctgcctcccagct

SEQ ID NO: 9403385 - DNA, 20 bp, Homo sapiens
tgcagggctgcctcccagct

SEQ ID NO: 9403386 - DNA, 20 bp, Homo sapiens
tgcagggctgcctcccagct

SEQ ID NO: 9403387 - DNA, 20 bp, Homo sapiens
tgcagggctctgcttctctc

SEQ ID NO: 9403388 - DNA, 20 bp, Homo sapiens
tgcagggctctgcttctctc

SEQ ID NO: 9403389 - DNA, 20 bp, Homo sapiens
tgcagggctctgcttctctc

SEQ ID NO: 9403390 - DNA, 22 bp, Homo sapiens
tgcagggctcctggctccaatc

SEQ ID NO: 9403391 - DNA, 20 bp, Homo sapiens
tgcagggctctgcttctctc

SEQ ID NO: 9403392 - DNA, 22 bp, Homo sapiens
tgcagggcttcctcttggagtt

SEQ ID NO: 9403393 - DNA, 22 bp, Homo sapiens
tgcagggcttcctcttggagtt

SEQ ID NO: 9403394 - DNA, 22 bp, Homo sapiens
tgcagggcttcctcttggagtt

SEQ ID NO: 9403395 - DNA, 19 bp, Homo sapiens
tgcagggctgcgcctgggg

SEQ ID NO: 9403396 - DNA, 19 bp, Homo sapiens
tgcagggctgcgcctgggg

SEQ ID NO: 9403397 - DNA, 19 bp, Homo sapiens
tgcagggctgcgcctgggg

SEQ ID NO: 9403398 - DNA, 22 bp, Homo sapiens
tgcagggcttcctcttggagtt

SEQ ID NO: 9403399 - DNA, 22 bp, Homo sapiens
tgcagggcttcctcttggagtt

SEQ ID NO: 9403400 - DNA, 22 bp, Homo sapiens
tgcaggtggacacgggagacgg

SEQ ID NO: 9403401 - DNA, 22 bp, Homo sapiens
tgcaggtgcagcgatactgtga

SEQ ID NO: 9403402 - DNA, 22 bp, Homo sapiens
tgcaggtgcagcgatactgtga

SEQ ID NO: 9403403 - DNA, 22 bp, Homo sapiens
tgcaggtggatatctcatcaga

SEQ ID NO: 9403404 - DNA, 22 bp, Homo sapiens
tgcaggtggatatctcatcaga

SEQ ID NO: 9403405 - DNA, 22 bp, Homo sapiens
tgcaggtggatatctcatcaga

SEQ ID NO: 9403406 - DNA, 22 bp, Homo sapiens
tgcaggtggatatctcatcaga

SEQ ID NO: 9403407 - DNA, 22 bp, Homo sapiens
tgcaggtgattctgatgcagtt

SEQ ID NO: 9403408 - DNA, 23 bp, Homo sapiens
tgcaggtgattaatccagtttca

SEQ ID NO: 9403409 - DNA, 23 bp, Homo sapiens
tgcaggtgattaatccagtttca

SEQ ID NO: 9403410 - DNA, 22 bp, Homo sapiens
tgcaggtgattctgatgcagtt

SEQ ID NO: 9403411 - DNA, 22 bp, Homo sapiens
tgcaggtgattctgatgcagtt

SEQ ID NO: 9403412 - DNA, 22 bp, Homo sapiens
tgcaggtggctccagggactgc

SEQ ID NO: 9403413 - DNA, 22 bp, Homo sapiens
tgcaggtggctccagggactgc

SEQ ID NO: 9403414 - DNA, 22 bp, Homo sapiens
tgcaggtggccatcttcgttct

SEQ ID NO: 9403415 - DNA, 22 bp, Homo sapiens
tgcaggtggccatcttcgttct

SEQ ID NO: 9403416 - DNA, 22 bp, Homo sapiens
tgcaggtggctccagggactgc

SEQ ID NO: 9403417 - DNA, 22 bp, Homo sapiens
tgcaggtggctccagggactgc

SEQ ID NO: 9403418 - DNA, 22 bp, Homo sapiens
tgcaggtggcagcggggcacca

SEQ ID NO: 9403419 - DNA, 22 bp, Homo sapiens
tgcaggtggcagcggggcacca

SEQ ID NO: 9403420 - DNA, 22 bp, Homo sapiens
tgcaggtggcagcggggcacca

SEQ ID NO: 9403421 - DNA, 22 bp, Homo sapiens
tgcaggtggattcaatgtggga

SEQ ID NO: 9403422 - DNA, 22 bp, Homo sapiens
tgcaggtggattcaatgtggga

SEQ ID NO: 9403423 - DNA, 22 bp, Homo sapiens
tgcaggtcatgtggcgggactg

SEQ ID NO: 9403424 - DNA, 22 bp, Homo sapiens
tgcaggtctccattggcagact

SEQ ID NO: 9403425 - DNA, 22 bp, Homo sapiens
tgcaggtctatttaaatgattg

SEQ ID NO: 9403426 - DNA, 22 bp, Homo sapiens
tgcaggtcatccctgtgcttct

SEQ ID NO: 9403427 - DNA, 22 bp, Homo sapiens
tgcaggtcatgtggcgggactg

SEQ ID NO: 9403428 - DNA, 22 bp, Homo sapiens
tgcaggtagcaggtacggttgt

SEQ ID NO: 9403429 - DNA, 22 bp, Homo sapiens
tgcaggtcaatcttcaggttcc

SEQ ID NO: 9403430 - DNA, 22 bp, Homo sapiens
tgcaggtacttgacaacttggg

SEQ ID NO: 9403431 - DNA, 22 bp, Homo sapiens
tgcagggtgtccggaggatcac

SEQ ID NO: 9403432 - DNA, 22 bp, Homo sapiens
tgcagggtgtccggaggatcac

SEQ ID NO: 9403433 - DNA, 22 bp, Homo sapiens
tgcaggtctctgcaaggcctat

SEQ ID NO: 9403434 - DNA, 22 bp, Homo sapiens
tgcaggtctctgcaaggcctat

SEQ ID NO: 9403435 - DNA, 22 bp, Homo sapiens
tgcaggtctccattggcagact

SEQ ID NO: 9403436 - DNA, 22 bp, Homo sapiens
tgcaggtgaaaattatgaggat

SEQ ID NO: 9403437 - DNA, 22 bp, Homo sapiens
tgcaggtgaaaattatgaggat

SEQ ID NO: 9403438 - DNA, 22 bp, Homo sapiens
tgcaggtctctgcaaggcctat

SEQ ID NO: 9403439 - DNA, 22 bp, Homo sapiens
tgcaggtgagtgcaggggctca

SEQ ID NO: 9403440 - DNA, 22 bp, Homo sapiens
tgcaggtgagtgcaggggctca

SEQ ID NO: 9403441 - DNA, 22 bp, Homo sapiens
tgcaggtgacaccactcttcct

SEQ ID NO: 9403442 - DNA, 22 bp, Homo sapiens
tgcaggtgagtgcaggggctca

SEQ ID NO: 9403443 - DNA, 22 bp, Homo sapiens
tgcaggtgacaccactcttcct

SEQ ID NO: 9403444 - DNA, 21 bp, Homo sapiens
tgcaggctgtgcgctcctgcc

SEQ ID NO: 9403445 - DNA, 21 bp, Homo sapiens
tgcaggctgtgcgctcctgcc

SEQ ID NO: 9403446 - DNA, 22 bp, Homo sapiens
tgcaggcttggatcacatctcc

SEQ ID NO: 9403447 - DNA, 22 bp, Homo sapiens
tgcaggcttggatcacatctcc

SEQ ID NO: 9403448 - DNA, 22 bp, Homo sapiens
tgcagggaaaacccaggatgct

SEQ ID NO: 9403449 - DNA, 22 bp, Homo sapiens
tgcagggaaaacccaggatgct

SEQ ID NO: 9403450 - DNA, 22 bp, Homo sapiens
tgcagggaacttggacagctag

SEQ ID NO: 9403451 - DNA, 22 bp, Homo sapiens
tgcagggaacttggacagctag

SEQ ID NO: 9403452 - DNA, 22 bp, Homo sapiens
tgcagggaaagggcactgggct

SEQ ID NO: 9403453 - DNA, 22 bp, Homo sapiens
tgcagggaaagtgttggcagca

SEQ ID NO: 9403454 - DNA, 22 bp, Homo sapiens
tgcagggaagtcccagctcctg

SEQ ID NO: 9403455 - DNA, 22 bp, Homo sapiens
tgcagggaagtcccagctcctg

SEQ ID NO: 9403456 - DNA, 22 bp, Homo sapiens
tgcagggaagtcccagctcctg

SEQ ID NO: 9403457 - DNA, 22 bp, Homo sapiens
tgcaggctgccttcacagagcc

SEQ ID NO: 9403458 - DNA, 22 bp, Homo sapiens
tgcaggctgccttcacagagcc

SEQ ID NO: 9403459 - DNA, 22 bp, Homo sapiens
tgcaggctctgtgtgtgcctgg

SEQ ID NO: 9403460 - DNA, 17 bp, Homo sapiens
tgcaggctcctgtccct

SEQ ID NO: 9403461 - DNA, 22 bp, Homo sapiens
tgcagggcatctttgaagtgtg

SEQ ID NO: 9403462 - DNA, 22 bp, Homo sapiens
tgcagggcatagggtccagttt

SEQ ID NO: 9403463 - DNA, 22 bp, Homo sapiens
tgcagggcatagggtccagttt

SEQ ID NO: 9403464 - DNA, 22 bp, Homo sapiens
tgcagggcagtttgtttcggca

SEQ ID NO: 9403465 - DNA, 22 bp, Homo sapiens
tgcagggcatagggtccagttt

SEQ ID NO: 9403466 - DNA, 22 bp, Homo sapiens
tgcagggcatctttgaagtgtg

SEQ ID NO: 9403467 - DNA, 22 bp, Homo sapiens
tgcagggcatctttgaagtgtg

SEQ ID NO: 9403468 - DNA, 22 bp, Homo sapiens
tgcagggccagactgggttgga

SEQ ID NO: 9403469 - DNA, 22 bp, Homo sapiens
tgcagggccagactgggttgga

SEQ ID NO: 9403470 - DNA, 22 bp, Homo sapiens
tgcagggcatctttgaagtgtg

SEQ ID NO: 9403471 - DNA, 22 bp, Homo sapiens
tgcagggcccctctgcatgagt

SEQ ID NO: 9403472 - DNA, 22 bp, Homo sapiens
tgcagggcccctctgcatgagt

SEQ ID NO: 9403473 - DNA, 22 bp, Homo sapiens
tgcagggccatggtggcggctg

SEQ ID NO: 9403474 - DNA, 22 bp, Homo sapiens
tgcagggccatggtggcggctg

SEQ ID NO: 9403475 - DNA, 22 bp, Homo sapiens
tgcagggccatggtggcggctg

SEQ ID NO: 9403476 - DNA, 22 bp, Homo sapiens
tgcagggccatggtggcggctg

SEQ ID NO: 9403477 - DNA, 22 bp, Homo sapiens
tgcagggccatggtggcggctg

SEQ ID NO: 9403478 - DNA, 22 bp, Homo sapiens
tgcagggccatggtggcggctg

SEQ ID NO: 9403479 - DNA, 22 bp, Homo sapiens
tgcagggccatggtggcggctg

SEQ ID NO: 9403480 - DNA, 22 bp, Homo sapiens
tgcagggccagactgggttgga

SEQ ID NO: 9403481 - DNA, 22 bp, Homo sapiens
tgcagggccagactgggttgga

SEQ ID NO: 9403482 - DNA, 22 bp, Homo sapiens
tgcagggctacaggactacaac

SEQ ID NO: 9403483 - DNA, 22 bp, Homo sapiens
tgcagggctacaggactacaac

SEQ ID NO: 9403484 - DNA, 22 bp, Homo sapiens
tgcagggccgctggaggtcatg

SEQ ID NO: 9403485 - DNA, 22 bp, Homo sapiens
tgcagggccgctggaggtcatg

SEQ ID NO: 9403486 - DNA, 22 bp, Homo sapiens
tgcagggccgctggaggtcatg

SEQ ID NO: 9403487 - DNA, 22 bp, Homo sapiens
tgcagggctcctggctccaatc

SEQ ID NO: 9403488 - DNA, 22 bp, Homo sapiens
tgcagggctcctggctccaatc

SEQ ID NO: 9403489 - DNA, 22 bp, Homo sapiens
tgcagggctcctggctccaatc

SEQ ID NO: 9403490 - DNA, 22 bp, Homo sapiens
tgcagggctataactccattct

SEQ ID NO: 9403491 - DNA, 22 bp, Homo sapiens
tgcagggctacaggactacaac

SEQ ID NO: 9403492 - DNA, 22 bp, Homo sapiens
tgcagggctataactccattct

SEQ ID NO: 9403493 - DNA, 22 bp, Homo sapiens
tgcagggcccctctgcatgagt

SEQ ID NO: 9403494 - DNA, 22 bp, Homo sapiens
tgcagggcccctctgcatgagt

SEQ ID NO: 9403495 - DNA, 22 bp, Homo sapiens
tgcagggccctcattcctgtcc

SEQ ID NO: 9403496 - DNA, 22 bp, Homo sapiens
tgcagggccctcattcctgtcc

SEQ ID NO: 9403497 - DNA, 22 bp, Homo sapiens
tgcagggcccttggggttgaac

SEQ ID NO: 9403498 - DNA, 22 bp, Homo sapiens
tgcagggcccttggggttgaac

SEQ ID NO: 9403499 - DNA, 22 bp, Homo sapiens
tgcagggcccttggggttgaac

SEQ ID NO: 9403500 - DNA, 22 bp, Homo sapiens
tgcagggcccttggggttgaac

SEQ ID NO: 9403501 - DNA, 22 bp, Homo sapiens
tgcagggccgctggaggtcatg

SEQ ID NO: 9403502 - DNA, 22 bp, Homo sapiens
tgcagggcagtggaggttgagt

SEQ ID NO: 9403503 - DNA, 22 bp, Homo sapiens
tgcagggcagtttgtttcggca

SEQ ID NO: 9403504 - DNA, 22 bp, Homo sapiens
tgcagggcagtggaggttgagt

SEQ ID NO: 9403505 - DNA, 22 bp, Homo sapiens
tgcagggcagtggaggttgagt

SEQ ID NO: 9403506 - DNA, 22 bp, Homo sapiens
tgcagggcagctagggagcttt

SEQ ID NO: 9403507 - DNA, 22 bp, Homo sapiens
tgcagggcagctagggagcttt

SEQ ID NO: 9403508 - DNA, 22 bp, Homo sapiens
tgcagggcagatatgactgtag

SEQ ID NO: 9403509 - DNA, 22 bp, Homo sapiens
tgcagggcagctagggagcttt

SEQ ID NO: 9403510 - DNA, 22 bp, Homo sapiens
tgcagggcagctagggagcttt

SEQ ID NO: 9403511 - DNA, 22 bp, Homo sapiens
tgcagggcagatatgactgtag

SEQ ID NO: 9403512 - DNA, 22 bp, Homo sapiens
tgcagggcagatatgactgtag

SEQ ID NO: 9403513 - DNA, 22 bp, Homo sapiens
tgcagggcagatatgactgtag

SEQ ID NO: 9403514 - DNA, 22 bp, Homo sapiens
tgcagggcacggtgcgcgtggg

SEQ ID NO: 9403515 - DNA, 22 bp, Homo sapiens
tgcagggcacacgcacgggtgt

SEQ ID NO: 9403516 - DNA, 22 bp, Homo sapiens
tgcagggcacacgcacgggtgt

SEQ ID NO: 9403517 - DNA, 22 bp, Homo sapiens
tgcagggcacggtgcgcgtggg

SEQ ID NO: 9403518 - DNA, 22 bp, Homo sapiens
tgcagggcacggtgcgcgtggg

SEQ ID NO: 9403519 - DNA, 22 bp, Homo sapiens
tgcagggcacggtgcgcgtggg

SEQ ID NO: 9403520 - DNA, 22 bp, Homo sapiens
tgcagggcacacgcacgggtgt

SEQ ID NO: 9403521 - DNA, 22 bp, Homo sapiens
tgcagggcacacgcacgggtgt

SEQ ID NO: 9403522 - DNA, 22 bp, Homo sapiens
tgcagggcacacgcacgggtgt

SEQ ID NO: 9403523 - DNA, 23 bp, Homo sapiens
tgcagggcaagttagagacccca

SEQ ID NO: 9403524 - DNA, 23 bp, Homo sapiens
tgcagggcaagttagagacccca

SEQ ID NO: 9403525 - DNA, 22 bp, Homo sapiens
tgcagggattatgtaggggttg

SEQ ID NO: 9403526 - DNA, 22 bp, Homo sapiens
tgcagggattgttggcatccat

SEQ ID NO: 9403527 - DNA, 22 bp, Homo sapiens
tgcagggattgttggcatccat

SEQ ID NO: 9403528 - DNA, 22 bp, Homo sapiens
tgcagggattagaggccgggga

SEQ ID NO: 9403529 - DNA, 23 bp, Homo sapiens
tgccagggccctgtgtgcaatgc

SEQ ID NO: 9403530 - DNA, 22 bp, Homo sapiens
tgccaggggacctagggatgtc

SEQ ID NO: 9403531 - DNA, 22 bp, Homo sapiens
tgccagggccatagggagtcta

SEQ ID NO: 9403532 - DNA, 22 bp, Homo sapiens
tgccagggccatagggagtcta

SEQ ID NO: 9403533 - DNA, 22 bp, Homo sapiens
tgccagggtgtcaggagagcta

SEQ ID NO: 9403534 - DNA, 22 bp, Homo sapiens
tgccagggtcagctgcagctct

SEQ ID NO: 9403535 - DNA, 22 bp, Homo sapiens
tgccatctcttcctcgtgctgc

SEQ ID NO: 9403536 - DNA, 22 bp, Homo sapiens
tgccatcctgtgtcatgctcat

SEQ ID NO: 9403537 - DNA, 22 bp, Homo sapiens
tgccatcctgtgtcatgctcat

SEQ ID NO: 9403538 - DNA, 22 bp, Homo sapiens
tgccatcactgaacttctgaaa

SEQ ID NO: 9403539 - DNA, 22 bp, Homo sapiens
tgccaggtacacaagtagccag

SEQ ID NO: 9403540 - DNA, 22 bp, Homo sapiens
tgccaggtacacaagtagccag

SEQ ID NO: 9403541 - DNA, 22 bp, Homo sapiens
tgccagggtgtcaggagagcta

SEQ ID NO: 9403542 - DNA, 22 bp, Homo sapiens
tgccagggtgtcaggagagcta

SEQ ID NO: 9403543 - DNA, 20 bp, Homo sapiens
tgccagggccagcagaggct

SEQ ID NO: 9403544 - DNA, 20 bp, Homo sapiens
tgccagggccagcagaggct

SEQ ID NO: 9403545 - DNA, 20 bp, Homo sapiens
tgccagggccagcagaggct

SEQ ID NO: 9403546 - DNA, 22 bp, Homo sapiens
tgccagggagccctgctgacca

SEQ ID NO: 9403547 - DNA, 22 bp, Homo sapiens
tgccaggctttggtcaaaggct

SEQ ID NO: 9403548 - DNA, 22 bp, Homo sapiens
tgccaggctttggtcaaaggct

SEQ ID NO: 9403549 - DNA, 22 bp, Homo sapiens
tgccaggctttggtcaaaggct

SEQ ID NO: 9403550 - DNA, 22 bp, Homo sapiens
tgccaggcttagagcaggggct

SEQ ID NO: 9403551 - DNA, 22 bp, Homo sapiens
tgccaggcttagagcaggggct

SEQ ID NO: 9403552 - DNA, 22 bp, Homo sapiens
tgccaggcttagagcaggggct

SEQ ID NO: 9403553 - DNA, 22 bp, Homo sapiens
tgccaggcttagagcaggggct

SEQ ID NO: 9403554 - DNA, 22 bp, Homo sapiens
tgccaggctgccctccagtctg

SEQ ID NO: 9403555 - DNA, 22 bp, Homo sapiens
tgccaggctgtcaattcaccca

SEQ ID NO: 9403556 - DNA, 22 bp, Homo sapiens
tgccaggctgccctccagtctg

SEQ ID NO: 9403557 - DNA, 22 bp, Homo sapiens
tgccaggctgccctccagtctg

SEQ ID NO: 9403558 - DNA, 22 bp, Homo sapiens
tgccaggctgtcctgggcctgg

SEQ ID NO: 9403559 - DNA, 22 bp, Homo sapiens
tgccaggctgtcctgggcctgg

SEQ ID NO: 9403560 - DNA, 22 bp, Homo sapiens
tgccaggctgtcaattcaccca

SEQ ID NO: 9403561 - DNA, 22 bp, Homo sapiens
tgccaggctgtcctgggcctgg

SEQ ID NO: 9403562 - DNA, 22 bp, Homo sapiens
tgccaggctgaacagggtctta

SEQ ID NO: 9403563 - DNA, 22 bp, Homo sapiens
tgccaggctgaacagggtctta

SEQ ID NO: 9403564 - DNA, 22 bp, Homo sapiens
tgccaggctgaacagggtctta

SEQ ID NO: 9403565 - DNA, 20 bp, Homo sapiens
tgccaggctgcacgcctgcc

SEQ ID NO: 9403566 - DNA, 20 bp, Homo sapiens
tgccaggctgcacgcctgcc

SEQ ID NO: 9403567 - DNA, 20 bp, Homo sapiens
tgccaggctgcacgcctgcc

SEQ ID NO: 9403568 - DNA, 22 bp, Homo sapiens
tgccaggctccggaacgacagt

SEQ ID NO: 9403569 - DNA, 22 bp, Homo sapiens
tgccaggctccggaacgacagt

SEQ ID NO: 9403570 - DNA, 22 bp, Homo sapiens
tgccaggctcaggatgtccctg

SEQ ID NO: 9403571 - DNA, 22 bp, Homo sapiens
tgccaggctccggaacgacagt

SEQ ID NO: 9403572 - DNA, 22 bp, Homo sapiens
tgccaggcaactgcccagccat

SEQ ID NO: 9403573 - DNA, 22 bp, Homo sapiens
tgccaggcaactgcccagccat

SEQ ID NO: 9403574 - DNA, 22 bp, Homo sapiens
tgccaggcaactgcccagccat

SEQ ID NO: 9403575 - DNA, 20 bp, Homo sapiens
tgccaggcacggagtgcatg

SEQ ID NO: 9403576 - DNA, 20 bp, Homo sapiens
tgccaggcacggagtgcatg

SEQ ID NO: 9403577 - DNA, 22 bp, Homo sapiens
tgccaggatggccagggggcca

SEQ ID NO: 9403578 - DNA, 19 bp, Homo sapiens
tgccagctcacaggagctc

SEQ ID NO: 9403579 - DNA, 22 bp, Homo sapiens
tgccagcctggcctgagtcttt

SEQ ID NO: 9403580 - DNA, 22 bp, Homo sapiens
tgccagcctggcctgagtcttt

SEQ ID NO: 9403581 - DNA, 18 bp, Homo sapiens
tgccagccgactggcctg

SEQ ID NO: 9403582 - DNA, 17 bp, Homo sapiens
tgccagcctgtcccagg

SEQ ID NO: 9403583 - DNA, 19 bp, Homo sapiens
tgccagctcacaggagctc

SEQ ID NO: 9403584 - DNA, 22 bp, Homo sapiens
tgccaggcatgtagtagacttg

SEQ ID NO: 9403585 - DNA, 22 bp, Homo sapiens
tgccaggcatatggcctctttg

SEQ ID NO: 9403586 - DNA, 22 bp, Homo sapiens
tgccaggcatgtagtagacttg

SEQ ID NO: 9403587 - DNA, 22 bp, Homo sapiens
tgccaggcatgtagtagacttg

SEQ ID NO: 9403588 - DNA, 22 bp, Homo sapiens
tgccaggcatatggcctctttg

SEQ ID NO: 9403589 - DNA, 22 bp, Homo sapiens
tgccaggcatatggcctctttg

SEQ ID NO: 9403590 - DNA, 22 bp, Homo sapiens
tgccaggcagtgtcagattgag

SEQ ID NO: 9403591 - DNA, 22 bp, Homo sapiens
tgccaggcagtgtcagattgag

SEQ ID NO: 9403592 - DNA, 22 bp, Homo sapiens
tgccaggcagtgtcagattgag

SEQ ID NO: 9403593 - DNA, 22 bp, Homo sapiens
tgccaggcaggaccctagaacc

SEQ ID NO: 9403594 - DNA, 22 bp, Homo sapiens
tgccaggcaggaccctagaacc

SEQ ID NO: 9403595 - DNA, 22 bp, Homo sapiens
tgccaggcaggaccctagaacc

SEQ ID NO: 9403596 - DNA, 22 bp, Homo sapiens
tgccaggcacgtgagagtggcc

SEQ ID NO: 9403597 - DNA, 22 bp, Homo sapiens
tgccaggcacgtgagagtggcc

SEQ ID NO: 9403598 - DNA, 22 bp, Homo sapiens
tgccaggcacgtgagagtggcc

SEQ ID NO: 9403599 - DNA, 20 bp, Homo sapiens
tgccaggcacggagtgcatg

SEQ ID NO: 9403600 - DNA, 22 bp, Homo sapiens
tgccaggcccagctccagagct

SEQ ID NO: 9403601 - DNA, 22 bp, Homo sapiens
tgccaggcccagctccagagct

SEQ ID NO: 9403602 - DNA, 22 bp, Homo sapiens
tgccaggcccagctccagagct

SEQ ID NO: 9403603 - DNA, 22 bp, Homo sapiens
tgccaggcccagcagggcggcc

SEQ ID NO: 9403604 - DNA, 22 bp, Homo sapiens
tgccaggcccagcagggcggcc

SEQ ID NO: 9403605 - DNA, 22 bp, Homo sapiens
tgccaggccacgtagcttcaag

SEQ ID NO: 9403606 - DNA, 22 bp, Homo sapiens
tgccaggccacgtagcttcaag

SEQ ID NO: 9403607 - DNA, 22 bp, Homo sapiens
tgccaggccacgtagcttcaag

SEQ ID NO: 9403608 - DNA, 22 bp, Homo sapiens
tgccaggcccagcagggcggcc

SEQ ID NO: 9403609 - DNA, 22 bp, Homo sapiens
tgccaggcccagcagggcggcc

SEQ ID NO: 9403610 - DNA, 22 bp, Homo sapiens
tgccaggcatttgacagacact

SEQ ID NO: 9403611 - DNA, 22 bp, Homo sapiens
tgccaggcatttgacagacact

SEQ ID NO: 9403612 - DNA, 22 bp, Homo sapiens
tgccaggcatttgacagacact

SEQ ID NO: 9403613 - DNA, 22 bp, Homo sapiens
tgccaggccaatgaaggcaggg

SEQ ID NO: 9403614 - DNA, 22 bp, Homo sapiens
tgccaggccaattctatttgac

SEQ ID NO: 9403615 - DNA, 22 bp, Homo sapiens
tgccaggccaatgaaggcaggg

SEQ ID NO: 9403616 - DNA, 22 bp, Homo sapiens
tgccaggccaatgaaggcaggg

SEQ ID NO: 9403617 - DNA, 22 bp, Homo sapiens
tgccaggccctgtgctggatgc

SEQ ID NO: 9403618 - DNA, 22 bp, Homo sapiens
tgccaggctcaggatgtccctg

SEQ ID NO: 9403619 - DNA, 22 bp, Homo sapiens
tgccaggctcaggatgtccctg

SEQ ID NO: 9403620 - DNA, 22 bp, Homo sapiens
tgccaggctcagcccctatctt

SEQ ID NO: 9403621 - DNA, 22 bp, Homo sapiens
tgccaggctcagcccctatctt

SEQ ID NO: 9403622 - DNA, 22 bp, Homo sapiens
tgccaggctcagcccctatctt

SEQ ID NO: 9403623 - DNA, 22 bp, Homo sapiens
tgccaggccctgcggggtccca

SEQ ID NO: 9403624 - DNA, 22 bp, Homo sapiens
tgccaggccctgtgctggatgc

SEQ ID NO: 9403625 - DNA, 22 bp, Homo sapiens
tgccaggccctgcggggtccca

SEQ ID NO: 9403626 - DNA, 22 bp, Homo sapiens
tgccaggccctgcggggtccca

SEQ ID NO: 9403627 - DNA, 22 bp, Homo sapiens
tgccaggccctcccacagatta

SEQ ID NO: 9403628 - DNA, 22 bp, Homo sapiens
tgccaggccctcccacagatta

SEQ ID NO: 9403629 - DNA, 22 bp, Homo sapiens
tgccaggccctcccacagatta

SEQ ID NO: 9403630 - DNA, 22 bp, Homo sapiens
tgcccaggatctggcgatgctc

SEQ ID NO: 9403631 - DNA, 22 bp, Homo sapiens
tgcccagcagggagctacctgg

SEQ ID NO: 9403632 - DNA, 22 bp, Homo sapiens
tgcccagcactgtgccagtcac

SEQ ID NO: 9403633 - DNA, 22 bp, Homo sapiens
tgcccagcaataaaccagaaga

SEQ ID NO: 9403634 - DNA, 22 bp, Homo sapiens
tgcccagcaataaaccagaaga

SEQ ID NO: 9403635 - DNA, 22 bp, Homo sapiens
tgcccagcaataaaccagaaga

SEQ ID NO: 9403636 - DNA, 22 bp, Homo sapiens
tgcccagcactgtgccagtcac

SEQ ID NO: 9403637 - DNA, 22 bp, Homo sapiens
tgcccagaatagatgggctgtg

SEQ ID NO: 9403638 - DNA, 22 bp, Homo sapiens
tgcccagaatagatgggctgtg

SEQ ID NO: 9403639 - DNA, 22 bp, Homo sapiens
tgcccagagcctcttacctcca

SEQ ID NO: 9403640 - DNA, 18 bp, Homo sapiens
tgcccagaaaagcaggga

SEQ ID NO: 9403641 - DNA, 20 bp, Homo sapiens
tgcccagcaagagtgcagtt

SEQ ID NO: 9403642 - DNA, 22 bp, Homo sapiens
tgcccagagcctgagaggatta

SEQ ID NO: 9403643 - DNA, 19 bp, Homo sapiens
tgcccagagtgtatgcgca

SEQ ID NO: 9403644 - DNA, 22 bp, Homo sapiens
tgcccacattctgaagctccct

SEQ ID NO: 9403645 - DNA, 22 bp, Homo sapiens
tgcccacatggtgccatggcca

SEQ ID NO: 9403646 - DNA, 22 bp, Homo sapiens
tgcccacatggtgccatggcca

SEQ ID NO: 9403647 - DNA, 22 bp, Homo sapiens
tgcccacatggtgccatggcca

SEQ ID NO: 9403648 - DNA, 20 bp, Homo sapiens
tgcccacaattcacaatgcc

SEQ ID NO: 9403649 - DNA, 23 bp, Homo sapiens
tgcccacaaaagtaaagacattt

SEQ ID NO: 9403650 - DNA, 20 bp, Homo sapiens
tgcccacatcactcaggagt

SEQ ID NO: 9403651 - DNA, 22 bp, Homo sapiens
tgcccacagctcagggctgctc

SEQ ID NO: 9403652 - DNA, 21 bp, Homo sapiens
tgcccacagcaaatgcagagg

SEQ ID NO: 9403653 - DNA, 22 bp, Homo sapiens
tgcccacagatatgtgcagtct

SEQ ID NO: 9403654 - DNA, 22 bp, Homo sapiens
tgccatttctcacatatgtatg

SEQ ID NO: 9403655 - DNA, 23 bp, Homo sapiens
tgccattttccatctcatgcaga

SEQ ID NO: 9403656 - DNA, 22 bp, Homo sapiens
tgccatttgtaactatcattct

SEQ ID NO: 9403657 - DNA, 22 bp, Homo sapiens
tgccatttgctggttttctgat

SEQ ID NO: 9403658 - DNA, 22 bp, Homo sapiens
tgccccaggtgctgaggttgga

SEQ ID NO: 9403659 - DNA, 23 bp, Homo sapiens
tgcccattgcatcttggtactgg

SEQ ID NO: 9403660 - DNA, 22 bp, Homo sapiens
tgcccattattcagccattaaa

SEQ ID NO: 9403661 - DNA, 23 bp, Homo sapiens
tgcccagtgggtgcagggggtat

SEQ ID NO: 9403662 - DNA, 22 bp, Homo sapiens
tgcccatgtttctctgtatccc

SEQ ID NO: 9403663 - DNA, 22 bp, Homo sapiens
tgcccagtctccgggccagccc

SEQ ID NO: 9403664 - DNA, 22 bp, Homo sapiens
tgcccaggtttgagtgcccaag

SEQ ID NO: 9403665 - DNA, 22 bp, Homo sapiens
tgcccagggtggagtgcagtgg

SEQ ID NO: 9403666 - DNA, 22 bp, Homo sapiens
tgcccagggtggagtgcagtgg

SEQ ID NO: 9403667 - DNA, 22 bp, Homo sapiens
tgcccagggtttctaagagcag

SEQ ID NO: 9403668 - DNA, 22 bp, Homo sapiens
tgcccagggtttctaagagcag

SEQ ID NO: 9403669 - DNA, 22 bp, Homo sapiens
tgcccagggtttctaagagcag

SEQ ID NO: 9403670 - DNA, 22 bp, Homo sapiens
tgcccaggtttgagtgcccaag

SEQ ID NO: 9403671 - DNA, 22 bp, Homo sapiens
tgcccaggctggaatgcagtgg

SEQ ID NO: 9403672 - DNA, 22 bp, Homo sapiens
tgcccaggctcctcgcagcctt

SEQ ID NO: 9403673 - DNA, 22 bp, Homo sapiens
tgcccaggctcctcgcagcctt

SEQ ID NO: 9403674 - DNA, 22 bp, Homo sapiens
tgcccaggattgtgaggtcagg

SEQ ID NO: 9403675 - DNA, 19 bp, Homo sapiens
tgcccaggccaggttgggc

SEQ ID NO: 9403676 - DNA, 22 bp, Homo sapiens
tgcccaggctggagtgcagtgg

SEQ ID NO: 9403677 - DNA, 22 bp, Homo sapiens
tgcccaggctggagtgcagtgg

SEQ ID NO: 9403678 - DNA, 22 bp, Homo sapiens
tgcccaggcttcaccctcagag

SEQ ID NO: 9403679 - DNA, 22 bp, Homo sapiens
tgcccaggcttcaccctcagag

SEQ ID NO: 9403680 - DNA, 22 bp, Homo sapiens
tgcccaggctggagtgcagagg

SEQ ID NO: 9403681 - DNA, 22 bp, Homo sapiens
tgcccaggctggagtgcagagg

SEQ ID NO: 9403682 - DNA, 22 bp, Homo sapiens
tgcccaggctggagtgcagagg

SEQ ID NO: 9403683 - DNA, 22 bp, Homo sapiens
tgcccagggataagcctagaga

SEQ ID NO: 9403684 - DNA, 22 bp, Homo sapiens
tgcccagggataagcctagaga

SEQ ID NO: 9403685 - DNA, 22 bp, Homo sapiens
tgcccagggataagcctagaga

SEQ ID NO: 9403686 - DNA, 22 bp, Homo sapiens
tgcccagggtggagtgcagcgg

SEQ ID NO: 9403687 - DNA, 21 bp, Homo sapiens
tgcccaggggccaaccgctgc

SEQ ID NO: 9403688 - DNA, 22 bp, Homo sapiens
tgcccagggtggagtgcagcgg

SEQ ID NO: 9403689 - DNA, 22 bp, Homo sapiens
tgcccagggtggagtgcagcgg

SEQ ID NO: 9403690 - DNA, 22 bp, Homo sapiens
tgccctgcccttgctatttcta

SEQ ID NO: 9403691 - DNA, 22 bp, Homo sapiens
tgccctgcctgagagacagtaa

SEQ ID NO: 9403692 - DNA, 22 bp, Homo sapiens
tgccctgcggctatctagatga

SEQ ID NO: 9403693 - DNA, 22 bp, Homo sapiens
tgccctgcggctatctagatga

SEQ ID NO: 9403694 - DNA, 22 bp, Homo sapiens
tgccctgcctgagagacagtaa

SEQ ID NO: 9403695 - DNA, 22 bp, Homo sapiens
tgccctgctgtgcctggagcca

SEQ ID NO: 9403696 - DNA, 22 bp, Homo sapiens
tgccctgctaaccttggttcca

SEQ ID NO: 9403697 - DNA, 22 bp, Homo sapiens
tgccctgctgtgcctggagcca

SEQ ID NO: 9403698 - DNA, 22 bp, Homo sapiens
tgccctgctaaatataggtagc

SEQ ID NO: 9403699 - DNA, 22 bp, Homo sapiens
tgccctgccaagactcagtggt

SEQ ID NO: 9403700 - DNA, 22 bp, Homo sapiens
tgccctgccaagactcagtggt

SEQ ID NO: 9403701 - DNA, 22 bp, Homo sapiens
tgccctgcatgcagggagctgt

SEQ ID NO: 9403702 - DNA, 22 bp, Homo sapiens
tgccctgccaagaccaagtggt

SEQ ID NO: 9403703 - DNA, 22 bp, Homo sapiens
tgccctgcccatctaccctgtc

SEQ ID NO: 9403704 - DNA, 22 bp, Homo sapiens
tgccctgccaagactgagtggt

SEQ ID NO: 9403705 - DNA, 22 bp, Homo sapiens
tgccctgccaagactgagtggt

SEQ ID NO: 9403706 - DNA, 22 bp, Homo sapiens
tgccctgcccatctaccctgtc

SEQ ID NO: 9403707 - DNA, 19 bp, Homo sapiens
tgccctgcccgcagccttg

SEQ ID NO: 9403708 - DNA, 19 bp, Homo sapiens
tgccctgcccgcagccttg

SEQ ID NO: 9403709 - DNA, 21 bp, Homo sapiens
tgcccctttatgggctcccta

SEQ ID NO: 9403710 - DNA, 22 bp, Homo sapiens
tgcccctctcctgtgatccaag

SEQ ID NO: 9403711 - DNA, 22 bp, Homo sapiens
tgccctgcagtgagtgcgtctg

SEQ ID NO: 9403712 - DNA, 22 bp, Homo sapiens
tgccctgcagaccctgcagtgt

SEQ ID NO: 9403713 - DNA, 22 bp, Homo sapiens
tgccctgcagaccctgcagtgt

SEQ ID NO: 9403714 - DNA, 22 bp, Homo sapiens
tgccctcagaattgctccctgc

SEQ ID NO: 9403715 - DNA, 22 bp, Homo sapiens
tgccctggaggggcttacagtc

SEQ ID NO: 9403716 - DNA, 22 bp, Homo sapiens
tgccctggaggggcttacagtc

SEQ ID NO: 9403717 - DNA, 22 bp, Homo sapiens
tgccctggaggggcttacagtc

SEQ ID NO: 9403718 - DNA, 22 bp, Homo sapiens
tgccctggagtcagtggctatt

SEQ ID NO: 9403719 - DNA, 22 bp, Homo sapiens
tgccctggaaccatctacagtc

SEQ ID NO: 9403720 - DNA, 22 bp, Homo sapiens
tgccctgctgtggctctgccca

SEQ ID NO: 9403721 - DNA, 22 bp, Homo sapiens
tgccctgcttctcttgggacag

SEQ ID NO: 9403722 - DNA, 22 bp, Homo sapiens
tgccctgctgtggctctgccca

SEQ ID NO: 9403723 - DNA, 22 bp, Homo sapiens
tgccctgctgtggctctgccca

SEQ ID NO: 9403724 - DNA, 22 bp, Homo sapiens
tgccctgctgtggctctgccca

SEQ ID NO: 9403725 - DNA, 22 bp, Homo sapiens
tgccctggaaccatctacagtc

SEQ ID NO: 9403726 - DNA, 22 bp, Homo sapiens
tgccctggaaatgagaggtgtg

SEQ ID NO: 9403727 - DNA, 22 bp, Homo sapiens
tgccctgcttggtttattttca

SEQ ID NO: 9403728 - DNA, 22 bp, Homo sapiens
tgccctggatgctgcaggtgtg

SEQ ID NO: 9403729 - DNA, 22 bp, Homo sapiens
tgccctggcacacacacagctg

SEQ ID NO: 9403730 - DNA, 22 bp, Homo sapiens
tgccctggctcctcccacgctg

SEQ ID NO: 9403731 - DNA, 22 bp, Homo sapiens
tgccctggctcctcccacgctg

SEQ ID NO: 9403732 - DNA, 22 bp, Homo sapiens
tgccctggctcctcccacgctg

SEQ ID NO: 9403733 - DNA, 22 bp, Homo sapiens
tgccctggcgctgtctctatgg

SEQ ID NO: 9403734 - DNA, 22 bp, Homo sapiens
tgccctggctcttcttgttcca

SEQ ID NO: 9403735 - DNA, 22 bp, Homo sapiens
tgcctaggctggagtgtagtgg

SEQ ID NO: 9403736 - DNA, 22 bp, Homo sapiens
tgcctagaactttattctttat

SEQ ID NO: 9403737 - DNA, 22 bp, Homo sapiens
tgcctcaagccctccactgcac

SEQ ID NO: 9403738 - DNA, 22 bp, Homo sapiens
tgcctcaagccctccactgcac

SEQ ID NO: 9403739 - DNA, 22 bp, Homo sapiens
tgccgcagtgcggggagggccc

SEQ ID NO: 9403740 - DNA, 22 bp, Homo sapiens
tgccgcctggtttctccgcccc

SEQ ID NO: 9403741 - DNA, 22 bp, Homo sapiens
tgccgcagtgcggggagggccc

SEQ ID NO: 9403742 - DNA, 22 bp, Homo sapiens
tgccgcagtgcggggagggccc

SEQ ID NO: 9403743 - DNA, 22 bp, Homo sapiens
tgccgcgcgcccaggttaggtg

SEQ ID NO: 9403744 - DNA, 22 bp, Homo sapiens
tgccgcgcccgccaggtgtgtc

SEQ ID NO: 9403745 - DNA, 22 bp, Homo sapiens
tgccgctccaggtctcgcggtg

SEQ ID NO: 9403746 - DNA, 20 bp, Homo sapiens
tgccgggcagcctgaggagt

SEQ ID NO: 9403747 - DNA, 22 bp, Homo sapiens
tgcctaccagtgttctcccttc

SEQ ID NO: 9403748 - DNA, 22 bp, Homo sapiens
tgcctactagtactattttgtg

SEQ ID NO: 9403749 - DNA, 22 bp, Homo sapiens
tgcctaactccaccaggcaggt

SEQ ID NO: 9403750 - DNA, 22 bp, Homo sapiens
tgcctaaacagtccccaaatta

SEQ ID NO: 9403751 - DNA, 22 bp, Homo sapiens
tgcccttgggtaacttgctgat

SEQ ID NO: 9403752 - DNA, 22 bp, Homo sapiens
tgccgcaagtactgctgcctgt

SEQ ID NO: 9403753 - DNA, 22 bp, Homo sapiens
tgccctgtgccagacttcctgg

SEQ ID NO: 9403754 - DNA, 22 bp, Homo sapiens
tgccctgtcgctcactcccacc

SEQ ID NO: 9403755 - DNA, 22 bp, Homo sapiens
tgccctgtctaagctgtcagta

SEQ ID NO: 9403756 - DNA, 22 bp, Homo sapiens
tgccctgggaacacagatgcca

SEQ ID NO: 9403757 - DNA, 22 bp, Homo sapiens
tgccctgggaacacagatgcca

SEQ ID NO: 9403758 - DNA, 22 bp, Homo sapiens
tgccctgggaacacagatgcca

SEQ ID NO: 9403759 - DNA, 22 bp, Homo sapiens
tgccctgggaacacagatgcca

SEQ ID NO: 9403760 - DNA, 22 bp, Homo sapiens
tgcctgatgcaggagtatcaga

SEQ ID NO: 9403761 - DNA, 22 bp, Homo sapiens
tgcctgatgcaggagtatcaga

SEQ ID NO: 9403762 - DNA, 22 bp, Homo sapiens
tgcctgccacgcttgctaccac

SEQ ID NO: 9403763 - DNA, 22 bp, Homo sapiens
tgcctgcccacgactacagcag

SEQ ID NO: 9403764 - DNA, 22 bp, Homo sapiens
tgcctgctttctgggctgccat

SEQ ID NO: 9403765 - DNA, 22 bp, Homo sapiens
tgcctgctttctcctcaactca

SEQ ID NO: 9403766 - DNA, 22 bp, Homo sapiens
tgcctgctttctcctcaactca

SEQ ID NO: 9403767 - DNA, 18 bp, Homo sapiens
tgcctggaaggaacagga

SEQ ID NO: 9403768 - DNA, 18 bp, Homo sapiens
tgcctggaaggaacagga

SEQ ID NO: 9403769 - DNA, 22 bp, Homo sapiens
tgcctggaaggcccatgggaag

SEQ ID NO: 9403770 - DNA, 22 bp, Homo sapiens
tgcctggagaaggcaccatctg

SEQ ID NO: 9403771 - DNA, 23 bp, Homo sapiens
tgcctggagaagcatgaaatgta

SEQ ID NO: 9403772 - DNA, 23 bp, Homo sapiens
tgcctggagaagcatgaaatgta

SEQ ID NO: 9403773 - DNA, 22 bp, Homo sapiens
tgcctggaccccacctccggaa

SEQ ID NO: 9403774 - DNA, 22 bp, Homo sapiens
tgcctggaccccacctccggaa

SEQ ID NO: 9403775 - DNA, 19 bp, Homo sapiens
tgcctggacaaatgtgggg

SEQ ID NO: 9403776 - DNA, 22 bp, Homo sapiens
tgcctggaaggcccatgggaag

SEQ ID NO: 9403777 - DNA, 19 bp, Homo sapiens
tgcctggacaaatgtgggg

SEQ ID NO: 9403778 - DNA, 22 bp, Homo sapiens
tgcctgctgcctttcatcccaa

SEQ ID NO: 9403779 - DNA, 22 bp, Homo sapiens
tgcctgcttgtttacctactcc

SEQ ID NO: 9403780 - DNA, 19 bp, Homo sapiens
tgcctgctgtattccagag

SEQ ID NO: 9403781 - DNA, 20 bp, Homo sapiens
tgcctgcccaggtcctgcac

SEQ ID NO: 9403782 - DNA, 22 bp, Homo sapiens
tgcctggcaagaggggctggct

SEQ ID NO: 9403783 - DNA, 22 bp, Homo sapiens
tgcctggcaagaggggctggct

SEQ ID NO: 9403784 - DNA, 22 bp, Homo sapiens
tgcctggcaagaggggctggct

SEQ ID NO: 9403785 - DNA, 22 bp, Homo sapiens
tgcctggattcggttgttgtca

SEQ ID NO: 9403786 - DNA, 22 bp, Homo sapiens
tgcctggattcggttgttgtca

SEQ ID NO: 9403787 - DNA, 22 bp, Homo sapiens
tgcctggattcaaagctcatgt

SEQ ID NO: 9403788 - DNA, 22 bp, Homo sapiens
tgcctggatgtgctggcctcac

SEQ ID NO: 9403789 - DNA, 22 bp, Homo sapiens
tgcctggattcaaagctcatgt

SEQ ID NO: 9403790 - DNA, 22 bp, Homo sapiens
tgcctggatgtgctggcctcac

SEQ ID NO: 9403791 - DNA, 22 bp, Homo sapiens
tgcctggatctgaggacccatt

SEQ ID NO: 9403792 - DNA, 22 bp, Homo sapiens
tgcctggatggctctgagcagg

SEQ ID NO: 9403793 - DNA, 22 bp, Homo sapiens
tgcctggatggctctgagcagg

SEQ ID NO: 9403794 - DNA, 22 bp, Homo sapiens
tgcctggagtgtgttcaggatt

SEQ ID NO: 9403795 - DNA, 22 bp, Homo sapiens
tgcctggagtccccaagtccat

SEQ ID NO: 9403796 - DNA, 22 bp, Homo sapiens
tgcctggatctgaggacccatt

SEQ ID NO: 9403797 - DNA, 22 bp, Homo sapiens
tgcctggatactcattaatttc

SEQ ID NO: 9403798 - DNA, 19 bp, Homo sapiens
tgcctggagcataacaggc

SEQ ID NO: 9403799 - DNA, 22 bp, Homo sapiens
tgcctggagaaggcaccatctg

SEQ ID NO: 9403800 - DNA, 22 bp, Homo sapiens
tgcctggagtccccaagtccat

SEQ ID NO: 9403801 - DNA, 19 bp, Homo sapiens
tgcctggagcataacaggc

SEQ ID NO: 9403802 - DNA, 22 bp, Homo sapiens
tgcctggcatctagccctggga

SEQ ID NO: 9403803 - DNA, 22 bp, Homo sapiens
tgcctggcagcttgaaagaaat

SEQ ID NO: 9403804 - DNA, 22 bp, Homo sapiens
tgcctggcatctagccctggga

SEQ ID NO: 9403805 - DNA, 22 bp, Homo sapiens
tgcctggcatctagccctggga

SEQ ID NO: 9403806 - DNA, 22 bp, Homo sapiens
tgcctggcatgttatagacaca

SEQ ID NO: 9403807 - DNA, 22 bp, Homo sapiens
tgcctggcaccccagtctgcac

SEQ ID NO: 9403808 - DNA, 22 bp, Homo sapiens
tgcctggcacagagcaggtggc

SEQ ID NO: 9403809 - DNA, 19 bp, Homo sapiens
tgcctggcaccagctccac

SEQ ID NO: 9403810 - DNA, 19 bp, Homo sapiens
tgcctggcaccagctccac

SEQ ID NO: 9403811 - DNA, 22 bp, Homo sapiens
tgcctggcaccccagtctgcac

SEQ ID NO: 9403812 - DNA, 22 bp, Homo sapiens
tgcctcagctgaggccgctcca

SEQ ID NO: 9403813 - DNA, 22 bp, Homo sapiens
tgcctcaggcacctggcaggtt

SEQ ID NO: 9403814 - DNA, 22 bp, Homo sapiens
tgcctcaggcacctggcaggtt

SEQ ID NO: 9403815 - DNA, 22 bp, Homo sapiens
tgcctcagctgaggccgctcca

SEQ ID NO: 9403816 - DNA, 19 bp, Homo sapiens
tgcctcagggctttgagga

SEQ ID NO: 9403817 - DNA, 19 bp, Homo sapiens
tgcctcagggctttgagga

SEQ ID NO: 9403818 - DNA, 22 bp, Homo sapiens
tgcctcagtctaaagtctctca

SEQ ID NO: 9403819 - DNA, 22 bp, Homo sapiens
tgcctcagtctaaagtctctca

SEQ ID NO: 9403820 - DNA, 22 bp, Homo sapiens
tgcctccattcctgggtcattg

SEQ ID NO: 9403821 - DNA, 22 bp, Homo sapiens
tgcctccctctctgccactgga

SEQ ID NO: 9403822 - DNA, 22 bp, Homo sapiens
tgcctccctctctgccactgga

SEQ ID NO: 9403823 - DNA, 22 bp, Homo sapiens
tgcctccctctctgccactgga

SEQ ID NO: 9403824 - DNA, 22 bp, Homo sapiens
tgcctccctggcaagtctctcc

SEQ ID NO: 9403825 - DNA, 22 bp, Homo sapiens
tgcctccctggcaagtctctcc

SEQ ID NO: 9403826 - DNA, 22 bp, Homo sapiens
tgcctctctaacccatgcccaa

SEQ ID NO: 9403827 - DNA, 22 bp, Homo sapiens
tgcctctctaacccatgcccaa

SEQ ID NO: 9403828 - DNA, 22 bp, Homo sapiens
tgcctctctaacccatgcccaa

SEQ ID NO: 9403829 - DNA, 22 bp, Homo sapiens
tgcctctctaacccatgcccaa

SEQ ID NO: 9403830 - DNA, 22 bp, Homo sapiens
tgcctctgctgctgtggcatca

SEQ ID NO: 9403831 - DNA, 22 bp, Homo sapiens
tgcctgaggagtcagggcaggt

SEQ ID NO: 9403832 - DNA, 22 bp, Homo sapiens
tgcctgaggagtcagggcaggt

SEQ ID NO: 9403833 - DNA, 22 bp, Homo sapiens
tgcctgagggagtaagagtcct

SEQ ID NO: 9403834 - DNA, 22 bp, Homo sapiens
tgcctgagtgatgtggcagcca

SEQ ID NO: 9403835 - DNA, 22 bp, Homo sapiens
tgcctgagtttaaccctcagag

SEQ ID NO: 9403836 - DNA, 22 bp, Homo sapiens
tgcctgagtgatgtggcagcca

SEQ ID NO: 9403837 - DNA, 22 bp, Homo sapiens
tgcctctggttatctggtacct

SEQ ID NO: 9403838 - DNA, 22 bp, Homo sapiens
tgcctctgtgggccttcctggc

SEQ ID NO: 9403839 - DNA, 22 bp, Homo sapiens
tgcctctgtgggcagagctgcc

SEQ ID NO: 9403840 - DNA, 22 bp, Homo sapiens
tgcctctgtgggccttcctggc

SEQ ID NO: 9403841 - DNA, 22 bp, Homo sapiens
tgaggaagggtgtgacggcacc

SEQ ID NO: 9403842 - DNA, 22 bp, Homo sapiens
tgaggaagggtgtgacggcacc

SEQ ID NO: 9403843 - DNA, 22 bp, Homo sapiens
tgaggaagggtgtgacggcacc

SEQ ID NO: 9403844 - DNA, 22 bp, Homo sapiens
tgaggaagggtgtgacggcacc

SEQ ID NO: 9403845 - DNA, 22 bp, Homo sapiens
tgaggaagtggttgtatggttt

SEQ ID NO: 9403846 - DNA, 22 bp, Homo sapiens
tgaggagaaatgctcagagcca

SEQ ID NO: 9403847 - DNA, 22 bp, Homo sapiens
tgaggagaaatgctcagagcca

SEQ ID NO: 9403848 - DNA, 22 bp, Homo sapiens
tgaggaagttgatctcatcagt

SEQ ID NO: 9403849 - DNA, 22 bp, Homo sapiens
tgaggaagttgatctcatcagt

SEQ ID NO: 9403850 - DNA, 22 bp, Homo sapiens
tgaggaaatatggtgaactctt

SEQ ID NO: 9403851 - DNA, 22 bp, Homo sapiens
tgaggaaatatggtgaactctt

SEQ ID NO: 9403852 - DNA, 22 bp, Homo sapiens
tgaggaaagaaaggcatgcatg

SEQ ID NO: 9403853 - DNA, 22 bp, Homo sapiens
tgaggaaattgaggctcacaga

SEQ ID NO: 9403854 - DNA, 22 bp, Homo sapiens
tgaggaaattgaggctcacaga

SEQ ID NO: 9403855 - DNA, 22 bp, Homo sapiens
tgaggaacaactcctgtgacta

SEQ ID NO: 9403856 - DNA, 22 bp, Homo sapiens
tgaggaagaacaagaatttaga

SEQ ID NO: 9403857 - DNA, 22 bp, Homo sapiens
tgaggaactcaccaggcagaga

SEQ ID NO: 9403858 - DNA, 22 bp, Homo sapiens
tgaggaagcaaaggcttgtgtg

SEQ ID NO: 9403859 - DNA, 22 bp, Homo sapiens
tgaggaagcaaaggcttgtgtg

SEQ ID NO: 9403860 - DNA, 22 bp, Homo sapiens
tgaggaagaacaagaatttaga

SEQ ID NO: 9403861 - DNA, 22 bp, Homo sapiens
tgaggaagccaaacagctacac

SEQ ID NO: 9403862 - DNA, 22 bp, Homo sapiens
tgaggatggtgttggagagggc

SEQ ID NO: 9403863 - DNA, 22 bp, Homo sapiens
tgaggatggcagtgtgctcagc

SEQ ID NO: 9403864 - DNA, 22 bp, Homo sapiens
tgaggatggcagtgtgctcagc

SEQ ID NO: 9403865 - DNA, 22 bp, Homo sapiens
tgaggatggaatgctgtgcaag

SEQ ID NO: 9403866 - DNA, 22 bp, Homo sapiens
tgaggatggcagtgtgctcagc

SEQ ID NO: 9403867 - DNA, 22 bp, Homo sapiens
tgaggagtgtggatggagcttg

SEQ ID NO: 9403868 - DNA, 22 bp, Homo sapiens
tgaggagtatggtggggtcatt

SEQ ID NO: 9403869 - DNA, 22 bp, Homo sapiens
tgaggatgacgatggcaatggc

SEQ ID NO: 9403870 - DNA, 22 bp, Homo sapiens
tgaggatgagatgagataacac

SEQ ID NO: 9403871 - DNA, 22 bp, Homo sapiens
tgaggagcgggcagggatgcag

SEQ ID NO: 9403872 - DNA, 23 bp, Homo sapiens
tgaggagcatagctgactgacag

SEQ ID NO: 9403873 - DNA, 22 bp, Homo sapiens
tgaggagcttctggaaagtgca

SEQ ID NO: 9403874 - DNA, 23 bp, Homo sapiens
tgaggagcatagctgactgacag

SEQ ID NO: 9403875 - DNA, 22 bp, Homo sapiens
tgaggagccactctagcagtca

SEQ ID NO: 9403876 - DNA, 22 bp, Homo sapiens
tgaggaggcccaggttggggct

SEQ ID NO: 9403877 - DNA, 22 bp, Homo sapiens
tgaggaggcccaggttggggct

SEQ ID NO: 9403878 - DNA, 22 bp, Homo sapiens
tgaggaggcccaggttggggct

SEQ ID NO: 9403879 - DNA, 22 bp, Homo sapiens
tgaggaggtcagagtctggctg

SEQ ID NO: 9403880 - DNA, 22 bp, Homo sapiens
tgaggaggtcagagtctggctg

SEQ ID NO: 9403881 - DNA, 22 bp, Homo sapiens
tgaggaggtcagagtctggctg

SEQ ID NO: 9403882 - DNA, 22 bp, Homo sapiens
tgaggaggtgggcacacagagt

SEQ ID NO: 9403883 - DNA, 22 bp, Homo sapiens
tgaggaggtgggcacacagagt

SEQ ID NO: 9403884 - DNA, 22 bp, Homo sapiens
tgaggaggtgggcacacagagt

SEQ ID NO: 9403885 - DNA, 22 bp, Homo sapiens
tgaggaggtgggcacacagagt

SEQ ID NO: 9403886 - DNA, 22 bp, Homo sapiens
tgaggcaggactgagcgggatg

SEQ ID NO: 9403887 - DNA, 22 bp, Homo sapiens
tgaggcaggacttgcataaagt

SEQ ID NO: 9403888 - DNA, 22 bp, Homo sapiens
tgaggcaggagaatcacatgaa

SEQ ID NO: 9403889 - DNA, 22 bp, Homo sapiens
tgaggcaggagaatcacatgaa

SEQ ID NO: 9403890 - DNA, 20 bp, Homo sapiens
tgaggcaggagaatggcatg

SEQ ID NO: 9403891 - DNA, 20 bp, Homo sapiens
tgaggcaggagaatggcatg

SEQ ID NO: 9403892 - DNA, 22 bp, Homo sapiens
tgaggcaggagaatcaccggaa

SEQ ID NO: 9403893 - DNA, 22 bp, Homo sapiens
tgaggcaggagaatcacatgaa

SEQ ID NO: 9403894 - DNA, 22 bp, Homo sapiens
tgaggcaggagaatcacatgaa

SEQ ID NO: 9403895 - DNA, 22 bp, Homo sapiens
tgaggcaggagaatcaccggaa

SEQ ID NO: 9403896 - DNA, 22 bp, Homo sapiens
tgaggcaggagaatcaccggaa

SEQ ID NO: 9403897 - DNA, 22 bp, Homo sapiens
tgaggcagctttttctgtgtgt

SEQ ID NO: 9403898 - DNA, 22 bp, Homo sapiens
tgaggcagctttttctgtgtgt

SEQ ID NO: 9403899 - DNA, 22 bp, Homo sapiens
tgaggcagcctgcattaaagag

SEQ ID NO: 9403900 - DNA, 22 bp, Homo sapiens
tgaggcaggacatggacaactg

SEQ ID NO: 9403901 - DNA, 22 bp, Homo sapiens
tgaggcaggacatggacaactg

SEQ ID NO: 9403902 - DNA, 22 bp, Homo sapiens
tgaggcaggactgagcgggatg

SEQ ID NO: 9403903 - DNA, 22 bp, Homo sapiens
tgaggatggtgttggagagggc

SEQ ID NO: 9403904 - DNA, 22 bp, Homo sapiens
tgaggatttaatgggactcatt

SEQ ID NO: 9403905 - DNA, 21 bp, Homo sapiens
tgaggatttcagtagatgcct

SEQ ID NO: 9403906 - DNA, 22 bp, Homo sapiens
tgaggcaaagttcaagctgaaa

SEQ ID NO: 9403907 - DNA, 22 bp, Homo sapiens
tgaggatttcctgcagctttct

SEQ ID NO: 9403908 - DNA, 19 bp, Homo sapiens
tgaggcaagatggctctgg

SEQ ID NO: 9403909 - DNA, 22 bp, Homo sapiens
tgaggcaacagaaagggccaat

SEQ ID NO: 9403910 - DNA, 22 bp, Homo sapiens
tgaggcaagctgggcccatgga

SEQ ID NO: 9403911 - DNA, 22 bp, Homo sapiens
tgaggcacatccaggccagctc

SEQ ID NO: 9403912 - DNA, 22 bp, Homo sapiens
tgaggcaatgtccttcatcctt

SEQ ID NO: 9403913 - DNA, 19 bp, Homo sapiens
tgaggcactagtctggtcc

SEQ ID NO: 9403914 - DNA, 19 bp, Homo sapiens
tgaggcacatgataagaac

SEQ ID NO: 9403915 - DNA, 22 bp, Homo sapiens
tgaggccaatgaccctgggcag

SEQ ID NO: 9403916 - DNA, 22 bp, Homo sapiens
tgaggccaatgaccctgggcag

SEQ ID NO: 9403917 - DNA, 22 bp, Homo sapiens
tgaggccacaggaaagggcccg

SEQ ID NO: 9403918 - DNA, 21 bp, Homo sapiens
tgaggccaatagcccctggac

SEQ ID NO: 9403919 - DNA, 19 bp, Homo sapiens
tgaggccaaggtcacagat

SEQ ID NO: 9403920 - DNA, 21 bp, Homo sapiens
tgaggccaatagcccctggac

SEQ ID NO: 9403921 - DNA, 22 bp, Homo sapiens
tgaggccacttccccacagccc

SEQ ID NO: 9403922 - DNA, 22 bp, Homo sapiens
tgaggccacttccccacagccc

SEQ ID NO: 9403923 - DNA, 22 bp, Homo sapiens
tgaggccagagagtttgcattt

SEQ ID NO: 9403924 - DNA, 22 bp, Homo sapiens
tgaggccacagtatcagaacag

SEQ ID NO: 9403925 - DNA, 22 bp, Homo sapiens
tgaggccacagtatcagaacag

SEQ ID NO: 9403926 - DNA, 22 bp, Homo sapiens
tgaggccacttccccacagccc

SEQ ID NO: 9403927 - DNA, 22 bp, Homo sapiens
tgaggccagactgaaaccaaca

SEQ ID NO: 9403928 - DNA, 18 bp, Homo sapiens
tgaggccagagtgggcat

SEQ ID NO: 9403929 - DNA, 18 bp, Homo sapiens
tgaggccagagtgggcat

SEQ ID NO: 9403930 - DNA, 22 bp, Homo sapiens
tgaggccagagtttttaattcc

SEQ ID NO: 9403931 - DNA, 22 bp, Homo sapiens
tgaggccagccacagccaccct

SEQ ID NO: 9403932 - DNA, 22 bp, Homo sapiens
tgaggccagcttcagcagtgga

SEQ ID NO: 9403933 - DNA, 22 bp, Homo sapiens
tgaggccaggacccccagcagg

SEQ ID NO: 9403934 - DNA, 16 bp, Homo sapiens
tgaggccagccatttc

SEQ ID NO: 9403935 - DNA, 22 bp, Homo sapiens
tgaggccagcttcagcagtgga

SEQ ID NO: 9403936 - DNA, 22 bp, Homo sapiens
tgaggccaggacccccagcagg

SEQ ID NO: 9403937 - DNA, 22 bp, Homo sapiens
tgaggccaggacccccagcagg

SEQ ID NO: 9403938 - DNA, 22 bp, Homo sapiens
tgaggccctctgggctggtcct

SEQ ID NO: 9403939 - DNA, 22 bp, Homo sapiens
tgaggccctctgggctggtcct

SEQ ID NO: 9403940 - DNA, 17 bp, Homo sapiens
tgaggcctgcatcagtg

SEQ ID NO: 9403941 - DNA, 17 bp, Homo sapiens
tgaggcctgcatcagtg

SEQ ID NO: 9403942 - DNA, 22 bp, Homo sapiens
tgaggcctctgaggcctaggct

SEQ ID NO: 9403943 - DNA, 18 bp, Homo sapiens
tgaggcctctgctgggcc

SEQ ID NO: 9403944 - DNA, 22 bp, Homo sapiens
tgaggcctctgtgccatccagg

SEQ ID NO: 9403945 - DNA, 22 bp, Homo sapiens
tgaggcctgaagcctggagcct

SEQ ID NO: 9403946 - DNA, 22 bp, Homo sapiens
tgaggcctctgtgccatccagg

SEQ ID NO: 9403947 - DNA, 22 bp, Homo sapiens
tgaggcctctgtgccatccagg

SEQ ID NO: 9403948 - DNA, 22 bp, Homo sapiens
tgaggcaggaggttgagaactg

SEQ ID NO: 9403949 - DNA, 22 bp, Homo sapiens
tgaggcaggaggattgcaggat

SEQ ID NO: 9403950 - DNA, 22 bp, Homo sapiens
tgaggcaggaggattgcaggat

SEQ ID NO: 9403951 - DNA, 22 bp, Homo sapiens
tgaggcaggagaatggcgggaa

SEQ ID NO: 9403952 - DNA, 22 bp, Homo sapiens
tgaggcaggagttcaggctgcg

SEQ ID NO: 9403953 - DNA, 22 bp, Homo sapiens
tgaggcaggagttcaggctgcg

SEQ ID NO: 9403954 - DNA, 22 bp, Homo sapiens
tgaggcaggagttcaggctgcg

SEQ ID NO: 9403955 - DNA, 22 bp, Homo sapiens
tgaggcaggagttcaggctgcg

SEQ ID NO: 9403956 - DNA, 22 bp, Homo sapiens
tgaggcaggatgcttgcacagg

SEQ ID NO: 9403957 - DNA, 22 bp, Homo sapiens
tgaggcaggagttcaggctgcg

SEQ ID NO: 9403958 - DNA, 23 bp, Homo sapiens
tgaggcaggcggatcacgaggtc

SEQ ID NO: 9403959 - DNA, 23 bp, Homo sapiens
tgaggcaggcggatcacgaggtc

SEQ ID NO: 9403960 - DNA, 23 bp, Homo sapiens
tgaggcaggcggatcacgaggtc

SEQ ID NO: 9403961 - DNA, 22 bp, Homo sapiens
tgaggcagttcttacttgtatt

SEQ ID NO: 9403962 - DNA, 21 bp, Homo sapiens
tgaggcaggggtgcttttgtc

SEQ ID NO: 9403963 - DNA, 22 bp, Homo sapiens
tgaggcagggagtttaattgtc

SEQ ID NO: 9403964 - DNA, 22 bp, Homo sapiens
tgaggcagtgtgagataataaa

SEQ ID NO: 9403965 - DNA, 22 bp, Homo sapiens
tgaggcagggagagtggatatg

SEQ ID NO: 9403966 - DNA, 22 bp, Homo sapiens
tgaggcagggagagtggatatg

SEQ ID NO: 9403967 - DNA, 23 bp, Homo sapiens
tgaggcaggcggatcacgaggtc

SEQ ID NO: 9403968 - DNA, 22 bp, Homo sapiens
tgaggcagttgagcttcctgag

SEQ ID NO: 9403969 - DNA, 22 bp, Homo sapiens
tgaggcagttgagcttcctgag

SEQ ID NO: 9403970 - DNA, 22 bp, Homo sapiens
tgaggcatggtcctgagggagc

SEQ ID NO: 9403971 - DNA, 22 bp, Homo sapiens
tgaggcattaaagggaggtcaa

SEQ ID NO: 9403972 - DNA, 22 bp, Homo sapiens
tgaggccaaaatgactcaaatg

SEQ ID NO: 9403973 - DNA, 22 bp, Homo sapiens
tgaggccaagcctcctctgcca

SEQ ID NO: 9403974 - DNA, 22 bp, Homo sapiens
tgaggccaactagggagatgga

SEQ ID NO: 9403975 - DNA, 22 bp, Homo sapiens
tgaggccaagcctcctctgcca

SEQ ID NO: 9403976 - DNA, 19 bp, Homo sapiens
tgaggccaaggtcacagat

SEQ ID NO: 9403977 - DNA, 22 bp, Homo sapiens
tgaggtggctggatctcagcct

SEQ ID NO: 9403978 - DNA, 22 bp, Homo sapiens
tgaggtggctagggaggcactc

SEQ ID NO: 9403979 - DNA, 22 bp, Homo sapiens
tgaggtggctagggaggcactc

SEQ ID NO: 9403980 - DNA, 22 bp, Homo sapiens
tgaggtgggtgtcaggtcagag

SEQ ID NO: 9403981 - DNA, 22 bp, Homo sapiens
tgaggtgggcttgtggatttgc

SEQ ID NO: 9403982 - DNA, 22 bp, Homo sapiens
tgaggtgggcttgtggatttgc

SEQ ID NO: 9403983 - DNA, 22 bp, Homo sapiens
tgaggtggccgaggagcaggac

SEQ ID NO: 9403984 - DNA, 22 bp, Homo sapiens
tgaggtggccgaggagcaggac

SEQ ID NO: 9403985 - DNA, 22 bp, Homo sapiens
tgaggtggctagggaggcactc

SEQ ID NO: 9403986 - DNA, 22 bp, Homo sapiens
tgaggtgccacccaagagcctt

SEQ ID NO: 9403987 - DNA, 22 bp, Homo sapiens
tgaggtgataataactccctgc

SEQ ID NO: 9403988 - DNA, 22 bp, Homo sapiens
tgaggtgatacagaccctactt

SEQ ID NO: 9403989 - DNA, 22 bp, Homo sapiens
tgaggtggttactgtggtgctc

SEQ ID NO: 9403990 - DNA, 22 bp, Homo sapiens
tgaggtggttactgtggtgctc

SEQ ID NO: 9403991 - DNA, 22 bp, Homo sapiens
tgaggtggtgctaatctctgct

SEQ ID NO: 9403992 - DNA, 22 bp, Homo sapiens
tgaggtggtccaaagactgttt

SEQ ID NO: 9403993 - DNA, 22 bp, Homo sapiens
tgaggtggtccaaagactgttt

SEQ ID NO: 9403994 - DNA, 22 bp, Homo sapiens
tgaggtgggtgtcaggtcagag

SEQ ID NO: 9403995 - DNA, 22 bp, Homo sapiens
tgaggtggtttgtatcactggg

SEQ ID NO: 9403996 - DNA, 22 bp, Homo sapiens
tgaggtggttcaagagccttgt

SEQ ID NO: 9403997 - DNA, 22 bp, Homo sapiens
tgagtactcttctcactacacc

SEQ ID NO: 9403998 - DNA, 22 bp, Homo sapiens
tgagtactttatgttagttatt

SEQ ID NO: 9403999 - DNA, 22 bp, Homo sapiens
tgagtagagaattcagctaagg

SEQ ID NO: 9404000 - DNA, 22 bp, Homo sapiens
tgagtagagaattcagctaagg

SEQ ID NO: 9404001 - DNA, 22 bp, Homo sapiens
tgagtagagaattcagctaagg

SEQ ID NO: 9404002 - DNA, 22 bp, Homo sapiens
tgagtagacgtgatctagtaac

SEQ ID NO: 9404003 - DNA, 17 bp, Homo sapiens
tgagtagggaagaggag

SEQ ID NO: 9404004 - DNA, 22 bp, Homo sapiens
tgagtaggtggttaagcatgga

SEQ ID NO: 9404005 - DNA, 22 bp, Homo sapiens
tgagtatacaatggcactgcca

SEQ ID NO: 9404006 - DNA, 22 bp, Homo sapiens
tgagtatacactcctaagggta

SEQ ID NO: 9404007 - DNA, 22 bp, Homo sapiens
tgagtataaaacatatacatca

SEQ ID NO: 9404008 - DNA, 22 bp, Homo sapiens
tgagtatatgatttgtgtttgc

SEQ ID NO: 9404009 - DNA, 22 bp, Homo sapiens
tgagtatattaatttgccagca

SEQ ID NO: 9404010 - DNA, 22 bp, Homo sapiens
tgagtatatacccagaagtgga

SEQ ID NO: 9404011 - DNA, 22 bp, Homo sapiens
tgagtatagaaagtcacccttt

SEQ ID NO: 9404012 - DNA, 22 bp, Homo sapiens
tgagtatagcatgatgggccat

SEQ ID NO: 9404013 - DNA, 23 bp, Homo sapiens
tgagtcttgagctttggattctg

SEQ ID NO: 9404014 - DNA, 22 bp, Homo sapiens
tgagtcacatccatttttgtgt

SEQ ID NO: 9404015 - DNA, 22 bp, Homo sapiens
tgagtatattgagtttagggca

SEQ ID NO: 9404016 - DNA, 22 bp, Homo sapiens
tgagtatattttccctgggtgg

SEQ ID NO: 9404017 - DNA, 22 bp, Homo sapiens
tgaggtgagtcatgcattggag

SEQ ID NO: 9404018 - DNA, 22 bp, Homo sapiens
tgaggtgagtcatgcattggag

SEQ ID NO: 9404019 - DNA, 22 bp, Homo sapiens
tgaggtgagtcagtttctgatg

SEQ ID NO: 9404020 - DNA, 22 bp, Homo sapiens
tgaggtgaggttgaggaaagaa

SEQ ID NO: 9404021 - DNA, 22 bp, Homo sapiens
tgaggtgagcatctttatcttc

SEQ ID NO: 9404022 - DNA, 22 bp, Homo sapiens
tgaggtgagatggctaccccaa

SEQ ID NO: 9404023 - DNA, 22 bp, Homo sapiens
tgaggtgacacaatttactcca

SEQ ID NO: 9404024 - DNA, 22 bp, Homo sapiens
tgaggtgaccgcagatgggaag

SEQ ID NO: 9404025 - DNA, 20 bp, Homo sapiens
tgaggtgaatgtcttttaga

SEQ ID NO: 9404026 - DNA, 22 bp, Homo sapiens
tgaggtgaatggtgtccctgga

SEQ ID NO: 9404027 - DNA, 22 bp, Homo sapiens
tgaggtgacaattcattctcca

SEQ ID NO: 9404028 - DNA, 22 bp, Homo sapiens
tgaggtctgctcaagtccctgg

SEQ ID NO: 9404029 - DNA, 22 bp, Homo sapiens
tgaggtctcagctgggaagact

SEQ ID NO: 9404030 - DNA, 22 bp, Homo sapiens
tgaggtcttttatagtgtgtca

SEQ ID NO: 9404031 - DNA, 22 bp, Homo sapiens
tgaggtgaagagtggagctcag

SEQ ID NO: 9404032 - DNA, 22 bp, Homo sapiens
tgaggtgaagagtggagctcag

SEQ ID NO: 9404033 - DNA, 22 bp, Homo sapiens
tgaggtcttttatagtgtgtca

SEQ ID NO: 9404034 - DNA, 22 bp, Homo sapiens
tgaggtgaagagtggagctcag

SEQ ID NO: 9404035 - DNA, 22 bp, Homo sapiens
tgaggtgaatggtgtccctgga

SEQ ID NO: 9404036 - DNA, 22 bp, Homo sapiens
tgaggtgaatggtgtccctgga

SEQ ID NO: 9404037 - DNA, 22 bp, Homo sapiens
tgaggtgaaggagttttaaagt

SEQ ID NO: 9404038 - DNA, 22 bp, Homo sapiens
tgagggtgggcctgcaggaaga

SEQ ID NO: 9404039 - DNA, 22 bp, Homo sapiens
tgagggtgggccctgggcatct

SEQ ID NO: 9404040 - DNA, 22 bp, Homo sapiens
tgagggtggccttgtgtggact

SEQ ID NO: 9404041 - DNA, 22 bp, Homo sapiens
tgaggtagagattgtgactgta

SEQ ID NO: 9404042 - DNA, 22 bp, Homo sapiens
tgaggggccagaccccacctag

SEQ ID NO: 9404043 - DNA, 22 bp, Homo sapiens
tgaggggccgcccaagcacttc

SEQ ID NO: 9404044 - DNA, 22 bp, Homo sapiens
tgaggggcgctggcaggttcct

SEQ ID NO: 9404045 - DNA, 19 bp, Homo sapiens
tgaggggctcacagtctca

SEQ ID NO: 9404046 - DNA, 22 bp, Homo sapiens
tgagggtggcacaggcacaaag

SEQ ID NO: 9404047 - DNA, 22 bp, Homo sapiens
tgagggtagctggatcacggag

SEQ ID NO: 9404048 - DNA, 22 bp, Homo sapiens
tgagggtagaggcaggagtgca

SEQ ID NO: 9404049 - DNA, 22 bp, Homo sapiens
tgaggggttgtgagaaatgtag

SEQ ID NO: 9404050 - DNA, 22 bp, Homo sapiens
tgagggtaacctggagctgctg

SEQ ID NO: 9404051 - DNA, 22 bp, Homo sapiens
tgaggggtctaggctgcgcacc

SEQ ID NO: 9404052 - DNA, 22 bp, Homo sapiens
tgaggggtaagtaaaggaattg

SEQ ID NO: 9404053 - DNA, 22 bp, Homo sapiens
tgagggggttaattaggagagt

SEQ ID NO: 9404054 - DNA, 22 bp, Homo sapiens
tgaggggggtaatcactgggtt

SEQ ID NO: 9404055 - DNA, 22 bp, Homo sapiens
tgaggctcagagaagtgctgtt

SEQ ID NO: 9404056 - DNA, 22 bp, Homo sapiens
tgaggctcagaaatgtaagttt

SEQ ID NO: 9404057 - DNA, 22 bp, Homo sapiens
tgaggctcagaagtgccaagtg

SEQ ID NO: 9404058 - DNA, 20 bp, Homo sapiens
tgaggctcagagaggttgag

SEQ ID NO: 9404059 - DNA, 18 bp, Homo sapiens
tgaggctcagctcctggt

SEQ ID NO: 9404060 - DNA, 22 bp, Homo sapiens
tgaggctcagtgagccctgcag

SEQ ID NO: 9404061 - DNA, 22 bp, Homo sapiens
tgaggcctggactctgcatgga

SEQ ID NO: 9404062 - DNA, 22 bp, Homo sapiens
tgaggcctggagggaggagttt

SEQ ID NO: 9404063 - DNA, 22 bp, Homo sapiens
tgaggctcaagaatagacagta

SEQ ID NO: 9404064 - DNA, 22 bp, Homo sapiens
tgaggctaaaggtgaccagatt

SEQ ID NO: 9404065 - DNA, 22 bp, Homo sapiens
tgaggctcaagaaagatttgtt

SEQ ID NO: 9404066 - DNA, 21 bp, Homo sapiens
tgaggctgttgtaccagggag

SEQ ID NO: 9404067 - DNA, 21 bp, Homo sapiens
tgaggctgttgtaccagggag

SEQ ID NO: 9404068 - DNA, 22 bp, Homo sapiens
tgaggctgttctaccagggcca

SEQ ID NO: 9404069 - DNA, 22 bp, Homo sapiens
tgaggctggcaaggctggtatt

SEQ ID NO: 9404070 - DNA, 22 bp, Homo sapiens
tgaggctgttctaccagggcca

SEQ ID NO: 9404071 - DNA, 22 bp, Homo sapiens
tgaggcttggagaggtcaggga

SEQ ID NO: 9404072 - DNA, 21 bp, Homo sapiens
tgaggctgttgtaccagggag

SEQ ID NO: 9404073 - DNA, 21 bp, Homo sapiens
tgaggctgttgtaccagggag

SEQ ID NO: 9404074 - DNA, 22 bp, Homo sapiens
tgaggctggatgggatgcctcc

SEQ ID NO: 9404075 - DNA, 22 bp, Homo sapiens
tgaggctggcaaggctggtatt

SEQ ID NO: 9404076 - DNA, 22 bp, Homo sapiens
tgaggctgccttgggaagaggg

SEQ ID NO: 9404077 - DNA, 22 bp, Homo sapiens
tgaggctgccttgggaagaggg

SEQ ID NO: 9404078 - DNA, 22 bp, Homo sapiens
tgaggctgccttgggaagaggg

SEQ ID NO: 9404079 - DNA, 22 bp, Homo sapiens
tgaggctggatgggatgcctcc

SEQ ID NO: 9404080 - DNA, 22 bp, Homo sapiens
tgaggctgccttgggaagaggg

SEQ ID NO: 9404081 - DNA, 22 bp, Homo sapiens
tgaggctgccttgggaagaggg

SEQ ID NO: 9404082 - DNA, 22 bp, Homo sapiens
tgaggctctgcttctgtggctc

SEQ ID NO: 9404083 - DNA, 21 bp, Homo sapiens
tgaggctctgttgtgcctgca

SEQ ID NO: 9404084 - DNA, 17 bp, Homo sapiens
tgaggctcggtgaggag

SEQ ID NO: 9404085 - DNA, 22 bp, Homo sapiens
tgaggggagcccgccctggacg

SEQ ID NO: 9404086 - DNA, 22 bp, Homo sapiens
tgaggggagcccgccctggacg

SEQ ID NO: 9404087 - DNA, 22 bp, Homo sapiens
tgaggggagcccgccctggacg

SEQ ID NO: 9404088 - DNA, 22 bp, Homo sapiens
tgaggggagctagcatgccttg

SEQ ID NO: 9404089 - DNA, 19 bp, Homo sapiens
tgaggggaggagaggcctg

SEQ ID NO: 9404090 - DNA, 22 bp, Homo sapiens
tgaggggaggttggggcacatc

SEQ ID NO: 9404091 - DNA, 22 bp, Homo sapiens
tgagggagtcatgattaaggaa

SEQ ID NO: 9404092 - DNA, 22 bp, Homo sapiens
tgagggagtgtggatacagtag

SEQ ID NO: 9404093 - DNA, 22 bp, Homo sapiens
tgagggagtgtggatacagtag

SEQ ID NO: 9404094 - DNA, 22 bp, Homo sapiens
tgagggagttgggtgtatagga

SEQ ID NO: 9404095 - DNA, 22 bp, Homo sapiens
tgaggggagaagcagcagcctg

SEQ ID NO: 9404096 - DNA, 22 bp, Homo sapiens
tgaggggagacagagtggactc

SEQ ID NO: 9404097 - DNA, 22 bp, Homo sapiens
tgaggggagacagagtggactc

SEQ ID NO: 9404098 - DNA, 22 bp, Homo sapiens
tgaggggaactgatgcccattg

SEQ ID NO: 9404099 - DNA, 22 bp, Homo sapiens
tgagggaggcctccatctgcca

SEQ ID NO: 9404100 - DNA, 22 bp, Homo sapiens
tgagggagctgacctttctgtg

SEQ ID NO: 9404101 - DNA, 22 bp, Homo sapiens
tgagggagagggcgaaaatgaa

SEQ ID NO: 9404102 - DNA, 22 bp, Homo sapiens
tgagggacttgctagttctctg

SEQ ID NO: 9404103 - DNA, 19 bp, Homo sapiens
tgagggacattgggagcag

SEQ ID NO: 9404104 - DNA, 22 bp, Homo sapiens
tgagggacttgctagttctctg

SEQ ID NO: 9404105 - DNA, 23 bp, Homo sapiens
tgagggacatggtggcttctgag

SEQ ID NO: 9404106 - DNA, 19 bp, Homo sapiens
tgagggacattgggagcag

SEQ ID NO: 9404107 - DNA, 23 bp, Homo sapiens
tgagggacatggtggcttctgag

SEQ ID NO: 9404108 - DNA, 22 bp, Homo sapiens
tgagggaatattgatagatccg

SEQ ID NO: 9404109 - DNA, 22 bp, Homo sapiens
tgagggaatattgatagatccg

SEQ ID NO: 9404110 - DNA, 22 bp, Homo sapiens
tgaggcttggaggctccagtgg

SEQ ID NO: 9404111 - DNA, 22 bp, Homo sapiens
tgagctagggctggtgaggagc

SEQ ID NO: 9404112 - DNA, 22 bp, Homo sapiens
tgagcctgtcctgtgcatgtga

SEQ ID NO: 9404113 - DNA, 22 bp, Homo sapiens
tgagcctgtcattattcagaga

SEQ ID NO: 9404114 - DNA, 22 bp, Homo sapiens
tgagcctgggagatggaggctg

SEQ ID NO: 9404115 - DNA, 22 bp, Homo sapiens
tgagcctgggctttctctggag

SEQ ID NO: 9404116 - DNA, 22 bp, Homo sapiens
tgagcctggggcctgggcagcg

SEQ ID NO: 9404117 - DNA, 22 bp, Homo sapiens
tgagcctggttgcagtgtctgg

SEQ ID NO: 9404118 - DNA, 22 bp, Homo sapiens
tgagcctggttgcagtgtctgg

SEQ ID NO: 9404119 - DNA, 22 bp, Homo sapiens
tgagcctggagcccagatgttt

SEQ ID NO: 9404120 - DNA, 22 bp, Homo sapiens
tgagcctgctgtcgctggaccc

SEQ ID NO: 9404121 - DNA, 22 bp, Homo sapiens
tgagcctggagtcgtggagggg

SEQ ID NO: 9404122 - DNA, 22 bp, Homo sapiens
tgagcctggcggaagcagcgtg

SEQ ID NO: 9404123 - DNA, 22 bp, Homo sapiens
tgagcctggcctgcagagacca

SEQ ID NO: 9404124 - DNA, 22 bp, Homo sapiens
tgagcctgcaataagcacagcc

SEQ ID NO: 9404125 - DNA, 22 bp, Homo sapiens
tgagcctgcaataagcacagcc

SEQ ID NO: 9404126 - DNA, 22 bp, Homo sapiens
tgagcctgagttcaaggctgca

SEQ ID NO: 9404127 - DNA, 22 bp, Homo sapiens
tgagcctgcctgcaggtgtgct

SEQ ID NO: 9404128 - DNA, 20 bp, Homo sapiens
tgagcctgctgtaggaggcc

SEQ ID NO: 9404129 - DNA, 23 bp, Homo sapiens
tgagcctgctgatagacacaatt

SEQ ID NO: 9404130 - DNA, 22 bp, Homo sapiens
tgagccagtctctcagaaccct

SEQ ID NO: 9404131 - DNA, 22 bp, Homo sapiens
tgagccagtctgtctgggtgaa

SEQ ID NO: 9404132 - DNA, 22 bp, Homo sapiens
tgagcccagtctgtctgacatg

SEQ ID NO: 9404133 - DNA, 22 bp, Homo sapiens
tgagccagtctgtctgggtgaa

SEQ ID NO: 9404134 - DNA, 20 bp, Homo sapiens
tgagccagtcaagctacatt

SEQ ID NO: 9404135 - DNA, 22 bp, Homo sapiens
tgagccaggttaagacaggagc

SEQ ID NO: 9404136 - DNA, 22 bp, Homo sapiens
tgagccaggtctcactcacctt

SEQ ID NO: 9404137 - DNA, 22 bp, Homo sapiens
tgagccgtggtctctgagggtg

SEQ ID NO: 9404138 - DNA, 21 bp, Homo sapiens
tgagcccttgcctcagagccc

SEQ ID NO: 9404139 - DNA, 22 bp, Homo sapiens
tgagccctgaggatctgttcgg

SEQ ID NO: 9404140 - DNA, 22 bp, Homo sapiens
tgagccctgacctagcctggcc

SEQ ID NO: 9404141 - DNA, 22 bp, Homo sapiens
tgagccctggagccctctgtta

SEQ ID NO: 9404142 - DNA, 23 bp, Homo sapiens
tgagcccagttttccctcttgcc

SEQ ID NO: 9404143 - DNA, 23 bp, Homo sapiens
tgagcccagttttccctcttgcc

SEQ ID NO: 9404144 - DNA, 22 bp, Homo sapiens
tgagcccatgctctttctacga

SEQ ID NO: 9404145 - DNA, 22 bp, Homo sapiens
tgagcccatgtagcacttccat

SEQ ID NO: 9404146 - DNA, 22 bp, Homo sapiens
tgagcccatgtagcacttccat

SEQ ID NO: 9404147 - DNA, 22 bp, Homo sapiens
tgagccctaagggtcaagcagg

SEQ ID NO: 9404148 - DNA, 22 bp, Homo sapiens
tgagccctacctgctcatctcc

SEQ ID NO: 9404149 - DNA, 22 bp, Homo sapiens
tgagccctaatttacaacatct

SEQ ID NO: 9404150 - DNA, 22 bp, Homo sapiens
tgagccctcggctggggcagag

SEQ ID NO: 9404151 - DNA, 22 bp, Homo sapiens
tgagccctccaaacccaggatt

SEQ ID NO: 9404152 - DNA, 22 bp, Homo sapiens
tgaggaaaacgtattgaaagga

SEQ ID NO: 9404153 - DNA, 22 bp, Homo sapiens
tgaggaaactgaggcacagatg

SEQ ID NO: 9404154 - DNA, 22 bp, Homo sapiens
tgaggaaaatgtcttatagatt

SEQ ID NO: 9404155 - DNA, 22 bp, Homo sapiens
tgaggaaacttacaaggcagaa

SEQ ID NO: 9404156 - DNA, 22 bp, Homo sapiens
tgaggaaactgaggcacagatg

SEQ ID NO: 9404157 - DNA, 22 bp, Homo sapiens
tgagcttacgtgggaacagact

SEQ ID NO: 9404158 - DNA, 22 bp, Homo sapiens
tgagctgtctatggtcctgtct

SEQ ID NO: 9404159 - DNA, 19 bp, Homo sapiens
tgagctgctgctgcccatc

SEQ ID NO: 9404160 - DNA, 22 bp, Homo sapiens
tgagctgatggcatccctgttt

SEQ ID NO: 9404161 - DNA, 22 bp, Homo sapiens
tgagctgataggctgtgagcct

SEQ ID NO: 9404162 - DNA, 23 bp, Homo sapiens
tgagctctatggaggactgaacc

SEQ ID NO: 9404163 - DNA, 22 bp, Homo sapiens
tgagctctgttagggctggaac

SEQ ID NO: 9404164 - DNA, 19 bp, Homo sapiens
tgagctctccacaatttcc

SEQ ID NO: 9404165 - DNA, 22 bp, Homo sapiens
tgagctctgacttttgggaatt

SEQ ID NO: 9404166 - DNA, 19 bp, Homo sapiens
tgagctctccacaatttcc

SEQ ID NO: 9404167 - DNA, 22 bp, Homo sapiens
tgagctctcattaatattattc

SEQ ID NO: 9404168 - DNA, 22 bp, Homo sapiens
tgagctcttctaactaattgtg

SEQ ID NO: 9404169 - DNA, 22 bp, Homo sapiens
tgagctgacacccaatcatact

SEQ ID NO: 9404170 - DNA, 22 bp, Homo sapiens
tgagctctgttagggctggaac

SEQ ID NO: 9404171 - DNA, 22 bp, Homo sapiens
tgagctgagaacacttgggcta

SEQ ID NO: 9404172 - DNA, 22 bp, Homo sapiens
tgagctgagtttaaaagctgct

SEQ ID NO: 9404173 - DNA, 23 bp, Homo sapiens
tgagctgagtgagttggcctggg

SEQ ID NO: 9404174 - DNA, 22 bp, Homo sapiens
tgagctgagtggcaggtctcag

SEQ ID NO: 9404175 - DNA, 22 bp, Homo sapiens
tgagctggttcttgaggcatga

SEQ ID NO: 9404176 - DNA, 22 bp, Homo sapiens
tgagctggagtctgtggctcct

SEQ ID NO: 9404177 - DNA, 22 bp, Homo sapiens
tgagctggagtctgtggctcct

SEQ ID NO: 9404178 - DNA, 22 bp, Homo sapiens
tgagcaggactcactgcagcct

SEQ ID NO: 9404179 - DNA, 22 bp, Homo sapiens
tgagcagcaactgtccatggca

SEQ ID NO: 9404180 - DNA, 22 bp, Homo sapiens
tgagcagatgtgccaaactgta

SEQ ID NO: 9404181 - DNA, 22 bp, Homo sapiens
tgagcagcaggatcttctggta

SEQ ID NO: 9404182 - DNA, 22 bp, Homo sapiens
tgagcagcccttcctccggcca

SEQ ID NO: 9404183 - DNA, 22 bp, Homo sapiens
tgagcagggactttgagtgtag

SEQ ID NO: 9404184 - DNA, 22 bp, Homo sapiens
tgagcagggactttgagtgtag

SEQ ID NO: 9404185 - DNA, 22 bp, Homo sapiens
tgagcaggcgcagcaggaggtc

SEQ ID NO: 9404186 - DNA, 22 bp, Homo sapiens
tgagcaggcgcagcaggaggtc

SEQ ID NO: 9404187 - DNA, 21 bp, Homo sapiens
tgagcaggagtcatgggaatg

SEQ ID NO: 9404188 - DNA, 22 bp, Homo sapiens
tgagcaggcgcagcaggaggtc

SEQ ID NO: 9404189 - DNA, 22 bp, Homo sapiens
tgagcagatggaggcttctgca

SEQ ID NO: 9404190 - DNA, 22 bp, Homo sapiens
tgagcagagtcgctccagagtg

SEQ ID NO: 9404191 - DNA, 22 bp, Homo sapiens
tgagcagaggaggctgccaact

SEQ ID NO: 9404192 - DNA, 22 bp, Homo sapiens
tgagcagagcaggctgcgccct

SEQ ID NO: 9404193 - DNA, 22 bp, Homo sapiens
tgagcagaggagtgacgtaggt

SEQ ID NO: 9404194 - DNA, 22 bp, Homo sapiens
tgagcaagacccggcctctgcc

SEQ ID NO: 9404195 - DNA, 22 bp, Homo sapiens
tgagcaaagggatgaatcactg

SEQ ID NO: 9404196 - DNA, 22 bp, Homo sapiens
tgagcaagagaaactgactgta

SEQ ID NO: 9404197 - DNA, 23 bp, Homo sapiens
tgagcaagtgaccaactgtctgt

SEQ ID NO: 9404198 - DNA, 22 bp, Homo sapiens
tgagcacaagtttgcatgtgtg

SEQ ID NO: 9404199 - DNA, 22 bp, Homo sapiens
tgagcacatgccagcccttctc

SEQ ID NO: 9404200 - DNA, 22 bp, Homo sapiens
tgagcagagatgactgggcatt

SEQ ID NO: 9404201 - DNA, 22 bp, Homo sapiens
tgagccagcaggcctccagtgg

SEQ ID NO: 9404202 - DNA, 22 bp, Homo sapiens
tgagccagcaggcctccagtgg

SEQ ID NO: 9404203 - DNA, 22 bp, Homo sapiens
tgagccagcctcagaagtcacg

SEQ ID NO: 9404204 - DNA, 22 bp, Homo sapiens
tgagccagccttgcagctgtgc

SEQ ID NO: 9404205 - DNA, 22 bp, Homo sapiens
tgagccaggcactgctcctgga

SEQ ID NO: 9404206 - DNA, 22 bp, Homo sapiens
tgagccaggagtttgaggctgt

SEQ ID NO: 9404207 - DNA, 22 bp, Homo sapiens
tgagccaggcactgctcctgga

SEQ ID NO: 9404208 - DNA, 22 bp, Homo sapiens
tgagccaggcactgctcctgga

SEQ ID NO: 9404209 - DNA, 22 bp, Homo sapiens
tgagccagctccttgcctgtca

SEQ ID NO: 9404210 - DNA, 22 bp, Homo sapiens
tgagccaggagtttgaggctgt

SEQ ID NO: 9404211 - DNA, 22 bp, Homo sapiens
tgagccagggtttccggctgct

SEQ ID NO: 9404212 - DNA, 21 bp, Homo sapiens
tgagccaggctgacggctgtg

SEQ ID NO: 9404213 - DNA, 22 bp, Homo sapiens
tgagccaggctcaagtgatcct

SEQ ID NO: 9404214 - DNA, 20 bp, Homo sapiens
tgagccaggctaggaagggc

SEQ ID NO: 9404215 - DNA, 22 bp, Homo sapiens
tgagccaggcccagtggggtca

SEQ ID NO: 9404216 - DNA, 22 bp, Homo sapiens
tgagccaaggcctcaagaattt

SEQ ID NO: 9404217 - DNA, 22 bp, Homo sapiens
tgagcattggatcaaatgactt

SEQ ID NO: 9404218 - DNA, 22 bp, Homo sapiens
tgagccagagaggttgaggcta

SEQ ID NO: 9404219 - DNA, 22 bp, Homo sapiens
tgagccagagaggttgaggcta

SEQ ID NO: 9404220 - DNA, 22 bp, Homo sapiens
tgagccagaggaggctgtgtgg

SEQ ID NO: 9404221 - DNA, 22 bp, Homo sapiens
tgagccagagtggagtgtgcct

SEQ ID NO: 9404222 - DNA, 22 bp, Homo sapiens
tgagccagaggaggctgtgtgg

SEQ ID NO: 9404223 - DNA, 22 bp, Homo sapiens
tgagcagggagctgggctgagc

SEQ ID NO: 9404224 - DNA, 22 bp, Homo sapiens
tgagcatggtgggtgcagagca

SEQ ID NO: 9404225 - DNA, 19 bp, Homo sapiens
tgagcatgcgagctgagaa

SEQ ID NO: 9404226 - DNA, 22 bp, Homo sapiens
tgagcatagcccttctagtgtt

SEQ ID NO: 9404227 - DNA, 22 bp, Homo sapiens
tgagcagggagctgggctgagc

SEQ ID NO: 9404228 - DNA, 22 bp, Homo sapiens
tgagcagggactttggagtctg

SEQ ID NO: 9404229 - DNA, 22 bp, Homo sapiens
tgagcagggactttggagtctg

SEQ ID NO: 9404230 - DNA, 22 bp, Homo sapiens
tgagcagggactttggagtctg

SEQ ID NO: 9404231 - DNA, 21 bp, Homo sapiens
tgagcaaaatttagagtgatg

SEQ ID NO: 9404232 - DNA, 22 bp, Homo sapiens
tgagattttcctaaatataatg

SEQ ID NO: 9404233 - DNA, 22 bp, Homo sapiens
tgagattttcagcatcacttca

SEQ ID NO: 9404234 - DNA, 22 bp, Homo sapiens
tgagattttaatattgagaaaa

SEQ ID NO: 9404235 - DNA, 20 bp, Homo sapiens
tgagatttgtattataagtc

SEQ ID NO: 9404236 - DNA, 22 bp, Homo sapiens
tgagatttgggttgtttaacat

SEQ ID NO: 9404237 - DNA, 22 bp, Homo sapiens
tgagatttggaaaatttgatat

SEQ ID NO: 9404238 - DNA, 22 bp, Homo sapiens
tgagatttggaaaatttgatat

SEQ ID NO: 9404239 - DNA, 22 bp, Homo sapiens
tgagatttcgccgacagtattt

SEQ ID NO: 9404240 - DNA, 22 bp, Homo sapiens
tgagatgtaaggtatgcttact

SEQ ID NO: 9404241 - DNA, 22 bp, Homo sapiens
tgagattcagttgattagtgat

SEQ ID NO: 9404242 - DNA, 22 bp, Homo sapiens
tgagatgggtgtccagggagga

SEQ ID NO: 9404243 - DNA, 22 bp, Homo sapiens
tgagatggttgaccagagagca

SEQ ID NO: 9404244 - DNA, 22 bp, Homo sapiens
tgagatgtaaggtatgcttact

SEQ ID NO: 9404245 - DNA, 22 bp, Homo sapiens
tgagatggagttttggggatat

SEQ ID NO: 9404246 - DNA, 22 bp, Homo sapiens
tgagatggattgggttggttcc

SEQ ID NO: 9404247 - DNA, 22 bp, Homo sapiens
tgagatgggatgtgcacttggc

SEQ ID NO: 9404248 - DNA, 22 bp, Homo sapiens
tgagatggggagggctgcagaa

SEQ ID NO: 9404249 - DNA, 22 bp, Homo sapiens
tgagatgggtcatcaggtttgg

SEQ ID NO: 9404250 - DNA, 22 bp, Homo sapiens
tgagatgggtggggagctcagg

SEQ ID NO: 9404251 - DNA, 22 bp, Homo sapiens
tgagatggggagggctgcagaa

SEQ ID NO: 9404252 - DNA, 22 bp, Homo sapiens
tgagatggggtcatgctttgtc

SEQ ID NO: 9404253 - DNA, 22 bp, Homo sapiens
tgagatggagtctcactctgtt

SEQ ID NO: 9404254 - DNA, 22 bp, Homo sapiens
tgagatggagtctcgctctgtt

SEQ ID NO: 9404255 - DNA, 22 bp, Homo sapiens
tgagatggagtctcgctctgtt

SEQ ID NO: 9404256 - DNA, 22 bp, Homo sapiens
tgagatggagtcttgctctgtt

SEQ ID NO: 9404257 - DNA, 22 bp, Homo sapiens
tgagatggagttctgctcttgt

SEQ ID NO: 9404258 - DNA, 22 bp, Homo sapiens
tgagatggaaggtgaggcagta

SEQ ID NO: 9404259 - DNA, 22 bp, Homo sapiens
tgagatggaaggtgaggcagta

SEQ ID NO: 9404260 - DNA, 22 bp, Homo sapiens
tgagatggaaggtgaggcagta

SEQ ID NO: 9404261 - DNA, 22 bp, Homo sapiens
tgagatgatgggataagagggc

SEQ ID NO: 9404262 - DNA, 22 bp, Homo sapiens
tgagatgatgggataagagggc

SEQ ID NO: 9404263 - DNA, 23 bp, Homo sapiens
tgagatctttgtagtatcaatga

SEQ ID NO: 9404264 - DNA, 22 bp, Homo sapiens
tgagatctgtgcatgttagtta

SEQ ID NO: 9404265 - DNA, 22 bp, Homo sapiens
tgagatcttcgctcttcacaga

SEQ ID NO: 9404266 - DNA, 22 bp, Homo sapiens
tgagatccccaggaaggacaac

SEQ ID NO: 9404267 - DNA, 23 bp, Homo sapiens
tgagatctacagatctcagatct

SEQ ID NO: 9404268 - DNA, 22 bp, Homo sapiens
tgagatcatttatttacctttc

SEQ ID NO: 9404269 - DNA, 22 bp, Homo sapiens
tgagaggtcaaagggcatggag

SEQ ID NO: 9404270 - DNA, 22 bp, Homo sapiens
tgagatatctgttaattttctt

SEQ ID NO: 9404271 - DNA, 23 bp, Homo sapiens
tgagataggtattattatcatgc

SEQ ID NO: 9404272 - DNA, 22 bp, Homo sapiens
tgagatcaaaattggtattaga

SEQ ID NO: 9404273 - DNA, 22 bp, Homo sapiens
tgagagggcccagagcacacca

SEQ ID NO: 9404274 - DNA, 22 bp, Homo sapiens
tgagagggttcccaggggtttc

SEQ ID NO: 9404275 - DNA, 22 bp, Homo sapiens
tgagagggcccagagcacacca

SEQ ID NO: 9404276 - DNA, 22 bp, Homo sapiens
tgagagggcccagagcacacca

SEQ ID NO: 9404277 - DNA, 19 bp, Homo sapiens
tgagaggcttaaggcagct

SEQ ID NO: 9404278 - DNA, 18 bp, Homo sapiens
tgagaggcaggtagagga

SEQ ID NO: 9404279 - DNA, 22 bp, Homo sapiens
tgagaggcgctcactctcaggt

SEQ ID NO: 9404280 - DNA, 18 bp, Homo sapiens
tgagaggctattttttgc

SEQ ID NO: 9404281 - DNA, 22 bp, Homo sapiens
tgagaggctagatcagctctgt

SEQ ID NO: 9404282 - DNA, 22 bp, Homo sapiens
tgagaggctagatcagctctgt

SEQ ID NO: 9404283 - DNA, 22 bp, Homo sapiens
tgagaggagtgattgtaaaatt

SEQ ID NO: 9404284 - DNA, 20 bp, Homo sapiens
tgagaggacatttttcatgt

SEQ ID NO: 9404285 - DNA, 22 bp, Homo sapiens
tgagaggaacaggcagtaggtt

SEQ ID NO: 9404286 - DNA, 22 bp, Homo sapiens
tgagaggaacaggcagtaggtt

SEQ ID NO: 9404287 - DNA, 22 bp, Homo sapiens
tgagaggatattttgggaggat

SEQ ID NO: 9404288 - DNA, 22 bp, Homo sapiens
tgagaggatattttgggaggat

SEQ ID NO: 9404289 - DNA, 22 bp, Homo sapiens
tgagaggatattttgggaggat

SEQ ID NO: 9404290 - DNA, 22 bp, Homo sapiens
tgagaggagtgattgtaaaatt

SEQ ID NO: 9404291 - DNA, 22 bp, Homo sapiens
tgagaggatattttgggaggat

SEQ ID NO: 9404292 - DNA, 22 bp, Homo sapiens
tgagaggaacaggcagtaggtt

SEQ ID NO: 9404293 - DNA, 21 bp, Homo sapiens
tgagagcctccaaccggctac

SEQ ID NO: 9404294 - DNA, 22 bp, Homo sapiens
tgagagccaggatctgctctat

SEQ ID NO: 9404295 - DNA, 22 bp, Homo sapiens
tgagagccaggatctgctctat

SEQ ID NO: 9404296 - DNA, 18 bp, Homo sapiens
tgagagcctgcttgtccc

SEQ ID NO: 9404297 - DNA, 18 bp, Homo sapiens
tgagagcctgcttgtccc

SEQ ID NO: 9404298 - DNA, 23 bp, Homo sapiens
tgagagcctggcagcctgggttc

SEQ ID NO: 9404299 - DNA, 23 bp, Homo sapiens
tgagagcctggcagcctgggttc

SEQ ID NO: 9404300 - DNA, 17 bp, Homo sapiens
tgagagcagggctgggc

SEQ ID NO: 9404301 - DNA, 17 bp, Homo sapiens
tgagagcagggctgggc

SEQ ID NO: 9404302 - DNA, 17 bp, Homo sapiens
tgagagcagggctgggc

SEQ ID NO: 9404303 - DNA, 17 bp, Homo sapiens
tgagagcagggctgggc

SEQ ID NO: 9404304 - DNA, 22 bp, Homo sapiens
tgagagcagaggtgggcagcct

SEQ ID NO: 9404305 - DNA, 22 bp, Homo sapiens
tgagagatgaagttagttgttc

SEQ ID NO: 9404306 - DNA, 22 bp, Homo sapiens
tgagagattgctgtatgttttg

SEQ ID NO: 9404307 - DNA, 22 bp, Homo sapiens
tgagagatgaagttagttgttc

SEQ ID NO: 9404308 - DNA, 22 bp, Homo sapiens
tgagagcaacacgcagtagtat

SEQ ID NO: 9404309 - DNA, 22 bp, Homo sapiens
tgagagcacacagaaatatttt

SEQ ID NO: 9404310 - DNA, 21 bp, Homo sapiens
tgagagagtagcaggacatat

SEQ ID NO: 9404311 - DNA, 21 bp, Homo sapiens
tgagagagtagcaggacatat

SEQ ID NO: 9404312 - DNA, 21 bp, Homo sapiens
tgagagagtagcaggacatat

SEQ ID NO: 9404313 - DNA, 21 bp, Homo sapiens
tgagagagtagcaggacatat

SEQ ID NO: 9404314 - DNA, 21 bp, Homo sapiens
tgagagagtagcaggacatat

SEQ ID NO: 9404315 - DNA, 21 bp, Homo sapiens
tgagagagtagcaggacatat

SEQ ID NO: 9404316 - DNA, 22 bp, Homo sapiens
tgagagagtaattgagtggtaa

SEQ ID NO: 9404317 - DNA, 22 bp, Homo sapiens
tgagagagtaattgagtggtaa

SEQ ID NO: 9404318 - DNA, 22 bp, Homo sapiens
tgagagagtaattgagtggtaa

SEQ ID NO: 9404319 - DNA, 22 bp, Homo sapiens
tgagagagtaattgagtggtaa

SEQ ID NO: 9404320 - DNA, 22 bp, Homo sapiens
tgagagaggatgccctcatatt

SEQ ID NO: 9404321 - DNA, 22 bp, Homo sapiens
tgagagaggggactgcctgctt

SEQ ID NO: 9404322 - DNA, 22 bp, Homo sapiens
tgagagagggatgcaccctcct

SEQ ID NO: 9404323 - DNA, 22 bp, Homo sapiens
tgagagagcctgaatctcttac

SEQ ID NO: 9404324 - DNA, 21 bp, Homo sapiens
tgagagactggtggatacagg

SEQ ID NO: 9404325 - DNA, 22 bp, Homo sapiens
tgagagagcgcctgggatcatt

SEQ ID NO: 9404326 - DNA, 22 bp, Homo sapiens
tgagacttgtgagtccttctag

SEQ ID NO: 9404327 - DNA, 22 bp, Homo sapiens
tgagacttgtgagtccttctag

SEQ ID NO: 9404328 - DNA, 22 bp, Homo sapiens
tgagagacacactgtgcatgta

SEQ ID NO: 9404329 - DNA, 22 bp, Homo sapiens
tgagaagcattaggaagaacat

SEQ ID NO: 9404330 - DNA, 23 bp, Homo sapiens
tgagaagccaggggagcgtgagg

SEQ ID NO: 9404331 - DNA, 23 bp, Homo sapiens
tgagaagccattagagcaggtgg

SEQ ID NO: 9404332 - DNA, 22 bp, Homo sapiens
tgagaagcccaagccgggtggt

SEQ ID NO: 9404333 - DNA, 22 bp, Homo sapiens
tgagaagagcaaggaactggtt

SEQ ID NO: 9404334 - DNA, 22 bp, Homo sapiens
tgagaagattgggcagagtgga

SEQ ID NO: 9404335 - DNA, 22 bp, Homo sapiens
tgagaagcagtttcagtaagaa

SEQ ID NO: 9404336 - DNA, 22 bp, Homo sapiens
tgagaagcagcttacaggtgtc

SEQ ID NO: 9404337 - DNA, 22 bp, Homo sapiens
tgagaagcagcttacaggtgtc

SEQ ID NO: 9404338 - DNA, 22 bp, Homo sapiens
tgagaacaaagttgaaagtttg

SEQ ID NO: 9404339 - DNA, 22 bp, Homo sapiens
tgagaacacattcgtgccctac

SEQ ID NO: 9404340 - DNA, 22 bp, Homo sapiens
tgagaacttgtgctattgcaca

SEQ ID NO: 9404341 - DNA, 22 bp, Homo sapiens
tgagaactggtttctattcatg

SEQ ID NO: 9404342 - DNA, 22 bp, Homo sapiens
tgagaactgaggatttgaattc

SEQ ID NO: 9404343 - DNA, 22 bp, Homo sapiens
tgagaaaatccagaggctagtt

SEQ ID NO: 9404344 - DNA, 22 bp, Homo sapiens
tgagaaaattactataattgtc

SEQ ID NO: 9404345 - DNA, 22 bp, Homo sapiens
tgagaaacacaggcatgaatag

SEQ ID NO: 9404346 - DNA, 22 bp, Homo sapiens
tgagaaagacagacattcctaa

SEQ ID NO: 9404347 - DNA, 22 bp, Homo sapiens
tgagaaaggtatttcatgcact

SEQ ID NO: 9404348 - DNA, 22 bp, Homo sapiens
tgagaaattcgacatatattta

SEQ ID NO: 9404349 - DNA, 22 bp, Homo sapiens
tgagaaatccagatgtgcagtt

SEQ ID NO: 9404350 - DNA, 20 bp, Homo sapiens
tgagaaagtagagactcagg

SEQ ID NO: 9404351 - DNA, 22 bp, Homo sapiens
tgagaaaggtatttcatgcact

SEQ ID NO: 9404352 - DNA, 22 bp, Homo sapiens
tgagaaaggtatttcatgcact

SEQ ID NO: 9404353 - DNA, 20 bp, Homo sapiens
tgagaaagtagagactcagg

SEQ ID NO: 9404354 - DNA, 22 bp, Homo sapiens
tgagacagcagattagcaatga

SEQ ID NO: 9404355 - DNA, 22 bp, Homo sapiens
tgagacaaagcagctgacagaa

SEQ ID NO: 9404356 - DNA, 22 bp, Homo sapiens
tgagacaaagcagctgacagaa

SEQ ID NO: 9404357 - DNA, 22 bp, Homo sapiens
tgagacaatattaacctatctt

SEQ ID NO: 9404358 - DNA, 22 bp, Homo sapiens
tgagacaatatcctttgtaacc

SEQ ID NO: 9404359 - DNA, 22 bp, Homo sapiens
tgagacaatatcctttgtaacc

SEQ ID NO: 9404360 - DNA, 22 bp, Homo sapiens
tgagacaataaggctgagaagc

SEQ ID NO: 9404361 - DNA, 22 bp, Homo sapiens
tgagacaataaggctgagaagc

SEQ ID NO: 9404362 - DNA, 22 bp, Homo sapiens
tgagaagctgctgacttagcct

SEQ ID NO: 9404363 - DNA, 22 bp, Homo sapiens
tgagaagctgcttgtgctgtat

SEQ ID NO: 9404364 - DNA, 22 bp, Homo sapiens
tgagaattttcagtttcacttt

SEQ ID NO: 9404365 - DNA, 22 bp, Homo sapiens
tgagaatttgtgaacttttctc

SEQ ID NO: 9404366 - DNA, 22 bp, Homo sapiens
tgagacaaaattgacagacaaa

SEQ ID NO: 9404367 - DNA, 22 bp, Homo sapiens
tgagacaaaattgacagacaaa

SEQ ID NO: 9404368 - DNA, 22 bp, Homo sapiens
tgagacagcccttctgcacagg

SEQ ID NO: 9404369 - DNA, 22 bp, Homo sapiens
tgagacagcagtcagggaaata

SEQ ID NO: 9404370 - DNA, 19 bp, Homo sapiens
tgagacagggattcaggtg

SEQ ID NO: 9404371 - DNA, 22 bp, Homo sapiens
tctttgtaaatgcctagcataa

SEQ ID NO: 9404372 - DNA, 22 bp, Homo sapiens
tctttgtaactgtctattgaga

SEQ ID NO: 9404373 - DNA, 22 bp, Homo sapiens
tctttggcacttctgttttaag

SEQ ID NO: 9404374 - DNA, 19 bp, Homo sapiens
tctttgtacaagtctctgc

SEQ ID NO: 9404375 - DNA, 22 bp, Homo sapiens
tctttgtactttctggctgtcc

SEQ ID NO: 9404376 - DNA, 22 bp, Homo sapiens
tctttgtgccatgcagtgaggc

SEQ ID NO: 9404377 - DNA, 18 bp, Homo sapiens
tctttggacaactactgg

SEQ ID NO: 9404378 - DNA, 22 bp, Homo sapiens
tctttggatcccaactggctgg

SEQ ID NO: 9404379 - DNA, 22 bp, Homo sapiens
tctttgcatcccttccatagtt

SEQ ID NO: 9404380 - DNA, 22 bp, Homo sapiens
tctttgctattgtgagtagtgc

SEQ ID NO: 9404381 - DNA, 22 bp, Homo sapiens
tctttggaatgctagcattcta

SEQ ID NO: 9404382 - DNA, 22 bp, Homo sapiens
tctttgctgagtacatctccaa

SEQ ID NO: 9404383 - DNA, 22 bp, Homo sapiens
tctttgcaggccaaattgttaa

SEQ ID NO: 9404384 - DNA, 22 bp, Homo sapiens
tctttgcactgtgcaagcagaa

SEQ ID NO: 9404385 - DNA, 22 bp, Homo sapiens
tctttgcagaatttaactttgc

SEQ ID NO: 9404386 - DNA, 22 bp, Homo sapiens
tctttgcaaatgttattatctt

SEQ ID NO: 9404387 - DNA, 22 bp, Homo sapiens
tctttgcaaaatacaacaatgg

SEQ ID NO: 9404388 - DNA, 22 bp, Homo sapiens
tcttttatagtgaattttcttg

SEQ ID NO: 9404389 - DNA, 22 bp, Homo sapiens
tcttttatagtgaattttcttg

SEQ ID NO: 9404390 - DNA, 22 bp, Homo sapiens
tcttttatagtgaattttcttg

SEQ ID NO: 9404391 - DNA, 22 bp, Homo sapiens
tcttttatcctacatttagctc

SEQ ID NO: 9404392 - DNA, 22 bp, Homo sapiens
tcttttagagcatttctgattc

SEQ ID NO: 9404393 - DNA, 22 bp, Homo sapiens
tcttttagtaataaatatttgt

SEQ ID NO: 9404394 - DNA, 21 bp, Homo sapiens
tcttttaacaccaggaattcc

SEQ ID NO: 9404395 - DNA, 22 bp, Homo sapiens
tcttttaacctaactagcttgg

SEQ ID NO: 9404396 - DNA, 22 bp, Homo sapiens
tcttttaagcctctggcatagg

SEQ ID NO: 9404397 - DNA, 22 bp, Homo sapiens
tcttttagaaaagttgaatgta

SEQ ID NO: 9404398 - DNA, 20 bp, Homo sapiens
tctttgttaattttatctcc

SEQ ID NO: 9404399 - DNA, 22 bp, Homo sapiens
tctttgttattgctttatctat

SEQ ID NO: 9404400 - DNA, 22 bp, Homo sapiens
tctttgtttgtactgttagaat

SEQ ID NO: 9404401 - DNA, 21 bp, Homo sapiens
tcttttaacaccaggaattcc

SEQ ID NO: 9404402 - DNA, 21 bp, Homo sapiens
tcttttaacaccaggaattcc

SEQ ID NO: 9404403 - DNA, 22 bp, Homo sapiens
tctttgtttgcctttatcaaga

SEQ ID NO: 9404404 - DNA, 22 bp, Homo sapiens
tctttgtttgtactgttagaat

SEQ ID NO: 9404405 - DNA, 22 bp, Homo sapiens
tcttttcatcatttaataggta

SEQ ID NO: 9404406 - DNA, 22 bp, Homo sapiens
tcttttcacagacaaatggaga

SEQ ID NO: 9404407 - DNA, 22 bp, Homo sapiens
tcttttcacaaaggagctggag

SEQ ID NO: 9404408 - DNA, 22 bp, Homo sapiens
tcttttatcctacatttagctc

SEQ ID NO: 9404409 - DNA, 22 bp, Homo sapiens
tcttttatctgttgtgtaacaa

SEQ ID NO: 9404410 - DNA, 20 bp, Homo sapiens
tcttttattggcagatcctg

SEQ ID NO: 9404411 - DNA, 20 bp, Homo sapiens
tcttttattggcagatcctg

SEQ ID NO: 9404412 - DNA, 22 bp, Homo sapiens
tcttttattaggctgaaatggg

SEQ ID NO: 9404413 - DNA, 22 bp, Homo sapiens
tcttttattaggctgaaatggg

SEQ ID NO: 9404414 - DNA, 22 bp, Homo sapiens
tcttttccttccctacagatct

SEQ ID NO: 9404415 - DNA, 18 bp, Homo sapiens
tcttttccttccacttcc

SEQ ID NO: 9404416 - DNA, 21 bp, Homo sapiens
tcttttcctttctgtgtgcaa

SEQ ID NO: 9404417 - DNA, 22 bp, Homo sapiens
tcttttctagcaaatccaggag

SEQ ID NO: 9404418 - DNA, 22 bp, Homo sapiens
tcttttctagcaaatccaggag

SEQ ID NO: 9404419 - DNA, 21 bp, Homo sapiens
tcttttctcagctttgtggtt

SEQ ID NO: 9404420 - DNA, 22 bp, Homo sapiens
tcttttctagcaaatccaggag

SEQ ID NO: 9404421 - DNA, 21 bp, Homo sapiens
tcttttctctgcaggattcct

SEQ ID NO: 9404422 - DNA, 22 bp, Homo sapiens
tcttttctccagacctgggatc

SEQ ID NO: 9404423 - DNA, 21 bp, Homo sapiens
tcttttctctgcaggattcct

SEQ ID NO: 9404424 - DNA, 22 bp, Homo sapiens
tgaaagaactagcatcttcaag

SEQ ID NO: 9404425 - DNA, 22 bp, Homo sapiens
tgaaagaactagcatcttcaag

SEQ ID NO: 9404426 - DNA, 21 bp, Homo sapiens
tgaaagaggatgtggtcattc

SEQ ID NO: 9404427 - DNA, 21 bp, Homo sapiens
tgaaagaggatgtggtcattc

SEQ ID NO: 9404428 - DNA, 17 bp, Homo sapiens
tgaaagaatcagggaga

SEQ ID NO: 9404429 - DNA, 22 bp, Homo sapiens
tgaaagaagtgtcacattgcca

SEQ ID NO: 9404430 - DNA, 22 bp, Homo sapiens
tgaaacttgctaattgcacgta

SEQ ID NO: 9404431 - DNA, 22 bp, Homo sapiens
tgaaagaaacaggtatattggg

SEQ ID NO: 9404432 - DNA, 22 bp, Homo sapiens
tgaaagaaacaggtatattggg

SEQ ID NO: 9404433 - DNA, 22 bp, Homo sapiens
tgaaacggaatgttctttatcg

SEQ ID NO: 9404434 - DNA, 22 bp, Homo sapiens
tgaaacttataagaatatgaat

SEQ ID NO: 9404435 - DNA, 22 bp, Homo sapiens
tgaaacatttgatgatctttgg

SEQ ID NO: 9404436 - DNA, 21 bp, Homo sapiens
tgaaacatttgatcaaagcac

SEQ ID NO: 9404437 - DNA, 22 bp, Homo sapiens
tgaaacataaagttatcttcag

SEQ ID NO: 9404438 - DNA, 22 bp, Homo sapiens
tgaaacataaagttatcttcag

SEQ ID NO: 9404439 - DNA, 22 bp, Homo sapiens
tgaaacattatagaatatttat

SEQ ID NO: 9404440 - DNA, 22 bp, Homo sapiens
tgaaacattatagaatatttat

SEQ ID NO: 9404441 - DNA, 22 bp, Homo sapiens
tgaaacattaggaaatcattat

SEQ ID NO: 9404442 - DNA, 22 bp, Homo sapiens
tgaaacattaggaaatcattat

SEQ ID NO: 9404443 - DNA, 19 bp, Homo sapiens
tgaaacaaacttaaaagga

SEQ ID NO: 9404444 - DNA, 22 bp, Homo sapiens
tgaaacaaaccagtaattttgt

SEQ ID NO: 9404445 - DNA, 23 bp, Homo sapiens
tctttttaagagatctagtgacg

SEQ ID NO: 9404446 - DNA, 23 bp, Homo sapiens
tctttttaagagatctagtgacg

SEQ ID NO: 9404447 - DNA, 22 bp, Homo sapiens
tcttttgttgatggaattaatg

SEQ ID NO: 9404448 - DNA, 22 bp, Homo sapiens
tctttttcttattcccacactg

SEQ ID NO: 9404449 - DNA, 22 bp, Homo sapiens
tctttttttcctgtgcagagct

SEQ ID NO: 9404450 - DNA, 22 bp, Homo sapiens
tgaaaactccaagtttcatcag

SEQ ID NO: 9404451 - DNA, 22 bp, Homo sapiens
tgaaaaactttaatccataaag

SEQ ID NO: 9404452 - DNA, 22 bp, Homo sapiens
tgaaaaacactaattggaaagc

SEQ ID NO: 9404453 - DNA, 22 bp, Homo sapiens
tgaaaaaacaagttggcccatt

SEQ ID NO: 9404454 - DNA, 22 bp, Homo sapiens
tgaaaaaacaagttggcccatt

SEQ ID NO: 9404455 - DNA, 22 bp, Homo sapiens
tgaaaatatagttttccagact

SEQ ID NO: 9404456 - DNA, 22 bp, Homo sapiens
tgaaaatatagttttccagact

SEQ ID NO: 9404457 - DNA, 22 bp, Homo sapiens
tgaaaatatagttttccagact

SEQ ID NO: 9404458 - DNA, 22 bp, Homo sapiens
tgaaaagggtagatccctaagt

SEQ ID NO: 9404459 - DNA, 22 bp, Homo sapiens
tgaaaagtcttatattgtctga

SEQ ID NO: 9404460 - DNA, 22 bp, Homo sapiens
tgaaaagactgcaagagagcat

SEQ ID NO: 9404461 - DNA, 22 bp, Homo sapiens
tgaaacaaaagtatgtagcttg

SEQ ID NO: 9404462 - DNA, 22 bp, Homo sapiens
tgaaaattgttgtacttgataa

SEQ ID NO: 9404463 - DNA, 22 bp, Homo sapiens
tgaaaattgttgtacttgataa

SEQ ID NO: 9404464 - DNA, 22 bp, Homo sapiens
tgaaaattcatctcatagcaga

SEQ ID NO: 9404465 - DNA, 22 bp, Homo sapiens
tgaaaatgccctctatgtctca

SEQ ID NO: 9404466 - DNA, 22 bp, Homo sapiens
tgaagcagaggggtcttgagct

SEQ ID NO: 9404467 - DNA, 22 bp, Homo sapiens
tgaagcagagaatttgacagtc

SEQ ID NO: 9404468 - DNA, 22 bp, Homo sapiens
tgaagcagagaatttgacagtc

SEQ ID NO: 9404469 - DNA, 19 bp, Homo sapiens
tgaagcaataccatttttg

SEQ ID NO: 9404470 - DNA, 22 bp, Homo sapiens
tgaagcaaatttttctcagagt

SEQ ID NO: 9404471 - DNA, 19 bp, Homo sapiens
tgaagcaggcagagaagat

SEQ ID NO: 9404472 - DNA, 22 bp, Homo sapiens
tgaagcagttctcagaagtggg

SEQ ID NO: 9404473 - DNA, 20 bp, Homo sapiens
tgaagcagccttgattctgt

SEQ ID NO: 9404474 - DNA, 19 bp, Homo sapiens
tgaagcagcaaactctcag

SEQ ID NO: 9404475 - DNA, 22 bp, Homo sapiens
tgaagcagcaccattttagagc

SEQ ID NO: 9404476 - DNA, 22 bp, Homo sapiens
tgaagaaacagaccaagaggat

SEQ ID NO: 9404477 - DNA, 22 bp, Homo sapiens
tgaagaaacgcagagaggtagg

SEQ ID NO: 9404478 - DNA, 22 bp, Homo sapiens
tgaagaaacgcagagaggtagg

SEQ ID NO: 9404479 - DNA, 22 bp, Homo sapiens
tgaagaagccaattggtaggct

SEQ ID NO: 9404480 - DNA, 22 bp, Homo sapiens
tgaagaataaatggttgagact

SEQ ID NO: 9404481 - DNA, 22 bp, Homo sapiens
tgaagaataagatagatggagc

SEQ ID NO: 9404482 - DNA, 18 bp, Homo sapiens
tgaagacatgaggttagt

SEQ ID NO: 9404483 - DNA, 22 bp, Homo sapiens
tgaagactcagaagctaagata

SEQ ID NO: 9404484 - DNA, 22 bp, Homo sapiens
tgaagactcagaagctaagata

SEQ ID NO: 9404485 - DNA, 22 bp, Homo sapiens
tgaagactcagaagctaagata

SEQ ID NO: 9404486 - DNA, 22 bp, Homo sapiens
tgaagacaagaaaacactgggg

SEQ ID NO: 9404487 - DNA, 22 bp, Homo sapiens
tgaagaatgttgcagtgagcat

SEQ ID NO: 9404488 - DNA, 22 bp, Homo sapiens
tgaagaatgttgcagtgagcat

SEQ ID NO: 9404489 - DNA, 22 bp, Homo sapiens
tgaagaatgtgaattggtagct

SEQ ID NO: 9404490 - DNA, 22 bp, Homo sapiens
tgaagaatcccagggaatttgg

SEQ ID NO: 9404491 - DNA, 22 bp, Homo sapiens
tgaagaatcagattggcctgcg

SEQ ID NO: 9404492 - DNA, 22 bp, Homo sapiens
tgaacaaactgcattcttcact

SEQ ID NO: 9404493 - DNA, 22 bp, Homo sapiens
tgaacaaactgcattcttcact

SEQ ID NO: 9404494 - DNA, 23 bp, Homo sapiens
tgaacaaaggcaggagaaggcgg

SEQ ID NO: 9404495 - DNA, 22 bp, Homo sapiens
tgaaattcattgttttatgtgt

SEQ ID NO: 9404496 - DNA, 23 bp, Homo sapiens
tgaaattgtagagattttgtgtg

SEQ ID NO: 9404497 - DNA, 22 bp, Homo sapiens
tgaaattagtgaagttacagtt

SEQ ID NO: 9404498 - DNA, 22 bp, Homo sapiens
tgaaattcaaaacacatttgtc

SEQ ID NO: 9404499 - DNA, 22 bp, Homo sapiens
tgaaattatgcattgttgtacc

SEQ ID NO: 9404500 - DNA, 22 bp, Homo sapiens
tgaaattatgcattgttgtacc

SEQ ID NO: 9404501 - DNA, 22 bp, Homo sapiens
tgaacaaatgaatcagtgtagc

SEQ ID NO: 9404502 - DNA, 22 bp, Homo sapiens
tgaacaaatggaaataaccagt

SEQ ID NO: 9404503 - DNA, 22 bp, Homo sapiens
tgaacacacacctatgtacaaa

SEQ ID NO: 9404504 - DNA, 22 bp, Homo sapiens
tgaacagtcatttagaatgtgc

SEQ ID NO: 9404505 - DNA, 22 bp, Homo sapiens
tgaacagtgggcatgtgaagac

SEQ ID NO: 9404506 - DNA, 22 bp, Homo sapiens
tgaacagtggttcatgtcacgg

SEQ ID NO: 9404507 - DNA, 22 bp, Homo sapiens
tgaacagtgatctacatgtggc

SEQ ID NO: 9404508 - DNA, 22 bp, Homo sapiens
tgaacagtttcaagaaaacttt

SEQ ID NO: 9404509 - DNA, 22 bp, Homo sapiens
tgaacatacaattattaagaac

SEQ ID NO: 9404510 - DNA, 22 bp, Homo sapiens
tgaacagtttcaagaaaacttt

SEQ ID NO: 9404511 - DNA, 22 bp, Homo sapiens
tgaacagtgtatctagatcatg

SEQ ID NO: 9404512 - DNA, 22 bp, Homo sapiens
tgaacagttactttgtagaaga

SEQ ID NO: 9404513 - DNA, 22 bp, Homo sapiens
tgaacagtgtgagggtgtgacc

SEQ ID NO: 9404514 - DNA, 22 bp, Homo sapiens
tgaacattagttgagtaaagtc

SEQ ID NO: 9404515 - DNA, 22 bp, Homo sapiens
tgaacatgctgttgatggcctg

SEQ ID NO: 9404516 - DNA, 22 bp, Homo sapiens
tgaacattcctgaatgaagcat

SEQ ID NO: 9404517 - DNA, 22 bp, Homo sapiens
tgaacattggcacaaggcagca

SEQ ID NO: 9404518 - DNA, 22 bp, Homo sapiens
tgaacatgctgttgatggcctg

SEQ ID NO: 9404519 - DNA, 22 bp, Homo sapiens
tgaacatgctgttgatggcctg

SEQ ID NO: 9404520 - DNA, 22 bp, Homo sapiens
tgaacatattcacctctaaata

SEQ ID NO: 9404521 - DNA, 22 bp, Homo sapiens
tgaacatgctgttgatggcctg

SEQ ID NO: 9404522 - DNA, 22 bp, Homo sapiens
tgaacatacaattattaagaac

SEQ ID NO: 9404523 - DNA, 22 bp, Homo sapiens
tgaacattgtcacattcctagc

SEQ ID NO: 9404524 - DNA, 22 bp, Homo sapiens
tgaacgttcatagttatttgtt

SEQ ID NO: 9404525 - DNA, 22 bp, Homo sapiens
tgaaagcacaagttctaacagg

SEQ ID NO: 9404526 - DNA, 22 bp, Homo sapiens
tgaaaggtagctggcctcatag

SEQ ID NO: 9404527 - DNA, 22 bp, Homo sapiens
tgaaagataagttattatgtac

SEQ ID NO: 9404528 - DNA, 22 bp, Homo sapiens
tgaaagataagttattatgtac

SEQ ID NO: 9404529 - DNA, 22 bp, Homo sapiens
tgaaagatgaaagcaggctggt

SEQ ID NO: 9404530 - DNA, 22 bp, Homo sapiens
tgaaagatgctcaatgaatggt

SEQ ID NO: 9404531 - DNA, 22 bp, Homo sapiens
tgaaagttattactgatgatgt

SEQ ID NO: 9404532 - DNA, 22 bp, Homo sapiens
tgaaagttattactgatgatgt

SEQ ID NO: 9404533 - DNA, 22 bp, Homo sapiens
tgaaagttacaggaaaacagat

SEQ ID NO: 9404534 - DNA, 22 bp, Homo sapiens
tgaaagttaggatgtagtaatt

SEQ ID NO: 9404535 - DNA, 21 bp, Homo sapiens
tgaaagttggagtcaaatgta

SEQ ID NO: 9404536 - DNA, 22 bp, Homo sapiens
tgaaagttgcacataagagaat

SEQ ID NO: 9404537 - DNA, 23 bp, Homo sapiens
tgaaagttctgaagagatcatgc

SEQ ID NO: 9404538 - DNA, 22 bp, Homo sapiens
tgaaaggtgacatttcttggat

SEQ ID NO: 9404539 - DNA, 20 bp, Homo sapiens
tgaaaggtgggaattgtggg

SEQ ID NO: 9404540 - DNA, 22 bp, Homo sapiens
tgaaaggtgtccaatatttctc

SEQ ID NO: 9404541 - DNA, 22 bp, Homo sapiens
tgaaaggttatttaggtctgct

SEQ ID NO: 9404542 - DNA, 22 bp, Homo sapiens
tgaaaggttaaaagtagtattg

SEQ ID NO: 9404543 - DNA, 22 bp, Homo sapiens
tgaaatatgctcccattcactt

SEQ ID NO: 9404544 - DNA, 22 bp, Homo sapiens
tgaaatcaactaggagacacca

SEQ ID NO: 9404545 - DNA, 22 bp, Homo sapiens
tgaaatcaattgcaatgtttat

SEQ ID NO: 9404546 - DNA, 22 bp, Homo sapiens
tgaaatcaatgtcttctgtctc

SEQ ID NO: 9404547 - DNA, 17 bp, Homo sapiens
tgaaatcagcacccagg

SEQ ID NO: 9404548 - DNA, 22 bp, Homo sapiens
tgaaatcaattgcaatgtttat

SEQ ID NO: 9404549 - DNA, 22 bp, Homo sapiens
tgaaatcagtatgtctttctca

SEQ ID NO: 9404550 - DNA, 22 bp, Homo sapiens
tgaaatcagtggtataatcggg

SEQ ID NO: 9404551 - DNA, 22 bp, Homo sapiens
tgaaatcagtatgtctttctca

SEQ ID NO: 9404552 - DNA, 22 bp, Homo sapiens
tgaaatcatcaaaagagccatt

SEQ ID NO: 9404553 - DNA, 22 bp, Homo sapiens
tgaaatcatctgccaataagtt

SEQ ID NO: 9404554 - DNA, 22 bp, Homo sapiens
tgaaataatatctggatcaatc

SEQ ID NO: 9404555 - DNA, 22 bp, Homo sapiens
tgaaataatatctggatcaatc

SEQ ID NO: 9404556 - DNA, 22 bp, Homo sapiens
tgaaatactgagtgaaagaatt

SEQ ID NO: 9404557 - DNA, 22 bp, Homo sapiens
tgaaataggaaacagatgtttc

SEQ ID NO: 9404558 - DNA, 22 bp, Homo sapiens
tgaaatagtcaagtatttgaac

SEQ ID NO: 9404559 - DNA, 22 bp, Homo sapiens
tgaaatagacttgcactatatg

SEQ ID NO: 9404560 - DNA, 22 bp, Homo sapiens
tgaaatatcattttcatctccc

SEQ ID NO: 9404561 - DNA, 22 bp, Homo sapiens
tgaaatcttagccattctgcct

SEQ ID NO: 9404562 - DNA, 22 bp, Homo sapiens
tgaaatctgcatgcaaagtcct

SEQ ID NO: 9404563 - DNA, 22 bp, Homo sapiens
tgaaatcattggggttgaataa

SEQ ID NO: 9404564 - DNA, 22 bp, Homo sapiens
tgaaatcattggggttgaataa

SEQ ID NO: 9404565 - DNA, 22 bp, Homo sapiens
tgaaatcatgagatagtgtcac

SEQ ID NO: 9404566 - DNA, 22 bp, Homo sapiens
tgaaatcatgagatagtgtcac

SEQ ID NO: 9404567 - DNA, 22 bp, Homo sapiens
tgaaatcatgaacaaggtaggt

SEQ ID NO: 9404568 - DNA, 22 bp, Homo sapiens
tgaaatcattgccaagtattga

SEQ ID NO: 9404569 - DNA, 22 bp, Homo sapiens
tgaaatcattgccaagtattga

SEQ ID NO: 9404570 - DNA, 22 bp, Homo sapiens
tgaaatcatgtagttattgcaa

SEQ ID NO: 9404571 - DNA, 22 bp, Homo sapiens
tgaaatcatgtagttattgcaa

SEQ ID NO: 9404572 - DNA, 22 bp, Homo sapiens
tgaaatgcttttacaggatatt

SEQ ID NO: 9404573 - DNA, 22 bp, Homo sapiens
tgaaatgcttgggaccagaagt

SEQ ID NO: 9404574 - DNA, 22 bp, Homo sapiens
tgaaatggatgagagcagaggt

SEQ ID NO: 9404575 - DNA, 22 bp, Homo sapiens
tgaaatggcaaggcagagcttt

SEQ ID NO: 9404576 - DNA, 22 bp, Homo sapiens
tgaaatggcaaggcagagcttt

SEQ ID NO: 9404577 - DNA, 22 bp, Homo sapiens
tgaaatggatgagagcagaggt

SEQ ID NO: 9404578 - DNA, 22 bp, Homo sapiens
tgaaatgctgtagagactgtat

SEQ ID NO: 9404579 - DNA, 22 bp, Homo sapiens
tgaaatgctgtagagactgtat

SEQ ID NO: 9404580 - DNA, 22 bp, Homo sapiens
tgaaatgcttaggaccagaagg

SEQ ID NO: 9404581 - DNA, 22 bp, Homo sapiens
tgaaatgcaacagttatttttg

SEQ ID NO: 9404582 - DNA, 22 bp, Homo sapiens
tgaaatctttagtttctgtccc

SEQ ID NO: 9404583 - DNA, 22 bp, Homo sapiens
tgaaatgtgttctagtgttttg

SEQ ID NO: 9404584 - DNA, 22 bp, Homo sapiens
tgaaatgttggtaattttatat

SEQ ID NO: 9404585 - DNA, 22 bp, Homo sapiens
tgaaatgtcagtgttttataag

SEQ ID NO: 9404586 - DNA, 22 bp, Homo sapiens
tgaaatgtagattaggcattct

SEQ ID NO: 9404587 - DNA, 22 bp, Homo sapiens
tgaaatgtacataaaaacgcac

SEQ ID NO: 9404588 - DNA, 22 bp, Homo sapiens
tgaaatgtgtccatgttatttc

SEQ ID NO: 9404589 - DNA, 22 bp, Homo sapiens
tgaaatgtgtaatgtggatgcc

SEQ ID NO: 9404590 - DNA, 22 bp, Homo sapiens
tgaaatgtctttgcaattgaaa

SEQ ID NO: 9404591 - DNA, 21 bp, Homo sapiens
tgacatttccaatataaagcc

SEQ ID NO: 9404592 - DNA, 21 bp, Homo sapiens
tgacatttccaatataaagcc

SEQ ID NO: 9404593 - DNA, 22 bp, Homo sapiens
tgacatttatcttctacaatga

SEQ ID NO: 9404594 - DNA, 22 bp, Homo sapiens
tgacatttatcttctacaatga

SEQ ID NO: 9404595 - DNA, 22 bp, Homo sapiens
tgacatttatcttctacaatga

SEQ ID NO: 9404596 - DNA, 22 bp, Homo sapiens
tgacatttcagatatggtattt

SEQ ID NO: 9404597 - DNA, 21 bp, Homo sapiens
tgacatttagtagcattgtca

SEQ ID NO: 9404598 - DNA, 22 bp, Homo sapiens
tgacatttatcttctacaatga

SEQ ID NO: 9404599 - DNA, 22 bp, Homo sapiens
tgacatttatcaaagaaatggt

SEQ ID NO: 9404600 - DNA, 22 bp, Homo sapiens
tgacatgtccaggtggtcctgt

SEQ ID NO: 9404601 - DNA, 22 bp, Homo sapiens
tgacatgtcctgagaagatggc

SEQ ID NO: 9404602 - DNA, 22 bp, Homo sapiens
tgacatgtatgttgttggcatg

SEQ ID NO: 9404603 - DNA, 22 bp, Homo sapiens
tgacatgtgctcatcttggcta

SEQ ID NO: 9404604 - DNA, 22 bp, Homo sapiens
tgacatgtggctttgacccagg

SEQ ID NO: 9404605 - DNA, 22 bp, Homo sapiens
tgacatgtgtctccttccgtct

SEQ ID NO: 9404606 - DNA, 22 bp, Homo sapiens
tgacatgtgtaatcagctccgt

SEQ ID NO: 9404607 - DNA, 22 bp, Homo sapiens
tgacatgttagggaaatgtgat

SEQ ID NO: 9404608 - DNA, 22 bp, Homo sapiens
tgacatttaatccctaaatatt

SEQ ID NO: 9404609 - DNA, 22 bp, Homo sapiens
tgacatttaatccctaaatatt

SEQ ID NO: 9404610 - DNA, 22 bp, Homo sapiens
tgacatttaatccctaaatatt

SEQ ID NO: 9404611 - DNA, 22 bp, Homo sapiens
tgacatttaattaacgaatgct

SEQ ID NO: 9404612 - DNA, 22 bp, Homo sapiens
tgacatttaatccctaaatatt

SEQ ID NO: 9404613 - DNA, 22 bp, Homo sapiens
tgacatttaagcctctgatttc

SEQ ID NO: 9404614 - DNA, 22 bp, Homo sapiens
tgacatttttaaaaccactagt

SEQ ID NO: 9404615 - DNA, 22 bp, Homo sapiens
tgacattttatcaatatcacag

SEQ ID NO: 9404616 - DNA, 22 bp, Homo sapiens
tgacattttatcaatatcacag

SEQ ID NO: 9404617 - DNA, 21 bp, Homo sapiens
tgacatttggattcatagtaa

SEQ ID NO: 9404618 - DNA, 18 bp, Homo sapiens
tgaccctttctccctgtg

SEQ ID NO: 9404619 - DNA, 22 bp, Homo sapiens
tgacatttcttgttgatataaa

SEQ ID NO: 9404620 - DNA, 22 bp, Homo sapiens
tgacatttcttgttgatataaa

SEQ ID NO: 9404621 - DNA, 22 bp, Homo sapiens
tgacatttcggtgtatgtgatg

SEQ ID NO: 9404622 - DNA, 22 bp, Homo sapiens
tgacatttcggtgtatgtgatg

SEQ ID NO: 9404623 - DNA, 22 bp, Homo sapiens
tgacatttcggtgtatgtgatg

SEQ ID NO: 9404624 - DNA, 22 bp, Homo sapiens
tgacatttcctagtgctttgtg

SEQ ID NO: 9404625 - DNA, 22 bp, Homo sapiens
tgacatttgagcatacatgtaa

SEQ ID NO: 9404626 - DNA, 22 bp, Homo sapiens
tgacatttgagcatacatgtaa

SEQ ID NO: 9404627 - DNA, 22 bp, Homo sapiens
tgacatttgagcatacatgtaa

SEQ ID NO: 9404628 - DNA, 22 bp, Homo sapiens
tgacatttgagcatacatgtaa

SEQ ID NO: 9404629 - DNA, 22 bp, Homo sapiens
tgacatttgagagagatataca

SEQ ID NO: 9404630 - DNA, 22 bp, Homo sapiens
tgacatttcttgttgatataaa

SEQ ID NO: 9404631 - DNA, 22 bp, Homo sapiens
tgacgtcaactgcaaaggcctt

SEQ ID NO: 9404632 - DNA, 22 bp, Homo sapiens
tgacgttttaggtgttaaatcg

SEQ ID NO: 9404633 - DNA, 22 bp, Homo sapiens
tgactaaaataggacattaact

SEQ ID NO: 9404634 - DNA, 22 bp, Homo sapiens
tgactaattatgttactaatca

SEQ ID NO: 9404635 - DNA, 22 bp, Homo sapiens
tgacctttctctgggtgcttgg

SEQ ID NO: 9404636 - DNA, 22 bp, Homo sapiens
tgacctttgtgctagaaacata

SEQ ID NO: 9404637 - DNA, 22 bp, Homo sapiens
tgactctgaatttatgaaatgg

SEQ ID NO: 9404638 - DNA, 19 bp, Homo sapiens
tgactctgtggaacagaag

SEQ ID NO: 9404639 - DNA, 22 bp, Homo sapiens
tgactcttaaatatactgttga

SEQ ID NO: 9404640 - DNA, 22 bp, Homo sapiens
tgactattttttatagattcca

SEQ ID NO: 9404641 - DNA, 22 bp, Homo sapiens
tgactattttttatagattcca

SEQ ID NO: 9404642 - DNA, 22 bp, Homo sapiens
tgactattacggccacgaattt

SEQ ID NO: 9404643 - DNA, 22 bp, Homo sapiens
tgactattcacaattacaatag

SEQ ID NO: 9404644 - DNA, 22 bp, Homo sapiens
tgactctcccaagtttgaggga

SEQ ID NO: 9404645 - DNA, 22 bp, Homo sapiens
tgactccacaatttgacttata

SEQ ID NO: 9404646 - DNA, 22 bp, Homo sapiens
tgactgaaggactagattgatt

SEQ ID NO: 9404647 - DNA, 22 bp, Homo sapiens
tgactgagagagaactcagctt

SEQ ID NO: 9404648 - DNA, 21 bp, Homo sapiens
tgactgaggcttcttcacaca

SEQ ID NO: 9404649 - DNA, 22 bp, Homo sapiens
tgactttaaaataacaagttta

SEQ ID NO: 9404650 - DNA, 22 bp, Homo sapiens
tgacttgtctctttgggagaca

SEQ ID NO: 9404651 - DNA, 17 bp, Homo sapiens
tgacttaacagcaaggc

SEQ ID NO: 9404652 - DNA, 22 bp, Homo sapiens
tgacttactctagagaatgctg

SEQ ID NO: 9404653 - DNA, 22 bp, Homo sapiens
tgacttcctgcactcaggtgat

SEQ ID NO: 9404654 - DNA, 22 bp, Homo sapiens
tgacttcctgcactcaggtgat

SEQ ID NO: 9404655 - DNA, 22 bp, Homo sapiens
tgacttcctgcactcaggtgat

SEQ ID NO: 9404656 - DNA, 22 bp, Homo sapiens
tgacttctagcatttagcaacc

SEQ ID NO: 9404657 - DNA, 23 bp, Homo sapiens
tgacaggccagaagagcagctgg

SEQ ID NO: 9404658 - DNA, 23 bp, Homo sapiens
tgacaggccagaagagcagctgg

SEQ ID NO: 9404659 - DNA, 22 bp, Homo sapiens
tgacaggcgtttttctctagta

SEQ ID NO: 9404660 - DNA, 22 bp, Homo sapiens
tgacaggagggttgtggcaggg

SEQ ID NO: 9404661 - DNA, 22 bp, Homo sapiens
tgacaggcactgctgtagtgct

SEQ ID NO: 9404662 - DNA, 22 bp, Homo sapiens
tgacaggaggcttgaggccagg

SEQ ID NO: 9404663 - DNA, 22 bp, Homo sapiens
tgacagcataacactggtcttg

SEQ ID NO: 9404664 - DNA, 22 bp, Homo sapiens
tgacagcagcatagtgagcaat

SEQ ID NO: 9404665 - DNA, 22 bp, Homo sapiens
tgacaggtgattgtgaactaag

SEQ ID NO: 9404666 - DNA, 22 bp, Homo sapiens
tgacaggtgctgggggcagtgt

SEQ ID NO: 9404667 - DNA, 21 bp, Homo sapiens
tgacaggtatttatctggaaa

SEQ ID NO: 9404668 - DNA, 22 bp, Homo sapiens
tgacaggttcgttagtcatgtt

SEQ ID NO: 9404669 - DNA, 22 bp, Homo sapiens
tgacaggttcgttagtcatgtt

SEQ ID NO: 9404670 - DNA, 22 bp, Homo sapiens
tgacaggttgtgtaggtggcca

SEQ ID NO: 9404671 - DNA, 21 bp, Homo sapiens
tgacaggtttaggattaaaat

SEQ ID NO: 9404672 - DNA, 19 bp, Homo sapiens
tgacaggttttatgtgttt

SEQ ID NO: 9404673 - DNA, 22 bp, Homo sapiens
tgacatgtatgtatttgtttat

SEQ ID NO: 9404674 - DNA, 22 bp, Homo sapiens
tgacatgtatatcttacgctat

SEQ ID NO: 9404675 - DNA, 22 bp, Homo sapiens
tgacatgtaagatggaaaagcg

SEQ ID NO: 9404676 - DNA, 21 bp, Homo sapiens
tgacaggtatttatctggaaa

SEQ ID NO: 9404677 - DNA, 22 bp, Homo sapiens
tgacaggtcatataagcttgca

SEQ ID NO: 9404678 - DNA, 22 bp, Homo sapiens
tgacaggtgaaatgtccttatt

SEQ ID NO: 9404679 - DNA, 22 bp, Homo sapiens
tgacaggtgattgtgaactaag

SEQ ID NO: 9404680 - DNA, 22 bp, Homo sapiens
tgacaggggctggtggataaat

SEQ ID NO: 9404681 - DNA, 22 bp, Homo sapiens
tgacacagtagaaagatgatga

SEQ ID NO: 9404682 - DNA, 22 bp, Homo sapiens
tgacacataccgaaaatatttg

SEQ ID NO: 9404683 - DNA, 22 bp, Homo sapiens
tgacacatgcaccagtctttaa

SEQ ID NO: 9404684 - DNA, 22 bp, Homo sapiens
tgacacagggaaagcggatcca

SEQ ID NO: 9404685 - DNA, 22 bp, Homo sapiens
tgacacaggggaaggagtctgg

SEQ ID NO: 9404686 - DNA, 23 bp, Homo sapiens
tgacacaggtcaaaaataagatg

SEQ ID NO: 9404687 - DNA, 22 bp, Homo sapiens
tgacacagaaattaagctgtca

SEQ ID NO: 9404688 - DNA, 22 bp, Homo sapiens
tgacacactaggaaaagcattt

SEQ ID NO: 9404689 - DNA, 22 bp, Homo sapiens
tgacacagattagagacatacc

SEQ ID NO: 9404690 - DNA, 22 bp, Homo sapiens
tgacagacatggaagccagagt

SEQ ID NO: 9404691 - DNA, 17 bp, Homo sapiens
tgacagacatcatgagc

SEQ ID NO: 9404692 - DNA, 22 bp, Homo sapiens
tgacagacacaccttaggaaag

SEQ ID NO: 9404693 - DNA, 22 bp, Homo sapiens
tgacagacagcttctcatttta

SEQ ID NO: 9404694 - DNA, 22 bp, Homo sapiens
tgacagaccactgcaactctgt

SEQ ID NO: 9404695 - DNA, 23 bp, Homo sapiens
tgacagaccttcccagacagtca

SEQ ID NO: 9404696 - DNA, 22 bp, Homo sapiens
tgacagatgaagctggggacca

SEQ ID NO: 9404697 - DNA, 22 bp, Homo sapiens
tgacagattttttctgagctaa

SEQ ID NO: 9404698 - DNA, 22 bp, Homo sapiens
tgacagaaagaatatgtcaatc

SEQ ID NO: 9404699 - DNA, 22 bp, Homo sapiens
tgacactttgtgactctgagaa

SEQ ID NO: 9404700 - DNA, 22 bp, Homo sapiens
tgacacttgggctttgagaggt

SEQ ID NO: 9404701 - DNA, 22 bp, Homo sapiens
tgacagaaaaatgtagctccat

SEQ ID NO: 9404702 - DNA, 22 bp, Homo sapiens
tgacagaaagagtattaaagat

SEQ ID NO: 9404703 - DNA, 22 bp, Homo sapiens
tgacacttggaagcttggcaac

SEQ ID NO: 9404704 - DNA, 22 bp, Homo sapiens
tgacacttctgaaacggaagtt

SEQ ID NO: 9404705 - DNA, 20 bp, Homo sapiens
tgacacttgatattgtcagt

SEQ ID NO: 9404706 - DNA, 22 bp, Homo sapiens
tgacacttccggtaaaaaatgc

SEQ ID NO: 9404707 - DNA, 22 bp, Homo sapiens
tgacacttccagttaaaaatat

SEQ ID NO: 9404708 - DNA, 22 bp, Homo sapiens
tgacactgcatatattgaagtt

SEQ ID NO: 9404709 - DNA, 22 bp, Homo sapiens
tgaagggcaaccccaggcccag

SEQ ID NO: 9404710 - DNA, 22 bp, Homo sapiens
tgaagggcaaccccaggcccag

SEQ ID NO: 9404711 - DNA, 22 bp, Homo sapiens
tgaaggcagcatgcacactagt

SEQ ID NO: 9404712 - DNA, 22 bp, Homo sapiens
tgaaggcataaatcttgggaac

SEQ ID NO: 9404713 - DNA, 22 bp, Homo sapiens
tgaaggcattgatgaaggaatc

SEQ ID NO: 9404714 - DNA, 22 bp, Homo sapiens
tgaagtttttccagacaagtcc

SEQ ID NO: 9404715 - DNA, 22 bp, Homo sapiens
tgaataaactatgaggaggaat

SEQ ID NO: 9404716 - DNA, 22 bp, Homo sapiens
tgaagttttctggttgattaag

SEQ ID NO: 9404717 - DNA, 22 bp, Homo sapiens
tgaagttttactaggtgaattt

SEQ ID NO: 9404718 - DNA, 22 bp, Homo sapiens
tgaagttttacatcctctccaa

SEQ ID NO: 9404719 - DNA, 22 bp, Homo sapiens
tgaataatccacagtcattcat

SEQ ID NO: 9404720 - DNA, 22 bp, Homo sapiens
tgaataaatcaaagactgccct

SEQ ID NO: 9404721 - DNA, 22 bp, Homo sapiens
tgaataaattgagagcgaatgt

SEQ ID NO: 9404722 - DNA, 22 bp, Homo sapiens
tgaagtttaaggttagataagt

SEQ ID NO: 9404723 - DNA, 22 bp, Homo sapiens
tgaagtttaattttggacatga

SEQ ID NO: 9404724 - DNA, 22 bp, Homo sapiens
tgaagtttaattttggacatga

SEQ ID NO: 9404725 - DNA, 22 bp, Homo sapiens
tgaagtttataacatagcctcc

SEQ ID NO: 9404726 - DNA, 22 bp, Homo sapiens
tgaagtttggtggaaatttcct

SEQ ID NO: 9404727 - DNA, 22 bp, Homo sapiens
tgaagtttcttgaatcttggag

SEQ ID NO: 9404728 - DNA, 22 bp, Homo sapiens
tgaagtttgaactgtgttgctg

SEQ ID NO: 9404729 - DNA, 22 bp, Homo sapiens
tgaagtttcctctgaggccagt

SEQ ID NO: 9404730 - DNA, 22 bp, Homo sapiens
tgaagtttcacgcgtcattcaa

SEQ ID NO: 9404731 - DNA, 22 bp, Homo sapiens
tgaaggtgaatgtctatgggga

SEQ ID NO: 9404732 - DNA, 22 bp, Homo sapiens
tgaaggtggcataggagagatg

SEQ ID NO: 9404733 - DNA, 22 bp, Homo sapiens
tgaaggtggcataggagagatg

SEQ ID NO: 9404734 - DNA, 22 bp, Homo sapiens
tgaaggtgggaattcaccaggt

SEQ ID NO: 9404735 - DNA, 22 bp, Homo sapiens
tgaaggcacttgcctaggggca

SEQ ID NO: 9404736 - DNA, 22 bp, Homo sapiens
tgaaggcacttgcctaggggca

SEQ ID NO: 9404737 - DNA, 22 bp, Homo sapiens
tgaaggagggaagaaggctctg

SEQ ID NO: 9404738 - DNA, 19 bp, Homo sapiens
tgaaggagggggatggcca

SEQ ID NO: 9404739 - DNA, 19 bp, Homo sapiens
tgaaggagggggatggcca

SEQ ID NO: 9404740 - DNA, 22 bp, Homo sapiens
tgaaggagctgatgtaaggggt

SEQ ID NO: 9404741 - DNA, 22 bp, Homo sapiens
tgaaggaggaatgtggcctcca

SEQ ID NO: 9404742 - DNA, 22 bp, Homo sapiens
tgaaggaggaatgtggcctcca

SEQ ID NO: 9404743 - DNA, 22 bp, Homo sapiens
tgaaggagggaagaaggctctg

SEQ ID NO: 9404744 - DNA, 22 bp, Homo sapiens
tgaagctggaagttaggtagac

SEQ ID NO: 9404745 - DNA, 22 bp, Homo sapiens
tgaagctggaagcatgcagact

SEQ ID NO: 9404746 - DNA, 22 bp, Homo sapiens
tgaagctggttgtatgactgga

SEQ ID NO: 9404747 - DNA, 22 bp, Homo sapiens
tgaagctggcttgacatggcct

SEQ ID NO: 9404748 - DNA, 22 bp, Homo sapiens
tgaagctggaagttaggtagac

SEQ ID NO: 9404749 - DNA, 22 bp, Homo sapiens
tgaagctgtaggcatgggcagc

SEQ ID NO: 9404750 - DNA, 22 bp, Homo sapiens
tgaagctggttgtatgactgga

SEQ ID NO: 9404751 - DNA, 22 bp, Homo sapiens
tgaaggagctcaggagatagtc

SEQ ID NO: 9404752 - DNA, 22 bp, Homo sapiens
tgaaggagctcaggagatagtc

SEQ ID NO: 9404753 - DNA, 22 bp, Homo sapiens
tgaaggagctcaggagatagtc

SEQ ID NO: 9404754 - DNA, 22 bp, Homo sapiens
tgaaggagctgatgtaaggggt

SEQ ID NO: 9404755 - DNA, 22 bp, Homo sapiens
tgaaggagctcaggagatagtc

SEQ ID NO: 9404756 - DNA, 22 bp, Homo sapiens
tgaaggagatttttagggaggc

SEQ ID NO: 9404757 - DNA, 22 bp, Homo sapiens
tgaaggagatttttagggaggc

SEQ ID NO: 9404758 - DNA, 22 bp, Homo sapiens
tgaaggagatttttagggaggc

SEQ ID NO: 9404759 - DNA, 22 bp, Homo sapiens
tgaaggagatttttagggaggc

SEQ ID NO: 9404760 - DNA, 22 bp, Homo sapiens
tgaagccatccctcagatggcc

SEQ ID NO: 9404761 - DNA, 22 bp, Homo sapiens
tgaagccatccctcagatggcc

SEQ ID NO: 9404762 - DNA, 22 bp, Homo sapiens
tgaagccatcaggaagccagca

SEQ ID NO: 9404763 - DNA, 22 bp, Homo sapiens
tgaagccattactgtgttaggg

SEQ ID NO: 9404764 - DNA, 22 bp, Homo sapiens
tgaagccattactgtgttaggg

SEQ ID NO: 9404765 - DNA, 22 bp, Homo sapiens
tgaagctatataagttacagca

SEQ ID NO: 9404766 - DNA, 17 bp, Homo sapiens
tgaagcgtgcctttgaa

SEQ ID NO: 9404767 - DNA, 22 bp, Homo sapiens
tgaagcgtgacccctcacctct

SEQ ID NO: 9404768 - DNA, 19 bp, Homo sapiens
tgaagcgtcgctcctcttc

SEQ ID NO: 9404769 - DNA, 22 bp, Homo sapiens
tgaagccataggacagaggata

SEQ ID NO: 9404770 - DNA, 22 bp, Homo sapiens
tgaagccagtcaatgttaagtt

SEQ ID NO: 9404771 - DNA, 22 bp, Homo sapiens
tgaagccagtcaatgttaagtt

SEQ ID NO: 9404772 - DNA, 21 bp, Homo sapiens
tgaagccaggatcacgattct

SEQ ID NO: 9404773 - DNA, 22 bp, Homo sapiens
tgaagccactttccagaatcac

SEQ ID NO: 9404774 - DNA, 22 bp, Homo sapiens
tgaagccaccgaaccagaagag

SEQ ID NO: 9404775 - DNA, 22 bp, Homo sapiens
tgaagccacactagcttgtcct

SEQ ID NO: 9404776 - DNA, 22 bp, Homo sapiens
tgaagccacagagcatctgcct

SEQ ID NO: 9404777 - DNA, 22 bp, Homo sapiens
tgaagccacagagcatctgcct

SEQ ID NO: 9404778 - DNA, 22 bp, Homo sapiens
tgaagccaatctgccaggcaga

SEQ ID NO: 9404779 - DNA, 22 bp, Homo sapiens
tgaattgaattgaattgaattg

SEQ ID NO: 9404780 - DNA, 22 bp, Homo sapiens
tgaattgctgccatcatatttc

SEQ ID NO: 9404781 - DNA, 22 bp, Homo sapiens
tgaattgctgccatcatatttc

SEQ ID NO: 9404782 - DNA, 22 bp, Homo sapiens
tgaattgactggctcagaattg

SEQ ID NO: 9404783 - DNA, 22 bp, Homo sapiens
tgaatttatcaaagattcttaa

SEQ ID NO: 9404784 - DNA, 21 bp, Homo sapiens
tgaatttccctctatcattct

SEQ ID NO: 9404785 - DNA, 22 bp, Homo sapiens
tgaatttatattgctgagagtt

SEQ ID NO: 9404786 - DNA, 22 bp, Homo sapiens
tgaatttaagcactgatgttaa

SEQ ID NO: 9404787 - DNA, 22 bp, Homo sapiens
tgaattctggccctctcactta

SEQ ID NO: 9404788 - DNA, 22 bp, Homo sapiens
tgaattctggctcttctgttta

SEQ ID NO: 9404789 - DNA, 22 bp, Homo sapiens
tgaattcatccatttatgcaag

SEQ ID NO: 9404790 - DNA, 22 bp, Homo sapiens
tgacacaaaggaaagcataatc

SEQ ID NO: 9404791 - DNA, 20 bp, Homo sapiens
tgacacaaattgctttctca

SEQ ID NO: 9404792 - DNA, 22 bp, Homo sapiens
tgacaaaactgcaattactttt

SEQ ID NO: 9404793 - DNA, 22 bp, Homo sapiens
tgacaaaactgcaattactttt

SEQ ID NO: 9404794 - DNA, 22 bp, Homo sapiens
tgacaaaactgcaattactttt

SEQ ID NO: 9404795 - DNA, 22 bp, Homo sapiens
tgacaaagcatgatggtgacag

SEQ ID NO: 9404796 - DNA, 22 bp, Homo sapiens
tgacaaagaggaacagcagggg

SEQ ID NO: 9404797 - DNA, 23 bp, Homo sapiens
tgacaaagcgagactccagctca

SEQ ID NO: 9404798 - DNA, 22 bp, Homo sapiens
tgaatcatgccactgagctccc

SEQ ID NO: 9404799 - DNA, 22 bp, Homo sapiens
tgaatcagtataaattctcaaa

SEQ ID NO: 9404800 - DNA, 22 bp, Homo sapiens
tgaatatgctttgcaatcctaa

SEQ ID NO: 9404801 - DNA, 22 bp, Homo sapiens
tgaatatgattgcaaatttggc

SEQ ID NO: 9404802 - DNA, 22 bp, Homo sapiens
tgaatagttctactacttgaca

SEQ ID NO: 9404803 - DNA, 22 bp, Homo sapiens
tgaatatggcaactcttgtaac

SEQ ID NO: 9404804 - DNA, 22 bp, Homo sapiens
tgaatatggcacctctgtgtaa

SEQ ID NO: 9404805 - DNA, 22 bp, Homo sapiens
tgaatatggcaactcttgtaac

SEQ ID NO: 9404806 - DNA, 22 bp, Homo sapiens
tgaatatgttcctcacaagttc

SEQ ID NO: 9404807 - DNA, 22 bp, Homo sapiens
tgaatactatttcataatgtgg

SEQ ID NO: 9404808 - DNA, 22 bp, Homo sapiens
tgaatagacatctggccataga

SEQ ID NO: 9404809 - DNA, 22 bp, Homo sapiens
tgaatagactggggctgtgaag

SEQ ID NO: 9404810 - DNA, 20 bp, Homo sapiens
tgaatagagagcacatatgc

SEQ ID NO: 9404811 - DNA, 22 bp, Homo sapiens
tgaatagtccttggaataactg

SEQ ID NO: 9404812 - DNA, 22 bp, Homo sapiens
tgaatagtccttggaataactg

SEQ ID NO: 9404813 - DNA, 22 bp, Homo sapiens
tgaatagatttttaacatataa

SEQ ID NO: 9404814 - DNA, 22 bp, Homo sapiens
tgaatagctgtgacagacatca

SEQ ID NO: 9404815 - DNA, 22 bp, Homo sapiens
tgaatagatggtgacagtatga

SEQ ID NO: 9404816 - DNA, 22 bp, Homo sapiens
tgaatagatggtgacagtatga

SEQ ID NO: 9404817 - DNA, 22 bp, Homo sapiens
tgaatagataaaaattcctgct

SEQ ID NO: 9404818 - DNA, 22 bp, Homo sapiens
tgaatagagcttggcactagaa

SEQ ID NO: 9404819 - DNA, 22 bp, Homo sapiens
tgaataattcctttttgtcaag

SEQ ID NO: 9404820 - DNA, 22 bp, Homo sapiens
tgaatacactaaaaatcacttt

SEQ ID NO: 9404821 - DNA, 22 bp, Homo sapiens
tgaatacactaaaaatcacttt

SEQ ID NO: 9404822 - DNA, 22 bp, Homo sapiens
tgaatacaggaaaatatactga

SEQ ID NO: 9404823 - DNA, 22 bp, Homo sapiens
tgaatacaggaaaatatactga

SEQ ID NO: 9404824 - DNA, 19 bp, Homo sapiens
tgaatacagagatacagaa

SEQ ID NO: 9404825 - DNA, 19 bp, Homo sapiens
tgaatacagagatacagaa

SEQ ID NO: 9404826 - DNA, 22 bp, Homo sapiens
tgaatgacctttgaggatggaa

SEQ ID NO: 9404827 - DNA, 22 bp, Homo sapiens
tgaatgagaacactgaaagagg

SEQ ID NO: 9404828 - DNA, 19 bp, Homo sapiens
tgaatgacgggcatgagca

SEQ ID NO: 9404829 - DNA, 21 bp, Homo sapiens
tgaatgcttcgtcatcctggc

SEQ ID NO: 9404830 - DNA, 22 bp, Homo sapiens
tgaatgagtgagttcagacctc

SEQ ID NO: 9404831 - DNA, 22 bp, Homo sapiens
tgaatgctttggagccttctaa

SEQ ID NO: 9404832 - DNA, 22 bp, Homo sapiens
tgaatggatataacaacagtgt

SEQ ID NO: 9404833 - DNA, 21 bp, Homo sapiens
tgaatgagcatctggactttt

SEQ ID NO: 9404834 - DNA, 22 bp, Homo sapiens
tgaatgagaacactgaaagagg

SEQ ID NO: 9404835 - DNA, 21 bp, Homo sapiens
tgaatgagcatctggactttt

SEQ ID NO: 9404836 - DNA, 22 bp, Homo sapiens
tgaatgaggatccttgacctta

SEQ ID NO: 9404837 - DNA, 21 bp, Homo sapiens
tgaatgaggaggatggcattt

SEQ ID NO: 9404838 - DNA, 22 bp, Homo sapiens
tgaatgaggatccttgacctta

SEQ ID NO: 9404839 - DNA, 22 bp, Homo sapiens
tgaatgagtcaatcatttagct

SEQ ID NO: 9404840 - DNA, 18 bp, Homo sapiens
tgaatgttttctggaccc

SEQ ID NO: 9404841 - DNA, 19 bp, Homo sapiens
tgaattagaattatcctct

SEQ ID NO: 9404842 - DNA, 22 bp, Homo sapiens
tgaattatcttgtaattttgaa

SEQ ID NO: 9404843 - DNA, 18 bp, Homo sapiens
tgaattagtttgtggttt

SEQ ID NO: 9404844 - DNA, 22 bp, Homo sapiens
tgaatgtgatgctaaacatatg

SEQ ID NO: 9404845 - DNA, 22 bp, Homo sapiens
tgaatgtgatgctaaacatatg

SEQ ID NO: 9404846 - DNA, 22 bp, Homo sapiens
tgaatgtgatgctaaacatatg

SEQ ID NO: 9404847 - DNA, 22 bp, Homo sapiens
ttccagatgtttaagttctgct

SEQ ID NO: 9404848 - DNA, 17 bp, Homo sapiens
ttccagcatgttactaa

SEQ ID NO: 9404849 - DNA, 17 bp, Homo sapiens
ttccagcatgttactaa

SEQ ID NO: 9404850 - DNA, 22 bp, Homo sapiens
ttccagcagggtacttgtaatt

SEQ ID NO: 9404851 - DNA, 22 bp, Homo sapiens
ttccagcagggtacttgtaatt

SEQ ID NO: 9404852 - DNA, 22 bp, Homo sapiens
ttccagcagcgtgggagaagta

SEQ ID NO: 9404853 - DNA, 22 bp, Homo sapiens
ttccagcagcgtgggagaagta

SEQ ID NO: 9404854 - DNA, 22 bp, Homo sapiens
ttccagcaggcagacaggagat

SEQ ID NO: 9404855 - DNA, 22 bp, Homo sapiens
ttccagctaactcacatccctt

SEQ ID NO: 9404856 - DNA, 22 bp, Homo sapiens
ttccagctaactcacatccctt

SEQ ID NO: 9404857 - DNA, 22 bp, Homo sapiens
ttccagctaactcacatccctt

SEQ ID NO: 9404858 - DNA, 22 bp, Homo sapiens
ttccagccagatttgctgggtt

SEQ ID NO: 9404859 - DNA, 22 bp, Homo sapiens
ttccagccagatttgctgggtt

SEQ ID NO: 9404860 - DNA, 22 bp, Homo sapiens
ttccagaggggaggtggcagcc

SEQ ID NO: 9404861 - DNA, 22 bp, Homo sapiens
ttccagaggttctcagccctgt

SEQ ID NO: 9404862 - DNA, 22 bp, Homo sapiens
ttccagaggttctcagccctgt

SEQ ID NO: 9404863 - DNA, 22 bp, Homo sapiens
ttccagaggcttcagggaagaa

SEQ ID NO: 9404864 - DNA, 22 bp, Homo sapiens
ttccagaggcttgaggaaaatt

SEQ ID NO: 9404865 - DNA, 22 bp, Homo sapiens
ttccagagtctggttccatggt

SEQ ID NO: 9404866 - DNA, 22 bp, Homo sapiens
ttccagagtgactgtgccactt

SEQ ID NO: 9404867 - DNA, 22 bp, Homo sapiens
ttccagctaactcacatccctt

SEQ ID NO: 9404868 - DNA, 22 bp, Homo sapiens
ttccagctcttgaaggtgggat

SEQ ID NO: 9404869 - DNA, 22 bp, Homo sapiens
ttccagcttagagcatcatgtt

SEQ ID NO: 9404870 - DNA, 22 bp, Homo sapiens
ttccagcttgacttctacttaa

SEQ ID NO: 9404871 - DNA, 22 bp, Homo sapiens
ttccagcttgacttctacttaa

SEQ ID NO: 9404872 - DNA, 22 bp, Homo sapiens
ttccagaggaaagaaaatgact

SEQ ID NO: 9404873 - DNA, 23 bp, Homo sapiens
ttccagaggaagaagtcatgact

SEQ ID NO: 9404874 - DNA, 22 bp, Homo sapiens
ttccagaggatctcaggtattt

SEQ ID NO: 9404875 - DNA, 22 bp, Homo sapiens
ttccagaggagtgattcagagg

SEQ ID NO: 9404876 - DNA, 22 bp, Homo sapiens
ttccagaggatctcaggtattt

SEQ ID NO: 9404877 - DNA, 19 bp, Homo sapiens
ttcattctttctacttacc

SEQ ID NO: 9404878 - DNA, 22 bp, Homo sapiens
ttcattcttttacatgtgaata

SEQ ID NO: 9404879 - DNA, 22 bp, Homo sapiens
ttcattcattcatgaatgttaa

SEQ ID NO: 9404880 - DNA, 22 bp, Homo sapiens
ttcattcttgtctttgtatagt

SEQ ID NO: 9404881 - DNA, 22 bp, Homo sapiens
ttcattcttgtctttgtatagt

SEQ ID NO: 9404882 - DNA, 22 bp, Homo sapiens
ttcatgttttattcagtaatta

SEQ ID NO: 9404883 - DNA, 22 bp, Homo sapiens
ttcatgttttattcagtaatta

SEQ ID NO: 9404884 - DNA, 20 bp, Homo sapiens
ttcattcacgtagctgttga

SEQ ID NO: 9404885 - DNA, 22 bp, Homo sapiens
ttcattcaggtgtatttatggg

SEQ ID NO: 9404886 - DNA, 22 bp, Homo sapiens
ttcagcatctacatatttagaa

SEQ ID NO: 9404887 - DNA, 22 bp, Homo sapiens
ttcactgctacatccaggtgcc

SEQ ID NO: 9404888 - DNA, 22 bp, Homo sapiens
ttcactgctgggtgattgggtt

SEQ ID NO: 9404889 - DNA, 22 bp, Homo sapiens
ttcactggtcctttataggaac

SEQ ID NO: 9404890 - DNA, 21 bp, Homo sapiens
ttcagcagtcctctagagata

SEQ ID NO: 9404891 - DNA, 22 bp, Homo sapiens
ttcaccatgttggccaggctgg

SEQ ID NO: 9404892 - DNA, 22 bp, Homo sapiens
ttcaccattacatacaaagatg

SEQ ID NO: 9404893 - DNA, 22 bp, Homo sapiens
ttcaccattctaagacattggt

SEQ ID NO: 9404894 - DNA, 22 bp, Homo sapiens
ttcaccatttcccactaaacca

SEQ ID NO: 9404895 - DNA, 22 bp, Homo sapiens
ttcaccccaaattcccagtgga

SEQ ID NO: 9404896 - DNA, 22 bp, Homo sapiens
ttcaccctgagccccacctctg

SEQ ID NO: 9404897 - DNA, 22 bp, Homo sapiens
ttcacctggcacatgtgagcct

SEQ ID NO: 9404898 - DNA, 22 bp, Homo sapiens
ttcactgcagcccatgaaggga

SEQ ID NO: 9404899 - DNA, 22 bp, Homo sapiens
ttcactgaagtttcttccatgt

SEQ ID NO: 9404900 - DNA, 19 bp, Homo sapiens
ttcactaggtcacaaggtc

SEQ ID NO: 9404901 - DNA, 22 bp, Homo sapiens
ttcaggaataattatcatatga

SEQ ID NO: 9404902 - DNA, 22 bp, Homo sapiens
ttcagcttgctgactgcggcag

SEQ ID NO: 9404903 - DNA, 22 bp, Homo sapiens
ttcagcttgctgactgcggcag

SEQ ID NO: 9404904 - DNA, 22 bp, Homo sapiens
ttcaggaaatgtctgcctacca

SEQ ID NO: 9404905 - DNA, 23 bp, Homo sapiens
ttcaggaaatgaatacagacaca

SEQ ID NO: 9404906 - DNA, 22 bp, Homo sapiens
ttcagcattggtatgaaaaccc

SEQ ID NO: 9404907 - DNA, 22 bp, Homo sapiens
ttcagcatttctgttgttggct

SEQ ID NO: 9404908 - DNA, 22 bp, Homo sapiens
ttcagcatgggtgtgataaatg

SEQ ID NO: 9404909 - DNA, 22 bp, Homo sapiens
ttcagcatgggtgtgataaatg

SEQ ID NO: 9404910 - DNA, 19 bp, Homo sapiens
ttcagcattatattctagc

SEQ ID NO: 9404911 - DNA, 22 bp, Homo sapiens
ttcagcatgaaaggatttgagt

SEQ ID NO: 9404912 - DNA, 22 bp, Homo sapiens
ttcagcccaggagttggaggct

SEQ ID NO: 9404913 - DNA, 22 bp, Homo sapiens
ttcagcccccaaagcctcattc

SEQ ID NO: 9404914 - DNA, 21 bp, Homo sapiens
ttcagctcggtctggcatgat

SEQ ID NO: 9404915 - DNA, 22 bp, Homo sapiens
ttcagctctagtaagcagacac

SEQ ID NO: 9404916 - DNA, 21 bp, Homo sapiens
ttcagctctgcttcagggaat

SEQ ID NO: 9404917 - DNA, 22 bp, Homo sapiens
ttcagctcagtctgtgcagcag

SEQ ID NO: 9404918 - DNA, 22 bp, Homo sapiens
ttcagctcagcactgacaagat

SEQ ID NO: 9404919 - DNA, 22 bp, Homo sapiens
ttatttcttgtctatgtagcca

SEQ ID NO: 9404920 - DNA, 22 bp, Homo sapiens
ttatttcttgtctatgtagcca

SEQ ID NO: 9404921 - DNA, 22 bp, Homo sapiens
ttatttcttgtctatgtagcca

SEQ ID NO: 9404922 - DNA, 22 bp, Homo sapiens
ttatttgaaaagaaggttacgt

SEQ ID NO: 9404923 - DNA, 22 bp, Homo sapiens
ttatttcctgacacagctgatt

SEQ ID NO: 9404924 - DNA, 22 bp, Homo sapiens
ttatttctactattttgcctga

SEQ ID NO: 9404925 - DNA, 20 bp, Homo sapiens
ttatttctcattctcctact

SEQ ID NO: 9404926 - DNA, 22 bp, Homo sapiens
ttatttcctgacacagctgatt

SEQ ID NO: 9404927 - DNA, 22 bp, Homo sapiens
ttatttcctagggaatttgcct

SEQ ID NO: 9404928 - DNA, 22 bp, Homo sapiens
ttatttcctctctaatagggta

SEQ ID NO: 9404929 - DNA, 22 bp, Homo sapiens
ttatttcctgacacagctgatt

SEQ ID NO: 9404930 - DNA, 22 bp, Homo sapiens
ttatttcctctctaatagggta

SEQ ID NO: 9404931 - DNA, 22 bp, Homo sapiens
ttatttcctaaatctctttgtt

SEQ ID NO: 9404932 - DNA, 22 bp, Homo sapiens
ttatttcctagggaatttgcct

SEQ ID NO: 9404933 - DNA, 22 bp, Homo sapiens
ttatttcctagggaatttgcct

SEQ ID NO: 9404934 - DNA, 22 bp, Homo sapiens
ttatttcctaaatctctttgtt

SEQ ID NO: 9404935 - DNA, 22 bp, Homo sapiens
ttatttgcccatgtttagcaga

SEQ ID NO: 9404936 - DNA, 20 bp, Homo sapiens
ttatttgctctttatctgca

SEQ ID NO: 9404937 - DNA, 22 bp, Homo sapiens
ttatttgccagaatttctcttg

SEQ ID NO: 9404938 - DNA, 22 bp, Homo sapiens
ttatttgctgatttcagtttca

SEQ ID NO: 9404939 - DNA, 22 bp, Homo sapiens
ttatttggatttagcttatcaa

SEQ ID NO: 9404940 - DNA, 22 bp, Homo sapiens
ttatttgtaaggcagggccagt

SEQ ID NO: 9404941 - DNA, 22 bp, Homo sapiens
ttatttgtaaaggtccatagta

SEQ ID NO: 9404942 - DNA, 22 bp, Homo sapiens
ttcaccagattttgtatagtca

SEQ ID NO: 9404943 - DNA, 22 bp, Homo sapiens
ttcaccataatgcaaagtggga

SEQ ID NO: 9404944 - DNA, 18 bp, Homo sapiens
ttcaccagtgtgatgggt

SEQ ID NO: 9404945 - DNA, 22 bp, Homo sapiens
ttcaccatgtaaaccatgtggc

SEQ ID NO: 9404946 - DNA, 19 bp, Homo sapiens
ttcaccatgggactggagc

SEQ ID NO: 9404947 - DNA, 22 bp, Homo sapiens
ttcaccatgggatgacaacagt

SEQ ID NO: 9404948 - DNA, 19 bp, Homo sapiens
ttcaccatctcaccaaacc

SEQ ID NO: 9404949 - DNA, 19 bp, Homo sapiens
ttcaccatctcaccaaacc

SEQ ID NO: 9404950 - DNA, 22 bp, Homo sapiens
ttcaccatcattaacttcatgt

SEQ ID NO: 9404951 - DNA, 19 bp, Homo sapiens
ttcacattttgctctgagg

SEQ ID NO: 9404952 - DNA, 22 bp, Homo sapiens
ttcacatttgcccttatgtgtg

SEQ ID NO: 9404953 - DNA, 22 bp, Homo sapiens
ttcacattgtggttcatgtgaa

SEQ ID NO: 9404954 - DNA, 22 bp, Homo sapiens
ttcacattgtgcagattatggt

SEQ ID NO: 9404955 - DNA, 22 bp, Homo sapiens
ttacatgtttatgtggtacatg

SEQ ID NO: 9404956 - DNA, 22 bp, Homo sapiens
ttacatgtttatgtggtacatg

SEQ ID NO: 9404957 - DNA, 22 bp, Homo sapiens
ttacatgtttacggatacactt

SEQ ID NO: 9404958 - DNA, 22 bp, Homo sapiens
ttacatgtttatgggggtacat

SEQ ID NO: 9404959 - DNA, 23 bp, Homo sapiens
ttacatgtgtgcacacattctgg

SEQ ID NO: 9404960 - DNA, 22 bp, Homo sapiens
ttacatgtggagtctgattgca

SEQ ID NO: 9404961 - DNA, 22 bp, Homo sapiens
ttacatgtggtgtgaagaagag

SEQ ID NO: 9404962 - DNA, 22 bp, Homo sapiens
ttacatgttctcatacacagag

SEQ ID NO: 9404963 - DNA, 21 bp, Homo sapiens
ttacatggtttatcatatgga

SEQ ID NO: 9404964 - DNA, 22 bp, Homo sapiens
ttacatgtaatctaaaataatt

SEQ ID NO: 9404965 - DNA, 22 bp, Homo sapiens
ttacatgtggtgtgaagaagag

SEQ ID NO: 9404966 - DNA, 22 bp, Homo sapiens
ttacatgtattttggaaaaagt

SEQ ID NO: 9404967 - DNA, 22 bp, Homo sapiens
ttacatgtactggtttgactta

SEQ ID NO: 9404968 - DNA, 22 bp, Homo sapiens
ttacatgtaatctaaaataatt

SEQ ID NO: 9404969 - DNA, 22 bp, Homo sapiens
ttacatgtacaaacaattctta

SEQ ID NO: 9404970 - DNA, 22 bp, Homo sapiens
ttacatttcccccttggaggct

SEQ ID NO: 9404971 - DNA, 22 bp, Homo sapiens
ttacatgatgatttcataaaca

SEQ ID NO: 9404972 - DNA, 22 bp, Homo sapiens
ttacatgcttagagatgcatgc

SEQ ID NO: 9404973 - DNA, 23 bp, Homo sapiens
ttacagctaactgctgttattag

SEQ ID NO: 9404974 - DNA, 22 bp, Homo sapiens
ttacagctagccaattatttag

SEQ ID NO: 9404975 - DNA, 22 bp, Homo sapiens
ttacatgactcaatagaagggc

SEQ ID NO: 9404976 - DNA, 22 bp, Homo sapiens
ttacagcagtgggaaggagtca

SEQ ID NO: 9404977 - DNA, 22 bp, Homo sapiens
ttacagcagcagggacagacta

SEQ ID NO: 9404978 - DNA, 17 bp, Homo sapiens
ttacagcagcaatagag

SEQ ID NO: 9404979 - DNA, 22 bp, Homo sapiens
ttacagatggatctagcaaaat

SEQ ID NO: 9404980 - DNA, 22 bp, Homo sapiens
ttacagatcatcaaggtataat

SEQ ID NO: 9404981 - DNA, 22 bp, Homo sapiens
ttacagattaaaatgctgaggt

SEQ ID NO: 9404982 - DNA, 22 bp, Homo sapiens
ttacagattaaaatgctgaggt

SEQ ID NO: 9404983 - DNA, 22 bp, Homo sapiens
ttacagatgtttcaggaatact

SEQ ID NO: 9404984 - DNA, 18 bp, Homo sapiens
ttacagcagcaacaggaa

SEQ ID NO: 9404985 - DNA, 22 bp, Homo sapiens
ttacaattgagtctattgtatg

SEQ ID NO: 9404986 - DNA, 22 bp, Homo sapiens
ttacaattgagtctattgtatg

SEQ ID NO: 9404987 - DNA, 22 bp, Homo sapiens
ttacaattacttgatctcagct

SEQ ID NO: 9404988 - DNA, 22 bp, Homo sapiens
ttacaatgggtatacttccatt

SEQ ID NO: 9404989 - DNA, 22 bp, Homo sapiens
ttacaagtactgaatatgattt

SEQ ID NO: 9404990 - DNA, 22 bp, Homo sapiens
ttacaatgatgggattcagcca

SEQ ID NO: 9404991 - DNA, 22 bp, Homo sapiens
ttacaatgcactcacctttaga

SEQ ID NO: 9404992 - DNA, 22 bp, Homo sapiens
ttacaaggaggatagcatttcc

SEQ ID NO: 9404993 - DNA, 22 bp, Homo sapiens
ttacaaggtaagttgttaagtc

SEQ ID NO: 9404994 - DNA, 23 bp, Homo sapiens
ttacaaggctagaattccagcga

SEQ ID NO: 9404995 - DNA, 19 bp, Homo sapiens
ttacaagcattgaaagaaa

SEQ ID NO: 9404996 - DNA, 22 bp, Homo sapiens
ttacaagctaattgtttcagct

SEQ ID NO: 9404997 - DNA, 20 bp, Homo sapiens
ttacaagccttgttaaatct

SEQ ID NO: 9404998 - DNA, 22 bp, Homo sapiens
ttacaagctaattgtttcagct

SEQ ID NO: 9404999 - DNA, 23 bp, Homo sapiens
ttacaaggaagtgcacagatggg

SEQ ID NO: 9405000 - DNA, 22 bp, Homo sapiens
ttacaagatatgtgagaactag

SEQ ID NO: 9405001 - DNA, 22 bp, Homo sapiens
ttacaagcagctacatatcaca

SEQ ID NO: 9405002 - DNA, 22 bp, Homo sapiens
ttacaagcagctacatatcaca

SEQ ID NO: 9405003 - DNA, 22 bp, Homo sapiens
ttacagaggtatgtatgtctct

SEQ ID NO: 9405004 - DNA, 17 bp, Homo sapiens
ttacagaggtaattaag

SEQ ID NO: 9405005 - DNA, 22 bp, Homo sapiens
ttacagagtagggaattgaagt

SEQ ID NO: 9405006 - DNA, 22 bp, Homo sapiens
ttacagagtggtctggctatgt

SEQ ID NO: 9405007 - DNA, 22 bp, Homo sapiens
ttacagagttcgcacctggtgg

SEQ ID NO: 9405008 - DNA, 22 bp, Homo sapiens
ttacagatactttgtaggcaag

SEQ ID NO: 9405009 - DNA, 22 bp, Homo sapiens
ttacagatactttgtaggcaag

SEQ ID NO: 9405010 - DNA, 17 bp, Homo sapiens
ttacagaggtaattaag

SEQ ID NO: 9405011 - DNA, 22 bp, Homo sapiens
ttacagaggcttccagggccca

SEQ ID NO: 9405012 - DNA, 22 bp, Homo sapiens
ttacagagctcatttctaaggg

SEQ ID NO: 9405013 - DNA, 22 bp, Homo sapiens
ttacagagctgggtggagagag

SEQ ID NO: 9405014 - DNA, 22 bp, Homo sapiens
ttacagagaggtgattgtgaag

SEQ ID NO: 9405015 - DNA, 22 bp, Homo sapiens
ttacagagaggtgattgtgaag

SEQ ID NO: 9405016 - DNA, 22 bp, Homo sapiens
ttacagagataaactgtaagtg

SEQ ID NO: 9405017 - DNA, 22 bp, Homo sapiens
ttacagagcctcattttagaga

SEQ ID NO: 9405018 - DNA, 22 bp, Homo sapiens
ttacagagcctcattttagaga

SEQ ID NO: 9405019 - DNA, 22 bp, Homo sapiens
ttacagaatgtgccatttggtc

SEQ ID NO: 9405020 - DNA, 22 bp, Homo sapiens
ttacacaaaaataagatatggc

SEQ ID NO: 9405021 - DNA, 22 bp, Homo sapiens
ttacacaaaaataagatatggc

SEQ ID NO: 9405022 - DNA, 20 bp, Homo sapiens
ttacactttgtagcattttt

SEQ ID NO: 9405023 - DNA, 20 bp, Homo sapiens
ttacactttgtagcattttt

SEQ ID NO: 9405024 - DNA, 22 bp, Homo sapiens
ttaaagagaactcaatgaatga

SEQ ID NO: 9405025 - DNA, 22 bp, Homo sapiens
ttaaagagtctactgcacatcc

SEQ ID NO: 9405026 - DNA, 22 bp, Homo sapiens
ttaaagaggcatgggaatgtat

SEQ ID NO: 9405027 - DNA, 22 bp, Homo sapiens
ttaaagcaagtagaagcctgag

SEQ ID NO: 9405028 - DNA, 22 bp, Homo sapiens
ttaaagcaacctcagccctctt

SEQ ID NO: 9405029 - DNA, 22 bp, Homo sapiens
ttaaagcaggcatcattcctca

SEQ ID NO: 9405030 - DNA, 22 bp, Homo sapiens
ttaaagcagtttgtatacatgg

SEQ ID NO: 9405031 - DNA, 22 bp, Homo sapiens
ttaaagcagtttgtatacatgg

SEQ ID NO: 9405032 - DNA, 22 bp, Homo sapiens
ttaatacaagcatatgcacaca

SEQ ID NO: 9405033 - DNA, 22 bp, Homo sapiens
ttaatacaagcatatgcacaca

SEQ ID NO: 9405034 - DNA, 22 bp, Homo sapiens
ttaatacactatatgatcacat

SEQ ID NO: 9405035 - DNA, 22 bp, Homo sapiens
ttaatacagtctccagaagtaa

SEQ ID NO: 9405036 - DNA, 22 bp, Homo sapiens
ttaatacatttcagactgttat

SEQ ID NO: 9405037 - DNA, 22 bp, Homo sapiens
ttaatacagtctccagaagtaa

SEQ ID NO: 9405038 - DNA, 22 bp, Homo sapiens
ttaatacagaagcaagacactg

SEQ ID NO: 9405039 - DNA, 23 bp, Homo sapiens
ttacaacagtgtccatatttgta

SEQ ID NO: 9405040 - DNA, 22 bp, Homo sapiens
ttacaacactacttatccttga

SEQ ID NO: 9405041 - DNA, 22 bp, Homo sapiens
ttacaacagacacatattctaa

SEQ ID NO: 9405042 - DNA, 22 bp, Homo sapiens
ttacaacagacacatattctaa

SEQ ID NO: 9405043 - DNA, 22 bp, Homo sapiens
ttacaacaccaggcagtatcct

SEQ ID NO: 9405044 - DNA, 22 bp, Homo sapiens
ttacaacaaaggcacgtgcatg

SEQ ID NO: 9405045 - DNA, 17 bp, Homo sapiens
ttacaacaattcatgag

SEQ ID NO: 9405046 - DNA, 17 bp, Homo sapiens
ttacaacaattcatgag

SEQ ID NO: 9405047 - DNA, 22 bp, Homo sapiens
ttacaacctaattttactctcc

SEQ ID NO: 9405048 - DNA, 22 bp, Homo sapiens
ttacaactctgaactacagagg

SEQ ID NO: 9405049 - DNA, 22 bp, Homo sapiens
ttacaactctgtcagtatagct

SEQ ID NO: 9405050 - DNA, 22 bp, Homo sapiens
ttacaactgaagctaatgtgct

SEQ ID NO: 9405051 - DNA, 22 bp, Homo sapiens
ttacaactggtgaattttatgg

SEQ ID NO: 9405052 - DNA, 22 bp, Homo sapiens
ttacaacatatttagcttgatt

SEQ ID NO: 9405053 - DNA, 22 bp, Homo sapiens
ttacaacatatgataggagtct

SEQ ID NO: 9405054 - DNA, 22 bp, Homo sapiens
ttacaaagagaagttgtagaat

SEQ ID NO: 9405055 - DNA, 22 bp, Homo sapiens
ttaattaaattcatgagcattg

SEQ ID NO: 9405056 - DNA, 22 bp, Homo sapiens
ttaatgtgtgtacaggattttg

SEQ ID NO: 9405057 - DNA, 22 bp, Homo sapiens
ttaatgttttaagttatagaga

SEQ ID NO: 9405058 - DNA, 22 bp, Homo sapiens
ttacaaagtgttatgataaaca

SEQ ID NO: 9405059 - DNA, 22 bp, Homo sapiens
ttacaaagttctgagttcaaac

SEQ ID NO: 9405060 - DNA, 22 bp, Homo sapiens
ttacaaagttctgagttcaaac

SEQ ID NO: 9405061 - DNA, 21 bp, Homo sapiens
ttacaaagctacagatgttgc

SEQ ID NO: 9405062 - DNA, 22 bp, Homo sapiens
ttacaaagtgctgcaccatttt

SEQ ID NO: 9405063 - DNA, 22 bp, Homo sapiens
ttattctgttgcttttacagta

SEQ ID NO: 9405064 - DNA, 22 bp, Homo sapiens
ttattctgttgcttttacagta

SEQ ID NO: 9405065 - DNA, 22 bp, Homo sapiens
ttattctggaggaagcaaatgg

SEQ ID NO: 9405066 - DNA, 17 bp, Homo sapiens
ttattctggcatatgtg

SEQ ID NO: 9405067 - DNA, 22 bp, Homo sapiens
ttattctggaggaagcaaatgg

SEQ ID NO: 9405068 - DNA, 22 bp, Homo sapiens
ttattctgtatttcaggtatgt

SEQ ID NO: 9405069 - DNA, 22 bp, Homo sapiens
ttattctgtgaacatggttaat

SEQ ID NO: 9405070 - DNA, 22 bp, Homo sapiens
ttattctgtctttggtctcaat

SEQ ID NO: 9405071 - DNA, 22 bp, Homo sapiens
ttatttccagtccagaaattta

SEQ ID NO: 9405072 - DNA, 20 bp, Homo sapiens
ttatttccagtccaggtcct

SEQ ID NO: 9405073 - DNA, 22 bp, Homo sapiens
ttatttccagtccagaaattta

SEQ ID NO: 9405074 - DNA, 22 bp, Homo sapiens
ttatttccacaatgtggtaggg

SEQ ID NO: 9405075 - DNA, 22 bp, Homo sapiens
ttatttcctaaatctctttgtt

SEQ ID NO: 9405076 - DNA, 22 bp, Homo sapiens
ttatttccctgagggttgcagg

SEQ ID NO: 9405077 - DNA, 22 bp, Homo sapiens
ttatttccctgagggttgcagg

SEQ ID NO: 9405078 - DNA, 20 bp, Homo sapiens
ttatttccagtccaggtcct

SEQ ID NO: 9405079 - DNA, 22 bp, Homo sapiens
ttatttccagtccagaaattta

SEQ ID NO: 9405080 - DNA, 22 bp, Homo sapiens
ttatttccaaactggatatacc

SEQ ID NO: 9405081 - DNA, 22 bp, Homo sapiens
ttatttccacaatgtggtaggg

SEQ ID NO: 9405082 - DNA, 22 bp, Homo sapiens
ttatttccaaactggatatacc

SEQ ID NO: 9405083 - DNA, 22 bp, Homo sapiens
ttatttcattgatttctaagac

SEQ ID NO: 9405084 - DNA, 22 bp, Homo sapiens
ttatttccaaactggatatacc

SEQ ID NO: 9405085 - DNA, 22 bp, Homo sapiens
ttatttatggccctcacctgat

SEQ ID NO: 9405086 - DNA, 22 bp, Homo sapiens
ttatttatggccctcacctgat

SEQ ID NO: 9405087 - DNA, 22 bp, Homo sapiens
ttatttatgttaacagtcgaga

SEQ ID NO: 9405088 - DNA, 22 bp, Homo sapiens
ttatttatggcactgttggtgg

SEQ ID NO: 9405089 - DNA, 22 bp, Homo sapiens
ttattcttggatctgagtctct

SEQ ID NO: 9405090 - DNA, 22 bp, Homo sapiens
ttattctgactaatgtataact

SEQ ID NO: 9405091 - DNA, 22 bp, Homo sapiens
ttattctcatctccctacttag

SEQ ID NO: 9405092 - DNA, 22 bp, Homo sapiens
ttattctgcacttttaaaatat

SEQ ID NO: 9405093 - DNA, 22 bp, Homo sapiens
ttattctgagagttgaagtaat

SEQ ID NO: 9405094 - DNA, 22 bp, Homo sapiens
ttattccattcagttcaacaag

SEQ ID NO: 9405095 - DNA, 22 bp, Homo sapiens
ttattattgattcgctctcaaa

SEQ ID NO: 9405096 - DNA, 22 bp, Homo sapiens
ttattattgattcgctctcaaa

SEQ ID NO: 9405097 - DNA, 22 bp, Homo sapiens
ttattattggtgagttaaggaa

SEQ ID NO: 9405098 - DNA, 22 bp, Homo sapiens
ttattattggtgagttaaggaa

SEQ ID NO: 9405099 - DNA, 22 bp, Homo sapiens
ttatgaagttcctgttacagtg

SEQ ID NO: 9405100 - DNA, 22 bp, Homo sapiens
ttatcttgtagagatattttcg

SEQ ID NO: 9405101 - DNA, 22 bp, Homo sapiens
ttatcttagaggtgattgtatt

SEQ ID NO: 9405102 - DNA, 17 bp, Homo sapiens
ttatcttgctgtttcta

SEQ ID NO: 9405103 - DNA, 22 bp, Homo sapiens
ttatcttggtgttttagtaatt

SEQ ID NO: 9405104 - DNA, 22 bp, Homo sapiens
ttatgatttgccacagattggt

SEQ ID NO: 9405105 - DNA, 22 bp, Homo sapiens
ttattattccccaagtcattat

SEQ ID NO: 9405106 - DNA, 22 bp, Homo sapiens
ttattattccccaagtcattat

SEQ ID NO: 9405107 - DNA, 22 bp, Homo sapiens
ttatgatttgccacagattggt

SEQ ID NO: 9405108 - DNA, 22 bp, Homo sapiens
ttatctgtttaacaaagtatct

SEQ ID NO: 9405109 - DNA, 22 bp, Homo sapiens
ttatctgttgttttagtacaat

SEQ ID NO: 9405110 - DNA, 19 bp, Homo sapiens
ttatctgtgttgcagtggt

SEQ ID NO: 9405111 - DNA, 22 bp, Homo sapiens
ttatctggtatagtggggaaga

SEQ ID NO: 9405112 - DNA, 22 bp, Homo sapiens
ttatctgtgatcctaaatgtct

SEQ ID NO: 9405113 - DNA, 22 bp, Homo sapiens
ttatctgtctatcaagactagc

SEQ ID NO: 9405114 - DNA, 22 bp, Homo sapiens
ttatatgtttctgtttggaggc

SEQ ID NO: 9405115 - DNA, 22 bp, Homo sapiens
ttatatgtttctgtttggaggc

SEQ ID NO: 9405116 - DNA, 22 bp, Homo sapiens
ttatatgtttctgtttggaggc

SEQ ID NO: 9405117 - DNA, 22 bp, Homo sapiens
ttatatgtatgcttataaacca

SEQ ID NO: 9405118 - DNA, 22 bp, Homo sapiens
ttagtgctaaatactcccacag

SEQ ID NO: 9405119 - DNA, 22 bp, Homo sapiens
ttatatgtatgcttataaacca

SEQ ID NO: 9405120 - DNA, 22 bp, Homo sapiens
ttagtcttggtgagtcttggtt

SEQ ID NO: 9405121 - DNA, 22 bp, Homo sapiens
ttagtcttcttccttatatgtt

SEQ ID NO: 9405122 - DNA, 22 bp, Homo sapiens
ttagtagtaagagtcatatgta

SEQ ID NO: 9405123 - DNA, 22 bp, Homo sapiens
ttagtgcattttaatagagatg

SEQ ID NO: 9405124 - DNA, 22 bp, Homo sapiens
ttagtgcaccatcctgaggtgt

SEQ ID NO: 9405125 - DNA, 22 bp, Homo sapiens
ttagtgaatcacagagtacata

SEQ ID NO: 9405126 - DNA, 22 bp, Homo sapiens
ttagatttatatgtgagaatgg

SEQ ID NO: 9405127 - DNA, 22 bp, Homo sapiens
ttagatgttcactctatccccc

SEQ ID NO: 9405128 - DNA, 22 bp, Homo sapiens
ttagcagttgtgagaccctaga

SEQ ID NO: 9405129 - DNA, 22 bp, Homo sapiens
ttagcactggatttcatcagaa

SEQ ID NO: 9405130 - DNA, 22 bp, Homo sapiens
ttagtacattgattcattatgt

SEQ ID NO: 9405131 - DNA, 22 bp, Homo sapiens
ttagtaaataaagtctactttc

SEQ ID NO: 9405132 - DNA, 22 bp, Homo sapiens
ttaggtattttgttatgtcagc

SEQ ID NO: 9405133 - DNA, 22 bp, Homo sapiens
ttagtaaataaagtctactttc

SEQ ID NO: 9405134 - DNA, 22 bp, Homo sapiens
ttaggtaagtaggatcaaaaaa

SEQ ID NO: 9405135 - DNA, 22 bp, Homo sapiens
ttaggtaaggatggtgacagta

SEQ ID NO: 9405136 - DNA, 22 bp, Homo sapiens
ttaggtaaggatggtgacagta

SEQ ID NO: 9405137 - DNA, 22 bp, Homo sapiens
ttaggtaaggatggtgacagta

SEQ ID NO: 9405138 - DNA, 22 bp, Homo sapiens
ttaggaaatcactttgctcacc

SEQ ID NO: 9405139 - DNA, 22 bp, Homo sapiens
ttaggaagatgctttttctggg

SEQ ID NO: 9405140 - DNA, 22 bp, Homo sapiens
ttaggaagagctttcaatcact

SEQ ID NO: 9405141 - DNA, 22 bp, Homo sapiens
ttagggaaggacagtgaagaaa

SEQ ID NO: 9405142 - DNA, 22 bp, Homo sapiens
ttagggaagcatggaggagatg

SEQ ID NO: 9405143 - DNA, 22 bp, Homo sapiens
ttagggttacaccagcctcctg

SEQ ID NO: 9405144 - DNA, 22 bp, Homo sapiens
ttagggagaaatgcttccctca

SEQ ID NO: 9405145 - DNA, 22 bp, Homo sapiens
ttagaaatctgctgccatgcaa

SEQ ID NO: 9405146 - DNA, 22 bp, Homo sapiens
ttagaacaccattctatattac

SEQ ID NO: 9405147 - DNA, 21 bp, Homo sapiens
ttagaacaatatttggtatag

SEQ ID NO: 9405148 - DNA, 22 bp, Homo sapiens
ttacattttgcacagatgtccc

SEQ ID NO: 9405149 - DNA, 22 bp, Homo sapiens
ttagatatgtttttgctaatgc

SEQ ID NO: 9405150 - DNA, 22 bp, Homo sapiens
ttagatcaatactaaagaagtt

SEQ ID NO: 9405151 - DNA, 22 bp, Homo sapiens
ttagatatgtttttgctaatgc

SEQ ID NO: 9405152 - DNA, 22 bp, Homo sapiens
ttagataatgttattgtaattt

SEQ ID NO: 9405153 - DNA, 22 bp, Homo sapiens
ttagaacatctgtgtctttatg

SEQ ID NO: 9405154 - DNA, 22 bp, Homo sapiens
ttagaacatctgtgtctttatg

SEQ ID NO: 9405155 - DNA, 22 bp, Homo sapiens
ttagaacatctctcttctgcca

SEQ ID NO: 9405156 - DNA, 22 bp, Homo sapiens
ttagaacaccattctatattac

SEQ ID NO: 9405157 - DNA, 22 bp, Homo sapiens
ttagaacatagcaacagaatta

SEQ ID NO: 9405158 - DNA, 22 bp, Homo sapiens
tgtctcttgttaatgattacta

SEQ ID NO: 9405159 - DNA, 22 bp, Homo sapiens
tgtctcttggctctatcactta

SEQ ID NO: 9405160 - DNA, 22 bp, Homo sapiens
tgtctctggcccatgagcagag

SEQ ID NO: 9405161 - DNA, 22 bp, Homo sapiens
tgtctctgctttccttgcaggg

SEQ ID NO: 9405162 - DNA, 22 bp, Homo sapiens
tgtctctgctgcaccttctggg

SEQ ID NO: 9405163 - DNA, 22 bp, Homo sapiens
tgtctctgctttccttgcaggg

SEQ ID NO: 9405164 - DNA, 22 bp, Homo sapiens
tgtctcttttcaagctaccctt

SEQ ID NO: 9405165 - DNA, 22 bp, Homo sapiens
tgtctctttgggttcctcttgg

SEQ ID NO: 9405166 - DNA, 22 bp, Homo sapiens
tgtctctttgggttcctcttgg

SEQ ID NO: 9405167 - DNA, 22 bp, Homo sapiens
tgtctctttgggttcctcttgg

SEQ ID NO: 9405168 - DNA, 22 bp, Homo sapiens
tgtctctgagatgactcccacc

SEQ ID NO: 9405169 - DNA, 18 bp, Homo sapiens
tgtctctgaattccagtg

SEQ ID NO: 9405170 - DNA, 22 bp, Homo sapiens
tgtctctgccagctagcagaat

SEQ ID NO: 9405171 - DNA, 22 bp, Homo sapiens
tgtctctgataagtagttcagt

SEQ ID NO: 9405172 - DNA, 22 bp, Homo sapiens
tgtctctgccagctagcagaat

SEQ ID NO: 9405173 - DNA, 22 bp, Homo sapiens
tgtctctctgcccccattgctc

SEQ ID NO: 9405174 - DNA, 22 bp, Homo sapiens
tgtctctctagctcttggtttg

SEQ ID NO: 9405175 - DNA, 22 bp, Homo sapiens
tgtctctctgcccccattgctc

SEQ ID NO: 9405176 - DNA, 19 bp, Homo sapiens
tgtctctgaaagatgagct

SEQ ID NO: 9405177 - DNA, 22 bp, Homo sapiens
tgtctctgaaatatgtggctcc

SEQ ID NO: 9405178 - DNA, 22 bp, Homo sapiens
tgtctctgaaatatgtggctcc

SEQ ID NO: 9405179 - DNA, 22 bp, Homo sapiens
tgtctctgaaatatgtggctcc

SEQ ID NO: 9405180 - DNA, 22 bp, Homo sapiens
tgtctctgaacagcttactaaa

SEQ ID NO: 9405181 - DNA, 22 bp, Homo sapiens
tgtctctgaagccccctccttt

SEQ ID NO: 9405182 - DNA, 22 bp, Homo sapiens
tgtctgcctgtctctgtgcaaa

SEQ ID NO: 9405183 - DNA, 22 bp, Homo sapiens
tgtctgccaaagcttcctcctg

SEQ ID NO: 9405184 - DNA, 22 bp, Homo sapiens
tgtctgatcatgaggcagggct

SEQ ID NO: 9405185 - DNA, 22 bp, Homo sapiens
tgtctgatgatagtgtctctcc

SEQ ID NO: 9405186 - DNA, 22 bp, Homo sapiens
tgtctgagtggtgcaaggctga

SEQ ID NO: 9405187 - DNA, 22 bp, Homo sapiens
tgtctgagtgtgcctgggcatt

SEQ ID NO: 9405188 - DNA, 22 bp, Homo sapiens
tgtctgagctgcacagaagtaa

SEQ ID NO: 9405189 - DNA, 22 bp, Homo sapiens
tgtctgagctggggcagacaga

SEQ ID NO: 9405190 - DNA, 22 bp, Homo sapiens
tgtctgagactgttttactttc

SEQ ID NO: 9405191 - DNA, 22 bp, Homo sapiens
tgtctgaggaagtcagcccttt

SEQ ID NO: 9405192 - DNA, 19 bp, Homo sapiens
tgtctgagtatgctgacaa

SEQ ID NO: 9405193 - DNA, 22 bp, Homo sapiens
tgtctatacctgatacagagtt

SEQ ID NO: 9405194 - DNA, 22 bp, Homo sapiens
tgtctatgcaatggaaggactg

SEQ ID NO: 9405195 - DNA, 22 bp, Homo sapiens
tgtctccaaaacaatctcagat

SEQ ID NO: 9405196 - DNA, 22 bp, Homo sapiens
tgtctccaactcactgtatact

SEQ ID NO: 9405197 - DNA, 22 bp, Homo sapiens
tgtctccaactcactgtatact

SEQ ID NO: 9405198 - DNA, 22 bp, Homo sapiens
tgtctccatagaagagactgca

SEQ ID NO: 9405199 - DNA, 20 bp, Homo sapiens
tgtctccagggctgagtgga

SEQ ID NO: 9405200 - DNA, 22 bp, Homo sapiens
tgtctccacaggtgtcagctca

SEQ ID NO: 9405201 - DNA, 22 bp, Homo sapiens
tgtctccaccatcatcttacca

SEQ ID NO: 9405202 - DNA, 22 bp, Homo sapiens
tgtctacttgggctctacagca

SEQ ID NO: 9405203 - DNA, 22 bp, Homo sapiens
tgtctagaaatgctgagtctca

SEQ ID NO: 9405204 - DNA, 23 bp, Homo sapiens
tgtctaggatcagtcaggatgag

SEQ ID NO: 9405205 - DNA, 22 bp, Homo sapiens
tgtctagggcgagaatgtgtag

SEQ ID NO: 9405206 - DNA, 22 bp, Homo sapiens
tgtctaaacttgttttatctca

SEQ ID NO: 9405207 - DNA, 22 bp, Homo sapiens
tgtcggccacgagggagccgcg

SEQ ID NO: 9405208 - DNA, 22 bp, Homo sapiens
tgtctaaatgcaatggatttcc

SEQ ID NO: 9405209 - DNA, 22 bp, Homo sapiens
tgtctaaacttgttttatctca

SEQ ID NO: 9405210 - DNA, 22 bp, Homo sapiens
tgtctaaatgaaaagagatgcc

SEQ ID NO: 9405211 - DNA, 22 bp, Homo sapiens
tgtctaatggcaatttcatgtg

SEQ ID NO: 9405212 - DNA, 22 bp, Homo sapiens
tgtctaaatgcaatggatttcc

SEQ ID NO: 9405213 - DNA, 22 bp, Homo sapiens
tgtctacagaatgttaatattt

SEQ ID NO: 9405214 - DNA, 22 bp, Homo sapiens
tgtctcctcaactcatgctcga

SEQ ID NO: 9405215 - DNA, 22 bp, Homo sapiens
tgtctcctcaactcatgctcga

SEQ ID NO: 9405216 - DNA, 22 bp, Homo sapiens
tgtctcctcggctgtccagcca

SEQ ID NO: 9405217 - DNA, 22 bp, Homo sapiens
tgtctcctcaactcatgctcga

SEQ ID NO: 9405218 - DNA, 22 bp, Homo sapiens
tgtctcctactgcctgtggatc

SEQ ID NO: 9405219 - DNA, 22 bp, Homo sapiens
tgtctccattttcaagtagcag

SEQ ID NO: 9405220 - DNA, 23 bp, Homo sapiens
tgtctccatctcattacttgggg

SEQ ID NO: 9405221 - DNA, 22 bp, Homo sapiens
tgtctcctgagagctggacaga

SEQ ID NO: 9405222 - DNA, 22 bp, Homo sapiens
tgtctcctgggtcccttccacc

SEQ ID NO: 9405223 - DNA, 21 bp, Homo sapiens
tgtctcctgttggcacatggc

SEQ ID NO: 9405224 - DNA, 22 bp, Homo sapiens
tgtctcctgggtcccttccacc

SEQ ID NO: 9405225 - DNA, 22 bp, Homo sapiens
tgtctctccacacagccagtgc

SEQ ID NO: 9405226 - DNA, 22 bp, Homo sapiens
tgtctctcctgatgatctggtg

SEQ ID NO: 9405227 - DNA, 18 bp, Homo sapiens
tgtctctcctttctgtgt

SEQ ID NO: 9405228 - DNA, 18 bp, Homo sapiens
tgtctctcctttctgtgt

SEQ ID NO: 9405229 - DNA, 20 bp, Homo sapiens
tgtctctcggttttgtgact

SEQ ID NO: 9405230 - DNA, 22 bp, Homo sapiens
tgtctctagggcaatgtgaact

SEQ ID NO: 9405231 - DNA, 22 bp, Homo sapiens
tgtctctagggcaatgtgaact

SEQ ID NO: 9405232 - DNA, 22 bp, Homo sapiens
tgtctctcatttagttttgcac

SEQ ID NO: 9405233 - DNA, 20 bp, Homo sapiens
tgtctctcagtgtcagtgca

SEQ ID NO: 9405234 - DNA, 22 bp, Homo sapiens
tgtctttaaaattaaacacatc

SEQ ID NO: 9405235 - DNA, 22 bp, Homo sapiens
tgtcttgtctgtgagggcattg

SEQ ID NO: 9405236 - DNA, 22 bp, Homo sapiens
tgtcttctaccttgacagcatt

SEQ ID NO: 9405237 - DNA, 22 bp, Homo sapiens
tgtcttctaccttgacagcatt

SEQ ID NO: 9405238 - DNA, 17 bp, Homo sapiens
tgtcttctgaagagagc

SEQ ID NO: 9405239 - DNA, 22 bp, Homo sapiens
tgtcttctgtattcaagtctat

SEQ ID NO: 9405240 - DNA, 22 bp, Homo sapiens
tgtcttcattctgtatgtccag

SEQ ID NO: 9405241 - DNA, 23 bp, Homo sapiens
tgtcttcgactcctgcgtgcttc

SEQ ID NO: 9405242 - DNA, 22 bp, Homo sapiens
tgtcttcatgcctgaaagaaga

SEQ ID NO: 9405243 - DNA, 22 bp, Homo sapiens
tgtcttcatggcggaacaactt

SEQ ID NO: 9405244 - DNA, 22 bp, Homo sapiens
tgtcttcatggcggaacaactt

SEQ ID NO: 9405245 - DNA, 22 bp, Homo sapiens
tgtcttcattccccatgaagtc

SEQ ID NO: 9405246 - DNA, 20 bp, Homo sapiens
tgtcttcattatggtgccct

SEQ ID NO: 9405247 - DNA, 22 bp, Homo sapiens
tgtcttcagtaaaatacactat

SEQ ID NO: 9405248 - DNA, 22 bp, Homo sapiens
tgtcttcagtaaaatacactat

SEQ ID NO: 9405249 - DNA, 22 bp, Homo sapiens
tgtcttcatctccatgcacaga

SEQ ID NO: 9405250 - DNA, 22 bp, Homo sapiens
tgtcttcatctccatgcacaga

SEQ ID NO: 9405251 - DNA, 21 bp, Homo sapiens
tgtcttcatatgagatggtgt

SEQ ID NO: 9405252 - DNA, 22 bp, Homo sapiens
tgtcttcatctcagacacagtt

SEQ ID NO: 9405253 - DNA, 22 bp, Homo sapiens
tgtcttttataactgacatata

SEQ ID NO: 9405254 - DNA, 22 bp, Homo sapiens
tgtcttttagtttgtgagatct

SEQ ID NO: 9405255 - DNA, 22 bp, Homo sapiens
tgtcttttgccaaagatcagtt

SEQ ID NO: 9405256 - DNA, 22 bp, Homo sapiens
tgtcttttgccaaagatcagtt

SEQ ID NO: 9405257 - DNA, 22 bp, Homo sapiens
tgtcttttgccaaagatcagtt

SEQ ID NO: 9405258 - DNA, 22 bp, Homo sapiens
tgtcttttctactgtaagcata

SEQ ID NO: 9405259 - DNA, 19 bp, Homo sapiens
tgtctttggtctgagtttc

SEQ ID NO: 9405260 - DNA, 22 bp, Homo sapiens
tgtcttttacctaatgagctgg

SEQ ID NO: 9405261 - DNA, 22 bp, Homo sapiens
tgtctttgttattgtggacagg

SEQ ID NO: 9405262 - DNA, 22 bp, Homo sapiens
tgtctttgtgtacaggatcgcc

SEQ ID NO: 9405263 - DNA, 23 bp, Homo sapiens
tgtctttgttaggactgtgttta

SEQ ID NO: 9405264 - DNA, 22 bp, Homo sapiens
tgtgaaaagcaggctactttct

SEQ ID NO: 9405265 - DNA, 22 bp, Homo sapiens
tgtgaaaagcaggctactttct

SEQ ID NO: 9405266 - DNA, 22 bp, Homo sapiens
tgtgaaaagcgtgtgttctagg

SEQ ID NO: 9405267 - DNA, 22 bp, Homo sapiens
tgtgaaaagcgtgtgttctagg

SEQ ID NO: 9405268 - DNA, 22 bp, Homo sapiens
tgtgaaaagggctttgtacaaa

SEQ ID NO: 9405269 - DNA, 22 bp, Homo sapiens
tgtgaaaagggctttgtacaaa

SEQ ID NO: 9405270 - DNA, 22 bp, Homo sapiens
tgtctttttactatgttcaatc

SEQ ID NO: 9405271 - DNA, 22 bp, Homo sapiens
tgtcttttggagcatctttctt

SEQ ID NO: 9405272 - DNA, 19 bp, Homo sapiens
tgtctggaagagctgcagg

SEQ ID NO: 9405273 - DNA, 19 bp, Homo sapiens
tgtctggaagagctgcagg

SEQ ID NO: 9405274 - DNA, 19 bp, Homo sapiens
tgtctggaagagctgcagg

SEQ ID NO: 9405275 - DNA, 19 bp, Homo sapiens
tgtctggaagagctgcagg

SEQ ID NO: 9405276 - DNA, 22 bp, Homo sapiens
tgtctggacagagattctcaat

SEQ ID NO: 9405277 - DNA, 22 bp, Homo sapiens
tgtctggacagagattctcaat

SEQ ID NO: 9405278 - DNA, 22 bp, Homo sapiens
tgtctggacattgacaatcatg

SEQ ID NO: 9405279 - DNA, 22 bp, Homo sapiens
tgtctggaagggctatgtgacc

SEQ ID NO: 9405280 - DNA, 22 bp, Homo sapiens
tgtctggaagtaccagggaagc

SEQ ID NO: 9405281 - DNA, 22 bp, Homo sapiens
tgtctggaatttctattttgtc

SEQ ID NO: 9405282 - DNA, 23 bp, Homo sapiens
tgtctggagcctgagcaggtgct

SEQ ID NO: 9405283 - DNA, 22 bp, Homo sapiens
tgtctggagggctggctccctg

SEQ ID NO: 9405284 - DNA, 22 bp, Homo sapiens
tgtctggaggggatgttatggt

SEQ ID NO: 9405285 - DNA, 22 bp, Homo sapiens
tgtctggacattgacaatcatg

SEQ ID NO: 9405286 - DNA, 22 bp, Homo sapiens
tgtctggactgctcacagtacc

SEQ ID NO: 9405287 - DNA, 23 bp, Homo sapiens
tgtctggagagggcttgctctcc

SEQ ID NO: 9405288 - DNA, 22 bp, Homo sapiens
tgtctggatcagtgggtgcttg

SEQ ID NO: 9405289 - DNA, 22 bp, Homo sapiens
tgtctggatggtggagattgag

SEQ ID NO: 9405290 - DNA, 22 bp, Homo sapiens
tgtctggatggtggagattgag

SEQ ID NO: 9405291 - DNA, 23 bp, Homo sapiens
tgtctggagttttgcactgttgc

SEQ ID NO: 9405292 - DNA, 22 bp, Homo sapiens
tgtctggatagagcctaggccc

SEQ ID NO: 9405293 - DNA, 22 bp, Homo sapiens
tgtctggaggtcaggtcctggg

SEQ ID NO: 9405294 - DNA, 22 bp, Homo sapiens
tgtctgggagggacagggctac

SEQ ID NO: 9405295 - DNA, 22 bp, Homo sapiens
tgtctgggagggacagggctac

SEQ ID NO: 9405296 - DNA, 22 bp, Homo sapiens
tgtctgggagggacagggctac

SEQ ID NO: 9405297 - DNA, 23 bp, Homo sapiens
tgtctggctcatggtgggtctca

SEQ ID NO: 9405298 - DNA, 22 bp, Homo sapiens
tgtctggatgtctggagcatcg

SEQ ID NO: 9405299 - DNA, 20 bp, Homo sapiens
tgtctggatgtttaagcaga

SEQ ID NO: 9405300 - DNA, 22 bp, Homo sapiens
tgtctggattgctgagccccag

SEQ ID NO: 9405301 - DNA, 23 bp, Homo sapiens
tgtctggattcgactgtggttgg

SEQ ID NO: 9405302 - DNA, 22 bp, Homo sapiens
tgtctgtgacctcttaggcaag

SEQ ID NO: 9405303 - DNA, 22 bp, Homo sapiens
tgtctgtgacctcttaggcaag

SEQ ID NO: 9405304 - DNA, 22 bp, Homo sapiens
tgtctgtgacctctttggagcc

SEQ ID NO: 9405305 - DNA, 22 bp, Homo sapiens
tgtctgtgacctctttggagcc

SEQ ID NO: 9405306 - DNA, 22 bp, Homo sapiens
tgtcttatgtagatactgagaa

SEQ ID NO: 9405307 - DNA, 22 bp, Homo sapiens
tgtcttcacaaagcagaaggga

SEQ ID NO: 9405308 - DNA, 22 bp, Homo sapiens
tgtcttcacatgataagccatt

SEQ ID NO: 9405309 - DNA, 22 bp, Homo sapiens
tgtcttcacatgataagccatt

SEQ ID NO: 9405310 - DNA, 22 bp, Homo sapiens
tgtcttcacaaagcagaaggga

SEQ ID NO: 9405311 - DNA, 22 bp, Homo sapiens
tgtcttcagataggcattcttc

SEQ ID NO: 9405312 - DNA, 22 bp, Homo sapiens
tgtcttcagaattaagagtatg

SEQ ID NO: 9405313 - DNA, 22 bp, Homo sapiens
tgtcttcaggagtaaatatcat

SEQ ID NO: 9405314 - DNA, 22 bp, Homo sapiens
tgtctgtggcaattgtgggtaa

SEQ ID NO: 9405315 - DNA, 22 bp, Homo sapiens
tgtctgtgatttaggccagggc

SEQ ID NO: 9405316 - DNA, 22 bp, Homo sapiens
tgtctgttattggtgtataaga

SEQ ID NO: 9405317 - DNA, 22 bp, Homo sapiens
tgtctgttattggtgtataaga

SEQ ID NO: 9405318 - DNA, 22 bp, Homo sapiens
tgtcttaaacttgtgggacttc

SEQ ID NO: 9405319 - DNA, 22 bp, Homo sapiens
tgtcttaatttccctttgtcat

SEQ ID NO: 9405320 - DNA, 22 bp, Homo sapiens
tgtcttaatttggatgatgttt

SEQ ID NO: 9405321 - DNA, 19 bp, Homo sapiens
tgtcttaattaactcagag

SEQ ID NO: 9405322 - DNA, 22 bp, Homo sapiens
tgtgatttcatctgaggccagg

SEQ ID NO: 9405323 - DNA, 22 bp, Homo sapiens
tgtgatttcactggtgacatgt

SEQ ID NO: 9405324 - DNA, 22 bp, Homo sapiens
tgtgatttattgaaaagagctt

SEQ ID NO: 9405325 - DNA, 22 bp, Homo sapiens
tgtgatttccagccattaaaaa

SEQ ID NO: 9405326 - DNA, 18 bp, Homo sapiens
tgtgatttggctggaaat

SEQ ID NO: 9405327 - DNA, 22 bp, Homo sapiens
tgtgattttcaaggtgactcaa

SEQ ID NO: 9405328 - DNA, 22 bp, Homo sapiens
tgtgcaaaataataaatcactg

SEQ ID NO: 9405329 - DNA, 22 bp, Homo sapiens
tgtgattttcgttatggcttgg

SEQ ID NO: 9405330 - DNA, 22 bp, Homo sapiens
tgtgatttatgcatggggaagt

SEQ ID NO: 9405331 - DNA, 19 bp, Homo sapiens
tgtgataagcagaattcca

SEQ ID NO: 9405332 - DNA, 22 bp, Homo sapiens
tgtgataagttaaattaaacct

SEQ ID NO: 9405333 - DNA, 21 bp, Homo sapiens
tgtgataatactatatgctct

SEQ ID NO: 9405334 - DNA, 22 bp, Homo sapiens
tgtgatagaaagtatcacaagg

SEQ ID NO: 9405335 - DNA, 22 bp, Homo sapiens
tgtgatagatatgcacatagct

SEQ ID NO: 9405336 - DNA, 22 bp, Homo sapiens
tgtgatatttgagtattgtcaa

SEQ ID NO: 9405337 - DNA, 22 bp, Homo sapiens
tgtgatgtcagtggtatcaaag

SEQ ID NO: 9405338 - DNA, 22 bp, Homo sapiens
tgtgagtagctgaagcagaaca

SEQ ID NO: 9405339 - DNA, 22 bp, Homo sapiens
tgtgagcactggctgggaaagt

SEQ ID NO: 9405340 - DNA, 22 bp, Homo sapiens
tgtgataacttttacattttcg

SEQ ID NO: 9405341 - DNA, 22 bp, Homo sapiens
tgtgagttcttattgctcatct

SEQ ID NO: 9405342 - DNA, 22 bp, Homo sapiens
tgtgagttcttagaaagtcagt

SEQ ID NO: 9405343 - DNA, 22 bp, Homo sapiens
tgtgagttattttcaggagttt

SEQ ID NO: 9405344 - DNA, 22 bp, Homo sapiens
tgtgagcactatggctaggctc

SEQ ID NO: 9405345 - DNA, 22 bp, Homo sapiens
tgtgagattttatttgatatgc

SEQ ID NO: 9405346 - DNA, 19 bp, Homo sapiens
tgtgagaggctagctgccc

SEQ ID NO: 9405347 - DNA, 22 bp, Homo sapiens
tgtgagagctgcttcagccagg

SEQ ID NO: 9405348 - DNA, 22 bp, Homo sapiens
tgtgacctcatcttaactggaa

SEQ ID NO: 9405349 - DNA, 22 bp, Homo sapiens
tgtgacatgcaggaggtgctca

SEQ ID NO: 9405350 - DNA, 22 bp, Homo sapiens
tgtgactatcattctaaacatc

SEQ ID NO: 9405351 - DNA, 22 bp, Homo sapiens
tgtgactatcattctaaacatc

SEQ ID NO: 9405352 - DNA, 22 bp, Homo sapiens
tgtgactaggcctgagctcttg

SEQ ID NO: 9405353 - DNA, 22 bp, Homo sapiens
tgtgactgaggctccaagctag

SEQ ID NO: 9405354 - DNA, 22 bp, Homo sapiens
tgtgactggttgtcccgctttc

SEQ ID NO: 9405355 - DNA, 19 bp, Homo sapiens
tgtgactggttgtctcgct

SEQ ID NO: 9405356 - DNA, 22 bp, Homo sapiens
tgtgacttaatccttgggtggg

SEQ ID NO: 9405357 - DNA, 22 bp, Homo sapiens
tgtgagaaaatgattgcacagt

SEQ ID NO: 9405358 - DNA, 22 bp, Homo sapiens
tgtgagaagggcatgcagggag

SEQ ID NO: 9405359 - DNA, 22 bp, Homo sapiens
tgtgagaagggtgaggctttta

SEQ ID NO: 9405360 - DNA, 22 bp, Homo sapiens
tgtgagacaggatttagagcag

SEQ ID NO: 9405361 - DNA, 22 bp, Homo sapiens
tgtgagacaattgcatcagggc

SEQ ID NO: 9405362 - DNA, 22 bp, Homo sapiens
tgtgagacgtgttagaacagtg

SEQ ID NO: 9405363 - DNA, 22 bp, Homo sapiens
tgtgagagctccatcctcatga

SEQ ID NO: 9405364 - DNA, 22 bp, Homo sapiens
tgtgaatggacaattaaatcta

SEQ ID NO: 9405365 - DNA, 22 bp, Homo sapiens
tgtgaataccttgaattcatca

SEQ ID NO: 9405366 - DNA, 22 bp, Homo sapiens
tgtgaatacattggtagaagca

SEQ ID NO: 9405367 - DNA, 22 bp, Homo sapiens
tgtgaataccttgaattcatca

SEQ ID NO: 9405368 - DNA, 22 bp, Homo sapiens
tgtgaatagattgaagctttgg

SEQ ID NO: 9405369 - DNA, 22 bp, Homo sapiens
tgtgaatagtgccgcaataaac

SEQ ID NO: 9405370 - DNA, 22 bp, Homo sapiens
tgtgaacatttctggttatttg

SEQ ID NO: 9405371 - DNA, 22 bp, Homo sapiens
tgtgaacatttctggttatttg

SEQ ID NO: 9405372 - DNA, 22 bp, Homo sapiens
tgtgaagtccagagaagtcagg

SEQ ID NO: 9405373 - DNA, 22 bp, Homo sapiens
tgtgaataatgccgcaataaac

SEQ ID NO: 9405374 - DNA, 19 bp, Homo sapiens
tgtgacatcactgggcagc

SEQ ID NO: 9405375 - DNA, 22 bp, Homo sapiens
tgtgacatcgctgtgtctgttt

SEQ ID NO: 9405376 - DNA, 23 bp, Homo sapiens
tgtgacagtgacaatactgactt

SEQ ID NO: 9405377 - DNA, 22 bp, Homo sapiens
tgtgacagtgccagcttcatag

SEQ ID NO: 9405378 - DNA, 22 bp, Homo sapiens
tgtgacagccagtaaagtaagc

SEQ ID NO: 9405379 - DNA, 23 bp, Homo sapiens
tgtgacagggtcattgaaaaggg

SEQ ID NO: 9405380 - DNA, 22 bp, Homo sapiens
tgtgacagaattggtctgttct

SEQ ID NO: 9405381 - DNA, 22 bp, Homo sapiens
tgtgacaagcattgtatattgg

SEQ ID NO: 9405382 - DNA, 22 bp, Homo sapiens
tgtgacagatctctatacatga

SEQ ID NO: 9405383 - DNA, 22 bp, Homo sapiens
tgtgaaaggggtcacagggaaa

SEQ ID NO: 9405384 - DNA, 22 bp, Homo sapiens
tgtgaaagtcaaattaattgaa

SEQ ID NO: 9405385 - DNA, 21 bp, Homo sapiens
tgtgaaatagctatgctacat

SEQ ID NO: 9405386 - DNA, 22 bp, Homo sapiens
tgtgaaatctgatgaattgacc

SEQ ID NO: 9405387 - DNA, 22 bp, Homo sapiens
tgtgaaatctgatgaattgacc

SEQ ID NO: 9405388 - DNA, 22 bp, Homo sapiens
tgtgaaatctgaactcaaagat

SEQ ID NO: 9405389 - DNA, 22 bp, Homo sapiens
tgtgaaatctgaactcaaagat

SEQ ID NO: 9405390 - DNA, 22 bp, Homo sapiens
tgtgaaatcacaggctatttag

SEQ ID NO: 9405391 - DNA, 22 bp, Homo sapiens
tgtgaaatcaattagctgcaga

SEQ ID NO: 9405392 - DNA, 22 bp, Homo sapiens
tgtgaaatcacaggctatttag

SEQ ID NO: 9405393 - DNA, 22 bp, Homo sapiens
tgtgaaatcaattagctgcaga

SEQ ID NO: 9405394 - DNA, 22 bp, Homo sapiens
tgtgaaatatttatatactcaa

SEQ ID NO: 9405395 - DNA, 22 bp, Homo sapiens
tgtgaaatattggcaatttcat

SEQ ID NO: 9405396 - DNA, 22 bp, Homo sapiens
tgtgaaatattggcaatttcat

SEQ ID NO: 9405397 - DNA, 22 bp, Homo sapiens
tgtgaaattgaatgcccattgc

SEQ ID NO: 9405398 - DNA, 22 bp, Homo sapiens
tgtgaaattgagaaactttcac

SEQ ID NO: 9405399 - DNA, 22 bp, Homo sapiens
tgtgaaattgagaaactttcac

SEQ ID NO: 9405400 - DNA, 23 bp, Homo sapiens
tgtgaaatttgaggtcagtgctt

SEQ ID NO: 9405401 - DNA, 18 bp, Homo sapiens
tgtgaacacatttttctg

SEQ ID NO: 9405402 - DNA, 18 bp, Homo sapiens
tgtgaacacatttttctg

SEQ ID NO: 9405403 - DNA, 22 bp, Homo sapiens
tgtgaacagtatgtcatttcac

SEQ ID NO: 9405404 - DNA, 22 bp, Homo sapiens
tgtgaacagtatgtcatttcac

SEQ ID NO: 9405405 - DNA, 22 bp, Homo sapiens
tgtgaaatgtgtgtataattaa

SEQ ID NO: 9405406 - DNA, 22 bp, Homo sapiens
tgtgaaattacttaaaggaaat

SEQ ID NO: 9405407 - DNA, 22 bp, Homo sapiens
tgtgaaatgtgtgtataattaa

SEQ ID NO: 9405408 - DNA, 22 bp, Homo sapiens
tgtgaaattcttgaaatgcaca

SEQ ID NO: 9405409 - DNA, 22 bp, Homo sapiens
tgtgaaatgaagataattcttg

SEQ ID NO: 9405410 - DNA, 22 bp, Homo sapiens
tgtgaaatgaagataattcttg

SEQ ID NO: 9405411 - DNA, 22 bp, Homo sapiens
tgtgaaatgagtatatttgaat

SEQ ID NO: 9405412 - DNA, 22 bp, Homo sapiens
tgtgaaatgctattgtgacaaa

SEQ ID NO: 9405413 - DNA, 22 bp, Homo sapiens
tgtgaaatgagtatatttgaat

SEQ ID NO: 9405414 - DNA, 22 bp, Homo sapiens
tgtgaaatgtggatgttaatag

SEQ ID NO: 9405415 - DNA, 22 bp, Homo sapiens
tgtgaaatgctatttccatgag

SEQ ID NO: 9405416 - DNA, 22 bp, Homo sapiens
tgtgaaatgtggatgttaatag

SEQ ID NO: 9405417 - DNA, 22 bp, Homo sapiens
tgtgaaatgtgtgtataattaa

SEQ ID NO: 9405418 - DNA, 22 bp, Homo sapiens
tgtgaaatgctatttccatgag

SEQ ID NO: 9405419 - DNA, 22 bp, Homo sapiens
tgtgccttctcagtcctgctca

SEQ ID NO: 9405420 - DNA, 22 bp, Homo sapiens
tgtgccttccctctgctgattt

SEQ ID NO: 9405421 - DNA, 22 bp, Homo sapiens
tgtgccttccctctgctgattt

SEQ ID NO: 9405422 - DNA, 22 bp, Homo sapiens
tgtgcctgtcaccctcagagag

SEQ ID NO: 9405423 - DNA, 22 bp, Homo sapiens
tgtgcctgttcccactttgcct

SEQ ID NO: 9405424 - DNA, 22 bp, Homo sapiens
tgtgcctgttggtgtagacata

SEQ ID NO: 9405425 - DNA, 22 bp, Homo sapiens
tgtgcctggcccagtggtgtca

SEQ ID NO: 9405426 - DNA, 22 bp, Homo sapiens
tgtgcctggcattctgggcttc

SEQ ID NO: 9405427 - DNA, 22 bp, Homo sapiens
tgtgcctggcattctgggcttc

SEQ ID NO: 9405428 - DNA, 22 bp, Homo sapiens
tgtgcctggatctctgtgacaa

SEQ ID NO: 9405429 - DNA, 22 bp, Homo sapiens
tgtgcctgatggtcacgtggcc

SEQ ID NO: 9405430 - DNA, 22 bp, Homo sapiens
tgtgcctgagttggctgagtac

SEQ ID NO: 9405431 - DNA, 22 bp, Homo sapiens
tgtggaaaagccccacaggact

SEQ ID NO: 9405432 - DNA, 22 bp, Homo sapiens
tgtggaaagtcaagttccagga

SEQ ID NO: 9405433 - DNA, 22 bp, Homo sapiens
tgtggaaagtggtctaagcaca

SEQ ID NO: 9405434 - DNA, 22 bp, Homo sapiens
tgtggaaaagaataagggagat

SEQ ID NO: 9405435 - DNA, 22 bp, Homo sapiens
tgtggaaaaaccacaagtttgg

SEQ ID NO: 9405436 - DNA, 22 bp, Homo sapiens
tgtgctgctgtgaataagacct

SEQ ID NO: 9405437 - DNA, 22 bp, Homo sapiens
tgtgctcttctgttacttgtag

SEQ ID NO: 9405438 - DNA, 22 bp, Homo sapiens
tgtgctgctctcagtgacagcc

SEQ ID NO: 9405439 - DNA, 22 bp, Homo sapiens
tgtgctgagcaaatccatctgt

SEQ ID NO: 9405440 - DNA, 22 bp, Homo sapiens
tgtgctgacaagatcagaaggt

SEQ ID NO: 9405441 - DNA, 22 bp, Homo sapiens
tgtgctcatggtccagcatggt

SEQ ID NO: 9405442 - DNA, 22 bp, Homo sapiens
tgtgctcatggtccagcatggt

SEQ ID NO: 9405443 - DNA, 22 bp, Homo sapiens
tgtgctcatggtccagcatggt

SEQ ID NO: 9405444 - DNA, 22 bp, Homo sapiens
tgtgctaagtattttcttattt

SEQ ID NO: 9405445 - DNA, 22 bp, Homo sapiens
tgtgctaaggcagtctatcaca

SEQ ID NO: 9405446 - DNA, 22 bp, Homo sapiens
tgtgctctgactttctcctggt

SEQ ID NO: 9405447 - DNA, 22 bp, Homo sapiens
tgtgctctgactttctcctggt

SEQ ID NO: 9405448 - DNA, 17 bp, Homo sapiens
tgtgctctctcactcag

SEQ ID NO: 9405449 - DNA, 17 bp, Homo sapiens
tgtgctctctcactcag

SEQ ID NO: 9405450 - DNA, 22 bp, Homo sapiens
tgtgctctgaagagtgcatgtc

SEQ ID NO: 9405451 - DNA, 22 bp, Homo sapiens
tgtgctccatcatccataatct

SEQ ID NO: 9405452 - DNA, 23 bp, Homo sapiens
tgtgctcccaaatgtaggtctat

SEQ ID NO: 9405453 - DNA, 22 bp, Homo sapiens
tgtgcacaggaagctattctct

SEQ ID NO: 9405454 - DNA, 22 bp, Homo sapiens
tgtgcacattctaggactagta

SEQ ID NO: 9405455 - DNA, 22 bp, Homo sapiens
tgtgcaataatcatagtgattt

SEQ ID NO: 9405456 - DNA, 22 bp, Homo sapiens
tgtgcaaattaagtagattttc

SEQ ID NO: 9405457 - DNA, 22 bp, Homo sapiens
tgtgcaaattaagtagattttc

SEQ ID NO: 9405458 - DNA, 22 bp, Homo sapiens
tgtgcaaagtgtacaaattaat

SEQ ID NO: 9405459 - DNA, 22 bp, Homo sapiens
tgtgcaaagtgtacaaattaat

SEQ ID NO: 9405460 - DNA, 22 bp, Homo sapiens
tgtgcaaagtgtacaaattaat

SEQ ID NO: 9405461 - DNA, 22 bp, Homo sapiens
tgtgcaaattaagtagattttc

SEQ ID NO: 9405462 - DNA, 22 bp, Homo sapiens
tgtgcaatcatattttaaaatg

SEQ ID NO: 9405463 - DNA, 22 bp, Homo sapiens
tgtgcagctctagagccaagcc

SEQ ID NO: 9405464 - DNA, 20 bp, Homo sapiens
tgtgcaggagagtgaggctg

SEQ ID NO: 9405465 - DNA, 22 bp, Homo sapiens
tgtgcagagtaaggcagctgtt

SEQ ID NO: 9405466 - DNA, 22 bp, Homo sapiens
tgtgcagagcccacaggcagct

SEQ ID NO: 9405467 - DNA, 22 bp, Homo sapiens
tgtgcaggtgcaggaagggggc

SEQ ID NO: 9405468 - DNA, 22 bp, Homo sapiens
tgtgcagtgtgaccagggctgc

SEQ ID NO: 9405469 - DNA, 22 bp, Homo sapiens
tgtgcagggaagggcatgctat

SEQ ID NO: 9405470 - DNA, 20 bp, Homo sapiens
tgtgcaggagagtgaggctg

SEQ ID NO: 9405471 - DNA, 20 bp, Homo sapiens
tgtgcaggagagtgaggctg

SEQ ID NO: 9405472 - DNA, 22 bp, Homo sapiens
tgtgcagggaagggcatgctat

SEQ ID NO: 9405473 - DNA, 22 bp, Homo sapiens
tgtgccctgcctacatcacctt

SEQ ID NO: 9405474 - DNA, 20 bp, Homo sapiens
tgtgccctgcagacttcttt

SEQ ID NO: 9405475 - DNA, 19 bp, Homo sapiens
tgtgccccctccagcctgc

SEQ ID NO: 9405476 - DNA, 22 bp, Homo sapiens
tgtgccctcagaagagtacatc

SEQ ID NO: 9405477 - DNA, 22 bp, Homo sapiens
tgtgcctcaccctgctcttggc

SEQ ID NO: 9405478 - DNA, 22 bp, Homo sapiens
tgtgcatattactacctactcc

SEQ ID NO: 9405479 - DNA, 17 bp, Homo sapiens
tgtgcatagaataatga

SEQ ID NO: 9405480 - DNA, 22 bp, Homo sapiens
tgtgcagttttaagtggtctaa

SEQ ID NO: 9405481 - DNA, 22 bp, Homo sapiens
tgtgcatgcacatatatgttgc

SEQ ID NO: 9405482 - DNA, 20 bp, Homo sapiens
tgtgcatgaactgagggatt

SEQ ID NO: 9405483 - DNA, 22 bp, Homo sapiens
tgtgcatcttgcctggatgttt

SEQ ID NO: 9405484 - DNA, 22 bp, Homo sapiens
tgtgcatgttgcttgaactcct

SEQ ID NO: 9405485 - DNA, 22 bp, Homo sapiens
tgtgcatgtgtctttatagtag

SEQ ID NO: 9405486 - DNA, 22 bp, Homo sapiens
ttaaaatttccccaccatgtat

SEQ ID NO: 9405487 - DNA, 22 bp, Homo sapiens
ttaaaatgtacaggggaaagtg

SEQ ID NO: 9405488 - DNA, 22 bp, Homo sapiens
ttaaaatgtacaggggaaagtg

SEQ ID NO: 9405489 - DNA, 22 bp, Homo sapiens
ttaaaattatggcccatttgga

SEQ ID NO: 9405490 - DNA, 22 bp, Homo sapiens
ttaaacaccacagcagtcccta

SEQ ID NO: 9405491 - DNA, 22 bp, Homo sapiens
ttaaacaccaagtgcaaaccac

SEQ ID NO: 9405492 - DNA, 23 bp, Homo sapiens
ttaaacactagttcgagtagcat

SEQ ID NO: 9405493 - DNA, 22 bp, Homo sapiens
ttaaacactggagctgggtgtt

SEQ ID NO: 9405494 - DNA, 22 bp, Homo sapiens
ttaaacacctgtctagtgtagc

SEQ ID NO: 9405495 - DNA, 22 bp, Homo sapiens
ttaaacacctgtctagtgtagc

SEQ ID NO: 9405496 - DNA, 22 bp, Homo sapiens
ttaaaatttccccaccatgtat

SEQ ID NO: 9405497 - DNA, 22 bp, Homo sapiens
ttaaacacactgagatttatgt

SEQ ID NO: 9405498 - DNA, 22 bp, Homo sapiens
ttaaacacactgagatttatgt

SEQ ID NO: 9405499 - DNA, 17 bp, Homo sapiens
ttaaaccataaagaagg

SEQ ID NO: 9405500 - DNA, 22 bp, Homo sapiens
ttaaaccatagtttaacataag

SEQ ID NO: 9405501 - DNA, 22 bp, Homo sapiens
ttaaaccatagtttaacataag

SEQ ID NO: 9405502 - DNA, 22 bp, Homo sapiens
ttaaacatttttgatgatcgat

SEQ ID NO: 9405503 - DNA, 22 bp, Homo sapiens
ttaaacatttttgatgatcgat

SEQ ID NO: 9405504 - DNA, 22 bp, Homo sapiens
ttaaacatttatggaggcagca

SEQ ID NO: 9405505 - DNA, 22 bp, Homo sapiens
ttaaacactgggggttaatgca

SEQ ID NO: 9405506 - DNA, 22 bp, Homo sapiens
ttaaacagacagtaaatgaaac

SEQ ID NO: 9405507 - DNA, 22 bp, Homo sapiens
ttaaacagagtctgaaatgtaa

SEQ ID NO: 9405508 - DNA, 22 bp, Homo sapiens
ttaaaatgcagattctgattca

SEQ ID NO: 9405509 - DNA, 22 bp, Homo sapiens
ttaaaagacctgttgaggttag

SEQ ID NO: 9405510 - DNA, 22 bp, Homo sapiens
ttaaaactgcaaatcctactga

SEQ ID NO: 9405511 - DNA, 22 bp, Homo sapiens
ttaaaagaatcctgttatcctc

SEQ ID NO: 9405512 - DNA, 22 bp, Homo sapiens
ttaaaacagcgtgaatctggca

SEQ ID NO: 9405513 - DNA, 22 bp, Homo sapiens
ttaaaactgcaaatcctactga

SEQ ID NO: 9405514 - DNA, 22 bp, Homo sapiens
tgtttttgttcaatgctaggtc

SEQ ID NO: 9405515 - DNA, 20 bp, Homo sapiens
ttaaaaagagtcacaggaga

SEQ ID NO: 9405516 - DNA, 22 bp, Homo sapiens
ttaaaaatatgtagggcccgat

SEQ ID NO: 9405517 - DNA, 18 bp, Homo sapiens
tgtttatttttctcttac

SEQ ID NO: 9405518 - DNA, 18 bp, Homo sapiens
tgtttatttttctcttac

SEQ ID NO: 9405519 - DNA, 18 bp, Homo sapiens
tgtttatttttctcttac

SEQ ID NO: 9405520 - DNA, 18 bp, Homo sapiens
tgtttatttttctcttac

SEQ ID NO: 9405521 - DNA, 22 bp, Homo sapiens
tgtttgctctgactatcttgcg

SEQ ID NO: 9405522 - DNA, 22 bp, Homo sapiens
tgtttgctctgactatcttgcg

SEQ ID NO: 9405523 - DNA, 22 bp, Homo sapiens
tgtttgcacattcgtttcaata

SEQ ID NO: 9405524 - DNA, 20 bp, Homo sapiens
tgtttgtgccagctttgtca

SEQ ID NO: 9405525 - DNA, 22 bp, Homo sapiens
tgtttgtgctgcctggtgggca

SEQ ID NO: 9405526 - DNA, 22 bp, Homo sapiens
tgtttgtggttataataagtat

SEQ ID NO: 9405527 - DNA, 22 bp, Homo sapiens
tgttttaagggtcaactgtcac

SEQ ID NO: 9405528 - DNA, 22 bp, Homo sapiens
tgttttaatctcccattgctct

SEQ ID NO: 9405529 - DNA, 22 bp, Homo sapiens
tgttttagctgacacatggagc

SEQ ID NO: 9405530 - DNA, 22 bp, Homo sapiens
tgttttaagagcgcactttata

SEQ ID NO: 9405531 - DNA, 22 bp, Homo sapiens
tgttttaagctctagaagggga

SEQ ID NO: 9405532 - DNA, 22 bp, Homo sapiens
tgtttttgtctccttgtctgct

SEQ ID NO: 9405533 - DNA, 22 bp, Homo sapiens
tgttttatgagccatataacct

SEQ ID NO: 9405534 - DNA, 22 bp, Homo sapiens
tgttttatttctccaagaggga

SEQ ID NO: 9405535 - DNA, 22 bp, Homo sapiens
tgttttatgagccatataacct

SEQ ID NO: 9405536 - DNA, 22 bp, Homo sapiens
tgttttatataagcagagcggt

SEQ ID NO: 9405537 - DNA, 22 bp, Homo sapiens
tgttttatataagcagagcggt

SEQ ID NO: 9405538 - DNA, 22 bp, Homo sapiens
tgttttatcaagatggcatgtc

SEQ ID NO: 9405539 - DNA, 22 bp, Homo sapiens
tgttttatcaagatggcatgtc

SEQ ID NO: 9405540 - DNA, 22 bp, Homo sapiens
tgttgtaatcattttatgaaaa

SEQ ID NO: 9405541 - DNA, 22 bp, Homo sapiens
tgttggtttaaaatgctgattt

SEQ ID NO: 9405542 - DNA, 22 bp, Homo sapiens
tgttgtactcaacagatgaatt

SEQ ID NO: 9405543 - DNA, 22 bp, Homo sapiens
tgttgtaaaatttgagatgtca

SEQ ID NO: 9405544 - DNA, 22 bp, Homo sapiens
tgttgaagataaagttctcatt

SEQ ID NO: 9405545 - DNA, 22 bp, Homo sapiens
tgttgactcaacactgtgggca

SEQ ID NO: 9405546 - DNA, 22 bp, Homo sapiens
tgtttaaatagaacatactgca

SEQ ID NO: 9405547 - DNA, 22 bp, Homo sapiens
tgtttaaatagaacatactgca

SEQ ID NO: 9405548 - DNA, 22 bp, Homo sapiens
tgtttactcctgatatattttt

SEQ ID NO: 9405549 - DNA, 22 bp, Homo sapiens
tgtttactgcattctatttgct

SEQ ID NO: 9405550 - DNA, 20 bp, Homo sapiens
tgtttactctagagggtaga

SEQ ID NO: 9405551 - DNA, 21 bp, Homo sapiens
tgtttactccctgcaagcacg

SEQ ID NO: 9405552 - DNA, 23 bp, Homo sapiens
tgttgtgactggatgctttgtcc

SEQ ID NO: 9405553 - DNA, 22 bp, Homo sapiens
tgttgttcagtctttgctggct

SEQ ID NO: 9405554 - DNA, 22 bp, Homo sapiens
tgttgttttctcatggagaata

SEQ ID NO: 9405555 - DNA, 22 bp, Homo sapiens
tgtttaaatagaacatactgca

SEQ ID NO: 9405556 - DNA, 22 bp, Homo sapiens
tgtttaaatagaacatactgca

SEQ ID NO: 9405557 - DNA, 22 bp, Homo sapiens
tgtttattgctgcaattgtgcc

SEQ ID NO: 9405558 - DNA, 22 bp, Homo sapiens
tgtttattttcaggatggattg

SEQ ID NO: 9405559 - DNA, 22 bp, Homo sapiens
tgtttattttcaggatggattg

SEQ ID NO: 9405560 - DNA, 22 bp, Homo sapiens
tgtttattgcagtgctgggctg

SEQ ID NO: 9405561 - DNA, 22 bp, Homo sapiens
tgtttattgctgcaattgtgcc

SEQ ID NO: 9405562 - DNA, 22 bp, Homo sapiens
tgtttattgagtgcctactata

SEQ ID NO: 9405563 - DNA, 22 bp, Homo sapiens
tgtttattgagtgcctactata

SEQ ID NO: 9405564 - DNA, 22 bp, Homo sapiens
tgtttattgagtgcctactata

SEQ ID NO: 9405565 - DNA, 18 bp, Homo sapiens
tgtttattctcctgacag

SEQ ID NO: 9405566 - DNA, 18 bp, Homo sapiens
tgtttattctcctgacag

SEQ ID NO: 9405567 - DNA, 18 bp, Homo sapiens
tgtttattctcctgacag

SEQ ID NO: 9405568 - DNA, 18 bp, Homo sapiens
tgtttattctcctgacag

SEQ ID NO: 9405569 - DNA, 18 bp, Homo sapiens
tgtttattctcctgacag

SEQ ID NO: 9405570 - DNA, 22 bp, Homo sapiens
tgtttattcatggctaatgaaa

SEQ ID NO: 9405571 - DNA, 22 bp, Homo sapiens
tgtttattcatggctaatgaaa

SEQ ID NO: 9405572 - DNA, 22 bp, Homo sapiens
tgtttattcatggctaatgaaa

SEQ ID NO: 9405573 - DNA, 22 bp, Homo sapiens
tgtttattacagttcttggaat

SEQ ID NO: 9405574 - DNA, 22 bp, Homo sapiens
tgtttattacagttcttggaat

SEQ ID NO: 9405575 - DNA, 22 bp, Homo sapiens
tgtttatagggtctgtcacttg

SEQ ID NO: 9405576 - DNA, 22 bp, Homo sapiens
tgtttatagggtctgtcacttg

SEQ ID NO: 9405577 - DNA, 22 bp, Homo sapiens
tgttactgtctcatcattggat

SEQ ID NO: 9405578 - DNA, 22 bp, Homo sapiens
tgttactgatttgatatacagt

SEQ ID NO: 9405579 - DNA, 18 bp, Homo sapiens
tgttactgagttatgttc

SEQ ID NO: 9405580 - DNA, 22 bp, Homo sapiens
tgttactgagtaatgtatagat

SEQ ID NO: 9405581 - DNA, 22 bp, Homo sapiens
tgttaaggagacacatgaaaaa

SEQ ID NO: 9405582 - DNA, 22 bp, Homo sapiens
tgttaaatgagattggaatttg

SEQ ID NO: 9405583 - DNA, 18 bp, Homo sapiens
tgttaaatgaagatttgc

SEQ ID NO: 9405584 - DNA, 22 bp, Homo sapiens
tgttaaatgagattggaatttg

SEQ ID NO: 9405585 - DNA, 22 bp, Homo sapiens
tgttaaatgttcctttactgga

SEQ ID NO: 9405586 - DNA, 22 bp, Homo sapiens
tgttaaatgttttgctagtgtc

SEQ ID NO: 9405587 - DNA, 22 bp, Homo sapiens
tgttaaattgattcacctttct

SEQ ID NO: 9405588 - DNA, 22 bp, Homo sapiens
tgttaggagcttcctgggctga

SEQ ID NO: 9405589 - DNA, 22 bp, Homo sapiens
tgttcttaacttttgtgtatat

SEQ ID NO: 9405590 - DNA, 22 bp, Homo sapiens
tgttcttaacttttgtgtatat

SEQ ID NO: 9405591 - DNA, 17 bp, Homo sapiens
tgttctgttggaaagca

SEQ ID NO: 9405592 - DNA, 22 bp, Homo sapiens
tgttctgttttatggtagggaa

SEQ ID NO: 9405593 - DNA, 22 bp, Homo sapiens
tgttcttgggaatcttacagtt

SEQ ID NO: 9405594 - DNA, 22 bp, Homo sapiens
tgttcttgagcctttagaccta

SEQ ID NO: 9405595 - DNA, 22 bp, Homo sapiens
tgttcttgagcctttagaccta

SEQ ID NO: 9405596 - DNA, 22 bp, Homo sapiens
tgttcttgagcctttagaccta

SEQ ID NO: 9405597 - DNA, 22 bp, Homo sapiens
tgttcttgagcctttagaccta

SEQ ID NO: 9405598 - DNA, 22 bp, Homo sapiens
tgttctttggcttcacagctct

SEQ ID NO: 9405599 - DNA, 22 bp, Homo sapiens
tgttctttgctgttgatgtaga

SEQ ID NO: 9405600 - DNA, 22 bp, Homo sapiens
tgttctttgccagtgatttaat

SEQ ID NO: 9405601 - DNA, 22 bp, Homo sapiens
tgttctttgccagtgatttaat

SEQ ID NO: 9405602 - DNA, 22 bp, Homo sapiens
tgttctttggcttcctttccgt

SEQ ID NO: 9405603 - DNA, 22 bp, Homo sapiens
tgttctttggcttcacagctct

SEQ ID NO: 9405604 - DNA, 22 bp, Homo sapiens
tgttctttggcttcacagctct

SEQ ID NO: 9405605 - DNA, 22 bp, Homo sapiens
tgtggggactgagtggaggctt

SEQ ID NO: 9405606 - DNA, 22 bp, Homo sapiens
tgtggggactgagtggaggctt

SEQ ID NO: 9405607 - DNA, 22 bp, Homo sapiens
tgtggggacccatgccatgggc

SEQ ID NO: 9405608 - DNA, 22 bp, Homo sapiens
tgtggggacccatgccatgggc

SEQ ID NO: 9405609 - DNA, 22 bp, Homo sapiens
tgtggggacccatgccatgggc

SEQ ID NO: 9405610 - DNA, 22 bp, Homo sapiens
tgtggggaagagtatgacttgg

SEQ ID NO: 9405611 - DNA, 20 bp, Homo sapiens
tgtgggctttgaaatgtgtg

SEQ ID NO: 9405612 - DNA, 22 bp, Homo sapiens
tgtggggactgagtggaggctt

SEQ ID NO: 9405613 - DNA, 22 bp, Homo sapiens
tgtggggactgagtggaggctt

SEQ ID NO: 9405614 - DNA, 22 bp, Homo sapiens
tgtgtacaagagtgtttactgt

SEQ ID NO: 9405615 - DNA, 22 bp, Homo sapiens
tgtgtacacaagtatatataca

SEQ ID NO: 9405616 - DNA, 23 bp, Homo sapiens
tgtgtacacaatagatgaggttt

SEQ ID NO: 9405617 - DNA, 22 bp, Homo sapiens
tgtgtacacaatgattgcagag

SEQ ID NO: 9405618 - DNA, 22 bp, Homo sapiens
tgtgtacacacagatatataca

SEQ ID NO: 9405619 - DNA, 22 bp, Homo sapiens
tgtgtacacatgacaggcaccc

SEQ ID NO: 9405620 - DNA, 22 bp, Homo sapiens
tgtgtacaggaactgatcagat

SEQ ID NO: 9405621 - DNA, 22 bp, Homo sapiens
tgtgtacacgagaggttatata

SEQ ID NO: 9405622 - DNA, 22 bp, Homo sapiens
tgtgtacagcaggatttctcaa

SEQ ID NO: 9405623 - DNA, 22 bp, Homo sapiens
tgtgtacatatacacaaataca

SEQ ID NO: 9405624 - DNA, 23 bp, Homo sapiens
tgtgtacatacatatgtacacac

SEQ ID NO: 9405625 - DNA, 22 bp, Homo sapiens
tgtgtacaggccttgctagact

SEQ ID NO: 9405626 - DNA, 22 bp, Homo sapiens
tgtgtacatctcttctcacatt

SEQ ID NO: 9405627 - DNA, 22 bp, Homo sapiens
tgtgtacatatctatcctagat

SEQ ID NO: 9405628 - DNA, 22 bp, Homo sapiens
tgtgtacatatctatcctagat

SEQ ID NO: 9405629 - DNA, 22 bp, Homo sapiens
tgtgtacattgccttttaaagg

SEQ ID NO: 9405630 - DNA, 22 bp, Homo sapiens
tgtgggcaaagggtagctgggt

SEQ ID NO: 9405631 - DNA, 22 bp, Homo sapiens
tgtgggcactaatgacatgcag

SEQ ID NO: 9405632 - DNA, 22 bp, Homo sapiens
tgtgggaggtctggaaggctcc

SEQ ID NO: 9405633 - DNA, 22 bp, Homo sapiens
tgtgggaggtctggaaggctcc

SEQ ID NO: 9405634 - DNA, 22 bp, Homo sapiens
tgtgggaggtctggaaggctcc

SEQ ID NO: 9405635 - DNA, 22 bp, Homo sapiens
tgtgggaggtctggaaggctcc

SEQ ID NO: 9405636 - DNA, 22 bp, Homo sapiens
tgtgggaggattcagaattggg

SEQ ID NO: 9405637 - DNA, 22 bp, Homo sapiens
tgtgggaggattcagaattggg

SEQ ID NO: 9405638 - DNA, 22 bp, Homo sapiens
tgtgggaggaattagaatggga

SEQ ID NO: 9405639 - DNA, 22 bp, Homo sapiens
tgtgggaggaattagaatggga

SEQ ID NO: 9405640 - DNA, 22 bp, Homo sapiens
tgtgggctccccctcactctgt

SEQ ID NO: 9405641 - DNA, 22 bp, Homo sapiens
tgtgggctctaatggcagcaga

SEQ ID NO: 9405642 - DNA, 22 bp, Homo sapiens
tgtgggctctaatggcagcaga

SEQ ID NO: 9405643 - DNA, 19 bp, Homo sapiens
tgtgggctgggaaatgtct

SEQ ID NO: 9405644 - DNA, 22 bp, Homo sapiens
tgtgggctccccctcactctgt

SEQ ID NO: 9405645 - DNA, 20 bp, Homo sapiens
tgtgggcccttggctggcaa

SEQ ID NO: 9405646 - DNA, 22 bp, Homo sapiens
tgtgggaggaattagaatggga

SEQ ID NO: 9405647 - DNA, 22 bp, Homo sapiens
tgtgggaggaattagaatggga

SEQ ID NO: 9405648 - DNA, 22 bp, Homo sapiens
tgtgggaggaacacagccagaa

SEQ ID NO: 9405649 - DNA, 22 bp, Homo sapiens
tgtgggagaaggaagcaagctg

SEQ ID NO: 9405650 - DNA, 23 bp, Homo sapiens
tgtgggaatgttggagaggaaac

SEQ ID NO: 9405651 - DNA, 23 bp, Homo sapiens
tgtgggaatgttggagaggaaac

SEQ ID NO: 9405652 - DNA, 22 bp, Homo sapiens
tgtgggaatgacgaggaagagg

SEQ ID NO: 9405653 - DNA, 22 bp, Homo sapiens
tgtgggaatcagccaggggggc

SEQ ID NO: 9405654 - DNA, 22 bp, Homo sapiens
tgtgggaatgacgaggaagagg

SEQ ID NO: 9405655 - DNA, 22 bp, Homo sapiens
tgtggctgcaaaggaaggctgc

SEQ ID NO: 9405656 - DNA, 22 bp, Homo sapiens
tgtggctgcaaaggaaggctgc

SEQ ID NO: 9405657 - DNA, 22 bp, Homo sapiens
tgtggctgcaaaggaaggctgc

SEQ ID NO: 9405658 - DNA, 22 bp, Homo sapiens
tgtggctgcagacactggagcc

SEQ ID NO: 9405659 - DNA, 22 bp, Homo sapiens
tgtggctgcagacactggagcc

SEQ ID NO: 9405660 - DNA, 22 bp, Homo sapiens
tgtggctgcaggcgatggagga

SEQ ID NO: 9405661 - DNA, 22 bp, Homo sapiens
tgtgggaagagcagtggcagca

SEQ ID NO: 9405662 - DNA, 22 bp, Homo sapiens
tgtgggaaatgggagtggaaga

SEQ ID NO: 9405663 - DNA, 22 bp, Homo sapiens
tgtgggaaatgggagtggaaga

SEQ ID NO: 9405664 - DNA, 22 bp, Homo sapiens
tgtggctgccaccctgaagccg

SEQ ID NO: 9405665 - DNA, 22 bp, Homo sapiens
tgtgggaagatgttgcaggaga

SEQ ID NO: 9405666 - DNA, 22 bp, Homo sapiens
tgtgggaagatgttgcaggaga

SEQ ID NO: 9405667 - DNA, 22 bp, Homo sapiens
tgtgggaagtttggagggaaag

SEQ ID NO: 9405668 - DNA, 22 bp, Homo sapiens
tgtgggaagtttggagggaaag

SEQ ID NO: 9405669 - DNA, 22 bp, Homo sapiens
tgtggaagggacactggactgg

SEQ ID NO: 9405670 - DNA, 22 bp, Homo sapiens
tgtggaagaacactggccaggc

SEQ ID NO: 9405671 - DNA, 22 bp, Homo sapiens
tgtggaagaacactggccaggc

SEQ ID NO: 9405672 - DNA, 22 bp, Homo sapiens
tgtggacaccactgggactgga

SEQ ID NO: 9405673 - DNA, 22 bp, Homo sapiens
tgtggaatgggagtgagaagac

SEQ ID NO: 9405674 - DNA, 22 bp, Homo sapiens
tgtggccttgcagcctggaggt

SEQ ID NO: 9405675 - DNA, 22 bp, Homo sapiens
tgtggcctttcaaggatggaat

SEQ ID NO: 9405676 - DNA, 22 bp, Homo sapiens
tgtggctcggccagctgctgaa

SEQ ID NO: 9405677 - DNA, 22 bp, Homo sapiens
tgtggctctgcctggcagtatt

SEQ ID NO: 9405678 - DNA, 21 bp, Homo sapiens
tgtggctgacaccctttggga

SEQ ID NO: 9405679 - DNA, 22 bp, Homo sapiens
tgtggctctgcctggcagtatt

SEQ ID NO: 9405680 - DNA, 22 bp, Homo sapiens
tgtggctctcctcctgctgccc

SEQ ID NO: 9405681 - DNA, 22 bp, Homo sapiens
tgtggctgactcctggtcccca

SEQ ID NO: 9405682 - DNA, 23 bp, Homo sapiens
tgtggctgagaaattgacaactt

SEQ ID NO: 9405683 - DNA, 19 bp, Homo sapiens
tgtggctgagcactcctta

SEQ ID NO: 9405684 - DNA, 22 bp, Homo sapiens
tgtggctgatcaaagcgctcag

SEQ ID NO: 9405685 - DNA, 19 bp, Homo sapiens
tgtggctgagcactcctta

SEQ ID NO: 9405686 - DNA, 19 bp, Homo sapiens
tgtgtgtttatatatgtat

SEQ ID NO: 9405687 - DNA, 19 bp, Homo sapiens
tgtgtgtttatatatgtat

SEQ ID NO: 9405688 - DNA, 19 bp, Homo sapiens
tgtgtgtttatatatgtat

SEQ ID NO: 9405689 - DNA, 22 bp, Homo sapiens
tgtgttaagtatttgatacact

SEQ ID NO: 9405690 - DNA, 22 bp, Homo sapiens
tgttaaacctagtacaggtcct

SEQ ID NO: 9405691 - DNA, 18 bp, Homo sapiens
tgttaaatgaagatttgc

SEQ ID NO: 9405692 - DNA, 22 bp, Homo sapiens
tgttaaagtggataagctgaat

SEQ ID NO: 9405693 - DNA, 22 bp, Homo sapiens
tgtgtgtgtttataaatctaaa

SEQ ID NO: 9405694 - DNA, 22 bp, Homo sapiens
tgtgtgtgtttataaatctaaa

SEQ ID NO: 9405695 - DNA, 22 bp, Homo sapiens
tgtgtgtgtttacagtttctca

SEQ ID NO: 9405696 - DNA, 22 bp, Homo sapiens
tgtgtgtgtttacagtttctca

SEQ ID NO: 9405697 - DNA, 22 bp, Homo sapiens
tgtgtgtgttcctcctcagcta

SEQ ID NO: 9405698 - DNA, 22 bp, Homo sapiens
tgtgtgtgtttacagtttctca

SEQ ID NO: 9405699 - DNA, 22 bp, Homo sapiens
tgtgtgttggctggagagggct

SEQ ID NO: 9405700 - DNA, 22 bp, Homo sapiens
tgtgtgttattttcagccatta

SEQ ID NO: 9405701 - DNA, 22 bp, Homo sapiens
tgtgtgtgtttctgctcataca

SEQ ID NO: 9405702 - DNA, 22 bp, Homo sapiens
tgtgtgtgtttctgctcataca

SEQ ID NO: 9405703 - DNA, 22 bp, Homo sapiens
tgtgtgttatcttagttcatct

SEQ ID NO: 9405704 - DNA, 22 bp, Homo sapiens
tgtgtgtgcacgtgcgcgcgag

SEQ ID NO: 9405705 - DNA, 22 bp, Homo sapiens
tgtgtgtgcaggagagcaggtg

SEQ ID NO: 9405706 - DNA, 22 bp, Homo sapiens
tgtgtgtgcacgtgcgcgcgag

SEQ ID NO: 9405707 - DNA, 21 bp, Homo sapiens
tgtgtgtgcaggcacacacac

SEQ ID NO: 9405708 - DNA, 22 bp, Homo sapiens
tgtgtgtgcaggagagcaggtg

SEQ ID NO: 9405709 - DNA, 22 bp, Homo sapiens
tgtgtgtgggcggaacggcccc

SEQ ID NO: 9405710 - DNA, 22 bp, Homo sapiens
tgtgtgtgggcggaacggcccc

SEQ ID NO: 9405711 - DNA, 21 bp, Homo sapiens
tgtgtgtgcaggcacacacac

SEQ ID NO: 9405712 - DNA, 22 bp, Homo sapiens
tgtgtgtgtaaaagcatttata

SEQ ID NO: 9405713 - DNA, 22 bp, Homo sapiens
tgtgtgtggggaggcagcagat

SEQ ID NO: 9405714 - DNA, 22 bp, Homo sapiens
tgtgtgtggggaggcagcagat

SEQ ID NO: 9405715 - DNA, 22 bp, Homo sapiens
tgtgtgtgttcctcctcagcta

SEQ ID NO: 9405716 - DNA, 22 bp, Homo sapiens
tgtgtgtgtgcgcgcacgcata

SEQ ID NO: 9405717 - DNA, 22 bp, Homo sapiens
tgtgtgtgtcctcatttgcaga

SEQ ID NO: 9405718 - DNA, 22 bp, Homo sapiens
tgtgtgtgtcctcatttgcaga

SEQ ID NO: 9405719 - DNA, 22 bp, Homo sapiens
tgtgtgtgtgcgcgcacgcata

SEQ ID NO: 9405720 - DNA, 20 bp, Homo sapiens
tgtgtgtgtacttctaaata

SEQ ID NO: 9405721 - DNA, 22 bp, Homo sapiens
tgtgtgtgtaaaagcatttata

SEQ ID NO: 9405722 - DNA, 20 bp, Homo sapiens
tgtgtgtgtacttctaaata

SEQ ID NO: 9405723 - DNA, 23 bp, Homo sapiens
tgtgtgtgtattctacgcaaggt

SEQ ID NO: 9405724 - DNA, 23 bp, Homo sapiens
tgtgtgtgtattctacgcaaggt

SEQ ID NO: 9405725 - DNA, 20 bp, Homo sapiens
tgtgtgtgtacttctaaata

SEQ ID NO: 9405726 - DNA, 22 bp, Homo sapiens
tgtgtatttctggaacagacta

SEQ ID NO: 9405727 - DNA, 22 bp, Homo sapiens
tgtgtattaccattttacagct

SEQ ID NO: 9405728 - DNA, 22 bp, Homo sapiens
tgtgtcaagacatttagtcatt

SEQ ID NO: 9405729 - DNA, 22 bp, Homo sapiens
tgtgtcagaaatcagtgcctcg

SEQ ID NO: 9405730 - DNA, 22 bp, Homo sapiens
tgtgtcagaaatcagtgcctcg

SEQ ID NO: 9405731 - DNA, 22 bp, Homo sapiens
tgtgtcagaagtacttttggaa

SEQ ID NO: 9405732 - DNA, 22 bp, Homo sapiens
tgtgtcagaatttttgtggcaa

SEQ ID NO: 9405733 - DNA, 22 bp, Homo sapiens
tgtgtcagaagtacttttggaa

SEQ ID NO: 9405734 - DNA, 22 bp, Homo sapiens
tgtgtcagaaggcaatggggat

SEQ ID NO: 9405735 - DNA, 22 bp, Homo sapiens
tgtgtcagaaggcaatggggat

SEQ ID NO: 9405736 - DNA, 22 bp, Homo sapiens
tgtgtgccagggcatgcacagg

SEQ ID NO: 9405737 - DNA, 22 bp, Homo sapiens
tgtgtgccccagatgagtagct

SEQ ID NO: 9405738 - DNA, 22 bp, Homo sapiens
tgtgtgcctgagccgtgcctgg

SEQ ID NO: 9405739 - DNA, 22 bp, Homo sapiens
tgtgtcagaggtagagatggca

SEQ ID NO: 9405740 - DNA, 22 bp, Homo sapiens
tgtgtcagaggtagagatggca

SEQ ID NO: 9405741 - DNA, 22 bp, Homo sapiens
tgtgtcagaatttttgtggcaa

SEQ ID NO: 9405742 - DNA, 22 bp, Homo sapiens
tgtgtgtgacaacctagttcag

SEQ ID NO: 9405743 - DNA, 22 bp, Homo sapiens
tgtgtgtgacaacctagttcag

SEQ ID NO: 9405744 - DNA, 22 bp, Homo sapiens
tgtgtgtgacaacctagttcag

SEQ ID NO: 9405745 - DNA, 22 bp, Homo sapiens
tgtgtgtgaaccattgagggct

SEQ ID NO: 9405746 - DNA, 22 bp, Homo sapiens
tgtgtgtgaaccattgagggct

SEQ ID NO: 9405747 - DNA, 22 bp, Homo sapiens
tgtgtgtgcacatgcatataca

SEQ ID NO: 9405748 - DNA, 22 bp, Homo sapiens
tgtgtgtgcacatgcatataca

SEQ ID NO: 9405749 - DNA, 22 bp, Homo sapiens
tgtgtgtgagtcctggctttcc

SEQ ID NO: 9405750 - DNA, 22 bp, Homo sapiens
tgtgtgtgagtcctggctttcc

SEQ ID NO: 9405751 - DNA, 22 bp, Homo sapiens
tgtgtgtgactcatactagaac

SEQ ID NO: 9405752 - DNA, 22 bp, Homo sapiens
tgtgtgtgagtcctggctttcc

SEQ ID NO: 9405753 - DNA, 22 bp, Homo sapiens
tgtgtgtgactcatactagaac

SEQ ID NO: 9405754 - DNA, 22 bp, Homo sapiens
tgtgtgtgagtcctggctttcc

SEQ ID NO: 9405755 - DNA, 22 bp, Homo sapiens
tgtgtgggagcacgggctgttg

SEQ ID NO: 9405756 - DNA, 22 bp, Homo sapiens
tgtgtgggagcacgggctgttg

SEQ ID NO: 9405757 - DNA, 22 bp, Homo sapiens
tgtgtggattcatctcaaagag

SEQ ID NO: 9405758 - DNA, 22 bp, Homo sapiens
tgtgtggattcatctcaaagag

SEQ ID NO: 9405759 - DNA, 22 bp, Homo sapiens
tgtgtggattcatctcaaagag

SEQ ID NO: 9405760 - DNA, 22 bp, Homo sapiens
tgggccaggcatgtgatcagca

SEQ ID NO: 9405761 - DNA, 22 bp, Homo sapiens
tgggccaggcatgtgatcagca

SEQ ID NO: 9405762 - DNA, 22 bp, Homo sapiens
tgggccaggcatgtgatcagca

SEQ ID NO: 9405763 - DNA, 22 bp, Homo sapiens
tgggccaggggcctcttctgat

SEQ ID NO: 9405764 - DNA, 22 bp, Homo sapiens
tgggccaggggcctcttctgat

SEQ ID NO: 9405765 - DNA, 22 bp, Homo sapiens
tgggccaggggcctcttctgat

SEQ ID NO: 9405766 - DNA, 22 bp, Homo sapiens
tgggccaggggcctcttctgat

SEQ ID NO: 9405767 - DNA, 22 bp, Homo sapiens
tgggccaggtctgtgtcagctg

SEQ ID NO: 9405768 - DNA, 22 bp, Homo sapiens
tgggccaggtctgtgtcagctg

SEQ ID NO: 9405769 - DNA, 22 bp, Homo sapiens
tgggccaggtctgtgtcagctg

SEQ ID NO: 9405770 - DNA, 17 bp, Homo sapiens
tgggccagtagaaggga

SEQ ID NO: 9405771 - DNA, 17 bp, Homo sapiens
tgggccagtagaaggga

SEQ ID NO: 9405772 - DNA, 22 bp, Homo sapiens
tgggccaggtgcagtgctttag

SEQ ID NO: 9405773 - DNA, 21 bp, Homo sapiens
tgggccagtagaaaggaaggc

SEQ ID NO: 9405774 - DNA, 22 bp, Homo sapiens
tgggccagtccagccccaggga

SEQ ID NO: 9405775 - DNA, 22 bp, Homo sapiens
tgggccagtagctactcgcaag

SEQ ID NO: 9405776 - DNA, 22 bp, Homo sapiens
tgggccagtagctactcgcaag

SEQ ID NO: 9405777 - DNA, 22 bp, Homo sapiens
tgggccagtagctactcgcaag

SEQ ID NO: 9405778 - DNA, 22 bp, Homo sapiens
tgggccagtccagccccaggga

SEQ ID NO: 9405779 - DNA, 22 bp, Homo sapiens
tgggccagttctttactcgtcc

SEQ ID NO: 9405780 - DNA, 22 bp, Homo sapiens
tgggccagttatttcacctctg

SEQ ID NO: 9405781 - DNA, 22 bp, Homo sapiens
tgggccagttatttcacctctg

SEQ ID NO: 9405782 - DNA, 22 bp, Homo sapiens
tgggccagtcctgcctaaggtg

SEQ ID NO: 9405783 - DNA, 22 bp, Homo sapiens
tgggccagttggaatggatact

SEQ ID NO: 9405784 - DNA, 22 bp, Homo sapiens
tgggccagttggaatggatact

SEQ ID NO: 9405785 - DNA, 22 bp, Homo sapiens
tgggccagttggtgactacaaa

SEQ ID NO: 9405786 - DNA, 22 bp, Homo sapiens
tgggccagttggtgactacaaa

SEQ ID NO: 9405787 - DNA, 22 bp, Homo sapiens
tgggcctcctggaagaatgtgg

SEQ ID NO: 9405788 - DNA, 22 bp, Homo sapiens
tgggcctcctttccattcagag

SEQ ID NO: 9405789 - DNA, 22 bp, Homo sapiens
tgggcctcctttccattcagag

SEQ ID NO: 9405790 - DNA, 22 bp, Homo sapiens
tgggcctcctgccctggcctag

SEQ ID NO: 9405791 - DNA, 22 bp, Homo sapiens
tgggcctccgcatggcccagcg

SEQ ID NO: 9405792 - DNA, 22 bp, Homo sapiens
tgggcctccgcatggcccagcg

SEQ ID NO: 9405793 - DNA, 22 bp, Homo sapiens
tgggcctcatcttcaatgagtc

SEQ ID NO: 9405794 - DNA, 22 bp, Homo sapiens
tgggcctcagtttccttaggat

SEQ ID NO: 9405795 - DNA, 22 bp, Homo sapiens
tgggcctccaattccagcggga

SEQ ID NO: 9405796 - DNA, 22 bp, Homo sapiens
tgggcctgggctcctgtcctct

SEQ ID NO: 9405797 - DNA, 22 bp, Homo sapiens
tgggcctgggctggacagcctg

SEQ ID NO: 9405798 - DNA, 22 bp, Homo sapiens
tgggcctggggcagcccaaatc

SEQ ID NO: 9405799 - DNA, 23 bp, Homo sapiens
tgggcctggaaagccttagagag

SEQ ID NO: 9405800 - DNA, 22 bp, Homo sapiens
tgggcctgctggggcattttca

SEQ ID NO: 9405801 - DNA, 22 bp, Homo sapiens
tgggcctgggctcctgtcctct

SEQ ID NO: 9405802 - DNA, 22 bp, Homo sapiens
tgggcctggacaaggccactag

SEQ ID NO: 9405803 - DNA, 18 bp, Homo sapiens
tgggcctgcatcctagtc

SEQ ID NO: 9405804 - DNA, 22 bp, Homo sapiens
tgggcctgccccaggcttcagc

SEQ ID NO: 9405805 - DNA, 19 bp, Homo sapiens
tgggcctgcatctgggtct

SEQ ID NO: 9405806 - DNA, 18 bp, Homo sapiens
tgggcctgcatcctagtc

SEQ ID NO: 9405807 - DNA, 22 bp, Homo sapiens
tgggcctgactcacctgcctcc

SEQ ID NO: 9405808 - DNA, 22 bp, Homo sapiens
tgggcctgactcacctgcctcc

SEQ ID NO: 9405809 - DNA, 22 bp, Homo sapiens
tgggcctgacacttactaggga

SEQ ID NO: 9405810 - DNA, 22 bp, Homo sapiens
tgggcctgacacttactaggga

SEQ ID NO: 9405811 - DNA, 22 bp, Homo sapiens
tgggcctgactcacctgcctcc

SEQ ID NO: 9405812 - DNA, 22 bp, Homo sapiens
tgggcctgagctcaccaggggc

SEQ ID NO: 9405813 - DNA, 22 bp, Homo sapiens
tgggcctgagtttgggaactgg

SEQ ID NO: 9405814 - DNA, 21 bp, Homo sapiens
tgggcctgattcccagggtca

SEQ ID NO: 9405815 - DNA, 22 bp, Homo sapiens
tgggcctgagctcaccaggggc

SEQ ID NO: 9405816 - DNA, 22 bp, Homo sapiens
tgggcctgagctcaccaggggc

SEQ ID NO: 9405817 - DNA, 22 bp, Homo sapiens
tgggcctcggagcacaggagac

SEQ ID NO: 9405818 - DNA, 22 bp, Homo sapiens
tgggcctgaaggagctgcgccc

SEQ ID NO: 9405819 - DNA, 22 bp, Homo sapiens
tgggcctctgtttcctcatctg

SEQ ID NO: 9405820 - DNA, 22 bp, Homo sapiens
tgggcgaggcccagggctgcgt

SEQ ID NO: 9405821 - DNA, 22 bp, Homo sapiens
tgggcgctgtgctcctctttgt

SEQ ID NO: 9405822 - DNA, 22 bp, Homo sapiens
tgggcggtgtgcaggctctgct

SEQ ID NO: 9405823 - DNA, 21 bp, Homo sapiens
tgggcgcttgacctctgcact

SEQ ID NO: 9405824 - DNA, 22 bp, Homo sapiens
tgggctcaatctgcttctgttt

SEQ ID NO: 9405825 - DNA, 22 bp, Homo sapiens
tgggctcaagtgatgctcctgt

SEQ ID NO: 9405826 - DNA, 22 bp, Homo sapiens
tgggctagcagggaagagagac

SEQ ID NO: 9405827 - DNA, 22 bp, Homo sapiens
tgggctcaaactggaggttgtt

SEQ ID NO: 9405828 - DNA, 22 bp, Homo sapiens
tgggctcagcctcagtctgtgg

SEQ ID NO: 9405829 - DNA, 21 bp, Homo sapiens
tgggctcagccccagccctgc

SEQ ID NO: 9405830 - DNA, 22 bp, Homo sapiens
tgggctcactggggcagggacc

SEQ ID NO: 9405831 - DNA, 22 bp, Homo sapiens
tgggctcactggggcagggacc

SEQ ID NO: 9405832 - DNA, 22 bp, Homo sapiens
tgggctcagtctgcacctgcgg

SEQ ID NO: 9405833 - DNA, 22 bp, Homo sapiens
tgggctcagggtcgaggacttt

SEQ ID NO: 9405834 - DNA, 22 bp, Homo sapiens
tgggctcagggaagcttggcct

SEQ ID NO: 9405835 - DNA, 22 bp, Homo sapiens
tgggctcaggaccccagaggcc

SEQ ID NO: 9405836 - DNA, 22 bp, Homo sapiens
tgggctcagctcccaagggaag

SEQ ID NO: 9405837 - DNA, 23 bp, Homo sapiens
tgggctcagcttccagtggggag

SEQ ID NO: 9405838 - DNA, 20 bp, Homo sapiens
tgggcctgtggcagaagtct

SEQ ID NO: 9405839 - DNA, 20 bp, Homo sapiens
tgggcctgtggcagaagtct

SEQ ID NO: 9405840 - DNA, 20 bp, Homo sapiens
tgggcctgtggcagaagtct

SEQ ID NO: 9405841 - DNA, 22 bp, Homo sapiens
tgggcctgtggcttggctctag

SEQ ID NO: 9405842 - DNA, 22 bp, Homo sapiens
tgggcctgggttcctcctgggc

SEQ ID NO: 9405843 - DNA, 22 bp, Homo sapiens
tgggcctgggttcctcctgggc

SEQ ID NO: 9405844 - DNA, 22 bp, Homo sapiens
tgggcctgggttcctcctgggc

SEQ ID NO: 9405845 - DNA, 22 bp, Homo sapiens
tgggcctgtgatgctgggctat

SEQ ID NO: 9405846 - DNA, 22 bp, Homo sapiens
tgggcctgttggggttgagtta

SEQ ID NO: 9405847 - DNA, 22 bp, Homo sapiens
tgggcctgtggggatcttgaag

SEQ ID NO: 9405848 - DNA, 22 bp, Homo sapiens
tgggcgacagagcaagactccg

SEQ ID NO: 9405849 - DNA, 23 bp, Homo sapiens
tgggcgaggcaggagtggagcac

SEQ ID NO: 9405850 - DNA, 22 bp, Homo sapiens
tgggccttacttggggctgact

SEQ ID NO: 9405851 - DNA, 22 bp, Homo sapiens
tgggccttctcaatgcactgga

SEQ ID NO: 9405852 - DNA, 22 bp, Homo sapiens
tgggccttctaatctggtccct

SEQ ID NO: 9405853 - DNA, 22 bp, Homo sapiens
tgggccttgtcccctcagctgt

SEQ ID NO: 9405854 - DNA, 22 bp, Homo sapiens
tgggccttgctgagctatggag

SEQ ID NO: 9405855 - DNA, 22 bp, Homo sapiens
tgggctctattcagagtttttc

SEQ ID NO: 9405856 - DNA, 19 bp, Homo sapiens
tgggctctcaagagcggaa

SEQ ID NO: 9405857 - DNA, 22 bp, Homo sapiens
tgggctctcaaagtgcggcttg

SEQ ID NO: 9405858 - DNA, 22 bp, Homo sapiens
tgggctctcaaagtgcggcttg

SEQ ID NO: 9405859 - DNA, 22 bp, Homo sapiens
tgggctctattcagagtttttc

SEQ ID NO: 9405860 - DNA, 22 bp, Homo sapiens
tgggctcagtctgcttggtcct

SEQ ID NO: 9405861 - DNA, 22 bp, Homo sapiens
tgggctctcacacatgttctga

SEQ ID NO: 9405862 - DNA, 22 bp, Homo sapiens
tgggctctcagtcagactggca

SEQ ID NO: 9405863 - DNA, 22 bp, Homo sapiens
tgggctctcctggaggacaaca

SEQ ID NO: 9405864 - DNA, 22 bp, Homo sapiens
tgggctctcctggaggacaaca

SEQ ID NO: 9405865 - DNA, 22 bp, Homo sapiens
tgggctctcagtcagactggca

SEQ ID NO: 9405866 - DNA, 22 bp, Homo sapiens
tgggctctctcacctggaggct

SEQ ID NO: 9405867 - DNA, 22 bp, Homo sapiens
tgggctctctcacctggaggct

SEQ ID NO: 9405868 - DNA, 22 bp, Homo sapiens
tgggctctcgtccctgcagaag

SEQ ID NO: 9405869 - DNA, 22 bp, Homo sapiens
tgggctctcgtccctgcagaag

SEQ ID NO: 9405870 - DNA, 22 bp, Homo sapiens
tgggctctctggcaggaaggct

SEQ ID NO: 9405871 - DNA, 22 bp, Homo sapiens
tgggctctctggcaggaaggct

SEQ ID NO: 9405872 - DNA, 22 bp, Homo sapiens
tgggctctgaagtcagtctgct

SEQ ID NO: 9405873 - DNA, 22 bp, Homo sapiens
tgggctctgaagtcagtctgct

SEQ ID NO: 9405874 - DNA, 22 bp, Homo sapiens
tgggctctgaagtcagtctgct

SEQ ID NO: 9405875 - DNA, 22 bp, Homo sapiens
tgggctctgcatcagtgcccat

SEQ ID NO: 9405876 - DNA, 22 bp, Homo sapiens
tgggctctgctgcgtaccagtt

SEQ ID NO: 9405877 - DNA, 22 bp, Homo sapiens
tgggctctgctgcgtaccagtt

SEQ ID NO: 9405878 - DNA, 22 bp, Homo sapiens
tgggctctgctgcgtaccagtt

SEQ ID NO: 9405879 - DNA, 22 bp, Homo sapiens
tgggctctggagggcctaggat

SEQ ID NO: 9405880 - DNA, 22 bp, Homo sapiens
tgggctctggagggcctaggat

SEQ ID NO: 9405881 - DNA, 22 bp, Homo sapiens
tgggctctggagggcctaggat

SEQ ID NO: 9405882 - DNA, 22 bp, Homo sapiens
tgggctctggaattgagtggcc

SEQ ID NO: 9405883 - DNA, 22 bp, Homo sapiens
tgggctctggacaaacccttgc

SEQ ID NO: 9405884 - DNA, 22 bp, Homo sapiens
tgggctctgggtggcctgagca

SEQ ID NO: 9405885 - DNA, 22 bp, Homo sapiens
tgggctctgggtggcctgagca

SEQ ID NO: 9405886 - DNA, 22 bp, Homo sapiens
tgggctctgggtggcctgagca

SEQ ID NO: 9405887 - DNA, 22 bp, Homo sapiens
tgggctctggtttcctggctgg

SEQ ID NO: 9405888 - DNA, 22 bp, Homo sapiens
tgggctctggggaaactgtgat

SEQ ID NO: 9405889 - DNA, 22 bp, Homo sapiens
tgggctctggggaaactgtgat

SEQ ID NO: 9405890 - DNA, 22 bp, Homo sapiens
tgggctgcccaaggtggccatg

SEQ ID NO: 9405891 - DNA, 22 bp, Homo sapiens
tgggctgccctgatggtcctca

SEQ ID NO: 9405892 - DNA, 22 bp, Homo sapiens
tgggctgcaggggttgagagct

SEQ ID NO: 9405893 - DNA, 22 bp, Homo sapiens
tgggctgcaccctcagcctctg

SEQ ID NO: 9405894 - DNA, 22 bp, Homo sapiens
tgggctgcaccctcagcctctg

SEQ ID NO: 9405895 - DNA, 22 bp, Homo sapiens
tgggctgcaccctcagcctctg

SEQ ID NO: 9405896 - DNA, 22 bp, Homo sapiens
tgggctctggtttcctggctgg

SEQ ID NO: 9405897 - DNA, 22 bp, Homo sapiens
tgggctctgtgccaggttggtg

SEQ ID NO: 9405898 - DNA, 22 bp, Homo sapiens
tgggctctgtgccaggttggtg

SEQ ID NO: 9405899 - DNA, 22 bp, Homo sapiens
tgggctctgtgccaggttggtg

SEQ ID NO: 9405900 - DNA, 22 bp, Homo sapiens
tgggctcttcagctttgatcag

SEQ ID NO: 9405901 - DNA, 22 bp, Homo sapiens
tgggctcttcctatagtttata

SEQ ID NO: 9405902 - DNA, 22 bp, Homo sapiens
tgggctgaaatgctgtggacta

SEQ ID NO: 9405903 - DNA, 21 bp, Homo sapiens
tgggctctttaacccaggcac

SEQ ID NO: 9405904 - DNA, 21 bp, Homo sapiens
tgggctctttaacccaggcac

SEQ ID NO: 9405905 - DNA, 20 bp, Homo sapiens
tgggctgaggatcaggtgcc

SEQ ID NO: 9405906 - DNA, 22 bp, Homo sapiens
tgggctgagtggcagccagagt

SEQ ID NO: 9405907 - DNA, 22 bp, Homo sapiens
tgggctgagtgtggaactagtt

SEQ ID NO: 9405908 - DNA, 22 bp, Homo sapiens
tgggctgagcactgaggaagga

SEQ ID NO: 9405909 - DNA, 20 bp, Homo sapiens
tgggctgaggatcaggtgcc

SEQ ID NO: 9405910 - DNA, 22 bp, Homo sapiens
tgggctgagcactgaggaagga

SEQ ID NO: 9405911 - DNA, 22 bp, Homo sapiens
tgggctgagcactgaggaagga

SEQ ID NO: 9405912 - DNA, 22 bp, Homo sapiens
tgggctgaaatgctgtggacta

SEQ ID NO: 9405913 - DNA, 22 bp, Homo sapiens
tgggcagttgctcctcagaccc

SEQ ID NO: 9405914 - DNA, 22 bp, Homo sapiens
tgggcatcccgcgtctggctgc

SEQ ID NO: 9405915 - DNA, 22 bp, Homo sapiens
tgggcatcccgcgtctggctgc

SEQ ID NO: 9405916 - DNA, 22 bp, Homo sapiens
tgggcaggttgttatttgacat

SEQ ID NO: 9405917 - DNA, 22 bp, Homo sapiens
tgggcagtgggcctaggtgtga

SEQ ID NO: 9405918 - DNA, 19 bp, Homo sapiens
tgggcaggttcagtaatgg

SEQ ID NO: 9405919 - DNA, 19 bp, Homo sapiens
tgggcaggttcagtaatgg

SEQ ID NO: 9405920 - DNA, 22 bp, Homo sapiens
tgggcaggtgctattttccatg

SEQ ID NO: 9405921 - DNA, 22 bp, Homo sapiens
tgggcaggttgttatttgacat

SEQ ID NO: 9405922 - DNA, 19 bp, Homo sapiens
tgggcaggttcagtaatgg

SEQ ID NO: 9405923 - DNA, 19 bp, Homo sapiens
tgggcaggttcagtaatgg

SEQ ID NO: 9405924 - DNA, 22 bp, Homo sapiens
tgggcagggtctctgttatcag

SEQ ID NO: 9405925 - DNA, 22 bp, Homo sapiens
tgggcagggtctctgttatcag

SEQ ID NO: 9405926 - DNA, 22 bp, Homo sapiens
tgggcaggtgctattttccatg

SEQ ID NO: 9405927 - DNA, 22 bp, Homo sapiens
tgggcagggtctctgttatcag

SEQ ID NO: 9405928 - DNA, 22 bp, Homo sapiens
tgggcagggtctctgttatcag

SEQ ID NO: 9405929 - DNA, 22 bp, Homo sapiens
tgggccacacacagaagaatca

SEQ ID NO: 9405930 - DNA, 22 bp, Homo sapiens
tgggccacgggggtggagagct

SEQ ID NO: 9405931 - DNA, 22 bp, Homo sapiens
tgggccagcaattgctgctcag

SEQ ID NO: 9405932 - DNA, 22 bp, Homo sapiens
tgggccagcaattgctgctcag

SEQ ID NO: 9405933 - DNA, 22 bp, Homo sapiens
tgggccagcactgggtgctcat

SEQ ID NO: 9405934 - DNA, 22 bp, Homo sapiens
tgggccagcactgggtgctcat

SEQ ID NO: 9405935 - DNA, 22 bp, Homo sapiens
tgggccagcactgggtgctcat

SEQ ID NO: 9405936 - DNA, 22 bp, Homo sapiens
tgggccagcactgggtgctcat

SEQ ID NO: 9405937 - DNA, 22 bp, Homo sapiens
tgggccagctccctgcccctgg

SEQ ID NO: 9405938 - DNA, 22 bp, Homo sapiens
tgggccagctccctgcccctgg

SEQ ID NO: 9405939 - DNA, 22 bp, Homo sapiens
tgggccagctccctgcccctgg

SEQ ID NO: 9405940 - DNA, 22 bp, Homo sapiens
tgggccagctgaagtgccgccc

SEQ ID NO: 9405941 - DNA, 22 bp, Homo sapiens
tgggccagctgaagtgccgccc

SEQ ID NO: 9405942 - DNA, 22 bp, Homo sapiens
tgggccagctgaagtgccgccc

SEQ ID NO: 9405943 - DNA, 22 bp, Homo sapiens
tgggcagattaatgcagtggct

SEQ ID NO: 9405944 - DNA, 21 bp, Homo sapiens
tgggcagatggcagtgtggct

SEQ ID NO: 9405945 - DNA, 21 bp, Homo sapiens
tgggcagatggcagtgtggct

SEQ ID NO: 9405946 - DNA, 22 bp, Homo sapiens
tgggcagatctttggtggctag

SEQ ID NO: 9405947 - DNA, 22 bp, Homo sapiens
tgggcagcaaagactgtgtgct

SEQ ID NO: 9405948 - DNA, 20 bp, Homo sapiens
tgggcagcactgctggctgg

SEQ ID NO: 9405949 - DNA, 22 bp, Homo sapiens
tgggcagcagaaccaggccgac

SEQ ID NO: 9405950 - DNA, 22 bp, Homo sapiens
tgggcagcagaaccaggccgac

SEQ ID NO: 9405951 - DNA, 22 bp, Homo sapiens
tgggcagcagaaccaggccgac

SEQ ID NO: 9405952 - DNA, 22 bp, Homo sapiens
tgggcagcagaaccaggccgac

SEQ ID NO: 9405953 - DNA, 22 bp, Homo sapiens
tgggcagcagaaccaggccgac

SEQ ID NO: 9405954 - DNA, 22 bp, Homo sapiens
tgggcagcatcctccacagtca

SEQ ID NO: 9405955 - DNA, 22 bp, Homo sapiens
tgggcagcagcaaagccagact

SEQ ID NO: 9405956 - DNA, 22 bp, Homo sapiens
tgggcagcagcaaagccagact

SEQ ID NO: 9405957 - DNA, 22 bp, Homo sapiens
tgggcaggggccctgcttccgt

SEQ ID NO: 9405958 - DNA, 22 bp, Homo sapiens
tgggcaggggccctgcttccgt

SEQ ID NO: 9405959 - DNA, 22 bp, Homo sapiens
tgggcaggggccctgcttccgt

SEQ ID NO: 9405960 - DNA, 22 bp, Homo sapiens
tgggcagggatctcttttgcaa

SEQ ID NO: 9405961 - DNA, 22 bp, Homo sapiens
tgggcaggggccctgcttccgt

SEQ ID NO: 9405962 - DNA, 22 bp, Homo sapiens
tgggcagggatctcttttgcaa

SEQ ID NO: 9405963 - DNA, 22 bp, Homo sapiens
tgggcagggagctggaaccaca

SEQ ID NO: 9405964 - DNA, 22 bp, Homo sapiens
tgggcagggagctggaaccaca

SEQ ID NO: 9405965 - DNA, 22 bp, Homo sapiens
tgggcagggagctggaaccaca

SEQ ID NO: 9405966 - DNA, 22 bp, Homo sapiens
tgggcagggatctcttttgcaa

SEQ ID NO: 9405967 - DNA, 22 bp, Homo sapiens
tgggcagggatctcttttgcaa

SEQ ID NO: 9405968 - DNA, 22 bp, Homo sapiens
tgggcaggagagaagctaaaga

SEQ ID NO: 9405969 - DNA, 23 bp, Homo sapiens
tgggcagcttctgcatgcccacc

SEQ ID NO: 9405970 - DNA, 22 bp, Homo sapiens
tgggcaggagagaagctaaaga

SEQ ID NO: 9405971 - DNA, 22 bp, Homo sapiens
tgggcaggagagaagctaaaga

SEQ ID NO: 9405972 - DNA, 22 bp, Homo sapiens
tgggcagggagctggaaccaca

SEQ ID NO: 9405973 - DNA, 22 bp, Homo sapiens
tgggcagggagctggaaccaca

SEQ ID NO: 9405974 - DNA, 22 bp, Homo sapiens
tgggcagggagctggaaccaca

SEQ ID NO: 9405975 - DNA, 22 bp, Homo sapiens
tgggcagccatcccagcctctc

SEQ ID NO: 9405976 - DNA, 22 bp, Homo sapiens
tgggcagccatcccagcctctc

SEQ ID NO: 9405977 - DNA, 22 bp, Homo sapiens
tgggcagccatcccagcctctc

SEQ ID NO: 9405978 - DNA, 19 bp, Homo sapiens
tgggcagctccctctgtcc

SEQ ID NO: 9405979 - DNA, 23 bp, Homo sapiens
tgggcagcttctgcatgcccacc

SEQ ID NO: 9405980 - DNA, 19 bp, Homo sapiens
tgggcagctccctctgtcc

SEQ ID NO: 9405981 - DNA, 23 bp, Homo sapiens
tgggcagcttctgcatgcccacc

SEQ ID NO: 9405982 - DNA, 22 bp, Homo sapiens
tgggatggcatcctgggccttg

SEQ ID NO: 9405983 - DNA, 22 bp, Homo sapiens
tgggatggcctttgaaagccag

SEQ ID NO: 9405984 - DNA, 22 bp, Homo sapiens
tgggatgggatctcgctgtgtc

SEQ ID NO: 9405985 - DNA, 22 bp, Homo sapiens
tgggatgggatctcgctgtgtc

SEQ ID NO: 9405986 - DNA, 21 bp, Homo sapiens
tgggatgggtctgggaccagc

SEQ ID NO: 9405987 - DNA, 22 bp, Homo sapiens
tgggatgtggccatggttctct

SEQ ID NO: 9405988 - DNA, 22 bp, Homo sapiens
tgggatgtggccatggttctct

SEQ ID NO: 9405989 - DNA, 22 bp, Homo sapiens
tgggatgtgtgctgcttagtcc

SEQ ID NO: 9405990 - DNA, 22 bp, Homo sapiens
tgggattcaccatgggcttcag

SEQ ID NO: 9405991 - DNA, 22 bp, Homo sapiens
tgggattcaccatgggcttcag

SEQ ID NO: 9405992 - DNA, 22 bp, Homo sapiens
tgggattcaccatgggcttcag

SEQ ID NO: 9405993 - DNA, 22 bp, Homo sapiens
tgggcaagggacaggcctggct

SEQ ID NO: 9405994 - DNA, 22 bp, Homo sapiens
tgggcacctgaggcctggcagg

SEQ ID NO: 9405995 - DNA, 22 bp, Homo sapiens
tgggcactatggctctgtgcac

SEQ ID NO: 9405996 - DNA, 22 bp, Homo sapiens
tgggcagagagtagaggcaacg

SEQ ID NO: 9405997 - DNA, 21 bp, Homo sapiens
tgggcaccaaaacctaggagt

SEQ ID NO: 9405998 - DNA, 22 bp, Homo sapiens
tgggcagaggctctgaagtcca

SEQ ID NO: 9405999 - DNA, 22 bp, Homo sapiens
tgggcagagtcgtggggaatag

SEQ ID NO: 9406000 - DNA, 22 bp, Homo sapiens
tgggcagagtcatacaggagac

SEQ ID NO: 9406001 - DNA, 22 bp, Homo sapiens
tgggaggccgaggcaggtggat

SEQ ID NO: 9406002 - DNA, 22 bp, Homo sapiens
tgggaggcccaggcctggcagg

SEQ ID NO: 9406003 - DNA, 22 bp, Homo sapiens
tgggaggcccaggcctggcagg

SEQ ID NO: 9406004 - DNA, 22 bp, Homo sapiens
tgggaggcccaggcctggcagg

SEQ ID NO: 9406005 - DNA, 22 bp, Homo sapiens
tgggaggcaggtaggtgatgat

SEQ ID NO: 9406006 - DNA, 22 bp, Homo sapiens
tgggaggcaggtaggtgatgat

SEQ ID NO: 9406007 - DNA, 22 bp, Homo sapiens
tgggaggccaaggcaggcggat

SEQ ID NO: 9406008 - DNA, 22 bp, Homo sapiens
tgggaggccaaggcaggcggat

SEQ ID NO: 9406009 - DNA, 22 bp, Homo sapiens
tgggaggcttccagaccttgct

SEQ ID NO: 9406010 - DNA, 22 bp, Homo sapiens
tgggaggcttccagaccttgct

SEQ ID NO: 9406011 - DNA, 22 bp, Homo sapiens
tgggaggtctcttgcggcctag

SEQ ID NO: 9406012 - DNA, 22 bp, Homo sapiens
tgggaggcttccagaccttgct

SEQ ID NO: 9406013 - DNA, 22 bp, Homo sapiens
tgggaggcttccagaccttgct

SEQ ID NO: 9406014 - DNA, 22 bp, Homo sapiens
tgggagtcagacagcctgagat

SEQ ID NO: 9406015 - DNA, 22 bp, Homo sapiens
tgggatgagggtgagccacatg

SEQ ID NO: 9406016 - DNA, 22 bp, Homo sapiens
tgggatgataggtaagtaatta

SEQ ID NO: 9406017 - DNA, 18 bp, Homo sapiens
tgggatggagagtaactg

SEQ ID NO: 9406018 - DNA, 18 bp, Homo sapiens
tgggatggagagtaactg

SEQ ID NO: 9406019 - DNA, 23 bp, Homo sapiens
tgggatggattcaccagtgtgct

SEQ ID NO: 9406020 - DNA, 22 bp, Homo sapiens
tgggatggagcctgagtatagt

SEQ ID NO: 9406021 - DNA, 22 bp, Homo sapiens
tgggatggcatcctgggccttg

SEQ ID NO: 9406022 - DNA, 23 bp, Homo sapiens
tgggatggattcaccagtgtgct

SEQ ID NO: 9406023 - DNA, 23 bp, Homo sapiens
tgggatggattcaccagtgtgct

SEQ ID NO: 9406024 - DNA, 22 bp, Homo sapiens
tgggatggcatcctgggccttg

SEQ ID NO: 9406025 - DNA, 22 bp, Homo sapiens
tgggatagtagctgagagacaa

SEQ ID NO: 9406026 - DNA, 22 bp, Homo sapiens
tgggatagattgatggatagag

SEQ ID NO: 9406027 - DNA, 18 bp, Homo sapiens
tgggagtgggagtggata

SEQ ID NO: 9406028 - DNA, 22 bp, Homo sapiens
tgggagtgatacagtatggaat

SEQ ID NO: 9406029 - DNA, 22 bp, Homo sapiens
tgggagtgatacagtatggaat

SEQ ID NO: 9406030 - DNA, 22 bp, Homo sapiens
tgggatgaatacaatgggatca

SEQ ID NO: 9406031 - DNA, 20 bp, Homo sapiens
tgggatcgaatcaagtctgt

SEQ ID NO: 9406032 - DNA, 22 bp, Homo sapiens
tgggatgagctatatagaaagt

SEQ ID NO: 9406033 - DNA, 22 bp, Homo sapiens
tgggatagtagctgagagacaa

SEQ ID NO: 9406034 - DNA, 22 bp, Homo sapiens
tgggatagtagctgagagacaa

SEQ ID NO: 9406035 - DNA, 22 bp, Homo sapiens
tgggatagtggccaggaccccc

SEQ ID NO: 9406036 - DNA, 20 bp, Homo sapiens
tgggatcgaatcaagtctgt

SEQ ID NO: 9406037 - DNA, 22 bp, Homo sapiens
tgggatataatctgaaaagtat

SEQ ID NO: 9406038 - DNA, 22 bp, Homo sapiens
tggtatggcctggagaatgcag

SEQ ID NO: 9406039 - DNA, 22 bp, Homo sapiens
tggtatggtcaaagcctgtgta

SEQ ID NO: 9406040 - DNA, 22 bp, Homo sapiens
tggtatggctaacgaggtcaag

SEQ ID NO: 9406041 - DNA, 22 bp, Homo sapiens
tggtatgaccgtggtgcaagca

SEQ ID NO: 9406042 - DNA, 22 bp, Homo sapiens
tggtatattttgctctatggtg

SEQ ID NO: 9406043 - DNA, 22 bp, Homo sapiens
tggtatattaactagtttcttc

SEQ ID NO: 9406044 - DNA, 22 bp, Homo sapiens
tggtatatgtgttagcacaagt

SEQ ID NO: 9406045 - DNA, 22 bp, Homo sapiens
tggtatatgcatggaggtatca

SEQ ID NO: 9406046 - DNA, 22 bp, Homo sapiens
tggtataagtaatcataattgc

SEQ ID NO: 9406047 - DNA, 22 bp, Homo sapiens
tggtataatacagtaagtgttg

SEQ ID NO: 9406048 - DNA, 22 bp, Homo sapiens
tggtataaaaatttgtgaatgt

SEQ ID NO: 9406049 - DNA, 22 bp, Homo sapiens
tggtataaaactttttattgaa

SEQ ID NO: 9406050 - DNA, 22 bp, Homo sapiens
tggtataaaaatttgtgaatgt

SEQ ID NO: 9406051 - DNA, 22 bp, Homo sapiens
tggtataaaactttttattgaa

SEQ ID NO: 9406052 - DNA, 22 bp, Homo sapiens
tggtataaaagagtaaactatg

SEQ ID NO: 9406053 - DNA, 22 bp, Homo sapiens
tggtataagtaatcataattgc

SEQ ID NO: 9406054 - DNA, 22 bp, Homo sapiens
tggtataatacagtaagtgttg

SEQ ID NO: 9406055 - DNA, 22 bp, Homo sapiens
tggtataagctgtgtcagagcc

SEQ ID NO: 9406056 - DNA, 22 bp, Homo sapiens
tggtataaacagttactggaga

SEQ ID NO: 9406057 - DNA, 21 bp, Homo sapiens
tggtaggtactggcttcaggc

SEQ ID NO: 9406058 - DNA, 22 bp, Homo sapiens
tggtagggacactatgcagaaa

SEQ ID NO: 9406059 - DNA, 23 bp, Homo sapiens
tggtataaaaacagtacctacct

SEQ ID NO: 9406060 - DNA, 22 bp, Homo sapiens
tggtattacttctagacacaag

SEQ ID NO: 9406061 - DNA, 22 bp, Homo sapiens
tggtattctttctgtagatcat

SEQ ID NO: 9406062 - DNA, 22 bp, Homo sapiens
tggtatttcagcttttgtatct

SEQ ID NO: 9406063 - DNA, 22 bp, Homo sapiens
tggtatttcagcttttgtatct

SEQ ID NO: 9406064 - DNA, 22 bp, Homo sapiens
tggtcaaaagaaagctcagaac

SEQ ID NO: 9406065 - DNA, 22 bp, Homo sapiens
tggtcaaaccagttatctgtaa

SEQ ID NO: 9406066 - DNA, 22 bp, Homo sapiens
tggtcacacatgtatctcaatg

SEQ ID NO: 9406067 - DNA, 22 bp, Homo sapiens
tggtaaagaaatgtcagggcag

SEQ ID NO: 9406068 - DNA, 19 bp, Homo sapiens
tggtaaagactgtccccca

SEQ ID NO: 9406069 - DNA, 22 bp, Homo sapiens
tggtaaagttgattggtgctct

SEQ ID NO: 9406070 - DNA, 22 bp, Homo sapiens
tggtaaagtggcttcacagtgt

SEQ ID NO: 9406071 - DNA, 22 bp, Homo sapiens
tggtaagaataggggctttgga

SEQ ID NO: 9406072 - DNA, 22 bp, Homo sapiens
tggtaaggtcttcactcagatt

SEQ ID NO: 9406073 - DNA, 22 bp, Homo sapiens
tggtaaggcccagctggagtcc

SEQ ID NO: 9406074 - DNA, 22 bp, Homo sapiens
tggtaaggattgtagaaacgaa

SEQ ID NO: 9406075 - DNA, 22 bp, Homo sapiens
tgggttcttaaagggctaggtt

SEQ ID NO: 9406076 - DNA, 19 bp, Homo sapiens
tgggttggaagggaatgaa

SEQ ID NO: 9406077 - DNA, 22 bp, Homo sapiens
tgggttctttcacttctcagtt

SEQ ID NO: 9406078 - DNA, 22 bp, Homo sapiens
tgggttagggcctggtctctga

SEQ ID NO: 9406079 - DNA, 22 bp, Homo sapiens
tgggttaggaaggggtatcacc

SEQ ID NO: 9406080 - DNA, 22 bp, Homo sapiens
tgggttagattccgcgaagcag

SEQ ID NO: 9406081 - DNA, 22 bp, Homo sapiens
tgggttttccacatatgccatg

SEQ ID NO: 9406082 - DNA, 22 bp, Homo sapiens
tgggttttccatctatttactc

SEQ ID NO: 9406083 - DNA, 22 bp, Homo sapiens
tgggttgtaagagagtgcactt

SEQ ID NO: 9406084 - DNA, 19 bp, Homo sapiens
tgggttgtatctctaatgg

SEQ ID NO: 9406085 - DNA, 22 bp, Homo sapiens
tgggttgtcatgggtccaaccc

SEQ ID NO: 9406086 - DNA, 22 bp, Homo sapiens
tgggttgtcctctttctgttaa

SEQ ID NO: 9406087 - DNA, 22 bp, Homo sapiens
tgggtttaaactcaactctaaa

SEQ ID NO: 9406088 - DNA, 22 bp, Homo sapiens
tgggttgttccccaagtccaca

SEQ ID NO: 9406089 - DNA, 22 bp, Homo sapiens
tgggttgttgtgacagttacca

SEQ ID NO: 9406090 - DNA, 22 bp, Homo sapiens
tgggttgttcccatccaggccc

SEQ ID NO: 9406091 - DNA, 22 bp, Homo sapiens
tgggttgtctttgtctccactt

SEQ ID NO: 9406092 - DNA, 16 bp, Homo sapiens
tgggtgggaggagcgg

SEQ ID NO: 9406093 - DNA, 16 bp, Homo sapiens
tgggtgggaggagcgg

SEQ ID NO: 9406094 - DNA, 21 bp, Homo sapiens
tgggtgggcagagtctcttca

SEQ ID NO: 9406095 - DNA, 21 bp, Homo sapiens
tgggtgggcagagtctcttca

SEQ ID NO: 9406096 - DNA, 17 bp, Homo sapiens
tgggtggtagggagagg

SEQ ID NO: 9406097 - DNA, 17 bp, Homo sapiens
tgggtggtagggagagg

SEQ ID NO: 9406098 - DNA, 22 bp, Homo sapiens
tgggtgtgaagtctgttggcct

SEQ ID NO: 9406099 - DNA, 22 bp, Homo sapiens
tgggtggttgctgaggctcctt

SEQ ID NO: 9406100 - DNA, 22 bp, Homo sapiens
tgggtgtgagcccgggagccgc

SEQ ID NO: 9406101 - DNA, 22 bp, Homo sapiens
tgggtgtgagcccgggagccgc

SEQ ID NO: 9406102 - DNA, 22 bp, Homo sapiens
tgggtgtgcccagatggtgtcc

SEQ ID NO: 9406103 - DNA, 22 bp, Homo sapiens
tgggtgtgcccagatggtgtcc

SEQ ID NO: 9406104 - DNA, 22 bp, Homo sapiens
tgggtgtgcccagatggtgtcc

SEQ ID NO: 9406105 - DNA, 22 bp, Homo sapiens
tgggtgaggatgatgaggcagc

SEQ ID NO: 9406106 - DNA, 22 bp, Homo sapiens
tgggtgagcggctgcacacccg

SEQ ID NO: 9406107 - DNA, 22 bp, Homo sapiens
tgggtgagccacaggagttgtc

SEQ ID NO: 9406108 - DNA, 22 bp, Homo sapiens
tgggtgagccacaggagttgtc

SEQ ID NO: 9406109 - DNA, 22 bp, Homo sapiens
tgggtgaggatgatgaggcagc

SEQ ID NO: 9406110 - DNA, 22 bp, Homo sapiens
tgggtgaggagaggctgtctaa

SEQ ID NO: 9406111 - DNA, 21 bp, Homo sapiens
tgggtggaagcgggaggccgc

SEQ ID NO: 9406112 - DNA, 22 bp, Homo sapiens
tgggtgctctgcttccctgcac

SEQ ID NO: 9406113 - DNA, 22 bp, Homo sapiens
tgggtgctctgcgaccgtaggg

SEQ ID NO: 9406114 - DNA, 22 bp, Homo sapiens
tgggtgcttcgtcagctctgag

SEQ ID NO: 9406115 - DNA, 22 bp, Homo sapiens
tgggtgccaacctctggtggcc

SEQ ID NO: 9406116 - DNA, 23 bp, Homo sapiens
tgggtgctaatctgctctgtgga

SEQ ID NO: 9406117 - DNA, 22 bp, Homo sapiens
tgggtgctctgcgaccgtaggg

SEQ ID NO: 9406118 - DNA, 22 bp, Homo sapiens
tgggtgctctgcgaccgtaggg

SEQ ID NO: 9406119 - DNA, 22 bp, Homo sapiens
tgggtgcaggtcttgtgccagg

SEQ ID NO: 9406120 - DNA, 22 bp, Homo sapiens
tgggtgcatgtgagcacgtgca

SEQ ID NO: 9406121 - DNA, 21 bp, Homo sapiens
tgggtgcaagctgcggatgct

SEQ ID NO: 9406122 - DNA, 22 bp, Homo sapiens
tgggtgcaggatgagtgctggc

SEQ ID NO: 9406123 - DNA, 21 bp, Homo sapiens
tgggggtgaggcctaggaatc

SEQ ID NO: 9406124 - DNA, 22 bp, Homo sapiens
tgggggtgactatctcgggaat

SEQ ID NO: 9406125 - DNA, 22 bp, Homo sapiens
tgggggtgaaagtctggacagt

SEQ ID NO: 9406126 - DNA, 22 bp, Homo sapiens
tgggggtgaaagtctggacagt

SEQ ID NO: 9406127 - DNA, 18 bp, Homo sapiens
tggggggcttgtctgaag

SEQ ID NO: 9406128 - DNA, 22 bp, Homo sapiens
tggggggcatgaacctccacgg

SEQ ID NO: 9406129 - DNA, 22 bp, Homo sapiens
tggggggcacttcagcacaatg

SEQ ID NO: 9406130 - DNA, 22 bp, Homo sapiens
tgggggctgtgcacaggctcac

SEQ ID NO: 9406131 - DNA, 22 bp, Homo sapiens
tgggggctgtgcacaggctcac

SEQ ID NO: 9406132 - DNA, 22 bp, Homo sapiens
tgggggtgctgagaagacagga

SEQ ID NO: 9406133 - DNA, 22 bp, Homo sapiens
tgggggtgctgagaagacagga

SEQ ID NO: 9406134 - DNA, 21 bp, Homo sapiens
tgggggtgaggcctaggaatc

SEQ ID NO: 9406135 - DNA, 21 bp, Homo sapiens
tgggggtgaggcctaggaatc

SEQ ID NO: 9406136 - DNA, 20 bp, Homo sapiens
tggggtctagttggcctggg

SEQ ID NO: 9406137 - DNA, 22 bp, Homo sapiens
tgggggtggttcttgcctccag

SEQ ID NO: 9406138 - DNA, 22 bp, Homo sapiens
tggggtctgagtatctgcattt

SEQ ID NO: 9406139 - DNA, 22 bp, Homo sapiens
tggggtgaatctttgttgtccg

SEQ ID NO: 9406140 - DNA, 22 bp, Homo sapiens
tggggtctggagttgcccatga

SEQ ID NO: 9406141 - DNA, 22 bp, Homo sapiens
tggggtggggttactcattctg

SEQ ID NO: 9406142 - DNA, 22 bp, Homo sapiens
tggggtggtaatacaccgttct

SEQ ID NO: 9406143 - DNA, 22 bp, Homo sapiens
tggggtgggcatgcgctgtcct

SEQ ID NO: 9406144 - DNA, 22 bp, Homo sapiens
tggggtgggcatgcgctgtcct

SEQ ID NO: 9406145 - DNA, 22 bp, Homo sapiens
tggggtggtaatacaccgttct

SEQ ID NO: 9406146 - DNA, 22 bp, Homo sapiens
tggggtggtaatacaccgttct

SEQ ID NO: 9406147 - DNA, 22 bp, Homo sapiens
tggggtggtgggaaccaagtag

SEQ ID NO: 9406148 - DNA, 22 bp, Homo sapiens
tggggtggtgggaaccaagtag

SEQ ID NO: 9406149 - DNA, 22 bp, Homo sapiens
tggggttacctacaagtctgag

SEQ ID NO: 9406150 - DNA, 17 bp, Homo sapiens
tggggtgttgaagggtt

SEQ ID NO: 9406151 - DNA, 22 bp, Homo sapiens
tggggtgtgctcagagcagggg

SEQ ID NO: 9406152 - DNA, 22 bp, Homo sapiens
tggggtgtgctcagagcagggg

SEQ ID NO: 9406153 - DNA, 22 bp, Homo sapiens
tggggtgccgacagggagggca

SEQ ID NO: 9406154 - DNA, 22 bp, Homo sapiens
tggggtgccgacagggagggca

SEQ ID NO: 9406155 - DNA, 22 bp, Homo sapiens
tggggtgacagtgcagtggtca

SEQ ID NO: 9406156 - DNA, 22 bp, Homo sapiens
tggggtggaacccttctgctgg

SEQ ID NO: 9406157 - DNA, 22 bp, Homo sapiens
tggggtggaacccttctgctgg

SEQ ID NO: 9406158 - DNA, 22 bp, Homo sapiens
tggggtggaacccttctgctgg

SEQ ID NO: 9406159 - DNA, 22 bp, Homo sapiens
tggggtggaacccttctgctgg

SEQ ID NO: 9406160 - DNA, 22 bp, Homo sapiens
tggggtggatagaaagtgatgt

SEQ ID NO: 9406161 - DNA, 22 bp, Homo sapiens
tggggtgggcatgcgctgtcct

SEQ ID NO: 9406162 - DNA, 22 bp, Homo sapiens
tggggtggatagaaagtgatgt

SEQ ID NO: 9406163 - DNA, 22 bp, Homo sapiens
tggggtggatagaaagtgatgt

SEQ ID NO: 9406164 - DNA, 22 bp, Homo sapiens
tgggtcccaggaaggaccagca

SEQ ID NO: 9406165 - DNA, 22 bp, Homo sapiens
tgggtcccaaactcctagaggt

SEQ ID NO: 9406166 - DNA, 22 bp, Homo sapiens
tgggtccctcatgagaggcatt

SEQ ID NO: 9406167 - DNA, 22 bp, Homo sapiens
tgggtccctcatgagaggcatt

SEQ ID NO: 9406168 - DNA, 22 bp, Homo sapiens
tgggtcccttcagctctcatgg

SEQ ID NO: 9406169 - DNA, 20 bp, Homo sapiens
tgggtcctgcacattctcca

SEQ ID NO: 9406170 - DNA, 20 bp, Homo sapiens
tgggtcctgcacattctcca

SEQ ID NO: 9406171 - DNA, 20 bp, Homo sapiens
tgggtcctgcttcttcctga

SEQ ID NO: 9406172 - DNA, 22 bp, Homo sapiens
tgggtcctgtctccttgttctg

SEQ ID NO: 9406173 - DNA, 22 bp, Homo sapiens
tgggtctcctgtgcctgggagg

SEQ ID NO: 9406174 - DNA, 22 bp, Homo sapiens
tgggtccttcaaagctgggtct

SEQ ID NO: 9406175 - DNA, 22 bp, Homo sapiens
tgggtctccagttcagggcagg

SEQ ID NO: 9406176 - DNA, 22 bp, Homo sapiens
tgggtccttgctgattgctgag

SEQ ID NO: 9406177 - DNA, 22 bp, Homo sapiens
tgggtccttgctaacttctatg

SEQ ID NO: 9406178 - DNA, 22 bp, Homo sapiens
tggggttgaagaaaggatctag

SEQ ID NO: 9406179 - DNA, 23 bp, Homo sapiens
tggggttgaattgtagctgtgcc

SEQ ID NO: 9406180 - DNA, 23 bp, Homo sapiens
tggggttgaattgtagctgtgcc

SEQ ID NO: 9406181 - DNA, 23 bp, Homo sapiens
tggggttgaattgtagctgtgcc

SEQ ID NO: 9406182 - DNA, 22 bp, Homo sapiens
tggggttgcctcccgccctgga

SEQ ID NO: 9406183 - DNA, 22 bp, Homo sapiens
tgggtaagaattgggggctctg

SEQ ID NO: 9406184 - DNA, 22 bp, Homo sapiens
tgggtaaggtactgtagatctg

SEQ ID NO: 9406185 - DNA, 23 bp, Homo sapiens
tgggtagagctgcaaggacactg

SEQ ID NO: 9406186 - DNA, 22 bp, Homo sapiens
tgggtaggaatcgagtgtatgg

SEQ ID NO: 9406187 - DNA, 22 bp, Homo sapiens
tgggtagcagggctgagctgtg

SEQ ID NO: 9406188 - DNA, 22 bp, Homo sapiens
tgggtagaaacaaggctggact

SEQ ID NO: 9406189 - DNA, 22 bp, Homo sapiens
tgggtagaaacaaggctggact

SEQ ID NO: 9406190 - DNA, 22 bp, Homo sapiens
tgggtagagacacagtctgggg

SEQ ID NO: 9406191 - DNA, 22 bp, Homo sapiens
tgggtagagcaggctggggctt

SEQ ID NO: 9406192 - DNA, 22 bp, Homo sapiens
tgggtaggccaggaagcagtgt

SEQ ID NO: 9406193 - DNA, 22 bp, Homo sapiens
tgggtagggacttagctggctg

SEQ ID NO: 9406194 - DNA, 22 bp, Homo sapiens
tgggtaggaccagaaatgcact

SEQ ID NO: 9406195 - DNA, 22 bp, Homo sapiens
tgggtaggaatcgagtgtatgg

SEQ ID NO: 9406196 - DNA, 22 bp, Homo sapiens
tgggtaggccaggaagcagtgt

SEQ ID NO: 9406197 - DNA, 22 bp, Homo sapiens
tgggtaggccaggaagcagtgt

SEQ ID NO: 9406198 - DNA, 22 bp, Homo sapiens
tgggtagggagctggaatccta

SEQ ID NO: 9406199 - DNA, 22 bp, Homo sapiens
tgggtagggacttagctggctg

SEQ ID NO: 9406200 - DNA, 22 bp, Homo sapiens
tgggtaggggacgtggaagaaa

SEQ ID NO: 9406201 - DNA, 22 bp, Homo sapiens
tgggtagggcctgcgcctgtgc

SEQ ID NO: 9406202 - DNA, 22 bp, Homo sapiens
tgggtaggggacgtggaagaaa

SEQ ID NO: 9406203 - DNA, 22 bp, Homo sapiens
tgggtccacttctgcactgtgg

SEQ ID NO: 9406204 - DNA, 22 bp, Homo sapiens
tgggtccacttctgcactgtgg

SEQ ID NO: 9406205 - DNA, 22 bp, Homo sapiens
tggggcagagtaggattttggc

SEQ ID NO: 9406206 - DNA, 22 bp, Homo sapiens
tggggcagagtaggattttggc

SEQ ID NO: 9406207 - DNA, 22 bp, Homo sapiens
tggggcagagtaggattttggc

SEQ ID NO: 9406208 - DNA, 22 bp, Homo sapiens
tggggcagcagacctttcttgg

SEQ ID NO: 9406209 - DNA, 22 bp, Homo sapiens
tggggcagcagacctttcttgg

SEQ ID NO: 9406210 - DNA, 22 bp, Homo sapiens
tggggccacagcctcctagctt

SEQ ID NO: 9406211 - DNA, 22 bp, Homo sapiens
tggggccacagcctcctagctt

SEQ ID NO: 9406212 - DNA, 22 bp, Homo sapiens
tggggccacagcctcctagctt

SEQ ID NO: 9406213 - DNA, 22 bp, Homo sapiens
tggggccagagctgcagggagc

SEQ ID NO: 9406214 - DNA, 22 bp, Homo sapiens
tggggccagagctgcagggagc

SEQ ID NO: 9406215 - DNA, 22 bp, Homo sapiens
tggggccagcggggaggactca

SEQ ID NO: 9406216 - DNA, 22 bp, Homo sapiens
tggggccagcggggaggactca

SEQ ID NO: 9406217 - DNA, 22 bp, Homo sapiens
tggggccagcggggaggactca

SEQ ID NO: 9406218 - DNA, 22 bp, Homo sapiens
tggggccaggtggctgcaggtc

SEQ ID NO: 9406219 - DNA, 22 bp, Homo sapiens
tggggccagggaggaccagaca

SEQ ID NO: 9406220 - DNA, 19 bp, Homo sapiens
tggggcctcctgtccctgg

SEQ ID NO: 9406221 - DNA, 22 bp, Homo sapiens
tggggcctgaaaggttctcgcc

SEQ ID NO: 9406222 - DNA, 22 bp, Homo sapiens
tggggcctgaaaggttctcgcc

SEQ ID NO: 9406223 - DNA, 22 bp, Homo sapiens
tggggcctgaggtggagctgca

SEQ ID NO: 9406224 - DNA, 22 bp, Homo sapiens
tggggccaggtggctgcaggtc

SEQ ID NO: 9406225 - DNA, 22 bp, Homo sapiens
tggggccatctcacccactgtt

SEQ ID NO: 9406226 - DNA, 23 bp, Homo sapiens
tggggctctggcaggcctgaggt

SEQ ID NO: 9406227 - DNA, 22 bp, Homo sapiens
tggggctgaggagcctcactct

SEQ ID NO: 9406228 - DNA, 22 bp, Homo sapiens
tggggctgaggagcctcactct

SEQ ID NO: 9406229 - DNA, 22 bp, Homo sapiens
tggggctcacctaggctggaag

SEQ ID NO: 9406230 - DNA, 22 bp, Homo sapiens
tggggctcctcctggcaggagg

SEQ ID NO: 9406231 - DNA, 22 bp, Homo sapiens
tggggctctccacagtgtctca

SEQ ID NO: 9406232 - DNA, 22 bp, Homo sapiens
tggggcctggtcagagctgcac

SEQ ID NO: 9406233 - DNA, 22 bp, Homo sapiens
tggggcctgtgacgggtccaga

SEQ ID NO: 9406234 - DNA, 20 bp, Homo sapiens
tggggcctgtttctgtggtt

SEQ ID NO: 9406235 - DNA, 20 bp, Homo sapiens
tggggcctgtttctgtggtt

SEQ ID NO: 9406236 - DNA, 22 bp, Homo sapiens
tggggctaaacacgcctggcct

SEQ ID NO: 9406237 - DNA, 22 bp, Homo sapiens
tgggggagagtttagatgattt

SEQ ID NO: 9406238 - DNA, 22 bp, Homo sapiens
tgggggagagtgcaagcatgaa

SEQ ID NO: 9406239 - DNA, 22 bp, Homo sapiens
tgggggagagtgcaagcatgaa

SEQ ID NO: 9406240 - DNA, 22 bp, Homo sapiens
tgggggagagtgcaagcatgaa

SEQ ID NO: 9406241 - DNA, 22 bp, Homo sapiens
tggggctgtccttagtctgaga

SEQ ID NO: 9406242 - DNA, 22 bp, Homo sapiens
tgggggagattagagcttctta

SEQ ID NO: 9406243 - DNA, 22 bp, Homo sapiens
tgggggagatagagtctgatgg

SEQ ID NO: 9406244 - DNA, 22 bp, Homo sapiens
tgggggagattgtgcatctcta

SEQ ID NO: 9406245 - DNA, 22 bp, Homo sapiens
tgggggagattgtgcatctcta

SEQ ID NO: 9406246 - DNA, 22 bp, Homo sapiens
tggggctggctattgtctccct

SEQ ID NO: 9406247 - DNA, 22 bp, Homo sapiens
tggggctggggatcttgagcct

SEQ ID NO: 9406248 - DNA, 22 bp, Homo sapiens
tggggctggggatcttgagcct

SEQ ID NO: 9406249 - DNA, 22 bp, Homo sapiens
tggggctggggatcttgagcct

SEQ ID NO: 9406250 - DNA, 22 bp, Homo sapiens
tggggctgtcccggtttggcga

SEQ ID NO: 9406251 - DNA, 22 bp, Homo sapiens
tggggctgtcccggtttggcga

SEQ ID NO: 9406252 - DNA, 22 bp, Homo sapiens
tggggctgtccttagtctgaga

SEQ ID NO: 9406253 - DNA, 22 bp, Homo sapiens
tggggctgtcccggtttggcga

SEQ ID NO: 9406254 - DNA, 22 bp, Homo sapiens
tgggggcagccaggctgtcaag

SEQ ID NO: 9406255 - DNA, 22 bp, Homo sapiens
tgggggcatggaccagcctggc

SEQ ID NO: 9406256 - DNA, 22 bp, Homo sapiens
tgggggctccaggctccaggga

SEQ ID NO: 9406257 - DNA, 22 bp, Homo sapiens
tgggggagtatagtctggcctc

SEQ ID NO: 9406258 - DNA, 22 bp, Homo sapiens
tgggggagctcagtccagccca

SEQ ID NO: 9406259 - DNA, 22 bp, Homo sapiens
tgggggagtatagtctggcctc

SEQ ID NO: 9406260 - DNA, 22 bp, Homo sapiens
tgggggagccttcacagtagct

SEQ ID NO: 9406261 - DNA, 22 bp, Homo sapiens
tgggggagccttcacagtagct

SEQ ID NO: 9406262 - DNA, 22 bp, Homo sapiens
tgggggagccttcacagtagct

SEQ ID NO: 9406263 - DNA, 22 bp, Homo sapiens
tgggggagctcagtccagccca

SEQ ID NO: 9406264 - DNA, 22 bp, Homo sapiens
tggggaagacagcagacactgt

SEQ ID NO: 9406265 - DNA, 22 bp, Homo sapiens
tggggaaatgtcctgccttccc

SEQ ID NO: 9406266 - DNA, 17 bp, Homo sapiens
tggggaagctcagattt

SEQ ID NO: 9406267 - DNA, 20 bp, Homo sapiens
tggggaaagccatcgatgag

SEQ ID NO: 9406268 - DNA, 22 bp, Homo sapiens
tggggaaaggaaagttaacctg

SEQ ID NO: 9406269 - DNA, 22 bp, Homo sapiens
tggggaaaggagagcattattt

SEQ ID NO: 9406270 - DNA, 22 bp, Homo sapiens
tggggaaagttcttgaaagtaa

SEQ ID NO: 9406271 - DNA, 22 bp, Homo sapiens
tggggaaagggatggctcccgc

SEQ ID NO: 9406272 - DNA, 22 bp, Homo sapiens
tggggaaactatttccttgtcc

SEQ ID NO: 9406273 - DNA, 22 bp, Homo sapiens
tggggaaactatttccttgtcc

SEQ ID NO: 9406274 - DNA, 22 bp, Homo sapiens
tggggaaagatagttttctcta

SEQ ID NO: 9406275 - DNA, 22 bp, Homo sapiens
tggggaaagacattcatacagt

SEQ ID NO: 9406276 - DNA, 22 bp, Homo sapiens
tggggaagggcaccctggagac

SEQ ID NO: 9406277 - DNA, 22 bp, Homo sapiens
tggggaagggcaccctggagac

SEQ ID NO: 9406278 - DNA, 22 bp, Homo sapiens
tggggacacagagccaaactat

SEQ ID NO: 9406279 - DNA, 22 bp, Homo sapiens
tgggcttcctggagcctgtgct

SEQ ID NO: 9406280 - DNA, 23 bp, Homo sapiens
tgggcttctgagaaagcacctaa

SEQ ID NO: 9406281 - DNA, 19 bp, Homo sapiens
tgggcttccccagggcaga

SEQ ID NO: 9406282 - DNA, 22 bp, Homo sapiens
tgggcttcataattggtcctag

SEQ ID NO: 9406283 - DNA, 22 bp, Homo sapiens
tgggctgtggagaggagctgga

SEQ ID NO: 9406284 - DNA, 22 bp, Homo sapiens
tgggctgtggagaggagctgga

SEQ ID NO: 9406285 - DNA, 22 bp, Homo sapiens
tgggctgtggagaggagctgga

SEQ ID NO: 9406286 - DNA, 22 bp, Homo sapiens
tgggcttaggtacctccctggt

SEQ ID NO: 9406287 - DNA, 22 bp, Homo sapiens
tgggctgtggagcacctttgca

SEQ ID NO: 9406288 - DNA, 22 bp, Homo sapiens
tgggcttggaaagctgctgtgc

SEQ ID NO: 9406289 - DNA, 22 bp, Homo sapiens
tgggcttctggagtggggcaga

SEQ ID NO: 9406290 - DNA, 22 bp, Homo sapiens
tgggcttctgatgttgagtgct

SEQ ID NO: 9406291 - DNA, 22 bp, Homo sapiens
tgggcttggaaagctgctgtgc

SEQ ID NO: 9406292 - DNA, 22 bp, Homo sapiens
tgggcttggtttctaggtaggt

SEQ ID NO: 9406293 - DNA, 22 bp, Homo sapiens
tgggcttggtttctaggtaggt

SEQ ID NO: 9406294 - DNA, 22 bp, Homo sapiens
tggggaaaacagaggaaattag

SEQ ID NO: 9406295 - DNA, 22 bp, Homo sapiens
tggggaaaagcgttaggagttc

SEQ ID NO: 9406296 - DNA, 22 bp, Homo sapiens
tggggaaaatgcagaagattac

SEQ ID NO: 9406297 - DNA, 22 bp, Homo sapiens
tggggaaaatgcttgtagtcag

SEQ ID NO: 9406298 - DNA, 22 bp, Homo sapiens
tgggctgtccagcacctgggct

SEQ ID NO: 9406299 - DNA, 22 bp, Homo sapiens
tgggctggtgagggatcattta

SEQ ID NO: 9406300 - DNA, 22 bp, Homo sapiens
tgggctggtgagggatcattta

SEQ ID NO: 9406301 - DNA, 22 bp, Homo sapiens
tgggctggctgaggcattcact

SEQ ID NO: 9406302 - DNA, 22 bp, Homo sapiens
tgggctggctgaggcattcact

SEQ ID NO: 9406303 - DNA, 22 bp, Homo sapiens
tgggctggcgtggagagtttag

SEQ ID NO: 9406304 - DNA, 22 bp, Homo sapiens
tgggctggcgtggagagtttag

SEQ ID NO: 9406305 - DNA, 22 bp, Homo sapiens
tgggctggcgtggagagtttag

SEQ ID NO: 9406306 - DNA, 22 bp, Homo sapiens
tgggctggctgaacttcaacct

SEQ ID NO: 9406307 - DNA, 20 bp, Homo sapiens
tggggagttgagcacgagca

SEQ ID NO: 9406308 - DNA, 22 bp, Homo sapiens
tggggatgaaacccaggcatct

SEQ ID NO: 9406309 - DNA, 20 bp, Homo sapiens
tggggagttgagcacgagca

SEQ ID NO: 9406310 - DNA, 22 bp, Homo sapiens
tggggatgaaacccaggcatct

SEQ ID NO: 9406311 - DNA, 19 bp, Homo sapiens
tggggatgctgatgaccaa

SEQ ID NO: 9406312 - DNA, 19 bp, Homo sapiens
tggggatgctgatgaccaa

SEQ ID NO: 9406313 - DNA, 22 bp, Homo sapiens
tggggatggatgaatctttgct

SEQ ID NO: 9406314 - DNA, 22 bp, Homo sapiens
tggggatgtaaatgaggtgata

SEQ ID NO: 9406315 - DNA, 22 bp, Homo sapiens
tggggatgtaaatgaggtgata

SEQ ID NO: 9406316 - DNA, 21 bp, Homo sapiens
tggggaggggacctgattatg

SEQ ID NO: 9406317 - DNA, 22 bp, Homo sapiens
tggggaggtaacaatttcaggc

SEQ ID NO: 9406318 - DNA, 22 bp, Homo sapiens
tggggaggtaacaatttcaggc

SEQ ID NO: 9406319 - DNA, 22 bp, Homo sapiens
tggggagtcgctgcagagcgat

SEQ ID NO: 9406320 - DNA, 22 bp, Homo sapiens
tggggagtcgctgcagagcgat

SEQ ID NO: 9406321 - DNA, 22 bp, Homo sapiens
tggggaggttcgggaatcttgt

SEQ ID NO: 9406322 - DNA, 22 bp, Homo sapiens
tggggaggttcgggaatcttgt

SEQ ID NO: 9406323 - DNA, 22 bp, Homo sapiens
tggggaggttcgggaatcttgt

SEQ ID NO: 9406324 - DNA, 22 bp, Homo sapiens
tggggaggaagtcagatttcag

SEQ ID NO: 9406325 - DNA, 22 bp, Homo sapiens
tggggacccggactcctgggtc

SEQ ID NO: 9406326 - DNA, 22 bp, Homo sapiens
tggggaggaagtcagatttcag

SEQ ID NO: 9406327 - DNA, 22 bp, Homo sapiens
tggggacagggctcagcaattt

SEQ ID NO: 9406328 - DNA, 22 bp, Homo sapiens
tggggacatagccagtctggct

SEQ ID NO: 9406329 - DNA, 23 bp, Homo sapiens
tggggagggaagtcatttctgta

SEQ ID NO: 9406330 - DNA, 21 bp, Homo sapiens
tggggaggggacctgattatg

SEQ ID NO: 9406331 - DNA, 21 bp, Homo sapiens
tggggaggggacctgattatg

SEQ ID NO: 9406332 - DNA, 22 bp, Homo sapiens
tggggaggacgggcgccttcct

SEQ ID NO: 9406333 - DNA, 22 bp, Homo sapiens
tggggaggacgggcgccttcct

SEQ ID NO: 9406334 - DNA, 22 bp, Homo sapiens
tggggaggatatgtgagttatt

SEQ ID NO: 9406335 - DNA, 22 bp, Homo sapiens
tggggaggatatgtgagttatt

SEQ ID NO: 9406336 - DNA, 22 bp, Homo sapiens
tggggaggatatgtgagttatt

SEQ ID NO: 9406337 - DNA, 22 bp, Homo sapiens
tggggaggatatgtgagttatt

SEQ ID NO: 9406338 - DNA, 21 bp, Homo sapiens
tggtgccttcagctgtctttt

SEQ ID NO: 9406339 - DNA, 21 bp, Homo sapiens
tggtgccttcagctgtctttt

SEQ ID NO: 9406340 - DNA, 22 bp, Homo sapiens
tggtgcctccagctgcttctcc

SEQ ID NO: 9406341 - DNA, 22 bp, Homo sapiens
tggtggacaccgcagccatgaa

SEQ ID NO: 9406342 - DNA, 22 bp, Homo sapiens
tggtggacctggcattgaacct

SEQ ID NO: 9406343 - DNA, 21 bp, Homo sapiens
tggtggaccagtgctgggaga

SEQ ID NO: 9406344 - DNA, 22 bp, Homo sapiens
tggtggagacctcgctaacccc

SEQ ID NO: 9406345 - DNA, 20 bp, Homo sapiens
tggtggactttggcatggct

SEQ ID NO: 9406346 - DNA, 22 bp, Homo sapiens
tggtggagcctaggctaagtct

SEQ ID NO: 9406347 - DNA, 22 bp, Homo sapiens
tggtggagggaactatttccag

SEQ ID NO: 9406348 - DNA, 19 bp, Homo sapiens
tggtggaggccccatgttc

SEQ ID NO: 9406349 - DNA, 22 bp, Homo sapiens
tggtggagctgtggccacgacc

SEQ ID NO: 9406350 - DNA, 22 bp, Homo sapiens
tggtggagctgtggccacgacc

SEQ ID NO: 9406351 - DNA, 22 bp, Homo sapiens
tggtggcaaaagaggcaaagtg

SEQ ID NO: 9406352 - DNA, 22 bp, Homo sapiens
tggtggcaaatcaggacacttc

SEQ ID NO: 9406353 - DNA, 22 bp, Homo sapiens
tggtggcaaagtacaaagtgac

SEQ ID NO: 9406354 - DNA, 22 bp, Homo sapiens
tggtggcaacattgctggagtg

SEQ ID NO: 9406355 - DNA, 22 bp, Homo sapiens
tggtggcaacattgctggagtg

SEQ ID NO: 9406356 - DNA, 22 bp, Homo sapiens
tggtggcaacattgctggagtg

SEQ ID NO: 9406357 - DNA, 19 bp, Homo sapiens
tggtggaggtgcacctgac

SEQ ID NO: 9406358 - DNA, 19 bp, Homo sapiens
tggtggaggtgcacctgac

SEQ ID NO: 9406359 - DNA, 21 bp, Homo sapiens
tggtggagtgtgctgagcatg

SEQ ID NO: 9406360 - DNA, 21 bp, Homo sapiens
tggtggagtgtgctgagcatg

SEQ ID NO: 9406361 - DNA, 21 bp, Homo sapiens
tggtggagtgtgctgagcatg

SEQ ID NO: 9406362 - DNA, 22 bp, Homo sapiens
tggtgcagtccaaagggagcag

SEQ ID NO: 9406363 - DNA, 22 bp, Homo sapiens
tggtgcagtccaaagggagcag

SEQ ID NO: 9406364 - DNA, 22 bp, Homo sapiens
tggtgcagtccaaagggagcag

SEQ ID NO: 9406365 - DNA, 22 bp, Homo sapiens
tggtgcagtccaaagggagcag

SEQ ID NO: 9406366 - DNA, 22 bp, Homo sapiens
tggtgcagtcattggcccaggg

SEQ ID NO: 9406367 - DNA, 22 bp, Homo sapiens
tggtgcagttcccagggccggg

SEQ ID NO: 9406368 - DNA, 22 bp, Homo sapiens
tggtgcagttcccagggccggg

SEQ ID NO: 9406369 - DNA, 22 bp, Homo sapiens
tggtgcagttcccagggccggg

SEQ ID NO: 9406370 - DNA, 22 bp, Homo sapiens
tggtgccaccctccttcagctg

SEQ ID NO: 9406371 - DNA, 22 bp, Homo sapiens
tggtgcaggagttggcagggac

SEQ ID NO: 9406372 - DNA, 22 bp, Homo sapiens
tggtgcaggagttggcagggac

SEQ ID NO: 9406373 - DNA, 22 bp, Homo sapiens
tggtgcagatgcaggtcactgg

SEQ ID NO: 9406374 - DNA, 22 bp, Homo sapiens
tggtgcagatagtggtgtagta

SEQ ID NO: 9406375 - DNA, 22 bp, Homo sapiens
tggtgcaggccaagctgcgagc

SEQ ID NO: 9406376 - DNA, 22 bp, Homo sapiens
tggtgcaggagttggcagggac

SEQ ID NO: 9406377 - DNA, 22 bp, Homo sapiens
tggtgcagtagagctgtctggg

SEQ ID NO: 9406378 - DNA, 22 bp, Homo sapiens
tggtgcagtagaaggccgactt

SEQ ID NO: 9406379 - DNA, 22 bp, Homo sapiens
tggtgcaggtgttgatgcagga

SEQ ID NO: 9406380 - DNA, 22 bp, Homo sapiens
tggtgcagtagaaggccgactt

SEQ ID NO: 9406381 - DNA, 22 bp, Homo sapiens
tggtgcagtagagctgtctggg

SEQ ID NO: 9406382 - DNA, 22 bp, Homo sapiens
tggtgcagtcattggcccaggg

SEQ ID NO: 9406383 - DNA, 22 bp, Homo sapiens
tggtgcagtcattggcccaggg

SEQ ID NO: 9406384 - DNA, 22 bp, Homo sapiens
tggtgcagtcattggcccaggg

SEQ ID NO: 9406385 - DNA, 22 bp, Homo sapiens
tggtgggggaggctgtctagca

SEQ ID NO: 9406386 - DNA, 22 bp, Homo sapiens
tggtgggggaggctgtctagca

SEQ ID NO: 9406387 - DNA, 22 bp, Homo sapiens
tggtgggggaggctgtctagca

SEQ ID NO: 9406388 - DNA, 22 bp, Homo sapiens
tggtgggggaggctgtctagca

SEQ ID NO: 9406389 - DNA, 22 bp, Homo sapiens
tggtggggtcatcgtcagatgc

SEQ ID NO: 9406390 - DNA, 22 bp, Homo sapiens
tggtggggctttccttctgctt

SEQ ID NO: 9406391 - DNA, 22 bp, Homo sapiens
tggtggggccagacttcagctc

SEQ ID NO: 9406392 - DNA, 20 bp, Homo sapiens
tggtggccagtgctgcaggc

SEQ ID NO: 9406393 - DNA, 22 bp, Homo sapiens
tggtgggagtgagggcatgcca

SEQ ID NO: 9406394 - DNA, 22 bp, Homo sapiens
tggtgggagtgacgttgccttc

SEQ ID NO: 9406395 - DNA, 22 bp, Homo sapiens
tggtgggagtccgctgtgctgc

SEQ ID NO: 9406396 - DNA, 22 bp, Homo sapiens
tggtgggagtgacgttgccttc

SEQ ID NO: 9406397 - DNA, 22 bp, Homo sapiens
tggtgggagtgacgttgccttc

SEQ ID NO: 9406398 - DNA, 22 bp, Homo sapiens
tggtgggcacagtgcccaggct

SEQ ID NO: 9406399 - DNA, 22 bp, Homo sapiens
tggtgggagtgagggcatgcca

SEQ ID NO: 9406400 - DNA, 22 bp, Homo sapiens
tggtgggagtgagggcatgcca

SEQ ID NO: 9406401 - DNA, 22 bp, Homo sapiens
tggtgggagtgagggcatgcca

SEQ ID NO: 9406402 - DNA, 22 bp, Homo sapiens
tggtggggattccctccctggc

SEQ ID NO: 9406403 - DNA, 16 bp, Homo sapiens
tggtggggaggacagc

SEQ ID NO: 9406404 - DNA, 22 bp, Homo sapiens
tggtggcacaagggagagaatc

SEQ ID NO: 9406405 - DNA, 22 bp, Homo sapiens
tggtggcacaagggagagaatc

SEQ ID NO: 9406406 - DNA, 22 bp, Homo sapiens
tggtggcaatgtcctggagaag

SEQ ID NO: 9406407 - DNA, 22 bp, Homo sapiens
tggtggcaatgtcctggagaag

SEQ ID NO: 9406408 - DNA, 19 bp, Homo sapiens
tggtggcaatgtcagctaa

SEQ ID NO: 9406409 - DNA, 22 bp, Homo sapiens
tggtggcaatgtcctggagaag

SEQ ID NO: 9406410 - DNA, 22 bp, Homo sapiens
tggtggcagagcaagagctgga

SEQ ID NO: 9406411 - DNA, 23 bp, Homo sapiens
tggtggcagaagtagcagatgac

SEQ ID NO: 9406412 - DNA, 23 bp, Homo sapiens
tggtggcagaagtagcagatgac

SEQ ID NO: 9406413 - DNA, 23 bp, Homo sapiens
tggtggcagaagtagcagatgac

SEQ ID NO: 9406414 - DNA, 22 bp, Homo sapiens
tggtggcactgacatcagacac

SEQ ID NO: 9406415 - DNA, 22 bp, Homo sapiens
tggtggcatcaattgacttctc

SEQ ID NO: 9406416 - DNA, 22 bp, Homo sapiens
tggtggcatcagtgaagtacac

SEQ ID NO: 9406417 - DNA, 22 bp, Homo sapiens
tggtggcatcagtgaagtacac

SEQ ID NO: 9406418 - DNA, 22 bp, Homo sapiens
tggtggccaattcacagggctc

SEQ ID NO: 9406419 - DNA, 20 bp, Homo sapiens
tggtggccagtgctgcaggc

SEQ ID NO: 9406420 - DNA, 20 bp, Homo sapiens
tggtggccagtgctgcaggc

SEQ ID NO: 9406421 - DNA, 22 bp, Homo sapiens
tggtggccacgtgggcgcgagc

SEQ ID NO: 9406422 - DNA, 22 bp, Homo sapiens
tggtggcagctgagtgtcaggt

SEQ ID NO: 9406423 - DNA, 22 bp, Homo sapiens
tggtggcagctgagtgtcaggt

SEQ ID NO: 9406424 - DNA, 22 bp, Homo sapiens
tggtggcagctgagtgtcaggt

SEQ ID NO: 9406425 - DNA, 22 bp, Homo sapiens
tggtggcagctgagtgtcaggt

SEQ ID NO: 9406426 - DNA, 22 bp, Homo sapiens
tggtggcagtctcctggctgtg

SEQ ID NO: 9406427 - DNA, 22 bp, Homo sapiens
tggtggcagctgggacagaggt

SEQ ID NO: 9406428 - DNA, 22 bp, Homo sapiens
tggtggcagctgggacagaggt

SEQ ID NO: 9406429 - DNA, 22 bp, Homo sapiens
tggtggcagctgggacagaggt

SEQ ID NO: 9406430 - DNA, 22 bp, Homo sapiens
tggtgcaaaactaattgcggtt

SEQ ID NO: 9406431 - DNA, 22 bp, Homo sapiens
tggtgaggtcatagagaactgt

SEQ ID NO: 9406432 - DNA, 22 bp, Homo sapiens
tggtgcagacaggagccccgct

SEQ ID NO: 9406433 - DNA, 22 bp, Homo sapiens
tggtgcagatagtggtgtagta

SEQ ID NO: 9406434 - DNA, 22 bp, Homo sapiens
tggtgcagagagggatctaggg

SEQ ID NO: 9406435 - DNA, 22 bp, Homo sapiens
tggtgactgggactggatatga

SEQ ID NO: 9406436 - DNA, 22 bp, Homo sapiens
tggtgacagcatggaagaagtg

SEQ ID NO: 9406437 - DNA, 22 bp, Homo sapiens
tggtctctgctgcagcttctca

SEQ ID NO: 9406438 - DNA, 22 bp, Homo sapiens
tggtctctgctgcagcttctca

SEQ ID NO: 9406439 - DNA, 22 bp, Homo sapiens
tggtctctgtaggctaccccat

SEQ ID NO: 9406440 - DNA, 19 bp, Homo sapiens
tggtctctgtctctttgca

SEQ ID NO: 9406441 - DNA, 22 bp, Homo sapiens
tggtgacacgaagtttgctatc

SEQ ID NO: 9406442 - DNA, 22 bp, Homo sapiens
tggtgacaccccatctctaaag

SEQ ID NO: 9406443 - DNA, 18 bp, Homo sapiens
tggtgaagggtggaggag

SEQ ID NO: 9406444 - DNA, 22 bp, Homo sapiens
tggtctctgtgctcgggcatgg

SEQ ID NO: 9406445 - DNA, 22 bp, Homo sapiens
tggtctctgagccttcctgtgg

SEQ ID NO: 9406446 - DNA, 22 bp, Homo sapiens
tggtctctgcaggccaggctca

SEQ ID NO: 9406447 - DNA, 22 bp, Homo sapiens
tggtctctgagccttcctgtgg

SEQ ID NO: 9406448 - DNA, 22 bp, Homo sapiens
tggtctctgagccttcctgtgg

SEQ ID NO: 9406449 - DNA, 22 bp, Homo sapiens
tggtctctgactctgaagaccc

SEQ ID NO: 9406450 - DNA, 22 bp, Homo sapiens
tggtctctctcctgcaacaact

SEQ ID NO: 9406451 - DNA, 22 bp, Homo sapiens
tggtctctccatgccctccacc

SEQ ID NO: 9406452 - DNA, 22 bp, Homo sapiens
tggtctctacggaggaaagctg

SEQ ID NO: 9406453 - DNA, 22 bp, Homo sapiens
tggtccttctgtcttccgcacc

SEQ ID NO: 9406454 - DNA, 22 bp, Homo sapiens
tggtccttgtggcttttcagta

SEQ ID NO: 9406455 - DNA, 22 bp, Homo sapiens
tggtccttgtaggcatttgagc

SEQ ID NO: 9406456 - DNA, 22 bp, Homo sapiens
tggtccttgtaggcatttgagc

SEQ ID NO: 9406457 - DNA, 23 bp, Homo sapiens
tggtctcacttggtaagatgaag

SEQ ID NO: 9406458 - DNA, 22 bp, Homo sapiens
tggtcgaccagttggaaagtaa

SEQ ID NO: 9406459 - DNA, 22 bp, Homo sapiens
tggtcctttaagtctttctctg

SEQ ID NO: 9406460 - DNA, 22 bp, Homo sapiens
tggtccttctctgcctgcagtg

SEQ ID NO: 9406461 - DNA, 22 bp, Homo sapiens
tggtccttcgtggtgcagttct

SEQ ID NO: 9406462 - DNA, 22 bp, Homo sapiens
tggtccttcgtggtgcagttct

SEQ ID NO: 9406463 - DNA, 22 bp, Homo sapiens
tggtcctggggatctgcagtga

SEQ ID NO: 9406464 - DNA, 22 bp, Homo sapiens
tggtcctggggtgcaggctgac

SEQ ID NO: 9406465 - DNA, 22 bp, Homo sapiens
tggtcctggggtgcaggctgac

SEQ ID NO: 9406466 - DNA, 22 bp, Homo sapiens
tggtccagaagatattcaacca

SEQ ID NO: 9406467 - DNA, 22 bp, Homo sapiens
tggtcatttttatttcagttgc

SEQ ID NO: 9406468 - DNA, 22 bp, Homo sapiens
tggtccagatgccttggcttta

SEQ ID NO: 9406469 - DNA, 22 bp, Homo sapiens
tggtccagactttgacctctca

SEQ ID NO: 9406470 - DNA, 22 bp, Homo sapiens
tggtccagacatttctgaggta

SEQ ID NO: 9406471 - DNA, 22 bp, Homo sapiens
tggtccagaagatattcaacca

SEQ ID NO: 9406472 - DNA, 22 bp, Homo sapiens
tggtcagttgtgactagaacac

SEQ ID NO: 9406473 - DNA, 22 bp, Homo sapiens
tggtcatgtagtagagacagct

SEQ ID NO: 9406474 - DNA, 22 bp, Homo sapiens
tggtcatgtagtagagacagct

SEQ ID NO: 9406475 - DNA, 22 bp, Homo sapiens
tggtcagttgcatcagagaagt

SEQ ID NO: 9406476 - DNA, 22 bp, Homo sapiens
tggtcagttgagcagaagggaa

SEQ ID NO: 9406477 - DNA, 22 bp, Homo sapiens
tggtcagtgtgacattttttaa

SEQ ID NO: 9406478 - DNA, 23 bp, Homo sapiens
tggtcagtgccttgcatgtggga

SEQ ID NO: 9406479 - DNA, 22 bp, Homo sapiens
tggtcaggtacctctggctgtc

SEQ ID NO: 9406480 - DNA, 22 bp, Homo sapiens
tggtcaggtacctctggctgtc

SEQ ID NO: 9406481 - DNA, 22 bp, Homo sapiens
tggtcaggtacctctggctgtc

SEQ ID NO: 9406482 - DNA, 22 bp, Homo sapiens
tggtcacccactgggactgcgg

SEQ ID NO: 9406483 - DNA, 22 bp, Homo sapiens
tggtcacccactgggactgcgg

SEQ ID NO: 9406484 - DNA, 18 bp, Homo sapiens
tggtcactgtggatagtg

SEQ ID NO: 9406485 - DNA, 22 bp, Homo sapiens
tggtcagacaaaggagaatgtt

SEQ ID NO: 9406486 - DNA, 19 bp, Homo sapiens
tggtcagatttcagaagtc

SEQ ID NO: 9406487 - DNA, 22 bp, Homo sapiens
tggtcaggctgctctgcggcgt

SEQ ID NO: 9406488 - DNA, 22 bp, Homo sapiens
tggtcaggctgctctgcggcgt

SEQ ID NO: 9406489 - DNA, 22 bp, Homo sapiens
tggtcaggctgctctgcggcgt

SEQ ID NO: 9406490 - DNA, 22 bp, Homo sapiens
tggtcaggggcttctgagctgt

SEQ ID NO: 9406491 - DNA, 22 bp, Homo sapiens
tggtcaggggcttctgagctgt

SEQ ID NO: 9406492 - DNA, 22 bp, Homo sapiens
tggtcaggattctcagcccttc

SEQ ID NO: 9406493 - DNA, 19 bp, Homo sapiens
tggtccagcttcttctcct

SEQ ID NO: 9406494 - DNA, 22 bp, Homo sapiens
tggtccagcttgattctcttct

SEQ ID NO: 9406495 - DNA, 20 bp, Homo sapiens
tggtccaggacctggtgtcc

SEQ ID NO: 9406496 - DNA, 20 bp, Homo sapiens
tggtccaggacctggtgtcc

SEQ ID NO: 9406497 - DNA, 22 bp, Homo sapiens
tggtcctcaggttctctgtgcg

SEQ ID NO: 9406498 - DNA, 20 bp, Homo sapiens
tggtcctcacatgccatctt

SEQ ID NO: 9406499 - DNA, 17 bp, Homo sapiens
tggtccaggtggagcca

SEQ ID NO: 9406500 - DNA, 22 bp, Homo sapiens
tggtcctgagcaccagcctgac

SEQ ID NO: 9406501 - DNA, 22 bp, Homo sapiens
tggtcctgatcaccgctgggca

SEQ ID NO: 9406502 - DNA, 22 bp, Homo sapiens
tggtcctgagaatcctgtcctc

SEQ ID NO: 9406503 - DNA, 22 bp, Homo sapiens
tggtcctgagcaccagcctgac

SEQ ID NO: 9406504 - DNA, 22 bp, Homo sapiens
tggtcctgccccgtgcacagag

SEQ ID NO: 9406505 - DNA, 22 bp, Homo sapiens
tggtcctggaaggtcctgaggg

SEQ ID NO: 9406506 - DNA, 22 bp, Homo sapiens
tggtcctgcccacgcccatctg

SEQ ID NO: 9406507 - DNA, 22 bp, Homo sapiens
tggtcctggaaggtcctgaggg

SEQ ID NO: 9406508 - DNA, 22 bp, Homo sapiens
tggtcctggagagtgttccata

SEQ ID NO: 9406509 - DNA, 22 bp, Homo sapiens
tggtcctggccttgaccccagg

SEQ ID NO: 9406510 - DNA, 22 bp, Homo sapiens
tggtcctggccttgaccccagg

SEQ ID NO: 9406511 - DNA, 18 bp, Homo sapiens
tgtaaacactttcattct

SEQ ID NO: 9406512 - DNA, 22 bp, Homo sapiens
tgtaaagtccaagatcaaagag

SEQ ID NO: 9406513 - DNA, 22 bp, Homo sapiens
tgtaaagtatctgtgagctctc

SEQ ID NO: 9406514 - DNA, 22 bp, Homo sapiens
tgtaaataattcctaggctttt

SEQ ID NO: 9406515 - DNA, 22 bp, Homo sapiens
tgtaaataatgcatgtaaatca

SEQ ID NO: 9406516 - DNA, 22 bp, Homo sapiens
tgtaaataatgcatgtaaatca

SEQ ID NO: 9406517 - DNA, 22 bp, Homo sapiens
tgtaaataatgcatgtaaatca

SEQ ID NO: 9406518 - DNA, 22 bp, Homo sapiens
tgtaaatcactgaactaaatga

SEQ ID NO: 9406519 - DNA, 22 bp, Homo sapiens
tgtaaatggtcagataaaccta

SEQ ID NO: 9406520 - DNA, 22 bp, Homo sapiens
tgtaaatgaagtatgctttact

SEQ ID NO: 9406521 - DNA, 20 bp, Homo sapiens
tgtaaataggcattgtagtt

SEQ ID NO: 9406522 - DNA, 22 bp, Homo sapiens
tgtaaatagttagcttgcctct

SEQ ID NO: 9406523 - DNA, 20 bp, Homo sapiens
tgtaaataggcattgtagtt

SEQ ID NO: 9406524 - DNA, 17 bp, Homo sapiens
tgtaaaacccagaggtc

SEQ ID NO: 9406525 - DNA, 22 bp, Homo sapiens
tgtaaaacaaaatttgtggaga

SEQ ID NO: 9406526 - DNA, 22 bp, Homo sapiens
tgtaaaacaaaatttgtggaga

SEQ ID NO: 9406527 - DNA, 22 bp, Homo sapiens
tgtaaaaagcccagccgctgag

SEQ ID NO: 9406528 - DNA, 22 bp, Homo sapiens
tgtaaaataccattccttgtca

SEQ ID NO: 9406529 - DNA, 22 bp, Homo sapiens
tgtaaaataattctccatgttt

SEQ ID NO: 9406530 - DNA, 22 bp, Homo sapiens
tggtttctttccactctccacc

SEQ ID NO: 9406531 - DNA, 22 bp, Homo sapiens
tggttttaaaagatgtttgaga

SEQ ID NO: 9406532 - DNA, 22 bp, Homo sapiens
tggttttaaaaacatgctgcat

SEQ ID NO: 9406533 - DNA, 22 bp, Homo sapiens
tggtttgtatatgtttgtgaga

SEQ ID NO: 9406534 - DNA, 22 bp, Homo sapiens
tggttttatttatgttgagtca

SEQ ID NO: 9406535 - DNA, 22 bp, Homo sapiens
tggttttagggaatcaatctat

SEQ ID NO: 9406536 - DNA, 22 bp, Homo sapiens
tggttttagggaatcaatctat

SEQ ID NO: 9406537 - DNA, 22 bp, Homo sapiens
tggttttagagtatattcaggg

SEQ ID NO: 9406538 - DNA, 22 bp, Homo sapiens
tggttttagagtatattcaggg

SEQ ID NO: 9406539 - DNA, 22 bp, Homo sapiens
tggttttaaaagatgtttgaga

SEQ ID NO: 9406540 - DNA, 22 bp, Homo sapiens
tggttttagatgcctttactgc

SEQ ID NO: 9406541 - DNA, 22 bp, Homo sapiens
tggttttagagtatattcaggg

SEQ ID NO: 9406542 - DNA, 22 bp, Homo sapiens
tggttttgctaaaatagaaaga

SEQ ID NO: 9406543 - DNA, 22 bp, Homo sapiens
tggtttttggtgttcacagagg

SEQ ID NO: 9406544 - DNA, 22 bp, Homo sapiens
tggttttctggtggtggcagtg

SEQ ID NO: 9406545 - DNA, 20 bp, Homo sapiens
tggttttgccagaaatccct

SEQ ID NO: 9406546 - DNA, 22 bp, Homo sapiens
tggttttagggaatcaatctat

SEQ ID NO: 9406547 - DNA, 22 bp, Homo sapiens
tggttttatttatgttgagtca

SEQ ID NO: 9406548 - DNA, 22 bp, Homo sapiens
tggttgtggtcctccacatcgc

SEQ ID NO: 9406549 - DNA, 22 bp, Homo sapiens
tggttgtgctgagtttagtgca

SEQ ID NO: 9406550 - DNA, 23 bp, Homo sapiens
tggttcttatgattttactacca

SEQ ID NO: 9406551 - DNA, 22 bp, Homo sapiens
tggttgaataagatagttttat

SEQ ID NO: 9406552 - DNA, 22 bp, Homo sapiens
tggttgcctctcagagattccg

SEQ ID NO: 9406553 - DNA, 22 bp, Homo sapiens
tggttgaatgtagcatttatgg

SEQ ID NO: 9406554 - DNA, 20 bp, Homo sapiens
tggttgaatttttagtgacc

SEQ ID NO: 9406555 - DNA, 22 bp, Homo sapiens
tggttgcattaactgagagggg

SEQ ID NO: 9406556 - DNA, 22 bp, Homo sapiens
tggtttaatttccatttccttg

SEQ ID NO: 9406557 - DNA, 22 bp, Homo sapiens
tggtttactctgtaaaccagga

SEQ ID NO: 9406558 - DNA, 22 bp, Homo sapiens
tggtttacctggaaaagcgcat

SEQ ID NO: 9406559 - DNA, 22 bp, Homo sapiens
tggtttaaggacagagagccag

SEQ ID NO: 9406560 - DNA, 22 bp, Homo sapiens
tggtttaacctgtctcttatta

SEQ ID NO: 9406561 - DNA, 22 bp, Homo sapiens
tggttgtgtcacttagattaga

SEQ ID NO: 9406562 - DNA, 22 bp, Homo sapiens
tggtttctcccttcgcagtgag

SEQ ID NO: 9406563 - DNA, 22 bp, Homo sapiens
tggtttctcagactctttgcag

SEQ ID NO: 9406564 - DNA, 22 bp, Homo sapiens
tggtttctcagactctttgcag

SEQ ID NO: 9406565 - DNA, 22 bp, Homo sapiens
tggtttcatgagatgagaattt

SEQ ID NO: 9406566 - DNA, 22 bp, Homo sapiens
tggtgtcactcaagcccggccg

SEQ ID NO: 9406567 - DNA, 22 bp, Homo sapiens
tggtgtcctaagtggaaggaca

SEQ ID NO: 9406568 - DNA, 22 bp, Homo sapiens
tggtgtcatgttggggtttatt

SEQ ID NO: 9406569 - DNA, 22 bp, Homo sapiens
tggtggtctggctttatatcct

SEQ ID NO: 9406570 - DNA, 22 bp, Homo sapiens
tggtggtccacaaatgggtaca

SEQ ID NO: 9406571 - DNA, 22 bp, Homo sapiens
tggtggtcatagcagaggccgt

SEQ ID NO: 9406572 - DNA, 23 bp, Homo sapiens
tggtggtcagccctttctggagg

SEQ ID NO: 9406573 - DNA, 22 bp, Homo sapiens
tggtggtcaaagccagtgttct

SEQ ID NO: 9406574 - DNA, 23 bp, Homo sapiens
tggtggggtcttggagacagcac

SEQ ID NO: 9406575 - DNA, 22 bp, Homo sapiens
tggtggggtcatcgtcagatgc

SEQ ID NO: 9406576 - DNA, 22 bp, Homo sapiens
tggtgtggtccagtgacatact

SEQ ID NO: 9406577 - DNA, 22 bp, Homo sapiens
tggttaaaatgcagattcagta

SEQ ID NO: 9406578 - DNA, 22 bp, Homo sapiens
tggtgtgggcgtggcaggcaag

SEQ ID NO: 9406579 - DNA, 22 bp, Homo sapiens
tggtgtgggcgtggcaggcaag

SEQ ID NO: 9406580 - DNA, 22 bp, Homo sapiens
tggtgtggggataagcactctg

SEQ ID NO: 9406581 - DNA, 22 bp, Homo sapiens
tggtgtggggataagcactctg

SEQ ID NO: 9406582 - DNA, 22 bp, Homo sapiens
tggtgtggggataagcactctg

SEQ ID NO: 9406583 - DNA, 22 bp, Homo sapiens
tggtgtgaggcgggagtgtagt

SEQ ID NO: 9406584 - DNA, 22 bp, Homo sapiens
tggtgtgagcaggtcaagttca

SEQ ID NO: 9406585 - DNA, 22 bp, Homo sapiens
tggtgtctcttagtacatagat

SEQ ID NO: 9406586 - DNA, 22 bp, Homo sapiens
tgtaacaatgaatatagtgact

SEQ ID NO: 9406587 - DNA, 23 bp, Homo sapiens
tgtaaattttgtagtcacatttt

SEQ ID NO: 9406588 - DNA, 22 bp, Homo sapiens
tgtaacaatttcttactattgt

SEQ ID NO: 9406589 - DNA, 22 bp, Homo sapiens
tgtaacaatttcttactattgt

SEQ ID NO: 9406590 - DNA, 23 bp, Homo sapiens
tgtaacaatttcatatacatgca

SEQ ID NO: 9406591 - DNA, 22 bp, Homo sapiens
tgtaacagttataacaatgtgg

SEQ ID NO: 9406592 - DNA, 22 bp, Homo sapiens
tgtaacagctctccatgtgggg

SEQ ID NO: 9406593 - DNA, 22 bp, Homo sapiens
tgtaactaagcacattatctaa

SEQ ID NO: 9406594 - DNA, 22 bp, Homo sapiens
tgtaacatggttcttactctca

SEQ ID NO: 9406595 - DNA, 22 bp, Homo sapiens
tgtaacctgactgctttgctct

SEQ ID NO: 9406596 - DNA, 22 bp, Homo sapiens
tgtacaaagagtatagctttga

SEQ ID NO: 9406597 - DNA, 22 bp, Homo sapiens
tgtacaaagccagaactcccaa

SEQ ID NO: 9406598 - DNA, 22 bp, Homo sapiens
tgtacaaagttaaacctatata

SEQ ID NO: 9406599 - DNA, 22 bp, Homo sapiens
tgtacaaaggtactttgatgtt

SEQ ID NO: 9406600 - DNA, 22 bp, Homo sapiens
tgtacaaagttaaacctatata

SEQ ID NO: 9406601 - DNA, 22 bp, Homo sapiens
tgtaaggtgctcatgtatttct

SEQ ID NO: 9406602 - DNA, 22 bp, Homo sapiens
tgtaattttacgtgacacagtt

SEQ ID NO: 9406603 - DNA, 22 bp, Homo sapiens
tgtaagtagaacaacataatct

SEQ ID NO: 9406604 - DNA, 22 bp, Homo sapiens
tgtacaaagagtatagctttga

SEQ ID NO: 9406605 - DNA, 22 bp, Homo sapiens
tgtaagcttcaaatatctgtga

SEQ ID NO: 9406606 - DNA, 22 bp, Homo sapiens
tgtacacaattcttaacataca

SEQ ID NO: 9406607 - DNA, 22 bp, Homo sapiens
tgtacacagtatgaggcatctt

SEQ ID NO: 9406608 - DNA, 22 bp, Homo sapiens
tgtacacagtatgaggcatctt

SEQ ID NO: 9406609 - DNA, 22 bp, Homo sapiens
tgtacacaattcttaacataca

SEQ ID NO: 9406610 - DNA, 22 bp, Homo sapiens
tgtacacaattcttaacataca

SEQ ID NO: 9406611 - DNA, 22 bp, Homo sapiens
tgtacaatagctattatctcca

SEQ ID NO: 9406612 - DNA, 22 bp, Homo sapiens
tgtacaaggccatctacatgct

SEQ ID NO: 9406613 - DNA, 22 bp, Homo sapiens
tgtacaaggccatctacatgct

SEQ ID NO: 9406614 - DNA, 23 bp, Homo sapiens
tgtacaagtacgacctctccctc

SEQ ID NO: 9406615 - DNA, 19 bp, Homo sapiens
tgtacaaggattatgcagg

SEQ ID NO: 9406616 - DNA, 19 bp, Homo sapiens
tgtacaaggattatgcagg

SEQ ID NO: 9406617 - DNA, 22 bp, Homo sapiens
tgtacaagaataattttatata

SEQ ID NO: 9406618 - DNA, 22 bp, Homo sapiens
tgtacaaattcattgaactgta

SEQ ID NO: 9406619 - DNA, 22 bp, Homo sapiens
tgtacaaattcattgaactgta

SEQ ID NO: 9406620 - DNA, 22 bp, Homo sapiens
tgtacaaattcagttctagggt

SEQ ID NO: 9406621 - DNA, 22 bp, Homo sapiens
tgtacaaattcagttctagggt

SEQ ID NO: 9406622 - DNA, 22 bp, Homo sapiens
tgtacacatggtgtacactccc

SEQ ID NO: 9406623 - DNA, 22 bp, Homo sapiens
tgtacagactttgcagtgtgca

SEQ ID NO: 9406624 - DNA, 22 bp, Homo sapiens
tgtacagtatatttcaaagcca

SEQ ID NO: 9406625 - DNA, 22 bp, Homo sapiens
tgtacagtacatgtgtagtgat

SEQ ID NO: 9406626 - DNA, 22 bp, Homo sapiens
tgtacagtaggaacttgttatt

SEQ ID NO: 9406627 - DNA, 22 bp, Homo sapiens
tgtacagtacatgtgtagtgat

SEQ ID NO: 9406628 - DNA, 22 bp, Homo sapiens
tgtacagggtgcagcgagcgga

SEQ ID NO: 9406629 - DNA, 22 bp, Homo sapiens
tgtacagatatcaggagtgagg

SEQ ID NO: 9406630 - DNA, 22 bp, Homo sapiens
tgtacagattgatcatggagag

SEQ ID NO: 9406631 - DNA, 22 bp, Homo sapiens
tgtacagataaagactgtaaat

SEQ ID NO: 9406632 - DNA, 22 bp, Homo sapiens
tgtacagtattggtgttagtag

SEQ ID NO: 9406633 - DNA, 22 bp, Homo sapiens
tgtacagtcatgctttctgttc

SEQ ID NO: 9406634 - DNA, 22 bp, Homo sapiens
tgtacctggagagctcttggcc

SEQ ID NO: 9406635 - DNA, 19 bp, Homo sapiens
tgtacctgggtcatggtgc

SEQ ID NO: 9406636 - DNA, 22 bp, Homo sapiens
tgtatttattcttctggtgttt

SEQ ID NO: 9406637 - DNA, 22 bp, Homo sapiens
tgtatttattcaggatgtaact

SEQ ID NO: 9406638 - DNA, 22 bp, Homo sapiens
tgtatttattcaggatgtaact

SEQ ID NO: 9406639 - DNA, 22 bp, Homo sapiens
tgtatttattcaggatgtaact

SEQ ID NO: 9406640 - DNA, 22 bp, Homo sapiens
tgtatttcaattttagcaccaa

SEQ ID NO: 9406641 - DNA, 22 bp, Homo sapiens
tgtatttattcttctggtgttt

SEQ ID NO: 9406642 - DNA, 22 bp, Homo sapiens
tgtatttattcttctggtgttt

SEQ ID NO: 9406643 - DNA, 17 bp, Homo sapiens
tgtatttatcatgtcag

SEQ ID NO: 9406644 - DNA, 17 bp, Homo sapiens
tgtatttatcatgtcag

SEQ ID NO: 9406645 - DNA, 22 bp, Homo sapiens
tgtatttattcaggatgtaact

SEQ ID NO: 9406646 - DNA, 22 bp, Homo sapiens
tgtatttattcaggatgtaact

SEQ ID NO: 9406647 - DNA, 17 bp, Homo sapiens
tgtatttatcatgtcag

SEQ ID NO: 9406648 - DNA, 22 bp, Homo sapiens
tgtatttattcaggatgtaact

SEQ ID NO: 9406649 - DNA, 22 bp, Homo sapiens
tgtatttctgctttctctagta

SEQ ID NO: 9406650 - DNA, 18 bp, Homo sapiens
tgtatttctaacagctaa

SEQ ID NO: 9406651 - DNA, 22 bp, Homo sapiens
tgtatttcgctaggtactccct

SEQ ID NO: 9406652 - DNA, 22 bp, Homo sapiens
tgtatttgaaacagtgcatggg

SEQ ID NO: 9406653 - DNA, 22 bp, Homo sapiens
tgtatttcctggtttagatcaa

SEQ ID NO: 9406654 - DNA, 22 bp, Homo sapiens
tgtattttgtgaggatcactct

SEQ ID NO: 9406655 - DNA, 22 bp, Homo sapiens
tgtattttctgaggagcattag

SEQ ID NO: 9406656 - DNA, 22 bp, Homo sapiens
tgtattttcttctggaagctta

SEQ ID NO: 9406657 - DNA, 22 bp, Homo sapiens
tgtattttctgaagataatcaa

SEQ ID NO: 9406658 - DNA, 22 bp, Homo sapiens
tgtattttctgaagataatcaa

SEQ ID NO: 9406659 - DNA, 23 bp, Homo sapiens
tgtattgaaggtgtagtttgtag

SEQ ID NO: 9406660 - DNA, 23 bp, Homo sapiens
tgtattgaaggtgtagtttgtag

SEQ ID NO: 9406661 - DNA, 22 bp, Homo sapiens
tgtattgaattgtgttatatct

SEQ ID NO: 9406662 - DNA, 22 bp, Homo sapiens
tgtattgaggattcatttttgt

SEQ ID NO: 9406663 - DNA, 22 bp, Homo sapiens
tgtattgttataatttgtatgt

SEQ ID NO: 9406664 - DNA, 22 bp, Homo sapiens
tgtattgttataatttgtatgt

SEQ ID NO: 9406665 - DNA, 22 bp, Homo sapiens
tgtattgtaagtggttatatgc

SEQ ID NO: 9406666 - DNA, 22 bp, Homo sapiens
tgtatttaagctttacctaaaa

SEQ ID NO: 9406667 - DNA, 22 bp, Homo sapiens
tgtatttaagctttacctaaaa

SEQ ID NO: 9406668 - DNA, 22 bp, Homo sapiens
tgtatttaagctttacctaaaa

SEQ ID NO: 9406669 - DNA, 20 bp, Homo sapiens
tgtatttaatgaaggctttt

SEQ ID NO: 9406670 - DNA, 20 bp, Homo sapiens
tgtatttaatgaaggctttt

SEQ ID NO: 9406671 - DNA, 22 bp, Homo sapiens
tgtatttaattgtatcatcaca

SEQ ID NO: 9406672 - DNA, 22 bp, Homo sapiens
tgtatttaattgtatcatcaca

SEQ ID NO: 9406673 - DNA, 22 bp, Homo sapiens
tgtatttagtccagtctctcat

SEQ ID NO: 9406674 - DNA, 22 bp, Homo sapiens
tgtatttagtccagtctctcat

SEQ ID NO: 9406675 - DNA, 22 bp, Homo sapiens
tgtatttagtccagtctctcat

SEQ ID NO: 9406676 - DNA, 22 bp, Homo sapiens
tgtatttatattagaatggttg

SEQ ID NO: 9406677 - DNA, 22 bp, Homo sapiens
tgtatttatattagaatggttg

SEQ ID NO: 9406678 - DNA, 22 bp, Homo sapiens
tgtatttaattgtatcatcaca

SEQ ID NO: 9406679 - DNA, 20 bp, Homo sapiens
tgtatttaatgaaggctttt

SEQ ID NO: 9406680 - DNA, 20 bp, Homo sapiens
tgtatttaatgaaggctttt

SEQ ID NO: 9406681 - DNA, 20 bp, Homo sapiens
tgtatttaatgaaggctttt

SEQ ID NO: 9406682 - DNA, 22 bp, Homo sapiens
tgtatgtatacacatagatacg

SEQ ID NO: 9406683 - DNA, 22 bp, Homo sapiens
tgtatgctttccaaaaatgctg

SEQ ID NO: 9406684 - DNA, 22 bp, Homo sapiens
tgtatgtaaagaaggatatttt

SEQ ID NO: 9406685 - DNA, 22 bp, Homo sapiens
tgtatgtaaagtttgtaataga

SEQ ID NO: 9406686 - DNA, 22 bp, Homo sapiens
tgtatgtaaagtttgtaataga

SEQ ID NO: 9406687 - DNA, 22 bp, Homo sapiens
tgtatgcttgagtgtgtatact

SEQ ID NO: 9406688 - DNA, 22 bp, Homo sapiens
tgtatgcataaaattatttaca

SEQ ID NO: 9406689 - DNA, 22 bp, Homo sapiens
tgtcacagtttgtactttatag

SEQ ID NO: 9406690 - DNA, 22 bp, Homo sapiens
tgtcacataggcaaaatgtttt

SEQ ID NO: 9406691 - DNA, 22 bp, Homo sapiens
tgtcacatcaggggtgttgaca

SEQ ID NO: 9406692 - DNA, 22 bp, Homo sapiens
tgtcacatcaggtggtggctgt

SEQ ID NO: 9406693 - DNA, 22 bp, Homo sapiens
tgtcacatgaagccaacatagc

SEQ ID NO: 9406694 - DNA, 21 bp, Homo sapiens
tgtcacatgtggatggtattt

SEQ ID NO: 9406695 - DNA, 22 bp, Homo sapiens
tgtcacatgtttaatgtggact

SEQ ID NO: 9406696 - DNA, 22 bp, Homo sapiens
tgtcacattgaatatgatttat

SEQ ID NO: 9406697 - DNA, 22 bp, Homo sapiens
tgtcacctctttggctgcagct

SEQ ID NO: 9406698 - DNA, 22 bp, Homo sapiens
tgtcacaaaaatcagtaattgc

SEQ ID NO: 9406699 - DNA, 22 bp, Homo sapiens
tgtcacacctcgtttagcattc

SEQ ID NO: 9406700 - DNA, 22 bp, Homo sapiens
tgtcaaaaataagagagattgt

SEQ ID NO: 9406701 - DNA, 22 bp, Homo sapiens
tgtcaaaaagctgggacaagca

SEQ ID NO: 9406702 - DNA, 22 bp, Homo sapiens
tgtatttttagacctttagacc

SEQ ID NO: 9406703 - DNA, 22 bp, Homo sapiens
tgtcaaaaccagcaattttgtt

SEQ ID NO: 9406704 - DNA, 22 bp, Homo sapiens
tgtcaaagcctgaatcacatag

SEQ ID NO: 9406705 - DNA, 22 bp, Homo sapiens
tgtcaaacaccaacatttctcc

SEQ ID NO: 9406706 - DNA, 22 bp, Homo sapiens
tgtatagagttggaagatgact

SEQ ID NO: 9406707 - DNA, 22 bp, Homo sapiens
tgtatacatttggtgcatattt

SEQ ID NO: 9406708 - DNA, 22 bp, Homo sapiens
tgtatacatttaactagataga

SEQ ID NO: 9406709 - DNA, 22 bp, Homo sapiens
tgtatacatttaactagataga

SEQ ID NO: 9406710 - DNA, 22 bp, Homo sapiens
tgtatataagcatttacttgtt

SEQ ID NO: 9406711 - DNA, 22 bp, Homo sapiens
tgtatatacacactcccatgtt

SEQ ID NO: 9406712 - DNA, 22 bp, Homo sapiens
tgtatatacatacacacatgaa

SEQ ID NO: 9406713 - DNA, 22 bp, Homo sapiens
tgtatagagttggaagatgact

SEQ ID NO: 9406714 - DNA, 22 bp, Homo sapiens
tgtatagatgaggaagctgtta

SEQ ID NO: 9406715 - DNA, 22 bp, Homo sapiens
tgtatagtttcttagttactga

SEQ ID NO: 9406716 - DNA, 22 bp, Homo sapiens
tgtatacaggcataagagatac

SEQ ID NO: 9406717 - DNA, 22 bp, Homo sapiens
tgtatacaggcataagagatac

SEQ ID NO: 9406718 - DNA, 22 bp, Homo sapiens
tgtatacaggattactcatagc

SEQ ID NO: 9406719 - DNA, 22 bp, Homo sapiens
tgtatacaggattactcatagc

SEQ ID NO: 9406720 - DNA, 22 bp, Homo sapiens
tgtatacatgtgttcatgcatg

SEQ ID NO: 9406721 - DNA, 22 bp, Homo sapiens
tgtatacatgtctgtgtgcaca

SEQ ID NO: 9406722 - DNA, 22 bp, Homo sapiens
tgtatacatgtgttcatgcatg

SEQ ID NO: 9406723 - DNA, 21 bp, Homo sapiens
tgtatacacacatatatgtac

SEQ ID NO: 9406724 - DNA, 21 bp, Homo sapiens
tgtatacacacatatatgtac

SEQ ID NO: 9406725 - DNA, 22 bp, Homo sapiens
tgtatacactatgctatatggt

SEQ ID NO: 9406726 - DNA, 22 bp, Homo sapiens
tgtatacactatgctatatggt

SEQ ID NO: 9406727 - DNA, 23 bp, Homo sapiens
tgtatacaccctgtgcatctggg

SEQ ID NO: 9406728 - DNA, 22 bp, Homo sapiens
tgtataactcttgttggagttt

SEQ ID NO: 9406729 - DNA, 22 bp, Homo sapiens
tgtataacacgcagttgagagg

SEQ ID NO: 9406730 - DNA, 21 bp, Homo sapiens
tgtataacaactatgcaatgt

SEQ ID NO: 9406731 - DNA, 22 bp, Homo sapiens
tgtataagcctagtgaaatttc

SEQ ID NO: 9406732 - DNA, 22 bp, Homo sapiens
tgtataacttgtggttatgaat

SEQ ID NO: 9406733 - DNA, 22 bp, Homo sapiens
tgtataagcctagtgaaatttc

SEQ ID NO: 9406734 - DNA, 22 bp, Homo sapiens
tgtatacaagtcgtgtaaactt

SEQ ID NO: 9406735 - DNA, 22 bp, Homo sapiens
tgtataaacttaagcaggaacc

SEQ ID NO: 9406736 - DNA, 22 bp, Homo sapiens
tgtataaatttaaattcctgct

SEQ ID NO: 9406737 - DNA, 22 bp, Homo sapiens
tgtataaatttaaattcctgct

SEQ ID NO: 9406738 - DNA, 22 bp, Homo sapiens
tgtataaacttaagcaggaacc

SEQ ID NO: 9406739 - DNA, 22 bp, Homo sapiens
tgtataaaccatggacagcttt

SEQ ID NO: 9406740 - DNA, 22 bp, Homo sapiens
tgtataaacttaagcaggaacc

SEQ ID NO: 9406741 - DNA, 22 bp, Homo sapiens
tgtatatatttctttcattcta

SEQ ID NO: 9406742 - DNA, 22 bp, Homo sapiens
tgtatatacatacacacatgaa

SEQ ID NO: 9406743 - DNA, 22 bp, Homo sapiens
tgtatatgcactttccttatcc

SEQ ID NO: 9406744 - DNA, 22 bp, Homo sapiens
tgtatatatttctttcattcta

SEQ ID NO: 9406745 - DNA, 22 bp, Homo sapiens
tgtatatgagtctgagtgtaca

SEQ ID NO: 9406746 - DNA, 22 bp, Homo sapiens
tgtatatgtgcacatgtgcttc

SEQ ID NO: 9406747 - DNA, 22 bp, Homo sapiens
tgtatatgtgtattttatgaca

SEQ ID NO: 9406748 - DNA, 22 bp, Homo sapiens
tgtatatgtgatgtacatgtac

SEQ ID NO: 9406749 - DNA, 22 bp, Homo sapiens
tgtatatgtgatgtacatgtac

SEQ ID NO: 9406750 - DNA, 22 bp, Homo sapiens
tgtatatgtgtattttatgaca

SEQ ID NO: 9406751 - DNA, 22 bp, Homo sapiens
tgtatatgtttgtatgtacaca

SEQ ID NO: 9406752 - DNA, 22 bp, Homo sapiens
tgtatcaaaccaaattaattct

SEQ ID NO: 9406753 - DNA, 22 bp, Homo sapiens
tgtatattgttctgtctcttca

SEQ ID NO: 9406754 - DNA, 22 bp, Homo sapiens
tgtatattgcctgagtctttcc

SEQ ID NO: 9406755 - DNA, 22 bp, Homo sapiens
tgtatgaaaaggaatagattga

SEQ ID NO: 9406756 - DNA, 22 bp, Homo sapiens
tgtatgaacctttaatatagtg

SEQ ID NO: 9406757 - DNA, 22 bp, Homo sapiens
tgtatctttctactgtctagtt

SEQ ID NO: 9406758 - DNA, 22 bp, Homo sapiens
tgtatctgtttagcacccagcc

SEQ ID NO: 9406759 - DNA, 22 bp, Homo sapiens
tgtatcaatcatgtaatttggt

SEQ ID NO: 9406760 - DNA, 22 bp, Homo sapiens
tgtatcaagggtttatgtaagc

SEQ ID NO: 9406761 - DNA, 23 bp, Homo sapiens
tgtatctgtactattcctgcctc

SEQ ID NO: 9406762 - DNA, 22 bp, Homo sapiens
tgtatgaatatgtattttcata

SEQ ID NO: 9406763 - DNA, 23 bp, Homo sapiens
tgtatgaatatgccacagtttaa

SEQ ID NO: 9406764 - DNA, 22 bp, Homo sapiens
tgtatgaacctttaatatagtg

SEQ ID NO: 9406765 - DNA, 22 bp, Homo sapiens
tgtatgaagccagaatctgttt

SEQ ID NO: 9406766 - DNA, 22 bp, Homo sapiens
tgtatgaggcatacatcaggca

SEQ ID NO: 9406767 - DNA, 22 bp, Homo sapiens
tgtatgaatctcatttgtttaa

SEQ ID NO: 9406768 - DNA, 22 bp, Homo sapiens
tgtatgaatctcatttgtttaa

SEQ ID NO: 9406769 - DNA, 22 bp, Homo sapiens
tgtatgaatgggaaaaggaaac

SEQ ID NO: 9406770 - DNA, 22 bp, Homo sapiens
tgtagaaattagtaagatcaac

SEQ ID NO: 9406771 - DNA, 22 bp, Homo sapiens
tgtagaaattagtaagatcaac

SEQ ID NO: 9406772 - DNA, 22 bp, Homo sapiens
tgtagaaattagtaagatcaac

SEQ ID NO: 9406773 - DNA, 22 bp, Homo sapiens
tgtagaaagctcttctgaaatc

SEQ ID NO: 9406774 - DNA, 22 bp, Homo sapiens
tgtagaacaagaaaatctcagt

SEQ ID NO: 9406775 - DNA, 22 bp, Homo sapiens
tgtagaagctagcctggagcca

SEQ ID NO: 9406776 - DNA, 22 bp, Homo sapiens
tgtagaagtaggagtcatctca

SEQ ID NO: 9406777 - DNA, 18 bp, Homo sapiens
tgtagagccaggtttgcc

SEQ ID NO: 9406778 - DNA, 22 bp, Homo sapiens
tgtagaagttcttcaggagaat

SEQ ID NO: 9406779 - DNA, 22 bp, Homo sapiens
tgtagaaaattggagcattcat

SEQ ID NO: 9406780 - DNA, 22 bp, Homo sapiens
tgtagaaactacacatgcaaca

SEQ ID NO: 9406781 - DNA, 18 bp, Homo sapiens
tgtagaaaagataggaat

SEQ ID NO: 9406782 - DNA, 18 bp, Homo sapiens
tgtagaaaagataggaat

SEQ ID NO: 9406783 - DNA, 22 bp, Homo sapiens
tgtacttattttatgtcagcac

SEQ ID NO: 9406784 - DNA, 22 bp, Homo sapiens
tgtacttgaacttgactgtaga

SEQ ID NO: 9406785 - DNA, 22 bp, Homo sapiens
tgtactaatgcatttaactaac

SEQ ID NO: 9406786 - DNA, 22 bp, Homo sapiens
tgtactaaggctgtgtagatgt

SEQ ID NO: 9406787 - DNA, 22 bp, Homo sapiens
tgtagcatgtaaattggttatt

SEQ ID NO: 9406788 - DNA, 22 bp, Homo sapiens
tgtagctctccagccagcaagg

SEQ ID NO: 9406789 - DNA, 18 bp, Homo sapiens
tgtagctggaggccaggc

SEQ ID NO: 9406790 - DNA, 22 bp, Homo sapiens
tgtagctctccagccagcaagg

SEQ ID NO: 9406791 - DNA, 22 bp, Homo sapiens
tgtataaaccatggacagcttt

SEQ ID NO: 9406792 - DNA, 22 bp, Homo sapiens
tgtaggaagatataaaatatct

SEQ ID NO: 9406793 - DNA, 22 bp, Homo sapiens
tgtaggaaaaacaatgatctgc

SEQ ID NO: 9406794 - DNA, 22 bp, Homo sapiens
tgtagatacacacatatagtgg

SEQ ID NO: 9406795 - DNA, 22 bp, Homo sapiens
tgtccagccggagtcggttaga

SEQ ID NO: 9406796 - DNA, 22 bp, Homo sapiens
tgtccagctcgagacactatct

SEQ ID NO: 9406797 - DNA, 22 bp, Homo sapiens
tgtccagctcgagacactatct

SEQ ID NO: 9406798 - DNA, 22 bp, Homo sapiens
tgtccagcggcctggctgctga

SEQ ID NO: 9406799 - DNA, 22 bp, Homo sapiens
tgtccaggcactgggactctag

SEQ ID NO: 9406800 - DNA, 22 bp, Homo sapiens
tgtccagcttttcccaccaagt

SEQ ID NO: 9406801 - DNA, 22 bp, Homo sapiens
tgtccaggaccctattctcact

SEQ ID NO: 9406802 - DNA, 22 bp, Homo sapiens
tgtcattttgtctcactgctat

SEQ ID NO: 9406803 - DNA, 22 bp, Homo sapiens
tgtcattttctggttagttaat

SEQ ID NO: 9406804 - DNA, 22 bp, Homo sapiens
tgtcattttcagcttatgcttc

SEQ ID NO: 9406805 - DNA, 22 bp, Homo sapiens
tgtcattttcagcttatgcttc

SEQ ID NO: 9406806 - DNA, 22 bp, Homo sapiens
tgtcattttctaatctgttgtc

SEQ ID NO: 9406807 - DNA, 22 bp, Homo sapiens
tgtcattttctaatctgttgtc

SEQ ID NO: 9406808 - DNA, 22 bp, Homo sapiens
tgtcattttctaatctgttgtc

SEQ ID NO: 9406809 - DNA, 22 bp, Homo sapiens
tgtcattttctaatctgttgtc

SEQ ID NO: 9406810 - DNA, 22 bp, Homo sapiens
tgtcattttcatcctaaggagc

SEQ ID NO: 9406811 - DNA, 22 bp, Homo sapiens
tgtcatttcacaatatcactca

SEQ ID NO: 9406812 - DNA, 22 bp, Homo sapiens
tgtcatttcctgaatgctgagt

SEQ ID NO: 9406813 - DNA, 22 bp, Homo sapiens
tgtcatttcacaatatcactca

SEQ ID NO: 9406814 - DNA, 22 bp, Homo sapiens
tgtcatttattttgctgtctgt

SEQ ID NO: 9406815 - DNA, 22 bp, Homo sapiens
tgtcattttagtgcatcactca

SEQ ID NO: 9406816 - DNA, 22 bp, Homo sapiens
tgtcatttcctgaatgctgagt

SEQ ID NO: 9406817 - DNA, 22 bp, Homo sapiens
tgtcatgagttatttcatagga

SEQ ID NO: 9406818 - DNA, 22 bp, Homo sapiens
tgtcattccttcaatgtagata

SEQ ID NO: 9406819 - DNA, 22 bp, Homo sapiens
tgtcatctgaatttctcatcac

SEQ ID NO: 9406820 - DNA, 22 bp, Homo sapiens
tgtcatctcttgcaggaagcct

SEQ ID NO: 9406821 - DNA, 22 bp, Homo sapiens
tgtcatctcactgatatagatg

SEQ ID NO: 9406822 - DNA, 22 bp, Homo sapiens
tgtcatatgtaatatgttcatt

SEQ ID NO: 9406823 - DNA, 22 bp, Homo sapiens
tgtcatatagaatgttctatga

SEQ ID NO: 9406824 - DNA, 20 bp, Homo sapiens
tgtcatttatttatcaaatg

SEQ ID NO: 9406825 - DNA, 22 bp, Homo sapiens
tgtcatttattctcttattcta

SEQ ID NO: 9406826 - DNA, 22 bp, Homo sapiens
tgtcatttattctcttattcta

SEQ ID NO: 9406827 - DNA, 22 bp, Homo sapiens
tgtcatttattttgctgtctgt

SEQ ID NO: 9406828 - DNA, 22 bp, Homo sapiens
tgtcatttattctcttattcta

SEQ ID NO: 9406829 - DNA, 22 bp, Homo sapiens
tgtcatttatgcttcttcagtg

SEQ ID NO: 9406830 - DNA, 22 bp, Homo sapiens
tgtcatttatcttatagtaatc

SEQ ID NO: 9406831 - DNA, 22 bp, Homo sapiens
tgtcatttattctcttattcta

SEQ ID NO: 9406832 - DNA, 20 bp, Homo sapiens
tgtcattcttctttcacagg

SEQ ID NO: 9406833 - DNA, 20 bp, Homo sapiens
tgtcattggcgtggttggct

SEQ ID NO: 9406834 - DNA, 22 bp, Homo sapiens
tgtcatttaaagctttccagat

SEQ ID NO: 9406835 - DNA, 22 bp, Homo sapiens
tgtcattgttctgtttgttcct

SEQ ID NO: 9406836 - DNA, 22 bp, Homo sapiens
tgtcatttagtcctctgtgtgt

SEQ ID NO: 9406837 - DNA, 22 bp, Homo sapiens
tgtcatttagtcctctgtgtgt

SEQ ID NO: 9406838 - DNA, 22 bp, Homo sapiens
tgtcatttaaagctttccagat

SEQ ID NO: 9406839 - DNA, 19 bp, Homo sapiens
tgtcaggggtgtgctgtgc

SEQ ID NO: 9406840 - DNA, 23 bp, Homo sapiens
tgtcaggtaaggaaggattcact

SEQ ID NO: 9406841 - DNA, 22 bp, Homo sapiens
tgtcaggtagagataatggggg

SEQ ID NO: 9406842 - DNA, 23 bp, Homo sapiens
tgtcaggtaaggaaggattcact

SEQ ID NO: 9406843 - DNA, 22 bp, Homo sapiens
tgtcagggatttaaagacacaa

SEQ ID NO: 9406844 - DNA, 22 bp, Homo sapiens
tgtcaggtctaaaatgggtctc

SEQ ID NO: 9406845 - DNA, 22 bp, Homo sapiens
tgtcaggtctaaaatgggtctc

SEQ ID NO: 9406846 - DNA, 22 bp, Homo sapiens
tgtcaggtctaaaatgggtctc

SEQ ID NO: 9406847 - DNA, 22 bp, Homo sapiens
tgtcaggtcagtatttgatgcc

SEQ ID NO: 9406848 - DNA, 22 bp, Homo sapiens
tgtcaggtcagtatttgatgcc

SEQ ID NO: 9406849 - DNA, 22 bp, Homo sapiens
tgtcaggtcattgccatggaaa

SEQ ID NO: 9406850 - DNA, 22 bp, Homo sapiens
tgtcaggtcattgccatggaaa

SEQ ID NO: 9406851 - DNA, 22 bp, Homo sapiens
tgtcaggtatgcaacagaatgc

SEQ ID NO: 9406852 - DNA, 22 bp, Homo sapiens
tgtcaggtatgcaacagaatgc

SEQ ID NO: 9406853 - DNA, 22 bp, Homo sapiens
tgtcaggtcagacttggttttt

SEQ ID NO: 9406854 - DNA, 22 bp, Homo sapiens
tgtcaggtcagacttggttttt

SEQ ID NO: 9406855 - DNA, 22 bp, Homo sapiens
tgtcaggtagtaggtagaaact

SEQ ID NO: 9406856 - DNA, 22 bp, Homo sapiens
tgtcaggtagtaggtagaaact

SEQ ID NO: 9406857 - DNA, 22 bp, Homo sapiens
tgtcaggtagagataatggggg

SEQ ID NO: 9406858 - DNA, 18 bp, Homo sapiens
tgtcagtaaagtgacaga

SEQ ID NO: 9406859 - DNA, 22 bp, Homo sapiens
tgtcaggtttctccaacttata

SEQ ID NO: 9406860 - DNA, 22 bp, Homo sapiens
tgtcaggtttcagttaatggtt

SEQ ID NO: 9406861 - DNA, 22 bp, Homo sapiens
tgtcaggttggttttcagagaa

SEQ ID NO: 9406862 - DNA, 22 bp, Homo sapiens
tgtcaggtttctccaacttata

SEQ ID NO: 9406863 - DNA, 22 bp, Homo sapiens
tgtcaggtttcagttaatggtt

SEQ ID NO: 9406864 - DNA, 22 bp, Homo sapiens
tgtcaggttggttttcagagaa

SEQ ID NO: 9406865 - DNA, 22 bp, Homo sapiens
tgtcaggttcagtgattttact

SEQ ID NO: 9406866 - DNA, 22 bp, Homo sapiens
tgtcaggttcagtgattttact

SEQ ID NO: 9406867 - DNA, 22 bp, Homo sapiens
tgtcaggttctttaattctgca

SEQ ID NO: 9406868 - DNA, 22 bp, Homo sapiens
tgtcaggttctttaattctgca

SEQ ID NO: 9406869 - DNA, 22 bp, Homo sapiens
tgtcaggtctctgtgatggtaa

SEQ ID NO: 9406870 - DNA, 22 bp, Homo sapiens
tgtcaggtctctgtgatggtaa

SEQ ID NO: 9406871 - DNA, 22 bp, Homo sapiens
tgtcaggtctacaaaaatgctg

SEQ ID NO: 9406872 - DNA, 22 bp, Homo sapiens
tgtcaggtctacaaaaatgctg

SEQ ID NO: 9406873 - DNA, 15 bp, Homo sapiens
tgtcaggtgaatggt

SEQ ID NO: 9406874 - DNA, 22 bp, Homo sapiens
tgtcaggtctctgtgatggtaa

SEQ ID NO: 9406875 - DNA, 22 bp, Homo sapiens
tgtcaggtgacacactaggagc

SEQ ID NO: 9406876 - DNA, 15 bp, Homo sapiens
tgtcaggtgaatggt

SEQ ID NO: 9406877 - DNA, 22 bp, Homo sapiens
tgtcaggtgacacactaggagc

SEQ ID NO: 9406878 - DNA, 22 bp, Homo sapiens
tgtcaggtgacacactaggagc

SEQ ID NO: 9406879 - DNA, 22 bp, Homo sapiens
tgtcaggtgacagtttttacca

SEQ ID NO: 9406880 - DNA, 22 bp, Homo sapiens
tgtcaggtgacagtttttacca

SEQ ID NO: 9406881 - DNA, 22 bp, Homo sapiens
tgtcaggtgcagcttggatgca

SEQ ID NO: 9406882 - DNA, 22 bp, Homo sapiens
tgtcaggtgcagcttggatgca

SEQ ID NO: 9406883 - DNA, 22 bp, Homo sapiens
tgtcaggttcaaatcttggtcc

SEQ ID NO: 9406884 - DNA, 22 bp, Homo sapiens
tgtcaggttcaaatcttggtcc

SEQ ID NO: 9406885 - DNA, 18 bp, Homo sapiens
tgtcactggataatggtc

SEQ ID NO: 9406886 - DNA, 22 bp, Homo sapiens
tgtcactgtgctctgttcattt

SEQ ID NO: 9406887 - DNA, 22 bp, Homo sapiens
tgtcactacatcataaatatat

SEQ ID NO: 9406888 - DNA, 22 bp, Homo sapiens
tgtcactcaagttccaatttac

SEQ ID NO: 9406889 - DNA, 22 bp, Homo sapiens
tgtcacttggagaagctgatcc

SEQ ID NO: 9406890 - DNA, 22 bp, Homo sapiens
tgtcacttggagaagctgatcc

SEQ ID NO: 9406891 - DNA, 22 bp, Homo sapiens
tgtcactttgccttctggactt

SEQ ID NO: 9406892 - DNA, 22 bp, Homo sapiens
tgtcactttttataggtgttga

SEQ ID NO: 9406893 - DNA, 22 bp, Homo sapiens
tgtcagtgctatagtgggaata

SEQ ID NO: 9406894 - DNA, 22 bp, Homo sapiens
tgtcagtggtaaggttgggagt

SEQ ID NO: 9406895 - DNA, 22 bp, Homo sapiens
tgtcagtggacctggagaggcc

SEQ ID NO: 9406896 - DNA, 22 bp, Homo sapiens
tgtcagtgtatacatacagtat

SEQ ID NO: 9406897 - DNA, 22 bp, Homo sapiens
tgtcagtgtaactcttatagca

SEQ ID NO: 9406898 - DNA, 22 bp, Homo sapiens
tgtcagtggtcatagtagaaaa

SEQ ID NO: 9406899 - DNA, 22 bp, Homo sapiens
tgtcagtgtctatgaagaattt

SEQ ID NO: 9406900 - DNA, 22 bp, Homo sapiens
tgtcagtgagttagttgcaagt

SEQ ID NO: 9406901 - DNA, 22 bp, Homo sapiens
tgtcagtgacctagcacggtgc

SEQ ID NO: 9406902 - DNA, 22 bp, Homo sapiens
tgtcagtgaactggaaggcctg

SEQ ID NO: 9406903 - DNA, 22 bp, Homo sapiens
tgtcagtgacagatttatgatc

SEQ ID NO: 9406904 - DNA, 22 bp, Homo sapiens
tgtcagtgaaaaattgtgatag

SEQ ID NO: 9406905 - DNA, 19 bp, Homo sapiens
tgtcagtagttgtctaggg

SEQ ID NO: 9406906 - DNA, 19 bp, Homo sapiens
tgtcagtagttgtctaggg

SEQ ID NO: 9406907 - DNA, 20 bp, Homo sapiens
tgtcagtgcctgaggcacag

SEQ ID NO: 9406908 - DNA, 22 bp, Homo sapiens
tgtcagtgcacagatggttgat

SEQ ID NO: 9406909 - DNA, 22 bp, Homo sapiens
tgtcagtgatttgtagggaatt

SEQ ID NO: 9406910 - DNA, 19 bp, Homo sapiens
tgtcagtgatacatgcttt

SEQ ID NO: 9406911 - DNA, 22 bp, Homo sapiens
tgtcataatcagttttgcatgt

SEQ ID NO: 9406912 - DNA, 22 bp, Homo sapiens
tgtcatagtgtggtagcagtgg

SEQ ID NO: 9406913 - DNA, 22 bp, Homo sapiens
tgtcagtgtgcaccgggaggcc

SEQ ID NO: 9406914 - DNA, 22 bp, Homo sapiens
tgtcagtgttttatgtgccctt

SEQ ID NO: 9406915 - DNA, 21 bp, Homo sapiens
tgtcctggtcactgctctccc

SEQ ID NO: 9406916 - DNA, 21 bp, Homo sapiens
tgtcctggtcactgctctccc

SEQ ID NO: 9406917 - DNA, 22 bp, Homo sapiens
tgtcctgggtggatgcttcatt

SEQ ID NO: 9406918 - DNA, 22 bp, Homo sapiens
tgtcctggtgctccaggtggct

SEQ ID NO: 9406919 - DNA, 22 bp, Homo sapiens
tgtcctgggtggatgcttcatt

SEQ ID NO: 9406920 - DNA, 22 bp, Homo sapiens
tgtcctgggtccctgctagaag

SEQ ID NO: 9406921 - DNA, 22 bp, Homo sapiens
tgtcctgggtccctgctagaag

SEQ ID NO: 9406922 - DNA, 22 bp, Homo sapiens
tgtcctgggtccctgctagaag

SEQ ID NO: 9406923 - DNA, 22 bp, Homo sapiens
tgtcctgggtccctgctagaag

SEQ ID NO: 9406924 - DNA, 22 bp, Homo sapiens
tgtcctggtgcttcttgggatt

SEQ ID NO: 9406925 - DNA, 22 bp, Homo sapiens
tgtcctggtgcttcttgggatt

SEQ ID NO: 9406926 - DNA, 22 bp, Homo sapiens
tgtcctggtgctccaggtggct

SEQ ID NO: 9406927 - DNA, 22 bp, Homo sapiens
tgtcctggtgctccaggtggct

SEQ ID NO: 9406928 - DNA, 22 bp, Homo sapiens
tgtcctggtgctccaggtggct

SEQ ID NO: 9406929 - DNA, 22 bp, Homo sapiens
tgtcctgttctggcgtgagtgg

SEQ ID NO: 9406930 - DNA, 22 bp, Homo sapiens
tgtcctgttatatgttgggtag

SEQ ID NO: 9406931 - DNA, 22 bp, Homo sapiens
tgtcctgtgtctaggggtcttc

SEQ ID NO: 9406932 - DNA, 22 bp, Homo sapiens
tgtcctgtgtctaggggtcttc

SEQ ID NO: 9406933 - DNA, 22 bp, Homo sapiens
tgtccttatattgtggaagggg

SEQ ID NO: 9406934 - DNA, 22 bp, Homo sapiens
tgtcctgggaactcacagtcca

SEQ ID NO: 9406935 - DNA, 22 bp, Homo sapiens
tgtcctgggaactcacagtcca

SEQ ID NO: 9406936 - DNA, 22 bp, Homo sapiens
tgtcctgggaatgggatgcagt

SEQ ID NO: 9406937 - DNA, 22 bp, Homo sapiens
tgtcctgggaatgggatgcagt

SEQ ID NO: 9406938 - DNA, 22 bp, Homo sapiens
tgtcctgggaggcggggtccag

SEQ ID NO: 9406939 - DNA, 22 bp, Homo sapiens
tgtcctgggaatgggatgcagt

SEQ ID NO: 9406940 - DNA, 22 bp, Homo sapiens
tgtcctgggaatgggatgcagt

SEQ ID NO: 9406941 - DNA, 22 bp, Homo sapiens
tgtcctgggaggcggggtccag

SEQ ID NO: 9406942 - DNA, 22 bp, Homo sapiens
tgtcctgggccggcgactggtc

SEQ ID NO: 9406943 - DNA, 22 bp, Homo sapiens
tgtcctgggccggcgactggtc

SEQ ID NO: 9406944 - DNA, 22 bp, Homo sapiens
tgtcctggggacaagaggccct

SEQ ID NO: 9406945 - DNA, 22 bp, Homo sapiens
tgtcctggggacaagaggccct

SEQ ID NO: 9406946 - DNA, 22 bp, Homo sapiens
tgtcctggggacaagaggccct

SEQ ID NO: 9406947 - DNA, 22 bp, Homo sapiens
tgtcctggggcgacttggggcc

SEQ ID NO: 9406948 - DNA, 22 bp, Homo sapiens
tgtcctggggacaagaggccct

SEQ ID NO: 9406949 - DNA, 22 bp, Homo sapiens
tgtcctggggacaagaggccct

SEQ ID NO: 9406950 - DNA, 22 bp, Homo sapiens
tgtcctgggtcaaatcctggtc

SEQ ID NO: 9406951 - DNA, 22 bp, Homo sapiens
tgtcctggggcgacttggggcc

SEQ ID NO: 9406952 - DNA, 22 bp, Homo sapiens
tgtcctgggtcaaatcctggtc

SEQ ID NO: 9406953 - DNA, 22 bp, Homo sapiens
tgtcctgggtcaaatcctggtc

SEQ ID NO: 9406954 - DNA, 22 bp, Homo sapiens
tgtcctgggtcaaccaggtcga

SEQ ID NO: 9406955 - DNA, 22 bp, Homo sapiens
tgtcctgggtcaaccaggtcga

SEQ ID NO: 9406956 - DNA, 19 bp, Homo sapiens
tgtcctcacagagcataac

SEQ ID NO: 9406957 - DNA, 22 bp, Homo sapiens
tgtcctcacaggaatgaacttt

SEQ ID NO: 9406958 - DNA, 19 bp, Homo sapiens
tgtcctcacagagcataac

SEQ ID NO: 9406959 - DNA, 22 bp, Homo sapiens
tgtcctcacaggaatgaacttt

SEQ ID NO: 9406960 - DNA, 22 bp, Homo sapiens
tgtcctcaaggagcttcagtct

SEQ ID NO: 9406961 - DNA, 22 bp, Homo sapiens
tgtcctcacacgtagggagtaa

SEQ ID NO: 9406962 - DNA, 22 bp, Homo sapiens
tgtcctggccaaggccttgctt

SEQ ID NO: 9406963 - DNA, 22 bp, Homo sapiens
tgtcctggccaaggccttgctt

SEQ ID NO: 9406964 - DNA, 22 bp, Homo sapiens
tgtcctggccaaggccttgctt

SEQ ID NO: 9406965 - DNA, 22 bp, Homo sapiens
tgtcctggcctccagaaagtcg

SEQ ID NO: 9406966 - DNA, 22 bp, Homo sapiens
tgtcctggcctccagaaagtcg

SEQ ID NO: 9406967 - DNA, 22 bp, Homo sapiens
tgtcctggcctccagaaagtcg

SEQ ID NO: 9406968 - DNA, 22 bp, Homo sapiens
tgtcctgggaaatcccttaggc

SEQ ID NO: 9406969 - DNA, 22 bp, Homo sapiens
tgtcctgggaaatcccttaggc

SEQ ID NO: 9406970 - DNA, 22 bp, Homo sapiens
tgtcctcaggacctggcacagt

SEQ ID NO: 9406971 - DNA, 22 bp, Homo sapiens
tgtcctcacatggtggggagag

SEQ ID NO: 9406972 - DNA, 22 bp, Homo sapiens
tgtcctcagatatgtctactct

SEQ ID NO: 9406973 - DNA, 22 bp, Homo sapiens
tgtcctcagatatgtctactct

SEQ ID NO: 9406974 - DNA, 22 bp, Homo sapiens
tgtccaggcactgggactctag

SEQ ID NO: 9406975 - DNA, 22 bp, Homo sapiens
tgtccaggctcccttggtgctg

SEQ ID NO: 9406976 - DNA, 22 bp, Homo sapiens
tgtccagggatggggtcaggga

SEQ ID NO: 9406977 - DNA, 22 bp, Homo sapiens
tgtccaggtcagcagcagggac

SEQ ID NO: 9406978 - DNA, 22 bp, Homo sapiens
tgtccaggtgtgtctaaagaga

SEQ ID NO: 9406979 - DNA, 22 bp, Homo sapiens
tgtcccagggaaggcccagcac

SEQ ID NO: 9406980 - DNA, 22 bp, Homo sapiens
tgtcccagggaaggcccagcac

SEQ ID NO: 9406981 - DNA, 22 bp, Homo sapiens
tgtcccagtttatctgggactg

SEQ ID NO: 9406982 - DNA, 22 bp, Homo sapiens
tgtcccagtttatctgggactg

SEQ ID NO: 9406983 - DNA, 22 bp, Homo sapiens
tgtcccagtcaaggctgtcatc

SEQ ID NO: 9406984 - DNA, 20 bp, Homo sapiens
tgtcctaatagacaagcaga

SEQ ID NO: 9406985 - DNA, 22 bp, Homo sapiens
tgtccctggagcttctgtcccc

SEQ ID NO: 9406986 - DNA, 19 bp, Homo sapiens
tgtccctggtcaccagact

SEQ ID NO: 9406987 - DNA, 22 bp, Homo sapiens
tgtccctggaactatggctcca

SEQ ID NO: 9406988 - DNA, 22 bp, Homo sapiens
tgtccctggaactatggctcca

SEQ ID NO: 9406989 - DNA, 22 bp, Homo sapiens
tgtccctggactccaggagcca

SEQ ID NO: 9406990 - DNA, 22 bp, Homo sapiens
tgtccctggagcttctgtcccc

SEQ ID NO: 9406991 - DNA, 22 bp, Homo sapiens
tgtccctgctgtacttagagca

SEQ ID NO: 9406992 - DNA, 18 bp, Homo sapiens
tgtccctgcaaataacat

SEQ ID NO: 9406993 - DNA, 22 bp, Homo sapiens
tgtccctctgaggcttccctgg

SEQ ID NO: 9406994 - DNA, 22 bp, Homo sapiens
tgtccctctgaggcttccctgg

SEQ ID NO: 9406995 - DNA, 22 bp, Homo sapiens
tgtccctgatccactggacccc

SEQ ID NO: 9406996 - DNA, 22 bp, Homo sapiens
tgtccctgatccactggacccc

SEQ ID NO: 9406997 - DNA, 20 bp, Homo sapiens
tgtcccctagatcccagctc

SEQ ID NO: 9406998 - DNA, 22 bp, Homo sapiens
tgtcccctgcccagggatggga

SEQ ID NO: 9406999 - DNA, 22 bp, Homo sapiens
tgtcccctttctttccttcgta

SEQ ID NO: 9407000 - DNA, 22 bp, Homo sapiens
tgtcccctttacctccgcagcc

SEQ ID NO: 9407001 - DNA, 22 bp, Homo sapiens
tgtcccctgcccagggatggga

SEQ ID NO: 9407002 - DNA, 22 bp, Homo sapiens
tgtccctcattgacgctgtgcc

SEQ ID NO: 9407003 - DNA, 22 bp, Homo sapiens
tgtccccaaggttcagcccaca

SEQ ID NO: 9407004 - DNA, 22 bp, Homo sapiens
tgtcccatggacacaacttctt

SEQ ID NO: 9407005 - DNA, 22 bp, Homo sapiens
tgtcccatggcttttctggtgg

SEQ ID NO: 9407006 - DNA, 22 bp, Homo sapiens
tgtccccacctaaatcttatct

SEQ ID NO: 9407007 - DNA, 22 bp, Homo sapiens
tgtccccagcactcactctcca

SEQ ID NO: 9407008 - DNA, 23 bp, Homo sapiens
tggccagggtactacacccaccc

SEQ ID NO: 9407009 - DNA, 22 bp, Homo sapiens
tggccaggggagttcccctcca

SEQ ID NO: 9407010 - DNA, 22 bp, Homo sapiens
tggccaggggagttcccctcca

SEQ ID NO: 9407011 - DNA, 22 bp, Homo sapiens
tggccaggggagttcccctcca

SEQ ID NO: 9407012 - DNA, 23 bp, Homo sapiens
tggccagggtactacacccaccc

SEQ ID NO: 9407013 - DNA, 19 bp, Homo sapiens
tggccaggtactgtctgct

SEQ ID NO: 9407014 - DNA, 19 bp, Homo sapiens
tggccaggtactgtctgct

SEQ ID NO: 9407015 - DNA, 22 bp, Homo sapiens
tggccaggcctcttggtgccca

SEQ ID NO: 9407016 - DNA, 22 bp, Homo sapiens
tggccaggcctcttggtgccca

SEQ ID NO: 9407017 - DNA, 22 bp, Homo sapiens
tggccaggctggtctggaacgc

SEQ ID NO: 9407018 - DNA, 22 bp, Homo sapiens
tggccaggctggtctggaacgc

SEQ ID NO: 9407019 - DNA, 22 bp, Homo sapiens
tggccaggctggtctggaacgc

SEQ ID NO: 9407020 - DNA, 22 bp, Homo sapiens
tggccaggggagttcccctcca

SEQ ID NO: 9407021 - DNA, 22 bp, Homo sapiens
tggccaggctggtctggaacgc

SEQ ID NO: 9407022 - DNA, 22 bp, Homo sapiens
tggccaggctggtctggaacgc

SEQ ID NO: 9407023 - DNA, 23 bp, Homo sapiens
tggccaggtagaggaggtagtga

SEQ ID NO: 9407024 - DNA, 23 bp, Homo sapiens
tggccaggtagaggaggtagtga

SEQ ID NO: 9407025 - DNA, 23 bp, Homo sapiens
tggccaggtagaggaggtagtga

SEQ ID NO: 9407026 - DNA, 23 bp, Homo sapiens
tggccaggtagaggaggtagtga

SEQ ID NO: 9407027 - DNA, 23 bp, Homo sapiens
tggccaggtagaggaggtagtga

SEQ ID NO: 9407028 - DNA, 19 bp, Homo sapiens
tggccaggtactgtctgct

SEQ ID NO: 9407029 - DNA, 22 bp, Homo sapiens
tggccagtagataggcaggcaa

SEQ ID NO: 9407030 - DNA, 22 bp, Homo sapiens
tggccagtagataggcaggcaa

SEQ ID NO: 9407031 - DNA, 22 bp, Homo sapiens
tggccagtagagctcagatagt

SEQ ID NO: 9407032 - DNA, 22 bp, Homo sapiens
tggccagtaatagcttctggtg

SEQ ID NO: 9407033 - DNA, 22 bp, Homo sapiens
tggccaggttgggctttgcagc

SEQ ID NO: 9407034 - DNA, 22 bp, Homo sapiens
tggccagagttgagggggtttc

SEQ ID NO: 9407035 - DNA, 22 bp, Homo sapiens
tggccagccagaaagaagcctt

SEQ ID NO: 9407036 - DNA, 22 bp, Homo sapiens
tggccagccagaaagaagcctt

SEQ ID NO: 9407037 - DNA, 22 bp, Homo sapiens
tggccagcagagttcactctct

SEQ ID NO: 9407038 - DNA, 22 bp, Homo sapiens
tggccagcccttcagccatgcc

SEQ ID NO: 9407039 - DNA, 22 bp, Homo sapiens
tggccagcccttcagccatgcc

SEQ ID NO: 9407040 - DNA, 22 bp, Homo sapiens
tggccagcccttcagccatgcc

SEQ ID NO: 9407041 - DNA, 22 bp, Homo sapiens
tggccagcccttcagccatgcc

SEQ ID NO: 9407042 - DNA, 22 bp, Homo sapiens
tggccagccagaaagaagcctt

SEQ ID NO: 9407043 - DNA, 22 bp, Homo sapiens
tggccagccctcttcccacact

SEQ ID NO: 9407044 - DNA, 22 bp, Homo sapiens
tggccagcccttcagccatgcc

SEQ ID NO: 9407045 - DNA, 22 bp, Homo sapiens
tggccagcctggtgcttgctcc

SEQ ID NO: 9407046 - DNA, 22 bp, Homo sapiens
tggccagcctggtgcttgctcc

SEQ ID NO: 9407047 - DNA, 22 bp, Homo sapiens
tggccagccttgtcatcgcttt

SEQ ID NO: 9407048 - DNA, 22 bp, Homo sapiens
tggccaggcattcagataagac

SEQ ID NO: 9407049 - DNA, 22 bp, Homo sapiens
tggccaggcattcagataagac

SEQ ID NO: 9407050 - DNA, 22 bp, Homo sapiens
tggccaggccggggacagaact

SEQ ID NO: 9407051 - DNA, 22 bp, Homo sapiens
tggccaggccggggacagaact

SEQ ID NO: 9407052 - DNA, 22 bp, Homo sapiens
tggccaggccggggacagaact

SEQ ID NO: 9407053 - DNA, 22 bp, Homo sapiens
tggccaggccggggacagaact

SEQ ID NO: 9407054 - DNA, 17 bp, Homo sapiens
tggccaggccccgccag

SEQ ID NO: 9407055 - DNA, 22 bp, Homo sapiens
tggcatgtaacatctccagatt

SEQ ID NO: 9407056 - DNA, 22 bp, Homo sapiens
tggcatgtattagttggcagtt

SEQ ID NO: 9407057 - DNA, 22 bp, Homo sapiens
tggcatgttctcttagcagctc

SEQ ID NO: 9407058 - DNA, 22 bp, Homo sapiens
tggcatgtccacttcaacagtt

SEQ ID NO: 9407059 - DNA, 22 bp, Homo sapiens
tggcatgtggcagctggttcag

SEQ ID NO: 9407060 - DNA, 22 bp, Homo sapiens
tggcatgtctgagggaggtttg

SEQ ID NO: 9407061 - DNA, 22 bp, Homo sapiens
tggcattggttgccaggctgtg

SEQ ID NO: 9407062 - DNA, 22 bp, Homo sapiens
tggcattatgtagcagggagca

SEQ ID NO: 9407063 - DNA, 22 bp, Homo sapiens
tggcattagtgctcctactcag

SEQ ID NO: 9407064 - DNA, 22 bp, Homo sapiens
tggcatgttttgctcttgaaaa

SEQ ID NO: 9407065 - DNA, 22 bp, Homo sapiens
tggccacactgcccccactggg

SEQ ID NO: 9407066 - DNA, 23 bp, Homo sapiens
tggcatttctatactggcaagtg

SEQ ID NO: 9407067 - DNA, 22 bp, Homo sapiens
tggccacagcctctgccagttc

SEQ ID NO: 9407068 - DNA, 23 bp, Homo sapiens
tggccacagtccatgcatgccca

SEQ ID NO: 9407069 - DNA, 23 bp, Homo sapiens
tggccacagtccatgcatgccca

SEQ ID NO: 9407070 - DNA, 22 bp, Homo sapiens
tggcatttatatcccagtttat

SEQ ID NO: 9407071 - DNA, 22 bp, Homo sapiens
tggcatttagaaaacaacatgt

SEQ ID NO: 9407072 - DNA, 22 bp, Homo sapiens
tggcatttcagtattttcataa

SEQ ID NO: 9407073 - DNA, 22 bp, Homo sapiens
tggccagacagagaggctttgt

SEQ ID NO: 9407074 - DNA, 17 bp, Homo sapiens
tggccagagcaggcccc

SEQ ID NO: 9407075 - DNA, 22 bp, Homo sapiens
tggccagaactcagacatgtgg

SEQ ID NO: 9407076 - DNA, 22 bp, Homo sapiens
tggccagaacctgcagtaggcc

SEQ ID NO: 9407077 - DNA, 22 bp, Homo sapiens
tggccacttggcatgtgtgcca

SEQ ID NO: 9407078 - DNA, 22 bp, Homo sapiens
tggccagaacctgcagtaggcc

SEQ ID NO: 9407079 - DNA, 22 bp, Homo sapiens
tggccactcctccctgcaggct

SEQ ID NO: 9407080 - DNA, 22 bp, Homo sapiens
tggccactcctccctgcaggct

SEQ ID NO: 9407081 - DNA, 22 bp, Homo sapiens
tggccactcctccctgcaggct

SEQ ID NO: 9407082 - DNA, 20 bp, Homo sapiens
tggccactggccactggagc

SEQ ID NO: 9407083 - DNA, 22 bp, Homo sapiens
tggccactcagggatgcaggaa

SEQ ID NO: 9407084 - DNA, 19 bp, Homo sapiens
tggccacctctgctgttct

SEQ ID NO: 9407085 - DNA, 23 bp, Homo sapiens
tggccacagtccatgcatgccca

SEQ ID NO: 9407086 - DNA, 23 bp, Homo sapiens
tggccacagtccatgcatgccca

SEQ ID NO: 9407087 - DNA, 22 bp, Homo sapiens
tggccacagtgtccagcagcag

SEQ ID NO: 9407088 - DNA, 22 bp, Homo sapiens
tggccacatctgaaatgagtgt

SEQ ID NO: 9407089 - DNA, 22 bp, Homo sapiens
tggccacatgcgtctgtgaggc

SEQ ID NO: 9407090 - DNA, 22 bp, Homo sapiens
tggccacatgcgtctgtgaggc

SEQ ID NO: 9407091 - DNA, 22 bp, Homo sapiens
tggccacatatgtgggacagct

SEQ ID NO: 9407092 - DNA, 22 bp, Homo sapiens
tggccacatatgtgggacagct

SEQ ID NO: 9407093 - DNA, 22 bp, Homo sapiens
tggccacccctttctctgcact

SEQ ID NO: 9407094 - DNA, 22 bp, Homo sapiens
tggccaccaccaatacttgcct

SEQ ID NO: 9407095 - DNA, 22 bp, Homo sapiens
tggcatcattttcagctggcca

SEQ ID NO: 9407096 - DNA, 22 bp, Homo sapiens
tggcatccagataccctgaggg

SEQ ID NO: 9407097 - DNA, 22 bp, Homo sapiens
tggcatccaggtcctcacatgg

SEQ ID NO: 9407098 - DNA, 22 bp, Homo sapiens
tggcatccagccatgtgatttt

SEQ ID NO: 9407099 - DNA, 18 bp, Homo sapiens
tggcatcccttctcttac

SEQ ID NO: 9407100 - DNA, 22 bp, Homo sapiens
tggcatcccttcccacccttta

SEQ ID NO: 9407101 - DNA, 21 bp, Homo sapiens
tggcatcctcttctcctttcc

SEQ ID NO: 9407102 - DNA, 22 bp, Homo sapiens
tggcagttcaggttggactctt

SEQ ID NO: 9407103 - DNA, 19 bp, Homo sapiens
tggcagtgtggggtatgaa

SEQ ID NO: 9407104 - DNA, 22 bp, Homo sapiens
tggcagtggctcagagtgcaga

SEQ ID NO: 9407105 - DNA, 22 bp, Homo sapiens
tggcagtggctcagagtgcaga

SEQ ID NO: 9407106 - DNA, 22 bp, Homo sapiens
tggcagtgtttctaaggggctc

SEQ ID NO: 9407107 - DNA, 22 bp, Homo sapiens
tggcagtggcgggactcagggc

SEQ ID NO: 9407108 - DNA, 22 bp, Homo sapiens
tggcagtggcgggactcagggc

SEQ ID NO: 9407109 - DNA, 22 bp, Homo sapiens
tggcagtggataggggagcggt

SEQ ID NO: 9407110 - DNA, 22 bp, Homo sapiens
tggcagtggataggggagcggt

SEQ ID NO: 9407111 - DNA, 22 bp, Homo sapiens
tggcagtggataggggagcggt

SEQ ID NO: 9407112 - DNA, 22 bp, Homo sapiens
tggcatgagtataggcttctca

SEQ ID NO: 9407113 - DNA, 22 bp, Homo sapiens
tggcatgataggaggtgcagaa

SEQ ID NO: 9407114 - DNA, 22 bp, Homo sapiens
tggcatgcacagccctgttcgg

SEQ ID NO: 9407115 - DNA, 21 bp, Homo sapiens
tggcatgcagtgttcctgtgc

SEQ ID NO: 9407116 - DNA, 22 bp, Homo sapiens
tggcatgccttgtcagacagtg

SEQ ID NO: 9407117 - DNA, 22 bp, Homo sapiens
tggcatgcattgtgggtaatta

SEQ ID NO: 9407118 - DNA, 17 bp, Homo sapiens
tggcatcttttgctcat

SEQ ID NO: 9407119 - DNA, 22 bp, Homo sapiens
tggcatctttgtcccagaagct

SEQ ID NO: 9407120 - DNA, 22 bp, Homo sapiens
tggcatgaatttagctttccat

SEQ ID NO: 9407121 - DNA, 22 bp, Homo sapiens
tggcatctgtgttgcggttgtc

SEQ ID NO: 9407122 - DNA, 23 bp, Homo sapiens
tggcatcttggcatcttgctgct

SEQ ID NO: 9407123 - DNA, 23 bp, Homo sapiens
tggcatcttggcatcttgctgct

SEQ ID NO: 9407124 - DNA, 22 bp, Homo sapiens
tggcatggactagtgctgaggt

SEQ ID NO: 9407125 - DNA, 21 bp, Homo sapiens
tggcatggaggtagcagtgtg

SEQ ID NO: 9407126 - DNA, 22 bp, Homo sapiens
tggcatggccagtgctgggagt

SEQ ID NO: 9407127 - DNA, 22 bp, Homo sapiens
tggcatggcaaccctgcaggga

SEQ ID NO: 9407128 - DNA, 22 bp, Homo sapiens
tggcatggcaaccctgcaggga

SEQ ID NO: 9407129 - DNA, 22 bp, Homo sapiens
tggcatgggtggagagagcaca

SEQ ID NO: 9407130 - DNA, 22 bp, Homo sapiens
tggcatgggccagggagagctg

SEQ ID NO: 9407131 - DNA, 16 bp, Homo sapiens
tggcaggtttttatct

SEQ ID NO: 9407132 - DNA, 22 bp, Homo sapiens
tggcaggtttcgttaaaaatgg

SEQ ID NO: 9407133 - DNA, 16 bp, Homo sapiens
tggcaggtttttatct

SEQ ID NO: 9407134 - DNA, 22 bp, Homo sapiens
tggcaggttggcctttggttca

SEQ ID NO: 9407135 - DNA, 22 bp, Homo sapiens
tggcaggtttcctcctcatagt

SEQ ID NO: 9407136 - DNA, 22 bp, Homo sapiens
tggcaggtttcctcctcatagt

SEQ ID NO: 9407137 - DNA, 22 bp, Homo sapiens
tggcaggtttcgttaaaaatgg

SEQ ID NO: 9407138 - DNA, 22 bp, Homo sapiens
tggcaggttggcctttggttca

SEQ ID NO: 9407139 - DNA, 21 bp, Homo sapiens
tggcaggttcaaaggcctatc

SEQ ID NO: 9407140 - DNA, 21 bp, Homo sapiens
tggcaggttcaaaggcctatc

SEQ ID NO: 9407141 - DNA, 22 bp, Homo sapiens
tggcagtctgggttggcagtta

SEQ ID NO: 9407142 - DNA, 22 bp, Homo sapiens
tggcagtccagaccctggactc

SEQ ID NO: 9407143 - DNA, 22 bp, Homo sapiens
tggcagtcattatcgctgagtc

SEQ ID NO: 9407144 - DNA, 22 bp, Homo sapiens
tggcagtcccctgtgcctggaa

SEQ ID NO: 9407145 - DNA, 22 bp, Homo sapiens
tggcagtcctcttcctcgggcg

SEQ ID NO: 9407146 - DNA, 22 bp, Homo sapiens
tggcagtgatgcggcaggacat

SEQ ID NO: 9407147 - DNA, 22 bp, Homo sapiens
tggcagtgatgcggcaggacat

SEQ ID NO: 9407148 - DNA, 22 bp, Homo sapiens
tggcagtgatgcggcaggacat

SEQ ID NO: 9407149 - DNA, 22 bp, Homo sapiens
tggcagtgatgcggcaggacat

SEQ ID NO: 9407150 - DNA, 22 bp, Homo sapiens
tggcagtgatgcggcaggacat

SEQ ID NO: 9407151 - DNA, 22 bp, Homo sapiens
tggcagtgatgcggcaggacat

SEQ ID NO: 9407152 - DNA, 22 bp, Homo sapiens
tggcagtgccccttgaccagtg

SEQ ID NO: 9407153 - DNA, 23 bp, Homo sapiens
tggcagtgcccagggagatgatc

SEQ ID NO: 9407154 - DNA, 23 bp, Homo sapiens
tggcagtgcccagggagatgatc

SEQ ID NO: 9407155 - DNA, 18 bp, Homo sapiens
tggcagtgaggtaggcat

SEQ ID NO: 9407156 - DNA, 18 bp, Homo sapiens
tggcagtgaggtaggcat

SEQ ID NO: 9407157 - DNA, 18 bp, Homo sapiens
tggcagtgaggtaggcat

SEQ ID NO: 9407158 - DNA, 18 bp, Homo sapiens
tggcagtgaggtaggcat

SEQ ID NO: 9407159 - DNA, 22 bp, Homo sapiens
tggcagtgaaccaaggctccaa

SEQ ID NO: 9407160 - DNA, 22 bp, Homo sapiens
tggcagggtgccagttgcgagt

SEQ ID NO: 9407161 - DNA, 22 bp, Homo sapiens
tggcagggtcttgctgtgttgc

SEQ ID NO: 9407162 - DNA, 22 bp, Homo sapiens
tggcagggtcttgctgtgttgc

SEQ ID NO: 9407163 - DNA, 22 bp, Homo sapiens
tggcagggtcttgctgtgttgc

SEQ ID NO: 9407164 - DNA, 22 bp, Homo sapiens
tggcagggtgccagttgcgagt

SEQ ID NO: 9407165 - DNA, 22 bp, Homo sapiens
tggcagggtgccagttgcgagt

SEQ ID NO: 9407166 - DNA, 22 bp, Homo sapiens
tggcaggtcatgagtggccacc

SEQ ID NO: 9407167 - DNA, 22 bp, Homo sapiens
tggcaggtcatgagtggccacc

SEQ ID NO: 9407168 - DNA, 22 bp, Homo sapiens
tggcagggtggcaacttttggt

SEQ ID NO: 9407169 - DNA, 22 bp, Homo sapiens
tggcaggtggcacagcctggga

SEQ ID NO: 9407170 - DNA, 22 bp, Homo sapiens
tggcaggtggcacagcctggga

SEQ ID NO: 9407171 - DNA, 22 bp, Homo sapiens
tggcaggtggagacagcagagc

SEQ ID NO: 9407172 - DNA, 20 bp, Homo sapiens
tggcaggtggcctcagttcc

SEQ ID NO: 9407173 - DNA, 20 bp, Homo sapiens
tggcaggtggcctcagttcc

SEQ ID NO: 9407174 - DNA, 22 bp, Homo sapiens
tggcaggtggagacagcagagc

SEQ ID NO: 9407175 - DNA, 22 bp, Homo sapiens
tggcaggtggcacagcctggga

SEQ ID NO: 9407176 - DNA, 22 bp, Homo sapiens
tggcaggttatgcgggccacat

SEQ ID NO: 9407177 - DNA, 22 bp, Homo sapiens
tggcaggttatgcgggccacat

SEQ ID NO: 9407178 - DNA, 22 bp, Homo sapiens
tggcaggttaacttacaactgt

SEQ ID NO: 9407179 - DNA, 22 bp, Homo sapiens
tggcaggttaacttacaactgt

SEQ ID NO: 9407180 - DNA, 23 bp, Homo sapiens
tggcaggtggttagatgttttgt

SEQ ID NO: 9407181 - DNA, 23 bp, Homo sapiens
tggcaggtggttagatgttttgt

SEQ ID NO: 9407182 - DNA, 22 bp, Homo sapiens
tggcaggtggctctggcattct

SEQ ID NO: 9407183 - DNA, 22 bp, Homo sapiens
tggcaggtggctctggcattct

SEQ ID NO: 9407184 - DNA, 18 bp, Homo sapiens
tggcaggtccagctgtgg

SEQ ID NO: 9407185 - DNA, 22 bp, Homo sapiens
tggcaggtccactcacagatct

SEQ ID NO: 9407186 - DNA, 22 bp, Homo sapiens
tggcaggtccactcacagatct

SEQ ID NO: 9407187 - DNA, 18 bp, Homo sapiens
tggcaggtccagctgtgg

SEQ ID NO: 9407188 - DNA, 22 bp, Homo sapiens
tggcaggtgaagttgttaggga

SEQ ID NO: 9407189 - DNA, 22 bp, Homo sapiens
tggcaggtgaagttgttaggga

SEQ ID NO: 9407190 - DNA, 22 bp, Homo sapiens
tggcaggtgcacttttggtttc

SEQ ID NO: 9407191 - DNA, 22 bp, Homo sapiens
tggcaggtgccatgggctcaga

SEQ ID NO: 9407192 - DNA, 22 bp, Homo sapiens
tggcaggtgcctgtaatctcag

SEQ ID NO: 9407193 - DNA, 22 bp, Homo sapiens
tggcaggtgcctgtaatctcag

SEQ ID NO: 9407194 - DNA, 22 bp, Homo sapiens
tggcaggtgaagttgttaggga

SEQ ID NO: 9407195 - DNA, 22 bp, Homo sapiens
tggcaggtgcacttttggtttc

SEQ ID NO: 9407196 - DNA, 22 bp, Homo sapiens
tggcaggtgccatgggctcaga

SEQ ID NO: 9407197 - DNA, 22 bp, Homo sapiens
tggccctgccgcactatcctca

SEQ ID NO: 9407198 - DNA, 22 bp, Homo sapiens
tggccctgccgccacgacgtct

SEQ ID NO: 9407199 - DNA, 22 bp, Homo sapiens
tggccctgccgcactatcctca

SEQ ID NO: 9407200 - DNA, 22 bp, Homo sapiens
tggccctgccctcttcatcttt

SEQ ID NO: 9407201 - DNA, 22 bp, Homo sapiens
tggccctgccctcttcatcttt

SEQ ID NO: 9407202 - DNA, 22 bp, Homo sapiens
tggccctgccactcactgctga

SEQ ID NO: 9407203 - DNA, 22 bp, Homo sapiens
tggccctgccactcactgctga

SEQ ID NO: 9407204 - DNA, 22 bp, Homo sapiens
tggccctgggcagaggcaacat

SEQ ID NO: 9407205 - DNA, 22 bp, Homo sapiens
tggccctgggcatctttcgtga

SEQ ID NO: 9407206 - DNA, 22 bp, Homo sapiens
tggccctgggcagaggcaacat

SEQ ID NO: 9407207 - DNA, 22 bp, Homo sapiens
tggccctgtccctggagcctgg

SEQ ID NO: 9407208 - DNA, 22 bp, Homo sapiens
tggccctgtccctggagcctgg

SEQ ID NO: 9407209 - DNA, 22 bp, Homo sapiens
tggccctggtggcacagcctgc

SEQ ID NO: 9407210 - DNA, 22 bp, Homo sapiens
tggccctggtggcacagcctgc

SEQ ID NO: 9407211 - DNA, 22 bp, Homo sapiens
tggccctgtcctcatttcatct

SEQ ID NO: 9407212 - DNA, 22 bp, Homo sapiens
tggccctgtcctcatttcatct

SEQ ID NO: 9407213 - DNA, 22 bp, Homo sapiens
tggccctgtctgcacacaggat

SEQ ID NO: 9407214 - DNA, 23 bp, Homo sapiens
tggccctgtgcatgctgcttccc

SEQ ID NO: 9407215 - DNA, 23 bp, Homo sapiens
tggccctgtgcatgctgcttccc

SEQ ID NO: 9407216 - DNA, 22 bp, Homo sapiens
tggccctgtgactgagttctag

SEQ ID NO: 9407217 - DNA, 22 bp, Homo sapiens
tggccctgtgtcctgctgccag

SEQ ID NO: 9407218 - DNA, 22 bp, Homo sapiens
tggccctgtgtgcaggctgcac

SEQ ID NO: 9407219 - DNA, 22 bp, Homo sapiens
tggccctgtgtgcaggctgcac

SEQ ID NO: 9407220 - DNA, 22 bp, Homo sapiens
tggccctgtggaggtcagtgag

SEQ ID NO: 9407221 - DNA, 22 bp, Homo sapiens
tggccctgtgtcctgctgccag

SEQ ID NO: 9407222 - DNA, 22 bp, Homo sapiens
tggcccttcaaattccctagtc

SEQ ID NO: 9407223 - DNA, 22 bp, Homo sapiens
tggcccttctgagcacagggcc

SEQ ID NO: 9407224 - DNA, 22 bp, Homo sapiens
tggcccttcaaattccctagtc

SEQ ID NO: 9407225 - DNA, 20 bp, Homo sapiens
tggccctgttttctccaggc

SEQ ID NO: 9407226 - DNA, 22 bp, Homo sapiens
tggccctttggtttatgactga

SEQ ID NO: 9407227 - DNA, 22 bp, Homo sapiens
tggcccttttgtgaagtggcca

SEQ ID NO: 9407228 - DNA, 22 bp, Homo sapiens
tggcccttgtcctgggagagtt

SEQ ID NO: 9407229 - DNA, 22 bp, Homo sapiens
tggccctttgggtgcaggggca

SEQ ID NO: 9407230 - DNA, 22 bp, Homo sapiens
tggccggtgccgcgaagccggg

SEQ ID NO: 9407231 - DNA, 16 bp, Homo sapiens
tggccgcagaggcctc

SEQ ID NO: 9407232 - DNA, 22 bp, Homo sapiens
tggcctcttaggacatcctcta

SEQ ID NO: 9407233 - DNA, 22 bp, Homo sapiens
tggcctctttcttccctttgac

SEQ ID NO: 9407234 - DNA, 22 bp, Homo sapiens
tggcctcttacgacatagcctt

SEQ ID NO: 9407235 - DNA, 22 bp, Homo sapiens
tggcctctgaggcacctttgcc

SEQ ID NO: 9407236 - DNA, 22 bp, Homo sapiens
tggcctctggctgaggactaac

SEQ ID NO: 9407237 - DNA, 20 bp, Homo sapiens
tggcctctgtagaggccaag

SEQ ID NO: 9407238 - DNA, 23 bp, Homo sapiens
tggcctgcagagtttctgctggg

SEQ ID NO: 9407239 - DNA, 22 bp, Homo sapiens
tggcctgcaaagtcttcttgct

SEQ ID NO: 9407240 - DNA, 22 bp, Homo sapiens
tggcctgaggctcggcatgggt

SEQ ID NO: 9407241 - DNA, 22 bp, Homo sapiens
tggcctgagttgtctgcaggcc

SEQ ID NO: 9407242 - DNA, 22 bp, Homo sapiens
tggcctgactgtccagccaggg

SEQ ID NO: 9407243 - DNA, 22 bp, Homo sapiens
tggcctgaggctcggcatgggt

SEQ ID NO: 9407244 - DNA, 22 bp, Homo sapiens
tggcctgcctcccggcttcttt

SEQ ID NO: 9407245 - DNA, 22 bp, Homo sapiens
tggcctgcccagagcagctctg

SEQ ID NO: 9407246 - DNA, 22 bp, Homo sapiens
tggcctgcccagagcagctctg

SEQ ID NO: 9407247 - DNA, 22 bp, Homo sapiens
tggcctgcccagagcagctctg

SEQ ID NO: 9407248 - DNA, 22 bp, Homo sapiens
tggcctgccactgccacgccac

SEQ ID NO: 9407249 - DNA, 22 bp, Homo sapiens
tggcctggccacatccagcagg

SEQ ID NO: 9407250 - DNA, 23 bp, Homo sapiens
tggcctggagagaaaagatgagt

SEQ ID NO: 9407251 - DNA, 22 bp, Homo sapiens
tggcctggcagagcaaggcctg

SEQ ID NO: 9407252 - DNA, 18 bp, Homo sapiens
tggcctggagacaactct

SEQ ID NO: 9407253 - DNA, 22 bp, Homo sapiens
tggcctggaagagaggtcgagg

SEQ ID NO: 9407254 - DNA, 22 bp, Homo sapiens
tggcctggaagagaggtcgagg

SEQ ID NO: 9407255 - DNA, 22 bp, Homo sapiens
tggcctggaagagaggtcgagg

SEQ ID NO: 9407256 - DNA, 23 bp, Homo sapiens
tggcctggagagaaaagatgagt

SEQ ID NO: 9407257 - DNA, 22 bp, Homo sapiens
tggcctggaaaaatgcagatgg

SEQ ID NO: 9407258 - DNA, 22 bp, Homo sapiens
tggcctgccttcgctgagctga

SEQ ID NO: 9407259 - DNA, 22 bp, Homo sapiens
tggcctgccttcgctgagctga

SEQ ID NO: 9407260 - DNA, 22 bp, Homo sapiens
tggcctggaaaaatgcagatgg

SEQ ID NO: 9407261 - DNA, 22 bp, Homo sapiens
tggcctggaacctggcagggac

SEQ ID NO: 9407262 - DNA, 22 bp, Homo sapiens
tggcctggaacctggcagggac

SEQ ID NO: 9407263 - DNA, 22 bp, Homo sapiens
tggcctggaagagaggtcgagg

SEQ ID NO: 9407264 - DNA, 22 bp, Homo sapiens
tggcctggaagagaggtcgagg

SEQ ID NO: 9407265 - DNA, 22 bp, Homo sapiens
tggcctggaacctggcagggac

SEQ ID NO: 9407266 - DNA, 22 bp, Homo sapiens
tggccctgcagaactagcctgg

SEQ ID NO: 9407267 - DNA, 22 bp, Homo sapiens
tggccctgccactcactgctga

SEQ ID NO: 9407268 - DNA, 22 bp, Homo sapiens
tggccctgcacccagagcagtt

SEQ ID NO: 9407269 - DNA, 22 bp, Homo sapiens
tggccctgcagaactagcctgg

SEQ ID NO: 9407270 - DNA, 22 bp, Homo sapiens
tggccctgcagaactagcctgg

SEQ ID NO: 9407271 - DNA, 22 bp, Homo sapiens
tggccctgagggctcggagcca

SEQ ID NO: 9407272 - DNA, 22 bp, Homo sapiens
tggccctgaggggctgtgcccc

SEQ ID NO: 9407273 - DNA, 22 bp, Homo sapiens
tggccctgcacccagagcagtt

SEQ ID NO: 9407274 - DNA, 22 bp, Homo sapiens
tggccctgacaggtcctgggca

SEQ ID NO: 9407275 - DNA, 22 bp, Homo sapiens
tggccctgactgatgtggaggg

SEQ ID NO: 9407276 - DNA, 22 bp, Homo sapiens
tggccctgacttggaggcctga

SEQ ID NO: 9407277 - DNA, 22 bp, Homo sapiens
tggccctgacttggaggcctga

SEQ ID NO: 9407278 - DNA, 22 bp, Homo sapiens
tggccctgacttggaggcctga

SEQ ID NO: 9407279 - DNA, 22 bp, Homo sapiens
tggccctgaggacccagtgtgg

SEQ ID NO: 9407280 - DNA, 22 bp, Homo sapiens
tggccctgaggacccagtgtgg

SEQ ID NO: 9407281 - DNA, 22 bp, Homo sapiens
tggcccagtcagcaggagaggg

SEQ ID NO: 9407282 - DNA, 22 bp, Homo sapiens
tggcccagtcagcaggagaggg

SEQ ID NO: 9407283 - DNA, 22 bp, Homo sapiens
tggcccagtcagcaggagaggg

SEQ ID NO: 9407284 - DNA, 22 bp, Homo sapiens
tggcccaggtgcaagagacaga

SEQ ID NO: 9407285 - DNA, 22 bp, Homo sapiens
tggcccaggtgcacccagaggc

SEQ ID NO: 9407286 - DNA, 22 bp, Homo sapiens
tggcccaggtgcaagagacaga

SEQ ID NO: 9407287 - DNA, 22 bp, Homo sapiens
tggcccaggtgcacccagaggc

SEQ ID NO: 9407288 - DNA, 22 bp, Homo sapiens
tggcccaggtgcacccagaggc

SEQ ID NO: 9407289 - DNA, 22 bp, Homo sapiens
tggccctcgtccgacaggtggg

SEQ ID NO: 9407290 - DNA, 22 bp, Homo sapiens
tggccctcgtccgacaggtggg

SEQ ID NO: 9407291 - DNA, 22 bp, Homo sapiens
tggccctgaaggccttgagcat

SEQ ID NO: 9407292 - DNA, 22 bp, Homo sapiens
tggccctcagtcttgctcctgc

SEQ ID NO: 9407293 - DNA, 22 bp, Homo sapiens
tggccctcagtcttgctcctgc

SEQ ID NO: 9407294 - DNA, 22 bp, Homo sapiens
tggccctcagcactgagacctt

SEQ ID NO: 9407295 - DNA, 22 bp, Homo sapiens
tggccctgacacgtggtactgg

SEQ ID NO: 9407296 - DNA, 23 bp, Homo sapiens
tggccctgaatctgtcctggagg

SEQ ID NO: 9407297 - DNA, 23 bp, Homo sapiens
tggccctgaatctgtcctggagg

SEQ ID NO: 9407298 - DNA, 22 bp, Homo sapiens
tggccctgaatcaaggccagca

SEQ ID NO: 9407299 - DNA, 22 bp, Homo sapiens
tggccctgaatcaaggccagca

SEQ ID NO: 9407300 - DNA, 22 bp, Homo sapiens
tggccatgacatggaggctttg

SEQ ID NO: 9407301 - DNA, 22 bp, Homo sapiens
tggccatgggatagtgcagggg

SEQ ID NO: 9407302 - DNA, 22 bp, Homo sapiens
tggccatgggatagtgcagggg

SEQ ID NO: 9407303 - DNA, 22 bp, Homo sapiens
tggccagttgaagacaatgctc

SEQ ID NO: 9407304 - DNA, 22 bp, Homo sapiens
tggccagtttgctcaggcagtc

SEQ ID NO: 9407305 - DNA, 22 bp, Homo sapiens
tggccagtttgctcaggcagtc

SEQ ID NO: 9407306 - DNA, 22 bp, Homo sapiens
tggccagtttgctcaggcagtc

SEQ ID NO: 9407307 - DNA, 22 bp, Homo sapiens
tggccatgaaggaggcagcaga

SEQ ID NO: 9407308 - DNA, 22 bp, Homo sapiens
tggccagtgtcggaggccagga

SEQ ID NO: 9407309 - DNA, 22 bp, Homo sapiens
tggccagtggggttgagcagga

SEQ ID NO: 9407310 - DNA, 22 bp, Homo sapiens
tggccagtggggttgagcagga

SEQ ID NO: 9407311 - DNA, 22 bp, Homo sapiens
tggccagtgtcggaggccagga

SEQ ID NO: 9407312 - DNA, 22 bp, Homo sapiens
tggccagtgtgtgctgccggct

SEQ ID NO: 9407313 - DNA, 22 bp, Homo sapiens
tggccagtgttggctagggaca

SEQ ID NO: 9407314 - DNA, 22 bp, Homo sapiens
tggccagtgttggctagggaca

SEQ ID NO: 9407315 - DNA, 22 bp, Homo sapiens
tggccagtgcctgccagtgcag

SEQ ID NO: 9407316 - DNA, 22 bp, Homo sapiens
tggccagtggactaagttctga

SEQ ID NO: 9407317 - DNA, 22 bp, Homo sapiens
tggccagtggggttgagcagga

SEQ ID NO: 9407318 - DNA, 22 bp, Homo sapiens
tggccagtgattaatgacgctt

SEQ ID NO: 9407319 - DNA, 22 bp, Homo sapiens
tggccagtcttagctgtgcctg

SEQ ID NO: 9407320 - DNA, 22 bp, Homo sapiens
tggccagtctgtggaagccagg

SEQ ID NO: 9407321 - DNA, 22 bp, Homo sapiens
tggcccagctcagggtgggcgg

SEQ ID NO: 9407322 - DNA, 22 bp, Homo sapiens
tggcccagccctgctctagggc

SEQ ID NO: 9407323 - DNA, 22 bp, Homo sapiens
tggcccagctcagggtgggcgg

SEQ ID NO: 9407324 - DNA, 22 bp, Homo sapiens
tggcccagactctgctcttatc

SEQ ID NO: 9407325 - DNA, 22 bp, Homo sapiens
tggcccagagcactgctgggca

SEQ ID NO: 9407326 - DNA, 22 bp, Homo sapiens
tggcccagccctgctctagggc

SEQ ID NO: 9407327 - DNA, 22 bp, Homo sapiens
tggcccagccctgctctagggc

SEQ ID NO: 9407328 - DNA, 22 bp, Homo sapiens
tggcccaggtctctctgagccc

SEQ ID NO: 9407329 - DNA, 22 bp, Homo sapiens
tggcccaggtctctctgagccc

SEQ ID NO: 9407330 - DNA, 22 bp, Homo sapiens
tggcccaggtctctctgagccc

SEQ ID NO: 9407331 - DNA, 22 bp, Homo sapiens
tggcccaggtctctctgagccc

SEQ ID NO: 9407332 - DNA, 22 bp, Homo sapiens
tggcccagggtctacagcctca

SEQ ID NO: 9407333 - DNA, 22 bp, Homo sapiens
tggcccagggtctacagcctca

SEQ ID NO: 9407334 - DNA, 22 bp, Homo sapiens
tggcccaggggctcttggtgtt

SEQ ID NO: 9407335 - DNA, 22 bp, Homo sapiens
tggcccaggggctcttggtgtt

SEQ ID NO: 9407336 - DNA, 22 bp, Homo sapiens
tggcccaggggctcttggtgtt

SEQ ID NO: 9407337 - DNA, 22 bp, Homo sapiens
tggcccagggcacagcagggag

SEQ ID NO: 9407338 - DNA, 22 bp, Homo sapiens
tggcccagggcacagcagggag

SEQ ID NO: 9407339 - DNA, 22 bp, Homo sapiens
tggcccagggcacagcagggag

SEQ ID NO: 9407340 - DNA, 22 bp, Homo sapiens
tggcccagctgcagatggtgga

SEQ ID NO: 9407341 - DNA, 22 bp, Homo sapiens
tggcccagctgcagatggtgga

SEQ ID NO: 9407342 - DNA, 22 bp, Homo sapiens
tggcccaggaggccagagggca

SEQ ID NO: 9407343 - DNA, 22 bp, Homo sapiens
tggcccaggaggccagagggca

SEQ ID NO: 9407344 - DNA, 22 bp, Homo sapiens
tggcccaggccaaagccctgga

SEQ ID NO: 9407345 - DNA, 22 bp, Homo sapiens
tggcccaggccaaagccctgga

SEQ ID NO: 9407346 - DNA, 22 bp, Homo sapiens
tggcccaggcgaggtgggcaga

SEQ ID NO: 9407347 - DNA, 22 bp, Homo sapiens
tggcccagggagttcatggtgt

SEQ ID NO: 9407348 - DNA, 22 bp, Homo sapiens
tggcccagggagttcatggtgt

SEQ ID NO: 9407349 - DNA, 22 bp, Homo sapiens
tggcccaggcgaggtgggcaga

SEQ ID NO: 9407350 - DNA, 22 bp, Homo sapiens
tggcccaggcgaggtgggcaga

SEQ ID NO: 9407351 - DNA, 18 bp, Homo sapiens
tggcagcaggaagccatt

SEQ ID NO: 9407352 - DNA, 22 bp, Homo sapiens
tggcagcagctaacttaggcag

SEQ ID NO: 9407353 - DNA, 18 bp, Homo sapiens
tggcagcaggaagccatt

SEQ ID NO: 9407354 - DNA, 22 bp, Homo sapiens
tggcagcagccatggaaggccc

SEQ ID NO: 9407355 - DNA, 22 bp, Homo sapiens
tggcagcagccatggaaggccc

SEQ ID NO: 9407356 - DNA, 22 bp, Homo sapiens
tggcagcagccatggaaggccc

SEQ ID NO: 9407357 - DNA, 22 bp, Homo sapiens
tggcagcagcaaatggcatatc

SEQ ID NO: 9407358 - DNA, 22 bp, Homo sapiens
tggcagcagcaaatggcatatc

SEQ ID NO: 9407359 - DNA, 22 bp, Homo sapiens
tggcagcagacatctgaggtct

SEQ ID NO: 9407360 - DNA, 22 bp, Homo sapiens
tggcagcagtggaggtagaaag

SEQ ID NO: 9407361 - DNA, 22 bp, Homo sapiens
tggcagcagtagccaccccagc

SEQ ID NO: 9407362 - DNA, 22 bp, Homo sapiens
tggcagcagtagccaccccagc

SEQ ID NO: 9407363 - DNA, 22 bp, Homo sapiens
tggcagcatgtcccggcctcag

SEQ ID NO: 9407364 - DNA, 22 bp, Homo sapiens
tggcagcatgtcccggcctcag

SEQ ID NO: 9407365 - DNA, 22 bp, Homo sapiens
tggcagcatgtcccggcctcag

SEQ ID NO: 9407366 - DNA, 22 bp, Homo sapiens
tggcagcatgttatgtaaggaa

SEQ ID NO: 9407367 - DNA, 22 bp, Homo sapiens
tggcagcagtagccaccccagc

SEQ ID NO: 9407368 - DNA, 22 bp, Homo sapiens
tggcagcagggcccctggagga

SEQ ID NO: 9407369 - DNA, 22 bp, Homo sapiens
tggcagcagggaggccagtgtt

SEQ ID NO: 9407370 - DNA, 22 bp, Homo sapiens
tggcagcagggaggccagtgtt

SEQ ID NO: 9407371 - DNA, 22 bp, Homo sapiens
tggcagcagggaggccagtgtt

SEQ ID NO: 9407372 - DNA, 22 bp, Homo sapiens
tggcagccttctctgagaaggt

SEQ ID NO: 9407373 - DNA, 22 bp, Homo sapiens
tggcagcctggaatctctcagc

SEQ ID NO: 9407374 - DNA, 22 bp, Homo sapiens
tggcagcctggaatctctcagc

SEQ ID NO: 9407375 - DNA, 22 bp, Homo sapiens
tggcagcctcccagctgcattc

SEQ ID NO: 9407376 - DNA, 22 bp, Homo sapiens
tggcagcctgcgtgaaggagct

SEQ ID NO: 9407377 - DNA, 22 bp, Homo sapiens
tggcagcctgcgtgaaggagct

SEQ ID NO: 9407378 - DNA, 22 bp, Homo sapiens
tggcagccatctgagggtgggg

SEQ ID NO: 9407379 - DNA, 22 bp, Homo sapiens
tggcagccatctgagggtgggg

SEQ ID NO: 9407380 - DNA, 22 bp, Homo sapiens
tggcagccatctgagggtgggg

SEQ ID NO: 9407381 - DNA, 22 bp, Homo sapiens
tggcagcctcccagctgcattc

SEQ ID NO: 9407382 - DNA, 19 bp, Homo sapiens
tggcagcctccacttttgc

SEQ ID NO: 9407383 - DNA, 22 bp, Homo sapiens
tggcagcctcagacaaggacct

SEQ ID NO: 9407384 - DNA, 22 bp, Homo sapiens
tggcagcctcagacaaggacct

SEQ ID NO: 9407385 - DNA, 22 bp, Homo sapiens
tggcagccacatctcgtggatt

SEQ ID NO: 9407386 - DNA, 22 bp, Homo sapiens
tggcagccacatctcgtggatt

SEQ ID NO: 9407387 - DNA, 22 bp, Homo sapiens
tggcagccacatctcgtggatt

SEQ ID NO: 9407388 - DNA, 22 bp, Homo sapiens
tggcagccatcagagcaggggt

SEQ ID NO: 9407389 - DNA, 22 bp, Homo sapiens
tggcagccatcagagcaggggt

SEQ ID NO: 9407390 - DNA, 22 bp, Homo sapiens
tggcagctcctggggccagcac

SEQ ID NO: 9407391 - DNA, 22 bp, Homo sapiens
tggcagctcctggggccagcac

SEQ ID NO: 9407392 - DNA, 22 bp, Homo sapiens
tggcagctccgggtaggggctg

SEQ ID NO: 9407393 - DNA, 22 bp, Homo sapiens
tggcagctcccagagcttccaa

SEQ ID NO: 9407394 - DNA, 22 bp, Homo sapiens
tggcagctattacaaggaagtc

SEQ ID NO: 9407395 - DNA, 22 bp, Homo sapiens
tggcagccttctctgagaaggt

SEQ ID NO: 9407396 - DNA, 22 bp, Homo sapiens
tggcagagtcatcacatctgga

SEQ ID NO: 9407397 - DNA, 22 bp, Homo sapiens
tggcagagtcatcacatctgga

SEQ ID NO: 9407398 - DNA, 22 bp, Homo sapiens
tggcagagtcatcacatctgga

SEQ ID NO: 9407399 - DNA, 22 bp, Homo sapiens
tggcagagtcatcacatctgga

SEQ ID NO: 9407400 - DNA, 22 bp, Homo sapiens
tggcagagtaggatggccctgt

SEQ ID NO: 9407401 - DNA, 22 bp, Homo sapiens
tggcagagtaggatggccctgt

SEQ ID NO: 9407402 - DNA, 22 bp, Homo sapiens
tggcagagtaggatggccctgt

SEQ ID NO: 9407403 - DNA, 22 bp, Homo sapiens
tggcagagtaggatggccctgt

SEQ ID NO: 9407404 - DNA, 22 bp, Homo sapiens
tggcagagtctctcctttccag

SEQ ID NO: 9407405 - DNA, 22 bp, Homo sapiens
tggcagagtctctcctttccag

SEQ ID NO: 9407406 - DNA, 22 bp, Homo sapiens
tggcagagtctgggcttgggca

SEQ ID NO: 9407407 - DNA, 22 bp, Homo sapiens
tggcagagtctgggcttgggca

SEQ ID NO: 9407408 - DNA, 22 bp, Homo sapiens
tggcagagtctgggcttgggca

SEQ ID NO: 9407409 - DNA, 22 bp, Homo sapiens
tggcagagtctgggcttgggca

SEQ ID NO: 9407410 - DNA, 22 bp, Homo sapiens
tggcagagtctgggcttgggca

SEQ ID NO: 9407411 - DNA, 22 bp, Homo sapiens
tggcagagtctctcctttccag

SEQ ID NO: 9407412 - DNA, 22 bp, Homo sapiens
tggcagagtctctcctttccag

SEQ ID NO: 9407413 - DNA, 22 bp, Homo sapiens
tggcagagtctctcctttccag

SEQ ID NO: 9407414 - DNA, 22 bp, Homo sapiens
tggcagagtctgggcttgggca

SEQ ID NO: 9407415 - DNA, 22 bp, Homo sapiens
tggcagagtgcagaagaggcat

SEQ ID NO: 9407416 - DNA, 22 bp, Homo sapiens
tggcagagtgcagaagaggcat

SEQ ID NO: 9407417 - DNA, 21 bp, Homo sapiens
tggcagagtgcagtctataca

SEQ ID NO: 9407418 - DNA, 22 bp, Homo sapiens
tggcagagtgcagaagaggcat

SEQ ID NO: 9407419 - DNA, 22 bp, Homo sapiens
tggcagagtgcagaagaggcat

SEQ ID NO: 9407420 - DNA, 22 bp, Homo sapiens
tggcagagtgcagaagaggcat

SEQ ID NO: 9407421 - DNA, 21 bp, Homo sapiens
tggcagagtgcagtctataca

SEQ ID NO: 9407422 - DNA, 21 bp, Homo sapiens
tggcagagtgcagtctataca

SEQ ID NO: 9407423 - DNA, 22 bp, Homo sapiens
tggcagagtgcggcatcccctg

SEQ ID NO: 9407424 - DNA, 22 bp, Homo sapiens
tggcagagtggaccatactcaa

SEQ ID NO: 9407425 - DNA, 22 bp, Homo sapiens
tggcagagtggaccatactcaa

SEQ ID NO: 9407426 - DNA, 22 bp, Homo sapiens
tggcagagttcgctgtgccttt

SEQ ID NO: 9407427 - DNA, 22 bp, Homo sapiens
tggcagagttcgctgtgccttt

SEQ ID NO: 9407428 - DNA, 22 bp, Homo sapiens
tggcagagttcgctgtgccttt

SEQ ID NO: 9407429 - DNA, 22 bp, Homo sapiens
tggcagagttcgctgtgccttt

SEQ ID NO: 9407430 - DNA, 22 bp, Homo sapiens
tggcagagttcgctgtgccttt

SEQ ID NO: 9407431 - DNA, 22 bp, Homo sapiens
tggcagagttcgctcctattca

SEQ ID NO: 9407432 - DNA, 22 bp, Homo sapiens
tggcagagtggaccatactcaa

SEQ ID NO: 9407433 - DNA, 18 bp, Homo sapiens
tggcagagtgtctgttct

SEQ ID NO: 9407434 - DNA, 18 bp, Homo sapiens
tggcagagtgtctgttct

SEQ ID NO: 9407435 - DNA, 22 bp, Homo sapiens
tggcagagttatgggtatttat

SEQ ID NO: 9407436 - DNA, 21 bp, Homo sapiens
tggcagagttgagtagttatg

SEQ ID NO: 9407437 - DNA, 22 bp, Homo sapiens
tggcagagttggaggtggaaga

SEQ ID NO: 9407438 - DNA, 22 bp, Homo sapiens
tggcagagttggaggtggaaga

SEQ ID NO: 9407439 - DNA, 22 bp, Homo sapiens
tggcagagttggaggtggaaga

SEQ ID NO: 9407440 - DNA, 22 bp, Homo sapiens
tggcagagttggaggtggaaga

SEQ ID NO: 9407441 - DNA, 20 bp, Homo sapiens
tggcagagttgtcccaccca

SEQ ID NO: 9407442 - DNA, 20 bp, Homo sapiens
tggcagagttgtcccaccca

SEQ ID NO: 9407443 - DNA, 20 bp, Homo sapiens
tggcagagttgtcccaccca

SEQ ID NO: 9407444 - DNA, 22 bp, Homo sapiens
tggcagcagacaaaaggccatt

SEQ ID NO: 9407445 - DNA, 22 bp, Homo sapiens
tggcagcagacaaaaggccatt

SEQ ID NO: 9407446 - DNA, 20 bp, Homo sapiens
tggcagagttgtcccaccca

SEQ ID NO: 9407447 - DNA, 22 bp, Homo sapiens
tggcaggaaaaagggccagagg

SEQ ID NO: 9407448 - DNA, 22 bp, Homo sapiens
tggcaggaaagtaacagagcac

SEQ ID NO: 9407449 - DNA, 22 bp, Homo sapiens
tggcagctgattagatggtgcc

SEQ ID NO: 9407450 - DNA, 22 bp, Homo sapiens
tggcaggaaccttaaccacaaa

SEQ ID NO: 9407451 - DNA, 22 bp, Homo sapiens
tggcaggaagacgtggggcacc

SEQ ID NO: 9407452 - DNA, 22 bp, Homo sapiens
tggcaggaaccaggaggctctc

SEQ ID NO: 9407453 - DNA, 18 bp, Homo sapiens
tggcaggaaatgcacttt

SEQ ID NO: 9407454 - DNA, 22 bp, Homo sapiens
tggcaggaaccaggaggctctc

SEQ ID NO: 9407455 - DNA, 22 bp, Homo sapiens
tggcaggaaataccctgcctag

SEQ ID NO: 9407456 - DNA, 18 bp, Homo sapiens
tggcaggaaatgcacttt

SEQ ID NO: 9407457 - DNA, 22 bp, Homo sapiens
tggcaggaaagtaacagagcac

SEQ ID NO: 9407458 - DNA, 22 bp, Homo sapiens
tggcaggaaataccctgcctag

SEQ ID NO: 9407459 - DNA, 22 bp, Homo sapiens
tggcaggaaagtaacagagcac

SEQ ID NO: 9407460 - DNA, 22 bp, Homo sapiens
tggcaggaaagtaacagagcac

SEQ ID NO: 9407461 - DNA, 22 bp, Homo sapiens
tggcaggaggttttctccagga

SEQ ID NO: 9407462 - DNA, 22 bp, Homo sapiens
tggcaggaggttttctccagga

SEQ ID NO: 9407463 - DNA, 22 bp, Homo sapiens
tggcaggatctttgagagtgaa

SEQ ID NO: 9407464 - DNA, 20 bp, Homo sapiens
tggcaggaggcagcagtgga

SEQ ID NO: 9407465 - DNA, 20 bp, Homo sapiens
tggcaggaggcagcagtgga

SEQ ID NO: 9407466 - DNA, 20 bp, Homo sapiens
tggcaggaggcagcagtgga

SEQ ID NO: 9407467 - DNA, 20 bp, Homo sapiens
tggcaggaggcagcagtgga

SEQ ID NO: 9407468 - DNA, 20 bp, Homo sapiens
tggcaggagccactggaagc

SEQ ID NO: 9407469 - DNA, 22 bp, Homo sapiens
tggcaggaggatgaggcggcta

SEQ ID NO: 9407470 - DNA, 22 bp, Homo sapiens
tggcaggaggatgaggcggcta

SEQ ID NO: 9407471 - DNA, 22 bp, Homo sapiens
tggcaggaggatgaggcggcta

SEQ ID NO: 9407472 - DNA, 22 bp, Homo sapiens
tggcaggaggatgaggcggcta

SEQ ID NO: 9407473 - DNA, 20 bp, Homo sapiens
tggcaggactggctccaccc

SEQ ID NO: 9407474 - DNA, 20 bp, Homo sapiens
tggcaggactggctccaccc

SEQ ID NO: 9407475 - DNA, 20 bp, Homo sapiens
tggcaggactggctccaccc

SEQ ID NO: 9407476 - DNA, 20 bp, Homo sapiens
tggcaggactggctccaccc

SEQ ID NO: 9407477 - DNA, 22 bp, Homo sapiens
tggcaggagacacatggcatag

SEQ ID NO: 9407478 - DNA, 22 bp, Homo sapiens
tggcaggagacacatggcatag

SEQ ID NO: 9407479 - DNA, 22 bp, Homo sapiens
tggcaggagacacatggcatag

SEQ ID NO: 9407480 - DNA, 22 bp, Homo sapiens
tggcaggagagcgtcagatcag

SEQ ID NO: 9407481 - DNA, 20 bp, Homo sapiens
tggcaggaatagggccagag

SEQ ID NO: 9407482 - DNA, 22 bp, Homo sapiens
tggcaggaagacgtggggcacc

SEQ ID NO: 9407483 - DNA, 22 bp, Homo sapiens
tggcagggcctgaatcttatac

SEQ ID NO: 9407484 - DNA, 22 bp, Homo sapiens
tggcagggcctgaatcttatac

SEQ ID NO: 9407485 - DNA, 22 bp, Homo sapiens
tggcagggcctgctcatcatcc

SEQ ID NO: 9407486 - DNA, 22 bp, Homo sapiens
tggcaggggaggtgcttgctta

SEQ ID NO: 9407487 - DNA, 22 bp, Homo sapiens
tggcagggcctgctcatcatcc

SEQ ID NO: 9407488 - DNA, 22 bp, Homo sapiens
tggcagggcctaccccaatatc

SEQ ID NO: 9407489 - DNA, 22 bp, Homo sapiens
tggcagggcctaccccaatatc

SEQ ID NO: 9407490 - DNA, 22 bp, Homo sapiens
tggcagggagttgcaggatttc

SEQ ID NO: 9407491 - DNA, 22 bp, Homo sapiens
tggcagggagttgcaggatttc

SEQ ID NO: 9407492 - DNA, 22 bp, Homo sapiens
tggcagggagttgcaggatttc

SEQ ID NO: 9407493 - DNA, 22 bp, Homo sapiens
tggcagggagttgcaggatttc

SEQ ID NO: 9407494 - DNA, 22 bp, Homo sapiens
tggcagggagttgcaggatttc

SEQ ID NO: 9407495 - DNA, 22 bp, Homo sapiens
tggcaggggaggtgcttgctta

SEQ ID NO: 9407496 - DNA, 18 bp, Homo sapiens
tggcaggggcagtacgcc

SEQ ID NO: 9407497 - DNA, 18 bp, Homo sapiens
tggcaggggcagtacgcc

SEQ ID NO: 9407498 - DNA, 18 bp, Homo sapiens
tggcaggggcagtacgcc

SEQ ID NO: 9407499 - DNA, 22 bp, Homo sapiens
tggcagggtacaccttaacacc

SEQ ID NO: 9407500 - DNA, 22 bp, Homo sapiens
tggcagggtacaccttaacacc

SEQ ID NO: 9407501 - DNA, 21 bp, Homo sapiens
tggcaggggtagtagtacagc

SEQ ID NO: 9407502 - DNA, 21 bp, Homo sapiens
tggcaggggtagtagtacagc

SEQ ID NO: 9407503 - DNA, 18 bp, Homo sapiens
tggcaggggcagtacgcc

SEQ ID NO: 9407504 - DNA, 21 bp, Homo sapiens
tggcaggggtagtagtacagc

SEQ ID NO: 9407505 - DNA, 22 bp, Homo sapiens
tggcaggcagtgtgggagctgg

SEQ ID NO: 9407506 - DNA, 22 bp, Homo sapiens
tggcaggcagtgtgggagctgg

SEQ ID NO: 9407507 - DNA, 22 bp, Homo sapiens
tggcaggcagctggcatcctaa

SEQ ID NO: 9407508 - DNA, 22 bp, Homo sapiens
tggcaggcaggcagccttctga

SEQ ID NO: 9407509 - DNA, 22 bp, Homo sapiens
tggcaggcagctggcatcctaa

SEQ ID NO: 9407510 - DNA, 22 bp, Homo sapiens
tggcaggcagctggcatcctaa

SEQ ID NO: 9407511 - DNA, 21 bp, Homo sapiens
tggcaggcagctggaagcttg

SEQ ID NO: 9407512 - DNA, 22 bp, Homo sapiens
tggcaggatttgcccggaagga

SEQ ID NO: 9407513 - DNA, 22 bp, Homo sapiens
tggcaggatctttgagagtgaa

SEQ ID NO: 9407514 - DNA, 22 bp, Homo sapiens
tggcaggcaagttcagctccac

SEQ ID NO: 9407515 - DNA, 22 bp, Homo sapiens
tggcaggcaagttcagctccac

SEQ ID NO: 9407516 - DNA, 22 bp, Homo sapiens
tggcaggatttgcccggaagga

SEQ ID NO: 9407517 - DNA, 21 bp, Homo sapiens
tggcaggcagctggaagcttg

SEQ ID NO: 9407518 - DNA, 22 bp, Homo sapiens
tggcaggcagagagcggccttt

SEQ ID NO: 9407519 - DNA, 22 bp, Homo sapiens
tggcaggcagagagcggccttt

SEQ ID NO: 9407520 - DNA, 19 bp, Homo sapiens
tggcagggagtgatattag

SEQ ID NO: 9407521 - DNA, 19 bp, Homo sapiens
tggcagggagtgatattag

SEQ ID NO: 9407522 - DNA, 19 bp, Homo sapiens
tggcagggagtgatattag

SEQ ID NO: 9407523 - DNA, 22 bp, Homo sapiens
tggcagggagttcgttcacaac

SEQ ID NO: 9407524 - DNA, 22 bp, Homo sapiens
tggcagggagttcgttcacaac

SEQ ID NO: 9407525 - DNA, 22 bp, Homo sapiens
tggcaggcagtgtgggagctgg

SEQ ID NO: 9407526 - DNA, 22 bp, Homo sapiens
tggcagggagccaccggtcatg

SEQ ID NO: 9407527 - DNA, 18 bp, Homo sapiens
tggcagggaggaaatata

SEQ ID NO: 9407528 - DNA, 18 bp, Homo sapiens
tggcagggaggaaatata

SEQ ID NO: 9407529 - DNA, 18 bp, Homo sapiens
tggcagggaggaaatata

SEQ ID NO: 9407530 - DNA, 22 bp, Homo sapiens
tggcacagcccagagctcttga

SEQ ID NO: 9407531 - DNA, 22 bp, Homo sapiens
tggcacagccatcttctcctgc

SEQ ID NO: 9407532 - DNA, 22 bp, Homo sapiens
tggcacagccactgaatcggga

SEQ ID NO: 9407533 - DNA, 21 bp, Homo sapiens
tggcacagcaagtgggctcat

SEQ ID NO: 9407534 - DNA, 23 bp, Homo sapiens
tggcacagcaggtgtgctttgtt

SEQ ID NO: 9407535 - DNA, 21 bp, Homo sapiens
tggcacagcaagtgggctcat

SEQ ID NO: 9407536 - DNA, 21 bp, Homo sapiens
tggcacagcaagtgggctcat

SEQ ID NO: 9407537 - DNA, 22 bp, Homo sapiens
tggcacagttaaagttgtagaa

SEQ ID NO: 9407538 - DNA, 22 bp, Homo sapiens
tggcacagtgctggatggtgct

SEQ ID NO: 9407539 - DNA, 22 bp, Homo sapiens
tggcacagtgctggatggtgct

SEQ ID NO: 9407540 - DNA, 17 bp, Homo sapiens
tggcacagaggtgctat

SEQ ID NO: 9407541 - DNA, 17 bp, Homo sapiens
tggcacagaggtgctat

SEQ ID NO: 9407542 - DNA, 17 bp, Homo sapiens
tggcacagaggtgctat

SEQ ID NO: 9407543 - DNA, 21 bp, Homo sapiens
tggcacagcaagtgggctcat

SEQ ID NO: 9407544 - DNA, 19 bp, Homo sapiens
tggcacagatttcctccct

SEQ ID NO: 9407545 - DNA, 17 bp, Homo sapiens
tggcacagaggtgctat

SEQ ID NO: 9407546 - DNA, 17 bp, Homo sapiens
tggcacagaggtgctat

SEQ ID NO: 9407547 - DNA, 22 bp, Homo sapiens
tggcacagactgggccaaggaa

SEQ ID NO: 9407548 - DNA, 22 bp, Homo sapiens
tggcacagactgggccaaggaa

SEQ ID NO: 9407549 - DNA, 22 bp, Homo sapiens
tggcacagactgggccaaggaa

SEQ ID NO: 9407550 - DNA, 22 bp, Homo sapiens
tggcacagactgggccaaggaa

SEQ ID NO: 9407551 - DNA, 23 bp, Homo sapiens
tggcacagaggaccatgctttgc

SEQ ID NO: 9407552 - DNA, 22 bp, Homo sapiens
tggcacagagggacccagcagc

SEQ ID NO: 9407553 - DNA, 22 bp, Homo sapiens
tggcacagacagatcaggagtc

SEQ ID NO: 9407554 - DNA, 22 bp, Homo sapiens
tggcacagacagatcaggagtc

SEQ ID NO: 9407555 - DNA, 22 bp, Homo sapiens
tggcacagacagatcaggagtc

SEQ ID NO: 9407556 - DNA, 20 bp, Homo sapiens
tggcacagaacccttgccta

SEQ ID NO: 9407557 - DNA, 22 bp, Homo sapiens
tggcacagacagatcaggagtc

SEQ ID NO: 9407558 - DNA, 22 bp, Homo sapiens
tggcacagacagatcaggagtc

SEQ ID NO: 9407559 - DNA, 22 bp, Homo sapiens
tggcacagacagatcaggagtc

SEQ ID NO: 9407560 - DNA, 22 bp, Homo sapiens
tggcacagaccttatcttctct

SEQ ID NO: 9407561 - DNA, 22 bp, Homo sapiens
tggcaattgtccactgtctgcc

SEQ ID NO: 9407562 - DNA, 22 bp, Homo sapiens
tggcaattcctgagctctgaga

SEQ ID NO: 9407563 - DNA, 22 bp, Homo sapiens
tggcaattatatttttggctga

SEQ ID NO: 9407564 - DNA, 22 bp, Homo sapiens
tggcacaaatctagtccctggt

SEQ ID NO: 9407565 - DNA, 22 bp, Homo sapiens
tggcacagaaaaatgctccatt

SEQ ID NO: 9407566 - DNA, 22 bp, Homo sapiens
tggcacaagggctattccttag

SEQ ID NO: 9407567 - DNA, 22 bp, Homo sapiens
tggcaatttcacatggcttaac

SEQ ID NO: 9407568 - DNA, 22 bp, Homo sapiens
tggcaattgtccactgtctgcc

SEQ ID NO: 9407569 - DNA, 22 bp, Homo sapiens
tggcacaaaagtaattgcagtt

SEQ ID NO: 9407570 - DNA, 22 bp, Homo sapiens
tggcaattttctagcagatggc

SEQ ID NO: 9407571 - DNA, 22 bp, Homo sapiens
tggatggttgaaaacgggcagt

SEQ ID NO: 9407572 - DNA, 22 bp, Homo sapiens
tggatggttctgggcggcagca

SEQ ID NO: 9407573 - DNA, 22 bp, Homo sapiens
tggatgggttgaaatgtgagcc

SEQ ID NO: 9407574 - DNA, 22 bp, Homo sapiens
tggatgtctcagcttgagctgc

SEQ ID NO: 9407575 - DNA, 22 bp, Homo sapiens
tggatgtgagaaggatcaggct

SEQ ID NO: 9407576 - DNA, 22 bp, Homo sapiens
tggatgtcatagttggatatac

SEQ ID NO: 9407577 - DNA, 20 bp, Homo sapiens
tggatgtcaaattaggctgg

SEQ ID NO: 9407578 - DNA, 22 bp, Homo sapiens
tggatgtcaaaggagtttccag

SEQ ID NO: 9407579 - DNA, 22 bp, Homo sapiens
tggattcacaccattctcctgc

SEQ ID NO: 9407580 - DNA, 22 bp, Homo sapiens
tggattaaagattaaaatgaca

SEQ ID NO: 9407581 - DNA, 22 bp, Homo sapiens
tggatgtgtcgccctggctctc

SEQ ID NO: 9407582 - DNA, 17 bp, Homo sapiens
tggatgtgggatctgga

SEQ ID NO: 9407583 - DNA, 22 bp, Homo sapiens
tggatgtgtcgccctggctctc

SEQ ID NO: 9407584 - DNA, 17 bp, Homo sapiens
tggatgtgggatctgga

SEQ ID NO: 9407585 - DNA, 22 bp, Homo sapiens
tggatttagttcttcacaggcc

SEQ ID NO: 9407586 - DNA, 19 bp, Homo sapiens
tggatttatattctttatc

SEQ ID NO: 9407587 - DNA, 22 bp, Homo sapiens
tggatttatggagaccgaaagt

SEQ ID NO: 9407588 - DNA, 22 bp, Homo sapiens
tggatttaacagaataccaggt

SEQ ID NO: 9407589 - DNA, 22 bp, Homo sapiens
tggatttccagacagcttaatt

SEQ ID NO: 9407590 - DNA, 22 bp, Homo sapiens
tggatttatggagaccgaaagt

SEQ ID NO: 9407591 - DNA, 22 bp, Homo sapiens
tggatttcagctccatacttac

SEQ ID NO: 9407592 - DNA, 22 bp, Homo sapiens
tggatttcatagactgccatct

SEQ ID NO: 9407593 - DNA, 22 bp, Homo sapiens
tggcaacaagaaaggcagaggg

SEQ ID NO: 9407594 - DNA, 22 bp, Homo sapiens
tggcaacatgtcgaagtgctgt

SEQ ID NO: 9407595 - DNA, 22 bp, Homo sapiens
tggcaacacctggaagacatgg

SEQ ID NO: 9407596 - DNA, 22 bp, Homo sapiens
tggcaacatggacaggtctgcc

SEQ ID NO: 9407597 - DNA, 22 bp, Homo sapiens
tggcaagttggtgggtttagtg

SEQ ID NO: 9407598 - DNA, 22 bp, Homo sapiens
tggcaagttcatatggtttaag

SEQ ID NO: 9407599 - DNA, 22 bp, Homo sapiens
tggcaaccgcatggcctgcttc

SEQ ID NO: 9407600 - DNA, 22 bp, Homo sapiens
tggcaactcctgactctactca

SEQ ID NO: 9407601 - DNA, 22 bp, Homo sapiens
tggcaccagcacctagatgggg

SEQ ID NO: 9407602 - DNA, 22 bp, Homo sapiens
tggcaccagcacctagatgggg

SEQ ID NO: 9407603 - DNA, 22 bp, Homo sapiens
tggcaccaggcggggtggctgt

SEQ ID NO: 9407604 - DNA, 22 bp, Homo sapiens
tggcaccatcaaggctgagaac

SEQ ID NO: 9407605 - DNA, 20 bp, Homo sapiens
tggcaccaggtggtggcccc

SEQ ID NO: 9407606 - DNA, 20 bp, Homo sapiens
tggcaccaggtggtggcccc

SEQ ID NO: 9407607 - DNA, 22 bp, Homo sapiens
tggcacagttaaagttgtagaa

SEQ ID NO: 9407608 - DNA, 22 bp, Homo sapiens
tggcacatagtaggtgctcaat

SEQ ID NO: 9407609 - DNA, 22 bp, Homo sapiens
tggcacctggtgcagggtggcc

SEQ ID NO: 9407610 - DNA, 22 bp, Homo sapiens
tggcaccctgaagttggtcact

SEQ ID NO: 9407611 - DNA, 22 bp, Homo sapiens
tggcacctgaacttagaggtgt

SEQ ID NO: 9407612 - DNA, 22 bp, Homo sapiens
tggcacgacaattggcaccaat

SEQ ID NO: 9407613 - DNA, 22 bp, Homo sapiens
tggcacgacaattggcaccaat

SEQ ID NO: 9407614 - DNA, 22 bp, Homo sapiens
tggcacgacaattggcaccaat

SEQ ID NO: 9407615 - DNA, 22 bp, Homo sapiens
tggcacgacaattggcaccaat

SEQ ID NO: 9407616 - DNA, 22 bp, Homo sapiens
tggcacgacaattggcaccaat

SEQ ID NO: 9407617 - DNA, 22 bp, Homo sapiens
tggcacgttggattgggagttc

SEQ ID NO: 9407618 - DNA, 22 bp, Homo sapiens
tggcactgaagctggaaagcct

SEQ ID NO: 9407619 - DNA, 22 bp, Homo sapiens
tggcactgacagggtgctcaag

SEQ ID NO: 9407620 - DNA, 22 bp, Homo sapiens
tggcactgacagggtgctcaag

SEQ ID NO: 9407621 - DNA, 22 bp, Homo sapiens
tggcactgtcaccaatgctgtc

SEQ ID NO: 9407622 - DNA, 22 bp, Homo sapiens
tggcactgtcaccaatgctgtc

SEQ ID NO: 9407623 - DNA, 22 bp, Homo sapiens
tggcactgtagccactactgcc

SEQ ID NO: 9407624 - DNA, 22 bp, Homo sapiens
tggcactgtagccactactgcc

SEQ ID NO: 9407625 - DNA, 22 bp, Homo sapiens
tggcactgggacagatgctctc

SEQ ID NO: 9407626 - DNA, 22 bp, Homo sapiens
tggcacttccgtctgccttgtg

SEQ ID NO: 9407627 - DNA, 22 bp, Homo sapiens
tggcacttccatttctttagtg

SEQ ID NO: 9407628 - DNA, 22 bp, Homo sapiens
tggcacttccactgtggctgct

SEQ ID NO: 9407629 - DNA, 22 bp, Homo sapiens
tggcacttattcatatcatgga

SEQ ID NO: 9407630 - DNA, 22 bp, Homo sapiens
tggcacttccactgtggctgct

SEQ ID NO: 9407631 - DNA, 22 bp, Homo sapiens
tggcacttagcagggaaggtgt

SEQ ID NO: 9407632 - DNA, 22 bp, Homo sapiens
tggcacttattcatatcatgga

SEQ ID NO: 9407633 - DNA, 22 bp, Homo sapiens
tggcacttaggtacaagggaat

SEQ ID NO: 9407634 - DNA, 22 bp, Homo sapiens
tggcacttaaaaattattcttc

SEQ ID NO: 9407635 - DNA, 22 bp, Homo sapiens
tggcacttagcagggaaggtgt

SEQ ID NO: 9407636 - DNA, 22 bp, Homo sapiens
tggcacttaatgcatgtgctat

SEQ ID NO: 9407637 - DNA, 22 bp, Homo sapiens
tggcacttagatcaggttgggt

SEQ ID NO: 9407638 - DNA, 22 bp, Homo sapiens
tggcactgccaacctgctaggt

SEQ ID NO: 9407639 - DNA, 22 bp, Homo sapiens
tggcactgccaacctgctaggt

SEQ ID NO: 9407640 - DNA, 22 bp, Homo sapiens
tggcactgccaacctgctaggt

SEQ ID NO: 9407641 - DNA, 22 bp, Homo sapiens
tggcactgaccccaggcctgtg

SEQ ID NO: 9407642 - DNA, 22 bp, Homo sapiens
tggcactgaccccaggcctgtg

SEQ ID NO: 9407643 - DNA, 22 bp, Homo sapiens
tggcactgaccccaggcctgtg

SEQ ID NO: 9407644 - DNA, 22 bp, Homo sapiens
tggcactgaccccaggcctgtg

SEQ ID NO: 9407645 - DNA, 22 bp, Homo sapiens
tggcactggaatcgtagccttg

SEQ ID NO: 9407646 - DNA, 22 bp, Homo sapiens
tggcactggaatcgtagccttg

SEQ ID NO: 9407647 - DNA, 21 bp, Homo sapiens
tggcactgcttagcaggttcc

SEQ ID NO: 9407648 - DNA, 22 bp, Homo sapiens
tggcactggaatcgtagccttg

SEQ ID NO: 9407649 - DNA, 22 bp, Homo sapiens
tggcactggaatcgtagccttg

SEQ ID NO: 9407650 - DNA, 22 bp, Homo sapiens
tggcactgccaacctgctaggt

SEQ ID NO: 9407651 - DNA, 22 bp, Homo sapiens
tggcagagacaaggccgggcct

SEQ ID NO: 9407652 - DNA, 22 bp, Homo sapiens
tggcagagacaaggccgggcct

SEQ ID NO: 9407653 - DNA, 22 bp, Homo sapiens
tggcagagacaaggccgggcct

SEQ ID NO: 9407654 - DNA, 22 bp, Homo sapiens
tggcagagaataaatcttgact

SEQ ID NO: 9407655 - DNA, 22 bp, Homo sapiens
tggcagagacaaggccgggcct

SEQ ID NO: 9407656 - DNA, 22 bp, Homo sapiens
tggcagagaacctgggctttgt

SEQ ID NO: 9407657 - DNA, 22 bp, Homo sapiens
tggcagagaataaatcttgact

SEQ ID NO: 9407658 - DNA, 22 bp, Homo sapiens
tggcagagaacctgggctttgt

SEQ ID NO: 9407659 - DNA, 22 bp, Homo sapiens
tggcagagaacctgggctttgt

SEQ ID NO: 9407660 - DNA, 22 bp, Homo sapiens
tggcagagaacacggctgatct

SEQ ID NO: 9407661 - DNA, 22 bp, Homo sapiens
tggcagagaacacggctgatct

SEQ ID NO: 9407662 - DNA, 22 bp, Homo sapiens
tggcagagaacacggctgatct

SEQ ID NO: 9407663 - DNA, 22 bp, Homo sapiens
tggcagagaacacggctgatct

SEQ ID NO: 9407664 - DNA, 22 bp, Homo sapiens
tggcagagagactctccttgat

SEQ ID NO: 9407665 - DNA, 22 bp, Homo sapiens
tggcagagagactctccttgat

SEQ ID NO: 9407666 - DNA, 22 bp, Homo sapiens
tggcagagactcctcctgggag

SEQ ID NO: 9407667 - DNA, 22 bp, Homo sapiens
tggcagagactcctcctgggag

SEQ ID NO: 9407668 - DNA, 23 bp, Homo sapiens
tggcagagacccagaatctacat

SEQ ID NO: 9407669 - DNA, 22 bp, Homo sapiens
tggcagagactcctcctgggag

SEQ ID NO: 9407670 - DNA, 22 bp, Homo sapiens
tggcagagactcctcctgggag

SEQ ID NO: 9407671 - DNA, 22 bp, Homo sapiens
tggcagagactcctcctgggag

SEQ ID NO: 9407672 - DNA, 22 bp, Homo sapiens
tggcagagagagtgcagtcgac

SEQ ID NO: 9407673 - DNA, 22 bp, Homo sapiens
tggcagagagagtgcagtcgac

SEQ ID NO: 9407674 - DNA, 22 bp, Homo sapiens
tggcagagagagtgcagtcgac

SEQ ID NO: 9407675 - DNA, 22 bp, Homo sapiens
tggcagagagagtgcagtcgac

SEQ ID NO: 9407676 - DNA, 22 bp, Homo sapiens
tggcagagagactctccttgat

SEQ ID NO: 9407677 - DNA, 22 bp, Homo sapiens
tggcagagagagtgcagtcgac

SEQ ID NO: 9407678 - DNA, 22 bp, Homo sapiens
tggcagagagactctccttgat

SEQ ID NO: 9407679 - DNA, 22 bp, Homo sapiens
tggcagagcccagactccagtc

SEQ ID NO: 9407680 - DNA, 22 bp, Homo sapiens
tggcagagcccagactccagtc

SEQ ID NO: 9407681 - DNA, 22 bp, Homo sapiens
tggcagagcccagactccagtc

SEQ ID NO: 9407682 - DNA, 22 bp, Homo sapiens
tggcagagcccagaactgagca

SEQ ID NO: 9407683 - DNA, 22 bp, Homo sapiens
tggcagagcccagaactgagca

SEQ ID NO: 9407684 - DNA, 22 bp, Homo sapiens
tggcagagcccagaactgagca

SEQ ID NO: 9407685 - DNA, 22 bp, Homo sapiens
tggcagagatgaagagttgttt

SEQ ID NO: 9407686 - DNA, 22 bp, Homo sapiens
tggcagagatgaagagttgttt

SEQ ID NO: 9407687 - DNA, 22 bp, Homo sapiens
tggcagagcaaaaagatagaat

SEQ ID NO: 9407688 - DNA, 22 bp, Homo sapiens
tggcagagcccagaactgagca

SEQ ID NO: 9407689 - DNA, 22 bp, Homo sapiens
tggcagagcaaaaagatagaat

SEQ ID NO: 9407690 - DNA, 22 bp, Homo sapiens
tggcagagcaaaaagatagaat

SEQ ID NO: 9407691 - DNA, 22 bp, Homo sapiens
tggcagagctggctgcggatga

SEQ ID NO: 9407692 - DNA, 22 bp, Homo sapiens
tggcagagctggctgcggatga

SEQ ID NO: 9407693 - DNA, 22 bp, Homo sapiens
tggcagagctggctgcggatga

SEQ ID NO: 9407694 - DNA, 22 bp, Homo sapiens
tggcagagctggctgcggatga

SEQ ID NO: 9407695 - DNA, 22 bp, Homo sapiens
tggcagagctggctgcggatga

SEQ ID NO: 9407696 - DNA, 22 bp, Homo sapiens
tggcagagccttgccaaactcc

SEQ ID NO: 9407697 - DNA, 22 bp, Homo sapiens
tggcagagccttgccaaactcc

SEQ ID NO: 9407698 - DNA, 22 bp, Homo sapiens
tggcagagccttgccaaactcc

SEQ ID NO: 9407699 - DNA, 22 bp, Homo sapiens
tggcagaggtatattgggagga

SEQ ID NO: 9407700 - DNA, 22 bp, Homo sapiens
tggcagaggtatattgggagga

SEQ ID NO: 9407701 - DNA, 16 bp, Homo sapiens
tggcagaggttcagcc

SEQ ID NO: 9407702 - DNA, 22 bp, Homo sapiens
tggcagaggaaaaagtcactgg

SEQ ID NO: 9407703 - DNA, 22 bp, Homo sapiens
tggcagaggaaaaagtcactgg

SEQ ID NO: 9407704 - DNA, 17 bp, Homo sapiens
tggctctgaggctgaat

SEQ ID NO: 9407705 - DNA, 23 bp, Homo sapiens
tggctctgagcttcctggtggcc

SEQ ID NO: 9407706 - DNA, 23 bp, Homo sapiens
tggctctgagcttcctggtggcc

SEQ ID NO: 9407707 - DNA, 22 bp, Homo sapiens
tggctctgagctgcaaagctgc

SEQ ID NO: 9407708 - DNA, 17 bp, Homo sapiens
tggctctgaggctgaat

SEQ ID NO: 9407709 - DNA, 22 bp, Homo sapiens
tggctctgagtctgcccttggc

SEQ ID NO: 9407710 - DNA, 17 bp, Homo sapiens
tggctctgaggctgaat

SEQ ID NO: 9407711 - DNA, 17 bp, Homo sapiens
tggctctgaggctgaat

SEQ ID NO: 9407712 - DNA, 22 bp, Homo sapiens
tggctctgagctgcaaagctgc

SEQ ID NO: 9407713 - DNA, 21 bp, Homo sapiens
tggctctgagcctcatggctg

SEQ ID NO: 9407714 - DNA, 21 bp, Homo sapiens
tggctctgagcctcatggctg

SEQ ID NO: 9407715 - DNA, 23 bp, Homo sapiens
tggctctgagaggttcagatgct

SEQ ID NO: 9407716 - DNA, 22 bp, Homo sapiens
tggctctgagacacaggctctc

SEQ ID NO: 9407717 - DNA, 23 bp, Homo sapiens
tggctctgagaggttcagatgct

SEQ ID NO: 9407718 - DNA, 22 bp, Homo sapiens
tggctctgagacacaggctctc

SEQ ID NO: 9407719 - DNA, 20 bp, Homo sapiens
tggctctcaccctgtgcgat

SEQ ID NO: 9407720 - DNA, 22 bp, Homo sapiens
tggctcctttccgggtctccag

SEQ ID NO: 9407721 - DNA, 20 bp, Homo sapiens
tggctcctggctcctccctc

SEQ ID NO: 9407722 - DNA, 22 bp, Homo sapiens
tggctccttcattctcctgcca

SEQ ID NO: 9407723 - DNA, 22 bp, Homo sapiens
tggctccttcattctcctgcca

SEQ ID NO: 9407724 - DNA, 22 bp, Homo sapiens
tggctccttcattctcctgcca

SEQ ID NO: 9407725 - DNA, 20 bp, Homo sapiens
tggctcctggctcctccctc

SEQ ID NO: 9407726 - DNA, 20 bp, Homo sapiens
tggctcctggctcctccctc

SEQ ID NO: 9407727 - DNA, 20 bp, Homo sapiens
tggctcctggctcctccctc

SEQ ID NO: 9407728 - DNA, 22 bp, Homo sapiens
tggctccttccgcagcatgcct

SEQ ID NO: 9407729 - DNA, 22 bp, Homo sapiens
tggctccttccgcagcatgcct

SEQ ID NO: 9407730 - DNA, 18 bp, Homo sapiens
tggctctggacttgctcc

SEQ ID NO: 9407731 - DNA, 22 bp, Homo sapiens
tggctctgctgaacctagtgca

SEQ ID NO: 9407732 - DNA, 22 bp, Homo sapiens
tggctctggagctggcggctga

SEQ ID NO: 9407733 - DNA, 22 bp, Homo sapiens
tggctctggagctcctgggccc

SEQ ID NO: 9407734 - DNA, 22 bp, Homo sapiens
tggctctgccccatacccctgc

SEQ ID NO: 9407735 - DNA, 22 bp, Homo sapiens
tggctctgcgtctgttcgtggg

SEQ ID NO: 9407736 - DNA, 21 bp, Homo sapiens
tggctctgctcagagcagtcc

SEQ ID NO: 9407737 - DNA, 22 bp, Homo sapiens
tggctctgcgtctgttcgtggg

SEQ ID NO: 9407738 - DNA, 21 bp, Homo sapiens
tggctctgctcagagcagtcc

SEQ ID NO: 9407739 - DNA, 21 bp, Homo sapiens
tggctctgctcagagcagtcc

SEQ ID NO: 9407740 - DNA, 21 bp, Homo sapiens
tggctctgctcagagcagtcc

SEQ ID NO: 9407741 - DNA, 22 bp, Homo sapiens
tggctctgcacctcagtgtacc

SEQ ID NO: 9407742 - DNA, 22 bp, Homo sapiens
tggctctgcagcagtgtgcgtg

SEQ ID NO: 9407743 - DNA, 22 bp, Homo sapiens
tggctctgcacctcagtgtacc

SEQ ID NO: 9407744 - DNA, 18 bp, Homo sapiens
tggctctgcagccagatg

SEQ ID NO: 9407745 - DNA, 18 bp, Homo sapiens
tggctctgcagccagatg

SEQ ID NO: 9407746 - DNA, 22 bp, Homo sapiens
tggctctgatgggaggtattgg

SEQ ID NO: 9407747 - DNA, 22 bp, Homo sapiens
tggctctgcacctcagtgtacc

SEQ ID NO: 9407748 - DNA, 22 bp, Homo sapiens
tggctctgatcagatgtccagt

SEQ ID NO: 9407749 - DNA, 22 bp, Homo sapiens
tggctctgatcagatgtccagt

SEQ ID NO: 9407750 - DNA, 18 bp, Homo sapiens
tggctctgccactcaccg

SEQ ID NO: 9407751 - DNA, 18 bp, Homo sapiens
tggctctgccactcaccg

SEQ ID NO: 9407752 - DNA, 18 bp, Homo sapiens
tggctctgccactcaccg

SEQ ID NO: 9407753 - DNA, 18 bp, Homo sapiens
tggctctgccactcaccg

SEQ ID NO: 9407754 - DNA, 18 bp, Homo sapiens
tggctctgccactcaccg

SEQ ID NO: 9407755 - DNA, 22 bp, Homo sapiens
tggctctgccccatacccctgc

SEQ ID NO: 9407756 - DNA, 18 bp, Homo sapiens
tggctctgcagccagatg

SEQ ID NO: 9407757 - DNA, 22 bp, Homo sapiens
tggctctgccacctttccctaa

SEQ ID NO: 9407758 - DNA, 22 bp, Homo sapiens
tggctctgccacctttccctaa

SEQ ID NO: 9407759 - DNA, 22 bp, Homo sapiens
tggctctgccactaacttggta

SEQ ID NO: 9407760 - DNA, 22 bp, Homo sapiens
tggctctgccactaacttggta

SEQ ID NO: 9407761 - DNA, 23 bp, Homo sapiens
tggctctgtggatccctcaggag

SEQ ID NO: 9407762 - DNA, 23 bp, Homo sapiens
tggctctgtggatccctcaggag

SEQ ID NO: 9407763 - DNA, 23 bp, Homo sapiens
tggctctgtggatccctcaggag

SEQ ID NO: 9407764 - DNA, 23 bp, Homo sapiens
tggctctgtgtcacatacaggat

SEQ ID NO: 9407765 - DNA, 22 bp, Homo sapiens
tggctctgtggtcttagcatgc

SEQ ID NO: 9407766 - DNA, 22 bp, Homo sapiens
tggctctgtggatgttctgacc

SEQ ID NO: 9407767 - DNA, 22 bp, Homo sapiens
tggctctgtggatgttctgacc

SEQ ID NO: 9407768 - DNA, 22 bp, Homo sapiens
tggctctgtggatgttctgacc

SEQ ID NO: 9407769 - DNA, 22 bp, Homo sapiens
tggctctgtcgccgtttggaat

SEQ ID NO: 9407770 - DNA, 22 bp, Homo sapiens
tggctctgtcgccgtttggaat

SEQ ID NO: 9407771 - DNA, 22 bp, Homo sapiens
tggctctggggacagtaagtcc

SEQ ID NO: 9407772 - DNA, 22 bp, Homo sapiens
tggctctgtgaacagacgactg

SEQ ID NO: 9407773 - DNA, 22 bp, Homo sapiens
tggctctgtgaacagacgactg

SEQ ID NO: 9407774 - DNA, 22 bp, Homo sapiens
tggctctgtgcttctagtatct

SEQ ID NO: 9407775 - DNA, 22 bp, Homo sapiens
tggctctgtgcttctagtatct

SEQ ID NO: 9407776 - DNA, 22 bp, Homo sapiens
tggctctgggaatctgttgctt

SEQ ID NO: 9407777 - DNA, 22 bp, Homo sapiens
tggctctggcgtgaagcccaga

SEQ ID NO: 9407778 - DNA, 22 bp, Homo sapiens
tggctctgggaatctgttgctt

SEQ ID NO: 9407779 - DNA, 22 bp, Homo sapiens
tggctctgggaatgggaagatg

SEQ ID NO: 9407780 - DNA, 22 bp, Homo sapiens
tggctctgggcaccgtgtccac

SEQ ID NO: 9407781 - DNA, 22 bp, Homo sapiens
tggctctgggaatgggaagatg

SEQ ID NO: 9407782 - DNA, 22 bp, Homo sapiens
tggctctggccaccgggagggc

SEQ ID NO: 9407783 - DNA, 22 bp, Homo sapiens
tggctctggcgtgaagcccaga

SEQ ID NO: 9407784 - DNA, 22 bp, Homo sapiens
tggctctggccaccgggagggc

SEQ ID NO: 9407785 - DNA, 22 bp, Homo sapiens
tggctctggccaccgggagggc

SEQ ID NO: 9407786 - DNA, 22 bp, Homo sapiens
tggctctggattaatctaggaa

SEQ ID NO: 9407787 - DNA, 22 bp, Homo sapiens
tggctctggagctggcggctga

SEQ ID NO: 9407788 - DNA, 22 bp, Homo sapiens
tggctctggattaatctaggaa

SEQ ID NO: 9407789 - DNA, 19 bp, Homo sapiens
tggctctgtttctctggag

SEQ ID NO: 9407790 - DNA, 19 bp, Homo sapiens
tggctctgtttctctggag

SEQ ID NO: 9407791 - DNA, 22 bp, Homo sapiens
tggctctgttgtgctgagccag

SEQ ID NO: 9407792 - DNA, 22 bp, Homo sapiens
tggctctgttgtgctgagccag

SEQ ID NO: 9407793 - DNA, 22 bp, Homo sapiens
tggctctgttttatgagtacca

SEQ ID NO: 9407794 - DNA, 22 bp, Homo sapiens
tggctcttaaggtccctgtgct

SEQ ID NO: 9407795 - DNA, 22 bp, Homo sapiens
tggctctgtttgttaactagac

SEQ ID NO: 9407796 - DNA, 22 bp, Homo sapiens
tggctctgtttgttaactagac

SEQ ID NO: 9407797 - DNA, 22 bp, Homo sapiens
tggctctgttttatgagtacca

SEQ ID NO: 9407798 - DNA, 22 bp, Homo sapiens
tggctctgtttgttaactagac

SEQ ID NO: 9407799 - DNA, 19 bp, Homo sapiens
tggctcttgtgggactgca

SEQ ID NO: 9407800 - DNA, 22 bp, Homo sapiens
tggctctttctgtctgggatcc

SEQ ID NO: 9407801 - DNA, 22 bp, Homo sapiens
tggctcttttcacgtcccctct

SEQ ID NO: 9407802 - DNA, 22 bp, Homo sapiens
tggctcttctcaagcattggct

SEQ ID NO: 9407803 - DNA, 22 bp, Homo sapiens
tggctcttaaggtccctgtgct

SEQ ID NO: 9407804 - DNA, 22 bp, Homo sapiens
tggctctgttcgccatcaggag

SEQ ID NO: 9407805 - DNA, 22 bp, Homo sapiens
tggctctgttcgccatcaggag

SEQ ID NO: 9407806 - DNA, 22 bp, Homo sapiens
tggctctgtgtctcccagcagc

SEQ ID NO: 9407807 - DNA, 21 bp, Homo sapiens
tggctctgttcaatatatgga

SEQ ID NO: 9407808 - DNA, 23 bp, Homo sapiens
tggctctgtgtcacatacaggat

SEQ ID NO: 9407809 - DNA, 23 bp, Homo sapiens
tggctctgtgtcacatacaggat

SEQ ID NO: 9407810 - DNA, 22 bp, Homo sapiens
tggctctgtgtctcccagcagc

SEQ ID NO: 9407811 - DNA, 22 bp, Homo sapiens
tggctctgttgaggtatggatt

SEQ ID NO: 9407812 - DNA, 22 bp, Homo sapiens
tggctctgttgctcgcagtttt

SEQ ID NO: 9407813 - DNA, 22 bp, Homo sapiens
tggctctgttgctcgcagtttt

SEQ ID NO: 9407814 - DNA, 22 bp, Homo sapiens
tggctctgttgtaaagaaattt

SEQ ID NO: 9407815 - DNA, 22 bp, Homo sapiens
tggctctgttgtaaagaaattt

SEQ ID NO: 9407816 - DNA, 22 bp, Homo sapiens
tggctctgttcgccatcaggag

SEQ ID NO: 9407817 - DNA, 22 bp, Homo sapiens
tggctctgttgaggtatggatt

SEQ ID NO: 9407818 - DNA, 22 bp, Homo sapiens
tggctctgttgaggtatggatt

SEQ ID NO: 9407819 - DNA, 22 bp, Homo sapiens
tggctctgttcgccatcaggag

SEQ ID NO: 9407820 - DNA, 23 bp, Homo sapiens
tggctgagcccactatcttggcc

SEQ ID NO: 9407821 - DNA, 23 bp, Homo sapiens
tggctgagcccactatcttggcc

SEQ ID NO: 9407822 - DNA, 22 bp, Homo sapiens
tggctgagcctttggggctttc

SEQ ID NO: 9407823 - DNA, 22 bp, Homo sapiens
tggctgagcctttggggctttc

SEQ ID NO: 9407824 - DNA, 23 bp, Homo sapiens
tggctgagcccactatcttggcc

SEQ ID NO: 9407825 - DNA, 22 bp, Homo sapiens
tggctgagccacttgttcagat

SEQ ID NO: 9407826 - DNA, 21 bp, Homo sapiens
tggctgagccaggtgtgtgga

SEQ ID NO: 9407827 - DNA, 21 bp, Homo sapiens
tggctgagccaggtgtgtgga

SEQ ID NO: 9407828 - DNA, 21 bp, Homo sapiens
tggctgagccaggtgtgtgga

SEQ ID NO: 9407829 - DNA, 22 bp, Homo sapiens
tggctgagagcaattgactctg

SEQ ID NO: 9407830 - DNA, 22 bp, Homo sapiens
tggctgagagtcatcctgtgtg

SEQ ID NO: 9407831 - DNA, 22 bp, Homo sapiens
tggctgagagcaattgactctg

SEQ ID NO: 9407832 - DNA, 23 bp, Homo sapiens
tggctgagatcctactgtttgct

SEQ ID NO: 9407833 - DNA, 22 bp, Homo sapiens
tggctgagccacttgttcagat

SEQ ID NO: 9407834 - DNA, 23 bp, Homo sapiens
tggctgagatcctactgtttgct

SEQ ID NO: 9407835 - DNA, 22 bp, Homo sapiens
tggctgagagtcatcctgtgtg

SEQ ID NO: 9407836 - DNA, 19 bp, Homo sapiens
tggctctttttatgacatt

SEQ ID NO: 9407837 - DNA, 22 bp, Homo sapiens
tggctctttctgtctgggatcc

SEQ ID NO: 9407838 - DNA, 22 bp, Homo sapiens
tggctgacaatgtagcagtaac

SEQ ID NO: 9407839 - DNA, 22 bp, Homo sapiens
tggctgacaaataggtgcagtt

SEQ ID NO: 9407840 - DNA, 22 bp, Homo sapiens
tggctgagaagttctggtggga

SEQ ID NO: 9407841 - DNA, 22 bp, Homo sapiens
tggctgagaagttctggtggga

SEQ ID NO: 9407842 - DNA, 22 bp, Homo sapiens
tggctgagaagttctggtggga

SEQ ID NO: 9407843 - DNA, 22 bp, Homo sapiens
tggctgagaagttctggtggga

SEQ ID NO: 9407844 - DNA, 22 bp, Homo sapiens
tggctgagaaaatggttttagg

SEQ ID NO: 9407845 - DNA, 22 bp, Homo sapiens
tggctgagaaaaaagagctata

SEQ ID NO: 9407846 - DNA, 22 bp, Homo sapiens
tggctgagaaaatggttttagg

SEQ ID NO: 9407847 - DNA, 22 bp, Homo sapiens
tggctgagaaaaaagagctata

SEQ ID NO: 9407848 - DNA, 22 bp, Homo sapiens
tggctgagaaaaaagagctata

SEQ ID NO: 9407849 - DNA, 22 bp, Homo sapiens
tggctgagaaaaaagagctata

SEQ ID NO: 9407850 - DNA, 22 bp, Homo sapiens
tggctgagaaaaaagagctata

SEQ ID NO: 9407851 - DNA, 22 bp, Homo sapiens
tggctgagaaaaaagagctata

SEQ ID NO: 9407852 - DNA, 19 bp, Homo sapiens
tggctgagctggactgagg

SEQ ID NO: 9407853 - DNA, 22 bp, Homo sapiens
tggctgaggagagggcggaagt

SEQ ID NO: 9407854 - DNA, 19 bp, Homo sapiens
tggctgagctggactgagg

SEQ ID NO: 9407855 - DNA, 22 bp, Homo sapiens
tggctgaggagagggcggaagt

SEQ ID NO: 9407856 - DNA, 22 bp, Homo sapiens
tggctgaggagagggcggaagt

SEQ ID NO: 9407857 - DNA, 22 bp, Homo sapiens
tggctgaggagggtcttctggt

SEQ ID NO: 9407858 - DNA, 22 bp, Homo sapiens
tggctgaggagggtcttctggt

SEQ ID NO: 9407859 - DNA, 22 bp, Homo sapiens
tggctgaggagggtcttctggt

SEQ ID NO: 9407860 - DNA, 22 bp, Homo sapiens
tggctgaggcacagctgccgcc

SEQ ID NO: 9407861 - DNA, 22 bp, Homo sapiens
tggctgagctccctgtgtgttg

SEQ ID NO: 9407862 - DNA, 22 bp, Homo sapiens
tggctgagctccctgtgtgttg

SEQ ID NO: 9407863 - DNA, 22 bp, Homo sapiens
tggctgagctgcagcgtggctt

SEQ ID NO: 9407864 - DNA, 22 bp, Homo sapiens
tggctgagcctttggggctttc

SEQ ID NO: 9407865 - DNA, 22 bp, Homo sapiens
tggctgagctccctgtgtgttg

SEQ ID NO: 9407866 - DNA, 19 bp, Homo sapiens
tggctgagctggactgagg

SEQ ID NO: 9407867 - DNA, 19 bp, Homo sapiens
tggctgagctggactgagg

SEQ ID NO: 9407868 - DNA, 22 bp, Homo sapiens
tggctgagctgcagcgtggctt

SEQ ID NO: 9407869 - DNA, 22 bp, Homo sapiens
tggctgagctgcagcgtggctt

SEQ ID NO: 9407870 - DNA, 22 bp, Homo sapiens
tggctgagctgcagcgtggctt

SEQ ID NO: 9407871 - DNA, 22 bp, Homo sapiens
tggctgagctgcagcgtggctt

SEQ ID NO: 9407872 - DNA, 22 bp, Homo sapiens
tggctgagtaagttgtgatatg

SEQ ID NO: 9407873 - DNA, 22 bp, Homo sapiens
tggctgaggttatgctggttgt

SEQ ID NO: 9407874 - DNA, 22 bp, Homo sapiens
tggctgagtgaacatgtccatt

SEQ ID NO: 9407875 - DNA, 22 bp, Homo sapiens
tggctgagtaagttgtgatatg

SEQ ID NO: 9407876 - DNA, 22 bp, Homo sapiens
tggctgaggttatgctggttgt

SEQ ID NO: 9407877 - DNA, 22 bp, Homo sapiens
tggctgaggtctggggcttctg

SEQ ID NO: 9407878 - DNA, 22 bp, Homo sapiens
tggctgaggttatgctggttgt

SEQ ID NO: 9407879 - DNA, 22 bp, Homo sapiens
tggctgaggcttttcttaaaga

SEQ ID NO: 9407880 - DNA, 22 bp, Homo sapiens
tggctgagggcactatgaagcc

SEQ ID NO: 9407881 - DNA, 22 bp, Homo sapiens
tggctgagggcactatgaagcc

SEQ ID NO: 9407882 - DNA, 22 bp, Homo sapiens
tggctgaggcttttcttaaaga

SEQ ID NO: 9407883 - DNA, 22 bp, Homo sapiens
tggctgaggctggagtgcagtg

SEQ ID NO: 9407884 - DNA, 22 bp, Homo sapiens
tggctgaggctggagtgcagtg

SEQ ID NO: 9407885 - DNA, 22 bp, Homo sapiens
tggctgaggcttttcttaaaga

SEQ ID NO: 9407886 - DNA, 22 bp, Homo sapiens
tggctgagggcactatgaagcc

SEQ ID NO: 9407887 - DNA, 22 bp, Homo sapiens
tggctgaggctggagtgcagtg

SEQ ID NO: 9407888 - DNA, 22 bp, Homo sapiens
tggctgaggctggagtgcagtg

SEQ ID NO: 9407889 - DNA, 22 bp, Homo sapiens
tggctgaggcacagctgccgcc

SEQ ID NO: 9407890 - DNA, 22 bp, Homo sapiens
tggctgaggcacagctgccgcc

SEQ ID NO: 9407891 - DNA, 22 bp, Homo sapiens
tggctgaggctggagtgcagtg

SEQ ID NO: 9407892 - DNA, 22 bp, Homo sapiens
tggctgaggctggagtgcagtg

SEQ ID NO: 9407893 - DNA, 22 bp, Homo sapiens
tggctgctgagaaggcagctgt

SEQ ID NO: 9407894 - DNA, 22 bp, Homo sapiens
tggctgctctcttccccagggt

SEQ ID NO: 9407895 - DNA, 22 bp, Homo sapiens
tggctgccatgacgcctgggga

SEQ ID NO: 9407896 - DNA, 22 bp, Homo sapiens
tggctgccatgacgcctgggga

SEQ ID NO: 9407897 - DNA, 22 bp, Homo sapiens
tggctgccaagcaggtcagaga

SEQ ID NO: 9407898 - DNA, 22 bp, Homo sapiens
tggctgccaagcaggtcagaga

SEQ ID NO: 9407899 - DNA, 22 bp, Homo sapiens
tggctgccaatggcttggaaag

SEQ ID NO: 9407900 - DNA, 22 bp, Homo sapiens
tggctgcagttcacaggagcaa

SEQ ID NO: 9407901 - DNA, 22 bp, Homo sapiens
tggctgcagttgggccctcaga

SEQ ID NO: 9407902 - DNA, 22 bp, Homo sapiens
tggctgcagttcacaggagcaa

SEQ ID NO: 9407903 - DNA, 22 bp, Homo sapiens
tggctgcagttcacaggagcaa

SEQ ID NO: 9407904 - DNA, 22 bp, Homo sapiens
tggctgctgcttggtcttcttc

SEQ ID NO: 9407905 - DNA, 22 bp, Homo sapiens
tggctgctgctcactcagcctc

SEQ ID NO: 9407906 - DNA, 22 bp, Homo sapiens
tggctgctgctcactcagcctc

SEQ ID NO: 9407907 - DNA, 22 bp, Homo sapiens
tggctgctgctcactcagcctc

SEQ ID NO: 9407908 - DNA, 18 bp, Homo sapiens
tggctgctggagtagggt

SEQ ID NO: 9407909 - DNA, 21 bp, Homo sapiens
tggctgctggccctctctcca

SEQ ID NO: 9407910 - DNA, 22 bp, Homo sapiens
tggctgctgtgggtagagggat

SEQ ID NO: 9407911 - DNA, 22 bp, Homo sapiens
tggctggaatatgtggagacca

SEQ ID NO: 9407912 - DNA, 22 bp, Homo sapiens
tggctggaatggagctgagcct

SEQ ID NO: 9407913 - DNA, 22 bp, Homo sapiens
tggctggaagtcagaaatggga

SEQ ID NO: 9407914 - DNA, 22 bp, Homo sapiens
tggctggaaacaggagattcag

SEQ ID NO: 9407915 - DNA, 22 bp, Homo sapiens
tggctgcttaaaattgctgcaa

SEQ ID NO: 9407916 - DNA, 18 bp, Homo sapiens
tggctgcttccaggtaca

SEQ ID NO: 9407917 - DNA, 22 bp, Homo sapiens
tggctgcagatcaagggcaggc

SEQ ID NO: 9407918 - DNA, 22 bp, Homo sapiens
tggctgcagatcaagggcaggc

SEQ ID NO: 9407919 - DNA, 22 bp, Homo sapiens
tggctgcagatctgtgggacac

SEQ ID NO: 9407920 - DNA, 22 bp, Homo sapiens
tggctgcagacacctatggcag

SEQ ID NO: 9407921 - DNA, 20 bp, Homo sapiens
tggctgcacaccaggacagg

SEQ ID NO: 9407922 - DNA, 20 bp, Homo sapiens
tggctgcacaccaggacagg

SEQ ID NO: 9407923 - DNA, 22 bp, Homo sapiens
tggctgagtttcatgcatcatg

SEQ ID NO: 9407924 - DNA, 21 bp, Homo sapiens
tggctgcaagcagctgcctcc

SEQ ID NO: 9407925 - DNA, 22 bp, Homo sapiens
tggctgagttctccaggagtag

SEQ ID NO: 9407926 - DNA, 22 bp, Homo sapiens
tggctgagtttcatgcatcatg

SEQ ID NO: 9407927 - DNA, 22 bp, Homo sapiens
tggctgagtttcatgcatcatg

SEQ ID NO: 9407928 - DNA, 22 bp, Homo sapiens
tggctgagttctccaggagtag

SEQ ID NO: 9407929 - DNA, 22 bp, Homo sapiens
tggctgagtgttccaaggagca

SEQ ID NO: 9407930 - DNA, 21 bp, Homo sapiens
tggctgagtggatgcatgaat

SEQ ID NO: 9407931 - DNA, 21 bp, Homo sapiens
tggctgagtggatgcatgaat

SEQ ID NO: 9407932 - DNA, 22 bp, Homo sapiens
tggctgagtgttccaaggagca

SEQ ID NO: 9407933 - DNA, 21 bp, Homo sapiens
tggctgagtggatgcatgaat

SEQ ID NO: 9407934 - DNA, 22 bp, Homo sapiens
tggctgagtgatatttgcaaag

SEQ ID NO: 9407935 - DNA, 21 bp, Homo sapiens
tggctgagtggatgcatgaat

SEQ ID NO: 9407936 - DNA, 22 bp, Homo sapiens
tggctgagtgatatttgcaaag

SEQ ID NO: 9407937 - DNA, 22 bp, Homo sapiens
tggctgagtgatatttgcaaag

SEQ ID NO: 9407938 - DNA, 22 bp, Homo sapiens
tggctgagtgaacatgtccatt

SEQ ID NO: 9407939 - DNA, 22 bp, Homo sapiens
tggctgagtaagttgtgatatg

SEQ ID NO: 9407940 - DNA, 22 bp, Homo sapiens
tggctgagttctccaggagtag

SEQ ID NO: 9407941 - DNA, 22 bp, Homo sapiens
tggctgagttctccaggagtag

SEQ ID NO: 9407942 - DNA, 22 bp, Homo sapiens
tggctgagttctccaggagtag

SEQ ID NO: 9407943 - DNA, 22 bp, Homo sapiens
tggctgagttcctggcacacgg

SEQ ID NO: 9407944 - DNA, 22 bp, Homo sapiens
tggctgagttcctggcacacgg

SEQ ID NO: 9407945 - DNA, 22 bp, Homo sapiens
tggctgagttacgaacagagca

SEQ ID NO: 9407946 - DNA, 22 bp, Homo sapiens
tggctgagtgttccaaggagca

SEQ ID NO: 9407947 - DNA, 22 bp, Homo sapiens
tggctgagttacgaacagagca

SEQ ID NO: 9407948 - DNA, 22 bp, Homo sapiens
tggctgagttacgaacagagca

SEQ ID NO: 9407949 - DNA, 22 bp, Homo sapiens
tggctgagtgttccaaggagca

SEQ ID NO: 9407950 - DNA, 22 bp, Homo sapiens
tggctgagttcctggcacacgg

SEQ ID NO: 9407951 - DNA, 22 bp, Homo sapiens
tggctgagttacgaacagagca

SEQ ID NO: 9407952 - DNA, 22 bp, Homo sapiens
tggctcagagccttgagagctg

SEQ ID NO: 9407953 - DNA, 22 bp, Homo sapiens
tggctcagagcagggactctgg

SEQ ID NO: 9407954 - DNA, 22 bp, Homo sapiens
tggctcagagccttgagagctg

SEQ ID NO: 9407955 - DNA, 22 bp, Homo sapiens
tggctcagaggggaagtggttt

SEQ ID NO: 9407956 - DNA, 22 bp, Homo sapiens
tggctcagagccttgagagctg

SEQ ID NO: 9407957 - DNA, 22 bp, Homo sapiens
tggctcagagccttgagagctg

SEQ ID NO: 9407958 - DNA, 22 bp, Homo sapiens
tggctcagaaggctgccttcac

SEQ ID NO: 9407959 - DNA, 22 bp, Homo sapiens
tggctcagaagaaaaggtaaac

SEQ ID NO: 9407960 - DNA, 22 bp, Homo sapiens
tggctcagagagggagtgtgga

SEQ ID NO: 9407961 - DNA, 18 bp, Homo sapiens
tggctcagatggctttaa

SEQ ID NO: 9407962 - DNA, 22 bp, Homo sapiens
tggctcagatgctcttccagtg

SEQ ID NO: 9407963 - DNA, 22 bp, Homo sapiens
tggctcagatgctcttccagtg

SEQ ID NO: 9407964 - DNA, 22 bp, Homo sapiens
tggctcagatgctcttccagtg

SEQ ID NO: 9407965 - DNA, 18 bp, Homo sapiens
tggctcagatggctttaa

SEQ ID NO: 9407966 - DNA, 18 bp, Homo sapiens
tggctcagatggctttaa

SEQ ID NO: 9407967 - DNA, 22 bp, Homo sapiens
tggctcagatttttgtaggctt

SEQ ID NO: 9407968 - DNA, 22 bp, Homo sapiens
tggctcagaggggaagtggttt

SEQ ID NO: 9407969 - DNA, 22 bp, Homo sapiens
tggctcagataattcaaggggc

SEQ ID NO: 9407970 - DNA, 22 bp, Homo sapiens
tggctcagagttcatcttttag

SEQ ID NO: 9407971 - DNA, 22 bp, Homo sapiens
tggctcagagttcatcttttag

SEQ ID NO: 9407972 - DNA, 22 bp, Homo sapiens
tggctcagatgctcttccagtg

SEQ ID NO: 9407973 - DNA, 22 bp, Homo sapiens
tggctcagataattcaaggggc

SEQ ID NO: 9407974 - DNA, 22 bp, Homo sapiens
tggctcagagttcatcttttag

SEQ ID NO: 9407975 - DNA, 22 bp, Homo sapiens
tggctcaccttcagaatatacc

SEQ ID NO: 9407976 - DNA, 22 bp, Homo sapiens
tggctcacaatctcccatgaag

SEQ ID NO: 9407977 - DNA, 22 bp, Homo sapiens
tggctcacaggactctctgggc

SEQ ID NO: 9407978 - DNA, 22 bp, Homo sapiens
tggctcacaatctcccatgaag

SEQ ID NO: 9407979 - DNA, 22 bp, Homo sapiens
tggctcagaactacttctagtt

SEQ ID NO: 9407980 - DNA, 22 bp, Homo sapiens
tggctcagaactacttctagtt

SEQ ID NO: 9407981 - DNA, 22 bp, Homo sapiens
tggctcacttccgtggagaggt

SEQ ID NO: 9407982 - DNA, 22 bp, Homo sapiens
tggctcactgtagccttgacct

SEQ ID NO: 9407983 - DNA, 22 bp, Homo sapiens
tggctcactgtagccttgacct

SEQ ID NO: 9407984 - DNA, 22 bp, Homo sapiens
tggctcagaagaaaaggtaaac

SEQ ID NO: 9407985 - DNA, 22 bp, Homo sapiens
tggctcagaactacttctagtt

SEQ ID NO: 9407986 - DNA, 22 bp, Homo sapiens
tggcggctttaattatcacttg

SEQ ID NO: 9407987 - DNA, 22 bp, Homo sapiens
tggcggcgtgtggactgaggac

SEQ ID NO: 9407988 - DNA, 22 bp, Homo sapiens
tggcgcgacgtgccccctgctt

SEQ ID NO: 9407989 - DNA, 22 bp, Homo sapiens
tggcggagttccagctgggatc

SEQ ID NO: 9407990 - DNA, 22 bp, Homo sapiens
tggcgcgctcgctctcgctgag

SEQ ID NO: 9407991 - DNA, 22 bp, Homo sapiens
tggctagtaggtgagtagtgct

SEQ ID NO: 9407992 - DNA, 23 bp, Homo sapiens
tggctaaacagtggagaaagctt

SEQ ID NO: 9407993 - DNA, 20 bp, Homo sapiens
tggcggggatgagggagtta

SEQ ID NO: 9407994 - DNA, 20 bp, Homo sapiens
tggcggggatgagggagtta

SEQ ID NO: 9407995 - DNA, 22 bp, Homo sapiens
tggcctggccctgaggccctgt

SEQ ID NO: 9407996 - DNA, 22 bp, Homo sapiens
tggcctggctcacagtgagatt

SEQ ID NO: 9407997 - DNA, 22 bp, Homo sapiens
tggcctggccctgaggccctgt

SEQ ID NO: 9407998 - DNA, 22 bp, Homo sapiens
tggcctgggtcacaccagggtc

SEQ ID NO: 9407999 - DNA, 22 bp, Homo sapiens
tggcctgggtgctgctgacatc

SEQ ID NO: 9408000 - DNA, 22 bp, Homo sapiens
tggcctggtccttgtcaaggca

SEQ ID NO: 9408001 - DNA, 22 bp, Homo sapiens
tggcctggtaccacatagattt

SEQ ID NO: 9408002 - DNA, 22 bp, Homo sapiens
tggcctgggtgctgctgacatc

SEQ ID NO: 9408003 - DNA, 22 bp, Homo sapiens
tggcctgggtgctgctgacatc

SEQ ID NO: 9408004 - DNA, 22 bp, Homo sapiens
tggcctggtgtctgcgaggcct

SEQ ID NO: 9408005 - DNA, 22 bp, Homo sapiens
tggcctggtgtctgcgaggcct

SEQ ID NO: 9408006 - DNA, 22 bp, Homo sapiens
tggcctggtgctcaggcagtag

SEQ ID NO: 9408007 - DNA, 22 bp, Homo sapiens
tggcctggtgctcaggcagtag

SEQ ID NO: 9408008 - DNA, 22 bp, Homo sapiens
tggcctggtgtctgcgaggcct

SEQ ID NO: 9408009 - DNA, 22 bp, Homo sapiens
tggcctggtccttgtcaaggca

SEQ ID NO: 9408010 - DNA, 22 bp, Homo sapiens
tggcctggtgctcaggcagtag

SEQ ID NO: 9408011 - DNA, 22 bp, Homo sapiens
tggcctggtgctcaggcagtag

SEQ ID NO: 9408012 - DNA, 22 bp, Homo sapiens
tggcgaggtttcagagagcggc

SEQ ID NO: 9408013 - DNA, 22 bp, Homo sapiens
tggcgaggtttcagagagcggc

SEQ ID NO: 9408014 - DNA, 18 bp, Homo sapiens
tggcgatggtcatttttc

SEQ ID NO: 9408015 - DNA, 22 bp, Homo sapiens
tggcgagccccgactgagtgtt

SEQ ID NO: 9408016 - DNA, 22 bp, Homo sapiens
tggcgagcatccagcgcatcca

SEQ ID NO: 9408017 - DNA, 22 bp, Homo sapiens
tggcgaggccaggccagggcct

SEQ ID NO: 9408018 - DNA, 22 bp, Homo sapiens
tggccttggtcctctttgcaat

SEQ ID NO: 9408019 - DNA, 22 bp, Homo sapiens
tggccttggccgtgctggggtc

SEQ ID NO: 9408020 - DNA, 22 bp, Homo sapiens
tggccttcctggtgactcatga

SEQ ID NO: 9408021 - DNA, 22 bp, Homo sapiens
tggccttgaaccaggtctccac

SEQ ID NO: 9408022 - DNA, 22 bp, Homo sapiens
tggcctgttgctcctaggggtc

SEQ ID NO: 9408023 - DNA, 22 bp, Homo sapiens
tggcctgttgctcctaggggtc

SEQ ID NO: 9408024 - DNA, 22 bp, Homo sapiens
tggcctgtgtggcttcctggga

SEQ ID NO: 9408025 - DNA, 22 bp, Homo sapiens
tggcctgtcttgttgtgctaga

SEQ ID NO: 9408026 - DNA, 22 bp, Homo sapiens
tggccttggagaggcacggccc

SEQ ID NO: 9408027 - DNA, 22 bp, Homo sapiens
tggccttgataactggggagag

SEQ ID NO: 9408028 - DNA, 22 bp, Homo sapiens
tggctcctaatgctgcccagac

SEQ ID NO: 9408029 - DNA, 22 bp, Homo sapiens
tggctcctatcaaggagtgggt

SEQ ID NO: 9408030 - DNA, 22 bp, Homo sapiens
tggctcctaggatggtgcctgg

SEQ ID NO: 9408031 - DNA, 22 bp, Homo sapiens
tggctccatgatagttcttaca

SEQ ID NO: 9408032 - DNA, 22 bp, Homo sapiens
tggctccaggggacacgcagta

SEQ ID NO: 9408033 - DNA, 22 bp, Homo sapiens
tggctccatcatccatgcaaga

SEQ ID NO: 9408034 - DNA, 19 bp, Homo sapiens
tggctcctgcctgccttct

SEQ ID NO: 9408035 - DNA, 19 bp, Homo sapiens
tggctcctgcctgccttct

SEQ ID NO: 9408036 - DNA, 18 bp, Homo sapiens
tggctcctgcctcctgca

SEQ ID NO: 9408037 - DNA, 18 bp, Homo sapiens
tggctcctgcctcctgca

SEQ ID NO: 9408038 - DNA, 18 bp, Homo sapiens
tggctcctgcctcctgca

SEQ ID NO: 9408039 - DNA, 18 bp, Homo sapiens
tggctcctgcctcctgca

SEQ ID NO: 9408040 - DNA, 22 bp, Homo sapiens
tggctcctgcagaccatctgga

SEQ ID NO: 9408041 - DNA, 18 bp, Homo sapiens
tggctcctgcctcctgca

SEQ ID NO: 9408042 - DNA, 22 bp, Homo sapiens
tggctcctgcagaccatctgga

SEQ ID NO: 9408043 - DNA, 22 bp, Homo sapiens
tggctcctgcagaccatctgga

SEQ ID NO: 9408044 - DNA, 22 bp, Homo sapiens
tggctcctcacgtcctcagagc

SEQ ID NO: 9408045 - DNA, 22 bp, Homo sapiens
tggctccaccgccgcggagctc

SEQ ID NO: 9408046 - DNA, 21 bp, Homo sapiens
tggctcagttgctgggcacag

SEQ ID NO: 9408047 - DNA, 21 bp, Homo sapiens
tggctcagttgctgggcacag

SEQ ID NO: 9408048 - DNA, 22 bp, Homo sapiens
tggctcagttccatcatctgga

SEQ ID NO: 9408049 - DNA, 22 bp, Homo sapiens
tggctcagttaggtcagaaaca

SEQ ID NO: 9408050 - DNA, 22 bp, Homo sapiens
tggctcagttccatcatctgga

SEQ ID NO: 9408051 - DNA, 22 bp, Homo sapiens
tggctccagatttcctgctgca

SEQ ID NO: 9408052 - DNA, 22 bp, Homo sapiens
tggctccagccctgagcaagct

SEQ ID NO: 9408053 - DNA, 23 bp, Homo sapiens
tggctccaggagaagccagaagc

SEQ ID NO: 9408054 - DNA, 23 bp, Homo sapiens
tggctccaggagaagccagaagc

SEQ ID NO: 9408055 - DNA, 22 bp, Homo sapiens
tggctcaggagggatctttgct

SEQ ID NO: 9408056 - DNA, 22 bp, Homo sapiens
tggctcaggagggatctttgct

SEQ ID NO: 9408057 - DNA, 22 bp, Homo sapiens
tggctcaggataattttcccaa

SEQ ID NO: 9408058 - DNA, 22 bp, Homo sapiens
tggctcaggagggatctttgct

SEQ ID NO: 9408059 - DNA, 22 bp, Homo sapiens
tggctcaggatctaagcagaat

SEQ ID NO: 9408060 - DNA, 22 bp, Homo sapiens
tggctcaggcctacgacgcctt

SEQ ID NO: 9408061 - DNA, 22 bp, Homo sapiens
tggctcaggcctacgacgcctt

SEQ ID NO: 9408062 - DNA, 22 bp, Homo sapiens
tggctcaggcttgaaaatagat

SEQ ID NO: 9408063 - DNA, 22 bp, Homo sapiens
tggctcaggccacttcttttat

SEQ ID NO: 9408064 - DNA, 22 bp, Homo sapiens
tggctcaggccacttcttttat

SEQ ID NO: 9408065 - DNA, 22 bp, Homo sapiens
tggctcagcaagacattgacct

SEQ ID NO: 9408066 - DNA, 22 bp, Homo sapiens
tggctcagatttttgtaggctt

SEQ ID NO: 9408067 - DNA, 22 bp, Homo sapiens
tggctcagcaggttagaaacta

SEQ ID NO: 9408068 - DNA, 22 bp, Homo sapiens
tggctcagccagccctaggaac

SEQ ID NO: 9408069 - DNA, 22 bp, Homo sapiens
tggctcagcattcactggtctt

SEQ ID NO: 9408070 - DNA, 22 bp, Homo sapiens
tggctcagcattcactggtctt

SEQ ID NO: 9408071 - DNA, 22 bp, Homo sapiens
tggctcagccagccctaggaac

SEQ ID NO: 9408072 - DNA, 22 bp, Homo sapiens
tggctcagccagccctaggaac

SEQ ID NO: 9408073 - DNA, 22 bp, Homo sapiens
tggctcagccagccctaggaac

SEQ ID NO: 9408074 - DNA, 22 bp, Homo sapiens
tggctcagctgtcacagcctgg

SEQ ID NO: 9408075 - DNA, 22 bp, Homo sapiens
tggctcagcttacttttgaggg

SEQ ID NO: 9408076 - DNA, 22 bp, Homo sapiens
tggctcagcttacttttgaggg

SEQ ID NO: 9408077 - DNA, 22 bp, Homo sapiens
tggctcagctttccccatctgg

SEQ ID NO: 9408078 - DNA, 22 bp, Homo sapiens
tggctcagtggcagccgcagct

SEQ ID NO: 9408079 - DNA, 22 bp, Homo sapiens
tggctcagtggcagccgcagct

SEQ ID NO: 9408080 - DNA, 22 bp, Homo sapiens
tggctcagtgcattcacagtaa

SEQ ID NO: 9408081 - DNA, 22 bp, Homo sapiens
tggctcagtgacattcctccca

SEQ ID NO: 9408082 - DNA, 22 bp, Homo sapiens
tggctcagtgacattcctccca

SEQ ID NO: 9408083 - DNA, 22 bp, Homo sapiens
tggctcagtgacattcctccca

SEQ ID NO: 9408084 - DNA, 22 bp, Homo sapiens
tggctcagtcatggatgagtaa

SEQ ID NO: 9408085 - DNA, 22 bp, Homo sapiens
tggctcagtctgggttgactga

SEQ ID NO: 9408086 - DNA, 22 bp, Homo sapiens
tggctcagtgaagagataactt

SEQ ID NO: 9408087 - DNA, 22 bp, Homo sapiens
tggctcagtctgggttgactga

SEQ ID NO: 9408088 - DNA, 22 bp, Homo sapiens
tggctcaggggtctggctctgt

SEQ ID NO: 9408089 - DNA, 22 bp, Homo sapiens
tggctcaggggtctggctctgt

SEQ ID NO: 9408090 - DNA, 22 bp, Homo sapiens
tggctcaggcttgaaaatagat

SEQ ID NO: 9408091 - DNA, 22 bp, Homo sapiens
tggctcaggggtctggctctgt

SEQ ID NO: 9408092 - DNA, 23 bp, Homo sapiens
tggctcagggtctcttatgaagt

SEQ ID NO: 9408093 - DNA, 22 bp, Homo sapiens
tggctcagggtccccaaatggt

SEQ ID NO: 9408094 - DNA, 22 bp, Homo sapiens
tggctcagggtccccaaatggt

SEQ ID NO: 9408095 - DNA, 22 bp, Homo sapiens
tggctcagtagcagtgtggtca

SEQ ID NO: 9408096 - DNA, 22 bp, Homo sapiens
tggctcagtagcagtgtggtca

SEQ ID NO: 9408097 - DNA, 22 bp, Homo sapiens
tggctcaggtgtgagctgaaga

SEQ ID NO: 9408098 - DNA, 22 bp, Homo sapiens
tggctcagtaatcgagtctcct

SEQ ID NO: 9408099 - DNA, 22 bp, Homo sapiens
tggctcagtaatcgagtctcct

SEQ ID NO: 9408100 - DNA, 23 bp, Homo sapiens
tggctggcagaaactgaagcatg

SEQ ID NO: 9408101 - DNA, 23 bp, Homo sapiens
tggctggcagaaactgaagcatg

SEQ ID NO: 9408102 - DNA, 22 bp, Homo sapiens
tggctggcagtaggctagtggc

SEQ ID NO: 9408103 - DNA, 22 bp, Homo sapiens
tggctggcagtaggctagtggc

SEQ ID NO: 9408104 - DNA, 22 bp, Homo sapiens
tggctggcagtaggctagtggc

SEQ ID NO: 9408105 - DNA, 22 bp, Homo sapiens
tggctggccctgggagtgcaga

SEQ ID NO: 9408106 - DNA, 22 bp, Homo sapiens
tggctggcgccgggctagccac

SEQ ID NO: 9408107 - DNA, 22 bp, Homo sapiens
tggctggcgccgggctagccac

SEQ ID NO: 9408108 - DNA, 22 bp, Homo sapiens
tggctggcatagccattgctcc

SEQ ID NO: 9408109 - DNA, 22 bp, Homo sapiens
tggctggcatagccattgctcc

SEQ ID NO: 9408110 - DNA, 22 bp, Homo sapiens
tggctggcatagccattgctcc

SEQ ID NO: 9408111 - DNA, 18 bp, Homo sapiens
tggctggcagtgggcagc

SEQ ID NO: 9408112 - DNA, 22 bp, Homo sapiens
tggctggcagttatctttggat

SEQ ID NO: 9408113 - DNA, 22 bp, Homo sapiens
tggctggcagttatctttggat

SEQ ID NO: 9408114 - DNA, 22 bp, Homo sapiens
tggctggcatagccattgctcc

SEQ ID NO: 9408115 - DNA, 22 bp, Homo sapiens
tggctggcgccgggctagccac

SEQ ID NO: 9408116 - DNA, 22 bp, Homo sapiens
tggctggcgccgggctagccac

SEQ ID NO: 9408117 - DNA, 23 bp, Homo sapiens
tggctggcgcctgcctcaccctg

SEQ ID NO: 9408118 - DNA, 23 bp, Homo sapiens
tggctggcgcctgcctcaccctg

SEQ ID NO: 9408119 - DNA, 22 bp, Homo sapiens
tggctggcgttggggccagtga

SEQ ID NO: 9408120 - DNA, 22 bp, Homo sapiens
tggctggctagaatggaaatgt

SEQ ID NO: 9408121 - DNA, 22 bp, Homo sapiens
tggctggcgttggggccagtga

SEQ ID NO: 9408122 - DNA, 22 bp, Homo sapiens
tggctgggagctggaactgggc

SEQ ID NO: 9408123 - DNA, 22 bp, Homo sapiens
tggctgggagctggaactgggc

SEQ ID NO: 9408124 - DNA, 22 bp, Homo sapiens
tggctgggagctggaactgggc

SEQ ID NO: 9408125 - DNA, 22 bp, Homo sapiens
tggctgggagctggaactgggc

SEQ ID NO: 9408126 - DNA, 22 bp, Homo sapiens
tggctgggcccccacctgcctc

SEQ ID NO: 9408127 - DNA, 22 bp, Homo sapiens
tggctgggcccccacctgcctc

SEQ ID NO: 9408128 - DNA, 22 bp, Homo sapiens
tggctggcaaggctggagtcag

SEQ ID NO: 9408129 - DNA, 22 bp, Homo sapiens
tggctggcaaggctggagtcag

SEQ ID NO: 9408130 - DNA, 22 bp, Homo sapiens
tggctggcaaggctggagtcag

SEQ ID NO: 9408131 - DNA, 22 bp, Homo sapiens
tggctggcaaggctggagtcag

SEQ ID NO: 9408132 - DNA, 22 bp, Homo sapiens
tggctggattattggctagtac

SEQ ID NO: 9408133 - DNA, 22 bp, Homo sapiens
tggctggatgtgagatcaagag

SEQ ID NO: 9408134 - DNA, 22 bp, Homo sapiens
tggctggatatcaggcaagggg

SEQ ID NO: 9408135 - DNA, 22 bp, Homo sapiens
tggctggagtctggtgctagcc

SEQ ID NO: 9408136 - DNA, 22 bp, Homo sapiens
tggctggagtgggagaagttta

SEQ ID NO: 9408137 - DNA, 22 bp, Homo sapiens
tggctggagtataggagtagga

SEQ ID NO: 9408138 - DNA, 22 bp, Homo sapiens
tggctggataatattctgttgt

SEQ ID NO: 9408139 - DNA, 21 bp, Homo sapiens
tggctggatagatgggaactg

SEQ ID NO: 9408140 - DNA, 22 bp, Homo sapiens
tggctggatatcagaggaagtg

SEQ ID NO: 9408141 - DNA, 22 bp, Homo sapiens
tggctggacagtgggcagtgga

SEQ ID NO: 9408142 - DNA, 22 bp, Homo sapiens
tggctggagagggtcccatgag

SEQ ID NO: 9408143 - DNA, 19 bp, Homo sapiens
tggctggagatctgctact

SEQ ID NO: 9408144 - DNA, 22 bp, Homo sapiens
tggctggagaacttggggatct

SEQ ID NO: 9408145 - DNA, 22 bp, Homo sapiens
tggctggacctgggctggaatt

SEQ ID NO: 9408146 - DNA, 22 bp, Homo sapiens
tggctggacctgggctggaatt

SEQ ID NO: 9408147 - DNA, 22 bp, Homo sapiens
tggctggagcattccttgtctt

SEQ ID NO: 9408148 - DNA, 22 bp, Homo sapiens
tggctggagcccctcaagagca

SEQ ID NO: 9408149 - DNA, 22 bp, Homo sapiens
tggctggagcgccctcctctgc

SEQ ID NO: 9408150 - DNA, 22 bp, Homo sapiens
tggctggaggaaggaactgagg

SEQ ID NO: 9408151 - DNA, 22 bp, Homo sapiens
tggctggagggttagtgagata

SEQ ID NO: 9408152 - DNA, 22 bp, Homo sapiens
tggctggagggacccactcaga

SEQ ID NO: 9408153 - DNA, 22 bp, Homo sapiens
tggctggaggcatgcaagctcc

SEQ ID NO: 9408154 - DNA, 22 bp, Homo sapiens
tggctgtgtccctgtccagagt

SEQ ID NO: 9408155 - DNA, 22 bp, Homo sapiens
tggcttaatatttcatatttaa

SEQ ID NO: 9408156 - DNA, 22 bp, Homo sapiens
tggctgtgttaccacttcatgt

SEQ ID NO: 9408157 - DNA, 22 bp, Homo sapiens
tggctgtgttaccacttcatgt

SEQ ID NO: 9408158 - DNA, 22 bp, Homo sapiens
tggctgtgtgccaggctgtctg

SEQ ID NO: 9408159 - DNA, 22 bp, Homo sapiens
tggcttcacacaggcacttccg

SEQ ID NO: 9408160 - DNA, 22 bp, Homo sapiens
tggctgtggtttatcccagttc

SEQ ID NO: 9408161 - DNA, 19 bp, Homo sapiens
tggctgtggggaaatgctt

SEQ ID NO: 9408162 - DNA, 22 bp, Homo sapiens
tggctgtgcggcctcgggcaga

SEQ ID NO: 9408163 - DNA, 22 bp, Homo sapiens
tggctgtcttcctggttcatgt

SEQ ID NO: 9408164 - DNA, 22 bp, Homo sapiens
tggctggggcctgaatcctgca

SEQ ID NO: 9408165 - DNA, 22 bp, Homo sapiens
tggctggggcctgaatcctgca

SEQ ID NO: 9408166 - DNA, 19 bp, Homo sapiens
tggctgggcgtgcctccgt

SEQ ID NO: 9408167 - DNA, 22 bp, Homo sapiens
tggctgggccgggccttgtgcc

SEQ ID NO: 9408168 - DNA, 22 bp, Homo sapiens
tggctgggccgggccttgtgcc

SEQ ID NO: 9408169 - DNA, 19 bp, Homo sapiens
tggctgggtgccaatggcc

SEQ ID NO: 9408170 - DNA, 22 bp, Homo sapiens
tggctgggggtgctatagctgc

SEQ ID NO: 9408171 - DNA, 22 bp, Homo sapiens
tggctgtagaatcagagacttg

SEQ ID NO: 9408172 - DNA, 22 bp, Homo sapiens
tggctgtcagctgcctggtgcg

SEQ ID NO: 9408173 - DNA, 22 bp, Homo sapiens
tggctggtcacatggtaggtct

SEQ ID NO: 9408174 - DNA, 22 bp, Homo sapiens
tggctggtcacatggtaggtct

SEQ ID NO: 9408175 - DNA, 22 bp, Homo sapiens
tggcttctctgttttagtattt

SEQ ID NO: 9408176 - DNA, 22 bp, Homo sapiens
tggcttctgagcattgaaacgt

SEQ ID NO: 9408177 - DNA, 22 bp, Homo sapiens
tggcttctcccgacaccctggc

SEQ ID NO: 9408178 - DNA, 22 bp, Homo sapiens
tggcttctccctacaacatgcc

SEQ ID NO: 9408179 - DNA, 22 bp, Homo sapiens
tggcttctgggacttgtgagca

SEQ ID NO: 9408180 - DNA, 22 bp, Homo sapiens
tggcttctgctcccagaatgat

SEQ ID NO: 9408181 - DNA, 22 bp, Homo sapiens
tggcttctattgctgtggcatt

SEQ ID NO: 9408182 - DNA, 22 bp, Homo sapiens
tggcttctcagtttcataatga

SEQ ID NO: 9408183 - DNA, 22 bp, Homo sapiens
tggcttctccagaaatcttggt

SEQ ID NO: 9408184 - DNA, 22 bp, Homo sapiens
tggcttctcagaatactctgga

SEQ ID NO: 9408185 - DNA, 22 bp, Homo sapiens
tggcttctagtttgaggaaaaa

SEQ ID NO: 9408186 - DNA, 22 bp, Homo sapiens
tggcttcactgctcaagtgatt

SEQ ID NO: 9408187 - DNA, 17 bp, Homo sapiens
tggcttcagatgtacat

SEQ ID NO: 9408188 - DNA, 17 bp, Homo sapiens
tggcttccctgggccac

SEQ ID NO: 9408189 - DNA, 17 bp, Homo sapiens
tggcttccctgggccac

SEQ ID NO: 9408190 - DNA, 22 bp, Homo sapiens
tggcttccgccgcgggcctcgg

SEQ ID NO: 9408191 - DNA, 22 bp, Homo sapiens
tggcttcctaggagcccgtgct

SEQ ID NO: 9408192 - DNA, 19 bp, Homo sapiens
tggcttcctgactctcatc

SEQ ID NO: 9408193 - DNA, 18 bp, Homo sapiens
tggcttcctgcgggctgc

SEQ ID NO: 9408194 - DNA, 23 bp, Homo sapiens
tggctttattcacatatctgacc

SEQ ID NO: 9408195 - DNA, 22 bp, Homo sapiens
tggctttcgctatagagcacgg

SEQ ID NO: 9408196 - DNA, 22 bp, Homo sapiens
tggcttcttgatcttggacttg

SEQ ID NO: 9408197 - DNA, 22 bp, Homo sapiens
tggcttcttgacttcttggctg

SEQ ID NO: 9408198 - DNA, 22 bp, Homo sapiens
tggctttgaaatccagtcatta

SEQ ID NO: 9408199 - DNA, 22 bp, Homo sapiens
tgggaaagactcaggacaggag

SEQ ID NO: 9408200 - DNA, 19 bp, Homo sapiens
tgggaaagtaacatacaaa

SEQ ID NO: 9408201 - DNA, 22 bp, Homo sapiens
tgggaacagtagctgctgagct

SEQ ID NO: 9408202 - DNA, 22 bp, Homo sapiens
tgggaaattgtatttctatttc

SEQ ID NO: 9408203 - DNA, 22 bp, Homo sapiens
tgggaaatattctaaaagtctt

SEQ ID NO: 9408204 - DNA, 22 bp, Homo sapiens
tgggaagaggcgggaggctgtt

SEQ ID NO: 9408205 - DNA, 22 bp, Homo sapiens
tgggaagaggagcactggaatg

SEQ ID NO: 9408206 - DNA, 22 bp, Homo sapiens
tgggaagaggagcactggaatg

SEQ ID NO: 9408207 - DNA, 22 bp, Homo sapiens
tgggaagactcctcaggaggcg

SEQ ID NO: 9408208 - DNA, 22 bp, Homo sapiens
tgggaagactcctcaggaggcg

SEQ ID NO: 9408209 - DNA, 22 bp, Homo sapiens
tgggaatggatgctaagtgcta

SEQ ID NO: 9408210 - DNA, 22 bp, Homo sapiens
tgggaatgggcctagaaggctg

SEQ ID NO: 9408211 - DNA, 22 bp, Homo sapiens
tgggaatgctgatttcaggaac

SEQ ID NO: 9408212 - DNA, 22 bp, Homo sapiens
tgggaatgctgagcccatgtat

SEQ ID NO: 9408213 - DNA, 22 bp, Homo sapiens
tgggacacaaaccagaccagga

SEQ ID NO: 9408214 - DNA, 22 bp, Homo sapiens
tgggaatgtggcaaggcataga

SEQ ID NO: 9408215 - DNA, 22 bp, Homo sapiens
tgggaatgtgagcattcattca

SEQ ID NO: 9408216 - DNA, 22 bp, Homo sapiens
tgggaatgggcctagaaggctg

SEQ ID NO: 9408217 - DNA, 22 bp, Homo sapiens
tgggaatgtagaatgtaaacca

SEQ ID NO: 9408218 - DNA, 22 bp, Homo sapiens
tgggaatgtagaatgtaaacca

SEQ ID NO: 9408219 - DNA, 22 bp, Homo sapiens
tgggaaggttagcagtttgtca

SEQ ID NO: 9408220 - DNA, 22 bp, Homo sapiens
tgggaaggttagcagtttgtca

SEQ ID NO: 9408221 - DNA, 22 bp, Homo sapiens
tgggaagtaggacagtgcagtt

SEQ ID NO: 9408222 - DNA, 22 bp, Homo sapiens
tgggaagttaggatgccaggga

SEQ ID NO: 9408223 - DNA, 23 bp, Homo sapiens
tgggaatgacatctagagcagag

SEQ ID NO: 9408224 - DNA, 23 bp, Homo sapiens
tgggaatgacatctagagcagag

SEQ ID NO: 9408225 - DNA, 23 bp, Homo sapiens
tgggaatgacatctagagcagag

SEQ ID NO: 9408226 - DNA, 18 bp, Homo sapiens
tgggaatgctcaaggccc

SEQ ID NO: 9408227 - DNA, 22 bp, Homo sapiens
tgggaatgcaaggaaagctgtt

SEQ ID NO: 9408228 - DNA, 22 bp, Homo sapiens
tgggacaggttggagagaagca

SEQ ID NO: 9408229 - DNA, 22 bp, Homo sapiens
tgggacaggttggagagaagca

SEQ ID NO: 9408230 - DNA, 22 bp, Homo sapiens
tgggacagtgaccccagaggtc

SEQ ID NO: 9408231 - DNA, 22 bp, Homo sapiens
tgggacagtgaccccagaggtc

SEQ ID NO: 9408232 - DNA, 22 bp, Homo sapiens
tgggacacagaaaaggcaggtt

SEQ ID NO: 9408233 - DNA, 22 bp, Homo sapiens
tgggacacaaaccagaccagga

SEQ ID NO: 9408234 - DNA, 22 bp, Homo sapiens
tgggacagggaatctgatcccc

SEQ ID NO: 9408235 - DNA, 22 bp, Homo sapiens
tgggacagggaatctgatcccc

SEQ ID NO: 9408236 - DNA, 22 bp, Homo sapiens
tgggacagtgtgccttgctcct

SEQ ID NO: 9408237 - DNA, 22 bp, Homo sapiens
tgggacagtgtgccttgctcct

SEQ ID NO: 9408238 - DNA, 22 bp, Homo sapiens
tgggacagtgtgccttgctcct

SEQ ID NO: 9408239 - DNA, 22 bp, Homo sapiens
tgggacagtgtgccttgctcct

SEQ ID NO: 9408240 - DNA, 22 bp, Homo sapiens
tgggacagttgtcctccactct

SEQ ID NO: 9408241 - DNA, 22 bp, Homo sapiens
tgggacagttgtcctccactct

SEQ ID NO: 9408242 - DNA, 21 bp, Homo sapiens
tgggacagtgatggctcctcc

SEQ ID NO: 9408243 - DNA, 21 bp, Homo sapiens
tgggacagtgatggctcctcc

SEQ ID NO: 9408244 - DNA, 21 bp, Homo sapiens
tgggacagtgatggctcctcc

SEQ ID NO: 9408245 - DNA, 21 bp, Homo sapiens
tgggacagtgatggctcctcc

SEQ ID NO: 9408246 - DNA, 22 bp, Homo sapiens
tgggacagtgtgccttgctcct

SEQ ID NO: 9408247 - DNA, 22 bp, Homo sapiens
tgggacagtgaccccagaggtc

SEQ ID NO: 9408248 - DNA, 23 bp, Homo sapiens
tgggacctgtttgcccacagatg

SEQ ID NO: 9408249 - DNA, 22 bp, Homo sapiens
tgggacctgttacattgagtta

SEQ ID NO: 9408250 - DNA, 22 bp, Homo sapiens
tgggacctgctcctggaatgag

SEQ ID NO: 9408251 - DNA, 22 bp, Homo sapiens
tgggacctgccctggccccatc

SEQ ID NO: 9408252 - DNA, 22 bp, Homo sapiens
tgggacctgctcttggaatgag

SEQ ID NO: 9408253 - DNA, 16 bp, Homo sapiens
tgggacctgtggccaa

SEQ ID NO: 9408254 - DNA, 22 bp, Homo sapiens
tgggacctctcttgagagagca

SEQ ID NO: 9408255 - DNA, 21 bp, Homo sapiens
tgggacctatttcaactggat

SEQ ID NO: 9408256 - DNA, 20 bp, Homo sapiens
tgggactgacccatctgagc

SEQ ID NO: 9408257 - DNA, 22 bp, Homo sapiens
tgggactgagaatatgatgggg

SEQ ID NO: 9408258 - DNA, 22 bp, Homo sapiens
tgggactgctcttgctggggtc

SEQ ID NO: 9408259 - DNA, 22 bp, Homo sapiens
tgggactgctcttgctggggtc

SEQ ID NO: 9408260 - DNA, 22 bp, Homo sapiens
tgggactgtgacctccagggta

SEQ ID NO: 9408261 - DNA, 22 bp, Homo sapiens
tgggaagggccgatggagcctc

SEQ ID NO: 9408262 - DNA, 22 bp, Homo sapiens
tgggaagggagtttcttggagt

SEQ ID NO: 9408263 - DNA, 22 bp, Homo sapiens
tgggaagggagtttcttggagt

SEQ ID NO: 9408264 - DNA, 22 bp, Homo sapiens
tgggaagggccgatggagcctc

SEQ ID NO: 9408265 - DNA, 22 bp, Homo sapiens
tgggaagggccgatggagcctc

SEQ ID NO: 9408266 - DNA, 22 bp, Homo sapiens
tgggaaggcgtggaagtagaag

SEQ ID NO: 9408267 - DNA, 22 bp, Homo sapiens
tgggaagcctagcagacagctg

SEQ ID NO: 9408268 - DNA, 22 bp, Homo sapiens
tgggaagggagagtgtcctgga

SEQ ID NO: 9408269 - DNA, 22 bp, Homo sapiens
tgggaagggagagtgtcctgga

SEQ ID NO: 9408270 - DNA, 22 bp, Homo sapiens
tgggaagggagagtgtcctgga

SEQ ID NO: 9408271 - DNA, 22 bp, Homo sapiens
tgggaaggcgtggaagtagaag

SEQ ID NO: 9408272 - DNA, 22 bp, Homo sapiens
tgggaaggcgtggaagtagaag

SEQ ID NO: 9408273 - DNA, 22 bp, Homo sapiens
tgggaagatggagtgacaggca

SEQ ID NO: 9408274 - DNA, 22 bp, Homo sapiens
tgggaagcattaatgatagggg

SEQ ID NO: 9408275 - DNA, 22 bp, Homo sapiens
tgggaagcacgctcagcagaaa

SEQ ID NO: 9408276 - DNA, 22 bp, Homo sapiens
tgggaagatatgagtgaccaac

SEQ ID NO: 9408277 - DNA, 22 bp, Homo sapiens
tgggaagagttagagacagctg

SEQ ID NO: 9408278 - DNA, 23 bp, Homo sapiens
tgggaagatatgtatgttcaagg

SEQ ID NO: 9408279 - DNA, 22 bp, Homo sapiens
tgggaagatatgagtgaccaac

SEQ ID NO: 9408280 - DNA, 22 bp, Homo sapiens
tgggaagagttagagacagctg

SEQ ID NO: 9408281 - DNA, 22 bp, Homo sapiens
tgggaagaggcgggaggctgtt

SEQ ID NO: 9408282 - DNA, 22 bp, Homo sapiens
tgggaagggtcaacagctggaa

SEQ ID NO: 9408283 - DNA, 22 bp, Homo sapiens
tgggaagggtcaacagctggaa

SEQ ID NO: 9408284 - DNA, 22 bp, Homo sapiens
tgggaaggggagctggaaagga

SEQ ID NO: 9408285 - DNA, 22 bp, Homo sapiens
tgggaaggggagctggaaagga

SEQ ID NO: 9408286 - DNA, 22 bp, Homo sapiens
tgggaagggtcaacagctggaa

SEQ ID NO: 9408287 - DNA, 22 bp, Homo sapiens
tgggaagggcctgcccttcctc

SEQ ID NO: 9408288 - DNA, 22 bp, Homo sapiens
tgggaaggggagctggaaagga

SEQ ID NO: 9408289 - DNA, 22 bp, Homo sapiens
tgggaagggcctgcccttcctc

SEQ ID NO: 9408290 - DNA, 22 bp, Homo sapiens
tgggaagggcctgcccttcctc

SEQ ID NO: 9408291 - DNA, 22 bp, Homo sapiens
tgggaaggggagctggaaagga

SEQ ID NO: 9408292 - DNA, 22 bp, Homo sapiens
tgggaaggtgattttccaaaag

SEQ ID NO: 9408293 - DNA, 22 bp, Homo sapiens
tgggaaggtgattttccaaaag

SEQ ID NO: 9408294 - DNA, 22 bp, Homo sapiens
tgggaaggtgtagaaagaacaa

SEQ ID NO: 9408295 - DNA, 22 bp, Homo sapiens
tgggaaggtgtagaaagaacaa

SEQ ID NO: 9408296 - DNA, 22 bp, Homo sapiens
tgggaaggtacacgggaaagag

SEQ ID NO: 9408297 - DNA, 22 bp, Homo sapiens
tgggaaggtacacgggaaagag

SEQ ID NO: 9408298 - DNA, 22 bp, Homo sapiens
tgggaaggtacacgggaaagag

SEQ ID NO: 9408299 - DNA, 22 bp, Homo sapiens
tgggaaggtacacgggaaagag

SEQ ID NO: 9408300 - DNA, 22 bp, Homo sapiens
tgggaagggtctgaatctgaga

SEQ ID NO: 9408301 - DNA, 22 bp, Homo sapiens
tgggaagggtctgaatctgaga

SEQ ID NO: 9408302 - DNA, 22 bp, Homo sapiens
tgggaagggtcaacagctggaa

SEQ ID NO: 9408303 - DNA, 22 bp, Homo sapiens
tgggaagggtcaacagctggaa

SEQ ID NO: 9408304 - DNA, 22 bp, Homo sapiens
tgggaagggtcaacagctggaa

SEQ ID NO: 9408305 - DNA, 22 bp, Homo sapiens
tgggaagggtcagtttcttcat

SEQ ID NO: 9408306 - DNA, 22 bp, Homo sapiens
tgggaagggtcagtttcttcat

SEQ ID NO: 9408307 - DNA, 22 bp, Homo sapiens
tgggagatatccggcctccgtg

SEQ ID NO: 9408308 - DNA, 22 bp, Homo sapiens
tgggagagtttgtttagagtga

SEQ ID NO: 9408309 - DNA, 22 bp, Homo sapiens
tgggagagtttgtttagagtga

SEQ ID NO: 9408310 - DNA, 22 bp, Homo sapiens
tgggagagtgctcaatgtgcaa

SEQ ID NO: 9408311 - DNA, 22 bp, Homo sapiens
tgggagagtgctcaatgtgcaa

SEQ ID NO: 9408312 - DNA, 22 bp, Homo sapiens
tgggagagtgctcaatgtgcaa

SEQ ID NO: 9408313 - DNA, 22 bp, Homo sapiens
tgggagagtctaaaaccgaggt

SEQ ID NO: 9408314 - DNA, 22 bp, Homo sapiens
tgggagagtctaaaaccgaggt

SEQ ID NO: 9408315 - DNA, 22 bp, Homo sapiens
tgggagcaagctacttagggaa

SEQ ID NO: 9408316 - DNA, 22 bp, Homo sapiens
tgggagcaaatgactgggagat

SEQ ID NO: 9408317 - DNA, 22 bp, Homo sapiens
tgggagatggttctgagacttt

SEQ ID NO: 9408318 - DNA, 22 bp, Homo sapiens
tgggagatggttctgagacttt

SEQ ID NO: 9408319 - DNA, 20 bp, Homo sapiens
tgggagatgatctccttgct

SEQ ID NO: 9408320 - DNA, 22 bp, Homo sapiens
tgggagatcttgaggcttattt

SEQ ID NO: 9408321 - DNA, 20 bp, Homo sapiens
tgggagatgatctccttgct

SEQ ID NO: 9408322 - DNA, 22 bp, Homo sapiens
tgggagatattgctgtggctgt

SEQ ID NO: 9408323 - DNA, 22 bp, Homo sapiens
tgggagatattgctgtggctgt

SEQ ID NO: 9408324 - DNA, 21 bp, Homo sapiens
tgggagagggctcagctaccc

SEQ ID NO: 9408325 - DNA, 21 bp, Homo sapiens
tgggagagggctcagctaccc

SEQ ID NO: 9408326 - DNA, 21 bp, Homo sapiens
tgggagagggctcagctaccc

SEQ ID NO: 9408327 - DNA, 22 bp, Homo sapiens
tgggagagtaaccaattccttc

SEQ ID NO: 9408328 - DNA, 22 bp, Homo sapiens
tgggagagtaaccaattccttc

SEQ ID NO: 9408329 - DNA, 22 bp, Homo sapiens
tgggagagtctaaaaccgaggt

SEQ ID NO: 9408330 - DNA, 22 bp, Homo sapiens
tgggagagtaaccaattccttc

SEQ ID NO: 9408331 - DNA, 19 bp, Homo sapiens
tgggagaggcaacagagta

SEQ ID NO: 9408332 - DNA, 19 bp, Homo sapiens
tgggagaggcaacagagta

SEQ ID NO: 9408333 - DNA, 22 bp, Homo sapiens
tgggagaggctgccatcttgca

SEQ ID NO: 9408334 - DNA, 22 bp, Homo sapiens
tgggagaggctgccatcttgca

SEQ ID NO: 9408335 - DNA, 22 bp, Homo sapiens
tgggagaggctgccatcttgca

SEQ ID NO: 9408336 - DNA, 19 bp, Homo sapiens
tgggagaggcaacagagta

SEQ ID NO: 9408337 - DNA, 19 bp, Homo sapiens
tgggagaggcaacagagta

SEQ ID NO: 9408338 - DNA, 22 bp, Homo sapiens
tgggagaagcagtgggacagta

SEQ ID NO: 9408339 - DNA, 21 bp, Homo sapiens
tgggagaccgccttcctggga

SEQ ID NO: 9408340 - DNA, 23 bp, Homo sapiens
tgggagacttttcattttgttct

SEQ ID NO: 9408341 - DNA, 22 bp, Homo sapiens
tgggagagcttcatgccttcag

SEQ ID NO: 9408342 - DNA, 22 bp, Homo sapiens
tgggagagcttcatgccttcag

SEQ ID NO: 9408343 - DNA, 22 bp, Homo sapiens
tgggagagaataatcaataggt

SEQ ID NO: 9408344 - DNA, 22 bp, Homo sapiens
tgggagacactggtgggagctt

SEQ ID NO: 9408345 - DNA, 22 bp, Homo sapiens
tgggagacactggtgggagctt

SEQ ID NO: 9408346 - DNA, 22 bp, Homo sapiens
tgggagacactggtgggagctt

SEQ ID NO: 9408347 - DNA, 22 bp, Homo sapiens
tgggagaagcagcagccaagtg

SEQ ID NO: 9408348 - DNA, 22 bp, Homo sapiens
tgggagaagcagcagccaagtg

SEQ ID NO: 9408349 - DNA, 20 bp, Homo sapiens
tgggagaagaacactggaac

SEQ ID NO: 9408350 - DNA, 22 bp, Homo sapiens
tgggagaacccagggtcaggct

SEQ ID NO: 9408351 - DNA, 22 bp, Homo sapiens
tgggacttgcctcgagggctgc

SEQ ID NO: 9408352 - DNA, 22 bp, Homo sapiens
tgggacttgcctcgagggctgc

SEQ ID NO: 9408353 - DNA, 22 bp, Homo sapiens
tgggacttaatatgcccttgat

SEQ ID NO: 9408354 - DNA, 22 bp, Homo sapiens
tgggagcaccttgagggcagaa

SEQ ID NO: 9408355 - DNA, 22 bp, Homo sapiens
tgggagcaccttgagggcagaa

SEQ ID NO: 9408356 - DNA, 22 bp, Homo sapiens
tgggagcaccttgagggcagaa

SEQ ID NO: 9408357 - DNA, 22 bp, Homo sapiens
tgggagcactctttgggaagca

SEQ ID NO: 9408358 - DNA, 22 bp, Homo sapiens
tgggagcaccctgaggagcttc

SEQ ID NO: 9408359 - DNA, 22 bp, Homo sapiens
tgggagcaccctgaggagcttc

SEQ ID NO: 9408360 - DNA, 22 bp, Homo sapiens
tgggagcaagctggtgctggag

SEQ ID NO: 9408361 - DNA, 22 bp, Homo sapiens
tgggagcaagctggtgctggag

SEQ ID NO: 9408362 - DNA, 22 bp, Homo sapiens
tgggagcaagctggtgctggag

SEQ ID NO: 9408363 - DNA, 22 bp, Homo sapiens
tgggagcagctttgcgagggag

SEQ ID NO: 9408364 - DNA, 22 bp, Homo sapiens
tgggagcagcctcagcttcggg

SEQ ID NO: 9408365 - DNA, 22 bp, Homo sapiens
tgggagcagcagggagatgcgg

SEQ ID NO: 9408366 - DNA, 22 bp, Homo sapiens
tgggagcagcagggagatgcgg

SEQ ID NO: 9408367 - DNA, 22 bp, Homo sapiens
tgggagcagccaacatggcctt

SEQ ID NO: 9408368 - DNA, 22 bp, Homo sapiens
tgggagcagcattgccatgtgc

SEQ ID NO: 9408369 - DNA, 22 bp, Homo sapiens
tgggaggagccctctgggaagg

SEQ ID NO: 9408370 - DNA, 22 bp, Homo sapiens
tgggaggagccctctgggaagg

SEQ ID NO: 9408371 - DNA, 22 bp, Homo sapiens
tgggaggagccctctgggaagg

SEQ ID NO: 9408372 - DNA, 22 bp, Homo sapiens
tgggaggatcgcttgagcccag

SEQ ID NO: 9408373 - DNA, 22 bp, Homo sapiens
tgggaggatcgcttgagcccag

SEQ ID NO: 9408374 - DNA, 22 bp, Homo sapiens
tgggaggatctcttgaggccag

SEQ ID NO: 9408375 - DNA, 22 bp, Homo sapiens
tgggaggatctcttgaggccag

SEQ ID NO: 9408376 - DNA, 22 bp, Homo sapiens
tgggaggatcgcttgagcccag

SEQ ID NO: 9408377 - DNA, 22 bp, Homo sapiens
tgggaggatcgcttgagcccag

SEQ ID NO: 9408378 - DNA, 22 bp, Homo sapiens
tgggaggcagaagttgactgga

SEQ ID NO: 9408379 - DNA, 22 bp, Homo sapiens
tgggaggcagaagttgactgga

SEQ ID NO: 9408380 - DNA, 22 bp, Homo sapiens
tgggaggatctcttgaggccag

SEQ ID NO: 9408381 - DNA, 22 bp, Homo sapiens
tgggaggatctcttgaggccag

SEQ ID NO: 9408382 - DNA, 22 bp, Homo sapiens
tgggaggatctcttgaggccag

SEQ ID NO: 9408383 - DNA, 22 bp, Homo sapiens
tgggaggatctcttgaggccag

SEQ ID NO: 9408384 - DNA, 22 bp, Homo sapiens
tgggaggacttgtgggcttcat

SEQ ID NO: 9408385 - DNA, 22 bp, Homo sapiens
tgggaggacttgtgggcttcat

SEQ ID NO: 9408386 - DNA, 22 bp, Homo sapiens
tgggaggacttgtgggcttcat

SEQ ID NO: 9408387 - DNA, 22 bp, Homo sapiens
tgggaggacttgtgggcttcat

SEQ ID NO: 9408388 - DNA, 22 bp, Homo sapiens
tgggaggaatgtcactgagcca

SEQ ID NO: 9408389 - DNA, 22 bp, Homo sapiens
tgggaggaatgtcactgagcca

SEQ ID NO: 9408390 - DNA, 22 bp, Homo sapiens
tgggaggaatgtcactgagcca

SEQ ID NO: 9408391 - DNA, 22 bp, Homo sapiens
tgggaggaagtgctaatgggag

SEQ ID NO: 9408392 - DNA, 22 bp, Homo sapiens
tgggaggaagtgctaatgggag

SEQ ID NO: 9408393 - DNA, 22 bp, Homo sapiens
tgggaggaatgtcactgagcca

SEQ ID NO: 9408394 - DNA, 22 bp, Homo sapiens
tgggagctggggttggacgtct

SEQ ID NO: 9408395 - DNA, 22 bp, Homo sapiens
tgggaggaagtgctaatgggag

SEQ ID NO: 9408396 - DNA, 22 bp, Homo sapiens
tgggaggaagtgctaatgggag

SEQ ID NO: 9408397 - DNA, 20 bp, Homo sapiens
tgggagctggtgaggtctca

SEQ ID NO: 9408398 - DNA, 22 bp, Homo sapiens
tgggagctggggttggacgtct

SEQ ID NO: 9408399 - DNA, 22 bp, Homo sapiens
tgctcccagggactctggctgg

SEQ ID NO: 9408400 - DNA, 22 bp, Homo sapiens
tgctcccaggctctgtggtctg

SEQ ID NO: 9408401 - DNA, 22 bp, Homo sapiens
tgctcccaggcattctctgttg

SEQ ID NO: 9408402 - DNA, 22 bp, Homo sapiens
tgctccagggcctccagtgggg

SEQ ID NO: 9408403 - DNA, 22 bp, Homo sapiens
tgctcccaggactcttgagcca

SEQ ID NO: 9408404 - DNA, 22 bp, Homo sapiens
tgctcccagctgtaggaatgtt

SEQ ID NO: 9408405 - DNA, 22 bp, Homo sapiens
tgctccctgctcagagaggcca

SEQ ID NO: 9408406 - DNA, 22 bp, Homo sapiens
tgctcccttgccagaggggaag

SEQ ID NO: 9408407 - DNA, 20 bp, Homo sapiens
tgctcctaccacttctgccc

SEQ ID NO: 9408408 - DNA, 22 bp, Homo sapiens
tgctccgttcttctgcttcttg

SEQ ID NO: 9408409 - DNA, 22 bp, Homo sapiens
tgctcctgctggccctcgtgcc

SEQ ID NO: 9408410 - DNA, 22 bp, Homo sapiens
tgctcctgctggccctcgtgcc

SEQ ID NO: 9408411 - DNA, 22 bp, Homo sapiens
tgctcctgctgcatgcatctcc

SEQ ID NO: 9408412 - DNA, 22 bp, Homo sapiens
tgctcctgctgcatgcatctcc

SEQ ID NO: 9408413 - DNA, 22 bp, Homo sapiens
tgctcctgctgcatgcatctcc

SEQ ID NO: 9408414 - DNA, 22 bp, Homo sapiens
tgctcctgaattacactactac

SEQ ID NO: 9408415 - DNA, 22 bp, Homo sapiens
tgctcctgagtgtgcaggagat

SEQ ID NO: 9408416 - DNA, 22 bp, Homo sapiens
tgctcctgagtgtgcaggagat

SEQ ID NO: 9408417 - DNA, 22 bp, Homo sapiens
tgctcctgaggttggagatcca

SEQ ID NO: 9408418 - DNA, 22 bp, Homo sapiens
tgctccagcgctgccaccagtt

SEQ ID NO: 9408419 - DNA, 20 bp, Homo sapiens
tgctccaggaacactggccg

SEQ ID NO: 9408420 - DNA, 20 bp, Homo sapiens
tgctccaggaacactggccg

SEQ ID NO: 9408421 - DNA, 22 bp, Homo sapiens
tgctccagcctatgctctccgg

SEQ ID NO: 9408422 - DNA, 22 bp, Homo sapiens
tgctccagcctatgctctccgg

SEQ ID NO: 9408423 - DNA, 22 bp, Homo sapiens
tgctccagcctatgctctccgg

SEQ ID NO: 9408424 - DNA, 22 bp, Homo sapiens
tgctccagcgctgccaccagtt

SEQ ID NO: 9408425 - DNA, 22 bp, Homo sapiens
tgctccagcctatgctctccgg

SEQ ID NO: 9408426 - DNA, 22 bp, Homo sapiens
tgctccagcatgaccctcaatg

SEQ ID NO: 9408427 - DNA, 22 bp, Homo sapiens
tgctccagcaccaagagctcca

SEQ ID NO: 9408428 - DNA, 18 bp, Homo sapiens
tgctccaggcccatgggc

SEQ ID NO: 9408429 - DNA, 18 bp, Homo sapiens
tgctccaggcccatgggc

SEQ ID NO: 9408430 - DNA, 22 bp, Homo sapiens
tgctccaggcaagctgagagtt

SEQ ID NO: 9408431 - DNA, 22 bp, Homo sapiens
tgctccaggagcactttccatt

SEQ ID NO: 9408432 - DNA, 22 bp, Homo sapiens
tgctccaggcaagctgagagtt

SEQ ID NO: 9408433 - DNA, 22 bp, Homo sapiens
tgctccaggccgcctggggctg

SEQ ID NO: 9408434 - DNA, 19 bp, Homo sapiens
tgctccaggccttgccgca

SEQ ID NO: 9408435 - DNA, 19 bp, Homo sapiens
tgctccaggccttgccgca

SEQ ID NO: 9408436 - DNA, 21 bp, Homo sapiens
tgctccagggcagcttccagc

SEQ ID NO: 9408437 - DNA, 22 bp, Homo sapiens
tgctccagggcctccagtgggg

SEQ ID NO: 9408438 - DNA, 21 bp, Homo sapiens
tgctccagggcagcttccagc

SEQ ID NO: 9408439 - DNA, 22 bp, Homo sapiens
tgctctcctgctcctcagccca

SEQ ID NO: 9408440 - DNA, 22 bp, Homo sapiens
tgctctcctgctcctcagccca

SEQ ID NO: 9408441 - DNA, 22 bp, Homo sapiens
tgctctcctgctcctcagccca

SEQ ID NO: 9408442 - DNA, 22 bp, Homo sapiens
tgctctccggcttccgtggcct

SEQ ID NO: 9408443 - DNA, 22 bp, Homo sapiens
tgctctcagagtcaggaggtaa

SEQ ID NO: 9408444 - DNA, 19 bp, Homo sapiens
tgctctctggtgcttcatg

SEQ ID NO: 9408445 - DNA, 22 bp, Homo sapiens
tgctctggctggagcaatgact

SEQ ID NO: 9408446 - DNA, 19 bp, Homo sapiens
tgctctctggtgcttcatg

SEQ ID NO: 9408447 - DNA, 22 bp, Homo sapiens
tgctctcctgctcctcagccca

SEQ ID NO: 9408448 - DNA, 22 bp, Homo sapiens
tgctctctcaggcctggcccac

SEQ ID NO: 9408449 - DNA, 22 bp, Homo sapiens
tgctctggctgggatgagtgca

SEQ ID NO: 9408450 - DNA, 22 bp, Homo sapiens
tgctctggctggagcaatgact

SEQ ID NO: 9408451 - DNA, 22 bp, Homo sapiens
tgctctggctggagcaatgact

SEQ ID NO: 9408452 - DNA, 22 bp, Homo sapiens
tgctctggctgggatgagtgca

SEQ ID NO: 9408453 - DNA, 22 bp, Homo sapiens
tgctctgggattcagcagcctg

SEQ ID NO: 9408454 - DNA, 23 bp, Homo sapiens
tgctctgggaggccctggagagc

SEQ ID NO: 9408455 - DNA, 23 bp, Homo sapiens
tgctctgggaggccctggagagc

SEQ ID NO: 9408456 - DNA, 22 bp, Homo sapiens
tgctctgggggaagccagctgt

SEQ ID NO: 9408457 - DNA, 22 bp, Homo sapiens
tgctctgggggaagccagctgt

SEQ ID NO: 9408458 - DNA, 22 bp, Homo sapiens
tgctctggggctccccaccaga

SEQ ID NO: 9408459 - DNA, 22 bp, Homo sapiens
tgctctggggagctcctctgcg

SEQ ID NO: 9408460 - DNA, 22 bp, Homo sapiens
tgctctggggagctcctctgcg

SEQ ID NO: 9408461 - DNA, 22 bp, Homo sapiens
tgctctggggagctcctctgcg

SEQ ID NO: 9408462 - DNA, 22 bp, Homo sapiens
tgctctgggctatctgagaaag

SEQ ID NO: 9408463 - DNA, 22 bp, Homo sapiens
tgctctgggctcaatggcagct

SEQ ID NO: 9408464 - DNA, 22 bp, Homo sapiens
tgctctgggcaacagcctccct

SEQ ID NO: 9408465 - DNA, 22 bp, Homo sapiens
tgctctgggctatctgagaaag

SEQ ID NO: 9408466 - DNA, 22 bp, Homo sapiens
tgctcctgtttcatcagctata

SEQ ID NO: 9408467 - DNA, 17 bp, Homo sapiens
tgctcctgtggcagcct

SEQ ID NO: 9408468 - DNA, 17 bp, Homo sapiens
tgctcctgtggcagcct

SEQ ID NO: 9408469 - DNA, 22 bp, Homo sapiens
tgctcctggctccttccctaac

SEQ ID NO: 9408470 - DNA, 22 bp, Homo sapiens
tgctcctggatgaggtactcca

SEQ ID NO: 9408471 - DNA, 22 bp, Homo sapiens
tgctcctggactggtgtgagat

SEQ ID NO: 9408472 - DNA, 22 bp, Homo sapiens
tgctcctggactggtgtgagat

SEQ ID NO: 9408473 - DNA, 22 bp, Homo sapiens
tgctcctggcatctctgcgtcc

SEQ ID NO: 9408474 - DNA, 22 bp, Homo sapiens
tgctcctggcatctctgcgtcc

SEQ ID NO: 9408475 - DNA, 22 bp, Homo sapiens
tgctcctggatgaggtactcca

SEQ ID NO: 9408476 - DNA, 22 bp, Homo sapiens
tgctcctggatgaggtactcca

SEQ ID NO: 9408477 - DNA, 22 bp, Homo sapiens
tgctccttcccttcccagtgag

SEQ ID NO: 9408478 - DNA, 21 bp, Homo sapiens
tgctcctttaccccacaagac

SEQ ID NO: 9408479 - DNA, 22 bp, Homo sapiens
tgctcctttcatccaattctca

SEQ ID NO: 9408480 - DNA, 22 bp, Homo sapiens
tgctcgaggtccccaccggctc

SEQ ID NO: 9408481 - DNA, 22 bp, Homo sapiens
tgctctagctcataggactcat

SEQ ID NO: 9408482 - DNA, 22 bp, Homo sapiens
tgctctagtgggtagagcattg

SEQ ID NO: 9408483 - DNA, 22 bp, Homo sapiens
tgctctagagctattggcttcc

SEQ ID NO: 9408484 - DNA, 22 bp, Homo sapiens
tgctctagccattgacctagct

SEQ ID NO: 9408485 - DNA, 22 bp, Homo sapiens
tgctctagcctgtaaaacatga

SEQ ID NO: 9408486 - DNA, 22 bp, Homo sapiens
tgctcgccccacatgccctcat

SEQ ID NO: 9408487 - DNA, 22 bp, Homo sapiens
tgctcgccccacatgccctcat

SEQ ID NO: 9408488 - DNA, 22 bp, Homo sapiens
tgctgaaagaccgtatttatct

SEQ ID NO: 9408489 - DNA, 22 bp, Homo sapiens
tgctgaaaatgcgtatcttcca

SEQ ID NO: 9408490 - DNA, 22 bp, Homo sapiens
tgctgaaggcaggggaggtggc

SEQ ID NO: 9408491 - DNA, 20 bp, Homo sapiens
tgctgaagaatcacagatgg

SEQ ID NO: 9408492 - DNA, 22 bp, Homo sapiens
tgctgaaggcaggggaggtggc

SEQ ID NO: 9408493 - DNA, 22 bp, Homo sapiens
tgctgaagggaaggtcttgaat

SEQ ID NO: 9408494 - DNA, 22 bp, Homo sapiens
tgctgaggaaaaatgtgactct

SEQ ID NO: 9408495 - DNA, 22 bp, Homo sapiens
tgctgagcgcatccggcggccg

SEQ ID NO: 9408496 - DNA, 22 bp, Homo sapiens
tgctgagcgcatccggcggccg

SEQ ID NO: 9408497 - DNA, 22 bp, Homo sapiens
tgctgaggaggtggctgtgctt

SEQ ID NO: 9408498 - DNA, 22 bp, Homo sapiens
tgctgaggaggtggctgtgctt

SEQ ID NO: 9408499 - DNA, 19 bp, Homo sapiens
tgctgaggatgcaagatcc

SEQ ID NO: 9408500 - DNA, 22 bp, Homo sapiens
tgctgaggactaaaggagatga

SEQ ID NO: 9408501 - DNA, 22 bp, Homo sapiens
tgctgaggactaaaggagatga

SEQ ID NO: 9408502 - DNA, 18 bp, Homo sapiens
tgctctggtctcacttgg

SEQ ID NO: 9408503 - DNA, 22 bp, Homo sapiens
tgctctggtaactcacttccat

SEQ ID NO: 9408504 - DNA, 22 bp, Homo sapiens
tgctctgggttcttgctgttac

SEQ ID NO: 9408505 - DNA, 20 bp, Homo sapiens
tgctctgggggtggagagac

SEQ ID NO: 9408506 - DNA, 20 bp, Homo sapiens
tgctctgggggtggagagac

SEQ ID NO: 9408507 - DNA, 20 bp, Homo sapiens
tgctctgggggtggagagac

SEQ ID NO: 9408508 - DNA, 22 bp, Homo sapiens
tgctcttcacagtttcagcatc

SEQ ID NO: 9408509 - DNA, 22 bp, Homo sapiens
tgctctgttcagtgtatcttgt

SEQ ID NO: 9408510 - DNA, 22 bp, Homo sapiens
tgctcttcggggccactgcttg

SEQ ID NO: 9408511 - DNA, 23 bp, Homo sapiens
tgctcttctcagacctgtcagcc

SEQ ID NO: 9408512 - DNA, 22 bp, Homo sapiens
tgctctgtccagtgcaccatca

SEQ ID NO: 9408513 - DNA, 17 bp, Homo sapiens
tgctctgtggtctttta

SEQ ID NO: 9408514 - DNA, 22 bp, Homo sapiens
tgctctgtaacaaattgacatg

SEQ ID NO: 9408515 - DNA, 22 bp, Homo sapiens
tgctctgtattctatggcagtt

SEQ ID NO: 9408516 - DNA, 22 bp, Homo sapiens
tgctgcagtatatatttcttgg

SEQ ID NO: 9408517 - DNA, 22 bp, Homo sapiens
tgctgcaggtgtgttcagtgag

SEQ ID NO: 9408518 - DNA, 22 bp, Homo sapiens
tgctgcaggtgtgttcagtgag

SEQ ID NO: 9408519 - DNA, 22 bp, Homo sapiens
tgctgcagttcaccctgccgtc

SEQ ID NO: 9408520 - DNA, 22 bp, Homo sapiens
tgctgcagggccttccctgcat

SEQ ID NO: 9408521 - DNA, 22 bp, Homo sapiens
tgctgcagggatttcagagaca

SEQ ID NO: 9408522 - DNA, 22 bp, Homo sapiens
tgctgcaaattctttaattctt

SEQ ID NO: 9408523 - DNA, 22 bp, Homo sapiens
tgctgcaaatgagaagagactg

SEQ ID NO: 9408524 - DNA, 22 bp, Homo sapiens
tgctgaggttgtggagtgcatt

SEQ ID NO: 9408525 - DNA, 22 bp, Homo sapiens
tgctgaggttgtggagtgcatt

SEQ ID NO: 9408526 - DNA, 22 bp, Homo sapiens
tgctgaggtttctgactatgga

SEQ ID NO: 9408527 - DNA, 22 bp, Homo sapiens
tgctgagtatttgtttgaataa

SEQ ID NO: 9408528 - DNA, 22 bp, Homo sapiens
tgctgatgagtccttctatcgc

SEQ ID NO: 9408529 - DNA, 22 bp, Homo sapiens
tgctgatgctgttctgttagga

SEQ ID NO: 9408530 - DNA, 22 bp, Homo sapiens
tgctgcaaagctggccagtagc

SEQ ID NO: 9408531 - DNA, 22 bp, Homo sapiens
tgctgattttgcctactgatcc

SEQ ID NO: 9408532 - DNA, 22 bp, Homo sapiens
tgctgcaaaagaggtactgaat

SEQ ID NO: 9408533 - DNA, 21 bp, Homo sapiens
tgctgatgtcagagaagcaag

SEQ ID NO: 9408534 - DNA, 22 bp, Homo sapiens
tgctgaggcatttggacagagt

SEQ ID NO: 9408535 - DNA, 22 bp, Homo sapiens
tgctgaggcagatgtctgtgac

SEQ ID NO: 9408536 - DNA, 22 bp, Homo sapiens
tgctgaggcagatgtctgtgac

SEQ ID NO: 9408537 - DNA, 22 bp, Homo sapiens
tgctgaggcagatgtctgtgac

SEQ ID NO: 9408538 - DNA, 20 bp, Homo sapiens
tgctgaggcctgaggcctgg

SEQ ID NO: 9408539 - DNA, 20 bp, Homo sapiens
tgctgaggcctgaggcctgg

SEQ ID NO: 9408540 - DNA, 22 bp, Homo sapiens
tgctgaggtcaccttgctgcta

SEQ ID NO: 9408541 - DNA, 22 bp, Homo sapiens
tgctgaggtcacggcggccaga

SEQ ID NO: 9408542 - DNA, 22 bp, Homo sapiens
tgccttttagtgctcaataaag

SEQ ID NO: 9408543 - DNA, 20 bp, Homo sapiens
tgccttttatacctttaaac

SEQ ID NO: 9408544 - DNA, 22 bp, Homo sapiens
tgccttttccagttcctagaag

SEQ ID NO: 9408545 - DNA, 22 bp, Homo sapiens
tgcgagcccagccagctctctg

SEQ ID NO: 9408546 - DNA, 22 bp, Homo sapiens
tgcgatgcaacagcttggcgga

SEQ ID NO: 9408547 - DNA, 22 bp, Homo sapiens
tgcgatgcaacagcttggcgga

SEQ ID NO: 9408548 - DNA, 22 bp, Homo sapiens
tgcgagagtggaaaggaagcct

SEQ ID NO: 9408549 - DNA, 22 bp, Homo sapiens
tgcctttaacaagatctccaga

SEQ ID NO: 9408550 - DNA, 22 bp, Homo sapiens
tgccttgtccttcgtcagggct

SEQ ID NO: 9408551 - DNA, 22 bp, Homo sapiens
tgccttggtttccccatctgta

SEQ ID NO: 9408552 - DNA, 20 bp, Homo sapiens
tgccttgggacagtgcctgt

SEQ ID NO: 9408553 - DNA, 22 bp, Homo sapiens
tgccttgggagccagcatgcca

SEQ ID NO: 9408554 - DNA, 22 bp, Homo sapiens
tgccttggaggaatgatgagag

SEQ ID NO: 9408555 - DNA, 22 bp, Homo sapiens
tgccttggattgcagggaacct

SEQ ID NO: 9408556 - DNA, 22 bp, Homo sapiens
tgccttggattgcagggaacct

SEQ ID NO: 9408557 - DNA, 22 bp, Homo sapiens
tgccttggtgcttcttcatgtg

SEQ ID NO: 9408558 - DNA, 22 bp, Homo sapiens
tgccttggttctctacttggag

SEQ ID NO: 9408559 - DNA, 22 bp, Homo sapiens
tgccttggtggcagtctgcggt

SEQ ID NO: 9408560 - DNA, 20 bp, Homo sapiens
tgccttggagcagccaaggt

SEQ ID NO: 9408561 - DNA, 22 bp, Homo sapiens
tgccttgcttcaatcaaaccgt

SEQ ID NO: 9408562 - DNA, 22 bp, Homo sapiens
tgccttgcgggcgtttctgttg

SEQ ID NO: 9408563 - DNA, 22 bp, Homo sapiens
tgcctgtgtatttccggcctgc

SEQ ID NO: 9408564 - DNA, 22 bp, Homo sapiens
tgcctgtgtgaccacgggcaag

SEQ ID NO: 9408565 - DNA, 22 bp, Homo sapiens
tgcctgtgtccccttcttggca

SEQ ID NO: 9408566 - DNA, 22 bp, Homo sapiens
tgcctgtgtatgtgcatgcaca

SEQ ID NO: 9408567 - DNA, 22 bp, Homo sapiens
tgcctgtggttccagttttttc

SEQ ID NO: 9408568 - DNA, 22 bp, Homo sapiens
tgcctgtgggtgccaccaccct

SEQ ID NO: 9408569 - DNA, 19 bp, Homo sapiens
tgcctgtggcgagcatctt

SEQ ID NO: 9408570 - DNA, 19 bp, Homo sapiens
tgcctgtggcgagcatctt

SEQ ID NO: 9408571 - DNA, 19 bp, Homo sapiens
tgcctgtggcgagcatctt

SEQ ID NO: 9408572 - DNA, 22 bp, Homo sapiens
tgcctggctgggctgctcatgg

SEQ ID NO: 9408573 - DNA, 22 bp, Homo sapiens
tgcctgggaaccaatcctggct

SEQ ID NO: 9408574 - DNA, 22 bp, Homo sapiens
tgcctgggaaccaatcctggct

SEQ ID NO: 9408575 - DNA, 22 bp, Homo sapiens
tgcctgggctcggtagccatcg

SEQ ID NO: 9408576 - DNA, 22 bp, Homo sapiens
tgcctggggattgctctgggcc

SEQ ID NO: 9408577 - DNA, 22 bp, Homo sapiens
tgcctggggattgctctgggcc

SEQ ID NO: 9408578 - DNA, 22 bp, Homo sapiens
tgcctggctgggctgctcatgg

SEQ ID NO: 9408579 - DNA, 22 bp, Homo sapiens
tgcctggctgaggtgacaggtt

SEQ ID NO: 9408580 - DNA, 22 bp, Homo sapiens
tgcctggctctatcagtggtgg

SEQ ID NO: 9408581 - DNA, 22 bp, Homo sapiens
tgcctggctctatcagtggtgg

SEQ ID NO: 9408582 - DNA, 22 bp, Homo sapiens
tgcctggccagaccctatagag

SEQ ID NO: 9408583 - DNA, 22 bp, Homo sapiens
tgcctggccctgacagccctgg

SEQ ID NO: 9408584 - DNA, 22 bp, Homo sapiens
tgcctggccctgacagccctgg

SEQ ID NO: 9408585 - DNA, 20 bp, Homo sapiens
tgcctggcctttctctgccc

SEQ ID NO: 9408586 - DNA, 22 bp, Homo sapiens
tgcctggtatttgaataaagag

SEQ ID NO: 9408587 - DNA, 22 bp, Homo sapiens
tgcctgggttcccaccccaaag

SEQ ID NO: 9408588 - DNA, 22 bp, Homo sapiens
tgcctgggtgtaaagggccaac

SEQ ID NO: 9408589 - DNA, 22 bp, Homo sapiens
tgcctgggtgtaaagggccaac

SEQ ID NO: 9408590 - DNA, 22 bp, Homo sapiens
tgcctgggtgtaaagggccaac

SEQ ID NO: 9408591 - DNA, 22 bp, Homo sapiens
tgcctgggtgtaaagggccaac

SEQ ID NO: 9408592 - DNA, 22 bp, Homo sapiens
tgcctgggtgctggctggtcac

SEQ ID NO: 9408593 - DNA, 22 bp, Homo sapiens
tgcctgggtgccctctgctcct

SEQ ID NO: 9408594 - DNA, 22 bp, Homo sapiens
tgcctgggtgccctctgctcct

SEQ ID NO: 9408595 - DNA, 22 bp, Homo sapiens
tgcctgggtgccctctgctcct

SEQ ID NO: 9408596 - DNA, 22 bp, Homo sapiens
tgcctgggtgccctctgctcct

SEQ ID NO: 9408597 - DNA, 22 bp, Homo sapiens
tgcctgtctttcctccctcgta

SEQ ID NO: 9408598 - DNA, 22 bp, Homo sapiens
tgcctgtctttcctccctcgta

SEQ ID NO: 9408599 - DNA, 22 bp, Homo sapiens
tgcctgtcttggagtcctggcc

SEQ ID NO: 9408600 - DNA, 22 bp, Homo sapiens
tgcctgtcttcaggagtgtcac

SEQ ID NO: 9408601 - DNA, 22 bp, Homo sapiens
tgcctgtgatcagctgagttca

SEQ ID NO: 9408602 - DNA, 22 bp, Homo sapiens
tgcctgtgaaaaccctggggtt

SEQ ID NO: 9408603 - DNA, 22 bp, Homo sapiens
tgcctgtcttcaggagtgtcac

SEQ ID NO: 9408604 - DNA, 21 bp, Homo sapiens
tgctcagattctccatctgga

SEQ ID NO: 9408605 - DNA, 21 bp, Homo sapiens
tgctcagattctccatctgga

SEQ ID NO: 9408606 - DNA, 22 bp, Homo sapiens
tgctcagcacagaccaggccag

SEQ ID NO: 9408607 - DNA, 22 bp, Homo sapiens
tgctcagcaaaaagcttgtgag

SEQ ID NO: 9408608 - DNA, 22 bp, Homo sapiens
tgctcagcagtcaaggtcatag

SEQ ID NO: 9408609 - DNA, 22 bp, Homo sapiens
tgctcagcagtcaaggtcatag

SEQ ID NO: 9408610 - DNA, 22 bp, Homo sapiens
tgctcagctgctctgtattctt

SEQ ID NO: 9408611 - DNA, 22 bp, Homo sapiens
tgctcagctggtgccagggtcc

SEQ ID NO: 9408612 - DNA, 22 bp, Homo sapiens
tgctcagccgtgagcagagccg

SEQ ID NO: 9408613 - DNA, 22 bp, Homo sapiens
tgctcagccgtgagcagagccg

SEQ ID NO: 9408614 - DNA, 22 bp, Homo sapiens
tgctcagacttaagaagatcag

SEQ ID NO: 9408615 - DNA, 22 bp, Homo sapiens
tgctcagacaagctgaacagta

SEQ ID NO: 9408616 - DNA, 22 bp, Homo sapiens
tgctcagacaagctgaacagta

SEQ ID NO: 9408617 - DNA, 22 bp, Homo sapiens
tgctcagaattgcgctggtgga

SEQ ID NO: 9408618 - DNA, 22 bp, Homo sapiens
tgctcagagctctggtgcaggt

SEQ ID NO: 9408619 - DNA, 22 bp, Homo sapiens
tgctcagagctccagctctcct

SEQ ID NO: 9408620 - DNA, 18 bp, Homo sapiens
tgctcagagaaatcaagg

SEQ ID NO: 9408621 - DNA, 18 bp, Homo sapiens
tgctcagagaaatcaagg

SEQ ID NO: 9408622 - DNA, 22 bp, Homo sapiens
tgctcaagtgtttgttgaatgg

SEQ ID NO: 9408623 - DNA, 17 bp, Homo sapiens
tgctcaaatacttttga

SEQ ID NO: 9408624 - DNA, 22 bp, Homo sapiens
tgctcagaacatgattcaggcg

SEQ ID NO: 9408625 - DNA, 22 bp, Homo sapiens
tgctcagaactgtgaatacatg

SEQ ID NO: 9408626 - DNA, 22 bp, Homo sapiens
tgctcagaactgtgaatacatg

SEQ ID NO: 9408627 - DNA, 22 bp, Homo sapiens
tgctcagaaacgaggtgcagcc

SEQ ID NO: 9408628 - DNA, 22 bp, Homo sapiens
tgctcacaggtgaccctgggca

SEQ ID NO: 9408629 - DNA, 22 bp, Homo sapiens
tgctccagcaccaagagctcca

SEQ ID NO: 9408630 - DNA, 22 bp, Homo sapiens
tgctccagcaacaggcttagct

SEQ ID NO: 9408631 - DNA, 22 bp, Homo sapiens
tgctccagcaacaggcttagct

SEQ ID NO: 9408632 - DNA, 22 bp, Homo sapiens
tgctccagcaacaggcttagct

SEQ ID NO: 9408633 - DNA, 22 bp, Homo sapiens
tgctccagaacctgaccatgct

SEQ ID NO: 9408634 - DNA, 22 bp, Homo sapiens
tgctccacttgggcacccccca

SEQ ID NO: 9408635 - DNA, 22 bp, Homo sapiens
tgctcattggcgatctgaggga

SEQ ID NO: 9408636 - DNA, 22 bp, Homo sapiens
tgctcattggcgatctgaggga

SEQ ID NO: 9408637 - DNA, 22 bp, Homo sapiens
tgctcattggcgatctgaggga

SEQ ID NO: 9408638 - DNA, 22 bp, Homo sapiens
tgctcattggcgatctgaggga

SEQ ID NO: 9408639 - DNA, 22 bp, Homo sapiens
tgctccactaagccatcccatt

SEQ ID NO: 9408640 - DNA, 22 bp, Homo sapiens
tgctccactcccaattgcatgt

SEQ ID NO: 9408641 - DNA, 22 bp, Homo sapiens
tgctccaccctcacactcttcc

SEQ ID NO: 9408642 - DNA, 22 bp, Homo sapiens
tgctcagcttcagaggatcccc

SEQ ID NO: 9408643 - DNA, 21 bp, Homo sapiens
tgctcagtctgtctccagctt

SEQ ID NO: 9408644 - DNA, 19 bp, Homo sapiens
tgctcagtggctaaaagca

SEQ ID NO: 9408645 - DNA, 22 bp, Homo sapiens
tgctattttagacatactttgt

SEQ ID NO: 9408646 - DNA, 22 bp, Homo sapiens
tgctatttgtgtaatggtaaat

SEQ ID NO: 9408647 - DNA, 22 bp, Homo sapiens
tgctatttttatcttgatcaaa

SEQ ID NO: 9408648 - DNA, 22 bp, Homo sapiens
tgctatttttatcttgatcaaa

SEQ ID NO: 9408649 - DNA, 22 bp, Homo sapiens
tgctatttgggggctacatgat

SEQ ID NO: 9408650 - DNA, 22 bp, Homo sapiens
tgctatttggcacttttgacct

SEQ ID NO: 9408651 - DNA, 21 bp, Homo sapiens
tgctatttaatttttctgttc

SEQ ID NO: 9408652 - DNA, 22 bp, Homo sapiens
tgctatttaacttttatgtgta

SEQ ID NO: 9408653 - DNA, 22 bp, Homo sapiens
tgctatgtccagcacagagtgg

SEQ ID NO: 9408654 - DNA, 22 bp, Homo sapiens
tgctatctctatatccatttat

SEQ ID NO: 9408655 - DNA, 22 bp, Homo sapiens
tgctatggaaaacagaatggca

SEQ ID NO: 9408656 - DNA, 22 bp, Homo sapiens
tgctatataatggaatttctaa

SEQ ID NO: 9408657 - DNA, 22 bp, Homo sapiens
tgctatataatggaatttctaa

SEQ ID NO: 9408658 - DNA, 22 bp, Homo sapiens
tgctataagctccacgctgtag

SEQ ID NO: 9408659 - DNA, 22 bp, Homo sapiens
tgcggggccctcccgtgcactg

SEQ ID NO: 9408660 - DNA, 22 bp, Homo sapiens
tgcggcaggagaaggtgttatg

SEQ ID NO: 9408661 - DNA, 22 bp, Homo sapiens
tgcggcagccaccgcgtggccc

SEQ ID NO: 9408662 - DNA, 22 bp, Homo sapiens
tgcgctgtggcagggcaggatg

SEQ ID NO: 9408663 - DNA, 22 bp, Homo sapiens
tgcgctggtggcggataagggt

SEQ ID NO: 9408664 - DNA, 22 bp, Homo sapiens
tgcgcctgtaagtccagagtcc

SEQ ID NO: 9408665 - DNA, 22 bp, Homo sapiens
tgcgcaggagctctgccaggag

SEQ ID NO: 9408666 - DNA, 20 bp, Homo sapiens
tgcgtgtgtatttattttct

SEQ ID NO: 9408667 - DNA, 21 bp, Homo sapiens
tgcgtgtgcatggccttcggg

SEQ ID NO: 9408668 - DNA, 22 bp, Homo sapiens
tgcgggttggtggcatatgcag

SEQ ID NO: 9408669 - DNA, 17 bp, Homo sapiens
tgctgtctgcttcccta

SEQ ID NO: 9408670 - DNA, 17 bp, Homo sapiens
tgctgtctgcttcccta

SEQ ID NO: 9408671 - DNA, 20 bp, Homo sapiens
tgctgtcgtgttttctgctt

SEQ ID NO: 9408672 - DNA, 22 bp, Homo sapiens
tgctgtctttttcccttcctaa

SEQ ID NO: 9408673 - DNA, 22 bp, Homo sapiens
tgctgtctttcattgtctgcct

SEQ ID NO: 9408674 - DNA, 22 bp, Homo sapiens
tgctgtcttctctgaggtccct

SEQ ID NO: 9408675 - DNA, 22 bp, Homo sapiens
tgctgtcttccaggatggtgaa

SEQ ID NO: 9408676 - DNA, 22 bp, Homo sapiens
tgctgtgcatcatagtgtttgg

SEQ ID NO: 9408677 - DNA, 23 bp, Homo sapiens
tgctgtgcctttgtctgcctcca

SEQ ID NO: 9408678 - DNA, 22 bp, Homo sapiens
tgctgtgaggttgagaaggaag

SEQ ID NO: 9408679 - DNA, 22 bp, Homo sapiens
tgctgtgcaaaggtgatgtgag

SEQ ID NO: 9408680 - DNA, 18 bp, Homo sapiens
tgctgtgcacagccctat

SEQ ID NO: 9408681 - DNA, 22 bp, Homo sapiens
tgcttaaaccctgatcatgtgt

SEQ ID NO: 9408682 - DNA, 22 bp, Homo sapiens
tgcttaaagtagtggattgtta

SEQ ID NO: 9408683 - DNA, 22 bp, Homo sapiens
tgcttaaaggatagtttaaact

SEQ ID NO: 9408684 - DNA, 22 bp, Homo sapiens
tgcttaaacatactatttatat

SEQ ID NO: 9408685 - DNA, 22 bp, Homo sapiens
tgcttaaacatccagacagtat

SEQ ID NO: 9408686 - DNA, 22 bp, Homo sapiens
tgcttaaacatccagacagtat

SEQ ID NO: 9408687 - DNA, 22 bp, Homo sapiens
tgcttaaaattttccaaggatt

SEQ ID NO: 9408688 - DNA, 22 bp, Homo sapiens
tgcttaaacacatacatacata

SEQ ID NO: 9408689 - DNA, 22 bp, Homo sapiens
tgcttaaacacatacatacata

SEQ ID NO: 9408690 - DNA, 22 bp, Homo sapiens
tgcttacattgcatctgtgcct

SEQ ID NO: 9408691 - DNA, 18 bp, Homo sapiens
tgcttacaggagttcctg

SEQ ID NO: 9408692 - DNA, 22 bp, Homo sapiens
tgcttaaagtgttaaccctgtt

SEQ ID NO: 9408693 - DNA, 22 bp, Homo sapiens
tgcttcagagaagaatggaaag

SEQ ID NO: 9408694 - DNA, 22 bp, Homo sapiens
tgcttcagaggaaaggcaaaag

SEQ ID NO: 9408695 - DNA, 22 bp, Homo sapiens
tgcttcagaggaaaggcaaaag

SEQ ID NO: 9408696 - DNA, 22 bp, Homo sapiens
tgcttcaaggacactgactttt

SEQ ID NO: 9408697 - DNA, 22 bp, Homo sapiens
tgcttatttgaatttattctca

SEQ ID NO: 9408698 - DNA, 22 bp, Homo sapiens
tgcttcagtcctatgggcaggt

SEQ ID NO: 9408699 - DNA, 17 bp, Homo sapiens
tgcttcatcccgatcct

SEQ ID NO: 9408700 - DNA, 22 bp, Homo sapiens
tgcttccactaatgagctgtgt

SEQ ID NO: 9408701 - DNA, 22 bp, Homo sapiens
tgcttccagcatccctggcctg

SEQ ID NO: 9408702 - DNA, 22 bp, Homo sapiens
tgcttccagctctctgtaaggt

SEQ ID NO: 9408703 - DNA, 22 bp, Homo sapiens
tgcttccaggaatccatctggc

SEQ ID NO: 9408704 - DNA, 22 bp, Homo sapiens
tgcttccaggaatccatctggc

SEQ ID NO: 9408705 - DNA, 22 bp, Homo sapiens
tgcttctcaaaaggaggtaggt

SEQ ID NO: 9408706 - DNA, 22 bp, Homo sapiens
tgcttctcaaagaagcataatg

SEQ ID NO: 9408707 - DNA, 22 bp, Homo sapiens
tgcttctccattgatgctaagt

SEQ ID NO: 9408708 - DNA, 22 bp, Homo sapiens
tgcttccctgaaggcacaggag

SEQ ID NO: 9408709 - DNA, 22 bp, Homo sapiens
tgcttctcccaaccagggcctg

SEQ ID NO: 9408710 - DNA, 21 bp, Homo sapiens
tgcttctctagatcaactact

SEQ ID NO: 9408711 - DNA, 22 bp, Homo sapiens
tgcttctgaaatgcaggtcttc

SEQ ID NO: 9408712 - DNA, 22 bp, Homo sapiens
tgcttctgaaatgcaggtcttc

SEQ ID NO: 9408713 - DNA, 23 bp, Homo sapiens
tgcttctctgcttgacagttctg

SEQ ID NO: 9408714 - DNA, 22 bp, Homo sapiens
tgcttctctttatttgtaggtt

SEQ ID NO: 9408715 - DNA, 22 bp, Homo sapiens
tgcttctctgttctaacccttg

SEQ ID NO: 9408716 - DNA, 22 bp, Homo sapiens
tgcttctgacatgttcttggtt

SEQ ID NO: 9408717 - DNA, 22 bp, Homo sapiens
tgcttctgactgggtcagttga

SEQ ID NO: 9408718 - DNA, 22 bp, Homo sapiens
tgcttctgagttgcaggacttg

SEQ ID NO: 9408719 - DNA, 22 bp, Homo sapiens
tgctgggcctttacctccaggg

SEQ ID NO: 9408720 - DNA, 22 bp, Homo sapiens
tgctgggcctgcccctgtcagc

SEQ ID NO: 9408721 - DNA, 22 bp, Homo sapiens
tgctgggctagaagctgaggcc

SEQ ID NO: 9408722 - DNA, 22 bp, Homo sapiens
tgctgggctagaagctgaggcc

SEQ ID NO: 9408723 - DNA, 22 bp, Homo sapiens
tgctgggctcaacctccagagc

SEQ ID NO: 9408724 - DNA, 22 bp, Homo sapiens
tgctgggctagggtggagctct

SEQ ID NO: 9408725 - DNA, 22 bp, Homo sapiens
tgctgggcttgaaagctgctaa

SEQ ID NO: 9408726 - DNA, 22 bp, Homo sapiens
tgctgggctgttcctgtccatg

SEQ ID NO: 9408727 - DNA, 22 bp, Homo sapiens
tgctgggctgttcctgtccatg

SEQ ID NO: 9408728 - DNA, 22 bp, Homo sapiens
tgctgggctggagctgccaggg

SEQ ID NO: 9408729 - DNA, 21 bp, Homo sapiens
tgctgggctgcaggggatgca

SEQ ID NO: 9408730 - DNA, 22 bp, Homo sapiens
tgctgggcatcgtaggaggtac

SEQ ID NO: 9408731 - DNA, 20 bp, Homo sapiens
tgctgggcatgcagtggaaa

SEQ ID NO: 9408732 - DNA, 20 bp, Homo sapiens
tgctgggcatgcagtggaaa

SEQ ID NO: 9408733 - DNA, 22 bp, Homo sapiens
tgctgggcatcgtaggaggtac

SEQ ID NO: 9408734 - DNA, 23 bp, Homo sapiens
tgctgggcagagctggtgctgag

SEQ ID NO: 9408735 - DNA, 22 bp, Homo sapiens
tgctggcttcctgtgcacagca

SEQ ID NO: 9408736 - DNA, 22 bp, Homo sapiens
tgctgggcatttatgcagatgg

SEQ ID NO: 9408737 - DNA, 18 bp, Homo sapiens
tgctgggcattaggctta

SEQ ID NO: 9408738 - DNA, 20 bp, Homo sapiens
tgctgggcatgcagtggaaa

SEQ ID NO: 9408739 - DNA, 22 bp, Homo sapiens
tgctgggcatttttatggctcc

SEQ ID NO: 9408740 - DNA, 22 bp, Homo sapiens
tgctgggccaaagcagggtttt

SEQ ID NO: 9408741 - DNA, 22 bp, Homo sapiens
tgctgggcccccagtgaccttc

SEQ ID NO: 9408742 - DNA, 22 bp, Homo sapiens
tgctgggcccagggagcctctg

SEQ ID NO: 9408743 - DNA, 20 bp, Homo sapiens
tgctgggccatcttgcatgc

SEQ ID NO: 9408744 - DNA, 20 bp, Homo sapiens
tgctgggccatcttgcatgc

SEQ ID NO: 9408745 - DNA, 22 bp, Homo sapiens
tgctgggttacctaagcctaaa

SEQ ID NO: 9408746 - DNA, 22 bp, Homo sapiens
tgctgggtggacttggctctca

SEQ ID NO: 9408747 - DNA, 22 bp, Homo sapiens
tgctggtgaggtccttgctgga

SEQ ID NO: 9408748 - DNA, 22 bp, Homo sapiens
tgctggtgaggtccttgctgga

SEQ ID NO: 9408749 - DNA, 20 bp, Homo sapiens
tgctggttacaccaccaagg

SEQ ID NO: 9408750 - DNA, 23 bp, Homo sapiens
tgctggttcaaaaaggaaggagg

SEQ ID NO: 9408751 - DNA, 22 bp, Homo sapiens
tgctggttcttaagatgcctcc

SEQ ID NO: 9408752 - DNA, 22 bp, Homo sapiens
tgctggttcttaggagagagat

SEQ ID NO: 9408753 - DNA, 22 bp, Homo sapiens
tgctggttctttccttcccttc

SEQ ID NO: 9408754 - DNA, 22 bp, Homo sapiens
tgctggttgtattttctctgtg

SEQ ID NO: 9408755 - DNA, 23 bp, Homo sapiens
tgctgtccaacagactggccatg

SEQ ID NO: 9408756 - DNA, 22 bp, Homo sapiens
tgctgtcagacagcagtggtaa

SEQ ID NO: 9408757 - DNA, 22 bp, Homo sapiens
tgctgtatatattttgaagtga

SEQ ID NO: 9408758 - DNA, 22 bp, Homo sapiens
tgctgtatatattttgaagtga

SEQ ID NO: 9408759 - DNA, 22 bp, Homo sapiens
tgctgtattacttttacaaact

SEQ ID NO: 9408760 - DNA, 22 bp, Homo sapiens
tgctgtcaaggttacatgcttt

SEQ ID NO: 9408761 - DNA, 16 bp, Homo sapiens
tgctggggcgccgtcc

SEQ ID NO: 9408762 - DNA, 16 bp, Homo sapiens
tgctggggcgccgtcc

SEQ ID NO: 9408763 - DNA, 22 bp, Homo sapiens
tgctggggcagaagagccaaga

SEQ ID NO: 9408764 - DNA, 22 bp, Homo sapiens
tgctggggcagaagagccaaga

SEQ ID NO: 9408765 - DNA, 22 bp, Homo sapiens
tgctggggatccgtaccaaccc

SEQ ID NO: 9408766 - DNA, 22 bp, Homo sapiens
tgctggggatccgtaccaaccc

SEQ ID NO: 9408767 - DNA, 20 bp, Homo sapiens
tgctggggacatacagggtg

SEQ ID NO: 9408768 - DNA, 20 bp, Homo sapiens
tgctggggacatacagggtg

SEQ ID NO: 9408769 - DNA, 20 bp, Homo sapiens
tgctggggacatacagggtg

SEQ ID NO: 9408770 - DNA, 22 bp, Homo sapiens
tgctggggagtgattgaccatc

SEQ ID NO: 9408771 - DNA, 22 bp, Homo sapiens
tgctggggagtgattgaccatc

SEQ ID NO: 9408772 - DNA, 23 bp, Homo sapiens
tgctggggtagtttgtggcacag

SEQ ID NO: 9408773 - DNA, 23 bp, Homo sapiens
tgctggggtagtttgtggcacag

SEQ ID NO: 9408774 - DNA, 22 bp, Homo sapiens
tgctggggtcatggggcgcccg

SEQ ID NO: 9408775 - DNA, 22 bp, Homo sapiens
tgctggggtcatggggcgcccg

SEQ ID NO: 9408776 - DNA, 22 bp, Homo sapiens
tgctggggtcatggggcgcccg

SEQ ID NO: 9408777 - DNA, 22 bp, Homo sapiens
tgctggggtctctccggtgccc

SEQ ID NO: 9408778 - DNA, 22 bp, Homo sapiens
tgctggggtctctccggtgccc

SEQ ID NO: 9408779 - DNA, 22 bp, Homo sapiens
tgctggggtctctccggtgccc

SEQ ID NO: 9408780 - DNA, 22 bp, Homo sapiens
tgctgggtagaagtattagtct

SEQ ID NO: 9408781 - DNA, 22 bp, Homo sapiens
tgctgggtagaagtattagtct

SEQ ID NO: 9408782 - DNA, 18 bp, Homo sapiens
tgctgggtaactgtatgg

SEQ ID NO: 9408783 - DNA, 22 bp, Homo sapiens
tgctgcctcaactgtcaggaac

SEQ ID NO: 9408784 - DNA, 18 bp, Homo sapiens
tgctgcccaactctcccc

SEQ ID NO: 9408785 - DNA, 22 bp, Homo sapiens
tgctgccatggtcgctggtgtc

SEQ ID NO: 9408786 - DNA, 23 bp, Homo sapiens
tgctgcccgcttggcacgctccc

SEQ ID NO: 9408787 - DNA, 23 bp, Homo sapiens
tgctgcccgcttggcacgctccc

SEQ ID NO: 9408788 - DNA, 23 bp, Homo sapiens
tgctgcccactcttccagccctc

SEQ ID NO: 9408789 - DNA, 23 bp, Homo sapiens
tgctgccctgccttcagctctcc

SEQ ID NO: 9408790 - DNA, 23 bp, Homo sapiens
tgctgccctgccttcagctctcc

SEQ ID NO: 9408791 - DNA, 22 bp, Homo sapiens
tgctgctgaggctaaagtatag

SEQ ID NO: 9408792 - DNA, 22 bp, Homo sapiens
tgctgctgaaaaggtgtgctta

SEQ ID NO: 9408793 - DNA, 22 bp, Homo sapiens
tgctgctgacatttggggcttg

SEQ ID NO: 9408794 - DNA, 21 bp, Homo sapiens
tgctgctgatcggggttggct

SEQ ID NO: 9408795 - DNA, 22 bp, Homo sapiens
tgctgctgatcatttatagtct

SEQ ID NO: 9408796 - DNA, 22 bp, Homo sapiens
tgctgctctcagccaccaggaa

SEQ ID NO: 9408797 - DNA, 22 bp, Homo sapiens
tgctgctctgtaaagtgatgag

SEQ ID NO: 9408798 - DNA, 22 bp, Homo sapiens
tgctgctccccagcacacagca

SEQ ID NO: 9408799 - DNA, 22 bp, Homo sapiens
tgctgctcctgcctggctccca

SEQ ID NO: 9408800 - DNA, 22 bp, Homo sapiens
tgctgccacctggtggctgaag

SEQ ID NO: 9408801 - DNA, 22 bp, Homo sapiens
tgctgccacctgtggtagtctg

SEQ ID NO: 9408802 - DNA, 22 bp, Homo sapiens
tgctgccacctggtggctgaag

SEQ ID NO: 9408803 - DNA, 22 bp, Homo sapiens
tgctgccactggtagtctcatt

SEQ ID NO: 9408804 - DNA, 22 bp, Homo sapiens
tgctgccagagagacagggact

SEQ ID NO: 9408805 - DNA, 22 bp, Homo sapiens
tgctgccagccaggccatggag

SEQ ID NO: 9408806 - DNA, 22 bp, Homo sapiens
tgctgccagccaggccatggag

SEQ ID NO: 9408807 - DNA, 22 bp, Homo sapiens
tgctgccagccaggccatggag

SEQ ID NO: 9408808 - DNA, 22 bp, Homo sapiens
tgctgccatctcaactgccctt

SEQ ID NO: 9408809 - DNA, 21 bp, Homo sapiens
tgctgccatcatgcagagatg

SEQ ID NO: 9408810 - DNA, 21 bp, Homo sapiens
tgctgccatcatgcagagatg

SEQ ID NO: 9408811 - DNA, 21 bp, Homo sapiens
tgctgccatagacctgaggga

SEQ ID NO: 9408812 - DNA, 21 bp, Homo sapiens
tgctgccatagacctgaggga

SEQ ID NO: 9408813 - DNA, 22 bp, Homo sapiens
tgctgccaggtcttgctgtcca

SEQ ID NO: 9408814 - DNA, 22 bp, Homo sapiens
tgctgccagggctctgcccaca

SEQ ID NO: 9408815 - DNA, 22 bp, Homo sapiens
tgctgccagggctctgcccaca

SEQ ID NO: 9408816 - DNA, 23 bp, Homo sapiens
tgctgccaagcacgagttgagtt

SEQ ID NO: 9408817 - DNA, 17 bp, Homo sapiens
tgctgccaagtcccaac

SEQ ID NO: 9408818 - DNA, 22 bp, Homo sapiens
tgctgccaagcccgtgctcctg

SEQ ID NO: 9408819 - DNA, 22 bp, Homo sapiens
tgctgcatttatcttctcaaac

SEQ ID NO: 9408820 - DNA, 22 bp, Homo sapiens
tgctgccaaatgcgagctctgt

SEQ ID NO: 9408821 - DNA, 17 bp, Homo sapiens
tgctgccaagtcccaac

SEQ ID NO: 9408822 - DNA, 22 bp, Homo sapiens
tgctgccaatttctggtcttga

SEQ ID NO: 9408823 - DNA, 22 bp, Homo sapiens
tgctgccaagcccgtgctcctg

SEQ ID NO: 9408824 - DNA, 22 bp, Homo sapiens
tgctgccacaaattcagctgcc

SEQ ID NO: 9408825 - DNA, 22 bp, Homo sapiens
tgctgccacaaattcagctgcc

SEQ ID NO: 9408826 - DNA, 22 bp, Homo sapiens
tgctgccacctggtggctgaag

SEQ ID NO: 9408827 - DNA, 22 bp, Homo sapiens
tgctgccacccctcaccagagc

SEQ ID NO: 9408828 - DNA, 22 bp, Homo sapiens
tgctgccacatttaaagagggg

SEQ ID NO: 9408829 - DNA, 22 bp, Homo sapiens
tgctgccacccctcaccagagc

SEQ ID NO: 9408830 - DNA, 22 bp, Homo sapiens
tgctgctttgatgtgtaaatca

SEQ ID NO: 9408831 - DNA, 20 bp, Homo sapiens
tgctgctgtgagcgtccctg

SEQ ID NO: 9408832 - DNA, 20 bp, Homo sapiens
tgctgctgtgagcgtccctg

SEQ ID NO: 9408833 - DNA, 20 bp, Homo sapiens
tgctgctgtgagcgtccctg

SEQ ID NO: 9408834 - DNA, 22 bp, Homo sapiens
tgctgctgttgacggctgtcca

SEQ ID NO: 9408835 - DNA, 22 bp, Homo sapiens
tgctgctgtttcctacatctca

SEQ ID NO: 9408836 - DNA, 22 bp, Homo sapiens
tgctgcttcctggtagatagga

SEQ ID NO: 9408837 - DNA, 22 bp, Homo sapiens
tgctgctgggtttgacagtcac

SEQ ID NO: 9408838 - DNA, 22 bp, Homo sapiens
tgctgctgcttctgtacagcct

SEQ ID NO: 9408839 - DNA, 20 bp, Homo sapiens
tgctgctgcttcacccccat

SEQ ID NO: 9408840 - DNA, 22 bp, Homo sapiens
tgctgctgatggatgcctggac

SEQ ID NO: 9408841 - DNA, 20 bp, Homo sapiens
tgctgctgcctccgcctctg

SEQ ID NO: 9408842 - DNA, 22 bp, Homo sapiens
tgctgctgatggcacctaggca

SEQ ID NO: 9408843 - DNA, 22 bp, Homo sapiens
tgctgctgtatcatgccttcat

SEQ ID NO: 9408844 - DNA, 22 bp, Homo sapiens
tgctgctgtatccttagtgtca

SEQ ID NO: 9408845 - DNA, 22 bp, Homo sapiens
tgctgctgtagctaggctttct

SEQ ID NO: 9408846 - DNA, 19 bp, Homo sapiens
tgctgctgtccttgcaggg

SEQ ID NO: 9408847 - DNA, 22 bp, Homo sapiens
tgctgctgtatccttagtgtca

SEQ ID NO: 9408848 - DNA, 22 bp, Homo sapiens
tgctggaagctcctgcatgtct

SEQ ID NO: 9408849 - DNA, 22 bp, Homo sapiens
tgctggaagggtcggcgtgggc

SEQ ID NO: 9408850 - DNA, 22 bp, Homo sapiens
tgctggagcggaggtgagccag

SEQ ID NO: 9408851 - DNA, 22 bp, Homo sapiens
tgctggagcggaggtgagccag

SEQ ID NO: 9408852 - DNA, 23 bp, Homo sapiens
tgctggagacaagtgtgagaagg

SEQ ID NO: 9408853 - DNA, 21 bp, Homo sapiens
tgctggaggacagggtttcat

SEQ ID NO: 9408854 - DNA, 21 bp, Homo sapiens
tgctggaggacagggtttcat

SEQ ID NO: 9408855 - DNA, 22 bp, Homo sapiens
tgctggaggagaaggttgctca

SEQ ID NO: 9408856 - DNA, 22 bp, Homo sapiens
tgctggaggagaaggttgctca

SEQ ID NO: 9408857 - DNA, 22 bp, Homo sapiens
tgctggagctccgggctgtagg

SEQ ID NO: 9408858 - DNA, 22 bp, Homo sapiens
tgctggagctccgggctgtagg

SEQ ID NO: 9408859 - DNA, 22 bp, Homo sapiens
tgctggagaactgctctgtgtt

SEQ ID NO: 9408860 - DNA, 23 bp, Homo sapiens
tgctggagaagcaaagttctgag

SEQ ID NO: 9408861 - DNA, 22 bp, Homo sapiens
tgctggagaactgctctgtgtt

SEQ ID NO: 9408862 - DNA, 22 bp, Homo sapiens
tgctggagaaagtttttctgaa

SEQ ID NO: 9408863 - DNA, 23 bp, Homo sapiens
tgctggagaagcaaagttctgag

SEQ ID NO: 9408864 - DNA, 22 bp, Homo sapiens
tgctggagaagctcctgggact

SEQ ID NO: 9408865 - DNA, 22 bp, Homo sapiens
tgctggctctaggctgagacag

SEQ ID NO: 9408866 - DNA, 22 bp, Homo sapiens
tgctggctcctcgaggcttcgt

SEQ ID NO: 9408867 - DNA, 22 bp, Homo sapiens
tgctggctcctcgaggcttcgt

SEQ ID NO: 9408868 - DNA, 22 bp, Homo sapiens
tgctggctcccaggagccgctg

SEQ ID NO: 9408869 - DNA, 22 bp, Homo sapiens
tgctggctctgggccaagcagg

SEQ ID NO: 9408870 - DNA, 22 bp, Homo sapiens
tgctggccaacaaggctccaag

SEQ ID NO: 9408871 - DNA, 22 bp, Homo sapiens
tgctggctactgatggcaggcc

SEQ ID NO: 9408872 - DNA, 22 bp, Homo sapiens
tgctggccaagcagaggtcaat

SEQ ID NO: 9408873 - DNA, 22 bp, Homo sapiens
tgctggcatttcaggactcacc

SEQ ID NO: 9408874 - DNA, 22 bp, Homo sapiens
tgctggcattgcataggcagtt

SEQ ID NO: 9408875 - DNA, 22 bp, Homo sapiens
tgctggcattgcataggcagtt

SEQ ID NO: 9408876 - DNA, 22 bp, Homo sapiens
tgctggcatttcaggactcacc

SEQ ID NO: 9408877 - DNA, 22 bp, Homo sapiens
tgctggcattgcataggcagtt

SEQ ID NO: 9408878 - DNA, 21 bp, Homo sapiens
tgctggcattaccacaaaccc

SEQ ID NO: 9408879 - DNA, 22 bp, Homo sapiens
tgctggctcagtttgcagactc

SEQ ID NO: 9408880 - DNA, 22 bp, Homo sapiens
tgctggctcagtttgcagactc

SEQ ID NO: 9408881 - DNA, 22 bp, Homo sapiens
tgctggctccaacctggcatct

SEQ ID NO: 9408882 - DNA, 22 bp, Homo sapiens
tgctggctcagtttgcagactc

SEQ ID NO: 9408883 - DNA, 22 bp, Homo sapiens
tgctggctatttaaagaagaaa

SEQ ID NO: 9408884 - DNA, 22 bp, Homo sapiens
tgctggctatttaaagaagaaa

SEQ ID NO: 9408885 - DNA, 23 bp, Homo sapiens
tgctggctgtgttattgccaaca

SEQ ID NO: 9408886 - DNA, 22 bp, Homo sapiens
tgctggctgtgtaccatctcaa

SEQ ID NO: 9408887 - DNA, 22 bp, Homo sapiens
tgctggctgtgtaccatctcaa

SEQ ID NO: 9408888 - DNA, 22 bp, Homo sapiens
tgctggctgtccctacctggct

SEQ ID NO: 9408889 - DNA, 22 bp, Homo sapiens
tgctggctgtccctacctggct

SEQ ID NO: 9408890 - DNA, 22 bp, Homo sapiens
tgctggctgttctagggaggcc

SEQ ID NO: 9408891 - DNA, 22 bp, Homo sapiens
tgctggcttcctgtgcacagca

SEQ ID NO: 9408892 - DNA, 23 bp, Homo sapiens
tgctggcttccagctgctccctc

SEQ ID NO: 9408893 - DNA, 22 bp, Homo sapiens
tgctggcttatttagtaaatgt

SEQ ID NO: 9408894 - DNA, 22 bp, Homo sapiens
tgctggcttatttagtaaatgt

SEQ ID NO: 9408895 - DNA, 22 bp, Homo sapiens
tgctggctggcctggcctggac

SEQ ID NO: 9408896 - DNA, 22 bp, Homo sapiens
tgctggctgggctgctggagac

SEQ ID NO: 9408897 - DNA, 22 bp, Homo sapiens
tgctggctgccaggttccctgt

SEQ ID NO: 9408898 - DNA, 22 bp, Homo sapiens
tgctggctggagtgcctctgga

SEQ ID NO: 9408899 - DNA, 22 bp, Homo sapiens
tgctggctggatcagagattgg

SEQ ID NO: 9408900 - DNA, 23 bp, Homo sapiens
tgctggagtttactcaggccagc

SEQ ID NO: 9408901 - DNA, 23 bp, Homo sapiens
tgctggagtttactcaggccagc

SEQ ID NO: 9408902 - DNA, 17 bp, Homo sapiens
tgctggcaacatacaaa

SEQ ID NO: 9408903 - DNA, 18 bp, Homo sapiens
tgctggcaactactattg

SEQ ID NO: 9408904 - DNA, 21 bp, Homo sapiens
tgctggcaagactcaggaata

SEQ ID NO: 9408905 - DNA, 21 bp, Homo sapiens
tgctggcaagactcaggaata

SEQ ID NO: 9408906 - DNA, 22 bp, Homo sapiens
tgctggcaaggtaggtttcatt

SEQ ID NO: 9408907 - DNA, 22 bp, Homo sapiens
tgctggcaagtcttggaattgt

SEQ ID NO: 9408908 - DNA, 22 bp, Homo sapiens
tgctggcacatagagactggct

SEQ ID NO: 9408909 - DNA, 22 bp, Homo sapiens
tgctggcaatgctcttgacgtc

SEQ ID NO: 9408910 - DNA, 22 bp, Homo sapiens
tgctggagtggcactgtgtggc

SEQ ID NO: 9408911 - DNA, 22 bp, Homo sapiens
tgctggagtggcactgtgtggc

SEQ ID NO: 9408912 - DNA, 22 bp, Homo sapiens
tgctggagttcgacattgcaaa

SEQ ID NO: 9408913 - DNA, 22 bp, Homo sapiens
tgctggagttcgacattgcaaa

SEQ ID NO: 9408914 - DNA, 22 bp, Homo sapiens
tgctggagtggcactgtgtggc

SEQ ID NO: 9408915 - DNA, 22 bp, Homo sapiens
tgctggagtgagtggtttctta

SEQ ID NO: 9408916 - DNA, 22 bp, Homo sapiens
tgctggagtgagattatgagtt

SEQ ID NO: 9408917 - DNA, 22 bp, Homo sapiens
tgctggagtgagattatgagtt

SEQ ID NO: 9408918 - DNA, 22 bp, Homo sapiens
tgctggagtgagtggtttctta

SEQ ID NO: 9408919 - DNA, 22 bp, Homo sapiens
tgctggagtgcagtggcttaac

SEQ ID NO: 9408920 - DNA, 22 bp, Homo sapiens
tgctggcagtggcagtgatggt

SEQ ID NO: 9408921 - DNA, 22 bp, Homo sapiens
tgctggcataccacctagttca

SEQ ID NO: 9408922 - DNA, 22 bp, Homo sapiens
tgctggcatatgaaaatcctta

SEQ ID NO: 9408923 - DNA, 22 bp, Homo sapiens
tgctggcatactctctttgttg

SEQ ID NO: 9408924 - DNA, 22 bp, Homo sapiens
tgctggcaggcacctcctgggg

SEQ ID NO: 9408925 - DNA, 22 bp, Homo sapiens
tgctggcaggcacctcctgggg

SEQ ID NO: 9408926 - DNA, 22 bp, Homo sapiens
tgctggcacgtgactgggaagt

SEQ ID NO: 9408927 - DNA, 22 bp, Homo sapiens
tgctggcagccatgccttggaa

SEQ ID NO: 9408928 - DNA, 22 bp, Homo sapiens
tgctggcagccccagctttaac

SEQ ID NO: 9408929 - DNA, 22 bp, Homo sapiens
tgctggcagcttctttaaatgt

SEQ ID NO: 9408930 - DNA, 22 bp, Homo sapiens
tgctggcatgcatgctgtagga

SEQ ID NO: 9408931 - DNA, 22 bp, Homo sapiens
tgctggcatgcatgctgtagga

SEQ ID NO: 9408932 - DNA, 20 bp, Homo sapiens
tgctggcatgcaagagggaa

SEQ ID NO: 9408933 - DNA, 22 bp, Homo sapiens
tgctggcatcttaatgttctgt

SEQ ID NO: 9408934 - DNA, 22 bp, Homo sapiens
tgctggcatgcatgctgtagga

SEQ ID NO: 9408935 - DNA, 22 bp, Homo sapiens
tgctggcatggtcttggtgaca

SEQ ID NO: 9408936 - DNA, 22 bp, Homo sapiens
tgctggcatggtcttggtgaca

SEQ ID NO: 9408937 - DNA, 22 bp, Homo sapiens
tgctggcatgcatgctgtagga

SEQ ID NO: 9408938 - DNA, 20 bp, Homo sapiens
tgctggcacgggtggactcc

SEQ ID NO: 9408939 - DNA, 20 bp, Homo sapiens
tgctggcacgggtggactcc

SEQ ID NO: 9408940 - DNA, 22 bp, Homo sapiens
tgctggcacgtggaccaggaga

SEQ ID NO: 9408941 - DNA, 22 bp, Homo sapiens
tgctggcacgtgactgggaagt

SEQ ID NO: 9408942 - DNA, 22 bp, Homo sapiens
tgctggcagaaggctcgtggaa

SEQ ID NO: 9408943 - DNA, 22 bp, Homo sapiens
tgctggcagaaggctcgtggaa

SEQ ID NO: 9408944 - DNA, 22 bp, Homo sapiens
tgctggcacatagagactggct

SEQ ID NO: 9408945 - DNA, 22 bp, Homo sapiens
tgctggcacatagagactggct

SEQ ID NO: 9408946 - DNA, 22 bp, Homo sapiens
tgctggcaccagaatgactgca

SEQ ID NO: 9408947 - DNA, 22 bp, Homo sapiens
tgctggcaccagaatgactgca

SEQ ID NO: 9408948 - DNA, 22 bp, Homo sapiens
tgctggcaccagaatgactgca

SEQ ID NO: 9408949 - DNA, 22 bp, Homo sapiens
tgctggcacatagagactggct

SEQ ID NO: 9408950 - DNA, 22 bp, Homo sapiens
tgctggcacgaaagggtgtcca

SEQ ID NO: 9408951 - DNA, 22 bp, Homo sapiens
tgctggcacgaaagggtgtcca

SEQ ID NO: 9408952 - DNA, 22 bp, Homo sapiens
tgctggcaccattttcggacat

SEQ ID NO: 9408953 - DNA, 19 bp, Homo sapiens
tgctggagggtagtgagtc

SEQ ID NO: 9408954 - DNA, 22 bp, Homo sapiens
tgctggaggggcctgaccagga

SEQ ID NO: 9408955 - DNA, 22 bp, Homo sapiens
tgctggaggggcctgaccagga

SEQ ID NO: 9408956 - DNA, 22 bp, Homo sapiens
tgctggagggggtaccactcaa

SEQ ID NO: 9408957 - DNA, 17 bp, Homo sapiens
tgctggaggcggggtat

SEQ ID NO: 9408958 - DNA, 17 bp, Homo sapiens
tgctggaggcggggtat

SEQ ID NO: 9408959 - DNA, 22 bp, Homo sapiens
tgctggaggggatgccttcact

SEQ ID NO: 9408960 - DNA, 19 bp, Homo sapiens
tgctggaggttgacagggt

SEQ ID NO: 9408961 - DNA, 19 bp, Homo sapiens
tgctggaggttgacagggt

SEQ ID NO: 9408962 - DNA, 19 bp, Homo sapiens
tgctggaggttgacagggt

SEQ ID NO: 9408963 - DNA, 22 bp, Homo sapiens
tgctggagtaacaagacactca

SEQ ID NO: 9408964 - DNA, 19 bp, Homo sapiens
tgctggagtgacattctga

SEQ ID NO: 9408965 - DNA, 22 bp, Homo sapiens
tgctggagtctcttgaccctgg

SEQ ID NO: 9408966 - DNA, 22 bp, Homo sapiens
tgctggagtaacaagacactca

SEQ ID NO: 9408967 - DNA, 22 bp, Homo sapiens
tgctggaggagtttactgtggc

SEQ ID NO: 9408968 - DNA, 22 bp, Homo sapiens
tgctggaggagaaggttgctca

SEQ ID NO: 9408969 - DNA, 22 bp, Homo sapiens
tgctggaggagtttactgtggc

SEQ ID NO: 9408970 - DNA, 22 bp, Homo sapiens
tgctggaggcagtggaggtgcc

SEQ ID NO: 9408971 - DNA, 22 bp, Homo sapiens
tgctggaggccagaagtctgag

SEQ ID NO: 9408972 - DNA, 22 bp, Homo sapiens
tgctggaggcagtggaggtgcc

SEQ ID NO: 9408973 - DNA, 22 bp, Homo sapiens
tgctggaggattaaacaagtca

SEQ ID NO: 9408974 - DNA, 22 bp, Homo sapiens
tgctggaggccagaagtctgag

SEQ ID NO: 9408975 - DNA, 22 bp, Homo sapiens
tgctggaggccgagaagcagca

SEQ ID NO: 9408976 - DNA, 22 bp, Homo sapiens
tgctggaggccgagaagcagca

SEQ ID NO: 9408977 - DNA, 20 bp, Homo sapiens
tgctggaggcgccggcgctc

SEQ ID NO: 9408978 - DNA, 22 bp, Homo sapiens
tgctggaggcctgactgtgttt

SEQ ID NO: 9408979 - DNA, 22 bp, Homo sapiens
tgctggaggcctgactgtgttt

SEQ ID NO: 9408980 - DNA, 22 bp, Homo sapiens
tggagtccgctccaagttctct

SEQ ID NO: 9408981 - DNA, 22 bp, Homo sapiens
tggagtgaagtaaagaggacaa

SEQ ID NO: 9408982 - DNA, 22 bp, Homo sapiens
tggagtctgtgatgctctgggt

SEQ ID NO: 9408983 - DNA, 20 bp, Homo sapiens
tggagtctgacagatgggta

SEQ ID NO: 9408984 - DNA, 22 bp, Homo sapiens
tggagtggacttcatgaggcca

SEQ ID NO: 9408985 - DNA, 22 bp, Homo sapiens
tggagtggacttcatgaggcca

SEQ ID NO: 9408986 - DNA, 22 bp, Homo sapiens
tggagtggacttcatgaggcca

SEQ ID NO: 9408987 - DNA, 20 bp, Homo sapiens
tggagtgctgtgttgagaag

SEQ ID NO: 9408988 - DNA, 21 bp, Homo sapiens
tggagtgcactcagagttggt

SEQ ID NO: 9408989 - DNA, 22 bp, Homo sapiens
tggagtgaagtaaagaggacaa

SEQ ID NO: 9408990 - DNA, 21 bp, Homo sapiens
tggagtgcaacactaggtata

SEQ ID NO: 9408991 - DNA, 22 bp, Homo sapiens
tggaggtgtccaactcgtgggt

SEQ ID NO: 9408992 - DNA, 22 bp, Homo sapiens
tggaggtgtccaactcgtgggt

SEQ ID NO: 9408993 - DNA, 22 bp, Homo sapiens
tggaggtgtataaggtagcttc

SEQ ID NO: 9408994 - DNA, 22 bp, Homo sapiens
tggaggtgtataaggtagcttc

SEQ ID NO: 9408995 - DNA, 22 bp, Homo sapiens
tggaggtgtataaggtagcttc

SEQ ID NO: 9408996 - DNA, 22 bp, Homo sapiens
tggaggtgtggagtcaaaggga

SEQ ID NO: 9408997 - DNA, 22 bp, Homo sapiens
tggaggtgtccaactcgtgggt

SEQ ID NO: 9408998 - DNA, 22 bp, Homo sapiens
tggaggtgtccaactcgtgggt

SEQ ID NO: 9408999 - DNA, 16 bp, Homo sapiens
tggaggtgtttctagt

SEQ ID NO: 9409000 - DNA, 23 bp, Homo sapiens
tggataaaatacttacattcaac

SEQ ID NO: 9409001 - DNA, 20 bp, Homo sapiens
tggagttgttctgctaggtc

SEQ ID NO: 9409002 - DNA, 20 bp, Homo sapiens
tggagttgttctgctaggtc

SEQ ID NO: 9409003 - DNA, 20 bp, Homo sapiens
tggagttgttctgctaggtc

SEQ ID NO: 9409004 - DNA, 22 bp, Homo sapiens
tggagttgtgtcatctttgtaa

SEQ ID NO: 9409005 - DNA, 20 bp, Homo sapiens
tggagttgttctgctaggtc

SEQ ID NO: 9409006 - DNA, 21 bp, Homo sapiens
tggataaaggcacttttcatc

SEQ ID NO: 9409007 - DNA, 22 bp, Homo sapiens
tggataaactcactgtaagttg

SEQ ID NO: 9409008 - DNA, 22 bp, Homo sapiens
tggataaaatctgtaaggctca

SEQ ID NO: 9409009 - DNA, 22 bp, Homo sapiens
tggagtgggcaatgtaggcaag

SEQ ID NO: 9409010 - DNA, 22 bp, Homo sapiens
tggagtgggcaatgtaggcaag

SEQ ID NO: 9409011 - DNA, 22 bp, Homo sapiens
tggagttgcagctaccagacat

SEQ ID NO: 9409012 - DNA, 22 bp, Homo sapiens
tggagttgcagctaccagacat

SEQ ID NO: 9409013 - DNA, 22 bp, Homo sapiens
tggagttggccgcccggaccga

SEQ ID NO: 9409014 - DNA, 20 bp, Homo sapiens
tggagttgggctggtttacc

SEQ ID NO: 9409015 - DNA, 22 bp, Homo sapiens
tggagttggccgcccggaccga

SEQ ID NO: 9409016 - DNA, 20 bp, Homo sapiens
tggagttgtggcagtttgga

SEQ ID NO: 9409017 - DNA, 23 bp, Homo sapiens
tggagttgatgtccttctgtgct

SEQ ID NO: 9409018 - DNA, 22 bp, Homo sapiens
tggatggccccactggatccat

SEQ ID NO: 9409019 - DNA, 22 bp, Homo sapiens
tggatggattgacgaaggcagc

SEQ ID NO: 9409020 - DNA, 22 bp, Homo sapiens
tggatggattgacgaaggcagc

SEQ ID NO: 9409021 - DNA, 19 bp, Homo sapiens
tggatggagcctgtggttg

SEQ ID NO: 9409022 - DNA, 22 bp, Homo sapiens
tggataaatgtgcagatgacat

SEQ ID NO: 9409023 - DNA, 22 bp, Homo sapiens
tggatatccttgttaactttct

SEQ ID NO: 9409024 - DNA, 22 bp, Homo sapiens
tggagggcatagctgttctttc

SEQ ID NO: 9409025 - DNA, 22 bp, Homo sapiens
tggagggcatctgtggtcaggc

SEQ ID NO: 9409026 - DNA, 22 bp, Homo sapiens
tggagggcatctgtggtcaggc

SEQ ID NO: 9409027 - DNA, 22 bp, Homo sapiens
tggagggcatagctgttctttc

SEQ ID NO: 9409028 - DNA, 22 bp, Homo sapiens
tggagggcgcttagatggaggg

SEQ ID NO: 9409029 - DNA, 22 bp, Homo sapiens
tggagggcatgctgtccatggg

SEQ ID NO: 9409030 - DNA, 22 bp, Homo sapiens
tggagggcatctgtggtcaggc

SEQ ID NO: 9409031 - DNA, 22 bp, Homo sapiens
tggaggctggagtgcagtggcg

SEQ ID NO: 9409032 - DNA, 22 bp, Homo sapiens
tggaggctggtttctgctgagg

SEQ ID NO: 9409033 - DNA, 22 bp, Homo sapiens
tggaggctgtgtgcatgagacc

SEQ ID NO: 9409034 - DNA, 22 bp, Homo sapiens
tggagggaacccaggctgctct

SEQ ID NO: 9409035 - DNA, 22 bp, Homo sapiens
tggaggtggggctcaggaatct

SEQ ID NO: 9409036 - DNA, 22 bp, Homo sapiens
tggaggtggggctcaggaatct

SEQ ID NO: 9409037 - DNA, 22 bp, Homo sapiens
tggaggtggggctcaggaatct

SEQ ID NO: 9409038 - DNA, 22 bp, Homo sapiens
tggaggtggggctcaggaatct

SEQ ID NO: 9409039 - DNA, 22 bp, Homo sapiens
tggaggtggggctcaggaatct

SEQ ID NO: 9409040 - DNA, 20 bp, Homo sapiens
tggaggtggtctgctgtcct

SEQ ID NO: 9409041 - DNA, 20 bp, Homo sapiens
tggaggtggtctgctgtcct

SEQ ID NO: 9409042 - DNA, 22 bp, Homo sapiens
tggaggtggtgcccagcaattt

SEQ ID NO: 9409043 - DNA, 22 bp, Homo sapiens
tggaggtggtgcccagcaattt

SEQ ID NO: 9409044 - DNA, 22 bp, Homo sapiens
tggaggtgtataaggtagcttc

SEQ ID NO: 9409045 - DNA, 22 bp, Homo sapiens
tggaggtgggagggactgtcct

SEQ ID NO: 9409046 - DNA, 22 bp, Homo sapiens
tggaggtgggagggactgtcct

SEQ ID NO: 9409047 - DNA, 22 bp, Homo sapiens
tggaggtggcatctgacagctg

SEQ ID NO: 9409048 - DNA, 22 bp, Homo sapiens
tggaggtggcatctgacagctg

SEQ ID NO: 9409049 - DNA, 22 bp, Homo sapiens
tggaggtgggagggactgtcct

SEQ ID NO: 9409050 - DNA, 22 bp, Homo sapiens
tggaggtggcatctgacagctg

SEQ ID NO: 9409051 - DNA, 22 bp, Homo sapiens
tggaggtggcatctgacagctg

SEQ ID NO: 9409052 - DNA, 22 bp, Homo sapiens
tggaggtggcacaagggaggtc

SEQ ID NO: 9409053 - DNA, 22 bp, Homo sapiens
tggaggtggcacaagggaggtc

SEQ ID NO: 9409054 - DNA, 22 bp, Homo sapiens
tggaggtggagttggaaactga

SEQ ID NO: 9409055 - DNA, 22 bp, Homo sapiens
tggaggtggagttggaaactga

SEQ ID NO: 9409056 - DNA, 22 bp, Homo sapiens
tggaggtggagttggaaactga

SEQ ID NO: 9409057 - DNA, 18 bp, Homo sapiens
tggagggcttgctgcagc

SEQ ID NO: 9409058 - DNA, 22 bp, Homo sapiens
tggagggctaagctgagggata

SEQ ID NO: 9409059 - DNA, 22 bp, Homo sapiens
tggagggcgcttagatggaggg

SEQ ID NO: 9409060 - DNA, 22 bp, Homo sapiens
tggagggcgcttagatggaggg

SEQ ID NO: 9409061 - DNA, 22 bp, Homo sapiens
tggagggctaagctgagggata

SEQ ID NO: 9409062 - DNA, 22 bp, Homo sapiens
tggagggctaagctgagggata

SEQ ID NO: 9409063 - DNA, 22 bp, Homo sapiens
tggagggctctttcacctggta

SEQ ID NO: 9409064 - DNA, 22 bp, Homo sapiens
tggagggctaagctgagggata

SEQ ID NO: 9409065 - DNA, 22 bp, Homo sapiens
tggaggcccccaggcaacagca

SEQ ID NO: 9409066 - DNA, 22 bp, Homo sapiens
tggaggcccccaggcaacagca

SEQ ID NO: 9409067 - DNA, 22 bp, Homo sapiens
tggaggccgcaatgcagtttcc

SEQ ID NO: 9409068 - DNA, 22 bp, Homo sapiens
tggaggccgcgtagtctgagca

SEQ ID NO: 9409069 - DNA, 20 bp, Homo sapiens
tggaggcctgcaggtttggg

SEQ ID NO: 9409070 - DNA, 22 bp, Homo sapiens
tggaggctggagtgcagtggcg

SEQ ID NO: 9409071 - DNA, 22 bp, Homo sapiens
tggaggcagtcacctgaagtca

SEQ ID NO: 9409072 - DNA, 19 bp, Homo sapiens
tggaggccaggacacaggt

SEQ ID NO: 9409073 - DNA, 19 bp, Homo sapiens
tggaggccaggacacaggt

SEQ ID NO: 9409074 - DNA, 22 bp, Homo sapiens
tggaggcagtcacctgaagtca

SEQ ID NO: 9409075 - DNA, 22 bp, Homo sapiens
tggaggcagtcacctgaagtca

SEQ ID NO: 9409076 - DNA, 22 bp, Homo sapiens
tggaggcagtaactgagcaaca

SEQ ID NO: 9409077 - DNA, 22 bp, Homo sapiens
tggaggcagtaactgagcaaca

SEQ ID NO: 9409078 - DNA, 22 bp, Homo sapiens
tggaggcagtaactgagcaaca

SEQ ID NO: 9409079 - DNA, 22 bp, Homo sapiens
tggaggcagtaactgagcaaca

SEQ ID NO: 9409080 - DNA, 22 bp, Homo sapiens
tggaggcaggttagccagacga

SEQ ID NO: 9409081 - DNA, 22 bp, Homo sapiens
tggaggcaggttagccagacga

SEQ ID NO: 9409082 - DNA, 22 bp, Homo sapiens
tggaggcaccactggctgcccg

SEQ ID NO: 9409083 - DNA, 22 bp, Homo sapiens
tggaggcaccactggctgcccg

SEQ ID NO: 9409084 - DNA, 20 bp, Homo sapiens
tggaggcacctgtggagatc

SEQ ID NO: 9409085 - DNA, 20 bp, Homo sapiens
tggaggcacctgtggagatc

SEQ ID NO: 9409086 - DNA, 22 bp, Homo sapiens
tggaggcaccactggctgcccg

SEQ ID NO: 9409087 - DNA, 22 bp, Homo sapiens
tggaggcaactgaagatgtagt

SEQ ID NO: 9409088 - DNA, 22 bp, Homo sapiens
tggaggcaccactggctgcccg

SEQ ID NO: 9409089 - DNA, 19 bp, Homo sapiens
tggaggcaagacatggagg

SEQ ID NO: 9409090 - DNA, 22 bp, Homo sapiens
tggaggcactaaatggccacaa

SEQ ID NO: 9409091 - DNA, 22 bp, Homo sapiens
tggaggcactaaatggccacaa

SEQ ID NO: 9409092 - DNA, 20 bp, Homo sapiens
tggaggcagagccagaggga

SEQ ID NO: 9409093 - DNA, 22 bp, Homo sapiens
tggaggcactaaatggccacaa

SEQ ID NO: 9409094 - DNA, 20 bp, Homo sapiens
tggaggcagagccagaggga

SEQ ID NO: 9409095 - DNA, 20 bp, Homo sapiens
tggaggcagagccagaggga

SEQ ID NO: 9409096 - DNA, 20 bp, Homo sapiens
tggaggcagagccagaggga

SEQ ID NO: 9409097 - DNA, 23 bp, Homo sapiens
tggaggcaggatgctaaggagtc

SEQ ID NO: 9409098 - DNA, 23 bp, Homo sapiens
tggaggcaggatgctaaggagtc

SEQ ID NO: 9409099 - DNA, 22 bp, Homo sapiens
tggaggcaggggatacaggtca

SEQ ID NO: 9409100 - DNA, 22 bp, Homo sapiens
tggaggcaggggatacaggtca

SEQ ID NO: 9409101 - DNA, 22 bp, Homo sapiens
tggaggcaggggatacaggtca

SEQ ID NO: 9409102 - DNA, 22 bp, Homo sapiens
tggaggcaggtggaggagtgaa

SEQ ID NO: 9409103 - DNA, 22 bp, Homo sapiens
tggaggcaggtggaggagtgaa

SEQ ID NO: 9409104 - DNA, 22 bp, Homo sapiens
tggaggcaggtggaggagtgaa

SEQ ID NO: 9409105 - DNA, 22 bp, Homo sapiens
tggaggcaggagacagggcaaa

SEQ ID NO: 9409106 - DNA, 22 bp, Homo sapiens
tggaggcagccgtgaaccacct

SEQ ID NO: 9409107 - DNA, 22 bp, Homo sapiens
tggaggcaggagacagggcaaa

SEQ ID NO: 9409108 - DNA, 22 bp, Homo sapiens
tggaggcaggagacagggcaaa

SEQ ID NO: 9409109 - DNA, 22 bp, Homo sapiens
tggaggcaggagacagggcaaa

SEQ ID NO: 9409110 - DNA, 22 bp, Homo sapiens
tggaggcaggagacagggcaaa

SEQ ID NO: 9409111 - DNA, 22 bp, Homo sapiens
tggaggcagatacactgtaaaa

SEQ ID NO: 9409112 - DNA, 22 bp, Homo sapiens
tggaggcagatacactgtaaaa

SEQ ID NO: 9409113 - DNA, 18 bp, Homo sapiens
tggaggcagagttctggc

SEQ ID NO: 9409114 - DNA, 18 bp, Homo sapiens
tggaggcagagttctggc

SEQ ID NO: 9409115 - DNA, 23 bp, Homo sapiens
tggagctgggctcagaccctggg

SEQ ID NO: 9409116 - DNA, 22 bp, Homo sapiens
tggagctggggtttgaatctgg

SEQ ID NO: 9409117 - DNA, 22 bp, Homo sapiens
tggagctggggtttgaatctgg

SEQ ID NO: 9409118 - DNA, 22 bp, Homo sapiens
tggagctgggatttgaactgca

SEQ ID NO: 9409119 - DNA, 22 bp, Homo sapiens
tggagctgggagtcctgggctg

SEQ ID NO: 9409120 - DNA, 23 bp, Homo sapiens
tggagctgggcagctgggaaagt

SEQ ID NO: 9409121 - DNA, 23 bp, Homo sapiens
tggagctgggcagctgggaaagt

SEQ ID NO: 9409122 - DNA, 23 bp, Homo sapiens
tggagctgggcagctgggaaagt

SEQ ID NO: 9409123 - DNA, 23 bp, Homo sapiens
tggagctgggcagctgggaaagt

SEQ ID NO: 9409124 - DNA, 23 bp, Homo sapiens
tggagctgggatttgatttgatt

SEQ ID NO: 9409125 - DNA, 22 bp, Homo sapiens
tggagctgggatttgaactgca

SEQ ID NO: 9409126 - DNA, 23 bp, Homo sapiens
tggagctgggatttgatttgatt

SEQ ID NO: 9409127 - DNA, 22 bp, Homo sapiens
tggagctggtaaacagtgacat

SEQ ID NO: 9409128 - DNA, 22 bp, Homo sapiens
tggagctggtaaacagtgacat

SEQ ID NO: 9409129 - DNA, 22 bp, Homo sapiens
tggagctggttctggggaagct

SEQ ID NO: 9409130 - DNA, 20 bp, Homo sapiens
tggagctgtaatcttgtctg

SEQ ID NO: 9409131 - DNA, 20 bp, Homo sapiens
tggagctgtaatcttgtctg

SEQ ID NO: 9409132 - DNA, 22 bp, Homo sapiens
tggagctggttctggggaagct

SEQ ID NO: 9409133 - DNA, 22 bp, Homo sapiens
tggagctgtcactcagaaccaa

SEQ ID NO: 9409134 - DNA, 20 bp, Homo sapiens
tggagctgtggtaaggagca

SEQ ID NO: 9409135 - DNA, 22 bp, Homo sapiens
tggaggaaaaaaccaggcagag

SEQ ID NO: 9409136 - DNA, 22 bp, Homo sapiens
tggaggaaaaaaccaggcagag

SEQ ID NO: 9409137 - DNA, 22 bp, Homo sapiens
tggaggaaaaaaccaggcagag

SEQ ID NO: 9409138 - DNA, 22 bp, Homo sapiens
tggaggagtagattttcagagg

SEQ ID NO: 9409139 - DNA, 22 bp, Homo sapiens
tggaggagtgtgattgtctgcc

SEQ ID NO: 9409140 - DNA, 22 bp, Homo sapiens
tggaggcaactgaagatgtagt

SEQ ID NO: 9409141 - DNA, 22 bp, Homo sapiens
tggaggattccacttacatgag

SEQ ID NO: 9409142 - DNA, 22 bp, Homo sapiens
tggaggcaactgaagatgtagt

SEQ ID NO: 9409143 - DNA, 22 bp, Homo sapiens
tggaggagaatttatggtcgaa

SEQ ID NO: 9409144 - DNA, 22 bp, Homo sapiens
tggaggagaccattccactcag

SEQ ID NO: 9409145 - DNA, 22 bp, Homo sapiens
tggaggagaatttatggtcgaa

SEQ ID NO: 9409146 - DNA, 22 bp, Homo sapiens
tggaggagaatttatggtcgaa

SEQ ID NO: 9409147 - DNA, 22 bp, Homo sapiens
tggaggagaatttatggtcgaa

SEQ ID NO: 9409148 - DNA, 22 bp, Homo sapiens
tggaggagggctggtgtctgta

SEQ ID NO: 9409149 - DNA, 22 bp, Homo sapiens
tggaggagggctggtgtctgta

SEQ ID NO: 9409150 - DNA, 22 bp, Homo sapiens
tggaggaggaacttcttatctc

SEQ ID NO: 9409151 - DNA, 19 bp, Homo sapiens
tggaggagaggaaaagtca

SEQ ID NO: 9409152 - DNA, 22 bp, Homo sapiens
tggagaggagcaccatggccat

SEQ ID NO: 9409153 - DNA, 22 bp, Homo sapiens
tggagaggagcaccatggccat

SEQ ID NO: 9409154 - DNA, 19 bp, Homo sapiens
tggagaggaaatgctgctc

SEQ ID NO: 9409155 - DNA, 19 bp, Homo sapiens
tggagaggaaatgctgctc

SEQ ID NO: 9409156 - DNA, 19 bp, Homo sapiens
tggagaggaaatgctgctc

SEQ ID NO: 9409157 - DNA, 22 bp, Homo sapiens
tggagaggtttaaacaaaagtt

SEQ ID NO: 9409158 - DNA, 22 bp, Homo sapiens
tggagaggttgaataacttgtc

SEQ ID NO: 9409159 - DNA, 22 bp, Homo sapiens
tggagaggtttaaacaaaagtt

SEQ ID NO: 9409160 - DNA, 22 bp, Homo sapiens
tggagaggttgaataacttgtc

SEQ ID NO: 9409161 - DNA, 22 bp, Homo sapiens
tggagagtaaatggcagaatca

SEQ ID NO: 9409162 - DNA, 22 bp, Homo sapiens
tggagagtaaatggcagaatca

SEQ ID NO: 9409163 - DNA, 22 bp, Homo sapiens
tggagagtctcaaggcaggaaa

SEQ ID NO: 9409164 - DNA, 22 bp, Homo sapiens
tggagagtctcaaggcaggaaa

SEQ ID NO: 9409165 - DNA, 22 bp, Homo sapiens
tggagagtaatttctgaagacc

SEQ ID NO: 9409166 - DNA, 22 bp, Homo sapiens
tggagcagagatgggagcccaa

SEQ ID NO: 9409167 - DNA, 22 bp, Homo sapiens
tggagcagagatggtggccttc

SEQ ID NO: 9409168 - DNA, 22 bp, Homo sapiens
tggagcagagatgggagcccaa

SEQ ID NO: 9409169 - DNA, 22 bp, Homo sapiens
tggagcagagatgggagcccaa

SEQ ID NO: 9409170 - DNA, 22 bp, Homo sapiens
tggagcagaaatttgaagccat

SEQ ID NO: 9409171 - DNA, 22 bp, Homo sapiens
tggagcagaaatggcctcttgt

SEQ ID NO: 9409172 - DNA, 22 bp, Homo sapiens
tggagcagaaatggcctcttgt

SEQ ID NO: 9409173 - DNA, 22 bp, Homo sapiens
tggagcagaaatttgaagccat

SEQ ID NO: 9409174 - DNA, 22 bp, Homo sapiens
tggagagtggatatgggagcaa

SEQ ID NO: 9409175 - DNA, 22 bp, Homo sapiens
tggagagttctgtagatatcta

SEQ ID NO: 9409176 - DNA, 22 bp, Homo sapiens
tggagagtgtagacttcagagt

SEQ ID NO: 9409177 - DNA, 22 bp, Homo sapiens
tggagagtctctgagccagggc

SEQ ID NO: 9409178 - DNA, 22 bp, Homo sapiens
tggagagtctctgagccagggc

SEQ ID NO: 9409179 - DNA, 22 bp, Homo sapiens
tggagcagcatcactttgagct

SEQ ID NO: 9409180 - DNA, 22 bp, Homo sapiens
tggagcagcattcatccagcag

SEQ ID NO: 9409181 - DNA, 22 bp, Homo sapiens
tggagcagcattcatccagcag

SEQ ID NO: 9409182 - DNA, 22 bp, Homo sapiens
tggagcagcattcatccagcag

SEQ ID NO: 9409183 - DNA, 22 bp, Homo sapiens
tggagcagccatgatgacagag

SEQ ID NO: 9409184 - DNA, 22 bp, Homo sapiens
tggagcagcacaagaaagggga

SEQ ID NO: 9409185 - DNA, 22 bp, Homo sapiens
tggagcagccttttctaagcaa

SEQ ID NO: 9409186 - DNA, 22 bp, Homo sapiens
tggagcagccttttctaagcaa

SEQ ID NO: 9409187 - DNA, 22 bp, Homo sapiens
tggagcagccatgatgacagag

SEQ ID NO: 9409188 - DNA, 22 bp, Homo sapiens
tggagcagcattcatccagcag

SEQ ID NO: 9409189 - DNA, 22 bp, Homo sapiens
tggagcagccatgatgacagag

SEQ ID NO: 9409190 - DNA, 22 bp, Homo sapiens
tggagcagccatgatgacagag

SEQ ID NO: 9409191 - DNA, 22 bp, Homo sapiens
tggagcagaggctgaggttggg

SEQ ID NO: 9409192 - DNA, 22 bp, Homo sapiens
tggagcagaggctgaggttggg

SEQ ID NO: 9409193 - DNA, 22 bp, Homo sapiens
tggagcagagttcagcggggag

SEQ ID NO: 9409194 - DNA, 22 bp, Homo sapiens
tggagcagagttcagcggggag

SEQ ID NO: 9409195 - DNA, 22 bp, Homo sapiens
tggagcagcacaagaaagggga

SEQ ID NO: 9409196 - DNA, 22 bp, Homo sapiens
tggagcagcacaagaaagggga

SEQ ID NO: 9409197 - DNA, 22 bp, Homo sapiens
tggagcagcacaagaaagggga

SEQ ID NO: 9409198 - DNA, 22 bp, Homo sapiens
tggagcagagttcagcggggag

SEQ ID NO: 9409199 - DNA, 22 bp, Homo sapiens
tggagcagagttcagcggggag

SEQ ID NO: 9409200 - DNA, 22 bp, Homo sapiens
tggagcagagatggtggccttc

SEQ ID NO: 9409201 - DNA, 22 bp, Homo sapiens
tggagcagaggaagaaggcttt

SEQ ID NO: 9409202 - DNA, 22 bp, Homo sapiens
tggagcagagatggtggccttc

SEQ ID NO: 9409203 - DNA, 22 bp, Homo sapiens
tggagcagaggctgaggttggg

SEQ ID NO: 9409204 - DNA, 22 bp, Homo sapiens
tggagcagaggaagaaggcttt

SEQ ID NO: 9409205 - DNA, 22 bp, Homo sapiens
tggagagaaagttgaatggagg

SEQ ID NO: 9409206 - DNA, 22 bp, Homo sapiens
tggagagaaaaaagacagttct

SEQ ID NO: 9409207 - DNA, 22 bp, Homo sapiens
tggagaagtcaaagtgaacagg

SEQ ID NO: 9409208 - DNA, 22 bp, Homo sapiens
tggagaagtcaaagtgaacagg

SEQ ID NO: 9409209 - DNA, 22 bp, Homo sapiens
tggagaagtcaaagtgaacagg

SEQ ID NO: 9409210 - DNA, 22 bp, Homo sapiens
tggagaagtcaaagtgaacagg

SEQ ID NO: 9409211 - DNA, 22 bp, Homo sapiens
tggagagaacagtgtctgaaag

SEQ ID NO: 9409212 - DNA, 22 bp, Homo sapiens
tggagagaacagtgtctgaaag

SEQ ID NO: 9409213 - DNA, 22 bp, Homo sapiens
tggagagaagaggcagtgtgct

SEQ ID NO: 9409214 - DNA, 22 bp, Homo sapiens
tggagagaagaggcagtgtgct

SEQ ID NO: 9409215 - DNA, 22 bp, Homo sapiens
tggagagagtcgggatagtaca

SEQ ID NO: 9409216 - DNA, 22 bp, Homo sapiens
tggagaaggacagcctgagaaa

SEQ ID NO: 9409217 - DNA, 22 bp, Homo sapiens
tggagaaggacagcctgagaaa

SEQ ID NO: 9409218 - DNA, 22 bp, Homo sapiens
tggagaaggccggccaggagtg

SEQ ID NO: 9409219 - DNA, 22 bp, Homo sapiens
tggagaaggccggccaggagtg

SEQ ID NO: 9409220 - DNA, 22 bp, Homo sapiens
tggagaaggggcagggtctcca

SEQ ID NO: 9409221 - DNA, 22 bp, Homo sapiens
tggagaagctgtaggtggactc

SEQ ID NO: 9409222 - DNA, 22 bp, Homo sapiens
tggagaagctgtaggtggactc

SEQ ID NO: 9409223 - DNA, 22 bp, Homo sapiens
tggagaagattggtcaccattc

SEQ ID NO: 9409224 - DNA, 22 bp, Homo sapiens
tggagagcgtgcttagcactct

SEQ ID NO: 9409225 - DNA, 22 bp, Homo sapiens
tggagagcgtgcttagcactct

SEQ ID NO: 9409226 - DNA, 22 bp, Homo sapiens
tggagagcgtgcttagcactct

SEQ ID NO: 9409227 - DNA, 22 bp, Homo sapiens
tggagagctggttcaaagcaga

SEQ ID NO: 9409228 - DNA, 22 bp, Homo sapiens
tggagagcctggagtccctgat

SEQ ID NO: 9409229 - DNA, 22 bp, Homo sapiens
tggagaggaaagtgcagttttg

SEQ ID NO: 9409230 - DNA, 22 bp, Homo sapiens
tggagaggaaagtgcagttttg

SEQ ID NO: 9409231 - DNA, 22 bp, Homo sapiens
tggagaggaaagtgcagttttg

SEQ ID NO: 9409232 - DNA, 22 bp, Homo sapiens
tggagaggaaagtgcagttttg

SEQ ID NO: 9409233 - DNA, 19 bp, Homo sapiens
tggagaggaaatgctgctc

SEQ ID NO: 9409234 - DNA, 19 bp, Homo sapiens
tggagaggaaatgctgctc

SEQ ID NO: 9409235 - DNA, 19 bp, Homo sapiens
tggagaggaaatgctgctc

SEQ ID NO: 9409236 - DNA, 22 bp, Homo sapiens
tggagagcaagtcgcagacatg

SEQ ID NO: 9409237 - DNA, 22 bp, Homo sapiens
tggagagcaagtcgcagacatg

SEQ ID NO: 9409238 - DNA, 22 bp, Homo sapiens
tggagagcaagtcgcagacatg

SEQ ID NO: 9409239 - DNA, 22 bp, Homo sapiens
tggagagcaagtcgcagacatg

SEQ ID NO: 9409240 - DNA, 22 bp, Homo sapiens
tggagagcaatgaggggcaggc

SEQ ID NO: 9409241 - DNA, 18 bp, Homo sapiens
tggagagcagcagtgggg

SEQ ID NO: 9409242 - DNA, 22 bp, Homo sapiens
tggagagcagggctggagttca

SEQ ID NO: 9409243 - DNA, 18 bp, Homo sapiens
tggagagcagcagtgggg

SEQ ID NO: 9409244 - DNA, 18 bp, Homo sapiens
tggagagcagcagtgggg

SEQ ID NO: 9409245 - DNA, 22 bp, Homo sapiens
tggagagcaggggatgcgggcg

SEQ ID NO: 9409246 - DNA, 22 bp, Homo sapiens
tggagagcagggctggagttca

SEQ ID NO: 9409247 - DNA, 22 bp, Homo sapiens
tggagagcagggctggagttca

SEQ ID NO: 9409248 - DNA, 20 bp, Homo sapiens
tggagagcctctggactgtg

SEQ ID NO: 9409249 - DNA, 20 bp, Homo sapiens
tggagagcctctggactgtg

SEQ ID NO: 9409250 - DNA, 20 bp, Homo sapiens
tggagagcctctggactgtg

SEQ ID NO: 9409251 - DNA, 22 bp, Homo sapiens
tggagagcaggggatgcgggcg

SEQ ID NO: 9409252 - DNA, 18 bp, Homo sapiens
tggagcaggtaggcatga

SEQ ID NO: 9409253 - DNA, 18 bp, Homo sapiens
tggagcaggtaggcatga

SEQ ID NO: 9409254 - DNA, 22 bp, Homo sapiens
tggagcaggacggggagtggta

SEQ ID NO: 9409255 - DNA, 22 bp, Homo sapiens
tggagcaggacggggagtggta

SEQ ID NO: 9409256 - DNA, 22 bp, Homo sapiens
tggagcaggaagtctatggctg

SEQ ID NO: 9409257 - DNA, 22 bp, Homo sapiens
tggagcaggacggggagtggta

SEQ ID NO: 9409258 - DNA, 22 bp, Homo sapiens
tggagcaggacggggagtggta

SEQ ID NO: 9409259 - DNA, 22 bp, Homo sapiens
tggagcaggacggggagtggta

SEQ ID NO: 9409260 - DNA, 22 bp, Homo sapiens
tggagcaggaagtctatggctg

SEQ ID NO: 9409261 - DNA, 22 bp, Homo sapiens
tggagcaggaagtctatggctg

SEQ ID NO: 9409262 - DNA, 22 bp, Homo sapiens
tggagcaggtgccaggtgtgtg

SEQ ID NO: 9409263 - DNA, 22 bp, Homo sapiens
tggagcaggtgccaggtgtgtg

SEQ ID NO: 9409264 - DNA, 22 bp, Homo sapiens
tggagcaggtgctcagggtaat

SEQ ID NO: 9409265 - DNA, 22 bp, Homo sapiens
tggagcaggtgccaggtgtgtg

SEQ ID NO: 9409266 - DNA, 22 bp, Homo sapiens
tggagcaggtgccaggtgtgtg

SEQ ID NO: 9409267 - DNA, 22 bp, Homo sapiens
tggagcaggtgccaggtgtgtg

SEQ ID NO: 9409268 - DNA, 22 bp, Homo sapiens
tggagcaggtcggcaccatttg

SEQ ID NO: 9409269 - DNA, 22 bp, Homo sapiens
tggagcaggtcggcaccatttg

SEQ ID NO: 9409270 - DNA, 22 bp, Homo sapiens
tggagcaggaaacatctagagg

SEQ ID NO: 9409271 - DNA, 22 bp, Homo sapiens
tggagcaggaaacatctagagg

SEQ ID NO: 9409272 - DNA, 22 bp, Homo sapiens
tggagcaggaaacatctagagg

SEQ ID NO: 9409273 - DNA, 18 bp, Homo sapiens
tggagcaggaagcctggc

SEQ ID NO: 9409274 - DNA, 18 bp, Homo sapiens
tggagcaggaagcctggc

SEQ ID NO: 9409275 - DNA, 22 bp, Homo sapiens
tggagcaggaagtctatggctg

SEQ ID NO: 9409276 - DNA, 22 bp, Homo sapiens
tggagcaggaagtctatggctg

SEQ ID NO: 9409277 - DNA, 18 bp, Homo sapiens
tggagcaggaagcctggc

SEQ ID NO: 9409278 - DNA, 22 bp, Homo sapiens
tggagcagctgaacagagttga

SEQ ID NO: 9409279 - DNA, 22 bp, Homo sapiens
tggagcagctgaacagagttga

SEQ ID NO: 9409280 - DNA, 22 bp, Homo sapiens
tggagcagctctagcgggcgcc

SEQ ID NO: 9409281 - DNA, 22 bp, Homo sapiens
tggagcagctctagcgggcgcc

SEQ ID NO: 9409282 - DNA, 22 bp, Homo sapiens
tggagcagctctagcgggcgcc

SEQ ID NO: 9409283 - DNA, 22 bp, Homo sapiens
tggagcagctaagcctctgaga

SEQ ID NO: 9409284 - DNA, 22 bp, Homo sapiens
tggagcagctaagcctctgaga

SEQ ID NO: 9409285 - DNA, 22 bp, Homo sapiens
tggagcagctaagcctctgaga

SEQ ID NO: 9409286 - DNA, 22 bp, Homo sapiens
tggagcagctaagcctctgaga

SEQ ID NO: 9409287 - DNA, 22 bp, Homo sapiens
tggagcagctctagcgggcgcc

SEQ ID NO: 9409288 - DNA, 22 bp, Homo sapiens
tggagccagcggcctgctgagg

SEQ ID NO: 9409289 - DNA, 22 bp, Homo sapiens
tggagccagcggcctgctgagg

SEQ ID NO: 9409290 - DNA, 22 bp, Homo sapiens
tggagccagagcgcagcctggg

SEQ ID NO: 9409291 - DNA, 22 bp, Homo sapiens
tggagccactcactatctgagt

SEQ ID NO: 9409292 - DNA, 22 bp, Homo sapiens
tggagccagcaggactcagagg

SEQ ID NO: 9409293 - DNA, 22 bp, Homo sapiens
tggagcaggtgggatgtcgtga

SEQ ID NO: 9409294 - DNA, 22 bp, Homo sapiens
tggagcaggtgggatgtcgtga

SEQ ID NO: 9409295 - DNA, 22 bp, Homo sapiens
tggagcagtggtcctggagatg

SEQ ID NO: 9409296 - DNA, 22 bp, Homo sapiens
tggagcaggtgctcagggtaat

SEQ ID NO: 9409297 - DNA, 22 bp, Homo sapiens
tggagcaggtgctcagggtaat

SEQ ID NO: 9409298 - DNA, 22 bp, Homo sapiens
tggagccaatgaacatttgctg

SEQ ID NO: 9409299 - DNA, 22 bp, Homo sapiens
tggagccaaaaagggaaggaga

SEQ ID NO: 9409300 - DNA, 22 bp, Homo sapiens
tggagcagtggtcctggagatg

SEQ ID NO: 9409301 - DNA, 22 bp, Homo sapiens
tggagcagtggtcctggagatg

SEQ ID NO: 9409302 - DNA, 22 bp, Homo sapiens
tggagctggaagaatgtagacg

SEQ ID NO: 9409303 - DNA, 21 bp, Homo sapiens
tggagctgccacttgtcctcc

SEQ ID NO: 9409304 - DNA, 21 bp, Homo sapiens
tggagctgccacttgagctgc

SEQ ID NO: 9409305 - DNA, 18 bp, Homo sapiens
tggagctgagtgctgtgc

SEQ ID NO: 9409306 - DNA, 22 bp, Homo sapiens
tggagctgatacagctggcttt

SEQ ID NO: 9409307 - DNA, 22 bp, Homo sapiens
tggagctgatacagctggcttt

SEQ ID NO: 9409308 - DNA, 18 bp, Homo sapiens
tggagctgagtgctgtgc

SEQ ID NO: 9409309 - DNA, 18 bp, Homo sapiens
tggagctgagtgctgtgc

SEQ ID NO: 9409310 - DNA, 21 bp, Homo sapiens
tggagctgccacttgagctgc

SEQ ID NO: 9409311 - DNA, 22 bp, Homo sapiens
tggagctgatacagctggcttt

SEQ ID NO: 9409312 - DNA, 22 bp, Homo sapiens
tggagctgatacagctggcttt

SEQ ID NO: 9409313 - DNA, 22 bp, Homo sapiens
tggagctggaatttctgggcct

SEQ ID NO: 9409314 - DNA, 22 bp, Homo sapiens
tggagctggaatttgagctgga

SEQ ID NO: 9409315 - DNA, 22 bp, Homo sapiens
tggagctggaagacagtgatat

SEQ ID NO: 9409316 - DNA, 22 bp, Homo sapiens
tggagctggaatttgagctgga

SEQ ID NO: 9409317 - DNA, 22 bp, Homo sapiens
tggagctggaatttgagctgga

SEQ ID NO: 9409318 - DNA, 22 bp, Homo sapiens
tggagctggcttgtggaagttg

SEQ ID NO: 9409319 - DNA, 22 bp, Homo sapiens
tggagctgggagtcctgggctg

SEQ ID NO: 9409320 - DNA, 22 bp, Homo sapiens
tggagctggcttgtggaagttg

SEQ ID NO: 9409321 - DNA, 22 bp, Homo sapiens
tggagctggcttgtggaagttg

SEQ ID NO: 9409322 - DNA, 22 bp, Homo sapiens
tggagctggcttgtggaagttg

SEQ ID NO: 9409323 - DNA, 22 bp, Homo sapiens
tggagctggcttgtggaagttg

SEQ ID NO: 9409324 - DNA, 23 bp, Homo sapiens
tggagctgacagtcagagggagg

SEQ ID NO: 9409325 - DNA, 22 bp, Homo sapiens
tggagctgaggggaatgctgag

SEQ ID NO: 9409326 - DNA, 22 bp, Homo sapiens
tggagcgagctcaaaggcagga

SEQ ID NO: 9409327 - DNA, 22 bp, Homo sapiens
tggagccttttacccacaggag

SEQ ID NO: 9409328 - DNA, 22 bp, Homo sapiens
tggagcctgtgtttctgcccag

SEQ ID NO: 9409329 - DNA, 22 bp, Homo sapiens
tggagcctccagtctttctaga

SEQ ID NO: 9409330 - DNA, 22 bp, Homo sapiens
tggagcctcctcacactgtggc

SEQ ID NO: 9409331 - DNA, 22 bp, Homo sapiens
tggagcccagacactggcattg

SEQ ID NO: 9409332 - DNA, 22 bp, Homo sapiens
tggagcccacggatgtcgcttt

SEQ ID NO: 9409333 - DNA, 22 bp, Homo sapiens
tggagcccacggatgtcgcttt

SEQ ID NO: 9409334 - DNA, 22 bp, Homo sapiens
tggaaaaaacccagactctaga

SEQ ID NO: 9409335 - DNA, 22 bp, Homo sapiens
tgctttttgcaccctttgccgt

SEQ ID NO: 9409336 - DNA, 22 bp, Homo sapiens
tgctttttagtactgtcttatt

SEQ ID NO: 9409337 - DNA, 22 bp, Homo sapiens
tgcttttatttaatatcttgca

SEQ ID NO: 9409338 - DNA, 22 bp, Homo sapiens
tgctttgtgatatgctgtgtct

SEQ ID NO: 9409339 - DNA, 22 bp, Homo sapiens
tgcttttaagaacaatgctgct

SEQ ID NO: 9409340 - DNA, 22 bp, Homo sapiens
tgcttttagctagtaactagta

SEQ ID NO: 9409341 - DNA, 22 bp, Homo sapiens
tgctttgtgacagattagtttt

SEQ ID NO: 9409342 - DNA, 22 bp, Homo sapiens
tgctttgggtctctctagtttc

SEQ ID NO: 9409343 - DNA, 22 bp, Homo sapiens
tgctttgggtctctctagtttc

SEQ ID NO: 9409344 - DNA, 21 bp, Homo sapiens
tgctttgggaattctcagtct

SEQ ID NO: 9409345 - DNA, 22 bp, Homo sapiens
tgctttggatctatttgctgag

SEQ ID NO: 9409346 - DNA, 22 bp, Homo sapiens
tgctttggccactagaattcag

SEQ ID NO: 9409347 - DNA, 22 bp, Homo sapiens
tggaaaatatttaggtgaatga

SEQ ID NO: 9409348 - DNA, 21 bp, Homo sapiens
tggaaaacatttaaatagcaa

SEQ ID NO: 9409349 - DNA, 22 bp, Homo sapiens
tggaaaattagtagtgaaaggc

SEQ ID NO: 9409350 - DNA, 19 bp, Homo sapiens
tggaaaatggattgaatca

SEQ ID NO: 9409351 - DNA, 17 bp, Homo sapiens
tggaaacaaaacttatt

SEQ ID NO: 9409352 - DNA, 22 bp, Homo sapiens
tggaaacacccacgcatgcata

SEQ ID NO: 9409353 - DNA, 22 bp, Homo sapiens
tggaaacacccacgcatgcata

SEQ ID NO: 9409354 - DNA, 22 bp, Homo sapiens
tggaaacactgcatgttcaccc

SEQ ID NO: 9409355 - DNA, 22 bp, Homo sapiens
tggaaacaggagaatatcttct

SEQ ID NO: 9409356 - DNA, 22 bp, Homo sapiens
tggaaagaggtagaggatctgg

SEQ ID NO: 9409357 - DNA, 18 bp, Homo sapiens
tggaaattgaaacagaaa

SEQ ID NO: 9409358 - DNA, 22 bp, Homo sapiens
tggaacaagacagcatagagct

SEQ ID NO: 9409359 - DNA, 22 bp, Homo sapiens
tggaagaaaattcaatcgagtt

SEQ ID NO: 9409360 - DNA, 23 bp, Homo sapiens
tggaagaaaatggtttggctgtg

SEQ ID NO: 9409361 - DNA, 22 bp, Homo sapiens
tggaacctaaaaatgtcattgc

SEQ ID NO: 9409362 - DNA, 22 bp, Homo sapiens
tggaacactttcagtagctatt

SEQ ID NO: 9409363 - DNA, 19 bp, Homo sapiens
tggaaatggaagctcagcc

SEQ ID NO: 9409364 - DNA, 22 bp, Homo sapiens
tggaaatggatctgatgagtct

SEQ ID NO: 9409365 - DNA, 22 bp, Homo sapiens
tggaaatattgggtaatagttg

SEQ ID NO: 9409366 - DNA, 22 bp, Homo sapiens
tggaaaggacagttgctgatag

SEQ ID NO: 9409367 - DNA, 22 bp, Homo sapiens
tggaaagcagttcttagaatcg

SEQ ID NO: 9409368 - DNA, 22 bp, Homo sapiens
tggaaagggacttatgagttcc

SEQ ID NO: 9409369 - DNA, 22 bp, Homo sapiens
tggaaaggaggcttgtggaata

SEQ ID NO: 9409370 - DNA, 22 bp, Homo sapiens
tggaaaggaggcttgtggaata

SEQ ID NO: 9409371 - DNA, 22 bp, Homo sapiens
tggaaagtctcttttgactgta

SEQ ID NO: 9409372 - DNA, 22 bp, Homo sapiens
tggaaaggtgtaaagcagaacc

SEQ ID NO: 9409373 - DNA, 22 bp, Homo sapiens
tggaaagtgctctagactttct

SEQ ID NO: 9409374 - DNA, 22 bp, Homo sapiens
tgcttgtcttcaggattatggt

SEQ ID NO: 9409375 - DNA, 22 bp, Homo sapiens
tgcttgtctctctgtgcccact

SEQ ID NO: 9409376 - DNA, 21 bp, Homo sapiens
tgcttgtctgcctagaggctt

SEQ ID NO: 9409377 - DNA, 22 bp, Homo sapiens
tgcttgtcttcaggaatgctga

SEQ ID NO: 9409378 - DNA, 19 bp, Homo sapiens
tgcttgcctgcctttccca

SEQ ID NO: 9409379 - DNA, 22 bp, Homo sapiens
tgcttgctatgcatcctgaact

SEQ ID NO: 9409380 - DNA, 22 bp, Homo sapiens
tgcttgctccctcacactgtcc

SEQ ID NO: 9409381 - DNA, 22 bp, Homo sapiens
tgcttgaaaggggtttcccagt

SEQ ID NO: 9409382 - DNA, 21 bp, Homo sapiens
tgcttgttctctgtccttgca

SEQ ID NO: 9409383 - DNA, 22 bp, Homo sapiens
tgcttgtgagagttttttcaga

SEQ ID NO: 9409384 - DNA, 22 bp, Homo sapiens
tgcttgttcatggcctagtggc

SEQ ID NO: 9409385 - DNA, 22 bp, Homo sapiens
tgctttaccttccatttaagga

SEQ ID NO: 9409386 - DNA, 22 bp, Homo sapiens
tgctttaccttcccagaaacca

SEQ ID NO: 9409387 - DNA, 22 bp, Homo sapiens
tgctttataaccatttctgtgg

SEQ ID NO: 9409388 - DNA, 22 bp, Homo sapiens
tgctttaacgctgagggtctca

SEQ ID NO: 9409389 - DNA, 22 bp, Homo sapiens
tgcttctggagtaacagggtga

SEQ ID NO: 9409390 - DNA, 22 bp, Homo sapiens
tgcttctgggtaggcctcagga

SEQ ID NO: 9409391 - DNA, 22 bp, Homo sapiens
tgcttctggggacaggctgcct

SEQ ID NO: 9409392 - DNA, 22 bp, Homo sapiens
tgcttcttactcatatgctgat

SEQ ID NO: 9409393 - DNA, 22 bp, Homo sapiens
tgcttcttactcatatgctgat

SEQ ID NO: 9409394 - DNA, 22 bp, Homo sapiens
tgcttctgtttgtttctgtcat

SEQ ID NO: 9409395 - DNA, 22 bp, Homo sapiens
tgcttctttactataggcaatt

SEQ ID NO: 9409396 - DNA, 22 bp, Homo sapiens
tgcttcttcctccatgtgttct

SEQ ID NO: 9409397 - DNA, 22 bp, Homo sapiens
tgcttctttatgatgtatgatt

SEQ ID NO: 9409398 - DNA, 22 bp, Homo sapiens
tgctttctctctaccccacttt

SEQ ID NO: 9409399 - DNA, 22 bp, Homo sapiens
tgctttattcgacatctggtag

SEQ ID NO: 9409400 - DNA, 22 bp, Homo sapiens
tgctttattaagagagaaattt

SEQ ID NO: 9409401 - DNA, 22 bp, Homo sapiens
tgctttatgttatcagaagggt

SEQ ID NO: 9409402 - DNA, 22 bp, Homo sapiens
tgctttattcccttctgatgtg

SEQ ID NO: 9409403 - DNA, 22 bp, Homo sapiens
tgctttattcagtctctgccat

SEQ ID NO: 9409404 - DNA, 22 bp, Homo sapiens
tgctttattcagggtttacccc

SEQ ID NO: 9409405 - DNA, 22 bp, Homo sapiens
tgctttctttagctcctgagtc

SEQ ID NO: 9409406 - DNA, 22 bp, Homo sapiens
tgctttctttagctcctgagtc

SEQ ID NO: 9409407 - DNA, 22 bp, Homo sapiens
tgctttgaaagataatactgtc

SEQ ID NO: 9409408 - DNA, 21 bp, Homo sapiens
tgctttatgggaaaaatgtca

SEQ ID NO: 9409409 - DNA, 22 bp, Homo sapiens
tgctttatgttatcagaagggt

SEQ ID NO: 9409410 - DNA, 22 bp, Homo sapiens
tgctttatgtggctgatactca

SEQ ID NO: 9409411 - DNA, 18 bp, Homo sapiens
tgctttatgcttatataa

SEQ ID NO: 9409412 - DNA, 18 bp, Homo sapiens
tgctttatgcttatataa

SEQ ID NO: 9409413 - DNA, 20 bp, Homo sapiens
tgctttatgctatactttgt

SEQ ID NO: 9409414 - DNA, 22 bp, Homo sapiens
tgctttatggagcccatctcat

SEQ ID NO: 9409415 - DNA, 22 bp, Homo sapiens
tgctttatggatttgtgtcctg

SEQ ID NO: 9409416 - DNA, 22 bp, Homo sapiens
tgctttatcaaagctatagtga

SEQ ID NO: 9409417 - DNA, 22 bp, Homo sapiens
tgctttatctgtgagaacctga

SEQ ID NO: 9409418 - DNA, 22 bp, Homo sapiens
tgctttatctgacttggcgctg

SEQ ID NO: 9409419 - DNA, 22 bp, Homo sapiens
tgctttatagacaaggaagtag

SEQ ID NO: 9409420 - DNA, 22 bp, Homo sapiens
tgctttataacttagtttatgg

SEQ ID NO: 9409421 - DNA, 22 bp, Homo sapiens
tgctttatatctctcttcttag

SEQ ID NO: 9409422 - DNA, 22 bp, Homo sapiens
tgctttataggggattgcaggc

SEQ ID NO: 9409423 - DNA, 22 bp, Homo sapiens
tggaagagcaggcagacaatgc

SEQ ID NO: 9409424 - DNA, 19 bp, Homo sapiens
tggaagaggaagggaaata

SEQ ID NO: 9409425 - DNA, 22 bp, Homo sapiens
tggaagagcaggcagacaatgc

SEQ ID NO: 9409426 - DNA, 22 bp, Homo sapiens
tggaagagaaaggagtggatct

SEQ ID NO: 9409427 - DNA, 22 bp, Homo sapiens
tggaagagaaaggagtggatct

SEQ ID NO: 9409428 - DNA, 22 bp, Homo sapiens
tggaagacattgctttcctttg

SEQ ID NO: 9409429 - DNA, 22 bp, Homo sapiens
tggaagacattgctttcctttg

SEQ ID NO: 9409430 - DNA, 22 bp, Homo sapiens
tggaagacattattttgtttgt

SEQ ID NO: 9409431 - DNA, 22 bp, Homo sapiens
tggaagacattattttgtttgt

SEQ ID NO: 9409432 - DNA, 22 bp, Homo sapiens
tggaagacatactgttttctta

SEQ ID NO: 9409433 - DNA, 22 bp, Homo sapiens
tggaagacattttggaccttgg

SEQ ID NO: 9409434 - DNA, 22 bp, Homo sapiens
tggaagaccacaagcccttaac

SEQ ID NO: 9409435 - DNA, 22 bp, Homo sapiens
tggaagactatcccgtgatttt

SEQ ID NO: 9409436 - DNA, 22 bp, Homo sapiens
tggaagacggaaatctgtagat

SEQ ID NO: 9409437 - DNA, 22 bp, Homo sapiens
tggaagaccagacttcccgaac

SEQ ID NO: 9409438 - DNA, 23 bp, Homo sapiens
tggaagactcctctcttggctgc

SEQ ID NO: 9409439 - DNA, 22 bp, Homo sapiens
tggaagactcaaggtggtgaat

SEQ ID NO: 9409440 - DNA, 22 bp, Homo sapiens
tggaagagaaaatccaccctta

SEQ ID NO: 9409441 - DNA, 22 bp, Homo sapiens
tggaagaggccagaaagtggga

SEQ ID NO: 9409442 - DNA, 20 bp, Homo sapiens
tggaagaggagatgcctctg

SEQ ID NO: 9409443 - DNA, 20 bp, Homo sapiens
tggaagaggagatgcctctg

SEQ ID NO: 9409444 - DNA, 19 bp, Homo sapiens
tggaagaggaagggaaata

SEQ ID NO: 9409445 - DNA, 22 bp, Homo sapiens
tggaagaggcccatgactgcct

SEQ ID NO: 9409446 - DNA, 22 bp, Homo sapiens
tggaagaggcccatgactgcct

SEQ ID NO: 9409447 - DNA, 22 bp, Homo sapiens
tggaagaggccagaaagtggga

SEQ ID NO: 9409448 - DNA, 22 bp, Homo sapiens
tggaagaggtggaagtggcttc

SEQ ID NO: 9409449 - DNA, 22 bp, Homo sapiens
tggaagaggtggaagtggcttc

SEQ ID NO: 9409450 - DNA, 22 bp, Homo sapiens
tggaagagggagctgggtggcc

SEQ ID NO: 9409451 - DNA, 22 bp, Homo sapiens
tggaagagggagctgggtggcc

SEQ ID NO: 9409452 - DNA, 22 bp, Homo sapiens
tggaagagggagctgggtggcc

SEQ ID NO: 9409453 - DNA, 22 bp, Homo sapiens
tggaaggaaaggtagcagagaa

SEQ ID NO: 9409454 - DNA, 22 bp, Homo sapiens
tggaagcttctgaccatttttg

SEQ ID NO: 9409455 - DNA, 22 bp, Homo sapiens
tggaagcttttgagattgttgc

SEQ ID NO: 9409456 - DNA, 22 bp, Homo sapiens
tggaaggaagccaaggaaggtt

SEQ ID NO: 9409457 - DNA, 22 bp, Homo sapiens
tggaaggaagccaaggaaggtt

SEQ ID NO: 9409458 - DNA, 22 bp, Homo sapiens
tggaagcggacgttgtggggtg

SEQ ID NO: 9409459 - DNA, 22 bp, Homo sapiens
tggaagcgagacagagatctcc

SEQ ID NO: 9409460 - DNA, 22 bp, Homo sapiens
tggaagcggtgctggcccatgg

SEQ ID NO: 9409461 - DNA, 22 bp, Homo sapiens
tggaagcctcagtttgccttct

SEQ ID NO: 9409462 - DNA, 22 bp, Homo sapiens
tggaagctagagcttagtctcg

SEQ ID NO: 9409463 - DNA, 18 bp, Homo sapiens
tggaagctggcagatttt

SEQ ID NO: 9409464 - DNA, 22 bp, Homo sapiens
tggaagctcaaggcagggtgag

SEQ ID NO: 9409465 - DNA, 17 bp, Homo sapiens
tggaagcttcatgttgg

SEQ ID NO: 9409466 - DNA, 17 bp, Homo sapiens
tggaagcttcatgttgg

SEQ ID NO: 9409467 - DNA, 22 bp, Homo sapiens
tggaagcttcctgttcttgagg

SEQ ID NO: 9409468 - DNA, 22 bp, Homo sapiens
tggaagcatagcagcgtgtgtg

SEQ ID NO: 9409469 - DNA, 22 bp, Homo sapiens
tggaagccaaggtcagaaggag

SEQ ID NO: 9409470 - DNA, 22 bp, Homo sapiens
tggaagccagctgggcacctgc

SEQ ID NO: 9409471 - DNA, 22 bp, Homo sapiens
tggaagccaggcccgctcctaa

SEQ ID NO: 9409472 - DNA, 22 bp, Homo sapiens
tggaagcccagaaggaagcaga

SEQ ID NO: 9409473 - DNA, 22 bp, Homo sapiens
tggaatctgtatgtatgtataa

SEQ ID NO: 9409474 - DNA, 22 bp, Homo sapiens
tggaatctgtgctgttttagtg

SEQ ID NO: 9409475 - DNA, 23 bp, Homo sapiens
tggaatcttcgatattgattcag

SEQ ID NO: 9409476 - DNA, 22 bp, Homo sapiens
tggaatagaggtgctgatatta

SEQ ID NO: 9409477 - DNA, 23 bp, Homo sapiens
tggaataataaggtacattaaca

SEQ ID NO: 9409478 - DNA, 20 bp, Homo sapiens
tggaataagttaagttgttt

SEQ ID NO: 9409479 - DNA, 23 bp, Homo sapiens
tggaataataaggtacattaaca

SEQ ID NO: 9409480 - DNA, 22 bp, Homo sapiens
tggaataactcaccaaggtcat

SEQ ID NO: 9409481 - DNA, 22 bp, Homo sapiens
tggaataactcaccaaggtcat

SEQ ID NO: 9409482 - DNA, 22 bp, Homo sapiens
tggaagtgtctacatgtggagt

SEQ ID NO: 9409483 - DNA, 22 bp, Homo sapiens
tggaagtgtcctcttctgagtc

SEQ ID NO: 9409484 - DNA, 22 bp, Homo sapiens
tggaagtgctcttctgaccaac

SEQ ID NO: 9409485 - DNA, 22 bp, Homo sapiens
tggaagtgctaaactggagtgt

SEQ ID NO: 9409486 - DNA, 22 bp, Homo sapiens
tggaagtggcagaaaatgaaca

SEQ ID NO: 9409487 - DNA, 22 bp, Homo sapiens
tggaagtggcagaaaatgaaca

SEQ ID NO: 9409488 - DNA, 21 bp, Homo sapiens
tggaagtcttgagtagggggc

SEQ ID NO: 9409489 - DNA, 22 bp, Homo sapiens
tggaagtccctgtgtgtggcct

SEQ ID NO: 9409490 - DNA, 22 bp, Homo sapiens
tggaagtgccttgctggctgtg

SEQ ID NO: 9409491 - DNA, 22 bp, Homo sapiens
tggaagtgatgctgaggtgacg

SEQ ID NO: 9409492 - DNA, 22 bp, Homo sapiens
tggaaggggagctggaaagggg

SEQ ID NO: 9409493 - DNA, 22 bp, Homo sapiens
tggaaggggccaggcgcggagt

SEQ ID NO: 9409494 - DNA, 22 bp, Homo sapiens
tggaaggggccaggcgcggagt

SEQ ID NO: 9409495 - DNA, 22 bp, Homo sapiens
tggaagggggaagacagctctg

SEQ ID NO: 9409496 - DNA, 22 bp, Homo sapiens
tggaaggtgtggcaggtctagt

SEQ ID NO: 9409497 - DNA, 22 bp, Homo sapiens
tggaaggtgtggcaggtctagt

SEQ ID NO: 9409498 - DNA, 20 bp, Homo sapiens
tggaaggtcccagaggaatt

SEQ ID NO: 9409499 - DNA, 22 bp, Homo sapiens
tggaaggggttacgcagcagga

SEQ ID NO: 9409500 - DNA, 22 bp, Homo sapiens
tggaagggggaagacagctctg

SEQ ID NO: 9409501 - DNA, 22 bp, Homo sapiens
tggaaggagactgggaagtgtg

SEQ ID NO: 9409502 - DNA, 22 bp, Homo sapiens
tggaaggagctaaggacctggg

SEQ ID NO: 9409503 - DNA, 22 bp, Homo sapiens
tggaaggagctaaggacctggg

SEQ ID NO: 9409504 - DNA, 22 bp, Homo sapiens
tggaaggggagctggaaagggg

SEQ ID NO: 9409505 - DNA, 22 bp, Homo sapiens
tggaaggggagctggaaagggg

SEQ ID NO: 9409506 - DNA, 22 bp, Homo sapiens
tggacaacatagtgagacctca

SEQ ID NO: 9409507 - DNA, 22 bp, Homo sapiens
tggaattaataggggatataca

SEQ ID NO: 9409508 - DNA, 22 bp, Homo sapiens
tggaatgttttcctaaatcaga

SEQ ID NO: 9409509 - DNA, 22 bp, Homo sapiens
tggaattatctgaagtgatttg

SEQ ID NO: 9409510 - DNA, 22 bp, Homo sapiens
tggaatgtttgacttattcagt

SEQ ID NO: 9409511 - DNA, 23 bp, Homo sapiens
tggaatgtttcttgtactgaatg

SEQ ID NO: 9409512 - DNA, 22 bp, Homo sapiens
tggaatgttgtgtataggtcag

SEQ ID NO: 9409513 - DNA, 22 bp, Homo sapiens
tggaatgttgggatttaagtgt

SEQ ID NO: 9409514 - DNA, 22 bp, Homo sapiens
tggaatgtttccccagcctgca

SEQ ID NO: 9409515 - DNA, 22 bp, Homo sapiens
tggaatgttgataaacataggc

SEQ ID NO: 9409516 - DNA, 22 bp, Homo sapiens
tggaatgttgctctgccttgcg

SEQ ID NO: 9409517 - DNA, 22 bp, Homo sapiens
tggaatgttgcataagatctga

SEQ ID NO: 9409518 - DNA, 19 bp, Homo sapiens
tggaatgttccaaggaggc

SEQ ID NO: 9409519 - DNA, 22 bp, Homo sapiens
tggaatgttatgatgatggtaa

SEQ ID NO: 9409520 - DNA, 22 bp, Homo sapiens
tggaatgttatgatgatggtaa

SEQ ID NO: 9409521 - DNA, 22 bp, Homo sapiens
tggaatggaaacaaactgagga

SEQ ID NO: 9409522 - DNA, 23 bp, Homo sapiens
tggaatgagctgggaagctgagc

SEQ ID NO: 9409523 - DNA, 22 bp, Homo sapiens
tggaatgagctggctaataacc

SEQ ID NO: 9409524 - DNA, 22 bp, Homo sapiens
tggaatgagtggctaagattca

SEQ ID NO: 9409525 - DNA, 22 bp, Homo sapiens
tggaatgatgactaggaattgt

SEQ ID NO: 9409526 - DNA, 18 bp, Homo sapiens
tggacacatggcctgggt

SEQ ID NO: 9409527 - DNA, 18 bp, Homo sapiens
tggacacatggcctgggt

SEQ ID NO: 9409528 - DNA, 18 bp, Homo sapiens
tggacacatggcctgggt

SEQ ID NO: 9409529 - DNA, 22 bp, Homo sapiens
tggacacaatgttgccttaggg

SEQ ID NO: 9409530 - DNA, 22 bp, Homo sapiens
tggacaacatagtgagacctca

SEQ ID NO: 9409531 - DNA, 22 bp, Homo sapiens
tggacacacatgtatgtcagag

SEQ ID NO: 9409532 - DNA, 23 bp, Homo sapiens
tggacactgtgcggggactaggt

SEQ ID NO: 9409533 - DNA, 22 bp, Homo sapiens
tggacactggggcaggcgggag

SEQ ID NO: 9409534 - DNA, 22 bp, Homo sapiens
tggacagagaggaaggccattt

SEQ ID NO: 9409535 - DNA, 22 bp, Homo sapiens
tggacagagaggaaggccattt

SEQ ID NO: 9409536 - DNA, 22 bp, Homo sapiens
tggacagagctgacagtatata

SEQ ID NO: 9409537 - DNA, 22 bp, Homo sapiens
tggacaggatagtgcagtacgc

SEQ ID NO: 9409538 - DNA, 22 bp, Homo sapiens
tggacaggatagtgcagtacgc

SEQ ID NO: 9409539 - DNA, 22 bp, Homo sapiens
tggacaggatctgagactgaga

SEQ ID NO: 9409540 - DNA, 22 bp, Homo sapiens
tggacaggatctgagactgaga

SEQ ID NO: 9409541 - DNA, 22 bp, Homo sapiens
tggacaggcaagcaagacatac

SEQ ID NO: 9409542 - DNA, 22 bp, Homo sapiens
tggacaggatctgagactgaga

SEQ ID NO: 9409543 - DNA, 22 bp, Homo sapiens
tggacaggatagtgcagtacgc

SEQ ID NO: 9409544 - DNA, 23 bp, Homo sapiens
tggacaggacccccttcggaccc

SEQ ID NO: 9409545 - DNA, 22 bp, Homo sapiens
tggacagcaaacatggagagaa

SEQ ID NO: 9409546 - DNA, 22 bp, Homo sapiens
tggacagccatgcaaatgagct

SEQ ID NO: 9409547 - DNA, 22 bp, Homo sapiens
tggacagcgaaagtgcctggga

SEQ ID NO: 9409548 - DNA, 22 bp, Homo sapiens
tggacagcgaaagtgcctggga

SEQ ID NO: 9409549 - DNA, 21 bp, Homo sapiens
tggaccaggaaggtggtggtg

SEQ ID NO: 9409550 - DNA, 21 bp, Homo sapiens
tggaccaggaaggtggtggtg

SEQ ID NO: 9409551 - DNA, 22 bp, Homo sapiens
tggacaggtgagtgactcaggg

SEQ ID NO: 9409552 - DNA, 21 bp, Homo sapiens
tggacatttacccttcaggga

SEQ ID NO: 9409553 - DNA, 22 bp, Homo sapiens
tggacattccacccatatcaga

SEQ ID NO: 9409554 - DNA, 23 bp, Homo sapiens
tggacagggtaactggtggtttt

SEQ ID NO: 9409555 - DNA, 23 bp, Homo sapiens
tggacagggtaactggtggtttt

SEQ ID NO: 9409556 - DNA, 22 bp, Homo sapiens
tggacaggggctgctgttgtca

SEQ ID NO: 9409557 - DNA, 18 bp, Homo sapiens
tggacagggtggagaaaa

SEQ ID NO: 9409558 - DNA, 18 bp, Homo sapiens
tggacagggtggagaaaa

SEQ ID NO: 9409559 - DNA, 18 bp, Homo sapiens
tggacagggtggagaaaa

SEQ ID NO: 9409560 - DNA, 20 bp, Homo sapiens
tggacaggggcataggttgc

SEQ ID NO: 9409561 - DNA, 22 bp, Homo sapiens
tggacaggctcctaggggttcc

SEQ ID NO: 9409562 - DNA, 22 bp, Homo sapiens
tggacaggctcctaggggttcc

SEQ ID NO: 9409563 - DNA, 22 bp, Homo sapiens
tggacagggcagagaccgagtc

SEQ ID NO: 9409564 - DNA, 22 bp, Homo sapiens
tggacctgctggatgggcaggt

SEQ ID NO: 9409565 - DNA, 22 bp, Homo sapiens
tggacctgagcctggccctgcc

SEQ ID NO: 9409566 - DNA, 22 bp, Homo sapiens
tggacctgctggatgggcaggt

SEQ ID NO: 9409567 - DNA, 22 bp, Homo sapiens
tggacctggggtggcctcctct

SEQ ID NO: 9409568 - DNA, 22 bp, Homo sapiens
tggacctgaagaataggaagta

SEQ ID NO: 9409569 - DNA, 22 bp, Homo sapiens
tggacctgagcctggccctgcc

SEQ ID NO: 9409570 - DNA, 22 bp, Homo sapiens
tggactgagcttgagagggttg

SEQ ID NO: 9409571 - DNA, 22 bp, Homo sapiens
tggactgggctaatggcagaca

SEQ ID NO: 9409572 - DNA, 21 bp, Homo sapiens
tggactgcgctgctatgcagt

SEQ ID NO: 9409573 - DNA, 22 bp, Homo sapiens
tggacctggggtggcctcctct

SEQ ID NO: 9409574 - DNA, 19 bp, Homo sapiens
tggacctgtgcccatggct

SEQ ID NO: 9409575 - DNA, 22 bp, Homo sapiens
tggactcaccttgagttagcca

SEQ ID NO: 9409576 - DNA, 22 bp, Homo sapiens
ttccaggaacaaactcacctta

SEQ ID NO: 9409577 - DNA, 22 bp, Homo sapiens
ttccaggaacaaactcacctta

SEQ ID NO: 9409578 - DNA, 22 bp, Homo sapiens
aaagagaaacttagaagcctga

SEQ ID NO: 9409579 - DNA, 22 bp, Homo sapiens
aaagagaaacttagaagcctga

SEQ ID NO: 9409580 - DNA, 22 bp, Homo sapiens
aaagagaaacttagaagcctga

SEQ ID NO: 9409581 - DNA, 22 bp, Homo sapiens
aaagagaaaatgatctgtacat

SEQ ID NO: 9409582 - DNA, 22 bp, Homo sapiens
aaagagaaaatgatctgtacat

SEQ ID NO: 9409583 - DNA, 22 bp, Homo sapiens
aaagagaaaaagatcccggctc

SEQ ID NO: 9409584 - DNA, 22 bp, Homo sapiens
aaagagaaaaagatcccggctc

SEQ ID NO: 9409585 - DNA, 21 bp, Homo sapiens
aaagagacaaatggcatatac

SEQ ID NO: 9409586 - DNA, 20 bp, Homo sapiens
aaagagaagcctcaccttgt

SEQ ID NO: 9409587 - DNA, 20 bp, Homo sapiens
aaagagaagcctcaccttgt

SEQ ID NO: 9409588 - DNA, 20 bp, Homo sapiens
aaagagaagcctcaccttgt

SEQ ID NO: 9409589 - DNA, 20 bp, Homo sapiens
aaagagaagcctcaccttgt

SEQ ID NO: 9409590 - DNA, 22 bp, Homo sapiens
aaagagaacttttacccaagaa

SEQ ID NO: 9409591 - DNA, 22 bp, Homo sapiens
aaagagaaacttagaagcctga

SEQ ID NO: 9409592 - DNA, 22 bp, Homo sapiens
aaagagacaccaaagactctag

SEQ ID NO: 9409593 - DNA, 23 bp, Homo sapiens
aaagagactgatacggaagttcc

SEQ ID NO: 9409594 - DNA, 22 bp, Homo sapiens
aaagagactggtggcattttgc

SEQ ID NO: 9409595 - DNA, 22 bp, Homo sapiens
aaagagcaagctgagatttgaa

SEQ ID NO: 9409596 - DNA, 22 bp, Homo sapiens
aaagagcaagctgagatttgaa

SEQ ID NO: 9409597 - DNA, 22 bp, Homo sapiens
aaagagcaagggctttgaggct

SEQ ID NO: 9409598 - DNA, 22 bp, Homo sapiens
aaagagcaagggctttgaggct

SEQ ID NO: 9409599 - DNA, 22 bp, Homo sapiens
aaagatcagaggatagctgagt

SEQ ID NO: 9409600 - DNA, 22 bp, Homo sapiens
aaagatcagaggatagctgagt

SEQ ID NO: 9409601 - DNA, 22 bp, Homo sapiens
aaagagcaccctcaatgtctga

SEQ ID NO: 9409602 - DNA, 22 bp, Homo sapiens
aaagatcagtctgaagcaacat

SEQ ID NO: 9409603 - DNA, 22 bp, Homo sapiens
aaagatcagtctgaagcaacat

SEQ ID NO: 9409604 - DNA, 22 bp, Homo sapiens
aaagatcagtctgaagcaacat

SEQ ID NO: 9409605 - DNA, 22 bp, Homo sapiens
aaagatcagtctgaagcaacat

SEQ ID NO: 9409606 - DNA, 22 bp, Homo sapiens
aaagatgtgtaagaaataaaca

SEQ ID NO: 9409607 - DNA, 22 bp, Homo sapiens
aaagatgtgtaagaaataaaca

SEQ ID NO: 9409608 - DNA, 22 bp, Homo sapiens
aaagatcatgctgttttgtgat

SEQ ID NO: 9409609 - DNA, 22 bp, Homo sapiens
aaagatgttaatagcaccattt

SEQ ID NO: 9409610 - DNA, 22 bp, Homo sapiens
aaagatgttatgaaataactat

SEQ ID NO: 9409611 - DNA, 22 bp, Homo sapiens
aaagatgttatgaaataactat

SEQ ID NO: 9409612 - DNA, 23 bp, Homo sapiens
aaagatgttcccaaagttcacgt

SEQ ID NO: 9409613 - DNA, 22 bp, Homo sapiens
aaagatgttgctgctccgccct

SEQ ID NO: 9409614 - DNA, 21 bp, Homo sapiens
aaagatgtttcatctgagaaa

SEQ ID NO: 9409615 - DNA, 21 bp, Homo sapiens
aaagatgtttcatctgagaaa

SEQ ID NO: 9409616 - DNA, 21 bp, Homo sapiens
aaagatgtttcatctgagaaa

SEQ ID NO: 9409617 - DNA, 22 bp, Homo sapiens
aaagacttgggagcagtatgct

SEQ ID NO: 9409618 - DNA, 22 bp, Homo sapiens
aaagacttggcttatgatttgc

SEQ ID NO: 9409619 - DNA, 22 bp, Homo sapiens
aaagacttgggtgaagtaattt

SEQ ID NO: 9409620 - DNA, 22 bp, Homo sapiens
aaagacttgggagcagtatgct

SEQ ID NO: 9409621 - DNA, 22 bp, Homo sapiens
aaagactttcacctagcaaaga

SEQ ID NO: 9409622 - DNA, 22 bp, Homo sapiens
aaagactttcacctagcaaaga

SEQ ID NO: 9409623 - DNA, 22 bp, Homo sapiens
aaagacttgggtgaagtaattt

SEQ ID NO: 9409624 - DNA, 22 bp, Homo sapiens
aaagactttcacctagcaaaga

SEQ ID NO: 9409625 - DNA, 22 bp, Homo sapiens
aaagactttcacctagcaaaga

SEQ ID NO: 9409626 - DNA, 22 bp, Homo sapiens
aaagactggaaggtgaggctgt

SEQ ID NO: 9409627 - DNA, 22 bp, Homo sapiens
aaagactgaggggaaagtgatg

SEQ ID NO: 9409628 - DNA, 22 bp, Homo sapiens
aaagactgaggggaaagtgatg

SEQ ID NO: 9409629 - DNA, 22 bp, Homo sapiens
aaagactgcaaaaacgcacaga

SEQ ID NO: 9409630 - DNA, 23 bp, Homo sapiens
aaagactgctgagaattttagga

SEQ ID NO: 9409631 - DNA, 22 bp, Homo sapiens
aaagactcttaactccctagcg

SEQ ID NO: 9409632 - DNA, 23 bp, Homo sapiens
aaagactctccagagggaagtag

SEQ ID NO: 9409633 - DNA, 23 bp, Homo sapiens
aaagactgaggaaagtctctgtc

SEQ ID NO: 9409634 - DNA, 22 bp, Homo sapiens
aaagactaagaagagtattatt

SEQ ID NO: 9409635 - DNA, 22 bp, Homo sapiens
aaagactacacgggaaagagct

SEQ ID NO: 9409636 - DNA, 22 bp, Homo sapiens
aaagactacacgggaaagagct

SEQ ID NO: 9409637 - DNA, 22 bp, Homo sapiens
aaagactacacgggaaagagct

SEQ ID NO: 9409638 - DNA, 22 bp, Homo sapiens
aaagaacaatgtggaatctcct

SEQ ID NO: 9409639 - DNA, 22 bp, Homo sapiens
aaagaacaatgtggaatctcct

SEQ ID NO: 9409640 - DNA, 21 bp, Homo sapiens
aaagaacaggcagatgttctt

SEQ ID NO: 9409641 - DNA, 22 bp, Homo sapiens
aaagaaacctatcagccacatg

SEQ ID NO: 9409642 - DNA, 22 bp, Homo sapiens
aaagaaacctatcagccacatg

SEQ ID NO: 9409643 - DNA, 22 bp, Homo sapiens
aaagaaacctatcagccacatg

SEQ ID NO: 9409644 - DNA, 16 bp, Homo sapiens
aaagaaacaggtgtcc

SEQ ID NO: 9409645 - DNA, 22 bp, Homo sapiens
aaagaaacctatcagccacatg

SEQ ID NO: 9409646 - DNA, 22 bp, Homo sapiens
aaagaaacctatcagccacatg

SEQ ID NO: 9409647 - DNA, 22 bp, Homo sapiens
aaagaaacctatcagccacatg

SEQ ID NO: 9409648 - DNA, 22 bp, Homo sapiens
aaagaaacctatcagccacatg

SEQ ID NO: 9409649 - DNA, 22 bp, Homo sapiens
aaagaaacctatcagccacatg

SEQ ID NO: 9409650 - DNA, 22 bp, Homo sapiens
aaagaaatacctttctcagctt

SEQ ID NO: 9409651 - DNA, 22 bp, Homo sapiens
aaacttttttaggttcataggc

SEQ ID NO: 9409652 - DNA, 22 bp, Homo sapiens
aaacttttttaggttcataggc

SEQ ID NO: 9409653 - DNA, 16 bp, Homo sapiens
aaagaaacaggtgtcc

SEQ ID NO: 9409654 - DNA, 22 bp, Homo sapiens
aaacttttttaggttcataggc

SEQ ID NO: 9409655 - DNA, 22 bp, Homo sapiens
aaactttttcttaggtatgtct

SEQ ID NO: 9409656 - DNA, 22 bp, Homo sapiens
aaacttttggtcctcatgggtt

SEQ ID NO: 9409657 - DNA, 22 bp, Homo sapiens
aaacttttcttggggacctgcc

SEQ ID NO: 9409658 - DNA, 22 bp, Homo sapiens
aaactttttattctaatgtcta

SEQ ID NO: 9409659 - DNA, 22 bp, Homo sapiens
aaactttttattctaatgtcta

SEQ ID NO: 9409660 - DNA, 22 bp, Homo sapiens
aaagaacaaattagctgtttta

SEQ ID NO: 9409661 - DNA, 22 bp, Homo sapiens
aaagaacaaattagctgtttta

SEQ ID NO: 9409662 - DNA, 22 bp, Homo sapiens
aaagaacaaatgatatatggtt

SEQ ID NO: 9409663 - DNA, 22 bp, Homo sapiens
aaagaacaaatgatatatggtt

SEQ ID NO: 9409664 - DNA, 21 bp, Homo sapiens
aaagaaatctcccattggtag

SEQ ID NO: 9409665 - DNA, 21 bp, Homo sapiens
aaagaaatctcccattggtag

SEQ ID NO: 9409666 - DNA, 21 bp, Homo sapiens
aaagaaatctcccattggtag

SEQ ID NO: 9409667 - DNA, 22 bp, Homo sapiens
aaagaaatagatggcatttaaa

SEQ ID NO: 9409668 - DNA, 22 bp, Homo sapiens
aaagaaatagatggcatttaaa

SEQ ID NO: 9409669 - DNA, 22 bp, Homo sapiens
aaagaaatagatggcatttaaa

SEQ ID NO: 9409670 - DNA, 22 bp, Homo sapiens
aaagaaatacctttctcagctt

SEQ ID NO: 9409671 - DNA, 22 bp, Homo sapiens
aaagaaatagatggcatttaaa

SEQ ID NO: 9409672 - DNA, 22 bp, Homo sapiens
aaagaaatagatggcatttaaa

SEQ ID NO: 9409673 - DNA, 22 bp, Homo sapiens
aaacttttcctgctcttgtcct

SEQ ID NO: 9409674 - DNA, 22 bp, Homo sapiens
aaactttgttcgtctgatgtgg

SEQ ID NO: 9409675 - DNA, 22 bp, Homo sapiens
aaacttttataaagctgcagat

SEQ ID NO: 9409676 - DNA, 22 bp, Homo sapiens
aaactttggattgtgattgtgc

SEQ ID NO: 9409677 - DNA, 22 bp, Homo sapiens
aaactttcatgtatctctttca

SEQ ID NO: 9409678 - DNA, 22 bp, Homo sapiens
aaactttcatgtatctctttca

SEQ ID NO: 9409679 - DNA, 22 bp, Homo sapiens
aaactttggtatgtagcaaaac

SEQ ID NO: 9409680 - DNA, 22 bp, Homo sapiens
aaactttaggaaggaatttaca

SEQ ID NO: 9409681 - DNA, 22 bp, Homo sapiens
aaactttaggaaggaatttaca

SEQ ID NO: 9409682 - DNA, 22 bp, Homo sapiens
aaactttcatgtatctctttca

SEQ ID NO: 9409683 - DNA, 22 bp, Homo sapiens
aaacttcattttcaactgcaaa

SEQ ID NO: 9409684 - DNA, 22 bp, Homo sapiens
aaatagtttagctctcatttca

SEQ ID NO: 9409685 - DNA, 22 bp, Homo sapiens
aaacttcattttcaactgcaaa

SEQ ID NO: 9409686 - DNA, 22 bp, Homo sapiens
aaacttcattttcaactgcaaa

SEQ ID NO: 9409687 - DNA, 17 bp, Homo sapiens
aaacttcattctcagga

SEQ ID NO: 9409688 - DNA, 22 bp, Homo sapiens
aaatagttgtttggatcaataa

SEQ ID NO: 9409689 - DNA, 22 bp, Homo sapiens
aaatagttgtttggatcaataa

SEQ ID NO: 9409690 - DNA, 22 bp, Homo sapiens
aaatagttgtttggatcaataa

SEQ ID NO: 9409691 - DNA, 22 bp, Homo sapiens
aaatagttgtttggatcaataa

SEQ ID NO: 9409692 - DNA, 22 bp, Homo sapiens
aaatagtttagctctcatttca

SEQ ID NO: 9409693 - DNA, 22 bp, Homo sapiens
aaatagtttagctctcatttca

SEQ ID NO: 9409694 - DNA, 22 bp, Homo sapiens
aaatagttacttctgctgtctt

SEQ ID NO: 9409695 - DNA, 22 bp, Homo sapiens
aaatagttacttctgctgtctt

SEQ ID NO: 9409696 - DNA, 22 bp, Homo sapiens
aaatagtcctgggaatagtact

SEQ ID NO: 9409697 - DNA, 22 bp, Homo sapiens
aaatagttagccctgcatatat

SEQ ID NO: 9409698 - DNA, 22 bp, Homo sapiens
aaatagttagccctgcatatat

SEQ ID NO: 9409699 - DNA, 22 bp, Homo sapiens
aaatagttagccctgcatatat

SEQ ID NO: 9409700 - DNA, 22 bp, Homo sapiens
aaactgtgaagcaagtacaagg

SEQ ID NO: 9409701 - DNA, 20 bp, Homo sapiens
aaactgtctgtcagtatcta

SEQ ID NO: 9409702 - DNA, 22 bp, Homo sapiens
aaatagttcagcttgtaaaccc

SEQ ID NO: 9409703 - DNA, 22 bp, Homo sapiens
aaatagttcagcttgtaaaccc

SEQ ID NO: 9409704 - DNA, 22 bp, Homo sapiens
aaatagttcagccacggtgact

SEQ ID NO: 9409705 - DNA, 22 bp, Homo sapiens
aaatagttagccctgcatatat

SEQ ID NO: 9409706 - DNA, 22 bp, Homo sapiens
aaatagttagccctgcatatat

SEQ ID NO: 9409707 - DNA, 22 bp, Homo sapiens
aaatagttagccctgcatatat

SEQ ID NO: 9409708 - DNA, 22 bp, Homo sapiens
aaatagttcagccacggtgact

SEQ ID NO: 9409709 - DNA, 22 bp, Homo sapiens
aaatagttagccctgcatatat

SEQ ID NO: 9409710 - DNA, 22 bp, Homo sapiens
aaatagttcagcttgtaaaccc

SEQ ID NO: 9409711 - DNA, 22 bp, Homo sapiens
aaatagttcagcttgtaaaccc

SEQ ID NO: 9409712 - DNA, 22 bp, Homo sapiens
aaatagttcagcttgtaaaccc

SEQ ID NO: 9409713 - DNA, 22 bp, Homo sapiens
aaacagctacttctgtataatg

SEQ ID NO: 9409714 - DNA, 22 bp, Homo sapiens
aaacagctaatggccaggaata

SEQ ID NO: 9409715 - DNA, 22 bp, Homo sapiens
aaacagctaagtacattcaagg

SEQ ID NO: 9409716 - DNA, 22 bp, Homo sapiens
aaacagctaagtacattcaagg

SEQ ID NO: 9409717 - DNA, 20 bp, Homo sapiens
aaacagctaaaccagctctc

SEQ ID NO: 9409718 - DNA, 22 bp, Homo sapiens
aaacagcaggaacatcttgcca

SEQ ID NO: 9409719 - DNA, 22 bp, Homo sapiens
aaacagcaatggagaagccagg

SEQ ID NO: 9409720 - DNA, 22 bp, Homo sapiens
aaacagattgaaattcgtagta

SEQ ID NO: 9409721 - DNA, 22 bp, Homo sapiens
aaacagattgaaattcgtagta

SEQ ID NO: 9409722 - DNA, 22 bp, Homo sapiens
aaacagatgagttataatagcc

SEQ ID NO: 9409723 - DNA, 22 bp, Homo sapiens
aaacagcaatggagaagccagg

SEQ ID NO: 9409724 - DNA, 22 bp, Homo sapiens
aaacagcaatggagaagccagg

SEQ ID NO: 9409725 - DNA, 22 bp, Homo sapiens
aaacagcaatggagaagccagg

SEQ ID NO: 9409726 - DNA, 22 bp, Homo sapiens
aaacatgatgcctgtactaaga

SEQ ID NO: 9409727 - DNA, 22 bp, Homo sapiens
aaacagctggtctcaaatgttc

SEQ ID NO: 9409728 - DNA, 22 bp, Homo sapiens
aaacatctcaaagaggtatttg

SEQ ID NO: 9409729 - DNA, 22 bp, Homo sapiens
aaacagctggtctcaaatgttc

SEQ ID NO: 9409730 - DNA, 22 bp, Homo sapiens
aaacagctgcactgctgatgtc

SEQ ID NO: 9409731 - DNA, 22 bp, Homo sapiens
aaacagctgcagtacacggcct

SEQ ID NO: 9409732 - DNA, 22 bp, Homo sapiens
aaacagctgggaggtagaggcg

SEQ ID NO: 9409733 - DNA, 22 bp, Homo sapiens
aaacagctgggaggtagaggcg

SEQ ID NO: 9409734 - DNA, 22 bp, Homo sapiens
aaacagctgggaggtagaggcg

SEQ ID NO: 9409735 - DNA, 22 bp, Homo sapiens
aaacagctccttagtttccatc

SEQ ID NO: 9409736 - DNA, 22 bp, Homo sapiens
aaacagctccttagtttccatc

SEQ ID NO: 9409737 - DNA, 22 bp, Homo sapiens
aaacagctcaagaagttactct

SEQ ID NO: 9409738 - DNA, 22 bp, Homo sapiens
aaacagctcaagaagttactct

SEQ ID NO: 9409739 - DNA, 22 bp, Homo sapiens
aaacagctacttctgtataatg

SEQ ID NO: 9409740 - DNA, 22 bp, Homo sapiens
aaacagagtttggtaaatagcc

SEQ ID NO: 9409741 - DNA, 22 bp, Homo sapiens
aaacagagtttggtaaatagcc

SEQ ID NO: 9409742 - DNA, 22 bp, Homo sapiens
aaacagataatgctataaatgg

SEQ ID NO: 9409743 - DNA, 22 bp, Homo sapiens
aaacagataagggacaatttca

SEQ ID NO: 9409744 - DNA, 22 bp, Homo sapiens
aaacagataagggacaatttca

SEQ ID NO: 9409745 - DNA, 22 bp, Homo sapiens
aaacagataatgctataaatgg

SEQ ID NO: 9409746 - DNA, 22 bp, Homo sapiens
aaacactgtgggacatcttact

SEQ ID NO: 9409747 - DNA, 22 bp, Homo sapiens
aaacactgtgggacatcttact

SEQ ID NO: 9409748 - DNA, 22 bp, Homo sapiens
aaagccaggcagccaagccagt

SEQ ID NO: 9409749 - DNA, 22 bp, Homo sapiens
aaagccaggctggcctggggtt

SEQ ID NO: 9409750 - DNA, 22 bp, Homo sapiens
aaagccaggcagccaagccagt

SEQ ID NO: 9409751 - DNA, 22 bp, Homo sapiens
aaagccaggcagccaagccagt

SEQ ID NO: 9409752 - DNA, 22 bp, Homo sapiens
aaagccaggaggagggcgctcg

SEQ ID NO: 9409753 - DNA, 22 bp, Homo sapiens
aaagccagctctgagctgcacc

SEQ ID NO: 9409754 - DNA, 22 bp, Homo sapiens
aaagccagagcaagctgtcaca

SEQ ID NO: 9409755 - DNA, 20 bp, Homo sapiens
aaagccactggcaagagact

SEQ ID NO: 9409756 - DNA, 22 bp, Homo sapiens
aaagccagaattcgtccagcct

SEQ ID NO: 9409757 - DNA, 22 bp, Homo sapiens
aaagccagcaaggtgagtttca

SEQ ID NO: 9409758 - DNA, 22 bp, Homo sapiens
aaagccagctctgagctgcacc

SEQ ID NO: 9409759 - DNA, 22 bp, Homo sapiens
aaagccagagtgtgttagagac

SEQ ID NO: 9409760 - DNA, 22 bp, Homo sapiens
aaagccagagcaagctgtcaca

SEQ ID NO: 9409761 - DNA, 22 bp, Homo sapiens
aaagccagagtgtgttagagac

SEQ ID NO: 9409762 - DNA, 22 bp, Homo sapiens
aaacactgaagacctatctggt

SEQ ID NO: 9409763 - DNA, 22 bp, Homo sapiens
aaacactgaagacctatctggt

SEQ ID NO: 9409764 - DNA, 22 bp, Homo sapiens
aaacactgaaaattttggtcat

SEQ ID NO: 9409765 - DNA, 22 bp, Homo sapiens
aaacactgaaaattttggtcat

SEQ ID NO: 9409766 - DNA, 22 bp, Homo sapiens
aaagccactgcatgtgtagtat

SEQ ID NO: 9409767 - DNA, 22 bp, Homo sapiens
aaacactgaagacctatctggt

SEQ ID NO: 9409768 - DNA, 22 bp, Homo sapiens
aaacactgaagacctatctggt

SEQ ID NO: 9409769 - DNA, 22 bp, Homo sapiens
aaacactgatggatatttttcc

SEQ ID NO: 9409770 - DNA, 22 bp, Homo sapiens
aaacattcactctcaattttag

SEQ ID NO: 9409771 - DNA, 22 bp, Homo sapiens
aaacattcactctcaattttag

SEQ ID NO: 9409772 - DNA, 20 bp, Homo sapiens
aaacattcatgtacaagtga

SEQ ID NO: 9409773 - DNA, 20 bp, Homo sapiens
aaacattcatgtacaagtga

SEQ ID NO: 9409774 - DNA, 20 bp, Homo sapiens
aaacattcatgtacaagtga

SEQ ID NO: 9409775 - DNA, 22 bp, Homo sapiens
aaacattccatttctatgtaag

SEQ ID NO: 9409776 - DNA, 22 bp, Homo sapiens
aaacattccatttctatgtaag

SEQ ID NO: 9409777 - DNA, 22 bp, Homo sapiens
aaacattagacaccatatgctc

SEQ ID NO: 9409778 - DNA, 22 bp, Homo sapiens
aaacattcaaagcaggatgtgt

SEQ ID NO: 9409779 - DNA, 22 bp, Homo sapiens
aaacattcacatttgctagtaa

SEQ ID NO: 9409780 - DNA, 22 bp, Homo sapiens
aaacatgttttctgaatatttt

SEQ ID NO: 9409781 - DNA, 22 bp, Homo sapiens
aaacatgtttagaaagcagctg

SEQ ID NO: 9409782 - DNA, 22 bp, Homo sapiens
aaacatgtttagaaagcagctg

SEQ ID NO: 9409783 - DNA, 22 bp, Homo sapiens
aaacatgtttagaaagcagctg

SEQ ID NO: 9409784 - DNA, 22 bp, Homo sapiens
aaacatgtaagttcagatcacc

SEQ ID NO: 9409785 - DNA, 22 bp, Homo sapiens
aaacatgtaagttcagatcacc

SEQ ID NO: 9409786 - DNA, 22 bp, Homo sapiens
aaacatgtaattctgcttaaga

SEQ ID NO: 9409787 - DNA, 18 bp, Homo sapiens
aaacatggcttaaaggct

SEQ ID NO: 9409788 - DNA, 22 bp, Homo sapiens
aaacatgctggatttagaatat

SEQ ID NO: 9409789 - DNA, 22 bp, Homo sapiens
aaacatgctggatttagaatat

SEQ ID NO: 9409790 - DNA, 22 bp, Homo sapiens
aaacatgctggatttagaatat

SEQ ID NO: 9409791 - DNA, 22 bp, Homo sapiens
aaacatgctggatttagaatat

SEQ ID NO: 9409792 - DNA, 22 bp, Homo sapiens
aaacatgcattcaagaaaatct

SEQ ID NO: 9409793 - DNA, 22 bp, Homo sapiens
aaacattgtaattttagcatgg

SEQ ID NO: 9409794 - DNA, 22 bp, Homo sapiens
aaacattgatgggaagtttaat

SEQ ID NO: 9409795 - DNA, 22 bp, Homo sapiens
aaacattccctaatgtgtccgt

SEQ ID NO: 9409796 - DNA, 22 bp, Homo sapiens
aaacattgagcacttgctattt

SEQ ID NO: 9409797 - DNA, 22 bp, Homo sapiens
aaacattgagcacttgctattt

SEQ ID NO: 9409798 - DNA, 22 bp, Homo sapiens
aaactgcaattatgtttgcaga

SEQ ID NO: 9409799 - DNA, 22 bp, Homo sapiens
aaactgtaaatactagtaagtg

SEQ ID NO: 9409800 - DNA, 22 bp, Homo sapiens
aaactgtaagagaataaactac

SEQ ID NO: 9409801 - DNA, 22 bp, Homo sapiens
aaactgtaagagaataaactac

SEQ ID NO: 9409802 - DNA, 22 bp, Homo sapiens
aaactgtatagggaaaagtaga

SEQ ID NO: 9409803 - DNA, 18 bp, Homo sapiens
aaactgtatttctttcta

SEQ ID NO: 9409804 - DNA, 22 bp, Homo sapiens
aaactgtcacctaatgtatttt

SEQ ID NO: 9409805 - DNA, 22 bp, Homo sapiens
aaactgtcattggatgcatttg

SEQ ID NO: 9409806 - DNA, 22 bp, Homo sapiens
aaactgtcattttatatagtta

SEQ ID NO: 9409807 - DNA, 22 bp, Homo sapiens
aaactgtatagggaaaagtaga

SEQ ID NO: 9409808 - DNA, 22 bp, Homo sapiens
aaactgtatagggaaaagtaga

SEQ ID NO: 9409809 - DNA, 22 bp, Homo sapiens
aaaaggatgttttcatgaaaca

SEQ ID NO: 9409810 - DNA, 22 bp, Homo sapiens
aaaaggatgttttcatgaaaca

SEQ ID NO: 9409811 - DNA, 22 bp, Homo sapiens
aaaaggatgttttcatgaaaca

SEQ ID NO: 9409812 - DNA, 22 bp, Homo sapiens
aaaaggatgttttcatgaaaca

SEQ ID NO: 9409813 - DNA, 22 bp, Homo sapiens
aaaaggcagtgcaagagagggt

SEQ ID NO: 9409814 - DNA, 22 bp, Homo sapiens
aaaaggcatggaggttgatagt

SEQ ID NO: 9409815 - DNA, 22 bp, Homo sapiens
aaaaggcatggaggttgatagt

SEQ ID NO: 9409816 - DNA, 22 bp, Homo sapiens
aaaaggcagtgcaagagagggt

SEQ ID NO: 9409817 - DNA, 22 bp, Homo sapiens
aaaaggcatggaggttgatagt

SEQ ID NO: 9409818 - DNA, 22 bp, Homo sapiens
aaaaggctagctagtaacagaa

SEQ ID NO: 9409819 - DNA, 22 bp, Homo sapiens
aaaaggctaattaagttttgga

SEQ ID NO: 9409820 - DNA, 22 bp, Homo sapiens
aaaacagtttttgctaactgct

SEQ ID NO: 9409821 - DNA, 22 bp, Homo sapiens
aaaacagtttttgctaactgct

SEQ ID NO: 9409822 - DNA, 22 bp, Homo sapiens
aaaaggctcttcaaaatggaag

SEQ ID NO: 9409823 - DNA, 22 bp, Homo sapiens
aaaaggctaatccagagcaact

SEQ ID NO: 9409824 - DNA, 22 bp, Homo sapiens
aaaaggcattttgtcaaccata

SEQ ID NO: 9409825 - DNA, 22 bp, Homo sapiens
aaaaggcatggaggttgatagt

SEQ ID NO: 9409826 - DNA, 22 bp, Homo sapiens
aaaaggcattttgtcaaccata

SEQ ID NO: 9409827 - DNA, 22 bp, Homo sapiens
aaaacctgattgaattctattt

SEQ ID NO: 9409828 - DNA, 22 bp, Homo sapiens
aaaaccttctagactttatatt

SEQ ID NO: 9409829 - DNA, 22 bp, Homo sapiens
aaaacctcagttctgctcttaa

SEQ ID NO: 9409830 - DNA, 22 bp, Homo sapiens
aaaaccaggtagcaaaggagac

SEQ ID NO: 9409831 - DNA, 22 bp, Homo sapiens
aaaaccaggtagcaaaggagac

SEQ ID NO: 9409832 - DNA, 22 bp, Homo sapiens
aaaaccaggcttgctgtgctcg

SEQ ID NO: 9409833 - DNA, 22 bp, Homo sapiens
aaaaccaggcttgctgtgctcg

SEQ ID NO: 9409834 - DNA, 22 bp, Homo sapiens
aaaactctgcagttagtttcta

SEQ ID NO: 9409835 - DNA, 22 bp, Homo sapiens
aaaaccttctagactttatatt

SEQ ID NO: 9409836 - DNA, 22 bp, Homo sapiens
aaaactacatttgacattttgt

SEQ ID NO: 9409837 - DNA, 22 bp, Homo sapiens
aaaactaaatacgctttgcctc

SEQ ID NO: 9409838 - DNA, 22 bp, Homo sapiens
aaaactaaatacgctttgcctc

SEQ ID NO: 9409839 - DNA, 22 bp, Homo sapiens
aaaaggaggtcactttattcct

SEQ ID NO: 9409840 - DNA, 21 bp, Homo sapiens
aaaaggaggcaggtgaacagc

SEQ ID NO: 9409841 - DNA, 21 bp, Homo sapiens
aaaaggaggcaggtgaacagc

SEQ ID NO: 9409842 - DNA, 22 bp, Homo sapiens
aaaaatacttcacttctgggtg

SEQ ID NO: 9409843 - DNA, 22 bp, Homo sapiens
aaaaatacttcacttctgggtg

SEQ ID NO: 9409844 - DNA, 22 bp, Homo sapiens
aaaaagtcatattcttgttcct

SEQ ID NO: 9409845 - DNA, 22 bp, Homo sapiens
aaaaagtattggccatggttga

SEQ ID NO: 9409846 - DNA, 22 bp, Homo sapiens
aaaaagtcatattcttgttcct

SEQ ID NO: 9409847 - DNA, 22 bp, Homo sapiens
aaaaaggctaagcatcttgtgc

SEQ ID NO: 9409848 - DNA, 22 bp, Homo sapiens
aaaaaggctaagcatcttgtgc

SEQ ID NO: 9409849 - DNA, 22 bp, Homo sapiens
aaaaaggctaagcatcttgtgc

SEQ ID NO: 9409850 - DNA, 22 bp, Homo sapiens
aaaaagcttaaatgagcagttc

SEQ ID NO: 9409851 - DNA, 22 bp, Homo sapiens
aaaaaggctaagcatcttgtgc

SEQ ID NO: 9409852 - DNA, 22 bp, Homo sapiens
aaaaagcttaaatgagcagttc

SEQ ID NO: 9409853 - DNA, 22 bp, Homo sapiens
aaaaaggttgatccagattagg

SEQ ID NO: 9409854 - DNA, 22 bp, Homo sapiens
aaaaaggttgatccagattagg

SEQ ID NO: 9409855 - DNA, 22 bp, Homo sapiens
aaaaagtattggccatggttga

SEQ ID NO: 9409856 - DNA, 22 bp, Homo sapiens
aaaaagatgtcctgaagtttag

SEQ ID NO: 9409857 - DNA, 22 bp, Homo sapiens
aaaaagatgtcctgaagtttag

SEQ ID NO: 9409858 - DNA, 22 bp, Homo sapiens
aaaaagatgtcctgaagtttag

SEQ ID NO: 9409859 - DNA, 21 bp, Homo sapiens
aaaaagctggggcatgcatgc

SEQ ID NO: 9409860 - DNA, 22 bp, Homo sapiens
aaaaagcttaaatgagcagttc

SEQ ID NO: 9409861 - DNA, 21 bp, Homo sapiens
aaaaagctggggcatgcatgc

SEQ ID NO: 9409862 - DNA, 22 bp, Homo sapiens
aaaattatggagtatcccaaag

SEQ ID NO: 9409863 - DNA, 22 bp, Homo sapiens
aaaattattcatggcttttgga

SEQ ID NO: 9409864 - DNA, 22 bp, Homo sapiens
aaaattattcatggcttttgga

SEQ ID NO: 9409865 - DNA, 22 bp, Homo sapiens
aaaattcatagaactgtacgct

SEQ ID NO: 9409866 - DNA, 22 bp, Homo sapiens
aaaattcatagaactgtacgct

SEQ ID NO: 9409867 - DNA, 22 bp, Homo sapiens
aaaattcatagaactgtacgct

SEQ ID NO: 9409868 - DNA, 22 bp, Homo sapiens
aaaattcatagaactgtacgct

SEQ ID NO: 9409869 - DNA, 22 bp, Homo sapiens
aaaattcatggcttgggaaaag

SEQ ID NO: 9409870 - DNA, 22 bp, Homo sapiens
aaaattcatggcttgggaaaag

SEQ ID NO: 9409871 - DNA, 22 bp, Homo sapiens
aaaattaagtgtctgggaagcc

SEQ ID NO: 9409872 - DNA, 22 bp, Homo sapiens
aaaattaagtgtctgggaagcc

SEQ ID NO: 9409873 - DNA, 22 bp, Homo sapiens
aaaattatggagtatcccaaag

SEQ ID NO: 9409874 - DNA, 22 bp, Homo sapiens
aaaattatggagtatcccaaag

SEQ ID NO: 9409875 - DNA, 22 bp, Homo sapiens
aaaattatggagtatcccaaag

SEQ ID NO: 9409876 - DNA, 22 bp, Homo sapiens
aaaattatagatctagtgcctg

SEQ ID NO: 9409877 - DNA, 22 bp, Homo sapiens
aaaattatagatctagtgcctg

SEQ ID NO: 9409878 - DNA, 22 bp, Homo sapiens
aaaactgtatcttcttgggact

SEQ ID NO: 9409879 - DNA, 22 bp, Homo sapiens
aaaacttagctaggcaagtttt

SEQ ID NO: 9409880 - DNA, 22 bp, Homo sapiens
aaaactttcagggatacagaaa

SEQ ID NO: 9409881 - DNA, 22 bp, Homo sapiens
aaaactgaaccttgagatcttt

SEQ ID NO: 9409882 - DNA, 22 bp, Homo sapiens
aaaactgaaccttgagatcttt

SEQ ID NO: 9409883 - DNA, 22 bp, Homo sapiens
aaaactgaggtttcctgaagaa

SEQ ID NO: 9409884 - DNA, 22 bp, Homo sapiens
aaaactgcccagtcagtaagca

SEQ ID NO: 9409885 - DNA, 22 bp, Homo sapiens
aaaactttcagggatacagaaa

SEQ ID NO: 9409886 - DNA, 22 bp, Homo sapiens
aaaagaacctagctcctcagtc

SEQ ID NO: 9409887 - DNA, 22 bp, Homo sapiens
aaaactttcagggatacagaaa

SEQ ID NO: 9409888 - DNA, 22 bp, Homo sapiens
aaacagctttcagaatctctca

SEQ ID NO: 9409889 - DNA, 22 bp, Homo sapiens
aaacagctttcagaatctctca

SEQ ID NO: 9409890 - DNA, 22 bp, Homo sapiens
aaacagcttgtttcaggaaagt

SEQ ID NO: 9409891 - DNA, 22 bp, Homo sapiens
aaacagcttgtttcaggaaagt

SEQ ID NO: 9409892 - DNA, 22 bp, Homo sapiens
aaaagtaattgtggtttttgcc

SEQ ID NO: 9409893 - DNA, 22 bp, Homo sapiens
aaaagtaattgtggtttttgcc

SEQ ID NO: 9409894 - DNA, 22 bp, Homo sapiens
aaaagtaattgtggttttggcc

SEQ ID NO: 9409895 - DNA, 22 bp, Homo sapiens
aaaagtaattgcggtttttgct

SEQ ID NO: 9409896 - DNA, 22 bp, Homo sapiens
aaaagtaattgcggtttttgct

SEQ ID NO: 9409897 - DNA, 22 bp, Homo sapiens
aaaagtaattgcggtttttgct

SEQ ID NO: 9409898 - DNA, 22 bp, Homo sapiens
aaaagtaattgcggtttttgcc

SEQ ID NO: 9409899 - DNA, 22 bp, Homo sapiens
aaaagtaattgcggtttttgcc

SEQ ID NO: 9409900 - DNA, 22 bp, Homo sapiens
aaaagtaattgcggtttttgcc

SEQ ID NO: 9409901 - DNA, 22 bp, Homo sapiens
aaaagtaattgcagttttcgcc

SEQ ID NO: 9409902 - DNA, 22 bp, Homo sapiens
aaaagtaattgcagttttgcca

SEQ ID NO: 9409903 - DNA, 22 bp, Homo sapiens
aaaagtaattgcagttttgcca

SEQ ID NO: 9409904 - DNA, 22 bp, Homo sapiens
aaaagtaattgcagttttcgcc

SEQ ID NO: 9409905 - DNA, 22 bp, Homo sapiens
aaaagtaattgcagttttgtca

SEQ ID NO: 9409906 - DNA, 22 bp, Homo sapiens
aaaagtaattgcagttttgcca

SEQ ID NO: 9409907 - DNA, 22 bp, Homo sapiens
aaaagtaattgcagttttgtca

SEQ ID NO: 9409908 - DNA, 22 bp, Homo sapiens
aaaagtaattgcagttttgtca

SEQ ID NO: 9409909 - DNA, 22 bp, Homo sapiens
aaaagtaattgcagttttgtca

SEQ ID NO: 9409910 - DNA, 22 bp, Homo sapiens
aaaagtaattgcagtttttgcc

SEQ ID NO: 9409911 - DNA, 22 bp, Homo sapiens
aaaagtaattgcagtttttgcc

SEQ ID NO: 9409912 - DNA, 22 bp, Homo sapiens
aaaagtaattgcagtttttgcc

SEQ ID NO: 9409913 - DNA, 22 bp, Homo sapiens
aaaaggtagttgccaaataagg

SEQ ID NO: 9409914 - DNA, 22 bp, Homo sapiens
aaaattcatggcttgggaaaag

SEQ ID NO: 9409915 - DNA, 19 bp, Homo sapiens
aaaaggagagatcagagtt

SEQ ID NO: 9409916 - DNA, 19 bp, Homo sapiens
aaaaggagagatcagagtt

SEQ ID NO: 9409917 - DNA, 22 bp, Homo sapiens
aaaaggtagttgccaaataagg

SEQ ID NO: 9409918 - DNA, 22 bp, Homo sapiens
aaaagtaattgatgcaatcgta

SEQ ID NO: 9409919 - DNA, 22 bp, Homo sapiens
aaaagtaatcgcagtttttgcc

SEQ ID NO: 9409920 - DNA, 22 bp, Homo sapiens
aaaagtaatcgcagtttttgcc

SEQ ID NO: 9409921 - DNA, 22 bp, Homo sapiens
aaaagtaatcgcagtttttgcc

SEQ ID NO: 9409922 - DNA, 22 bp, Homo sapiens
aaaagtaattgcaattttgtag

SEQ ID NO: 9409923 - DNA, 22 bp, Homo sapiens
aaaagtaattgcaattttgtag

SEQ ID NO: 9409924 - DNA, 22 bp, Homo sapiens
aaaagtaattgcaattttgtag

SEQ ID NO: 9409925 - DNA, 22 bp, Homo sapiens
aaaagtaattgcaattttgtag

SEQ ID NO: 9409926 - DNA, 22 bp, Homo sapiens
aaagagctaacattgccgagat

SEQ ID NO: 9409927 - DNA, 22 bp, Homo sapiens
aaagagccgctgatgtcagccc

SEQ ID NO: 9409928 - DNA, 22 bp, Homo sapiens
aaagagcctatattcagctgca

SEQ ID NO: 9409929 - DNA, 22 bp, Homo sapiens
aaagagcccttccatgactctt

SEQ ID NO: 9409930 - DNA, 20 bp, Homo sapiens
aaagagcccttggagcaggc

SEQ ID NO: 9409931 - DNA, 22 bp, Homo sapiens
aaaattggttcctttctgaggc

SEQ ID NO: 9409932 - DNA, 22 bp, Homo sapiens
aaagagccagctacctcagttt

SEQ ID NO: 9409933 - DNA, 18 bp, Homo sapiens
aaagagccacccagggcc

SEQ ID NO: 9409934 - DNA, 21 bp, Homo sapiens
aaagagcccgctgagaggttc

SEQ ID NO: 9409935 - DNA, 22 bp, Homo sapiens
aaaattgaggctcatgttaaat

SEQ ID NO: 9409936 - DNA, 22 bp, Homo sapiens
aaaattgaggctcatgttaaat

SEQ ID NO: 9409937 - DNA, 22 bp, Homo sapiens
aaaattgaggctcatgttaaat

SEQ ID NO: 9409938 - DNA, 22 bp, Homo sapiens
aaaattgagagtcttgtgcaag

SEQ ID NO: 9409939 - DNA, 22 bp, Homo sapiens
aaaattgagagttatagatggt

SEQ ID NO: 9409940 - DNA, 22 bp, Homo sapiens
aaaattgaagtgatcaggaact

SEQ ID NO: 9409941 - DNA, 17 bp, Homo sapiens
aaaattctgtaaagagg

SEQ ID NO: 9409942 - DNA, 22 bp, Homo sapiens
aaaattctgtcattaaattgtg

SEQ ID NO: 9409943 - DNA, 22 bp, Homo sapiens
aaaattcattcctcagactgcc

SEQ ID NO: 9409944 - DNA, 22 bp, Homo sapiens
aaaattctcttgatcttgacag

SEQ ID NO: 9409945 - DNA, 22 bp, Homo sapiens
aaaattctcttgatcttgacag

SEQ ID NO: 9409946 - DNA, 22 bp, Homo sapiens
aaaattcattcctcagactgcc

SEQ ID NO: 9409947 - DNA, 22 bp, Homo sapiens
aaaattcattcctcagactgcc

SEQ ID NO: 9409948 - DNA, 22 bp, Homo sapiens
aaaattcattcctcagactgcc

SEQ ID NO: 9409949 - DNA, 22 bp, Homo sapiens
aaacacattttaggaaaatcta

SEQ ID NO: 9409950 - DNA, 22 bp, Homo sapiens
aaacacattttaggaaaatcta

SEQ ID NO: 9409951 - DNA, 22 bp, Homo sapiens
aaacacattagccctgtggaaa

SEQ ID NO: 9409952 - DNA, 22 bp, Homo sapiens
aaacacatcattcatgtcgtca

SEQ ID NO: 9409953 - DNA, 22 bp, Homo sapiens
aaacacattttaggaaaatcta

SEQ ID NO: 9409954 - DNA, 22 bp, Homo sapiens
aaacacattagccctgtggaaa

SEQ ID NO: 9409955 - DNA, 22 bp, Homo sapiens
aaacactcatgtgttactctcc

SEQ ID NO: 9409956 - DNA, 22 bp, Homo sapiens
aaacactcatgtgttactctcc

SEQ ID NO: 9409957 - DNA, 22 bp, Homo sapiens
aaacactagcaggaagcactga

SEQ ID NO: 9409958 - DNA, 22 bp, Homo sapiens
aaacactagcaggaagcactga

SEQ ID NO: 9409959 - DNA, 22 bp, Homo sapiens
aaacactaataacagtggctgg

SEQ ID NO: 9409960 - DNA, 22 bp, Homo sapiens
aaacaccaagagctagctatta

SEQ ID NO: 9409961 - DNA, 22 bp, Homo sapiens
aaacaccagtcccagtatacac

SEQ ID NO: 9409962 - DNA, 22 bp, Homo sapiens
aaacaccagtcccagtatacac

SEQ ID NO: 9409963 - DNA, 22 bp, Homo sapiens
aaagagctcttactctagtgta

SEQ ID NO: 9409964 - DNA, 22 bp, Homo sapiens
aaagagctcacagtccactgga

SEQ ID NO: 9409965 - DNA, 22 bp, Homo sapiens
aaagagctcacagtccactgga

SEQ ID NO: 9409966 - DNA, 22 bp, Homo sapiens
aaagagctatacaaccatgtcc

SEQ ID NO: 9409967 - DNA, 22 bp, Homo sapiens
aaagagctgagacctggtggag

SEQ ID NO: 9409968 - DNA, 22 bp, Homo sapiens
aaagagctggcatttatagtct

SEQ ID NO: 9409969 - DNA, 22 bp, Homo sapiens
aaagagctgatagcatctgttt

SEQ ID NO: 9409970 - DNA, 22 bp, Homo sapiens
aaagagcttcatttccatttat

SEQ ID NO: 9409971 - DNA, 22 bp, Homo sapiens
aaagagcttgcttgctttatat

SEQ ID NO: 9409972 - DNA, 22 bp, Homo sapiens
aaacacaagaggcagggtacag

SEQ ID NO: 9409973 - DNA, 17 bp, Homo sapiens
aaagagcttggagtgtt

SEQ ID NO: 9409974 - DNA, 22 bp, Homo sapiens
aaacacaagaggcagggtacag

SEQ ID NO: 9409975 - DNA, 22 bp, Homo sapiens
aaacacaagaggcagggtacag

SEQ ID NO: 9409976 - DNA, 22 bp, Homo sapiens
aaacacatcattcatgtcgtca

SEQ ID NO: 9409977 - DNA, 22 bp, Homo sapiens
aaaatactgtggagtgttgaaa

SEQ ID NO: 9409978 - DNA, 22 bp, Homo sapiens
aaaatagttaacgttcagagta

SEQ ID NO: 9409979 - DNA, 22 bp, Homo sapiens
aaaatatcagcaaagggtgaca

SEQ ID NO: 9409980 - DNA, 22 bp, Homo sapiens
aaaatactgtggagtgttgaaa

SEQ ID NO: 9409981 - DNA, 22 bp, Homo sapiens
aaaatatgactgtgctccttaa

SEQ ID NO: 9409982 - DNA, 20 bp, Homo sapiens
aaaatatgtataactcttct

SEQ ID NO: 9409983 - DNA, 20 bp, Homo sapiens
aaaatatgtataactcttct

SEQ ID NO: 9409984 - DNA, 22 bp, Homo sapiens
aaacaggcttgcaacatgtttt

SEQ ID NO: 9409985 - DNA, 22 bp, Homo sapiens
aaacaggcttgcaacatgtttt

SEQ ID NO: 9409986 - DNA, 22 bp, Homo sapiens
aaacaggagttgaccaagtaca

SEQ ID NO: 9409987 - DNA, 22 bp, Homo sapiens
aaacaggcacatagtaacattt

SEQ ID NO: 9409988 - DNA, 22 bp, Homo sapiens
aaacagctttcagaatctctca

SEQ ID NO: 9409989 - DNA, 22 bp, Homo sapiens
aaacagctttcagaatctctca

SEQ ID NO: 9409990 - DNA, 22 bp, Homo sapiens
aaacaggcacatagtaacattt

SEQ ID NO: 9409991 - DNA, 22 bp, Homo sapiens
aaacagtagaagtgtattttat

SEQ ID NO: 9409992 - DNA, 22 bp, Homo sapiens
aaacagtattatcaatatattt

SEQ ID NO: 9409993 - DNA, 22 bp, Homo sapiens
aaacagtactcgatttttgtag

SEQ ID NO: 9409994 - DNA, 22 bp, Homo sapiens
aaacagtaagttctagtattat

SEQ ID NO: 9409995 - DNA, 22 bp, Homo sapiens
aaaatattttagggccaggaga

SEQ ID NO: 9409996 - DNA, 22 bp, Homo sapiens
aaaatattttagggccaggaga

SEQ ID NO: 9409997 - DNA, 22 bp, Homo sapiens
aaaatattttagggccaggaga

SEQ ID NO: 9409998 - DNA, 22 bp, Homo sapiens
aaactgcacaagggtgcatagc

SEQ ID NO: 9409999 - DNA, 22 bp, Homo sapiens
aaactgcactttattttgtcaa

SEQ ID NO: 9410000 - DNA, 22 bp, Homo sapiens
aaaatattttagggccaggaga

SEQ ID NO: 9410001 - DNA, 22 bp, Homo sapiens
aaaatattttagggccaggaga

SEQ ID NO: 9410002 - DNA, 22 bp, Homo sapiens
aaaatattttagggccaggaga

SEQ ID NO: 9410003 - DNA, 22 bp, Homo sapiens
aaaatatgtataactcttctgc

SEQ ID NO: 9410004 - DNA, 17 bp, Homo sapiens
aaactggggtcaggagc

SEQ ID NO: 9410005 - DNA, 22 bp, Homo sapiens
aaactgggattcttcacaaggt

SEQ ID NO: 9410006 - DNA, 22 bp, Homo sapiens
aaactggtaatcggcaagtgag

SEQ ID NO: 9410007 - DNA, 22 bp, Homo sapiens
aaactgcatgaagctgatttta

SEQ ID NO: 9410008 - DNA, 22 bp, Homo sapiens
aaactgcagagccatggttcaa

SEQ ID NO: 9410009 - DNA, 22 bp, Homo sapiens
aaactgcagagccatggttcaa

SEQ ID NO: 9410010 - DNA, 22 bp, Homo sapiens
aaactgctgggcatatatttct

SEQ ID NO: 9410011 - DNA, 22 bp, Homo sapiens
aaagatgttttacatagcacct

SEQ ID NO: 9410012 - DNA, 21 bp, Homo sapiens
aaagatgtttcttttcctcac

SEQ ID NO: 9410013 - DNA, 22 bp, Homo sapiens
aaagatgtttgttccaaaattc

SEQ ID NO: 9410014 - DNA, 22 bp, Homo sapiens
aaagatgttttataagttatgg

SEQ ID NO: 9410015 - DNA, 22 bp, Homo sapiens
aaagatgttttataagttatgg

SEQ ID NO: 9410016 - DNA, 22 bp, Homo sapiens
aaagatgttttataagttatgg

SEQ ID NO: 9410017 - DNA, 22 bp, Homo sapiens
aaagattaaatcaaattggtca

SEQ ID NO: 9410018 - DNA, 22 bp, Homo sapiens
aaagattagataagatagattt

SEQ ID NO: 9410019 - DNA, 22 bp, Homo sapiens
aaagattagataagatagattt

SEQ ID NO: 9410020 - DNA, 22 bp, Homo sapiens
aaagattaaggtattgttagct

SEQ ID NO: 9410021 - DNA, 22 bp, Homo sapiens
aaagattatggcattgaaatac

SEQ ID NO: 9410022 - DNA, 22 bp, Homo sapiens
aaagatttgagttctgcttata

SEQ ID NO: 9410023 - DNA, 22 bp, Homo sapiens
aaagcaaacagaaccccaagct

SEQ ID NO: 9410024 - DNA, 22 bp, Homo sapiens
aaagatttgaaattaggcatca

SEQ ID NO: 9410025 - DNA, 22 bp, Homo sapiens
aaagatttgagttctgcttata

SEQ ID NO: 9410026 - DNA, 22 bp, Homo sapiens
aaagatttcacatcccaagcct

SEQ ID NO: 9410027 - DNA, 22 bp, Homo sapiens
aaagatttatgaagttcaatta

SEQ ID NO: 9410028 - DNA, 22 bp, Homo sapiens
aaagatttatgaagttcaatta

SEQ ID NO: 9410029 - DNA, 22 bp, Homo sapiens
aaagatttcagaagcctgtgcc

SEQ ID NO: 9410030 - DNA, 22 bp, Homo sapiens
aaagatttaagaataatttgtg

SEQ ID NO: 9410031 - DNA, 22 bp, Homo sapiens
aaagatttaagaataatttgtg

SEQ ID NO: 9410032 - DNA, 22 bp, Homo sapiens
aaagatttaagaataatttgtg

SEQ ID NO: 9410033 - DNA, 22 bp, Homo sapiens
aaagatttaagaataatttgtg

SEQ ID NO: 9410034 - DNA, 22 bp, Homo sapiens
aaagatttatgaagttcaatta

SEQ ID NO: 9410035 - DNA, 22 bp, Homo sapiens
aaagatttatgaagttcaatta

SEQ ID NO: 9410036 - DNA, 22 bp, Homo sapiens
aaagattcgagcgatgtataaa

SEQ ID NO: 9410037 - DNA, 22 bp, Homo sapiens
aaagattgaaagagaatttgtc

SEQ ID NO: 9410038 - DNA, 22 bp, Homo sapiens
aaagattcctttattctccaag

SEQ ID NO: 9410039 - DNA, 22 bp, Homo sapiens
aaagattcgagcgatgtataaa

SEQ ID NO: 9410040 - DNA, 22 bp, Homo sapiens
aaagattatggcattgaaatac

SEQ ID NO: 9410041 - DNA, 22 bp, Homo sapiens
aaagattatggcattgaaatac

SEQ ID NO: 9410042 - DNA, 22 bp, Homo sapiens
aaagattatggcattgaaatac

SEQ ID NO: 9410043 - DNA, 22 bp, Homo sapiens
aacactgtgcccaccctagtcc

SEQ ID NO: 9410044 - DNA, 22 bp, Homo sapiens
aacactgtgcccaccctagtcc

SEQ ID NO: 9410045 - DNA, 22 bp, Homo sapiens
aacactgtcttatacttcaatg

SEQ ID NO: 9410046 - DNA, 22 bp, Homo sapiens
aacactgtcttatacttcaatg

SEQ ID NO: 9410047 - DNA, 22 bp, Homo sapiens
aacactgtgaggtaatgaccta

SEQ ID NO: 9410048 - DNA, 22 bp, Homo sapiens
aacactgtgcagtgtaatgctg

SEQ ID NO: 9410049 - DNA, 22 bp, Homo sapiens
aacactgtgctccccaggctgt

SEQ ID NO: 9410050 - DNA, 20 bp, Homo sapiens
aacactgtgcgtggtaggtg

SEQ ID NO: 9410051 - DNA, 22 bp, Homo sapiens
aacactgtggtcttttcagtaa

SEQ ID NO: 9410052 - DNA, 22 bp, Homo sapiens
aacacttaaggagagatcaaat

SEQ ID NO: 9410053 - DNA, 22 bp, Homo sapiens
aacactgtggtcttttcagtaa

SEQ ID NO: 9410054 - DNA, 22 bp, Homo sapiens
aacacttagatttttaaggttt

SEQ ID NO: 9410055 - DNA, 22 bp, Homo sapiens
aaagcaaacagaaccccaagct

SEQ ID NO: 9410056 - DNA, 22 bp, Homo sapiens
aaagcaaacagaaccccaagct

SEQ ID NO: 9410057 - DNA, 22 bp, Homo sapiens
aaagcaagatgcatccgtcaag

SEQ ID NO: 9410058 - DNA, 22 bp, Homo sapiens
aaagcaagatgcatccgtcaag

SEQ ID NO: 9410059 - DNA, 23 bp, Homo sapiens
aaagcaaggaattggcaacagag

SEQ ID NO: 9410060 - DNA, 23 bp, Homo sapiens
aaagcaaggaattggcaacagag

SEQ ID NO: 9410061 - DNA, 23 bp, Homo sapiens
aaagcaaggaattggcaacagag

SEQ ID NO: 9410062 - DNA, 23 bp, Homo sapiens
aaagcaaggaattggcaacagag

SEQ ID NO: 9410063 - DNA, 23 bp, Homo sapiens
aaagcaaggaattggcaacagag

SEQ ID NO: 9410064 - DNA, 22 bp, Homo sapiens
aaagcaagtctctacaaagtac

SEQ ID NO: 9410065 - DNA, 22 bp, Homo sapiens
aaagcaagtctctacaaagtac

SEQ ID NO: 9410066 - DNA, 22 bp, Homo sapiens
aaagcaagtctctacaaagtac

SEQ ID NO: 9410067 - DNA, 22 bp, Homo sapiens
aaagcaagtctctacaaagtac

SEQ ID NO: 9410068 - DNA, 22 bp, Homo sapiens
aacactgtcttatacttcaatg

SEQ ID NO: 9410069 - DNA, 22 bp, Homo sapiens
aacactgtcttatacttcaatg

SEQ ID NO: 9410070 - DNA, 22 bp, Homo sapiens
aacactgtatcagtcttcaata

SEQ ID NO: 9410071 - DNA, 22 bp, Homo sapiens
aacactgtatcagtcttcaata

SEQ ID NO: 9410072 - DNA, 22 bp, Homo sapiens
aacactgtcagcctttgatgga

SEQ ID NO: 9410073 - DNA, 22 bp, Homo sapiens
aacactgtatcagtcttcaata

SEQ ID NO: 9410074 - DNA, 22 bp, Homo sapiens
aacacattggaagccaagaatg

SEQ ID NO: 9410075 - DNA, 22 bp, Homo sapiens
aacacattttgcctaggcaata

SEQ ID NO: 9410076 - DNA, 22 bp, Homo sapiens
aaagcacttgaaatctggcagt

SEQ ID NO: 9410077 - DNA, 22 bp, Homo sapiens
aaagcacttcaggagcagtttg

SEQ ID NO: 9410078 - DNA, 22 bp, Homo sapiens
aacataagggagcttcaaaact

SEQ ID NO: 9410079 - DNA, 22 bp, Homo sapiens
aacagtgaggtgaatatgctcc

SEQ ID NO: 9410080 - DNA, 22 bp, Homo sapiens
aacagtgaggtgaatatgctcc

SEQ ID NO: 9410081 - DNA, 22 bp, Homo sapiens
aacagtgagttgatgactgaat

SEQ ID NO: 9410082 - DNA, 22 bp, Homo sapiens
aaagcagcaaatacttttgcac

SEQ ID NO: 9410083 - DNA, 22 bp, Homo sapiens
aacagtgagaaggtggacagga

SEQ ID NO: 9410084 - DNA, 19 bp, Homo sapiens
aaagcagaggagcatctga

SEQ ID NO: 9410085 - DNA, 19 bp, Homo sapiens
aaagcagaggagcatctga

SEQ ID NO: 9410086 - DNA, 22 bp, Homo sapiens
aaagcagattctgatgcagtag

SEQ ID NO: 9410087 - DNA, 22 bp, Homo sapiens
aaagcagaggttgcagtgagct

SEQ ID NO: 9410088 - DNA, 22 bp, Homo sapiens
aaagcagaggttgcagtgagct

SEQ ID NO: 9410089 - DNA, 22 bp, Homo sapiens
aacatagacccagttcaacaaa

SEQ ID NO: 9410090 - DNA, 22 bp, Homo sapiens
aacatagaattgttatattttc

SEQ ID NO: 9410091 - DNA, 22 bp, Homo sapiens
aacatagaattgttatattttc

SEQ ID NO: 9410092 - DNA, 22 bp, Homo sapiens
aaagccatgggtctttggcata

SEQ ID NO: 9410093 - DNA, 22 bp, Homo sapiens
aacatataaactcttaagttca

SEQ ID NO: 9410094 - DNA, 22 bp, Homo sapiens
aacatagctttactcaaatgac

SEQ ID NO: 9410095 - DNA, 22 bp, Homo sapiens
aaagccattgaactgtacttta

SEQ ID NO: 9410096 - DNA, 22 bp, Homo sapiens
aaagccattacaaaatttcata

SEQ ID NO: 9410097 - DNA, 22 bp, Homo sapiens
aaagccattacaaaatttcata

SEQ ID NO: 9410098 - DNA, 22 bp, Homo sapiens
aaagccattacaaaatttcata

SEQ ID NO: 9410099 - DNA, 22 bp, Homo sapiens
aaagccattgaactgtacttta

SEQ ID NO: 9410100 - DNA, 22 bp, Homo sapiens
aaagcccatgtggaagtacagg

SEQ ID NO: 9410101 - DNA, 22 bp, Homo sapiens
aaagcccatgtggaagtacagg

SEQ ID NO: 9410102 - DNA, 22 bp, Homo sapiens
aaagcccatgtggaagtacagg

SEQ ID NO: 9410103 - DNA, 22 bp, Homo sapiens
aacatacttatactaaataatg

SEQ ID NO: 9410104 - DNA, 22 bp, Homo sapiens
aacatacttatactaaataatg

SEQ ID NO: 9410105 - DNA, 22 bp, Homo sapiens
aacatacgagcagtttatagag

SEQ ID NO: 9410106 - DNA, 22 bp, Homo sapiens
aacatagaattgttatattttc

SEQ ID NO: 9410107 - DNA, 22 bp, Homo sapiens
aacatagaattgttatattttc

SEQ ID NO: 9410108 - DNA, 22 bp, Homo sapiens
aacatagaattgttatattttc

SEQ ID NO: 9410109 - DNA, 22 bp, Homo sapiens
aacatagaagatggttaattgt

SEQ ID NO: 9410110 - DNA, 22 bp, Homo sapiens
aacatagaataaatgagttagg

SEQ ID NO: 9410111 - DNA, 22 bp, Homo sapiens
aacatagaataaatgagttagg

SEQ ID NO: 9410112 - DNA, 22 bp, Homo sapiens
aacatacagtgagcagtggact

SEQ ID NO: 9410113 - DNA, 22 bp, Homo sapiens
aacatacagtgagcagtggact

SEQ ID NO: 9410114 - DNA, 22 bp, Homo sapiens
aacatacatatttcagtgtcca

SEQ ID NO: 9410115 - DNA, 22 bp, Homo sapiens
aacatacatatttcagtgtcca

SEQ ID NO: 9410116 - DNA, 22 bp, Homo sapiens
aacatacatatttcagtgtcca

SEQ ID NO: 9410117 - DNA, 22 bp, Homo sapiens
aacatacatatttcagtgtcca

SEQ ID NO: 9410118 - DNA, 22 bp, Homo sapiens
aacatacagtgagcagtggact

SEQ ID NO: 9410119 - DNA, 22 bp, Homo sapiens
aacataatgtggccaaagtcac

SEQ ID NO: 9410120 - DNA, 22 bp, Homo sapiens
aacataatgtggccaaagtcac

SEQ ID NO: 9410121 - DNA, 22 bp, Homo sapiens
aacccacaagcagctgtagccc

SEQ ID NO: 9410122 - DNA, 22 bp, Homo sapiens
aacccacaaaggatttcagctc

SEQ ID NO: 9410123 - DNA, 22 bp, Homo sapiens
aacatttgtttggcttcaatta

SEQ ID NO: 9410124 - DNA, 22 bp, Homo sapiens
aacatttgtttggcttcaatta

SEQ ID NO: 9410125 - DNA, 22 bp, Homo sapiens
aaagcctgggttcctcactatc

SEQ ID NO: 9410126 - DNA, 22 bp, Homo sapiens
aaagcctcccaggttatgagta

SEQ ID NO: 9410127 - DNA, 22 bp, Homo sapiens
aaagcctcccaggttatgagta

SEQ ID NO: 9410128 - DNA, 22 bp, Homo sapiens
aacccaggacagagctttgtgg

SEQ ID NO: 9410129 - DNA, 22 bp, Homo sapiens
aacccaccgtggtagggcacac

SEQ ID NO: 9410130 - DNA, 16 bp, Homo sapiens
aacccacagctcccga

SEQ ID NO: 9410131 - DNA, 22 bp, Homo sapiens
aaccccaggctggaggagtctc

SEQ ID NO: 9410132 - DNA, 22 bp, Homo sapiens
aaccccagtaccccaggatatg

SEQ ID NO: 9410133 - DNA, 22 bp, Homo sapiens
aacccgagggccccaggctcgg

SEQ ID NO: 9410134 - DNA, 22 bp, Homo sapiens
aacccgggaggcagaggttgtg

SEQ ID NO: 9410135 - DNA, 22 bp, Homo sapiens
aacccgggaggcagaggttgtg

SEQ ID NO: 9410136 - DNA, 22 bp, Homo sapiens
aacccgggaggcagaggttgtg

SEQ ID NO: 9410137 - DNA, 22 bp, Homo sapiens
aacccgggaggcagaggttgtg

SEQ ID NO: 9410138 - DNA, 22 bp, Homo sapiens
aaaggcagagttgttggaggca

SEQ ID NO: 9410139 - DNA, 22 bp, Homo sapiens
aaaggcagagttgttggaggca

SEQ ID NO: 9410140 - DNA, 18 bp, Homo sapiens
aaaggcagattactggga

SEQ ID NO: 9410141 - DNA, 22 bp, Homo sapiens
aaaggcaggactgcagcatagg

SEQ ID NO: 9410142 - DNA, 22 bp, Homo sapiens
aaaggcagtgggtatgtggatc

SEQ ID NO: 9410143 - DNA, 22 bp, Homo sapiens
aaaggcagtgggtatgtggatc

SEQ ID NO: 9410144 - DNA, 22 bp, Homo sapiens
aaaggcagtgggtatgtggatc

SEQ ID NO: 9410145 - DNA, 22 bp, Homo sapiens
aaaggcagtgggtatgtggatc

SEQ ID NO: 9410146 - DNA, 23 bp, Homo sapiens
aaaggcaggcctaggacatattg

SEQ ID NO: 9410147 - DNA, 22 bp, Homo sapiens
aaaggcaggctttcacatctca

SEQ ID NO: 9410148 - DNA, 22 bp, Homo sapiens
aaaggcaggctttcacatctca

SEQ ID NO: 9410149 - DNA, 19 bp, Homo sapiens
aaaggcagtgggtggcgtg

SEQ ID NO: 9410150 - DNA, 22 bp, Homo sapiens
aaaggcagtgtgatactgtggt

SEQ ID NO: 9410151 - DNA, 22 bp, Homo sapiens
aaaggcagtgtgatactgtggt

SEQ ID NO: 9410152 - DNA, 22 bp, Homo sapiens
aaaggcatgattaattctgtgt

SEQ ID NO: 9410153 - DNA, 18 bp, Homo sapiens
aaaggcatatatagaagt

SEQ ID NO: 9410154 - DNA, 21 bp, Homo sapiens
aactgcaaatgatgctggaga

SEQ ID NO: 9410155 - DNA, 22 bp, Homo sapiens
aagaacataaacagaaggacag

SEQ ID NO: 9410156 - DNA, 22 bp, Homo sapiens
aagaacataacagaagctgtgt

SEQ ID NO: 9410157 - DNA, 22 bp, Homo sapiens
aagaacataacagaagctgtgt

SEQ ID NO: 9410158 - DNA, 22 bp, Homo sapiens
aagaacataacagaagctgtgt

SEQ ID NO: 9410159 - DNA, 22 bp, Homo sapiens
aagaacataacagaagctgtgt

SEQ ID NO: 9410160 - DNA, 22 bp, Homo sapiens
aagaacataacagaagctgtgt

SEQ ID NO: 9410161 - DNA, 22 bp, Homo sapiens
aagaacatgaacacaatgttta

SEQ ID NO: 9410162 - DNA, 22 bp, Homo sapiens
aagaacagttgggaggtgagcc

SEQ ID NO: 9410163 - DNA, 22 bp, Homo sapiens
aagaacataaacagaaggacag

SEQ ID NO: 9410164 - DNA, 22 bp, Homo sapiens
aagaacagttgggaggtgagcc

SEQ ID NO: 9410165 - DNA, 22 bp, Homo sapiens
aagaacatgagttatgatgatt

SEQ ID NO: 9410166 - DNA, 22 bp, Homo sapiens
aagaacatgaagtcacaaatgc

SEQ ID NO: 9410167 - DNA, 22 bp, Homo sapiens
aagaacatgagttatgatgatt

SEQ ID NO: 9410168 - DNA, 22 bp, Homo sapiens
aagaacatgaacctcttctaac

SEQ ID NO: 9410169 - DNA, 22 bp, Homo sapiens
aagaacatgaagtcacaaatgc

SEQ ID NO: 9410170 - DNA, 22 bp, Homo sapiens
aagaacatgaacacaatgttta

SEQ ID NO: 9410171 - DNA, 22 bp, Homo sapiens
aagaacatgaacacaatgttta

SEQ ID NO: 9410172 - DNA, 22 bp, Homo sapiens
aaagtaattgcagtttctgcca

SEQ ID NO: 9410173 - DNA, 22 bp, Homo sapiens
aaagtaattaagaagctggaca

SEQ ID NO: 9410174 - DNA, 22 bp, Homo sapiens
aaagtaagaccaagtgatcatt

SEQ ID NO: 9410175 - DNA, 22 bp, Homo sapiens
aagaaataagacttctctgtcc

SEQ ID NO: 9410176 - DNA, 22 bp, Homo sapiens
aagaaataagacttctctgtcc

SEQ ID NO: 9410177 - DNA, 22 bp, Homo sapiens
aagaaataagacttctctgtcc

SEQ ID NO: 9410178 - DNA, 22 bp, Homo sapiens
aagaaataagacttctctgtcc

SEQ ID NO: 9410179 - DNA, 22 bp, Homo sapiens
aaagtaacctagtaatagtgtc

SEQ ID NO: 9410180 - DNA, 22 bp, Homo sapiens
aaagtaacctagtaatagtgtc

SEQ ID NO: 9410181 - DNA, 22 bp, Homo sapiens
aaagtaaagattgggaatgtgt

SEQ ID NO: 9410182 - DNA, 22 bp, Homo sapiens
aaagtaaagattgggaatgtgt

SEQ ID NO: 9410183 - DNA, 22 bp, Homo sapiens
aaagtaaagattgggaatgtgt

SEQ ID NO: 9410184 - DNA, 23 bp, Homo sapiens
aactgtcttgcaagtgtgatacc

SEQ ID NO: 9410185 - DNA, 22 bp, Homo sapiens
aactgtcttatttatatttctg

SEQ ID NO: 9410186 - DNA, 22 bp, Homo sapiens
aactgtctaaggagaatatgaa

SEQ ID NO: 9410187 - DNA, 22 bp, Homo sapiens
aactgtagaagggacacaaaag

SEQ ID NO: 9410188 - DNA, 22 bp, Homo sapiens
aactgtatacaattgtcagaca

SEQ ID NO: 9410189 - DNA, 22 bp, Homo sapiens
aactgtaaggcttagaacagca

SEQ ID NO: 9410190 - DNA, 22 bp, Homo sapiens
aactgtaagagaataaatgtgt

SEQ ID NO: 9410191 - DNA, 21 bp, Homo sapiens
aactgcaaatgatgctggaga

SEQ ID NO: 9410192 - DNA, 22 bp, Homo sapiens
aactgtaagaaataaaattctg

SEQ ID NO: 9410193 - DNA, 22 bp, Homo sapiens
aactgtacgataataaatttgt

SEQ ID NO: 9410194 - DNA, 22 bp, Homo sapiens
aactgtaatttttacatagtaa

SEQ ID NO: 9410195 - DNA, 22 bp, Homo sapiens
aactgtaatttttacatagtaa

SEQ ID NO: 9410196 - DNA, 22 bp, Homo sapiens
aactgtaatttttacatagtaa

SEQ ID NO: 9410197 - DNA, 22 bp, Homo sapiens
aactgtaatttttacatagtaa

SEQ ID NO: 9410198 - DNA, 19 bp, Homo sapiens
aactgtaattaatacccta

SEQ ID NO: 9410199 - DNA, 19 bp, Homo sapiens
aactgtaattaatacccta

SEQ ID NO: 9410200 - DNA, 22 bp, Homo sapiens
aactgtaatgaattgttcatga

SEQ ID NO: 9410201 - DNA, 22 bp, Homo sapiens
aagcaggcatcttggaggtcaa

SEQ ID NO: 9410202 - DNA, 22 bp, Homo sapiens
aagcaggcagggtggagagttt

SEQ ID NO: 9410203 - DNA, 22 bp, Homo sapiens
aagcaggatggatctagtgttc

SEQ ID NO: 9410204 - DNA, 22 bp, Homo sapiens
aagcaggcaaggttgtggggca

SEQ ID NO: 9410205 - DNA, 22 bp, Homo sapiens
aagcaggatggaggttgagtta

SEQ ID NO: 9410206 - DNA, 22 bp, Homo sapiens
aagcaggagagcctgggtgagc

SEQ ID NO: 9410207 - DNA, 22 bp, Homo sapiens
aagcaggagagcctgggtgagc

SEQ ID NO: 9410208 - DNA, 22 bp, Homo sapiens
aagcaggagagcctgggcgagc

SEQ ID NO: 9410209 - DNA, 22 bp, Homo sapiens
aagcaggagagcctgggcgagc

SEQ ID NO: 9410210 - DNA, 22 bp, Homo sapiens
aagcaggagagcctgggtgagc

SEQ ID NO: 9410211 - DNA, 22 bp, Homo sapiens
aagcaggagatgcaggaatgta

SEQ ID NO: 9410212 - DNA, 22 bp, Homo sapiens
aagcaggagatgggtgcttttc

SEQ ID NO: 9410213 - DNA, 22 bp, Homo sapiens
aagcaggagatgggtgcttttc

SEQ ID NO: 9410214 - DNA, 22 bp, Homo sapiens
aagcaggagatgcaggaatgta

SEQ ID NO: 9410215 - DNA, 22 bp, Homo sapiens
aagcaggagatgcaggaatgta

SEQ ID NO: 9410216 - DNA, 22 bp, Homo sapiens
aagcagcatatgacagcatcca

SEQ ID NO: 9410217 - DNA, 22 bp, Homo sapiens
aagattctcactgctcaacttt

SEQ ID NO: 9410218 - DNA, 22 bp, Homo sapiens
aagattctcactgctcaacttt

SEQ ID NO: 9410219 - DNA, 22 bp, Homo sapiens
aagattctagaggaacttctta

SEQ ID NO: 9410220 - DNA, 22 bp, Homo sapiens
aagattctacagtaggtacatt

SEQ ID NO: 9410221 - DNA, 22 bp, Homo sapiens
aagattctacagtaggtacatt

SEQ ID NO: 9410222 - DNA, 22 bp, Homo sapiens
aagattctagaggaacttctta

SEQ ID NO: 9410223 - DNA, 20 bp, Homo sapiens
aagattcattgtaattaggg

SEQ ID NO: 9410224 - DNA, 22 bp, Homo sapiens
aagattcccagagaagttccac

SEQ ID NO: 9410225 - DNA, 22 bp, Homo sapiens
aagattctacaaactctggtaa

SEQ ID NO: 9410226 - DNA, 22 bp, Homo sapiens
aagattatggcagataacaatt

SEQ ID NO: 9410227 - DNA, 22 bp, Homo sapiens
aagattatggcagataacaatt

SEQ ID NO: 9410228 - DNA, 22 bp, Homo sapiens
aagattatttaagacaggaacc

SEQ ID NO: 9410229 - DNA, 22 bp, Homo sapiens
aagattcacagagtgaatgaaa

SEQ ID NO: 9410230 - DNA, 22 bp, Homo sapiens
aagattcacagagtgaatgaaa

SEQ ID NO: 9410231 - DNA, 22 bp, Homo sapiens
aagattcagttgatgtgttcca

SEQ ID NO: 9410232 - DNA, 22 bp, Homo sapiens
aagattcagccaaattgttcat

SEQ ID NO: 9410233 - DNA, 22 bp, Homo sapiens
aagattcagccaaattgttcat

SEQ ID NO: 9410234 - DNA, 22 bp, Homo sapiens
aagatcaagtgtactttatgta

SEQ ID NO: 9410235 - DNA, 22 bp, Homo sapiens
aagatcaccaagtaacagtctg

SEQ ID NO: 9410236 - DNA, 18 bp, Homo sapiens
aagatcacaaaatagctg

SEQ ID NO: 9410237 - DNA, 22 bp, Homo sapiens
aagatcaatgttcattaagatg

SEQ ID NO: 9410238 - DNA, 22 bp, Homo sapiens
aagatcaccttgacatgaaaag

SEQ ID NO: 9410239 - DNA, 22 bp, Homo sapiens
aagatcagaactttatacagga

SEQ ID NO: 9410240 - DNA, 22 bp, Homo sapiens
aagatcagaactttatacagga

SEQ ID NO: 9410241 - DNA, 22 bp, Homo sapiens
aagatcaggcgtggaaaacact

SEQ ID NO: 9410242 - DNA, 22 bp, Homo sapiens
aagatcaggcgtggaaaacact

SEQ ID NO: 9410243 - DNA, 22 bp, Homo sapiens
aagatattcaaagatttattag

SEQ ID NO: 9410244 - DNA, 22 bp, Homo sapiens
aagatattcaaagatttattag

SEQ ID NO: 9410245 - DNA, 22 bp, Homo sapiens
aagatattttagaacattcact

SEQ ID NO: 9410246 - DNA, 22 bp, Homo sapiens
aagatattttagaacattcact

SEQ ID NO: 9410247 - DNA, 22 bp, Homo sapiens
aagatattttagaacattcact

SEQ ID NO: 9410248 - DNA, 22 bp, Homo sapiens
aagatattttagaacattcact

SEQ ID NO: 9410249 - DNA, 22 bp, Homo sapiens
aagatattttagaacattcact

SEQ ID NO: 9410250 - DNA, 22 bp, Homo sapiens
aagatattcaaagatttattag

SEQ ID NO: 9410251 - DNA, 22 bp, Homo sapiens
aagatatattttggtgatttca

SEQ ID NO: 9410252 - DNA, 22 bp, Homo sapiens
aagatatattttggtgatttca

SEQ ID NO: 9410253 - DNA, 18 bp, Homo sapiens
aagatgtttaatgggaag

SEQ ID NO: 9410254 - DNA, 22 bp, Homo sapiens
aagatgtttagatttatacaat

SEQ ID NO: 9410255 - DNA, 22 bp, Homo sapiens
aagatcctgcttttgcttctgt

SEQ ID NO: 9410256 - DNA, 22 bp, Homo sapiens
aagatccatgagggcagagatt

SEQ ID NO: 9410257 - DNA, 22 bp, Homo sapiens
aagatcctgtactttcctcact

SEQ ID NO: 9410258 - DNA, 22 bp, Homo sapiens
aagatgttgcattagaatacct

SEQ ID NO: 9410259 - DNA, 22 bp, Homo sapiens
aagatgttgcaagggactcttc

SEQ ID NO: 9410260 - DNA, 23 bp, Homo sapiens
aagatccattcaaattatgtatc

SEQ ID NO: 9410261 - DNA, 23 bp, Homo sapiens
aagatccattcaaattatgtatc

SEQ ID NO: 9410262 - DNA, 22 bp, Homo sapiens
aagatcataatatttatctcat

SEQ ID NO: 9410263 - DNA, 22 bp, Homo sapiens
aagccggctgggccgaggctgc

SEQ ID NO: 9410264 - DNA, 22 bp, Homo sapiens
aagcctagcactgaggaaaaga

SEQ ID NO: 9410265 - DNA, 21 bp, Homo sapiens
aagcctcaagcagaagacaga

SEQ ID NO: 9410266 - DNA, 21 bp, Homo sapiens
aagcctcaagcagaagacaga

SEQ ID NO: 9410267 - DNA, 22 bp, Homo sapiens
aagcccttggcgcacaccgggc

SEQ ID NO: 9410268 - DNA, 22 bp, Homo sapiens
aagcccttggcagagttcccca

SEQ ID NO: 9410269 - DNA, 22 bp, Homo sapiens
aagccctgttctttctctcacc

SEQ ID NO: 9410270 - DNA, 22 bp, Homo sapiens
aagcccttggcgcacaccgggc

SEQ ID NO: 9410271 - DNA, 22 bp, Homo sapiens
aagccctgtcaccctgacttca

SEQ ID NO: 9410272 - DNA, 22 bp, Homo sapiens
aagccctgtcaccctgacttca

SEQ ID NO: 9410273 - DNA, 22 bp, Homo sapiens
aagccctgtccggggggaagaa

SEQ ID NO: 9410274 - DNA, 22 bp, Homo sapiens
aagccctgtaaattgcccttaa

SEQ ID NO: 9410275 - DNA, 22 bp, Homo sapiens
aagccctgttctttctctcacc

SEQ ID NO: 9410276 - DNA, 22 bp, Homo sapiens
aagccctgttaggcactgggga

SEQ ID NO: 9410277 - DNA, 22 bp, Homo sapiens
aagccctgttctttctctcacc

SEQ ID NO: 9410278 - DNA, 22 bp, Homo sapiens
aagccctgttaggcactgggga

SEQ ID NO: 9410279 - DNA, 22 bp, Homo sapiens
aagccctgttaggcactgggga

SEQ ID NO: 9410280 - DNA, 22 bp, Homo sapiens
aagcctggcacattggagtctg

SEQ ID NO: 9410281 - DNA, 22 bp, Homo sapiens
aagcctggcacattggagtctg

SEQ ID NO: 9410282 - DNA, 22 bp, Homo sapiens
aagcctgaacattactagttgt

SEQ ID NO: 9410283 - DNA, 22 bp, Homo sapiens
aagcctgagcaacctgctggcg

SEQ ID NO: 9410284 - DNA, 22 bp, Homo sapiens
aagcctgagcaacctgctggcg

SEQ ID NO: 9410285 - DNA, 22 bp, Homo sapiens
aagcctgagggtgttgctagat

SEQ ID NO: 9410286 - DNA, 22 bp, Homo sapiens
aagcctgagccatgctttactg

SEQ ID NO: 9410287 - DNA, 22 bp, Homo sapiens
aagcccttggcgcacaccgggc

SEQ ID NO: 9410288 - DNA, 22 bp, Homo sapiens
aagcctcaccttttagaagcta

SEQ ID NO: 9410289 - DNA, 22 bp, Homo sapiens
aagcctcaccttttagaagcta

SEQ ID NO: 9410290 - DNA, 22 bp, Homo sapiens
aaatgcatgtagaataatagag

SEQ ID NO: 9410291 - DNA, 22 bp, Homo sapiens
aaatgcatgtagaataatagag

SEQ ID NO: 9410292 - DNA, 22 bp, Homo sapiens
aaatgcatgtagaataatagag

SEQ ID NO: 9410293 - DNA, 22 bp, Homo sapiens
aaatgcatgtatgtaatatgct

SEQ ID NO: 9410294 - DNA, 22 bp, Homo sapiens
aaatgcatggctgttttaaagc

SEQ ID NO: 9410295 - DNA, 22 bp, Homo sapiens
aaatgcatggtaaatgattgcc

SEQ ID NO: 9410296 - DNA, 22 bp, Homo sapiens
aaatgcatggctgttttaaagc

SEQ ID NO: 9410297 - DNA, 22 bp, Homo sapiens
aaatgcatggtaaatgattgcc

SEQ ID NO: 9410298 - DNA, 22 bp, Homo sapiens
aagcaggcattccagagacaat

SEQ ID NO: 9410299 - DNA, 22 bp, Homo sapiens
aagcaggccctgggccagggga

SEQ ID NO: 9410300 - DNA, 22 bp, Homo sapiens
aaatctcaatttgaattgtagc

SEQ ID NO: 9410301 - DNA, 22 bp, Homo sapiens
aagcaggcgagggcctggagca

SEQ ID NO: 9410302 - DNA, 22 bp, Homo sapiens
aagcaggccctgggccagggga

SEQ ID NO: 9410303 - DNA, 22 bp, Homo sapiens
aagcaggccctgggccagggga

SEQ ID NO: 9410304 - DNA, 22 bp, Homo sapiens
aaatctctgaacttaataatgc

SEQ ID NO: 9410305 - DNA, 22 bp, Homo sapiens
aaatctcattatttataccata

SEQ ID NO: 9410306 - DNA, 22 bp, Homo sapiens
aaatctcagtgttctaagcatt

SEQ ID NO: 9410307 - DNA, 22 bp, Homo sapiens
aaatctcagcccttattttaga

SEQ ID NO: 9410308 - DNA, 22 bp, Homo sapiens
aaatctcagcccttattttaga

SEQ ID NO: 9410309 - DNA, 22 bp, Homo sapiens
aaatctcactgtagtcaaagtg

SEQ ID NO: 9410310 - DNA, 22 bp, Homo sapiens
aaatctgaaatagtgtgaagta

SEQ ID NO: 9410311 - DNA, 22 bp, Homo sapiens
aaatctctggtcacagaactta

SEQ ID NO: 9410312 - DNA, 22 bp, Homo sapiens
aaatctctggcagaaataaact

SEQ ID NO: 9410313 - DNA, 22 bp, Homo sapiens
aaatctctgcaggcaaatgtga

SEQ ID NO: 9410314 - DNA, 22 bp, Homo sapiens
aagcccagatgagatccctgga

SEQ ID NO: 9410315 - DNA, 22 bp, Homo sapiens
aaatcttcctgaaatttgttca

SEQ ID NO: 9410316 - DNA, 22 bp, Homo sapiens
aaatctttccctttactatcca

SEQ ID NO: 9410317 - DNA, 22 bp, Homo sapiens
aagacgcaccctttgagggcac

SEQ ID NO: 9410318 - DNA, 22 bp, Homo sapiens
aagactcaaggaacaacacagt

SEQ ID NO: 9410319 - DNA, 22 bp, Homo sapiens
aagacccttctctgaggaggaa

SEQ ID NO: 9410320 - DNA, 22 bp, Homo sapiens
aagacccttctctgaggaggaa

SEQ ID NO: 9410321 - DNA, 22 bp, Homo sapiens
aagaccctatactcagtgaccc

SEQ ID NO: 9410322 - DNA, 22 bp, Homo sapiens
aagaccctatactcagtgaccc

SEQ ID NO: 9410323 - DNA, 17 bp, Homo sapiens
aagaccctagtctaccc

SEQ ID NO: 9410324 - DNA, 22 bp, Homo sapiens
aagaccctacccctggagagga

SEQ ID NO: 9410325 - DNA, 22 bp, Homo sapiens
aagaccctaagacctcttgatg

SEQ ID NO: 9410326 - DNA, 22 bp, Homo sapiens
aaagttgtttcctaaggtctaa

SEQ ID NO: 9410327 - DNA, 22 bp, Homo sapiens
aagactgtcttttctgagtgac

SEQ ID NO: 9410328 - DNA, 22 bp, Homo sapiens
aaagtttacagtgcacatgggt

SEQ ID NO: 9410329 - DNA, 22 bp, Homo sapiens
aaagtttaggctttgaaaccag

SEQ ID NO: 9410330 - DNA, 22 bp, Homo sapiens
aaagtttagtgtcctctaccac

SEQ ID NO: 9410331 - DNA, 22 bp, Homo sapiens
aaagtttaggctttgaaaccag

SEQ ID NO: 9410332 - DNA, 22 bp, Homo sapiens
aagactctatctttagagatca

SEQ ID NO: 9410333 - DNA, 22 bp, Homo sapiens
aagactcttgcctaatacatct

SEQ ID NO: 9410334 - DNA, 22 bp, Homo sapiens
aaagtgcaaggattacaggcat

SEQ ID NO: 9410335 - DNA, 22 bp, Homo sapiens
aaagtgcaatcagttagaccat

SEQ ID NO: 9410336 - DNA, 22 bp, Homo sapiens
aaagtgatttaagtacctcagg

SEQ ID NO: 9410337 - DNA, 20 bp, Homo sapiens
aaagtgcacagatacagctc

SEQ ID NO: 9410338 - DNA, 22 bp, Homo sapiens
aaagtgcacctgcttcttcttg

SEQ ID NO: 9410339 - DNA, 22 bp, Homo sapiens
aaagtgcactagaatccagatt

SEQ ID NO: 9410340 - DNA, 22 bp, Homo sapiens
aaagtgcactctcagtgctgct

SEQ ID NO: 9410341 - DNA, 22 bp, Homo sapiens
aaagtgcactctcagtgctgct

SEQ ID NO: 9410342 - DNA, 22 bp, Homo sapiens
aaagtgcactagaatccagatt

SEQ ID NO: 9410343 - DNA, 22 bp, Homo sapiens
aagacagagggaagcaatgatg

SEQ ID NO: 9410344 - DNA, 22 bp, Homo sapiens
aagacagagggaagcaatgatg

SEQ ID NO: 9410345 - DNA, 22 bp, Homo sapiens
aaagtgcagctgaaaacatcct

SEQ ID NO: 9410346 - DNA, 23 bp, Homo sapiens
aaagtgattagcatttctgcaga

SEQ ID NO: 9410347 - DNA, 22 bp, Homo sapiens
aaagtgaggacttgagtactgt

SEQ ID NO: 9410348 - DNA, 23 bp, Homo sapiens
aaagtgacttttataccactaac

SEQ ID NO: 9410349 - DNA, 22 bp, Homo sapiens
aaagtgacaaccatttattaag

SEQ ID NO: 9410350 - DNA, 22 bp, Homo sapiens
aaagtgacaaccagcaggactt

SEQ ID NO: 9410351 - DNA, 19 bp, Homo sapiens
aaagtgaatgctgttttct

SEQ ID NO: 9410352 - DNA, 22 bp, Homo sapiens
aaagtgaatgtatcccgtaagt

SEQ ID NO: 9410353 - DNA, 22 bp, Homo sapiens
aagaacatgctataattatctt

SEQ ID NO: 9410354 - DNA, 22 bp, Homo sapiens
aagaacatggactgtggggtta

SEQ ID NO: 9410355 - DNA, 22 bp, Homo sapiens
aagaacatggtaggataacaaa

SEQ ID NO: 9410356 - DNA, 22 bp, Homo sapiens
aagaacatggtaggataacaaa

SEQ ID NO: 9410357 - DNA, 22 bp, Homo sapiens
aagaacatggtaggataacaaa

SEQ ID NO: 9410358 - DNA, 22 bp, Homo sapiens
aagaacatgagttatgatgatt

SEQ ID NO: 9410359 - DNA, 22 bp, Homo sapiens
aagaacatgatggccatgtgca

SEQ ID NO: 9410360 - DNA, 22 bp, Homo sapiens
aagaacatgctataattatctt

SEQ ID NO: 9410361 - DNA, 22 bp, Homo sapiens
aagaacatgatggccatgtgca

SEQ ID NO: 9410362 - DNA, 22 bp, Homo sapiens
aagaacatgctataattatctt

SEQ ID NO: 9410363 - DNA, 22 bp, Homo sapiens
aaatactgggctcaaaagggtt

SEQ ID NO: 9410364 - DNA, 22 bp, Homo sapiens
aagataaactcttgatttctga

SEQ ID NO: 9410365 - DNA, 22 bp, Homo sapiens
aagataaactcttgatttctga

SEQ ID NO: 9410366 - DNA, 22 bp, Homo sapiens
aagataaactcttgatttctga

SEQ ID NO: 9410367 - DNA, 22 bp, Homo sapiens
aagataaactcttgatttctga

SEQ ID NO: 9410368 - DNA, 22 bp, Homo sapiens
aagatatagatggtggtataaa

SEQ ID NO: 9410369 - DNA, 22 bp, Homo sapiens
aagataaactcttgatttctga

SEQ ID NO: 9410370 - DNA, 22 bp, Homo sapiens
aaatactgctgctattcctttt

SEQ ID NO: 9410371 - DNA, 19 bp, Homo sapiens
aaatactgaagttgttcat

SEQ ID NO: 9410372 - DNA, 22 bp, Homo sapiens
aaatactctcaataaagaaagt

SEQ ID NO: 9410373 - DNA, 22 bp, Homo sapiens
aaatactagaattcagagttga

SEQ ID NO: 9410374 - DNA, 22 bp, Homo sapiens
aaatactattgaccaggtctct

SEQ ID NO: 9410375 - DNA, 22 bp, Homo sapiens
aaatactctcaataaagaaagt

SEQ ID NO: 9410376 - DNA, 22 bp, Homo sapiens
aaatactgctgctattcctttt

SEQ ID NO: 9410377 - DNA, 22 bp, Homo sapiens
aaatactggcaagtgctaattc

SEQ ID NO: 9410378 - DNA, 22 bp, Homo sapiens
aaatactggcaagtgctaattc

SEQ ID NO: 9410379 - DNA, 22 bp, Homo sapiens
aaatactggcaagtgctaattc

SEQ ID NO: 9410380 - DNA, 22 bp, Homo sapiens
aaatactagaattcagagttga

SEQ ID NO: 9410381 - DNA, 22 bp, Homo sapiens
aaatacgtgcacatacatacat

SEQ ID NO: 9410382 - DNA, 22 bp, Homo sapiens
aaatacatttacagtcgtggct

SEQ ID NO: 9410383 - DNA, 22 bp, Homo sapiens
aaatacatttacagtcgtggct

SEQ ID NO: 9410384 - DNA, 22 bp, Homo sapiens
aagaggtaaccatagcaaccac

SEQ ID NO: 9410385 - DNA, 22 bp, Homo sapiens
aagaggtaatgactgcttgagt

SEQ ID NO: 9410386 - DNA, 22 bp, Homo sapiens
aagaggggtggtctgtgaggat

SEQ ID NO: 9410387 - DNA, 19 bp, Homo sapiens
aagagggaaagtgctatgc

SEQ ID NO: 9410388 - DNA, 18 bp, Homo sapiens
aagaggaggagcaggttg

SEQ ID NO: 9410389 - DNA, 18 bp, Homo sapiens
aagaggaggagcaggttg

SEQ ID NO: 9410390 - DNA, 22 bp, Homo sapiens
aagagggaagtcacctggaggt

SEQ ID NO: 9410391 - DNA, 22 bp, Homo sapiens
aagagggagggcaaaggcactg

SEQ ID NO: 9410392 - DNA, 22 bp, Homo sapiens
aagagggagggcaaaggcactg

SEQ ID NO: 9410393 - DNA, 22 bp, Homo sapiens
aagagggaaattgttggctgct

SEQ ID NO: 9410394 - DNA, 22 bp, Homo sapiens
aagagggaagtcacctggaggt

SEQ ID NO: 9410395 - DNA, 22 bp, Homo sapiens
aagagggcagcacaggtgggtc

SEQ ID NO: 9410396 - DNA, 22 bp, Homo sapiens
aagagggaggtgcgggtgcaga

SEQ ID NO: 9410397 - DNA, 22 bp, Homo sapiens
aagagggaggtgcgggtgcaga

SEQ ID NO: 9410398 - DNA, 22 bp, Homo sapiens
aagagggctgcaatcttattgc

SEQ ID NO: 9410399 - DNA, 22 bp, Homo sapiens
aagagggctgcaatcttattgc

SEQ ID NO: 9410400 - DNA, 22 bp, Homo sapiens
aagagggaggtgcgggtgcaga

SEQ ID NO: 9410401 - DNA, 22 bp, Homo sapiens
aaagttttagctgtccagttcc

SEQ ID NO: 9410402 - DNA, 22 bp, Homo sapiens
aaagtttggatccagcaaaaga

SEQ ID NO: 9410403 - DNA, 22 bp, Homo sapiens
aaagtttgttgcttacaaagaa

SEQ ID NO: 9410404 - DNA, 23 bp, Homo sapiens
aaagtttgaagcaacagtagttg

SEQ ID NO: 9410405 - DNA, 23 bp, Homo sapiens
aaagtttgaagcaacagtagttg

SEQ ID NO: 9410406 - DNA, 22 bp, Homo sapiens
aaagtttcctgctaagtgctat

SEQ ID NO: 9410407 - DNA, 22 bp, Homo sapiens
aaagtttccaagttacaccatt

SEQ ID NO: 9410408 - DNA, 22 bp, Homo sapiens
aaagtttatcatagccggggac

SEQ ID NO: 9410409 - DNA, 22 bp, Homo sapiens
aaagtttattttccctggttag

SEQ ID NO: 9410410 - DNA, 19 bp, Homo sapiens
aacatctttccagtagagg

SEQ ID NO: 9410411 - DNA, 22 bp, Homo sapiens
aacatcttgtccttagattaaa

SEQ ID NO: 9410412 - DNA, 22 bp, Homo sapiens
aacatcttgtactgcacatttt

SEQ ID NO: 9410413 - DNA, 22 bp, Homo sapiens
aacatcttcagagaagctaagt

SEQ ID NO: 9410414 - DNA, 22 bp, Homo sapiens
aacatcttatctgcatgatccc

SEQ ID NO: 9410415 - DNA, 22 bp, Homo sapiens
aacatcttatctgcatgatccc

SEQ ID NO: 9410416 - DNA, 22 bp, Homo sapiens
aacatctaggttctcatcgata

SEQ ID NO: 9410417 - DNA, 22 bp, Homo sapiens
aacatctcagaagtgaccctga

SEQ ID NO: 9410418 - DNA, 22 bp, Homo sapiens
aacatctcagaagtgaccctga

SEQ ID NO: 9410419 - DNA, 22 bp, Homo sapiens
aacatctccaacctacatccac

SEQ ID NO: 9410420 - DNA, 22 bp, Homo sapiens
aatacatgttttctactattct

SEQ ID NO: 9410421 - DNA, 22 bp, Homo sapiens
aatagaatttaaatgcagtggc

SEQ ID NO: 9410422 - DNA, 22 bp, Homo sapiens
aatagaatttgtactgtgtttt

SEQ ID NO: 9410423 - DNA, 20 bp, Homo sapiens
aatacatgagcacactttca

SEQ ID NO: 9410424 - DNA, 22 bp, Homo sapiens
aacatgaaaagcccagagaggt

SEQ ID NO: 9410425 - DNA, 22 bp, Homo sapiens
aacatctttgccaaattgctat

SEQ ID NO: 9410426 - DNA, 22 bp, Homo sapiens
aatagatactacttagatgtag

SEQ ID NO: 9410427 - DNA, 19 bp, Homo sapiens
aatagattaattatcctct

SEQ ID NO: 9410428 - DNA, 19 bp, Homo sapiens
aatagattaattatcctct

SEQ ID NO: 9410429 - DNA, 22 bp, Homo sapiens
aatagatgggttaaacagcaaa

SEQ ID NO: 9410430 - DNA, 22 bp, Homo sapiens
aatagatactacttagatgtag

SEQ ID NO: 9410431 - DNA, 22 bp, Homo sapiens
aatagatactacttagatgtag

SEQ ID NO: 9410432 - DNA, 22 bp, Homo sapiens
aatagatactacttagatgtag

SEQ ID NO: 9410433 - DNA, 22 bp, Homo sapiens
aatagatactacttagatgtag

SEQ ID NO: 9410434 - DNA, 22 bp, Homo sapiens
aatagagtattttagcatctta

SEQ ID NO: 9410435 - DNA, 22 bp, Homo sapiens
aatagagtcagttctacattct

SEQ ID NO: 9410436 - DNA, 22 bp, Homo sapiens
aatagagtcagttctacattct

SEQ ID NO: 9410437 - DNA, 22 bp, Homo sapiens
aatagactccagggtctatttt

SEQ ID NO: 9410438 - DNA, 22 bp, Homo sapiens
aatagactccagggtctatttt

SEQ ID NO: 9410439 - DNA, 22 bp, Homo sapiens
aatagacaattctagccaacat

SEQ ID NO: 9410440 - DNA, 22 bp, Homo sapiens
aatagagacctagatgccatga

SEQ ID NO: 9410441 - DNA, 22 bp, Homo sapiens
aatagaggagctttggactccc

SEQ ID NO: 9410442 - DNA, 22 bp, Homo sapiens
aatagaggagctttggactccc

SEQ ID NO: 9410443 - DNA, 22 bp, Homo sapiens
aatagaggaagaaacctgattg

SEQ ID NO: 9410444 - DNA, 22 bp, Homo sapiens
aatagaggtggcatgttataga

SEQ ID NO: 9410445 - DNA, 22 bp, Homo sapiens
aacatgtcttactttgctttct

SEQ ID NO: 9410446 - DNA, 22 bp, Homo sapiens
aacatgtcttactttgctttct

SEQ ID NO: 9410447 - DNA, 22 bp, Homo sapiens
aacatgtcttactttgctttct

SEQ ID NO: 9410448 - DNA, 22 bp, Homo sapiens
aacatgtctttagagaaacatt

SEQ ID NO: 9410449 - DNA, 22 bp, Homo sapiens
aacatgtatcgctttttaatat

SEQ ID NO: 9410450 - DNA, 22 bp, Homo sapiens
aacatgtacctacaatcagaat

SEQ ID NO: 9410451 - DNA, 22 bp, Homo sapiens
aacatgtagcagaaacgactaa

SEQ ID NO: 9410452 - DNA, 22 bp, Homo sapiens
aacatgtagcagaaacgactaa

SEQ ID NO: 9410453 - DNA, 22 bp, Homo sapiens
aacatgtacctacaatcagaat

SEQ ID NO: 9410454 - DNA, 22 bp, Homo sapiens
aacatgtacctacaatcagaat

SEQ ID NO: 9410455 - DNA, 22 bp, Homo sapiens
aacatgtaaccagcattcatct

SEQ ID NO: 9410456 - DNA, 22 bp, Homo sapiens
aacatgtaaccagcattcatct

SEQ ID NO: 9410457 - DNA, 22 bp, Homo sapiens
aatagcaaacactggtaaagtt

SEQ ID NO: 9410458 - DNA, 19 bp, Homo sapiens
aatagattaattatcctct

SEQ ID NO: 9410459 - DNA, 22 bp, Homo sapiens
aatagcaaacactggtaaagtt

SEQ ID NO: 9410460 - DNA, 22 bp, Homo sapiens
aatagcaaacactggtaaagtt

SEQ ID NO: 9410461 - DNA, 22 bp, Homo sapiens
aacatgtaaatatcattgtact

SEQ ID NO: 9410462 - DNA, 22 bp, Homo sapiens
aagtgtctacatttgctaacca

SEQ ID NO: 9410463 - DNA, 22 bp, Homo sapiens
aagtgtctacatttgctaacca

SEQ ID NO: 9410464 - DNA, 22 bp, Homo sapiens
aagtgtctaactggttacttct

SEQ ID NO: 9410465 - DNA, 22 bp, Homo sapiens
aagtgtctagcacctggatgca

SEQ ID NO: 9410466 - DNA, 22 bp, Homo sapiens
aacagcctcagtgagattagga

SEQ ID NO: 9410467 - DNA, 22 bp, Homo sapiens
aagtgtcaatatttttgtaggt

SEQ ID NO: 9410468 - DNA, 22 bp, Homo sapiens
aacagctagtggtctagacttt

SEQ ID NO: 9410469 - DNA, 22 bp, Homo sapiens
aacagctattagaacttcatgg

SEQ ID NO: 9410470 - DNA, 22 bp, Homo sapiens
aacagctaccttctcactgtgc

SEQ ID NO: 9410471 - DNA, 22 bp, Homo sapiens
aacagctgcaaaaggttgcctg

SEQ ID NO: 9410472 - DNA, 22 bp, Homo sapiens
aacagctgcttcagtacttgaa

SEQ ID NO: 9410473 - DNA, 22 bp, Homo sapiens
aacagctgtatactgtagctgt

SEQ ID NO: 9410474 - DNA, 22 bp, Homo sapiens
aacagctgcttctatcttttca

SEQ ID NO: 9410475 - DNA, 22 bp, Homo sapiens
aagtggttgcttgtgagtcccc

SEQ ID NO: 9410476 - DNA, 21 bp, Homo sapiens
aagtggtttacatccagctgt

SEQ ID NO: 9410477 - DNA, 21 bp, Homo sapiens
aagtggtttacatccagctgt

SEQ ID NO: 9410478 - DNA, 22 bp, Homo sapiens
aagtggtttgattcagtttatg

SEQ ID NO: 9410479 - DNA, 21 bp, Homo sapiens
aagtggtttaggttaccgggg

SEQ ID NO: 9410480 - DNA, 22 bp, Homo sapiens
aagtggttttaagaggttcctt

SEQ ID NO: 9410481 - DNA, 23 bp, Homo sapiens
aagtggttttgaacccggaccct

SEQ ID NO: 9410482 - DNA, 22 bp, Homo sapiens
aagtggttattttgatctagaa

SEQ ID NO: 9410483 - DNA, 22 bp, Homo sapiens
aagtggtgtgttggaagaaatc

SEQ ID NO: 9410484 - DNA, 22 bp, Homo sapiens
aagtgcttgatcatagttctca

SEQ ID NO: 9410485 - DNA, 22 bp, Homo sapiens
aacagcttactcaatggtgatt

SEQ ID NO: 9410486 - DNA, 22 bp, Homo sapiens
aacagctgttcgcagatgtagg

SEQ ID NO: 9410487 - DNA, 22 bp, Homo sapiens
aacagctgttcgcagatgtagg

SEQ ID NO: 9410488 - DNA, 22 bp, Homo sapiens
aacagctgtctgcctatctctg

SEQ ID NO: 9410489 - DNA, 22 bp, Homo sapiens
aacagcttcatcacatggcata

SEQ ID NO: 9410490 - DNA, 22 bp, Homo sapiens
aacagcttgagactggatatgc

SEQ ID NO: 9410491 - DNA, 22 bp, Homo sapiens
aacagcttagaaatgttgctaa

SEQ ID NO: 9410492 - DNA, 22 bp, Homo sapiens
aacataaatttgaagtggcaaa

SEQ ID NO: 9410493 - DNA, 22 bp, Homo sapiens
aacataaatttgaagtggcaaa

SEQ ID NO: 9410494 - DNA, 22 bp, Homo sapiens
aacataaatttgaagtggcaaa

SEQ ID NO: 9410495 - DNA, 22 bp, Homo sapiens
aacatattcagatgccaagtcc

SEQ ID NO: 9410496 - DNA, 22 bp, Homo sapiens
aacatatttggctgatattccc

SEQ ID NO: 9410497 - DNA, 22 bp, Homo sapiens
aacatattcagatgccaagtcc

SEQ ID NO: 9410498 - DNA, 22 bp, Homo sapiens
aacatatttggctgatattccc

SEQ ID NO: 9410499 - DNA, 19 bp, Homo sapiens
aacatcatggctctttcca

SEQ ID NO: 9410500 - DNA, 22 bp, Homo sapiens
aacatcattatgtccattaatg

SEQ ID NO: 9410501 - DNA, 22 bp, Homo sapiens
aacatcatcatgaacaactaat

SEQ ID NO: 9410502 - DNA, 22 bp, Homo sapiens
aacatcatcatgaacaactaat

SEQ ID NO: 9410503 - DNA, 22 bp, Homo sapiens
aacatcagcacacaatagcaag

SEQ ID NO: 9410504 - DNA, 22 bp, Homo sapiens
aacatcaggatcttgttacagt

SEQ ID NO: 9410505 - DNA, 22 bp, Homo sapiens
aacatcaggatcttgttacagt

SEQ ID NO: 9410506 - DNA, 22 bp, Homo sapiens
aacatcaggatcttgttacagt

SEQ ID NO: 9410507 - DNA, 22 bp, Homo sapiens
aacatatttggctgatattccc

SEQ ID NO: 9410508 - DNA, 22 bp, Homo sapiens
aacatcacaatttcatttatgc

SEQ ID NO: 9410509 - DNA, 22 bp, Homo sapiens
aacatcagaagtagaagactca

SEQ ID NO: 9410510 - DNA, 22 bp, Homo sapiens
aacctgttttcttctcatctag

SEQ ID NO: 9410511 - DNA, 22 bp, Homo sapiens
aacctgttccctggtccttgac

SEQ ID NO: 9410512 - DNA, 22 bp, Homo sapiens
aacctgtaaatccaaacaatct

SEQ ID NO: 9410513 - DNA, 22 bp, Homo sapiens
aacctgggcttgaacagtgcct

SEQ ID NO: 9410514 - DNA, 22 bp, Homo sapiens
aacctgaattacttttgcacca

SEQ ID NO: 9410515 - DNA, 23 bp, Homo sapiens
aacctgaactagggtcttgcata

SEQ ID NO: 9410516 - DNA, 22 bp, Homo sapiens
aacctgaatttaattgaaatga

SEQ ID NO: 9410517 - DNA, 23 bp, Homo sapiens
aacctgaactagggtcttgcata

SEQ ID NO: 9410518 - DNA, 22 bp, Homo sapiens
aacctgaagaaaatatttgctg

SEQ ID NO: 9410519 - DNA, 22 bp, Homo sapiens
aacctgaaagtagtaaaagctg

SEQ ID NO: 9410520 - DNA, 22 bp, Homo sapiens
aacctgaaactacattcttgat

SEQ ID NO: 9410521 - DNA, 22 bp, Homo sapiens
aacctgagataataggagagta

SEQ ID NO: 9410522 - DNA, 22 bp, Homo sapiens
aatgaattctgaagtcttccaa

SEQ ID NO: 9410523 - DNA, 22 bp, Homo sapiens
aatgaattgcagtactgacttg

SEQ ID NO: 9410524 - DNA, 22 bp, Homo sapiens
aatgaattcgagtgaaggaaag

SEQ ID NO: 9410525 - DNA, 22 bp, Homo sapiens
aatgaatgttttaaggcataaa

SEQ ID NO: 9410526 - DNA, 22 bp, Homo sapiens
aatgaattcgagtgaaggaaag

SEQ ID NO: 9410527 - DNA, 22 bp, Homo sapiens
aatgaacaaatggtgctgcttg

SEQ ID NO: 9410528 - DNA, 22 bp, Homo sapiens
aatgaacaacactgaaggaaga

SEQ ID NO: 9410529 - DNA, 22 bp, Homo sapiens
aacgcccagccttgatcaaatg

SEQ ID NO: 9410530 - DNA, 22 bp, Homo sapiens
aacgcccagccttgatcaaatg

SEQ ID NO: 9410531 - DNA, 22 bp, Homo sapiens
aacctttgaggggagctctttc

SEQ ID NO: 9410532 - DNA, 22 bp, Homo sapiens
aacctttatttggtactattct

SEQ ID NO: 9410533 - DNA, 22 bp, Homo sapiens
aacctttcaattatcctcatct

SEQ ID NO: 9410534 - DNA, 23 bp, Homo sapiens
aacgacagctacaggcatcccac

SEQ ID NO: 9410535 - DNA, 22 bp, Homo sapiens
aaccttttgcaagtgccttgac

SEQ ID NO: 9410536 - DNA, 22 bp, Homo sapiens
aaccttttgcaagtgccttgac

SEQ ID NO: 9410537 - DNA, 19 bp, Homo sapiens
aacctttagatcattctcc

SEQ ID NO: 9410538 - DNA, 22 bp, Homo sapiens
aaccttgtataaaactttgaga

SEQ ID NO: 9410539 - DNA, 22 bp, Homo sapiens
aaccttcttgtgcagaactgta

SEQ ID NO: 9410540 - DNA, 22 bp, Homo sapiens
aaccttcttgtgcagaactgta

SEQ ID NO: 9410541 - DNA, 22 bp, Homo sapiens
aaccttcacttgcttcatttga

SEQ ID NO: 9410542 - DNA, 22 bp, Homo sapiens
aacatgttgagttgaaagtagc

SEQ ID NO: 9410543 - DNA, 22 bp, Homo sapiens
aacatgttgagttgaaagtagc

SEQ ID NO: 9410544 - DNA, 22 bp, Homo sapiens
aaccatttgcagttactgagac

SEQ ID NO: 9410545 - DNA, 22 bp, Homo sapiens
aaccatttgccattatcttaag

SEQ ID NO: 9410546 - DNA, 22 bp, Homo sapiens
aacatgttgctttaataatatt

SEQ ID NO: 9410547 - DNA, 22 bp, Homo sapiens
aaccatttgcagttactgagac

SEQ ID NO: 9410548 - DNA, 22 bp, Homo sapiens
aacccacaaaggatttcagctc

SEQ ID NO: 9410549 - DNA, 22 bp, Homo sapiens
aacccacaaaggatttcagctc

SEQ ID NO: 9410550 - DNA, 22 bp, Homo sapiens
aacccgggaggcggaggttgtg

SEQ ID NO: 9410551 - DNA, 22 bp, Homo sapiens
aacccgggaggcggaggttgtg

SEQ ID NO: 9410552 - DNA, 22 bp, Homo sapiens
aacccgtgatcctgactcccct

SEQ ID NO: 9410553 - DNA, 22 bp, Homo sapiens
aacccgtgatcctgactcccct

SEQ ID NO: 9410554 - DNA, 22 bp, Homo sapiens
aacccgggaggcggaggttgtg

SEQ ID NO: 9410555 - DNA, 22 bp, Homo sapiens
aacccgggaggcggaggttgtg

SEQ ID NO: 9410556 - DNA, 22 bp, Homo sapiens
aaccctggccctggaataggca

SEQ ID NO: 9410557 - DNA, 22 bp, Homo sapiens
aaccctcagctgtttgaggaga

SEQ ID NO: 9410558 - DNA, 22 bp, Homo sapiens
aaccctggggcagctgctaggg

SEQ ID NO: 9410559 - DNA, 22 bp, Homo sapiens
aacctcaaactcttgggcttaa

SEQ ID NO: 9410560 - DNA, 22 bp, Homo sapiens
aacctagactgacatatgtgta

SEQ ID NO: 9410561 - DNA, 22 bp, Homo sapiens
aacctagactgacatatgtgta

SEQ ID NO: 9410562 - DNA, 22 bp, Homo sapiens
aacctctctgtgccctgacttt

SEQ ID NO: 9410563 - DNA, 22 bp, Homo sapiens
aacctctccctttgtgtccctg

SEQ ID NO: 9410564 - DNA, 16 bp, Homo sapiens
aacctctctactgtgg

SEQ ID NO: 9410565 - DNA, 22 bp, Homo sapiens
aacctcaaactcttgggcttaa

SEQ ID NO: 9410566 - DNA, 22 bp, Homo sapiens
aatgacagccctctagtctggg

SEQ ID NO: 9410567 - DNA, 22 bp, Homo sapiens
aatgacagagcactgaacttgg

SEQ ID NO: 9410568 - DNA, 21 bp, Homo sapiens
aatgacagccagatcctttta

SEQ ID NO: 9410569 - DNA, 22 bp, Homo sapiens
aatgacagccctctagtctggg

SEQ ID NO: 9410570 - DNA, 22 bp, Homo sapiens
aatgacagccagattcttctct

SEQ ID NO: 9410571 - DNA, 22 bp, Homo sapiens
aatgacagccagattcttctct

SEQ ID NO: 9410572 - DNA, 22 bp, Homo sapiens
aatgacaatattaatttggagg

SEQ ID NO: 9410573 - DNA, 22 bp, Homo sapiens
aatgacaatggcagaggtagaa

SEQ ID NO: 9410574 - DNA, 23 bp, Homo sapiens
aatgacacctcataggtaacttc

SEQ ID NO: 9410575 - DNA, 22 bp, Homo sapiens
aatgacagagatagaagggatg

SEQ ID NO: 9410576 - DNA, 22 bp, Homo sapiens
aatgacaagacatagtctctga

SEQ ID NO: 9410577 - DNA, 22 bp, Homo sapiens
aatgacaataatcattaacttt

SEQ ID NO: 9410578 - DNA, 22 bp, Homo sapiens
aatgacaataatcattaacttt

SEQ ID NO: 9410579 - DNA, 22 bp, Homo sapiens
aatgacaagacatagtctctga

SEQ ID NO: 9410580 - DNA, 22 bp, Homo sapiens
aatgacaaccacaatggtgctg

SEQ ID NO: 9410581 - DNA, 22 bp, Homo sapiens
aatgacaagacatagtctctga

SEQ ID NO: 9410582 - DNA, 22 bp, Homo sapiens
aatgaattgcagtactgacttg

SEQ ID NO: 9410583 - DNA, 22 bp, Homo sapiens
aatgacaaatatggaagcctga

SEQ ID NO: 9410584 - DNA, 22 bp, Homo sapiens
aatgacagtggcacagtcactt

SEQ ID NO: 9410585 - DNA, 22 bp, Homo sapiens
aatgacagtattccctttatca

SEQ ID NO: 9410586 - DNA, 23 bp, Homo sapiens
aatgacaggcaatgtaattgtgt

SEQ ID NO: 9410587 - DNA, 22 bp, Homo sapiens
aatgacagtgttgggccagatg

SEQ ID NO: 9410588 - DNA, 23 bp, Homo sapiens
aatgacagtgtgtgattgaagaa

SEQ ID NO: 9410589 - DNA, 22 bp, Homo sapiens
aatgacatgctttttaattata

SEQ ID NO: 9410590 - DNA, 22 bp, Homo sapiens
aactactaccacagtcaagaca

SEQ ID NO: 9410591 - DNA, 22 bp, Homo sapiens
aactactaccagtagtagtagt

SEQ ID NO: 9410592 - DNA, 22 bp, Homo sapiens
aactagaacctgcattttaaca

SEQ ID NO: 9410593 - DNA, 22 bp, Homo sapiens
aactagaaaaagactttctgag

SEQ ID NO: 9410594 - DNA, 22 bp, Homo sapiens
aatggctctgatgttgttgtga

SEQ ID NO: 9410595 - DNA, 22 bp, Homo sapiens
aatggctctgatgttgttgtga

SEQ ID NO: 9410596 - DNA, 21 bp, Homo sapiens
aatggctgggcaaggtctctc

SEQ ID NO: 9410597 - DNA, 22 bp, Homo sapiens
aatggctgccagggcaggaggt

SEQ ID NO: 9410598 - DNA, 22 bp, Homo sapiens
aatggcttagctcagcgctcag

SEQ ID NO: 9410599 - DNA, 22 bp, Homo sapiens
aatggcttgcaaatgggtccat

SEQ ID NO: 9410600 - DNA, 22 bp, Homo sapiens
aatggcttctgaagcacacttt

SEQ ID NO: 9410601 - DNA, 22 bp, Homo sapiens
aactataatggggttaggaaat

SEQ ID NO: 9410602 - DNA, 22 bp, Homo sapiens
aactagttttagctctagcaac

SEQ ID NO: 9410603 - DNA, 22 bp, Homo sapiens
aactagtttagctttttaagac

SEQ ID NO: 9410604 - DNA, 22 bp, Homo sapiens
aatgctttcttataaccactgc

SEQ ID NO: 9410605 - DNA, 22 bp, Homo sapiens
aatgctttctcagagtccttca

SEQ ID NO: 9410606 - DNA, 22 bp, Homo sapiens
aactagcagctaagacataatt

SEQ ID NO: 9410607 - DNA, 22 bp, Homo sapiens
aactagaacgagaaagctgaac

SEQ ID NO: 9410608 - DNA, 22 bp, Homo sapiens
aactagcagctaagacataatt

SEQ ID NO: 9410609 - DNA, 22 bp, Homo sapiens
aactaggagtttttcttgagaa

SEQ ID NO: 9410610 - DNA, 22 bp, Homo sapiens
aactaggatatatttctgacca

SEQ ID NO: 9410611 - DNA, 23 bp, Homo sapiens
aactagttgccatgaataaaagc

SEQ ID NO: 9410612 - DNA, 22 bp, Homo sapiens
aactagtaaaagcaacagtata

SEQ ID NO: 9410613 - DNA, 22 bp, Homo sapiens
aaggaaagacaggacggaattc

SEQ ID NO: 9410614 - DNA, 22 bp, Homo sapiens
aaggaagacacagatgaagtga

SEQ ID NO: 9410615 - DNA, 22 bp, Homo sapiens
aaggaagacacagatgaagtga

SEQ ID NO: 9410616 - DNA, 22 bp, Homo sapiens
aaggaagacacagatgaagtga

SEQ ID NO: 9410617 - DNA, 22 bp, Homo sapiens
aaggaagacacagatgaagtga

SEQ ID NO: 9410618 - DNA, 22 bp, Homo sapiens
aaggaagacacagatgaagtga

SEQ ID NO: 9410619 - DNA, 22 bp, Homo sapiens
aaggaagactcgcaggtctatg

SEQ ID NO: 9410620 - DNA, 22 bp, Homo sapiens
aaggaagactcgcaggtctatg

SEQ ID NO: 9410621 - DNA, 22 bp, Homo sapiens
aaggaagacttgagaaggttcc

SEQ ID NO: 9410622 - DNA, 22 bp, Homo sapiens
aaggaagacttgagaaggttcc

SEQ ID NO: 9410623 - DNA, 22 bp, Homo sapiens
aaggaagacttgagaaggttcc

SEQ ID NO: 9410624 - DNA, 22 bp, Homo sapiens
aaggaagagaatccttctcaga

SEQ ID NO: 9410625 - DNA, 22 bp, Homo sapiens
aaggaagagaatccttctcaga

SEQ ID NO: 9410626 - DNA, 22 bp, Homo sapiens
aaggaagagaatccttctcaga

SEQ ID NO: 9410627 - DNA, 22 bp, Homo sapiens
aaggaagagaatccttctcaga

SEQ ID NO: 9410628 - DNA, 22 bp, Homo sapiens
aaggaagagcaaagaattatgt

SEQ ID NO: 9410629 - DNA, 22 bp, Homo sapiens
aaatgcattaagtcagaacaat

SEQ ID NO: 9410630 - DNA, 22 bp, Homo sapiens
aaatgcattaagtcagaacaat

SEQ ID NO: 9410631 - DNA, 22 bp, Homo sapiens
aaatgcattctgttttcactag

SEQ ID NO: 9410632 - DNA, 22 bp, Homo sapiens
aaatgcatgtatgtaatatgct

SEQ ID NO: 9410633 - DNA, 22 bp, Homo sapiens
aaatgcatgtatgtaatatgct

SEQ ID NO: 9410634 - DNA, 22 bp, Homo sapiens
aaatgcatgtgctatagatgtg

SEQ ID NO: 9410635 - DNA, 22 bp, Homo sapiens
aaatgcattggtttctacttgt

SEQ ID NO: 9410636 - DNA, 22 bp, Homo sapiens
aaatgcattggtttctacttgt

SEQ ID NO: 9410637 - DNA, 22 bp, Homo sapiens
aaatgcattggtttctacttgt

SEQ ID NO: 9410638 - DNA, 22 bp, Homo sapiens
aaatgcatttcactaatgtttc

SEQ ID NO: 9410639 - DNA, 22 bp, Homo sapiens
aaatgcatttcactaatgtttc

SEQ ID NO: 9410640 - DNA, 22 bp, Homo sapiens
aaggaaagacaggacggaattc

SEQ ID NO: 9410641 - DNA, 22 bp, Homo sapiens
aaggaaagacaggacggaattc

SEQ ID NO: 9410642 - DNA, 22 bp, Homo sapiens
aaggaaacagaggatgaccttg

SEQ ID NO: 9410643 - DNA, 22 bp, Homo sapiens
aaggaaacagaggatgaccttg

SEQ ID NO: 9410644 - DNA, 22 bp, Homo sapiens
aaggaagagtctagaacaggca

SEQ ID NO: 9410645 - DNA, 22 bp, Homo sapiens
aaggaagatatatcaagcttaa

SEQ ID NO: 9410646 - DNA, 22 bp, Homo sapiens
aaggaagagtctagaacaggca

SEQ ID NO: 9410647 - DNA, 22 bp, Homo sapiens
aaggaagagcaaagaattatgt

SEQ ID NO: 9410648 - DNA, 22 bp, Homo sapiens
aaggaagaggcaggttttgctg

SEQ ID NO: 9410649 - DNA, 22 bp, Homo sapiens
aaggaagagtctagaacaggca

SEQ ID NO: 9410650 - DNA, 22 bp, Homo sapiens
aaatgtcaaggtgatagatgca

SEQ ID NO: 9410651 - DNA, 22 bp, Homo sapiens
aaatgtcaaggtgatagatgca

SEQ ID NO: 9410652 - DNA, 22 bp, Homo sapiens
aaatgtcaaggtgatagatgca

SEQ ID NO: 9410653 - DNA, 22 bp, Homo sapiens
aaggaagatatatcaagcttaa

SEQ ID NO: 9410654 - DNA, 22 bp, Homo sapiens
aaggaagatgaaagtactgcta

SEQ ID NO: 9410655 - DNA, 22 bp, Homo sapiens
aaggaagatgaggtgctgctta

SEQ ID NO: 9410656 - DNA, 22 bp, Homo sapiens
aaatgtcagaaaacatggagtg

SEQ ID NO: 9410657 - DNA, 22 bp, Homo sapiens
aaatgtcagaaaacatggagtg

SEQ ID NO: 9410658 - DNA, 22 bp, Homo sapiens
aaatgtcagaaaacatggagtg

SEQ ID NO: 9410659 - DNA, 22 bp, Homo sapiens
aaatgtcagaaaacatggagtg

SEQ ID NO: 9410660 - DNA, 22 bp, Homo sapiens
aaatgtcagaaaacatggagtg

SEQ ID NO: 9410661 - DNA, 22 bp, Homo sapiens
aaatgtcagaggaacatattga

SEQ ID NO: 9410662 - DNA, 22 bp, Homo sapiens
aaatgtcagaggaacatattga

SEQ ID NO: 9410663 - DNA, 22 bp, Homo sapiens
aaatgtcagaagctttacttct

SEQ ID NO: 9410664 - DNA, 22 bp, Homo sapiens
aaatgtcagaagctttacttct

SEQ ID NO: 9410665 - DNA, 22 bp, Homo sapiens
aaatgtcagaagctttacttct

SEQ ID NO: 9410666 - DNA, 22 bp, Homo sapiens
aaatgtcagaagctttacttct

SEQ ID NO: 9410667 - DNA, 22 bp, Homo sapiens
aaatgtctactcctgtgtttat

SEQ ID NO: 9410668 - DNA, 22 bp, Homo sapiens
aaatgtcctgagattcaactta

SEQ ID NO: 9410669 - DNA, 22 bp, Homo sapiens
aaatgtcctgagattcaactta

SEQ ID NO: 9410670 - DNA, 22 bp, Homo sapiens
aaatgtcagaggaacatattga

SEQ ID NO: 9410671 - DNA, 22 bp, Homo sapiens
aaatgtcagaggaacatattga

SEQ ID NO: 9410672 - DNA, 22 bp, Homo sapiens
aaatgtcagaggaacatattga

SEQ ID NO: 9410673 - DNA, 22 bp, Homo sapiens
aaatgtcaggtggtggatggct

SEQ ID NO: 9410674 - DNA, 22 bp, Homo sapiens
aaattcaattaactttcatgct

SEQ ID NO: 9410675 - DNA, 22 bp, Homo sapiens
aaattcaattaactttcatgct

SEQ ID NO: 9410676 - DNA, 22 bp, Homo sapiens
aaattcaattaactttcatgct

SEQ ID NO: 9410677 - DNA, 22 bp, Homo sapiens
aaattattttcagaatggagaa

SEQ ID NO: 9410678 - DNA, 22 bp, Homo sapiens
aaattattttcagaatggagaa

SEQ ID NO: 9410679 - DNA, 22 bp, Homo sapiens
aaattattttcagaatggagaa

SEQ ID NO: 9410680 - DNA, 22 bp, Homo sapiens
aaattattgggtcccaccccag

SEQ ID NO: 9410681 - DNA, 22 bp, Homo sapiens
aaattattttcagaatggagaa

SEQ ID NO: 9410682 - DNA, 18 bp, Homo sapiens
aaattattcttccttttc

SEQ ID NO: 9410683 - DNA, 18 bp, Homo sapiens
aaattattcttccttttc

SEQ ID NO: 9410684 - DNA, 23 bp, Homo sapiens
aaattattgctcttcaattgcct

SEQ ID NO: 9410685 - DNA, 23 bp, Homo sapiens
aaattattgctcttcaattgcct

SEQ ID NO: 9410686 - DNA, 23 bp, Homo sapiens
aaattattgctcttcaattgcct

SEQ ID NO: 9410687 - DNA, 18 bp, Homo sapiens
aaattattcttccttttc

SEQ ID NO: 9410688 - DNA, 22 bp, Homo sapiens
aaattattctcatgtgtttctt

SEQ ID NO: 9410689 - DNA, 22 bp, Homo sapiens
aaattattctcatgtgtttctt

SEQ ID NO: 9410690 - DNA, 22 bp, Homo sapiens
aaattattctcatgtgtttctt

SEQ ID NO: 9410691 - DNA, 22 bp, Homo sapiens
aaattattcaaaaagctgtgtt

SEQ ID NO: 9410692 - DNA, 22 bp, Homo sapiens
aaggctgggtaacctgtccact

SEQ ID NO: 9410693 - DNA, 22 bp, Homo sapiens
aaggctgggtaacctgtccact

SEQ ID NO: 9410694 - DNA, 22 bp, Homo sapiens
aaggctggggtgcagacggcct

SEQ ID NO: 9410695 - DNA, 21 bp, Homo sapiens
aaattcacctagtaaaacttc

SEQ ID NO: 9410696 - DNA, 22 bp, Homo sapiens
aaattcacaagagcattgcctg

SEQ ID NO: 9410697 - DNA, 22 bp, Homo sapiens
aaggctgagccagggcccctat

SEQ ID NO: 9410698 - DNA, 22 bp, Homo sapiens
aaggctgagagtcacagtccta

SEQ ID NO: 9410699 - DNA, 21 bp, Homo sapiens
aaattcacctagtaaaacttc

SEQ ID NO: 9410700 - DNA, 19 bp, Homo sapiens
aaggctggtaccataggtt

SEQ ID NO: 9410701 - DNA, 19 bp, Homo sapiens
aaggctggtaccataggtt

SEQ ID NO: 9410702 - DNA, 22 bp, Homo sapiens
aaggctgggtttgggatgtgat

SEQ ID NO: 9410703 - DNA, 22 bp, Homo sapiens
aaggctgggtttgggatgtgat

SEQ ID NO: 9410704 - DNA, 22 bp, Homo sapiens
aaggcagcagaggaaaggtgct

SEQ ID NO: 9410705 - DNA, 22 bp, Homo sapiens
aaggcagcagaggaaaggtgct

SEQ ID NO: 9410706 - DNA, 22 bp, Homo sapiens
aaggcagcacagcaactgctca

SEQ ID NO: 9410707 - DNA, 22 bp, Homo sapiens
aaggcacttaacgtgggaggat

SEQ ID NO: 9410708 - DNA, 22 bp, Homo sapiens
aaggcagatataaagactagag

SEQ ID NO: 9410709 - DNA, 22 bp, Homo sapiens
aaggcactgtactagttagtta

SEQ ID NO: 9410710 - DNA, 22 bp, Homo sapiens
aaatgtctacttcccatctgta

SEQ ID NO: 9410711 - DNA, 22 bp, Homo sapiens
aaggcactgtactagttagtta

SEQ ID NO: 9410712 - DNA, 22 bp, Homo sapiens
aaggcagcaagaattccaggtt

SEQ ID NO: 9410713 - DNA, 22 bp, Homo sapiens
aaattattcaaaaagctgtgtt

SEQ ID NO: 9410714 - DNA, 22 bp, Homo sapiens
aaattattcaaaaagctgtgtt

SEQ ID NO: 9410715 - DNA, 22 bp, Homo sapiens
aaattattcaaaaagctgtgtt

SEQ ID NO: 9410716 - DNA, 22 bp, Homo sapiens
aaggcagccctggctcagcctg

SEQ ID NO: 9410717 - DNA, 22 bp, Homo sapiens
aaggcagccctggctcagcctg

SEQ ID NO: 9410718 - DNA, 22 bp, Homo sapiens
aaggcagccatagcaccatcca

SEQ ID NO: 9410719 - DNA, 22 bp, Homo sapiens
aaggcagccagatcctttgggt

SEQ ID NO: 9410720 - DNA, 22 bp, Homo sapiens
aaggcagcagtgcacgactgat

SEQ ID NO: 9410721 - DNA, 22 bp, Homo sapiens
aaggcagcagtgcacgactgat

SEQ ID NO: 9410722 - DNA, 22 bp, Homo sapiens
aaggcagcagtgcacgactgat

SEQ ID NO: 9410723 - DNA, 22 bp, Homo sapiens
aacaatgtaatctactctgctc

SEQ ID NO: 9410724 - DNA, 22 bp, Homo sapiens
aacaatgtgaagtgctgttcag

SEQ ID NO: 9410725 - DNA, 22 bp, Homo sapiens
aaatttgttcaatgtctatttg

SEQ ID NO: 9410726 - DNA, 22 bp, Homo sapiens
aaattttaaggctggaacttaa

SEQ ID NO: 9410727 - DNA, 22 bp, Homo sapiens
aaattttaaggctggaacttaa

SEQ ID NO: 9410728 - DNA, 22 bp, Homo sapiens
aacaatgcttgccaagtgtgat

SEQ ID NO: 9410729 - DNA, 22 bp, Homo sapiens
aaatttgataagccattgttac

SEQ ID NO: 9410730 - DNA, 22 bp, Homo sapiens
aaggctggttccatccctggtg

SEQ ID NO: 9410731 - DNA, 22 bp, Homo sapiens
aaggctggtggattatgaggtc

SEQ ID NO: 9410732 - DNA, 22 bp, Homo sapiens
aaggctggtcagatgtggtgaa

SEQ ID NO: 9410733 - DNA, 22 bp, Homo sapiens
aaggctggtcagatgtggtgaa

SEQ ID NO: 9410734 - DNA, 22 bp, Homo sapiens
aaatttctaagtcaagaagaac

SEQ ID NO: 9410735 - DNA, 22 bp, Homo sapiens
aaatttctggaagtgtcagagt

SEQ ID NO: 9410736 - DNA, 21 bp, Homo sapiens
aaatttctgcaagcctcaact

SEQ ID NO: 9410737 - DNA, 22 bp, Homo sapiens
aaatttctaagtcaagaagaac

SEQ ID NO: 9410738 - DNA, 22 bp, Homo sapiens
aaggctggttccatccctggtg

SEQ ID NO: 9410739 - DNA, 22 bp, Homo sapiens
aacacagggggttacaaattgt

SEQ ID NO: 9410740 - DNA, 22 bp, Homo sapiens
aacacaggggcgtggctcttac

SEQ ID NO: 9410741 - DNA, 22 bp, Homo sapiens
aacacagggactcccaggagaa

SEQ ID NO: 9410742 - DNA, 22 bp, Homo sapiens
aacacagggactcccaggagaa

SEQ ID NO: 9410743 - DNA, 22 bp, Homo sapiens
aacacagggcagctgctgggaa

SEQ ID NO: 9410744 - DNA, 22 bp, Homo sapiens
aacacaggccagcctgtgcagt

SEQ ID NO: 9410745 - DNA, 22 bp, Homo sapiens
aacacaggcatactggctccag

SEQ ID NO: 9410746 - DNA, 22 bp, Homo sapiens
aacacaggaggctatgttttct

SEQ ID NO: 9410747 - DNA, 22 bp, Homo sapiens
aacacaggaaattggtaaatgg

SEQ ID NO: 9410748 - DNA, 22 bp, Homo sapiens
aacacagctaatttctgtcaat

SEQ ID NO: 9410749 - DNA, 22 bp, Homo sapiens
aacacagatcaaaatatttcct

SEQ ID NO: 9410750 - DNA, 22 bp, Homo sapiens
aacacagctaatttctgtcaat

SEQ ID NO: 9410751 - DNA, 22 bp, Homo sapiens
aacacagatcaaaatatttcct

SEQ ID NO: 9410752 - DNA, 20 bp, Homo sapiens
aacacagataccaaaggttg

SEQ ID NO: 9410753 - DNA, 22 bp, Homo sapiens
aacacagatcaaaatatttcct

SEQ ID NO: 9410754 - DNA, 22 bp, Homo sapiens
aacacagatcaaaatatttcct

SEQ ID NO: 9410755 - DNA, 22 bp, Homo sapiens
aacacagacatagtgattacag

SEQ ID NO: 9410756 - DNA, 22 bp, Homo sapiens
aacacagacatagtgattacag

SEQ ID NO: 9410757 - DNA, 22 bp, Homo sapiens
aacacagagtatttgaagcatt

SEQ ID NO: 9410758 - DNA, 22 bp, Homo sapiens
aacacagagtatttgaagcatt

SEQ ID NO: 9410759 - DNA, 22 bp, Homo sapiens
aacacagagtatttgaagcatt

SEQ ID NO: 9410760 - DNA, 22 bp, Homo sapiens
aacacagagtatttgaagcatt

SEQ ID NO: 9410761 - DNA, 20 bp, Homo sapiens
aacacagataccaaaggttg

SEQ ID NO: 9410762 - DNA, 20 bp, Homo sapiens
aacacagataccaaaggttg

SEQ ID NO: 9410763 - DNA, 20 bp, Homo sapiens
aacacagataccaaaggttg

SEQ ID NO: 9410764 - DNA, 22 bp, Homo sapiens
aacacagacatagtgattacag

SEQ ID NO: 9410765 - DNA, 22 bp, Homo sapiens
aacacagaagtgccaagagcca

SEQ ID NO: 9410766 - DNA, 22 bp, Homo sapiens
aacacagaagtgccaagagcca

SEQ ID NO: 9410767 - DNA, 22 bp, Homo sapiens
aacacagaagtgccaagagcca

SEQ ID NO: 9410768 - DNA, 22 bp, Homo sapiens
aacacagaagtgccaagagcca

SEQ ID NO: 9410769 - DNA, 20 bp, Homo sapiens
aacacactggtggcatcagg

SEQ ID NO: 9410770 - DNA, 22 bp, Homo sapiens
aacacaatcttccagtttgctg

SEQ ID NO: 9410771 - DNA, 23 bp, Homo sapiens
aacacaaagctgattccagtggc

SEQ ID NO: 9410772 - DNA, 22 bp, Homo sapiens
aacactttcttccttgctcagg

SEQ ID NO: 9410773 - DNA, 22 bp, Homo sapiens
aacactttcttccttgctcagg

SEQ ID NO: 9410774 - DNA, 22 bp, Homo sapiens
aacactttctattattatggtt

SEQ ID NO: 9410775 - DNA, 22 bp, Homo sapiens
aacactttggatgcagaaccaa

SEQ ID NO: 9410776 - DNA, 22 bp, Homo sapiens
aacactttggaatagagatagg

SEQ ID NO: 9410777 - DNA, 22 bp, Homo sapiens
aacactttggaatagagatagg

SEQ ID NO: 9410778 - DNA, 22 bp, Homo sapiens
aacacagttttccaaaatagag

SEQ ID NO: 9410779 - DNA, 22 bp, Homo sapiens
aacactgtatcagtcttcaata

SEQ ID NO: 9410780 - DNA, 22 bp, Homo sapiens
aacacagtttctgcattggtag

SEQ ID NO: 9410781 - DNA, 22 bp, Homo sapiens
aacacagtttctctatgagagt

SEQ ID NO: 9410782 - DNA, 22 bp, Homo sapiens
aacacagttttccaaaatagag

SEQ ID NO: 9410783 - DNA, 22 bp, Homo sapiens
aacacaggttcattctgtgagg

SEQ ID NO: 9410784 - DNA, 20 bp, Homo sapiens
aacacagggttaccatcaga

SEQ ID NO: 9410785 - DNA, 20 bp, Homo sapiens
aacacagggttaccatcaga

SEQ ID NO: 9410786 - DNA, 22 bp, Homo sapiens
aacacaggtttgtggtaaataa

SEQ ID NO: 9410787 - DNA, 22 bp, Homo sapiens
aacacaggttgctgggcctcac

SEQ ID NO: 9410788 - DNA, 22 bp, Homo sapiens
aacagaagggggtatttacatt

SEQ ID NO: 9410789 - DNA, 22 bp, Homo sapiens
aacagaaatcatttagggctct

SEQ ID NO: 9410790 - DNA, 22 bp, Homo sapiens
aacagaatagttgatgtacagt

SEQ ID NO: 9410791 - DNA, 22 bp, Homo sapiens
aacagaatagttgatgtacagt

SEQ ID NO: 9410792 - DNA, 22 bp, Homo sapiens
aacagaatagttgatgtacagt

SEQ ID NO: 9410793 - DNA, 22 bp, Homo sapiens
aacagaatcttgggttcttttc

SEQ ID NO: 9410794 - DNA, 22 bp, Homo sapiens
aacagaattgtacaccagggag

SEQ ID NO: 9410795 - DNA, 22 bp, Homo sapiens
aacagacaactcctgtggctca

SEQ ID NO: 9410796 - DNA, 22 bp, Homo sapiens
aagtgcttccatgtttgagtgt

SEQ ID NO: 9410797 - DNA, 22 bp, Homo sapiens
aacagagaggccacctcagcag

SEQ ID NO: 9410798 - DNA, 22 bp, Homo sapiens
aacagacatatttttaatatgc

SEQ ID NO: 9410799 - DNA, 22 bp, Homo sapiens
aacagacatatttttaatatgc

SEQ ID NO: 9410800 - DNA, 22 bp, Homo sapiens
aacagacatatttttaatatgc

SEQ ID NO: 9410801 - DNA, 22 bp, Homo sapiens
aagaaactgttgcgtgacagcg

SEQ ID NO: 9410802 - DNA, 22 bp, Homo sapiens
aagaaactggaatatagagagc

SEQ ID NO: 9410803 - DNA, 22 bp, Homo sapiens
aagaaactggaatatagagagc

SEQ ID NO: 9410804 - DNA, 22 bp, Homo sapiens
aagaaactgttgcgtgacagcg

SEQ ID NO: 9410805 - DNA, 22 bp, Homo sapiens
aagaaacctagtctggagcagc

SEQ ID NO: 9410806 - DNA, 22 bp, Homo sapiens
aagaaactggaatatagagagc

SEQ ID NO: 9410807 - DNA, 22 bp, Homo sapiens
aagaaacaaccactgctctcct

SEQ ID NO: 9410808 - DNA, 22 bp, Homo sapiens
aagaaacaaccactgctctcct

SEQ ID NO: 9410809 - DNA, 22 bp, Homo sapiens
aagaaacaaccactgctctcct

SEQ ID NO: 9410810 - DNA, 22 bp, Homo sapiens
aagaaaatcagttctggtcagt

SEQ ID NO: 9410811 - DNA, 22 bp, Homo sapiens
aagaaaatcagttctggtcagt

SEQ ID NO: 9410812 - DNA, 22 bp, Homo sapiens
aagaaaatcagttctggtcagt

SEQ ID NO: 9410813 - DNA, 22 bp, Homo sapiens
aagaaaagaaacctgaggcttt

SEQ ID NO: 9410814 - DNA, 22 bp, Homo sapiens
aagaaaagaaacctgaggcttt

SEQ ID NO: 9410815 - DNA, 22 bp, Homo sapiens
aagaaaagaaacctgaggcttt

SEQ ID NO: 9410816 - DNA, 22 bp, Homo sapiens
aagaaaagaaacctgaggcttt

SEQ ID NO: 9410817 - DNA, 22 bp, Homo sapiens
aagaaaaggtaaccgcttatct

SEQ ID NO: 9410818 - DNA, 22 bp, Homo sapiens
aagaaaagatgtttggttttca

SEQ ID NO: 9410819 - DNA, 22 bp, Homo sapiens
aagaaaagatgtttggttttca

SEQ ID NO: 9410820 - DNA, 22 bp, Homo sapiens
aagaaaagatgtttggttttca

SEQ ID NO: 9410821 - DNA, 22 bp, Homo sapiens
aagaaaacatgatctaatttaa

SEQ ID NO: 9410822 - DNA, 22 bp, Homo sapiens
aactggaatagcacaggaaaag

SEQ ID NO: 9410823 - DNA, 22 bp, Homo sapiens
aactggaagagtgaatataact

SEQ ID NO: 9410824 - DNA, 22 bp, Homo sapiens
aactggaaagatcagtaggaag

SEQ ID NO: 9410825 - DNA, 22 bp, Homo sapiens
aatgggaagccagaagacaagg

SEQ ID NO: 9410826 - DNA, 22 bp, Homo sapiens
aactgcttgtaaataatgttga

SEQ ID NO: 9410827 - DNA, 22 bp, Homo sapiens
aactgcttgagatatgtttgtc

SEQ ID NO: 9410828 - DNA, 22 bp, Homo sapiens
aatggctttggtctgggtccca

SEQ ID NO: 9410829 - DNA, 22 bp, Homo sapiens
aatggctttgacattttcaaat

SEQ ID NO: 9410830 - DNA, 22 bp, Homo sapiens
aatggcttttgcacttaaatcg

SEQ ID NO: 9410831 - DNA, 22 bp, Homo sapiens
aactttctgtctgagctgcaga

SEQ ID NO: 9410832 - DNA, 22 bp, Homo sapiens
aagaaaacaatgacttgccagc

SEQ ID NO: 9410833 - DNA, 22 bp, Homo sapiens
aactttcttgtgacatttgggg

SEQ ID NO: 9410834 - DNA, 22 bp, Homo sapiens
aactttttctgggatggagggt

SEQ ID NO: 9410835 - DNA, 22 bp, Homo sapiens
aactggaatgaaatttacgatg

SEQ ID NO: 9410836 - DNA, 22 bp, Homo sapiens
aactggaatagcacaggaaaag

SEQ ID NO: 9410837 - DNA, 22 bp, Homo sapiens
aactggctgggaacacctagag

SEQ ID NO: 9410838 - DNA, 22 bp, Homo sapiens
aactggcatatgaacttgttct

SEQ ID NO: 9410839 - DNA, 22 bp, Homo sapiens
aactgggcccagtctgagttgg

SEQ ID NO: 9410840 - DNA, 21 bp, Homo sapiens
aactggcagaccaactatggc

SEQ ID NO: 9410841 - DNA, 22 bp, Homo sapiens
aattccatccatttgtttcaac

SEQ ID NO: 9410842 - DNA, 22 bp, Homo sapiens
aattcccatttgcagaaaatca

SEQ ID NO: 9410843 - DNA, 22 bp, Homo sapiens
aattccctcaggggactccttt

SEQ ID NO: 9410844 - DNA, 22 bp, Homo sapiens
aattccctcaggggactccttt

SEQ ID NO: 9410845 - DNA, 22 bp, Homo sapiens
aattcacaatgtgtagtcatgc

SEQ ID NO: 9410846 - DNA, 22 bp, Homo sapiens
aattcacaattatgttgggaga

SEQ ID NO: 9410847 - DNA, 22 bp, Homo sapiens
aattcacaatgtgtagtcatgc

SEQ ID NO: 9410848 - DNA, 22 bp, Homo sapiens
aattcacaatgtgtagtcatgc

SEQ ID NO: 9410849 - DNA, 20 bp, Homo sapiens
aagaaacttgaaagtacaag

SEQ ID NO: 9410850 - DNA, 22 bp, Homo sapiens
aagaaagagatcactcctccat

SEQ ID NO: 9410851 - DNA, 22 bp, Homo sapiens
aagaaagataaggtttgcttgg

SEQ ID NO: 9410852 - DNA, 22 bp, Homo sapiens
aattctgaaagattccttattc

SEQ ID NO: 9410853 - DNA, 22 bp, Homo sapiens
aattctctccagggtaacatca

SEQ ID NO: 9410854 - DNA, 22 bp, Homo sapiens
aattctcaggaatttcatctgt

SEQ ID NO: 9410855 - DNA, 22 bp, Homo sapiens
aattctctccagggtaacatca

SEQ ID NO: 9410856 - DNA, 22 bp, Homo sapiens
aattctataggcaagctatttt

SEQ ID NO: 9410857 - DNA, 22 bp, Homo sapiens
aattctatgttcttgagtaaga

SEQ ID NO: 9410858 - DNA, 22 bp, Homo sapiens
aattctagcccaggcaaaacta

SEQ ID NO: 9410859 - DNA, 22 bp, Homo sapiens
aattctataggcaagctatttt

SEQ ID NO: 9410860 - DNA, 22 bp, Homo sapiens
aattctatgttcttgagtaaga

SEQ ID NO: 9410861 - DNA, 22 bp, Homo sapiens
aattctcaggaatttcatctgt

SEQ ID NO: 9410862 - DNA, 22 bp, Homo sapiens
aattctaaatgtaatttagaat

SEQ ID NO: 9410863 - DNA, 22 bp, Homo sapiens
aattctaaatgtaatttagaat

SEQ ID NO: 9410864 - DNA, 22 bp, Homo sapiens
aattctacattggttcacattt

SEQ ID NO: 9410865 - DNA, 17 bp, Homo sapiens
aagaacactcaatagca

SEQ ID NO: 9410866 - DNA, 17 bp, Homo sapiens
aagaacactcaatagca

SEQ ID NO: 9410867 - DNA, 17 bp, Homo sapiens
aagaacactcaatagca

SEQ ID NO: 9410868 - DNA, 22 bp, Homo sapiens
aatttaaggaggccttcactct

SEQ ID NO: 9410869 - DNA, 22 bp, Homo sapiens
aatttacacttcatttggaggg

SEQ ID NO: 9410870 - DNA, 22 bp, Homo sapiens
aatttcactgtggagcacattt

SEQ ID NO: 9410871 - DNA, 22 bp, Homo sapiens
aatttcactgtggagcacattt

SEQ ID NO: 9410872 - DNA, 22 bp, Homo sapiens
aatttcactggaaaagataatt

SEQ ID NO: 9410873 - DNA, 22 bp, Homo sapiens
aatttcactggaaaagataatt

SEQ ID NO: 9410874 - DNA, 22 bp, Homo sapiens
aagaacaactgctttaaaagca

SEQ ID NO: 9410875 - DNA, 22 bp, Homo sapiens
aagaacaactgctttaaaagca

SEQ ID NO: 9410876 - DNA, 22 bp, Homo sapiens
aagaaattaatgtgccattact

SEQ ID NO: 9410877 - DNA, 22 bp, Homo sapiens
aagaaattaaggaatgcaacga

SEQ ID NO: 9410878 - DNA, 22 bp, Homo sapiens
aagaaattaatgtgccattact

SEQ ID NO: 9410879 - DNA, 22 bp, Homo sapiens
aagaaattaatgtgccattact

SEQ ID NO: 9410880 - DNA, 22 bp, Homo sapiens
aagaaattaaggaatgcaacga

SEQ ID NO: 9410881 - DNA, 22 bp, Homo sapiens
aattctgagaacaaaaggtact

SEQ ID NO: 9410882 - DNA, 22 bp, Homo sapiens
aattctgagaacaaaaggtact

SEQ ID NO: 9410883 - DNA, 22 bp, Homo sapiens
aagaaatggcttcatctgagta

SEQ ID NO: 9410884 - DNA, 22 bp, Homo sapiens
aagaaatggcttcatctgagta

SEQ ID NO: 9410885 - DNA, 22 bp, Homo sapiens
aagaaatgtagagcctagtaaa

SEQ ID NO: 9410886 - DNA, 22 bp, Homo sapiens
aagaaatggcttcatctgagta

SEQ ID NO: 9410887 - DNA, 22 bp, Homo sapiens
aagaaatgtgaatattgaatag

SEQ ID NO: 9410888 - DNA, 22 bp, Homo sapiens
aagaaatgtagagcctagtaaa

SEQ ID NO: 9410889 - DNA, 22 bp, Homo sapiens
aagaaatgtgaatattgaatag

SEQ ID NO: 9410890 - DNA, 22 bp, Homo sapiens
aagaaatgtgaatattgaatag

SEQ ID NO: 9410891 - DNA, 22 bp, Homo sapiens
aagaaatgtgaatattgaatag

SEQ ID NO: 9410892 - DNA, 20 bp, Homo sapiens
aattttatctccatcctttg

SEQ ID NO: 9410893 - DNA, 20 bp, Homo sapiens
aattttatctccatcctttg

SEQ ID NO: 9410894 - DNA, 22 bp, Homo sapiens
aagaccataatgtaagatgaat

SEQ ID NO: 9410895 - DNA, 22 bp, Homo sapiens
aagaccataatgtaagatgaat

SEQ ID NO: 9410896 - DNA, 22 bp, Homo sapiens
aagactttctcccaaatcctca

SEQ ID NO: 9410897 - DNA, 22 bp, Homo sapiens
aagactttccctcatcagaacg

SEQ ID NO: 9410898 - DNA, 22 bp, Homo sapiens
aagacttgaccaggttgaaggc

SEQ ID NO: 9410899 - DNA, 22 bp, Homo sapiens
aagacttgaccaggttgaaggc

SEQ ID NO: 9410900 - DNA, 22 bp, Homo sapiens
aagaccattgctgtatttgtag

SEQ ID NO: 9410901 - DNA, 22 bp, Homo sapiens
aagaccatttaatggagaaaga

SEQ ID NO: 9410902 - DNA, 22 bp, Homo sapiens
aagagaaagcagactttgtcat

SEQ ID NO: 9410903 - DNA, 22 bp, Homo sapiens
aagagaaagcagactttgtcat

SEQ ID NO: 9410904 - DNA, 22 bp, Homo sapiens
aagagaaagcagactttgtcat

SEQ ID NO: 9410905 - DNA, 22 bp, Homo sapiens
aagagaaggattctgagcctgg

SEQ ID NO: 9410906 - DNA, 20 bp, Homo sapiens
aagagaagaagtctttgaaa

SEQ ID NO: 9410907 - DNA, 20 bp, Homo sapiens
aagagaagaagtctttgaaa

SEQ ID NO: 9410908 - DNA, 22 bp, Homo sapiens
aagagaagaaagtgtctacaca

SEQ ID NO: 9410909 - DNA, 22 bp, Homo sapiens
aagagaagaaagtgtctacaca

SEQ ID NO: 9410910 - DNA, 22 bp, Homo sapiens
aagagaagaaagtgtctacaca

SEQ ID NO: 9410911 - DNA, 22 bp, Homo sapiens
aagagaagaaagtgtctacaca

SEQ ID NO: 9410912 - DNA, 22 bp, Homo sapiens
aatttcagatgtcataaatata

SEQ ID NO: 9410913 - DNA, 22 bp, Homo sapiens
aatttcagggtgaatggactga

SEQ ID NO: 9410914 - DNA, 22 bp, Homo sapiens
aatttcagctcaaacttgtgtt

SEQ ID NO: 9410915 - DNA, 22 bp, Homo sapiens
aatttcagtatgaagtttcaca

SEQ ID NO: 9410916 - DNA, 22 bp, Homo sapiens
aatttcagtatgaagtttcaca

SEQ ID NO: 9410917 - DNA, 22 bp, Homo sapiens
aatttcagatattaaagaatga

SEQ ID NO: 9410918 - DNA, 22 bp, Homo sapiens
aatttcagatgtcataaatata

SEQ ID NO: 9410919 - DNA, 22 bp, Homo sapiens
aatttcagaacccaaattagcg

SEQ ID NO: 9410920 - DNA, 22 bp, Homo sapiens
aattttaatcagtggtgctgag

SEQ ID NO: 9410921 - DNA, 22 bp, Homo sapiens
aattttaatcagtggtgctgag

SEQ ID NO: 9410922 - DNA, 22 bp, Homo sapiens
aattttaagcatatgactggtt

SEQ ID NO: 9410923 - DNA, 22 bp, Homo sapiens
aattttaagcatatgactggtt

SEQ ID NO: 9410924 - DNA, 22 bp, Homo sapiens
aatttccagaccccatccacag

SEQ ID NO: 9410925 - DNA, 22 bp, Homo sapiens
aatttgttagcatactctagtt

SEQ ID NO: 9410926 - DNA, 22 bp, Homo sapiens
aagagaaggccctgacccaccc

SEQ ID NO: 9410927 - DNA, 22 bp, Homo sapiens
aagagaaggccctgacccaccc

SEQ ID NO: 9410928 - DNA, 22 bp, Homo sapiens
aagagaaggtgaggaagccggt

SEQ ID NO: 9410929 - DNA, 22 bp, Homo sapiens
aagagaaggtgaggaagccggt

SEQ ID NO: 9410930 - DNA, 22 bp, Homo sapiens
aagagaatatcgatagcactct

SEQ ID NO: 9410931 - DNA, 22 bp, Homo sapiens
aagagaatgacaaggagaacct

SEQ ID NO: 9410932 - DNA, 22 bp, Homo sapiens
aagagaaggtgaggaagccggt

SEQ ID NO: 9410933 - DNA, 22 bp, Homo sapiens
aagagaatacaagcaggcagga

SEQ ID NO: 9410934 - DNA, 22 bp, Homo sapiens
aagagacaagaattccaacgct

SEQ ID NO: 9410935 - DNA, 22 bp, Homo sapiens
aagagacagagccatgtttcta

SEQ ID NO: 9410936 - DNA, 22 bp, Homo sapiens
aagagacagagccatgtttcta

SEQ ID NO: 9410937 - DNA, 22 bp, Homo sapiens
aagagacaatgacacttgggag

SEQ ID NO: 9410938 - DNA, 22 bp, Homo sapiens
aagagacaatgtcttttggata

SEQ ID NO: 9410939 - DNA, 22 bp, Homo sapiens
acacaaaatcaaagtcctaggc

SEQ ID NO: 9410940 - DNA, 22 bp, Homo sapiens
acaatgtttctctttagtcatt

SEQ ID NO: 9410941 - DNA, 22 bp, Homo sapiens
acaatgtttctctttagtcatt

SEQ ID NO: 9410942 - DNA, 22 bp, Homo sapiens
aagagacttgtccgaagttgta

SEQ ID NO: 9410943 - DNA, 22 bp, Homo sapiens
acaatgttctgtctgacttgtc

SEQ ID NO: 9410944 - DNA, 22 bp, Homo sapiens
aagagacatgaatactcgaagg

SEQ ID NO: 9410945 - DNA, 22 bp, Homo sapiens
aagagacatgaatactcgaagg

SEQ ID NO: 9410946 - DNA, 21 bp, Homo sapiens
aagagacatttctcatcagca

SEQ ID NO: 9410947 - DNA, 21 bp, Homo sapiens
aagagacatttctcatcagca

SEQ ID NO: 9410948 - DNA, 21 bp, Homo sapiens
aagagacatttctcatcagca

SEQ ID NO: 9410949 - DNA, 22 bp, Homo sapiens
aagagactatggtgtctatgaa

SEQ ID NO: 9410950 - DNA, 22 bp, Homo sapiens
acacaaagttggatgacaaaat

SEQ ID NO: 9410951 - DNA, 22 bp, Homo sapiens
acacaaagttggatgacaaaat

SEQ ID NO: 9410952 - DNA, 22 bp, Homo sapiens
acacaaagctattgagtgtcat

SEQ ID NO: 9410953 - DNA, 22 bp, Homo sapiens
acacaaagttggatgacaaaat

SEQ ID NO: 9410954 - DNA, 22 bp, Homo sapiens
acacaaagttggatgacaaaat

SEQ ID NO: 9410955 - DNA, 22 bp, Homo sapiens
acacaaagttggatgacaaaat

SEQ ID NO: 9410956 - DNA, 20 bp, Homo sapiens
acacaaagcaatggagtaca

SEQ ID NO: 9410957 - DNA, 22 bp, Homo sapiens
acacaaactgctagaaaattgg

SEQ ID NO: 9410958 - DNA, 22 bp, Homo sapiens
acacaaactgctagaaaattgg

SEQ ID NO: 9410959 - DNA, 22 bp, Homo sapiens
acacaaagctattgagtgtcat

SEQ ID NO: 9410960 - DNA, 20 bp, Homo sapiens
acacaaagcaatggagtaca

SEQ ID NO: 9410961 - DNA, 21 bp, Homo sapiens
acacaaacctcctcagcctgg

SEQ ID NO: 9410962 - DNA, 22 bp, Homo sapiens
acacaaacagtctatagcacca

SEQ ID NO: 9410963 - DNA, 22 bp, Homo sapiens
acacaaacagtctatagcacca

SEQ ID NO: 9410964 - DNA, 22 bp, Homo sapiens
acacaaacagtctatagcacca

SEQ ID NO: 9410965 - DNA, 22 bp, Homo sapiens
acacaaacagtctatagcacca

SEQ ID NO: 9410966 - DNA, 22 bp, Homo sapiens
acacaaaatcaaagtcctaggc

SEQ ID NO: 9410967 - DNA, 22 bp, Homo sapiens
aagagcaccgcagcagcccaac

SEQ ID NO: 9410968 - DNA, 22 bp, Homo sapiens
aagagcaagtgggtagtgaagc

SEQ ID NO: 9410969 - DNA, 22 bp, Homo sapiens
aagagcaagtgggtagtgaagc

SEQ ID NO: 9410970 - DNA, 22 bp, Homo sapiens
aagagcactaacagagctgata

SEQ ID NO: 9410971 - DNA, 22 bp, Homo sapiens
aagagcagcctccaggggtgga

SEQ ID NO: 9410972 - DNA, 22 bp, Homo sapiens
aagagcagattcctagtggagc

SEQ ID NO: 9410973 - DNA, 22 bp, Homo sapiens
aagagcagattcctagtggagc

SEQ ID NO: 9410974 - DNA, 22 bp, Homo sapiens
aagagcaacttggaaacactca

SEQ ID NO: 9410975 - DNA, 22 bp, Homo sapiens
aagagcaacttggaaacactca

SEQ ID NO: 9410976 - DNA, 22 bp, Homo sapiens
aagagcaacttggaaacactca

SEQ ID NO: 9410977 - DNA, 22 bp, Homo sapiens
aagagcaagtgggtagtgaagc

SEQ ID NO: 9410978 - DNA, 22 bp, Homo sapiens
aagagcaagtgggtagtgaagc

SEQ ID NO: 9410979 - DNA, 22 bp, Homo sapiens
acacaaagttggatgacaaaat

SEQ ID NO: 9410980 - DNA, 22 bp, Homo sapiens
acacaaagttggatgacaaaat

SEQ ID NO: 9410981 - DNA, 22 bp, Homo sapiens
aagagcaacttggaaacactca

SEQ ID NO: 9410982 - DNA, 22 bp, Homo sapiens
aagagatttctgtaaaatgtaa

SEQ ID NO: 9410983 - DNA, 22 bp, Homo sapiens
aagcacaatttaggactgaaat

SEQ ID NO: 9410984 - DNA, 22 bp, Homo sapiens
aagcacacatctctggctgggt

SEQ ID NO: 9410985 - DNA, 22 bp, Homo sapiens
aagcacccaatttacagcagtt

SEQ ID NO: 9410986 - DNA, 22 bp, Homo sapiens
aagcaccctttgtctggacatg

SEQ ID NO: 9410987 - DNA, 22 bp, Homo sapiens
aagcaccctttgtctggacatg

SEQ ID NO: 9410988 - DNA, 22 bp, Homo sapiens
aagcaccctttgtctggacatg

SEQ ID NO: 9410989 - DNA, 22 bp, Homo sapiens
aagcaattcagcaaacctagaa

SEQ ID NO: 9410990 - DNA, 22 bp, Homo sapiens
aagcaattgtcctgtctctaca

SEQ ID NO: 9410991 - DNA, 22 bp, Homo sapiens
aagcaattggttttagtaaaat

SEQ ID NO: 9410992 - DNA, 22 bp, Homo sapiens
aagcaattcagcaaacctagaa

SEQ ID NO: 9410993 - DNA, 22 bp, Homo sapiens
aagcaattgagtgaaacctctt

SEQ ID NO: 9410994 - DNA, 22 bp, Homo sapiens
aagcacaatgaacatcttagat

SEQ ID NO: 9410995 - DNA, 22 bp, Homo sapiens
aagcacaatttaggactgaaat

SEQ ID NO: 9410996 - DNA, 22 bp, Homo sapiens
aagcacaatgaacatcttagat

SEQ ID NO: 9410997 - DNA, 22 bp, Homo sapiens
aagcaatttgacagtacatatc

SEQ ID NO: 9410998 - DNA, 20 bp, Homo sapiens
aagcaatatagtgcaaatgt

SEQ ID NO: 9410999 - DNA, 22 bp, Homo sapiens
aagcaatatactgatatgatta

SEQ ID NO: 9411000 - DNA, 22 bp, Homo sapiens
aagcaatatactgatatgatta

SEQ ID NO: 9411001 - DNA, 23 bp, Homo sapiens
aagcaatgctgagccagttctga

SEQ ID NO: 9411002 - DNA, 22 bp, Homo sapiens
aagcaatgtgttaatgaatgag

SEQ ID NO: 9411003 - DNA, 22 bp, Homo sapiens
aagcaatgtgttaatgaatgag

SEQ ID NO: 9411004 - DNA, 22 bp, Homo sapiens
aagcaatgtgtttgaaaggcca

SEQ ID NO: 9411005 - DNA, 22 bp, Homo sapiens
aagcaatgtgtttgaaaggcca

SEQ ID NO: 9411006 - DNA, 22 bp, Homo sapiens
aagcaatgttagaggccttagg

SEQ ID NO: 9411007 - DNA, 19 bp, Homo sapiens
aagcaatgttgtgaatcta

SEQ ID NO: 9411008 - DNA, 21 bp, Homo sapiens
aagcaattaccttcccatgtg

SEQ ID NO: 9411009 - DNA, 22 bp, Homo sapiens
aagcagaatttaatagaaaggt

SEQ ID NO: 9411010 - DNA, 22 bp, Homo sapiens
aagcagaatagaggcccttccc

SEQ ID NO: 9411011 - DNA, 22 bp, Homo sapiens
aagcagaagttgatctaccata

SEQ ID NO: 9411012 - DNA, 22 bp, Homo sapiens
aagcagaaggggaataatattt

SEQ ID NO: 9411013 - DNA, 22 bp, Homo sapiens
aagcagaagttgatctaccata

SEQ ID NO: 9411014 - DNA, 22 bp, Homo sapiens
aagcagaagttgatctaccata

SEQ ID NO: 9411015 - DNA, 20 bp, Homo sapiens
aagcagaagctgctctcagc

SEQ ID NO: 9411016 - DNA, 20 bp, Homo sapiens
aagcagaagctgctctcagc

SEQ ID NO: 9411017 - DNA, 22 bp, Homo sapiens
aagcagaatttaatagaaaggt

SEQ ID NO: 9411018 - DNA, 22 bp, Homo sapiens
aagcagacatcccatacttttg

SEQ ID NO: 9411019 - DNA, 18 bp, Homo sapiens
aagcagacagcagacagt

SEQ ID NO: 9411020 - DNA, 22 bp, Homo sapiens
aagcagagaaaagcttaggttc

SEQ ID NO: 9411021 - DNA, 22 bp, Homo sapiens
aagcagagaatctgggagcgag

SEQ ID NO: 9411022 - DNA, 22 bp, Homo sapiens
aagcagagaccggctaatggag

SEQ ID NO: 9411023 - DNA, 22 bp, Homo sapiens
aagcagagagcagaattaagtt

SEQ ID NO: 9411024 - DNA, 22 bp, Homo sapiens
aagcagagcctgagacagggat

SEQ ID NO: 9411025 - DNA, 22 bp, Homo sapiens
aagcagagcctgagacagggat

SEQ ID NO: 9411026 - DNA, 22 bp, Homo sapiens
aagcagagcctgagacagggat

SEQ ID NO: 9411027 - DNA, 22 bp, Homo sapiens
aagcagagccaccagctttgga

SEQ ID NO: 9411028 - DNA, 22 bp, Homo sapiens
aagcagagagcagaattaagtt

SEQ ID NO: 9411029 - DNA, 22 bp, Homo sapiens
aagcagagcaagcgtatttatt

SEQ ID NO: 9411030 - DNA, 22 bp, Homo sapiens
aagcagagcaagcgtatttatt

SEQ ID NO: 9411031 - DNA, 21 bp, Homo sapiens
acagcagagatcaagactaag

SEQ ID NO: 9411032 - DNA, 22 bp, Homo sapiens
acagcagagacactcaggaggc

SEQ ID NO: 9411033 - DNA, 22 bp, Homo sapiens
acagcagagccagtggctctag

SEQ ID NO: 9411034 - DNA, 22 bp, Homo sapiens
acagcagagacactcaggaggc

SEQ ID NO: 9411035 - DNA, 22 bp, Homo sapiens
acagcagagacactcaggaggc

SEQ ID NO: 9411036 - DNA, 22 bp, Homo sapiens
acagcagaccccagtgccatgg

SEQ ID NO: 9411037 - DNA, 22 bp, Homo sapiens
acagcagagaactttagagggt

SEQ ID NO: 9411038 - DNA, 22 bp, Homo sapiens
acagcagagacactcaggaggc

SEQ ID NO: 9411039 - DNA, 22 bp, Homo sapiens
acagcaaaagacaagaacttaa

SEQ ID NO: 9411040 - DNA, 22 bp, Homo sapiens
aagcagagggtatggccaggtt

SEQ ID NO: 9411041 - DNA, 22 bp, Homo sapiens
aagcagaggtagggtgtgcagt

SEQ ID NO: 9411042 - DNA, 22 bp, Homo sapiens
aagcagaggtagggtgtgcagt

SEQ ID NO: 9411043 - DNA, 22 bp, Homo sapiens
aagcagaggaccgacggaggga

SEQ ID NO: 9411044 - DNA, 22 bp, Homo sapiens
aagcagaggccacagagtgggc

SEQ ID NO: 9411045 - DNA, 22 bp, Homo sapiens
aagcagaggccacagagtgggc

SEQ ID NO: 9411046 - DNA, 22 bp, Homo sapiens
aagcagaggaccgacggaggga

SEQ ID NO: 9411047 - DNA, 22 bp, Homo sapiens
aagcagagggtatggccaggtt

SEQ ID NO: 9411048 - DNA, 22 bp, Homo sapiens
aagcagagggtatggccaggtt

SEQ ID NO: 9411049 - DNA, 22 bp, Homo sapiens
aagcagaggccacagagtgggc

SEQ ID NO: 9411050 - DNA, 22 bp, Homo sapiens
acagcagagcctggtacttact

SEQ ID NO: 9411051 - DNA, 22 bp, Homo sapiens
acagcagagcctagcttaatct

SEQ ID NO: 9411052 - DNA, 22 bp, Homo sapiens
acagcagagtagttttccaact

SEQ ID NO: 9411053 - DNA, 22 bp, Homo sapiens
acagcagaggaaaagtctgata

SEQ ID NO: 9411054 - DNA, 22 bp, Homo sapiens
aagcagctgatttcacagctca

SEQ ID NO: 9411055 - DNA, 22 bp, Homo sapiens
aagcagctgatttcacagctca

SEQ ID NO: 9411056 - DNA, 22 bp, Homo sapiens
aagcagctgatttcacagctca

SEQ ID NO: 9411057 - DNA, 22 bp, Homo sapiens
acagcagagtggagatgagcac

SEQ ID NO: 9411058 - DNA, 22 bp, Homo sapiens
acagcagagtggagatgagcac

SEQ ID NO: 9411059 - DNA, 22 bp, Homo sapiens
aagcagctgcaggttcaaagga

SEQ ID NO: 9411060 - DNA, 22 bp, Homo sapiens
aagcagctgcaggttcaaagga

SEQ ID NO: 9411061 - DNA, 22 bp, Homo sapiens
aagcagctgcaggttcaaagga

SEQ ID NO: 9411062 - DNA, 22 bp, Homo sapiens
aagcagctggaagagtaagatg

SEQ ID NO: 9411063 - DNA, 22 bp, Homo sapiens
aagcagctggaagagtaagatg

SEQ ID NO: 9411064 - DNA, 22 bp, Homo sapiens
aagcagctgtgtgacataatct

SEQ ID NO: 9411065 - DNA, 22 bp, Homo sapiens
aagcagctgtgtgacataatct

SEQ ID NO: 9411066 - DNA, 22 bp, Homo sapiens
aagcagctgtgtgacataatct

SEQ ID NO: 9411067 - DNA, 22 bp, Homo sapiens
aagcagctgtgtgacataatct

SEQ ID NO: 9411068 - DNA, 22 bp, Homo sapiens
aagcagcttaaattagagcctg

SEQ ID NO: 9411069 - DNA, 21 bp, Homo sapiens
aagcagcttaataaagtatgt

SEQ ID NO: 9411070 - DNA, 21 bp, Homo sapiens
aagcagcttaataaagtatgt

SEQ ID NO: 9411071 - DNA, 21 bp, Homo sapiens
aagcagcttaataaagtatgt

SEQ ID NO: 9411072 - DNA, 22 bp, Homo sapiens
aagcagctttctttcctgtgaa

SEQ ID NO: 9411073 - DNA, 22 bp, Homo sapiens
aagcagcttttgaagagtgagg

SEQ ID NO: 9411074 - DNA, 21 bp, Homo sapiens
aagcaggaacttcaaagggac

SEQ ID NO: 9411075 - DNA, 22 bp, Homo sapiens
aagcagcttttgaagagtgagg

SEQ ID NO: 9411076 - DNA, 22 bp, Homo sapiens
aagcagcttccccaaagtgcct

SEQ ID NO: 9411077 - DNA, 22 bp, Homo sapiens
aagcagcttccctggctcctgg

SEQ ID NO: 9411078 - DNA, 22 bp, Homo sapiens
aagcagcttccctggctcctgg

SEQ ID NO: 9411079 - DNA, 22 bp, Homo sapiens
aagcagcttccccaaagtgcct

SEQ ID NO: 9411080 - DNA, 22 bp, Homo sapiens
aagcagcttccccaaagtgcct

SEQ ID NO: 9411081 - DNA, 22 bp, Homo sapiens
aagcagcttccccaaagtgcct

SEQ ID NO: 9411082 - DNA, 22 bp, Homo sapiens
acagcctgctgcctgcttcttg

SEQ ID NO: 9411083 - DNA, 22 bp, Homo sapiens
acagcctggactggctctctgc

SEQ ID NO: 9411084 - DNA, 22 bp, Homo sapiens
acagcctggactggctctctgc

SEQ ID NO: 9411085 - DNA, 22 bp, Homo sapiens
acagccagggcattgtcgccga

SEQ ID NO: 9411086 - DNA, 22 bp, Homo sapiens
aagcaggaagctcaggtccttg

SEQ ID NO: 9411087 - DNA, 22 bp, Homo sapiens
aagcaggaagctcaggtccttg

SEQ ID NO: 9411088 - DNA, 21 bp, Homo sapiens
aagcaggaacttcaaagggac

SEQ ID NO: 9411089 - DNA, 22 bp, Homo sapiens
aagcaggaagctcaggtccttg

SEQ ID NO: 9411090 - DNA, 22 bp, Homo sapiens
aagcaggaagctcaggtccttg

SEQ ID NO: 9411091 - DNA, 22 bp, Homo sapiens
acacatgctcataaataaatag

SEQ ID NO: 9411092 - DNA, 20 bp, Homo sapiens
acacatgcattcatgtgggc

SEQ ID NO: 9411093 - DNA, 22 bp, Homo sapiens
acacatgataagaaagtttaaa

SEQ ID NO: 9411094 - DNA, 22 bp, Homo sapiens
acacatgataagaaagtttaaa

SEQ ID NO: 9411095 - DNA, 22 bp, Homo sapiens
acacatgataagaaagtttaaa

SEQ ID NO: 9411096 - DNA, 22 bp, Homo sapiens
acacatgcaggtatacatgttc

SEQ ID NO: 9411097 - DNA, 22 bp, Homo sapiens
acacatgcacaacagttctttc

SEQ ID NO: 9411098 - DNA, 22 bp, Homo sapiens
acacatgattaatgccaagcat

SEQ ID NO: 9411099 - DNA, 19 bp, Homo sapiens
acacatgaggagggacccc

SEQ ID NO: 9411100 - DNA, 22 bp, Homo sapiens
acacatgagaaacatcagttgt

SEQ ID NO: 9411101 - DNA, 22 bp, Homo sapiens
acacatgagaaacatcagttgt

SEQ ID NO: 9411102 - DNA, 22 bp, Homo sapiens
acacatgaaataatattatgca

SEQ ID NO: 9411103 - DNA, 22 bp, Homo sapiens
acacatatatacatatttgtgc

SEQ ID NO: 9411104 - DNA, 22 bp, Homo sapiens
acacatatatgtcgaagtcctc

SEQ ID NO: 9411105 - DNA, 22 bp, Homo sapiens
aagagcaggctgtcaatggggc

SEQ ID NO: 9411106 - DNA, 22 bp, Homo sapiens
aagagcaggctgtcaatggggc

SEQ ID NO: 9411107 - DNA, 22 bp, Homo sapiens
aagagcaggacagaatcagaac

SEQ ID NO: 9411108 - DNA, 22 bp, Homo sapiens
aagagcaggacagaatcagaac

SEQ ID NO: 9411109 - DNA, 22 bp, Homo sapiens
aagagcaggctgctgtggagta

SEQ ID NO: 9411110 - DNA, 22 bp, Homo sapiens
aagagcaggctgctgtggagta

SEQ ID NO: 9411111 - DNA, 22 bp, Homo sapiens
acacatgctcataaataaatag

SEQ ID NO: 9411112 - DNA, 22 bp, Homo sapiens
acacatgctgataagaatataa

SEQ ID NO: 9411113 - DNA, 22 bp, Homo sapiens
acacattatgagcagttgtctt

SEQ ID NO: 9411114 - DNA, 21 bp, Homo sapiens
acacattatgagcatagactc

SEQ ID NO: 9411115 - DNA, 22 bp, Homo sapiens
acacattcatgagtgcatgcac

SEQ ID NO: 9411116 - DNA, 22 bp, Homo sapiens
acacattcctgcagacatgatg

SEQ ID NO: 9411117 - DNA, 22 bp, Homo sapiens
acacattcctgcagacatgatg

SEQ ID NO: 9411118 - DNA, 22 bp, Homo sapiens
acacatttacatgtttacgtat

SEQ ID NO: 9411119 - DNA, 22 bp, Homo sapiens
acacattgcagacatctcatta

SEQ ID NO: 9411120 - DNA, 22 bp, Homo sapiens
acacattgcagacatctcatta

SEQ ID NO: 9411121 - DNA, 22 bp, Homo sapiens
acacattctttaaatgtctgtt

SEQ ID NO: 9411122 - DNA, 22 bp, Homo sapiens
acacattctttaaatgtctgtt

SEQ ID NO: 9411123 - DNA, 22 bp, Homo sapiens
aagatccttgggaaattgacct

SEQ ID NO: 9411124 - DNA, 22 bp, Homo sapiens
aagatgaaaatttactgtgatg

SEQ ID NO: 9411125 - DNA, 22 bp, Homo sapiens
aagatccttctcactgcagtgt

SEQ ID NO: 9411126 - DNA, 22 bp, Homo sapiens
aagatatagataaaactatgca

SEQ ID NO: 9411127 - DNA, 22 bp, Homo sapiens
aagatatagataaaactatgca

SEQ ID NO: 9411128 - DNA, 22 bp, Homo sapiens
aagatatagataaaactatgca

SEQ ID NO: 9411129 - DNA, 22 bp, Homo sapiens
acacatttattacatgcatgtg

SEQ ID NO: 9411130 - DNA, 22 bp, Homo sapiens
acacatttattacatgcatgtg

SEQ ID NO: 9411131 - DNA, 22 bp, Homo sapiens
acacatttattacatgcatgtg

SEQ ID NO: 9411132 - DNA, 23 bp, Homo sapiens
aagatgtatttttaccaaatgtc

SEQ ID NO: 9411133 - DNA, 22 bp, Homo sapiens
aagatgtgaaattgtctctggg

SEQ ID NO: 9411134 - DNA, 22 bp, Homo sapiens
aagatgtgaaattgtctctggg

SEQ ID NO: 9411135 - DNA, 23 bp, Homo sapiens
aagatgtatttttaccaaatgtc

SEQ ID NO: 9411136 - DNA, 22 bp, Homo sapiens
aagatgtgatgggttaagggcc

SEQ ID NO: 9411137 - DNA, 22 bp, Homo sapiens
aagatgtatcagttaagtcttc

SEQ ID NO: 9411138 - DNA, 22 bp, Homo sapiens
aagatgtaaaggcaatataaag

SEQ ID NO: 9411139 - DNA, 22 bp, Homo sapiens
aagatgtaaaggcaatataaag

SEQ ID NO: 9411140 - DNA, 22 bp, Homo sapiens
aagatgtaaaggcaatataaag

SEQ ID NO: 9411141 - DNA, 22 bp, Homo sapiens
aagatggctgcagcaattccaa

SEQ ID NO: 9411142 - DNA, 22 bp, Homo sapiens
aagatggagcacgagcagaagc

SEQ ID NO: 9411143 - DNA, 21 bp, Homo sapiens
aagatgatattttatctgtag

SEQ ID NO: 9411144 - DNA, 22 bp, Homo sapiens
aagatgataggacttgcttaag

SEQ ID NO: 9411145 - DNA, 22 bp, Homo sapiens
aagatgatgttgtgttttcact

SEQ ID NO: 9411146 - DNA, 22 bp, Homo sapiens
aagatgatggtatatagggtat

SEQ ID NO: 9411147 - DNA, 22 bp, Homo sapiens
aagatgatgttgtgttttcact

SEQ ID NO: 9411148 - DNA, 22 bp, Homo sapiens
aagatgatagatctgtcaatgt

SEQ ID NO: 9411149 - DNA, 22 bp, Homo sapiens
aagatgcacaatgtggcaatta

SEQ ID NO: 9411150 - DNA, 22 bp, Homo sapiens
aagatgcacaatgtggcaatta

SEQ ID NO: 9411151 - DNA, 22 bp, Homo sapiens
aagatgcacaatgtggcaatta

SEQ ID NO: 9411152 - DNA, 22 bp, Homo sapiens
aagatgcagcaaactacttttt

SEQ ID NO: 9411153 - DNA, 22 bp, Homo sapiens
aagatgcatgctgaagctggct

SEQ ID NO: 9411154 - DNA, 22 bp, Homo sapiens
aagatgcagcttccacttttgc

SEQ ID NO: 9411155 - DNA, 22 bp, Homo sapiens
aagatgcagcttccacttttgc

SEQ ID NO: 9411156 - DNA, 22 bp, Homo sapiens
aagatgctaattgtggaagttg

SEQ ID NO: 9411157 - DNA, 22 bp, Homo sapiens
aagatgcggttgaccatggtgt

SEQ ID NO: 9411158 - DNA, 22 bp, Homo sapiens
aagatgcctgtagcaggaagat

SEQ ID NO: 9411159 - DNA, 22 bp, Homo sapiens
aagatgcatgctgaagctggct

SEQ ID NO: 9411160 - DNA, 22 bp, Homo sapiens
aagcaagttctcatcatttata

SEQ ID NO: 9411161 - DNA, 22 bp, Homo sapiens
aagcaagttctcatcatttata

SEQ ID NO: 9411162 - DNA, 22 bp, Homo sapiens
aagcaataaataatttttagta

SEQ ID NO: 9411163 - DNA, 22 bp, Homo sapiens
aagcaagtacaatagcaagtac

SEQ ID NO: 9411164 - DNA, 22 bp, Homo sapiens
aagcaagtaggtatttgacaaa

SEQ ID NO: 9411165 - DNA, 22 bp, Homo sapiens
aagcaataatcccaaagtgctg

SEQ ID NO: 9411166 - DNA, 22 bp, Homo sapiens
aagcaagcagtgtggaatttta

SEQ ID NO: 9411167 - DNA, 22 bp, Homo sapiens
aagcaagagttggagtgatgtt

SEQ ID NO: 9411168 - DNA, 22 bp, Homo sapiens
aagcaagcaaggtgttacatat

SEQ ID NO: 9411169 - DNA, 22 bp, Homo sapiens
aagcaaggcaacctatgtccag

SEQ ID NO: 9411170 - DNA, 19 bp, Homo sapiens
aagcaagctttgagtgggt

SEQ ID NO: 9411171 - DNA, 22 bp, Homo sapiens
aagcaagctgttggcaataggg

SEQ ID NO: 9411172 - DNA, 22 bp, Homo sapiens
aagcaagccaatctgttttgtt

SEQ ID NO: 9411173 - DNA, 22 bp, Homo sapiens
aagcaaggccggaaggaaactc

SEQ ID NO: 9411174 - DNA, 22 bp, Homo sapiens
aagcaaggcccagagcatcagc

SEQ ID NO: 9411175 - DNA, 22 bp, Homo sapiens
aagcaaggcccagagcatcagc

SEQ ID NO: 9411176 - DNA, 22 bp, Homo sapiens
aagcaaggccggaaggaaactc

SEQ ID NO: 9411177 - DNA, 22 bp, Homo sapiens
aagcaaggcaacctatgtccag

SEQ ID NO: 9411178 - DNA, 22 bp, Homo sapiens
aagcaaggcccagagcatcagc

SEQ ID NO: 9411179 - DNA, 22 bp, Homo sapiens
aagcaaggcccagagcatcagc

SEQ ID NO: 9411180 - DNA, 22 bp, Homo sapiens
aagcaaagacagtttgagtgga

SEQ ID NO: 9411181 - DNA, 22 bp, Homo sapiens
aagcaaagacagtttgagtgga

SEQ ID NO: 9411182 - DNA, 22 bp, Homo sapiens
aagcaaagagataaccttttgg

SEQ ID NO: 9411183 - DNA, 22 bp, Homo sapiens
aagcaagacagaagttactgcc

SEQ ID NO: 9411184 - DNA, 22 bp, Homo sapiens
aagcaagaggaaatgtggacct

SEQ ID NO: 9411185 - DNA, 22 bp, Homo sapiens
aagatgtgtctcatcagggtgt

SEQ ID NO: 9411186 - DNA, 22 bp, Homo sapiens
aagatgtgctatcaactggaga

SEQ ID NO: 9411187 - DNA, 22 bp, Homo sapiens
aagatgttagaggtcatgcaga

SEQ ID NO: 9411188 - DNA, 21 bp, Homo sapiens
acagatatttcattgaacatt

SEQ ID NO: 9411189 - DNA, 20 bp, Homo sapiens
acagatatttgattttcagt

SEQ ID NO: 9411190 - DNA, 20 bp, Homo sapiens
acagatatttgattttcagt

SEQ ID NO: 9411191 - DNA, 19 bp, Homo sapiens
acagagctctctgcttctg

SEQ ID NO: 9411192 - DNA, 22 bp, Homo sapiens
acagagcctccaggagtgctgg

SEQ ID NO: 9411193 - DNA, 22 bp, Homo sapiens
acagagctaaatttcaatccca

SEQ ID NO: 9411194 - DNA, 22 bp, Homo sapiens
acagagctaatgttgcataggc

SEQ ID NO: 9411195 - DNA, 22 bp, Homo sapiens
acagagctaatgttgcataggc

SEQ ID NO: 9411196 - DNA, 22 bp, Homo sapiens
acagatgagttaaagcagagtg

SEQ ID NO: 9411197 - DNA, 22 bp, Homo sapiens
acagatgagttagaataggcag

SEQ ID NO: 9411198 - DNA, 22 bp, Homo sapiens
acagatgaggctggcgagggca

SEQ ID NO: 9411199 - DNA, 22 bp, Homo sapiens
acagatgatgtgcacagataga

SEQ ID NO: 9411200 - DNA, 22 bp, Homo sapiens
acagatgatgtgcacagataga

SEQ ID NO: 9411201 - DNA, 22 bp, Homo sapiens
acagatgatttttatgaaaaca

SEQ ID NO: 9411202 - DNA, 19 bp, Homo sapiens
acagatgcttttgctgccc

SEQ ID NO: 9411203 - DNA, 22 bp, Homo sapiens
acagatgcaaggaaatgattgc

SEQ ID NO: 9411204 - DNA, 22 bp, Homo sapiens
agcctctccagagcctggcaga

SEQ ID NO: 9411205 - DNA, 22 bp, Homo sapiens
agcctctcatgttctcccccag

SEQ ID NO: 9411206 - DNA, 22 bp, Homo sapiens
agcctctctccagcttggcaga

SEQ ID NO: 9411207 - DNA, 22 bp, Homo sapiens
agcctctctgttagtcactggg

SEQ ID NO: 9411208 - DNA, 22 bp, Homo sapiens
agcctctcttatcccttcaaag

SEQ ID NO: 9411209 - DNA, 22 bp, Homo sapiens
agcctctcttatcccttcaaag

SEQ ID NO: 9411210 - DNA, 22 bp, Homo sapiens
agcctcctggagtttctgggat

SEQ ID NO: 9411211 - DNA, 20 bp, Homo sapiens
agccctgtttcctggagaga

SEQ ID NO: 9411212 - DNA, 22 bp, Homo sapiens
agccctgtttatgccacatcat

SEQ ID NO: 9411213 - DNA, 22 bp, Homo sapiens
agccctgttctgttttagtagc

SEQ ID NO: 9411214 - DNA, 22 bp, Homo sapiens
agcctctcactgtcaccctccc

SEQ ID NO: 9411215 - DNA, 22 bp, Homo sapiens
agcctctcactgtcaccctccc

SEQ ID NO: 9411216 - DNA, 22 bp, Homo sapiens
agcctctgatgatcacaggggg

SEQ ID NO: 9411217 - DNA, 22 bp, Homo sapiens
agcctctgatgatcacaggggg

SEQ ID NO: 9411218 - DNA, 22 bp, Homo sapiens
agcctctgatgatcacaggggg

SEQ ID NO: 9411219 - DNA, 22 bp, Homo sapiens
agcctctgatggctcccaagga

SEQ ID NO: 9411220 - DNA, 22 bp, Homo sapiens
agcctctgactgtcagcaaggt

SEQ ID NO: 9411221 - DNA, 22 bp, Homo sapiens
agcctctctttattcccagcta

SEQ ID NO: 9411222 - DNA, 22 bp, Homo sapiens
acagagcatttgggacagagag

SEQ ID NO: 9411223 - DNA, 22 bp, Homo sapiens
agcctctgatggctcccaagga

SEQ ID NO: 9411224 - DNA, 21 bp, Homo sapiens
acagagccgggcacaaagctg

SEQ ID NO: 9411225 - DNA, 22 bp, Homo sapiens
acagagcccttccttgcaccat

SEQ ID NO: 9411226 - DNA, 22 bp, Homo sapiens
agctcctgcttgacagaagagg

SEQ ID NO: 9411227 - DNA, 22 bp, Homo sapiens
agctcctgcttgacagaagagg

SEQ ID NO: 9411228 - DNA, 22 bp, Homo sapiens
agctcctgctctttgtccctaa

SEQ ID NO: 9411229 - DNA, 22 bp, Homo sapiens
agctcctgcgcacggtgcacac

SEQ ID NO: 9411230 - DNA, 22 bp, Homo sapiens
agctcctgctctttgtccctaa

SEQ ID NO: 9411231 - DNA, 22 bp, Homo sapiens
agctcctgctctttgtccctaa

SEQ ID NO: 9411232 - DNA, 22 bp, Homo sapiens
agctcctgctctttgtccctaa

SEQ ID NO: 9411233 - DNA, 22 bp, Homo sapiens
acagcacaatctgagtcccaga

SEQ ID NO: 9411234 - DNA, 22 bp, Homo sapiens
acagcacaatctgagtcccaga

SEQ ID NO: 9411235 - DNA, 22 bp, Homo sapiens
acagcacaatctgagtcccaga

SEQ ID NO: 9411236 - DNA, 22 bp, Homo sapiens
acagcacagagtggtatggctg

SEQ ID NO: 9411237 - DNA, 22 bp, Homo sapiens
acagcacagagtggtatggctg

SEQ ID NO: 9411238 - DNA, 22 bp, Homo sapiens
acagcacaggagttgaatgggc

SEQ ID NO: 9411239 - DNA, 22 bp, Homo sapiens
acagcacagagtggtatggctg

SEQ ID NO: 9411240 - DNA, 17 bp, Homo sapiens
agctcctgcccatggct

SEQ ID NO: 9411241 - DNA, 17 bp, Homo sapiens
agctcctgcccatggct

SEQ ID NO: 9411242 - DNA, 17 bp, Homo sapiens
agctcctgcccatggct

SEQ ID NO: 9411243 - DNA, 22 bp, Homo sapiens
agctcctgcgcacggtgcacac

SEQ ID NO: 9411244 - DNA, 22 bp, Homo sapiens
agctcctgcccaggaaggctct

SEQ ID NO: 9411245 - DNA, 22 bp, Homo sapiens
agctcctgcccaggaaggctct

SEQ ID NO: 9411246 - DNA, 19 bp, Homo sapiens
agctcctgattgtgcctcg

SEQ ID NO: 9411247 - DNA, 22 bp, Homo sapiens
agctcctgcacccagccttgag

SEQ ID NO: 9411248 - DNA, 22 bp, Homo sapiens
agctcctgcacccagccttgag

SEQ ID NO: 9411249 - DNA, 22 bp, Homo sapiens
agctcctgcaccaggggcccct

SEQ ID NO: 9411250 - DNA, 22 bp, Homo sapiens
agctcctgcagactcctgctca

SEQ ID NO: 9411251 - DNA, 22 bp, Homo sapiens
agctcctgcagactcctgctca

SEQ ID NO: 9411252 - DNA, 22 bp, Homo sapiens
agctcctgcagactcctgctca

SEQ ID NO: 9411253 - DNA, 22 bp, Homo sapiens
agctcctgccaacactgatggg

SEQ ID NO: 9411254 - DNA, 22 bp, Homo sapiens
agctcccagaaggccctgcgcc

SEQ ID NO: 9411255 - DNA, 22 bp, Homo sapiens
agctcccagagctcgagagtaa

SEQ ID NO: 9411256 - DNA, 19 bp, Homo sapiens
agctcctgattgtgcctcg

SEQ ID NO: 9411257 - DNA, 22 bp, Homo sapiens
acagattcactgcactggccat

SEQ ID NO: 9411258 - DNA, 22 bp, Homo sapiens
acagattcactgcactggccat

SEQ ID NO: 9411259 - DNA, 21 bp, Homo sapiens
acagattagcacaatgcaggc

SEQ ID NO: 9411260 - DNA, 22 bp, Homo sapiens
acagattagctggggccattga

SEQ ID NO: 9411261 - DNA, 22 bp, Homo sapiens
acagattcactgcactggccat

SEQ ID NO: 9411262 - DNA, 22 bp, Homo sapiens
acagattatggatatatgtgga

SEQ ID NO: 9411263 - DNA, 22 bp, Homo sapiens
acagatgtggagtttgcatgat

SEQ ID NO: 9411264 - DNA, 22 bp, Homo sapiens
acagatgtacactcatatataa

SEQ ID NO: 9411265 - DNA, 22 bp, Homo sapiens
acagatgttagcaatgatgatg

SEQ ID NO: 9411266 - DNA, 22 bp, Homo sapiens
acagatggagctactaggtaaa

SEQ ID NO: 9411267 - DNA, 22 bp, Homo sapiens
acagatggagctactaggtaaa

SEQ ID NO: 9411268 - DNA, 19 bp, Homo sapiens
acagatggaggaatctggg

SEQ ID NO: 9411269 - DNA, 22 bp, Homo sapiens
acagatggccatattactatat

SEQ ID NO: 9411270 - DNA, 21 bp, Homo sapiens
acagatgggatgagcacactg

SEQ ID NO: 9411271 - DNA, 22 bp, Homo sapiens
acagatggggcacaaagccaca

SEQ ID NO: 9411272 - DNA, 22 bp, Homo sapiens
acagatggggcacaaagccaca

SEQ ID NO: 9411273 - DNA, 22 bp, Homo sapiens
acagatggtactaaacccatat

SEQ ID NO: 9411274 - DNA, 22 bp, Homo sapiens
acagatggtgagccgctgatgt

SEQ ID NO: 9411275 - DNA, 22 bp, Homo sapiens
acagactgtcccaccacatgga

SEQ ID NO: 9411276 - DNA, 22 bp, Homo sapiens
acagacattcagctaagtctat

SEQ ID NO: 9411277 - DNA, 21 bp, Homo sapiens
agccagggtggacactgtatg

SEQ ID NO: 9411278 - DNA, 21 bp, Homo sapiens
acagagaaagagcagcctcct

SEQ ID NO: 9411279 - DNA, 21 bp, Homo sapiens
acagagaaagagcagcctcct

SEQ ID NO: 9411280 - DNA, 22 bp, Homo sapiens
acagagaaagtgggctgaagat

SEQ ID NO: 9411281 - DNA, 22 bp, Homo sapiens
acagagaaagtgggctgaagat

SEQ ID NO: 9411282 - DNA, 22 bp, Homo sapiens
agccagggtctctcgctctgtt

SEQ ID NO: 9411283 - DNA, 22 bp, Homo sapiens
agccagggtctctcgctctgtt

SEQ ID NO: 9411284 - DNA, 19 bp, Homo sapiens
agccagggtgagaaggagc

SEQ ID NO: 9411285 - DNA, 22 bp, Homo sapiens
agccagggtctctcgctctgtt

SEQ ID NO: 9411286 - DNA, 22 bp, Homo sapiens
agccagggtctctcgctctgtt

SEQ ID NO: 9411287 - DNA, 19 bp, Homo sapiens
agccagggtgagaaggagc

SEQ ID NO: 9411288 - DNA, 19 bp, Homo sapiens
agccagggtgagaaggagc

SEQ ID NO: 9411289 - DNA, 19 bp, Homo sapiens
agccagggtgagaaggagc

SEQ ID NO: 9411290 - DNA, 19 bp, Homo sapiens
agccagggtgagaaggagc

SEQ ID NO: 9411291 - DNA, 19 bp, Homo sapiens
agccagggtccagacatgt

SEQ ID NO: 9411292 - DNA, 22 bp, Homo sapiens
agccagggggacgctttctggc

SEQ ID NO: 9411293 - DNA, 22 bp, Homo sapiens
agccagggtaaggtacttagta

SEQ ID NO: 9411294 - DNA, 22 bp, Homo sapiens
agccagggggacgctttctggc

SEQ ID NO: 9411295 - DNA, 19 bp, Homo sapiens
agccagggtccagacatgt

SEQ ID NO: 9411296 - DNA, 19 bp, Homo sapiens
agccagggtccagacatgt

SEQ ID NO: 9411297 - DNA, 22 bp, Homo sapiens
acagagagctgtgattgagtta

SEQ ID NO: 9411298 - DNA, 22 bp, Homo sapiens
acagagacttggagcaggctga

SEQ ID NO: 9411299 - DNA, 22 bp, Homo sapiens
acagagagaaacaatcagcagc

SEQ ID NO: 9411300 - DNA, 22 bp, Homo sapiens
acagagagaaacaatcagcagc

SEQ ID NO: 9411301 - DNA, 22 bp, Homo sapiens
acagagactgggagcaagaggc

SEQ ID NO: 9411302 - DNA, 22 bp, Homo sapiens
acagagaaagttcctctcaggc

SEQ ID NO: 9411303 - DNA, 22 bp, Homo sapiens
acagagaaagtgggctgaagat

SEQ ID NO: 9411304 - DNA, 22 bp, Homo sapiens
acagagaaagttcctctcaggc

SEQ ID NO: 9411305 - DNA, 22 bp, Homo sapiens
acagagaaagtgggctgaagat

SEQ ID NO: 9411306 - DNA, 22 bp, Homo sapiens
acagagaaagttcctctcaggc

SEQ ID NO: 9411307 - DNA, 22 bp, Homo sapiens
acagagactaagcttttcatca

SEQ ID NO: 9411308 - DNA, 22 bp, Homo sapiens
acagagacctggccttgctttg

SEQ ID NO: 9411309 - DNA, 22 bp, Homo sapiens
acagagaccagcatcttctgcc

SEQ ID NO: 9411310 - DNA, 22 bp, Homo sapiens
acagaaaatgccagaagggtgg

SEQ ID NO: 9411311 - DNA, 22 bp, Homo sapiens
acagaaaatgccagaagggtgg

SEQ ID NO: 9411312 - DNA, 22 bp, Homo sapiens
acagaaaatgccagaagggtgg

SEQ ID NO: 9411313 - DNA, 22 bp, Homo sapiens
acacttttgtgtatatccagtt

SEQ ID NO: 9411314 - DNA, 22 bp, Homo sapiens
acacttttgtgtatatccagtt

SEQ ID NO: 9411315 - DNA, 22 bp, Homo sapiens
acacttttgtttgaagtctcca

SEQ ID NO: 9411316 - DNA, 22 bp, Homo sapiens
acagaaaaatgagggagctgga

SEQ ID NO: 9411317 - DNA, 22 bp, Homo sapiens
acagaaaagtttacttttgctc

SEQ ID NO: 9411318 - DNA, 22 bp, Homo sapiens
acagaaaaatgagggagctgga

SEQ ID NO: 9411319 - DNA, 22 bp, Homo sapiens
acagaaaaatgagggagctgga

SEQ ID NO: 9411320 - DNA, 22 bp, Homo sapiens
acagaaaaatgagggagctgga

SEQ ID NO: 9411321 - DNA, 22 bp, Homo sapiens
acagaaaagtttacttttgctc

SEQ ID NO: 9411322 - DNA, 22 bp, Homo sapiens
acacttttatctctggaggctt

SEQ ID NO: 9411323 - DNA, 22 bp, Homo sapiens
acacttttagctatgagttaat

SEQ ID NO: 9411324 - DNA, 22 bp, Homo sapiens
acacttttagctatgagttaat

SEQ ID NO: 9411325 - DNA, 22 bp, Homo sapiens
acacttttaagactttaatgaa

SEQ ID NO: 9411326 - DNA, 22 bp, Homo sapiens
acactttatctcatctcagaca

SEQ ID NO: 9411327 - DNA, 22 bp, Homo sapiens
acactttatctcatctcagaca

SEQ ID NO: 9411328 - DNA, 22 bp, Homo sapiens
acactttatctcatctcagaca

SEQ ID NO: 9411329 - DNA, 22 bp, Homo sapiens
acactttatctcatctcagaca

SEQ ID NO: 9411330 - DNA, 22 bp, Homo sapiens
acactttagtatgaagaggtag

SEQ ID NO: 9411331 - DNA, 22 bp, Homo sapiens
acactttatcaatattcaaaaa

SEQ ID NO: 9411332 - DNA, 22 bp, Homo sapiens
acactttatcaatattcaaaaa

SEQ ID NO: 9411333 - DNA, 22 bp, Homo sapiens
acactttatctcatctcagaca

SEQ ID NO: 9411334 - DNA, 22 bp, Homo sapiens
acactttatcaatattcaaaaa

SEQ ID NO: 9411335 - DNA, 22 bp, Homo sapiens
agccaggggattcatcagggac

SEQ ID NO: 9411336 - DNA, 22 bp, Homo sapiens
agccagggggacgctttctggc

SEQ ID NO: 9411337 - DNA, 22 bp, Homo sapiens
acagacagggcacctgcctcct

SEQ ID NO: 9411338 - DNA, 22 bp, Homo sapiens
acagacagggcacctgcctcct

SEQ ID NO: 9411339 - DNA, 22 bp, Homo sapiens
acagacagaggctccatgagga

SEQ ID NO: 9411340 - DNA, 22 bp, Homo sapiens
acagacagattttgtctgatgt

SEQ ID NO: 9411341 - DNA, 22 bp, Homo sapiens
acagacagattttgtctgatgt

SEQ ID NO: 9411342 - DNA, 22 bp, Homo sapiens
acagacagaggctccatgagga

SEQ ID NO: 9411343 - DNA, 22 bp, Homo sapiens
acagacagacagattgcatatg

SEQ ID NO: 9411344 - DNA, 18 bp, Homo sapiens
acagacacttagtatgag

SEQ ID NO: 9411345 - DNA, 22 bp, Homo sapiens
acagacagacagagaactattc

SEQ ID NO: 9411346 - DNA, 22 bp, Homo sapiens
acagacacaggcctgggctcct

SEQ ID NO: 9411347 - DNA, 22 bp, Homo sapiens
acagacacaggcgtggagtcgc

SEQ ID NO: 9411348 - DNA, 22 bp, Homo sapiens
acagacacaggcgtggagtcgc

SEQ ID NO: 9411349 - DNA, 22 bp, Homo sapiens
acagacaagtagttcagacaag

SEQ ID NO: 9411350 - DNA, 23 bp, Homo sapiens
acagacaacactgatgagagaaa

SEQ ID NO: 9411351 - DNA, 22 bp, Homo sapiens
acagacaagtagttcagacaag

SEQ ID NO: 9411352 - DNA, 22 bp, Homo sapiens
acagaaagataggcacaaggtc

SEQ ID NO: 9411353 - DNA, 22 bp, Homo sapiens
acagaaagataggcacaaggtc

SEQ ID NO: 9411354 - DNA, 22 bp, Homo sapiens
acagaattaatgaaaattacaa

SEQ ID NO: 9411355 - DNA, 20 bp, Homo sapiens
acagaaagagagaatgtcag

SEQ ID NO: 9411356 - DNA, 20 bp, Homo sapiens
acagaaagagagaatgtcag

SEQ ID NO: 9411357 - DNA, 22 bp, Homo sapiens
acagaaagaccttgtaacactt

SEQ ID NO: 9411358 - DNA, 22 bp, Homo sapiens
acagaaagaccttgtaacactt

SEQ ID NO: 9411359 - DNA, 20 bp, Homo sapiens
acagaaagagagaatgtcag

SEQ ID NO: 9411360 - DNA, 20 bp, Homo sapiens
acagaaagagagaatgtcag

SEQ ID NO: 9411361 - DNA, 20 bp, Homo sapiens
acagaaagagagaatgtcag

SEQ ID NO: 9411362 - DNA, 22 bp, Homo sapiens
acacatgtttacagtcttcagt

SEQ ID NO: 9411363 - DNA, 22 bp, Homo sapiens
acacatgtttacagtcttcagt

SEQ ID NO: 9411364 - DNA, 22 bp, Homo sapiens
acacatgttcaagaatgttcag

SEQ ID NO: 9411365 - DNA, 22 bp, Homo sapiens
acacatgttcaagaatgttcag

SEQ ID NO: 9411366 - DNA, 19 bp, Homo sapiens
acacatgtgtgttatgtgc

SEQ ID NO: 9411367 - DNA, 22 bp, Homo sapiens
acacatgtgtctgcatgcagtg

SEQ ID NO: 9411368 - DNA, 19 bp, Homo sapiens
acacatgtgtgttatgtgc

SEQ ID NO: 9411369 - DNA, 22 bp, Homo sapiens
acacatgtgtctgcatgcagtg

SEQ ID NO: 9411370 - DNA, 20 bp, Homo sapiens
acacatgtgcgtgttcagta

SEQ ID NO: 9411371 - DNA, 20 bp, Homo sapiens
acacatgtgcgtgttcagta

SEQ ID NO: 9411372 - DNA, 23 bp, Homo sapiens
acacatgtttatgcttgggggca

SEQ ID NO: 9411373 - DNA, 22 bp, Homo sapiens
acacatgtttccaaaagcaccc

SEQ ID NO: 9411374 - DNA, 22 bp, Homo sapiens
acacatgtttccaaaagcaccc

SEQ ID NO: 9411375 - DNA, 22 bp, Homo sapiens
acacatgtttgtgtagtcagtt

SEQ ID NO: 9411376 - DNA, 22 bp, Homo sapiens
acacatgtttgtgtagtcagtt

SEQ ID NO: 9411377 - DNA, 22 bp, Homo sapiens
acacattaaaacgtctacaatg

SEQ ID NO: 9411378 - DNA, 22 bp, Homo sapiens
acacatgtacagattagtattt

SEQ ID NO: 9411379 - DNA, 22 bp, Homo sapiens
acacatgtatatgcttgtgtgt

SEQ ID NO: 9411380 - DNA, 22 bp, Homo sapiens
acacatgtacagattagtattt

SEQ ID NO: 9411381 - DNA, 19 bp, Homo sapiens
acacatgtaacagtttttc

SEQ ID NO: 9411382 - DNA, 22 bp, Homo sapiens
acacatgtacagattagtattt

SEQ ID NO: 9411383 - DNA, 22 bp, Homo sapiens
acacatgtatatgcttgtgtgt

SEQ ID NO: 9411384 - DNA, 22 bp, Homo sapiens
acacatgtatatgcttgtgtgt

SEQ ID NO: 9411385 - DNA, 22 bp, Homo sapiens
acacatgtatgttttgtatttg

SEQ ID NO: 9411386 - DNA, 22 bp, Homo sapiens
acacatgtatggcacttacatt

SEQ ID NO: 9411387 - DNA, 22 bp, Homo sapiens
acacatgtatggcacttacatt

SEQ ID NO: 9411388 - DNA, 22 bp, Homo sapiens
acacatgtatggcacttacatt

SEQ ID NO: 9411389 - DNA, 22 bp, Homo sapiens
acacatgtgattctaagacagc

SEQ ID NO: 9411390 - DNA, 20 bp, Homo sapiens
acacatgtgcgtgttcagta

SEQ ID NO: 9411391 - DNA, 22 bp, Homo sapiens
acacatgtgattctaagacagc

SEQ ID NO: 9411392 - DNA, 22 bp, Homo sapiens
acacatgtgattctaagacagc

SEQ ID NO: 9411393 - DNA, 22 bp, Homo sapiens
acacatgtgattctaagacagc

SEQ ID NO: 9411394 - DNA, 22 bp, Homo sapiens
acacatgtgattctaagacagc

SEQ ID NO: 9411395 - DNA, 22 bp, Homo sapiens
acacatgtatggcacttacatt

SEQ ID NO: 9411396 - DNA, 22 bp, Homo sapiens
acacatgtatgttttgtatttg

SEQ ID NO: 9411397 - DNA, 20 bp, Homo sapiens
acacatgtcaagctaaaggc

SEQ ID NO: 9411398 - DNA, 22 bp, Homo sapiens
acacatgtgattctaagacagc

SEQ ID NO: 9411399 - DNA, 20 bp, Homo sapiens
acacatgtcaagctaaaggc

SEQ ID NO: 9411400 - DNA, 22 bp, Homo sapiens
acacatctgcaagagccagacc

SEQ ID NO: 9411401 - DNA, 22 bp, Homo sapiens
acacatcttagactgaaatatg

SEQ ID NO: 9411402 - DNA, 22 bp, Homo sapiens
acacatgggtggggagctaagt

SEQ ID NO: 9411403 - DNA, 22 bp, Homo sapiens
acacatgctgataagaatataa

SEQ ID NO: 9411404 - DNA, 22 bp, Homo sapiens
acacatgtaaaacacttagcaa

SEQ ID NO: 9411405 - DNA, 22 bp, Homo sapiens
acacatgtaaaacacttagcaa

SEQ ID NO: 9411406 - DNA, 22 bp, Homo sapiens
acacatggtggctggactatag

SEQ ID NO: 9411407 - DNA, 22 bp, Homo sapiens
acacatgtaaaacacttagcaa

SEQ ID NO: 9411408 - DNA, 19 bp, Homo sapiens
acacagggatcagagggtt

SEQ ID NO: 9411409 - DNA, 22 bp, Homo sapiens
acacagggcggaaagcatgaga

SEQ ID NO: 9411410 - DNA, 22 bp, Homo sapiens
acacagggcagagagctggctc

SEQ ID NO: 9411411 - DNA, 22 bp, Homo sapiens
acacagggcagagagctggctc

SEQ ID NO: 9411412 - DNA, 17 bp, Homo sapiens
acacagggagagggagc

SEQ ID NO: 9411413 - DNA, 17 bp, Homo sapiens
acacagggagagggagc

SEQ ID NO: 9411414 - DNA, 18 bp, Homo sapiens
acacaggctgacagcacc

SEQ ID NO: 9411415 - DNA, 22 bp, Homo sapiens
acacagggatatttcaggtggt

SEQ ID NO: 9411416 - DNA, 22 bp, Homo sapiens
acacaggcatagccatacatgt

SEQ ID NO: 9411417 - DNA, 22 bp, Homo sapiens
acacaggcatagccatacatgt

SEQ ID NO: 9411418 - DNA, 22 bp, Homo sapiens
agcagctggtgcaactctaaga

SEQ ID NO: 9411419 - DNA, 22 bp, Homo sapiens
agcagctggtgcaactctaaga

SEQ ID NO: 9411420 - DNA, 22 bp, Homo sapiens
agcagctggttcccgagggcgt

SEQ ID NO: 9411421 - DNA, 22 bp, Homo sapiens
agcagctggttcccgagggcgt

SEQ ID NO: 9411422 - DNA, 22 bp, Homo sapiens
agcagctggttcccgagggcgt

SEQ ID NO: 9411423 - DNA, 22 bp, Homo sapiens
agcagctggttcccgagggcgt

SEQ ID NO: 9411424 - DNA, 22 bp, Homo sapiens
acactgacacctgccctcaggt

SEQ ID NO: 9411425 - DNA, 17 bp, Homo sapiens
acactgacatgccacac

SEQ ID NO: 9411426 - DNA, 22 bp, Homo sapiens
acactgaatgctgtttagaaat

SEQ ID NO: 9411427 - DNA, 22 bp, Homo sapiens
acactgagcatctctagaggca

SEQ ID NO: 9411428 - DNA, 22 bp, Homo sapiens
acactgagcttccaagatgggg

SEQ ID NO: 9411429 - DNA, 22 bp, Homo sapiens
acactgagccatacaactggaa

SEQ ID NO: 9411430 - DNA, 22 bp, Homo sapiens
acactgagattttcctgacacc

SEQ ID NO: 9411431 - DNA, 22 bp, Homo sapiens
acactgagcatctctagaggca

SEQ ID NO: 9411432 - DNA, 22 bp, Homo sapiens
acactgactgggacagaagacc

SEQ ID NO: 9411433 - DNA, 22 bp, Homo sapiens
acactgacgcttgacagtcacc

SEQ ID NO: 9411434 - DNA, 17 bp, Homo sapiens
acactgacatgccacac

SEQ ID NO: 9411435 - DNA, 22 bp, Homo sapiens
acactgactgggacagaagacc

SEQ ID NO: 9411436 - DNA, 22 bp, Homo sapiens
acactgactgggcagtatagtc

SEQ ID NO: 9411437 - DNA, 22 bp, Homo sapiens
acactgactgggacagaagacc

SEQ ID NO: 9411438 - DNA, 22 bp, Homo sapiens
acactttagatattcccttctg

SEQ ID NO: 9411439 - DNA, 22 bp, Homo sapiens
acactttactcttacaccattg

SEQ ID NO: 9411440 - DNA, 22 bp, Homo sapiens
acactttactcttacaccattg

SEQ ID NO: 9411441 - DNA, 22 bp, Homo sapiens
acactttacagcttcctttgca

SEQ ID NO: 9411442 - DNA, 22 bp, Homo sapiens
acacttcagcagtatgcttggg

SEQ ID NO: 9411443 - DNA, 22 bp, Homo sapiens
acacttcagcagtatgcttggg

SEQ ID NO: 9411444 - DNA, 22 bp, Homo sapiens
acactgagcttccaagatgggg

SEQ ID NO: 9411445 - DNA, 22 bp, Homo sapiens
acacttcacccctgctcccagt

SEQ ID NO: 9411446 - DNA, 22 bp, Homo sapiens
acacttcacccctgctcccagt

SEQ ID NO: 9411447 - DNA, 22 bp, Homo sapiens
acacttcacccctgctcccagt

SEQ ID NO: 9411448 - DNA, 22 bp, Homo sapiens
acactgagttttaccaggcaca

SEQ ID NO: 9411449 - DNA, 19 bp, Homo sapiens
acactgatcagatcagcag

SEQ ID NO: 9411450 - DNA, 22 bp, Homo sapiens
acactgagtattgagtagggta

SEQ ID NO: 9411451 - DNA, 22 bp, Homo sapiens
acactgagtattgagtagggta

SEQ ID NO: 9411452 - DNA, 22 bp, Homo sapiens
acacattataggcaatcaaaag

SEQ ID NO: 9411453 - DNA, 22 bp, Homo sapiens
acacattataggcaatcaaaag

SEQ ID NO: 9411454 - DNA, 22 bp, Homo sapiens
acacattataggcaatcaaaag

SEQ ID NO: 9411455 - DNA, 22 bp, Homo sapiens
acacattatagagagtataata

SEQ ID NO: 9411456 - DNA, 22 bp, Homo sapiens
acacattatagagagtataata

SEQ ID NO: 9411457 - DNA, 22 bp, Homo sapiens
acacattagtgctctgtctcat

SEQ ID NO: 9411458 - DNA, 22 bp, Homo sapiens
acacattaggcagtgcttaaat

SEQ ID NO: 9411459 - DNA, 22 bp, Homo sapiens
acacattaggcagtgcttaaat

SEQ ID NO: 9411460 - DNA, 22 bp, Homo sapiens
acacccaggctggcgtgcagtg

SEQ ID NO: 9411461 - DNA, 22 bp, Homo sapiens
acacccaggctggcgtgcagtg

SEQ ID NO: 9411462 - DNA, 22 bp, Homo sapiens
acactagctaaatgctgattaa

SEQ ID NO: 9411463 - DNA, 22 bp, Homo sapiens
acacccaggaataaggactggg

SEQ ID NO: 9411464 - DNA, 22 bp, Homo sapiens
acacccaggaataaggactggg

SEQ ID NO: 9411465 - DNA, 22 bp, Homo sapiens
acactataagacagatacagca

SEQ ID NO: 9411466 - DNA, 22 bp, Homo sapiens
acactagtggaaattgatttgt

SEQ ID NO: 9411467 - DNA, 22 bp, Homo sapiens
acactcagtaaacgacaatggg

SEQ ID NO: 9411468 - DNA, 22 bp, Homo sapiens
acactcaccctcccactgcctg

SEQ ID NO: 9411469 - DNA, 22 bp, Homo sapiens
acactctgtaatgtcacactcc

SEQ ID NO: 9411470 - DNA, 22 bp, Homo sapiens
acactctgtaatgtcacactcc

SEQ ID NO: 9411471 - DNA, 22 bp, Homo sapiens
acactctgtgaggcatgtaatg

SEQ ID NO: 9411472 - DNA, 22 bp, Homo sapiens
acactctacagagcaatctacc

SEQ ID NO: 9411473 - DNA, 22 bp, Homo sapiens
acactctacagagcaatctacc

SEQ ID NO: 9411474 - DNA, 22 bp, Homo sapiens
acactctgctctgagcttcagg

SEQ ID NO: 9411475 - DNA, 22 bp, Homo sapiens
agcagctggtaggagtggccac

SEQ ID NO: 9411476 - DNA, 22 bp, Homo sapiens
agcagctggtaggagtggccac

SEQ ID NO: 9411477 - DNA, 22 bp, Homo sapiens
agcagctggtaggagtggccac

SEQ ID NO: 9411478 - DNA, 22 bp, Homo sapiens
agcagctggtaggagtggccac

SEQ ID NO: 9411479 - DNA, 22 bp, Homo sapiens
agcagctggtgcaactctaaga

SEQ ID NO: 9411480 - DNA, 22 bp, Homo sapiens
agcagctggtgagcaagctcag

SEQ ID NO: 9411481 - DNA, 22 bp, Homo sapiens
agcagctggtaggagtggccac

SEQ ID NO: 9411482 - DNA, 23 bp, Homo sapiens
agcagctggggtgctcttttgtc

SEQ ID NO: 9411483 - DNA, 22 bp, Homo sapiens
agcagctggggcctgtgacgat

SEQ ID NO: 9411484 - DNA, 22 bp, Homo sapiens
agcagctggggcctgtgacgat

SEQ ID NO: 9411485 - DNA, 23 bp, Homo sapiens
agcagctggggtgctcttttgtc

SEQ ID NO: 9411486 - DNA, 22 bp, Homo sapiens
agcagctggggcctgtgacgat

SEQ ID NO: 9411487 - DNA, 22 bp, Homo sapiens
agcagctgggtccggcggagca

SEQ ID NO: 9411488 - DNA, 22 bp, Homo sapiens
agcagctgggtccggcggagca

SEQ ID NO: 9411489 - DNA, 22 bp, Homo sapiens
agcagctgggtccggcggagca

SEQ ID NO: 9411490 - DNA, 22 bp, Homo sapiens
agcagctgggtccggcggagca

SEQ ID NO: 9411491 - DNA, 17 bp, Homo sapiens
agcagctgggttgatct

SEQ ID NO: 9411492 - DNA, 17 bp, Homo sapiens
agcagctgggttgatct

SEQ ID NO: 9411493 - DNA, 17 bp, Homo sapiens
agcagctgggttgatct

SEQ ID NO: 9411494 - DNA, 22 bp, Homo sapiens
acacagatgatgttccaggaac

SEQ ID NO: 9411495 - DNA, 22 bp, Homo sapiens
acacagatgatgttccaggaac

SEQ ID NO: 9411496 - DNA, 22 bp, Homo sapiens
acacagatattgtacttgatcc

SEQ ID NO: 9411497 - DNA, 22 bp, Homo sapiens
acacagataatgctcatatagg

SEQ ID NO: 9411498 - DNA, 22 bp, Homo sapiens
agcagctgagccccagctgtga

SEQ ID NO: 9411499 - DNA, 22 bp, Homo sapiens
acacagatgctatttagtctct

SEQ ID NO: 9411500 - DNA, 22 bp, Homo sapiens
acacagatgctatttagtctct

SEQ ID NO: 9411501 - DNA, 22 bp, Homo sapiens
agcagctgggctcagagctggg

SEQ ID NO: 9411502 - DNA, 22 bp, Homo sapiens
agcagctggggcctgtgacgat

SEQ ID NO: 9411503 - DNA, 22 bp, Homo sapiens
agcagctgggctcagagctggg

SEQ ID NO: 9411504 - DNA, 22 bp, Homo sapiens
agcagctgggctcagagctggg

SEQ ID NO: 9411505 - DNA, 22 bp, Homo sapiens
agcagctgggctcagagctggg

SEQ ID NO: 9411506 - DNA, 22 bp, Homo sapiens
agcagctgggctcagagctggg

SEQ ID NO: 9411507 - DNA, 22 bp, Homo sapiens
acacagagtccttactgaggta

SEQ ID NO: 9411508 - DNA, 22 bp, Homo sapiens
acacagagtccttactgaggta

SEQ ID NO: 9411509 - DNA, 22 bp, Homo sapiens
acacagagtatttagaaggggt

SEQ ID NO: 9411510 - DNA, 22 bp, Homo sapiens
acacagagtatcttttgcctag

SEQ ID NO: 9411511 - DNA, 22 bp, Homo sapiens
acacagagtccttactgaggta

SEQ ID NO: 9411512 - DNA, 22 bp, Homo sapiens
acacagagtttgacacatggga

SEQ ID NO: 9411513 - DNA, 22 bp, Homo sapiens
acacagagtttgacacatggga

SEQ ID NO: 9411514 - DNA, 22 bp, Homo sapiens
acacagagtttgacacatggga

SEQ ID NO: 9411515 - DNA, 22 bp, Homo sapiens
acacagagttattatgtgaact

SEQ ID NO: 9411516 - DNA, 22 bp, Homo sapiens
acacagagtggtttgtagaata

SEQ ID NO: 9411517 - DNA, 22 bp, Homo sapiens
acacagaggtggccactctttt

SEQ ID NO: 9411518 - DNA, 22 bp, Homo sapiens
acacagagtatcttttgcctag

SEQ ID NO: 9411519 - DNA, 22 bp, Homo sapiens
acacagaggtggccactctttt

SEQ ID NO: 9411520 - DNA, 22 bp, Homo sapiens
acacagaggctccagagataga

SEQ ID NO: 9411521 - DNA, 22 bp, Homo sapiens
acacagagggcagaagatacat

SEQ ID NO: 9411522 - DNA, 22 bp, Homo sapiens
acacagaggcatgacagtggct

SEQ ID NO: 9411523 - DNA, 22 bp, Homo sapiens
acacagaggcatgacagtggct

SEQ ID NO: 9411524 - DNA, 22 bp, Homo sapiens
acacagaggcatgacagtggct

SEQ ID NO: 9411525 - DNA, 22 bp, Homo sapiens
acacagaggaaagtgtgaaggg

SEQ ID NO: 9411526 - DNA, 22 bp, Homo sapiens
acacagaggaaagtgtgaaggg

SEQ ID NO: 9411527 - DNA, 22 bp, Homo sapiens
acacagaggaaagtgtgaaggg

SEQ ID NO: 9411528 - DNA, 22 bp, Homo sapiens
acacagaggaaagtgtgaaggg

SEQ ID NO: 9411529 - DNA, 22 bp, Homo sapiens
acacagagcttctcaactggga

SEQ ID NO: 9411530 - DNA, 22 bp, Homo sapiens
acacagaggcatgacagtggct

SEQ ID NO: 9411531 - DNA, 21 bp, Homo sapiens
acacagaggcatcatcacttt

SEQ ID NO: 9411532 - DNA, 22 bp, Homo sapiens
agcagatgagcctcatgactgg

SEQ ID NO: 9411533 - DNA, 22 bp, Homo sapiens
agcagatgaatcccagataaag

SEQ ID NO: 9411534 - DNA, 22 bp, Homo sapiens
agcagatgaatcccagataaag

SEQ ID NO: 9411535 - DNA, 22 bp, Homo sapiens
agcagatatttgttgagcactt

SEQ ID NO: 9411536 - DNA, 22 bp, Homo sapiens
agcagagtgtgaaggcagggct

SEQ ID NO: 9411537 - DNA, 22 bp, Homo sapiens
agcagagtgtgaaggcagggct

SEQ ID NO: 9411538 - DNA, 22 bp, Homo sapiens
agcagagtttctcaacatcagc

SEQ ID NO: 9411539 - DNA, 22 bp, Homo sapiens
agcagatagtagaacatgtata

SEQ ID NO: 9411540 - DNA, 20 bp, Homo sapiens
agcagatagcgggagagttt

SEQ ID NO: 9411541 - DNA, 18 bp, Homo sapiens
agcagagcccatgcattc

SEQ ID NO: 9411542 - DNA, 19 bp, Homo sapiens
agcagagccctgaagatcc

SEQ ID NO: 9411543 - DNA, 22 bp, Homo sapiens
agcagagcccttccatggcctt

SEQ ID NO: 9411544 - DNA, 22 bp, Homo sapiens
agcagagcccttccatggcctt

SEQ ID NO: 9411545 - DNA, 22 bp, Homo sapiens
agcagagcccttccatggcctt

SEQ ID NO: 9411546 - DNA, 19 bp, Homo sapiens
agcagagccctgaagatcc

SEQ ID NO: 9411547 - DNA, 22 bp, Homo sapiens
agcagatgagcctcatgactgg

SEQ ID NO: 9411548 - DNA, 22 bp, Homo sapiens
agcagatgcattatgattgaaa

SEQ ID NO: 9411549 - DNA, 22 bp, Homo sapiens
agcagatggagaatggagtcag

SEQ ID NO: 9411550 - DNA, 22 bp, Homo sapiens
agcagatgggagatggagctgc

SEQ ID NO: 9411551 - DNA, 22 bp, Homo sapiens
agcagatgggagatggagctgc

SEQ ID NO: 9411552 - DNA, 22 bp, Homo sapiens
agcagatgcgtctgagtgggag

SEQ ID NO: 9411553 - DNA, 22 bp, Homo sapiens
agcagatgcgtctgagtgggag

SEQ ID NO: 9411554 - DNA, 22 bp, Homo sapiens
agcagatgtgtctctgcactgt

SEQ ID NO: 9411555 - DNA, 22 bp, Homo sapiens
agcagatggtgtcatgggatgg

SEQ ID NO: 9411556 - DNA, 22 bp, Homo sapiens
agcagatgtgtctctgcactgt

SEQ ID NO: 9411557 - DNA, 22 bp, Homo sapiens
agcagatgttccctggtccctt

SEQ ID NO: 9411558 - DNA, 22 bp, Homo sapiens
agcagatgtttcagagcaggct

SEQ ID NO: 9411559 - DNA, 23 bp, Homo sapiens
agcagcaaaaatttatctttctg

SEQ ID NO: 9411560 - DNA, 22 bp, Homo sapiens
agcagcaaaagagaatagtttg

SEQ ID NO: 9411561 - DNA, 22 bp, Homo sapiens
agcagcaaaagagaatagtttg

SEQ ID NO: 9411562 - DNA, 23 bp, Homo sapiens
acacagaagaagacccaaggaag

SEQ ID NO: 9411563 - DNA, 22 bp, Homo sapiens
agcagcaaagaataggccctct

SEQ ID NO: 9411564 - DNA, 22 bp, Homo sapiens
acacagaagatctcttaatgct

SEQ ID NO: 9411565 - DNA, 22 bp, Homo sapiens
acacagaagatctcttaatgct

SEQ ID NO: 9411566 - DNA, 22 bp, Homo sapiens
acaatgcacctattttaaaact

SEQ ID NO: 9411567 - DNA, 22 bp, Homo sapiens
acaatgcacctattttaaaact

SEQ ID NO: 9411568 - DNA, 22 bp, Homo sapiens
acaatgcaccagcatcttcacc

SEQ ID NO: 9411569 - DNA, 22 bp, Homo sapiens
acaatgcaccagcatcttcacc

SEQ ID NO: 9411570 - DNA, 22 bp, Homo sapiens
acaatgcaccagcatcttcacc

SEQ ID NO: 9411571 - DNA, 22 bp, Homo sapiens
acaatgcacctattttaaaact

SEQ ID NO: 9411572 - DNA, 23 bp, Homo sapiens
acaatgcactttaaatggttccc

SEQ ID NO: 9411573 - DNA, 23 bp, Homo sapiens
acaatgcactttaaatggttccc

SEQ ID NO: 9411574 - DNA, 22 bp, Homo sapiens
acaatgcatacctagcagctca

SEQ ID NO: 9411575 - DNA, 21 bp, Homo sapiens
acaatgcatggaactcatggc

SEQ ID NO: 9411576 - DNA, 22 bp, Homo sapiens
acaatgctccctgtagtcagga

SEQ ID NO: 9411577 - DNA, 22 bp, Homo sapiens
acaatgctgcagggaaattagg

SEQ ID NO: 9411578 - DNA, 21 bp, Homo sapiens
acaatgcatggaactcatggc

SEQ ID NO: 9411579 - DNA, 22 bp, Homo sapiens
acaatgcatacctagcagctca

SEQ ID NO: 9411580 - DNA, 21 bp, Homo sapiens
acaatgcatggaactcatggc

SEQ ID NO: 9411581 - DNA, 22 bp, Homo sapiens
agcagagaggaggtggccctgt

SEQ ID NO: 9411582 - DNA, 22 bp, Homo sapiens
agcagagaggaggtggccctgt

SEQ ID NO: 9411583 - DNA, 22 bp, Homo sapiens
agcagagaggaggtggccctgt

SEQ ID NO: 9411584 - DNA, 22 bp, Homo sapiens
agcagaactgatgagacttgag

SEQ ID NO: 9411585 - DNA, 22 bp, Homo sapiens
agcagaacctgcagacctgtct

SEQ ID NO: 9411586 - DNA, 22 bp, Homo sapiens
acaatgctgcagggaaattagg

SEQ ID NO: 9411587 - DNA, 22 bp, Homo sapiens
agcagagcatgctaagtgactc

SEQ ID NO: 9411588 - DNA, 22 bp, Homo sapiens
agcagagcatgctaagtgactc

SEQ ID NO: 9411589 - DNA, 21 bp, Homo sapiens
agcagagccaccattacctgc

SEQ ID NO: 9411590 - DNA, 22 bp, Homo sapiens
agcagagcatggtgggaagggc

SEQ ID NO: 9411591 - DNA, 19 bp, Homo sapiens
agcagagcaaagtggctga

SEQ ID NO: 9411592 - DNA, 22 bp, Homo sapiens
agcagagcagaatgtgaaggtg

SEQ ID NO: 9411593 - DNA, 19 bp, Homo sapiens
agcagagcaaagtggctga

SEQ ID NO: 9411594 - DNA, 18 bp, Homo sapiens
agcagagagtgaatggga

SEQ ID NO: 9411595 - DNA, 18 bp, Homo sapiens
agcagagagtgaatggga

SEQ ID NO: 9411596 - DNA, 18 bp, Homo sapiens
agcagagagtgaatggga

SEQ ID NO: 9411597 - DNA, 22 bp, Homo sapiens
agagccagttacaactgtggag

SEQ ID NO: 9411598 - DNA, 22 bp, Homo sapiens
agagccagttacaactgtggag

SEQ ID NO: 9411599 - DNA, 22 bp, Homo sapiens
agagccagttacaactgtggag

SEQ ID NO: 9411600 - DNA, 22 bp, Homo sapiens
agagcctgcatctagcctcaga

SEQ ID NO: 9411601 - DNA, 22 bp, Homo sapiens
agagcctgcatctagcctcaga

SEQ ID NO: 9411602 - DNA, 22 bp, Homo sapiens
agagcctgcatctagcctcaga

SEQ ID NO: 9411603 - DNA, 22 bp, Homo sapiens
agagcctgcatcaggcttgggg

SEQ ID NO: 9411604 - DNA, 22 bp, Homo sapiens
agagccagttgttaagcactta

SEQ ID NO: 9411605 - DNA, 22 bp, Homo sapiens
agagcctggacctgagctacaa

SEQ ID NO: 9411606 - DNA, 22 bp, Homo sapiens
agagcctggaggttctgctgaa

SEQ ID NO: 9411607 - DNA, 22 bp, Homo sapiens
aattccagggggtaccattcat

SEQ ID NO: 9411608 - DNA, 22 bp, Homo sapiens
aattctgaggagggaagaggaa

SEQ ID NO: 9411609 - DNA, 22 bp, Homo sapiens
aattccatccatttgtttcaac

SEQ ID NO: 9411610 - DNA, 22 bp, Homo sapiens
aattctgcttcatcagctcttt

SEQ ID NO: 9411611 - DNA, 22 bp, Homo sapiens
aattctgatgagtcagagaaag

SEQ ID NO: 9411612 - DNA, 22 bp, Homo sapiens
aattctgatgaataaatcatcc

SEQ ID NO: 9411613 - DNA, 22 bp, Homo sapiens
aattctgatgaataaatcatcc

SEQ ID NO: 9411614 - DNA, 22 bp, Homo sapiens
agagccaggtgtagtctcggag

SEQ ID NO: 9411615 - DNA, 22 bp, Homo sapiens
agagccaggtgtagtctcggag

SEQ ID NO: 9411616 - DNA, 22 bp, Homo sapiens
agagccaggtgtagtctcggag

SEQ ID NO: 9411617 - DNA, 22 bp, Homo sapiens
agagccagttacaactgtggag

SEQ ID NO: 9411618 - DNA, 22 bp, Homo sapiens
agagccagttacaactgtggag

SEQ ID NO: 9411619 - DNA, 22 bp, Homo sapiens
agagccagttaagcacttacag

SEQ ID NO: 9411620 - DNA, 22 bp, Homo sapiens
agagccagttaagcacttacag

SEQ ID NO: 9411621 - DNA, 22 bp, Homo sapiens
agagccaggctcccatggggca

SEQ ID NO: 9411622 - DNA, 22 bp, Homo sapiens
agagccaggctcccatggggca

SEQ ID NO: 9411623 - DNA, 22 bp, Homo sapiens
agagccaggctcccatggggca

SEQ ID NO: 9411624 - DNA, 22 bp, Homo sapiens
agagccaggctcccatggggca

SEQ ID NO: 9411625 - DNA, 22 bp, Homo sapiens
agagccaggctcccatggggca

SEQ ID NO: 9411626 - DNA, 22 bp, Homo sapiens
agagccaggctctacctgggtt

SEQ ID NO: 9411627 - DNA, 22 bp, Homo sapiens
agagccaggtgctgctgtttga

SEQ ID NO: 9411628 - DNA, 22 bp, Homo sapiens
agagacagggttttgccatgtt

SEQ ID NO: 9411629 - DNA, 22 bp, Homo sapiens
agagacaggatatctgctcatg

SEQ ID NO: 9411630 - DNA, 22 bp, Homo sapiens
agagacaggatatctgctcatg

SEQ ID NO: 9411631 - DNA, 22 bp, Homo sapiens
agagcaggtggcaactctggga

SEQ ID NO: 9411632 - DNA, 22 bp, Homo sapiens
agagccaggcggctgggcacct

SEQ ID NO: 9411633 - DNA, 22 bp, Homo sapiens
agagccaggcggctgggcacct

SEQ ID NO: 9411634 - DNA, 22 bp, Homo sapiens
agacctaaagtacccagcatat

SEQ ID NO: 9411635 - DNA, 22 bp, Homo sapiens
agaccctttgaagaggataaag

SEQ ID NO: 9411636 - DNA, 22 bp, Homo sapiens
agacccttcagacggctagagc

SEQ ID NO: 9411637 - DNA, 22 bp, Homo sapiens
agacccttgcagtctggttgtc

SEQ ID NO: 9411638 - DNA, 22 bp, Homo sapiens
agaccctggtaaacactccagg

SEQ ID NO: 9411639 - DNA, 22 bp, Homo sapiens
agaccctgttagttccagtctt

SEQ ID NO: 9411640 - DNA, 20 bp, Homo sapiens
agaccctgtgtcctgtggcc

SEQ ID NO: 9411641 - DNA, 22 bp, Homo sapiens
agacctcaataccaggcaccac

SEQ ID NO: 9411642 - DNA, 22 bp, Homo sapiens
aattaaaaaaggagagcttgct

SEQ ID NO: 9411643 - DNA, 22 bp, Homo sapiens
aatgttttttggtctgatgaat

SEQ ID NO: 9411644 - DNA, 22 bp, Homo sapiens
aatgttttaaaagagattgaga

SEQ ID NO: 9411645 - DNA, 22 bp, Homo sapiens
aattaaaaaaggagagcttgct

SEQ ID NO: 9411646 - DNA, 22 bp, Homo sapiens
aatgtggttaacccatttaaga

SEQ ID NO: 9411647 - DNA, 22 bp, Homo sapiens
aatgtgggggtgagctgtatat

SEQ ID NO: 9411648 - DNA, 22 bp, Homo sapiens
aatgtggggaagccatggctga

SEQ ID NO: 9411649 - DNA, 18 bp, Homo sapiens
agaccctctaagggcagt

SEQ ID NO: 9411650 - DNA, 18 bp, Homo sapiens
agaccctctaagggcagt

SEQ ID NO: 9411651 - DNA, 22 bp, Homo sapiens
agaccctctcctcatggacatg

SEQ ID NO: 9411652 - DNA, 22 bp, Homo sapiens
agaccccatacctcagcaggta

SEQ ID NO: 9411653 - DNA, 22 bp, Homo sapiens
agaccccctttaatggaagtgc

SEQ ID NO: 9411654 - DNA, 22 bp, Homo sapiens
agaccccatacctcagcaggta

SEQ ID NO: 9411655 - DNA, 22 bp, Homo sapiens
agaccctggggaaagtcacttc

SEQ ID NO: 9411656 - DNA, 22 bp, Homo sapiens
agaccctggtaaacactccagg

SEQ ID NO: 9411657 - DNA, 22 bp, Homo sapiens
agaccctggggaaagtcacttc

SEQ ID NO: 9411658 - DNA, 22 bp, Homo sapiens
agaccctggggaaagtcacttc

SEQ ID NO: 9411659 - DNA, 22 bp, Homo sapiens
agaccctggagaatgaaagtgc

SEQ ID NO: 9411660 - DNA, 22 bp, Homo sapiens
agaccctgcattttccagggtt

SEQ ID NO: 9411661 - DNA, 21 bp, Homo sapiens
agaccctgcatatgttcagta

SEQ ID NO: 9411662 - DNA, 22 bp, Homo sapiens
agaccctctgccagatgcttta

SEQ ID NO: 9411663 - DNA, 20 bp, Homo sapiens
agaccctctggactgggccc

SEQ ID NO: 9411664 - DNA, 22 bp, Homo sapiens
agaccctgaagttttctatgat

SEQ ID NO: 9411665 - DNA, 22 bp, Homo sapiens
agaccctgcacctctcgtgggc

SEQ ID NO: 9411666 - DNA, 22 bp, Homo sapiens
agagacagatctgagggacctc

SEQ ID NO: 9411667 - DNA, 22 bp, Homo sapiens
agagacagatctgagggacctc

SEQ ID NO: 9411668 - DNA, 22 bp, Homo sapiens
agagacagaggcaatatagctt

SEQ ID NO: 9411669 - DNA, 22 bp, Homo sapiens
agagacagatctgagggacctc

SEQ ID NO: 9411670 - DNA, 18 bp, Homo sapiens
agagacagcagcaaaaga

SEQ ID NO: 9411671 - DNA, 22 bp, Homo sapiens
agagacaggaatggcattaaga

SEQ ID NO: 9411672 - DNA, 18 bp, Homo sapiens
agagacagcagcaaaaga

SEQ ID NO: 9411673 - DNA, 22 bp, Homo sapiens
agagacaggaatggcattaaga

SEQ ID NO: 9411674 - DNA, 22 bp, Homo sapiens
agagacaggagttctgtttcca

SEQ ID NO: 9411675 - DNA, 22 bp, Homo sapiens
aattaaaaaaggagagcttgct

SEQ ID NO: 9411676 - DNA, 22 bp, Homo sapiens
aattaaaaaaggagagcttgct

SEQ ID NO: 9411677 - DNA, 22 bp, Homo sapiens
aattaaaaaaggagagcttgct

SEQ ID NO: 9411678 - DNA, 22 bp, Homo sapiens
aattaaaaaaggagagcttgct

SEQ ID NO: 9411679 - DNA, 22 bp, Homo sapiens
aattaaaaaaggagagcttgct

SEQ ID NO: 9411680 - DNA, 22 bp, Homo sapiens
aattaaaagataacccatgagt

SEQ ID NO: 9411681 - DNA, 22 bp, Homo sapiens
aattaaaagataacccatgagt

SEQ ID NO: 9411682 - DNA, 22 bp, Homo sapiens
aattaaaagataacccatgagt

SEQ ID NO: 9411683 - DNA, 22 bp, Homo sapiens
aattaaaagataacccatgagt

SEQ ID NO: 9411684 - DNA, 22 bp, Homo sapiens
aattaaaagataacccatgagt

SEQ ID NO: 9411685 - DNA, 22 bp, Homo sapiens
aattaaaagataacccatgagt

SEQ ID NO: 9411686 - DNA, 22 bp, Homo sapiens
aattaaaagataacccatgagt

SEQ ID NO: 9411687 - DNA, 22 bp, Homo sapiens
aattaaaagataacccatgagt

SEQ ID NO: 9411688 - DNA, 23 bp, Homo sapiens
aattaaattgctagatccagggc

SEQ ID NO: 9411689 - DNA, 22 bp, Homo sapiens
aattaaattggtttagagagga

SEQ ID NO: 9411690 - DNA, 22 bp, Homo sapiens
aattaaattggtttagagagga

SEQ ID NO: 9411691 - DNA, 22 bp, Homo sapiens
aattaaatgacaggggaagatg

SEQ ID NO: 9411692 - DNA, 22 bp, Homo sapiens
aattaaatgacaggggaagatg

SEQ ID NO: 9411693 - DNA, 23 bp, Homo sapiens
aattaaattgctagatccagggc

SEQ ID NO: 9411694 - DNA, 23 bp, Homo sapiens
aattaaattgctagatccagggc

SEQ ID NO: 9411695 - DNA, 22 bp, Homo sapiens
aatgggataatagaagtagaat

SEQ ID NO: 9411696 - DNA, 22 bp, Homo sapiens
aatgggaggattttctctcttg

SEQ ID NO: 9411697 - DNA, 22 bp, Homo sapiens
aatggcagtagttgcatgagag

SEQ ID NO: 9411698 - DNA, 22 bp, Homo sapiens
aatggcagaggcaaagatggta

SEQ ID NO: 9411699 - DNA, 22 bp, Homo sapiens
aatggcagaatgggccagaagc

SEQ ID NO: 9411700 - DNA, 22 bp, Homo sapiens
aatggcactttataaatgttaa

SEQ ID NO: 9411701 - DNA, 22 bp, Homo sapiens
aatggcactttataaatgttaa

SEQ ID NO: 9411702 - DNA, 22 bp, Homo sapiens
aatggcagaggcaaagatggta

SEQ ID NO: 9411703 - DNA, 22 bp, Homo sapiens
aatggcagaatgggccagaagc

SEQ ID NO: 9411704 - DNA, 22 bp, Homo sapiens
aatggcagagactgttgaaata

SEQ ID NO: 9411705 - DNA, 22 bp, Homo sapiens
aatggcagaggcaaagatggta

SEQ ID NO: 9411706 - DNA, 22 bp, Homo sapiens
agacaattgttctaagtaaaaa

SEQ ID NO: 9411707 - DNA, 22 bp, Homo sapiens
agacaatgtttggtctacactt

SEQ ID NO: 9411708 - DNA, 22 bp, Homo sapiens
agacaattgttctaagtaaaaa

SEQ ID NO: 9411709 - DNA, 22 bp, Homo sapiens
aatggagactgacacaaagata

SEQ ID NO: 9411710 - DNA, 22 bp, Homo sapiens
aatggcaattcagtgaaattat

SEQ ID NO: 9411711 - DNA, 22 bp, Homo sapiens
aatggcaagctgaactcagaag

SEQ ID NO: 9411712 - DNA, 22 bp, Homo sapiens
agacaatggagagcagagtact

SEQ ID NO: 9411713 - DNA, 22 bp, Homo sapiens
agacaatggagggaaatacttc

SEQ ID NO: 9411714 - DNA, 22 bp, Homo sapiens
agacaatggagagcagagtact

SEQ ID NO: 9411715 - DNA, 22 bp, Homo sapiens
agacaatggctaagtaacctgt

SEQ ID NO: 9411716 - DNA, 22 bp, Homo sapiens
agacaatgtcaaggtgatcatc

SEQ ID NO: 9411717 - DNA, 22 bp, Homo sapiens
agacaatgtttggtctacactt

SEQ ID NO: 9411718 - DNA, 22 bp, Homo sapiens
agacaatgtcaaggtgatcatc

SEQ ID NO: 9411719 - DNA, 22 bp, Homo sapiens
agacaatggagagcagagtact

SEQ ID NO: 9411720 - DNA, 21 bp, Homo sapiens
agacaatgctgtaaaattcag

SEQ ID NO: 9411721 - DNA, 20 bp, Homo sapiens
agacaatgagtgacagagtt

SEQ ID NO: 9411722 - DNA, 20 bp, Homo sapiens
agacaatgagtgacagagtt

SEQ ID NO: 9411723 - DNA, 22 bp, Homo sapiens
agacaatatgtatattaagaat

SEQ ID NO: 9411724 - DNA, 22 bp, Homo sapiens
agaagcagactctgaggcaagg

SEQ ID NO: 9411725 - DNA, 22 bp, Homo sapiens
agaagcagaaggaagcagggcc

SEQ ID NO: 9411726 - DNA, 23 bp, Homo sapiens
agaagcagcttctggagtatcgg

SEQ ID NO: 9411727 - DNA, 23 bp, Homo sapiens
agaagcagcttctggagtatcgg

SEQ ID NO: 9411728 - DNA, 23 bp, Homo sapiens
agaagcagcttctggagtatcgg

SEQ ID NO: 9411729 - DNA, 22 bp, Homo sapiens
agaagcagctttcaaggtgatt

SEQ ID NO: 9411730 - DNA, 22 bp, Homo sapiens
agacaaacccagtggctgtttt

SEQ ID NO: 9411731 - DNA, 20 bp, Homo sapiens
agacaaaatgacttcatgca

SEQ ID NO: 9411732 - DNA, 22 bp, Homo sapiens
aatggtttatggggaccgcaaa

SEQ ID NO: 9411733 - DNA, 22 bp, Homo sapiens
aatggtttcaaacacactaagt

SEQ ID NO: 9411734 - DNA, 22 bp, Homo sapiens
aatggtttctgaagttaggcag

SEQ ID NO: 9411735 - DNA, 23 bp, Homo sapiens
aatggtcttcctccacccctctg

SEQ ID NO: 9411736 - DNA, 22 bp, Homo sapiens
aatggtttagttaagactgagt

SEQ ID NO: 9411737 - DNA, 22 bp, Homo sapiens
aatggttacagaaatgaaagta

SEQ ID NO: 9411738 - DNA, 22 bp, Homo sapiens
aatggtttaacatatgcttgag

SEQ ID NO: 9411739 - DNA, 22 bp, Homo sapiens
aatggtttgatggacaaaatga

SEQ ID NO: 9411740 - DNA, 19 bp, Homo sapiens
aatggtttgatgaagtata

SEQ ID NO: 9411741 - DNA, 22 bp, Homo sapiens
aatggtttggactattcaatag

SEQ ID NO: 9411742 - DNA, 22 bp, Homo sapiens
aatggttttctagaacatgaaa

SEQ ID NO: 9411743 - DNA, 22 bp, Homo sapiens
aatggttttgcaggtttgtgga

SEQ ID NO: 9411744 - DNA, 22 bp, Homo sapiens
aatggttttctagaacatgaaa

SEQ ID NO: 9411745 - DNA, 22 bp, Homo sapiens
aatggtttgtacctgtccttgg

SEQ ID NO: 9411746 - DNA, 20 bp, Homo sapiens
aatgggctttgatgagtgtg

SEQ ID NO: 9411747 - DNA, 22 bp, Homo sapiens
aatgggctttcttggacaggag

SEQ ID NO: 9411748 - DNA, 23 bp, Homo sapiens
aatgggtgcaactatccatgaca

SEQ ID NO: 9411749 - DNA, 23 bp, Homo sapiens
aatgggtgcaactatccatgaca

SEQ ID NO: 9411750 - DNA, 22 bp, Homo sapiens
aatggtaatggagagaactact

SEQ ID NO: 9411751 - DNA, 19 bp, Homo sapiens
aatggtaattagagaaatg

SEQ ID NO: 9411752 - DNA, 22 bp, Homo sapiens
aatggtaatttgcagaaagtcc

SEQ ID NO: 9411753 - DNA, 22 bp, Homo sapiens
aatggtaatttgcagaaagtcc

SEQ ID NO: 9411754 - DNA, 22 bp, Homo sapiens
aatggtatcacctcacagaatt

SEQ ID NO: 9411755 - DNA, 22 bp, Homo sapiens
aatggtaatattggcacagaaa

SEQ ID NO: 9411756 - DNA, 22 bp, Homo sapiens
aatggtaaatgtaacagcattc

SEQ ID NO: 9411757 - DNA, 22 bp, Homo sapiens
aatggtaatatttcatagttgt

SEQ ID NO: 9411758 - DNA, 22 bp, Homo sapiens
aatggtaatggagagaactact

SEQ ID NO: 9411759 - DNA, 22 bp, Homo sapiens
aatggtaatatttcatagttgt

SEQ ID NO: 9411760 - DNA, 22 bp, Homo sapiens
aatgtgaggccttggtagttat

SEQ ID NO: 9411761 - DNA, 22 bp, Homo sapiens
aatgtgagccaatgcccgtggg

SEQ ID NO: 9411762 - DNA, 22 bp, Homo sapiens
aatgtgcagatgaataaacaaa

SEQ ID NO: 9411763 - DNA, 22 bp, Homo sapiens
aatgtgcagtgcctgaagcatg

SEQ ID NO: 9411764 - DNA, 22 bp, Homo sapiens
aatgtgcaggctcaaaccttgt

SEQ ID NO: 9411765 - DNA, 22 bp, Homo sapiens
aatgtggccacttttttctggg

SEQ ID NO: 9411766 - DNA, 17 bp, Homo sapiens
aatgtggaagtacatgc

SEQ ID NO: 9411767 - DNA, 23 bp, Homo sapiens
aatgtgctgtattcatttctgga

SEQ ID NO: 9411768 - DNA, 22 bp, Homo sapiens
aatggtttttgcatattcaggt

SEQ ID NO: 9411769 - DNA, 22 bp, Homo sapiens
aatggtttttagtgagatcgat

SEQ ID NO: 9411770 - DNA, 22 bp, Homo sapiens
aatggttttgtctcatcaatgt

SEQ ID NO: 9411771 - DNA, 22 bp, Homo sapiens
aatggttttgctttagtattct

SEQ ID NO: 9411772 - DNA, 22 bp, Homo sapiens
aatggtttttgcatattcaggt

SEQ ID NO: 9411773 - DNA, 22 bp, Homo sapiens
aatgtaaaatatcttgtacttg

SEQ ID NO: 9411774 - DNA, 22 bp, Homo sapiens
aatgtgactgaatatttactct

SEQ ID NO: 9411775 - DNA, 22 bp, Homo sapiens
aatgtgactggagtctcttggc

SEQ ID NO: 9411776 - DNA, 18 bp, Homo sapiens
aatgtgaatatttacttc

SEQ ID NO: 9411777 - DNA, 18 bp, Homo sapiens
aatgtgaatatttacttc

SEQ ID NO: 9411778 - DNA, 18 bp, Homo sapiens
aatgtgaatatttacttc

SEQ ID NO: 9411779 - DNA, 22 bp, Homo sapiens
aatgtgaactttgtcatgtaac

SEQ ID NO: 9411780 - DNA, 22 bp, Homo sapiens
aatgtcttcagtgtatacatgg

SEQ ID NO: 9411781 - DNA, 22 bp, Homo sapiens
aatgtcttcagtgtatacatgg

SEQ ID NO: 9411782 - DNA, 22 bp, Homo sapiens
aatgtcttcagtgtatacatgg

SEQ ID NO: 9411783 - DNA, 22 bp, Homo sapiens
agaggctgtgcccaccaggcaa

SEQ ID NO: 9411784 - DNA, 22 bp, Homo sapiens
agaggctgttacactcccagat

SEQ ID NO: 9411785 - DNA, 22 bp, Homo sapiens
agaggctgttacactcccagat

SEQ ID NO: 9411786 - DNA, 22 bp, Homo sapiens
agaggctgttacactcccagat

SEQ ID NO: 9411787 - DNA, 22 bp, Homo sapiens
agaggctgtgcagagggagtgc

SEQ ID NO: 9411788 - DNA, 22 bp, Homo sapiens
agaggctgtgcagagggagtgc

SEQ ID NO: 9411789 - DNA, 22 bp, Homo sapiens
agaggctgtgcccaccaggcaa

SEQ ID NO: 9411790 - DNA, 22 bp, Homo sapiens
agaggctgtgcccaccaggcaa

SEQ ID NO: 9411791 - DNA, 22 bp, Homo sapiens
acaaagcttagacctaagagat

SEQ ID NO: 9411792 - DNA, 21 bp, Homo sapiens
acaaaggaagtctcttttaag

SEQ ID NO: 9411793 - DNA, 22 bp, Homo sapiens
acaaaggcagagaattcaacat

SEQ ID NO: 9411794 - DNA, 18 bp, Homo sapiens
acaaaggatcatgaggga

SEQ ID NO: 9411795 - DNA, 18 bp, Homo sapiens
acaaaggatcatgaggga

SEQ ID NO: 9411796 - DNA, 20 bp, Homo sapiens
agaggcttccttgggaggag

SEQ ID NO: 9411797 - DNA, 22 bp, Homo sapiens
acaaagaaggaattggtcttta

SEQ ID NO: 9411798 - DNA, 22 bp, Homo sapiens
acaaagaaggaattggtcttta

SEQ ID NO: 9411799 - DNA, 22 bp, Homo sapiens
acaaagaaggaattggtcttta

SEQ ID NO: 9411800 - DNA, 22 bp, Homo sapiens
acaaagaaggaattggtcttta

SEQ ID NO: 9411801 - DNA, 22 bp, Homo sapiens
acaaagtaggtcatcaaagctc

SEQ ID NO: 9411802 - DNA, 22 bp, Homo sapiens
acaaagtagtcaaagtagatga

SEQ ID NO: 9411803 - DNA, 22 bp, Homo sapiens
agagggggaaaatagaggtgtt

SEQ ID NO: 9411804 - DNA, 23 bp, Homo sapiens
acaaagtaattcctgcttccaaa

SEQ ID NO: 9411805 - DNA, 22 bp, Homo sapiens
acaaagtaggaagattagctga

SEQ ID NO: 9411806 - DNA, 18 bp, Homo sapiens
acaaaggtctgcaagacc

SEQ ID NO: 9411807 - DNA, 22 bp, Homo sapiens
acaaagggggactgcagagggt

SEQ ID NO: 9411808 - DNA, 22 bp, Homo sapiens
acaaaggcaggattgacttagt

SEQ ID NO: 9411809 - DNA, 22 bp, Homo sapiens
acaaaggtgagcagaagacaca

SEQ ID NO: 9411810 - DNA, 18 bp, Homo sapiens
acaaaggtctgcaagacc

SEQ ID NO: 9411811 - DNA, 22 bp, Homo sapiens
acaaagtaagggctaatgagca

SEQ ID NO: 9411812 - DNA, 22 bp, Homo sapiens
acaaagtaagggctaatgagca

SEQ ID NO: 9411813 - DNA, 22 bp, Homo sapiens
agagggggaaaatagaggtgtt

SEQ ID NO: 9411814 - DNA, 22 bp, Homo sapiens
agagggggaaaatagaggtgtt

SEQ ID NO: 9411815 - DNA, 22 bp, Homo sapiens
agagggggcagcggaccagtga

SEQ ID NO: 9411816 - DNA, 22 bp, Homo sapiens
agagggggcagcggaccagtga

SEQ ID NO: 9411817 - DNA, 22 bp, Homo sapiens
agagggggcagcggaccagtga

SEQ ID NO: 9411818 - DNA, 22 bp, Homo sapiens
agagggggcagcggaccagtga

SEQ ID NO: 9411819 - DNA, 22 bp, Homo sapiens
agagggggtgtcagcactgcag

SEQ ID NO: 9411820 - DNA, 22 bp, Homo sapiens
agagggggtgtcagcactgcag

SEQ ID NO: 9411821 - DNA, 22 bp, Homo sapiens
agagggggtgtcagcactgcag

SEQ ID NO: 9411822 - DNA, 22 bp, Homo sapiens
agagggggtgtcagcactgcag

SEQ ID NO: 9411823 - DNA, 22 bp, Homo sapiens
agagggggtgttccagaagcat

SEQ ID NO: 9411824 - DNA, 22 bp, Homo sapiens
agaggggtgggcacagcgccca

SEQ ID NO: 9411825 - DNA, 22 bp, Homo sapiens
agaggggtgggcacagcgccca

SEQ ID NO: 9411826 - DNA, 22 bp, Homo sapiens
agagggggtgttccagaagcat

SEQ ID NO: 9411827 - DNA, 22 bp, Homo sapiens
aattcttaatcccataaagtga

SEQ ID NO: 9411828 - DNA, 22 bp, Homo sapiens
aattcttaatcccataaagtga

SEQ ID NO: 9411829 - DNA, 22 bp, Homo sapiens
aattcttaatcccataaagtga

SEQ ID NO: 9411830 - DNA, 22 bp, Homo sapiens
aattctgtgcaggcagagctat

SEQ ID NO: 9411831 - DNA, 19 bp, Homo sapiens
aattctgtttcagcagatc

SEQ ID NO: 9411832 - DNA, 22 bp, Homo sapiens
aattctgttactaatgtgatgt

SEQ ID NO: 9411833 - DNA, 22 bp, Homo sapiens
aattctgtaactttactgaatt

SEQ ID NO: 9411834 - DNA, 22 bp, Homo sapiens
aattctgtaaagcttgtcatgc

SEQ ID NO: 9411835 - DNA, 20 bp, Homo sapiens
aattctgtcttttctgctgc

SEQ ID NO: 9411836 - DNA, 22 bp, Homo sapiens
aattctgtaactttactgaatt

SEQ ID NO: 9411837 - DNA, 22 bp, Homo sapiens
aattgaacaagtaatagaagag

SEQ ID NO: 9411838 - DNA, 22 bp, Homo sapiens
aattgaaaatattgtagaccat

SEQ ID NO: 9411839 - DNA, 22 bp, Homo sapiens
aattcttgttgttagtatattt

SEQ ID NO: 9411840 - DNA, 22 bp, Homo sapiens
aattgagtgctagacatcatga

SEQ ID NO: 9411841 - DNA, 22 bp, Homo sapiens
aattgatgtaaggaagacttag

SEQ ID NO: 9411842 - DNA, 22 bp, Homo sapiens
aattgatgggcactgaaatatt

SEQ ID NO: 9411843 - DNA, 22 bp, Homo sapiens
aattgatggacagagatgaaga

SEQ ID NO: 9411844 - DNA, 22 bp, Homo sapiens
aattgcaacaggtagacttttc

SEQ ID NO: 9411845 - DNA, 22 bp, Homo sapiens
aattgcaacaggtagacttttc

SEQ ID NO: 9411846 - DNA, 22 bp, Homo sapiens
aattgcaggcaccagcaggagc

SEQ ID NO: 9411847 - DNA, 22 bp, Homo sapiens
aattgcactttagcaatggtga

SEQ ID NO: 9411848 - DNA, 22 bp, Homo sapiens
aattgcaattttcttaaggtct

SEQ ID NO: 9411849 - DNA, 22 bp, Homo sapiens
aattgcaacaggtagacttttc

SEQ ID NO: 9411850 - DNA, 22 bp, Homo sapiens
aattgcataaaattcaactctg

SEQ ID NO: 9411851 - DNA, 22 bp, Homo sapiens
aattgcacatttcagtgttctg

SEQ ID NO: 9411852 - DNA, 22 bp, Homo sapiens
aattgcagcagcttcagcagtt

SEQ ID NO: 9411853 - DNA, 22 bp, Homo sapiens
aattgcatgttaatgactaagt

SEQ ID NO: 9411854 - DNA, 22 bp, Homo sapiens
aattgcttagttgcaactatgc

SEQ ID NO: 9411855 - DNA, 22 bp, Homo sapiens
aattgcttcattaacatttagg

SEQ ID NO: 9411856 - DNA, 22 bp, Homo sapiens
agaggccctctctctcctgatg

SEQ ID NO: 9411857 - DNA, 22 bp, Homo sapiens
agaggctctttgagctgggaga

SEQ ID NO: 9411858 - DNA, 22 bp, Homo sapiens
agaggctcttgcccttcccaca

SEQ ID NO: 9411859 - DNA, 22 bp, Homo sapiens
agaggctctttgagctgggaga

SEQ ID NO: 9411860 - DNA, 22 bp, Homo sapiens
agaggctctggtgcagcatgca

SEQ ID NO: 9411861 - DNA, 22 bp, Homo sapiens
agaggctctggtgcagcatgca

SEQ ID NO: 9411862 - DNA, 22 bp, Homo sapiens
agaggctctgccgcctcaggta

SEQ ID NO: 9411863 - DNA, 22 bp, Homo sapiens
agaggctctgccgcctcaggta

SEQ ID NO: 9411864 - DNA, 22 bp, Homo sapiens
agaggctctaataccagcatgg

SEQ ID NO: 9411865 - DNA, 22 bp, Homo sapiens
agaggctctaatcccctccaca

SEQ ID NO: 9411866 - DNA, 22 bp, Homo sapiens
acaagcagagattaaatgtttt

SEQ ID NO: 9411867 - DNA, 22 bp, Homo sapiens
acaagcagaaggtggggtctta

SEQ ID NO: 9411868 - DNA, 22 bp, Homo sapiens
acaagatttaatgcaacccaag

SEQ ID NO: 9411869 - DNA, 22 bp, Homo sapiens
acaagattcaatgaattgattg

SEQ ID NO: 9411870 - DNA, 22 bp, Homo sapiens
acaagattcaatgaattgattg

SEQ ID NO: 9411871 - DNA, 22 bp, Homo sapiens
acaagatggaatattgagaaaa

SEQ ID NO: 9411872 - DNA, 22 bp, Homo sapiens
acaagatggaatattgagaaaa

SEQ ID NO: 9411873 - DNA, 22 bp, Homo sapiens
acaagataggttgagtctagcc

SEQ ID NO: 9411874 - DNA, 22 bp, Homo sapiens
acaagatagcttagaagattca

SEQ ID NO: 9411875 - DNA, 22 bp, Homo sapiens
acaagatagcttagaagattca

SEQ ID NO: 9411876 - DNA, 22 bp, Homo sapiens
acaagctccttattcagctggg

SEQ ID NO: 9411877 - DNA, 22 bp, Homo sapiens
acaagctgtggtgggacaagag

SEQ ID NO: 9411878 - DNA, 22 bp, Homo sapiens
acaatcacacatgcaattatac

SEQ ID NO: 9411879 - DNA, 22 bp, Homo sapiens
acaatagacaaagtgaatggct

SEQ ID NO: 9411880 - DNA, 22 bp, Homo sapiens
acaatagacaaagtgaatggct

SEQ ID NO: 9411881 - DNA, 22 bp, Homo sapiens
acaatagaaggaaactgacata

SEQ ID NO: 9411882 - DNA, 21 bp, Homo sapiens
acaatagaatagagtgtggtg

SEQ ID NO: 9411883 - DNA, 22 bp, Homo sapiens
acaatagacaaagtgaatggct

SEQ ID NO: 9411884 - DNA, 17 bp, Homo sapiens
acaagcagtggccatgg

SEQ ID NO: 9411885 - DNA, 22 bp, Homo sapiens
acaagcagtaaaggccacagtc

SEQ ID NO: 9411886 - DNA, 22 bp, Homo sapiens
acaagcataagtgagatgaata

SEQ ID NO: 9411887 - DNA, 17 bp, Homo sapiens
acaagcagtggccatgg

SEQ ID NO: 9411888 - DNA, 22 bp, Homo sapiens
acaagcataagtgagatgaata

SEQ ID NO: 9411889 - DNA, 22 bp, Homo sapiens
acaatgattttttagagtagtt

SEQ ID NO: 9411890 - DNA, 22 bp, Homo sapiens
acaatgcaataggagctagaaa

SEQ ID NO: 9411891 - DNA, 22 bp, Homo sapiens
acaatgcaattgtaaggtgtgt

SEQ ID NO: 9411892 - DNA, 22 bp, Homo sapiens
acaatgatgcagatgagtaaga

SEQ ID NO: 9411893 - DNA, 19 bp, Homo sapiens
acaatgaatgtgttctctt

SEQ ID NO: 9411894 - DNA, 22 bp, Homo sapiens
acaatgaatttaataccttatt

SEQ ID NO: 9411895 - DNA, 22 bp, Homo sapiens
acaatgaatttaataccttatt

SEQ ID NO: 9411896 - DNA, 22 bp, Homo sapiens
acaatgaagataatgttgcagt

SEQ ID NO: 9411897 - DNA, 22 bp, Homo sapiens
acaatgaagggagacacttgct

SEQ ID NO: 9411898 - DNA, 22 bp, Homo sapiens
acaatgaagctccactgagctt

SEQ ID NO: 9411899 - DNA, 19 bp, Homo sapiens
acaatgaatgtgttctctt

SEQ ID NO: 9411900 - DNA, 22 bp, Homo sapiens
acaatgaatatcatgaagtact

SEQ ID NO: 9411901 - DNA, 22 bp, Homo sapiens
acaatgaatatcatgaagtact

SEQ ID NO: 9411902 - DNA, 22 bp, Homo sapiens
acaatgaatactaagcaccagg

SEQ ID NO: 9411903 - DNA, 22 bp, Homo sapiens
acaatcattccgttcacaacag

SEQ ID NO: 9411904 - DNA, 22 bp, Homo sapiens
acaatcattccgttcacaacag

SEQ ID NO: 9411905 - DNA, 22 bp, Homo sapiens
acaatcattccgttcacaacag

SEQ ID NO: 9411906 - DNA, 22 bp, Homo sapiens
acaatcattggcttcattacaa

SEQ ID NO: 9411907 - DNA, 22 bp, Homo sapiens
acaatcttattagtagtataga

SEQ ID NO: 9411908 - DNA, 22 bp, Homo sapiens
acaatgaaaaaatttactgtgg

SEQ ID NO: 9411909 - DNA, 22 bp, Homo sapiens
acaatcttattagtagtataga

SEQ ID NO: 9411910 - DNA, 22 bp, Homo sapiens
acaatgaaaaaatttactgtgg

SEQ ID NO: 9411911 - DNA, 22 bp, Homo sapiens
acaatgaacacacaaggaattc

SEQ ID NO: 9411912 - DNA, 22 bp, Homo sapiens
acaatgaaaggtattctgaact

SEQ ID NO: 9411913 - DNA, 22 bp, Homo sapiens
acaatgaaaggtattctgaact

SEQ ID NO: 9411914 - DNA, 22 bp, Homo sapiens
acaatgaaccaaatttaccaat

SEQ ID NO: 9411915 - DNA, 22 bp, Homo sapiens
acaatgaacacacaaggaattc

SEQ ID NO: 9411916 - DNA, 22 bp, Homo sapiens
acaatgaacgctttttaactgt

SEQ ID NO: 9411917 - DNA, 22 bp, Homo sapiens
acaatgaacgctttttaactgt

SEQ ID NO: 9411918 - DNA, 22 bp, Homo sapiens
acaatgaacgctttttaactgt

SEQ ID NO: 9411919 - DNA, 22 bp, Homo sapiens
acaagatactcagctacaagac

SEQ ID NO: 9411920 - DNA, 22 bp, Homo sapiens
acaagagtctgcatttctaaca

SEQ ID NO: 9411921 - DNA, 22 bp, Homo sapiens
acaagagcattgcaggtgtgtt

SEQ ID NO: 9411922 - DNA, 22 bp, Homo sapiens
acaagagtatctttgactttag

SEQ ID NO: 9411923 - DNA, 22 bp, Homo sapiens
acaagagtaatttcaacagagt

SEQ ID NO: 9411924 - DNA, 22 bp, Homo sapiens
acaagagtagacagccttcttt

SEQ ID NO: 9411925 - DNA, 22 bp, Homo sapiens
acaagagattatctacagatga

SEQ ID NO: 9411926 - DNA, 22 bp, Homo sapiens
agataatgaatgccatgacatt

SEQ ID NO: 9411927 - DNA, 22 bp, Homo sapiens
agataataagtctggtaataat

SEQ ID NO: 9411928 - DNA, 22 bp, Homo sapiens
agataatggagggatttgcatt

SEQ ID NO: 9411929 - DNA, 22 bp, Homo sapiens
agataatgaatttattgaatgt

SEQ ID NO: 9411930 - DNA, 22 bp, Homo sapiens
acaactagcaggtattaatttt

SEQ ID NO: 9411931 - DNA, 22 bp, Homo sapiens
acaaccttctggagatatctgt

SEQ ID NO: 9411932 - DNA, 22 bp, Homo sapiens
acaaccttctggagatatctgt

SEQ ID NO: 9411933 - DNA, 17 bp, Homo sapiens
agataagcttcagagct

SEQ ID NO: 9411934 - DNA, 22 bp, Homo sapiens
agataataaatgttttaggttt

SEQ ID NO: 9411935 - DNA, 22 bp, Homo sapiens
agataagatagtccagcacaat

SEQ ID NO: 9411936 - DNA, 22 bp, Homo sapiens
agataagctgtttttcaagaat

SEQ ID NO: 9411937 - DNA, 19 bp, Homo sapiens
agataagagttgactgtgg

SEQ ID NO: 9411938 - DNA, 22 bp, Homo sapiens
agataacttttgggtattcatg

SEQ ID NO: 9411939 - DNA, 22 bp, Homo sapiens
agataacttttgggtattcatg

SEQ ID NO: 9411940 - DNA, 22 bp, Homo sapiens
agataactggtttacattattg

SEQ ID NO: 9411941 - DNA, 22 bp, Homo sapiens
acaacaaggcttttcattcata

SEQ ID NO: 9411942 - DNA, 22 bp, Homo sapiens
acaacaaagacacttgaaatga

SEQ ID NO: 9411943 - DNA, 22 bp, Homo sapiens
acaacaaagacacttgaaatga

SEQ ID NO: 9411944 - DNA, 22 bp, Homo sapiens
acaacaaagacacttgaaatga

SEQ ID NO: 9411945 - DNA, 22 bp, Homo sapiens
acaacaatctaccctagcttct

SEQ ID NO: 9411946 - DNA, 22 bp, Homo sapiens
acaacaatctaccctagcttct

SEQ ID NO: 9411947 - DNA, 22 bp, Homo sapiens
acaacaatctaccctagcttct

SEQ ID NO: 9411948 - DNA, 20 bp, Homo sapiens
acaaattggcagaatgacaa

SEQ ID NO: 9411949 - DNA, 20 bp, Homo sapiens
acaacaaacttgcttaagga

SEQ ID NO: 9411950 - DNA, 22 bp, Homo sapiens
agaggggttaagtgctagtccg

SEQ ID NO: 9411951 - DNA, 22 bp, Homo sapiens
acaaattgcctagtctagcatc

SEQ ID NO: 9411952 - DNA, 19 bp, Homo sapiens
acaaattggcaaaatgcaa

SEQ ID NO: 9411953 - DNA, 22 bp, Homo sapiens
acaaattgccccattttgaact

SEQ ID NO: 9411954 - DNA, 22 bp, Homo sapiens
acaacagagctggactgagagg

SEQ ID NO: 9411955 - DNA, 22 bp, Homo sapiens
agataaattcctaagatttcag

SEQ ID NO: 9411956 - DNA, 22 bp, Homo sapiens
agataaattcctaagatttcag

SEQ ID NO: 9411957 - DNA, 22 bp, Homo sapiens
agataaattcctaagatttcag

SEQ ID NO: 9411958 - DNA, 22 bp, Homo sapiens
agataaattcctaagatttcag

SEQ ID NO: 9411959 - DNA, 22 bp, Homo sapiens
agataacatttattgaatgtaa

SEQ ID NO: 9411960 - DNA, 22 bp, Homo sapiens
agataacatttattgaatgtaa

SEQ ID NO: 9411961 - DNA, 22 bp, Homo sapiens
agataactcattttgtatatcc

SEQ ID NO: 9411962 - DNA, 22 bp, Homo sapiens
acaacagagctggactgagagg

SEQ ID NO: 9411963 - DNA, 17 bp, Homo sapiens
acaacagaaatgtattc

SEQ ID NO: 9411964 - DNA, 22 bp, Homo sapiens
acaacacatgtgtatatgtgtg

SEQ ID NO: 9411965 - DNA, 17 bp, Homo sapiens
acaacagaaatgtattc

SEQ ID NO: 9411966 - DNA, 22 bp, Homo sapiens
acaacacagctttcctcaagtt

SEQ ID NO: 9411967 - DNA, 22 bp, Homo sapiens
acaacacagctttcctcaagtt

SEQ ID NO: 9411968 - DNA, 22 bp, Homo sapiens
acaacacatgtgtatatgtgtg

SEQ ID NO: 9411969 - DNA, 22 bp, Homo sapiens
aaggagagtacaggagttggta

SEQ ID NO: 9411970 - DNA, 22 bp, Homo sapiens
aaggagagtacaggagttggta

SEQ ID NO: 9411971 - DNA, 22 bp, Homo sapiens
aaggagcacacaatctagaacc

SEQ ID NO: 9411972 - DNA, 22 bp, Homo sapiens
aaggagattgttaaagctatat

SEQ ID NO: 9411973 - DNA, 22 bp, Homo sapiens
aaggagctgggagggacacatg

SEQ ID NO: 9411974 - DNA, 22 bp, Homo sapiens
aaggagctgggagggacacatg

SEQ ID NO: 9411975 - DNA, 22 bp, Homo sapiens
aaggagcttgttcgccttcctc

SEQ ID NO: 9411976 - DNA, 22 bp, Homo sapiens
aaggagctgggagggacacatg

SEQ ID NO: 9411977 - DNA, 22 bp, Homo sapiens
aaggagctttcattacagcctt

SEQ ID NO: 9411978 - DNA, 22 bp, Homo sapiens
aaggagcgcttagggggcagaa

SEQ ID NO: 9411979 - DNA, 22 bp, Homo sapiens
aaggagctcttaaaatcagaga

SEQ ID NO: 9411980 - DNA, 22 bp, Homo sapiens
aaggagctcccggcagaccagg

SEQ ID NO: 9411981 - DNA, 22 bp, Homo sapiens
aaggagacatttgcagagcacc

SEQ ID NO: 9411982 - DNA, 22 bp, Homo sapiens
aaggagaatttggcttgtgatg

SEQ ID NO: 9411983 - DNA, 20 bp, Homo sapiens
aaggagaatgacacggctgc

SEQ ID NO: 9411984 - DNA, 22 bp, Homo sapiens
aaggacaggctaacctgacatt

SEQ ID NO: 9411985 - DNA, 22 bp, Homo sapiens
aagctggacactgacccactgt

SEQ ID NO: 9411986 - DNA, 22 bp, Homo sapiens
aagctggactctgccatttact

SEQ ID NO: 9411987 - DNA, 20 bp, Homo sapiens
aagctggaagaccagcattg

SEQ ID NO: 9411988 - DNA, 22 bp, Homo sapiens
aaggacaggcacagtggtggag

SEQ ID NO: 9411989 - DNA, 22 bp, Homo sapiens
aaggacaggcacagtggtggag

SEQ ID NO: 9411990 - DNA, 22 bp, Homo sapiens
aaggacaggctaacctgacatt

SEQ ID NO: 9411991 - DNA, 22 bp, Homo sapiens
aaggacaggctaacctgacatt

SEQ ID NO: 9411992 - DNA, 22 bp, Homo sapiens
aaggaggaataaagaggtggtg

SEQ ID NO: 9411993 - DNA, 22 bp, Homo sapiens
aaggaggaataaagaggtggtg

SEQ ID NO: 9411994 - DNA, 22 bp, Homo sapiens
aaggaggaataaagaggtggtg

SEQ ID NO: 9411995 - DNA, 19 bp, Homo sapiens
acagtcttacaaatgtcca

SEQ ID NO: 9411996 - DNA, 22 bp, Homo sapiens
acagtcttaatggataggagct

SEQ ID NO: 9411997 - DNA, 22 bp, Homo sapiens
acagtcttaatggataggagct

SEQ ID NO: 9411998 - DNA, 22 bp, Homo sapiens
aaggaggaataaagaggtggtg

SEQ ID NO: 9411999 - DNA, 22 bp, Homo sapiens
acagtcttatgcatacactatt

SEQ ID NO: 9412000 - DNA, 22 bp, Homo sapiens
acagtcttatgcatacactatt

SEQ ID NO: 9412001 - DNA, 22 bp, Homo sapiens
acagtcttatgcatacactatt

SEQ ID NO: 9412002 - DNA, 22 bp, Homo sapiens
acagtcttcatgctagaatggc

SEQ ID NO: 9412003 - DNA, 22 bp, Homo sapiens
acagtcttcatgctagaatggc

SEQ ID NO: 9412004 - DNA, 22 bp, Homo sapiens
acagtcttcccttattccactc

SEQ ID NO: 9412005 - DNA, 22 bp, Homo sapiens
acagtcttgagcatcagccaga

SEQ ID NO: 9412006 - DNA, 22 bp, Homo sapiens
acagtctttaatttctttgtgg

SEQ ID NO: 9412007 - DNA, 22 bp, Homo sapiens
acagtcttgcacttctatcagc

SEQ ID NO: 9412008 - DNA, 22 bp, Homo sapiens
acagtctttcagtaataatact

SEQ ID NO: 9412009 - DNA, 22 bp, Homo sapiens
acagtctttcagtaataatact

SEQ ID NO: 9412010 - DNA, 22 bp, Homo sapiens
acagtctttcagtaataatact

SEQ ID NO: 9412011 - DNA, 22 bp, Homo sapiens
acagtctttaatttctttgtgg

SEQ ID NO: 9412012 - DNA, 22 bp, Homo sapiens
acagtctttagagtattgtcct

SEQ ID NO: 9412013 - DNA, 22 bp, Homo sapiens
acagtctttaatttctttgtgg

SEQ ID NO: 9412014 - DNA, 22 bp, Homo sapiens
acagtctttaatttctttgtgg

SEQ ID NO: 9412015 - DNA, 17 bp, Homo sapiens
acagtgtctatgaaatg

SEQ ID NO: 9412016 - DNA, 16 bp, Homo sapiens
acagtgtctcaagcac

SEQ ID NO: 9412017 - DNA, 22 bp, Homo sapiens
acagtgtctcactgctgaaatc

SEQ ID NO: 9412018 - DNA, 22 bp, Homo sapiens
acagtgtttaaaaatcagatct

SEQ ID NO: 9412019 - DNA, 22 bp, Homo sapiens
aaggaggcactcgctctcaggg

SEQ ID NO: 9412020 - DNA, 23 bp, Homo sapiens
acatagaacagaatatatttgtg

SEQ ID NO: 9412021 - DNA, 22 bp, Homo sapiens
aaggaggcagaactcacatgga

SEQ ID NO: 9412022 - DNA, 20 bp, Homo sapiens
acatatgaatgatagagcca

SEQ ID NO: 9412023 - DNA, 22 bp, Homo sapiens
acatatgaggtgttattctatg

SEQ ID NO: 9412024 - DNA, 22 bp, Homo sapiens
aaggaggacacccaggactggg

SEQ ID NO: 9412025 - DNA, 22 bp, Homo sapiens
aaggaggagcggaggcttgttg

SEQ ID NO: 9412026 - DNA, 22 bp, Homo sapiens
aaggaggagtggggtcctggaa

SEQ ID NO: 9412027 - DNA, 22 bp, Homo sapiens
aaggaggagtggggtcctggaa

SEQ ID NO: 9412028 - DNA, 22 bp, Homo sapiens
aaggaggagcggaggcttgttg

SEQ ID NO: 9412029 - DNA, 22 bp, Homo sapiens
aaggaggcactcgctctcaggg

SEQ ID NO: 9412030 - DNA, 22 bp, Homo sapiens
aaggaggcaccctgagcctgcc

SEQ ID NO: 9412031 - DNA, 22 bp, Homo sapiens
aaggaggacacccaggactggg

SEQ ID NO: 9412032 - DNA, 22 bp, Homo sapiens
aaggaggacacccaggactggg

SEQ ID NO: 9412033 - DNA, 22 bp, Homo sapiens
aaggaggacacccaggactggg

SEQ ID NO: 9412034 - DNA, 22 bp, Homo sapiens
aaggaggaattctgagttcatg

SEQ ID NO: 9412035 - DNA, 22 bp, Homo sapiens
aaggaggaattctgagttcatg

SEQ ID NO: 9412036 - DNA, 22 bp, Homo sapiens
aaggaggaattctgagttcatg

SEQ ID NO: 9412037 - DNA, 22 bp, Homo sapiens
aaggaggaatttcagggtgaat

SEQ ID NO: 9412038 - DNA, 22 bp, Homo sapiens
aaggaggaatttcagggtgaat

SEQ ID NO: 9412039 - DNA, 22 bp, Homo sapiens
aaggaggaatttcagggtgaat

SEQ ID NO: 9412040 - DNA, 22 bp, Homo sapiens
acatatgtgttgtacatgcatg

SEQ ID NO: 9412041 - DNA, 19 bp, Homo sapiens
acatatgtggatatacatg

SEQ ID NO: 9412042 - DNA, 22 bp, Homo sapiens
acatatgtgtctgcacatgccc

SEQ ID NO: 9412043 - DNA, 22 bp, Homo sapiens
acatatgtgcttatatccatga

SEQ ID NO: 9412044 - DNA, 22 bp, Homo sapiens
acatatgtctatttcatgtaaa

SEQ ID NO: 9412045 - DNA, 19 bp, Homo sapiens
acatatgtggatatacatg

SEQ ID NO: 9412046 - DNA, 22 bp, Homo sapiens
acatatgtgcttatatccatga

SEQ ID NO: 9412047 - DNA, 22 bp, Homo sapiens
acatatgtatatgtacacagtc

SEQ ID NO: 9412048 - DNA, 22 bp, Homo sapiens
acatatgtatatgtacacagtc

SEQ ID NO: 9412049 - DNA, 22 bp, Homo sapiens
acatatgtatatgtacacagtc

SEQ ID NO: 9412050 - DNA, 22 bp, Homo sapiens
acatatgcgatcataggatgca

SEQ ID NO: 9412051 - DNA, 22 bp, Homo sapiens
acatatgctcatctgcattccc

SEQ ID NO: 9412052 - DNA, 22 bp, Homo sapiens
acatatgatattgaggatctca

SEQ ID NO: 9412053 - DNA, 22 bp, Homo sapiens
acatatgagtactatacagtgc

SEQ ID NO: 9412054 - DNA, 22 bp, Homo sapiens
acatatgtgttgtacatgcatg

SEQ ID NO: 9412055 - DNA, 22 bp, Homo sapiens
acatatgtgttgtacatgcatg

SEQ ID NO: 9412056 - DNA, 22 bp, Homo sapiens
aaggcagagattagcagaatga

SEQ ID NO: 9412057 - DNA, 22 bp, Homo sapiens
aaggcagagattagcagaatga

SEQ ID NO: 9412058 - DNA, 22 bp, Homo sapiens
aaggcagagattagcagaatga

SEQ ID NO: 9412059 - DNA, 22 bp, Homo sapiens
aaggcagaggaaggtctagttt

SEQ ID NO: 9412060 - DNA, 22 bp, Homo sapiens
aaggcagaggaaggtctagttt

SEQ ID NO: 9412061 - DNA, 22 bp, Homo sapiens
aaggcagagtctatcttggaag

SEQ ID NO: 9412062 - DNA, 22 bp, Homo sapiens
aaggcagagtctatcttggaag

SEQ ID NO: 9412063 - DNA, 22 bp, Homo sapiens
aaggcagagggctggatcagag

SEQ ID NO: 9412064 - DNA, 22 bp, Homo sapiens
aaggcagagggctggatcagag

SEQ ID NO: 9412065 - DNA, 19 bp, Homo sapiens
acagggcagcaataggata

SEQ ID NO: 9412066 - DNA, 22 bp, Homo sapiens
aagctgcctgggaggaagggct

SEQ ID NO: 9412067 - DNA, 22 bp, Homo sapiens
aagctgcctgccacgctagata

SEQ ID NO: 9412068 - DNA, 22 bp, Homo sapiens
aagctgcctagagttgaatgtc

SEQ ID NO: 9412069 - DNA, 22 bp, Homo sapiens
aagctgccctcattcccagtgc

SEQ ID NO: 9412070 - DNA, 22 bp, Homo sapiens
aagctgctggtgactgggctga

SEQ ID NO: 9412071 - DNA, 22 bp, Homo sapiens
aagctgctggtgactgggctga

SEQ ID NO: 9412072 - DNA, 23 bp, Homo sapiens
aagctgccttcgcagttggtctg

SEQ ID NO: 9412073 - DNA, 22 bp, Homo sapiens
aagctgccttccatgtgaggaa

SEQ ID NO: 9412074 - DNA, 22 bp, Homo sapiens
aagctgcctgggaggaagggct

SEQ ID NO: 9412075 - DNA, 22 bp, Homo sapiens
acagggcagagggcagttggta

SEQ ID NO: 9412076 - DNA, 22 bp, Homo sapiens
acagggcagagaggcaggcttg

SEQ ID NO: 9412077 - DNA, 22 bp, Homo sapiens
acagggcagcaactttgtgcct

SEQ ID NO: 9412078 - DNA, 19 bp, Homo sapiens
acagggcagcaataggata

SEQ ID NO: 9412079 - DNA, 22 bp, Homo sapiens
acagggcagagaggcaggcttg

SEQ ID NO: 9412080 - DNA, 17 bp, Homo sapiens
acagggcagaaacagct

SEQ ID NO: 9412081 - DNA, 22 bp, Homo sapiens
acagggcagaaatgttgcatct

SEQ ID NO: 9412082 - DNA, 17 bp, Homo sapiens
acagggcagaaacagct

SEQ ID NO: 9412083 - DNA, 17 bp, Homo sapiens
acagggcagaaacagct

SEQ ID NO: 9412084 - DNA, 17 bp, Homo sapiens
acagggcagaaacagct

SEQ ID NO: 9412085 - DNA, 22 bp, Homo sapiens
acagggaaagggacagcagcag

SEQ ID NO: 9412086 - DNA, 22 bp, Homo sapiens
acagggaacaggaatatacaaa

SEQ ID NO: 9412087 - DNA, 23 bp, Homo sapiens
acagggaaaagtcatcagtgtga

SEQ ID NO: 9412088 - DNA, 22 bp, Homo sapiens
acagggaaagggacagcagcag

SEQ ID NO: 9412089 - DNA, 22 bp, Homo sapiens
acagggaaagggacagcagcag

SEQ ID NO: 9412090 - DNA, 18 bp, Homo sapiens
aagctctggctaggaaaa

SEQ ID NO: 9412091 - DNA, 22 bp, Homo sapiens
aagctctgtagctcatgtgata

SEQ ID NO: 9412092 - DNA, 22 bp, Homo sapiens
aagctctgctcagcagactagg

SEQ ID NO: 9412093 - DNA, 22 bp, Homo sapiens
aagctctgctcagcagactagg

SEQ ID NO: 9412094 - DNA, 22 bp, Homo sapiens
aagctctgctcagcagactagg

SEQ ID NO: 9412095 - DNA, 22 bp, Homo sapiens
aagctctgatacttcctacctg

SEQ ID NO: 9412096 - DNA, 22 bp, Homo sapiens
aagctctgctcatgatgacgtt

SEQ ID NO: 9412097 - DNA, 22 bp, Homo sapiens
aagctcagtgatgcctccaggg

SEQ ID NO: 9412098 - DNA, 22 bp, Homo sapiens
aagctccccgaaacccacctct

SEQ ID NO: 9412099 - DNA, 22 bp, Homo sapiens
aagctccccgaaacccacctct

SEQ ID NO: 9412100 - DNA, 22 bp, Homo sapiens
aagctctgaggtgagcaatcgg

SEQ ID NO: 9412101 - DNA, 18 bp, Homo sapiens
aagctcattctcttccta

SEQ ID NO: 9412102 - DNA, 22 bp, Homo sapiens
aagctcagagtagctcagcgtc

SEQ ID NO: 9412103 - DNA, 22 bp, Homo sapiens
aagctcagagtagctcagcgtc

SEQ ID NO: 9412104 - DNA, 22 bp, Homo sapiens
aagctcagcagccaggccctgt

SEQ ID NO: 9412105 - DNA, 22 bp, Homo sapiens
aagctcagagtctcggagggaa

SEQ ID NO: 9412106 - DNA, 22 bp, Homo sapiens
aagctacaatgtgtttttgaaa

SEQ ID NO: 9412107 - DNA, 22 bp, Homo sapiens
aagctaatagccagttttcttc

SEQ ID NO: 9412108 - DNA, 22 bp, Homo sapiens
aagctacaatgtgtttttgaaa

SEQ ID NO: 9412109 - DNA, 23 bp, Homo sapiens
aagcgtcttttcaatgtggctgg

SEQ ID NO: 9412110 - DNA, 19 bp, Homo sapiens
aagcgtttcccacttgctt

SEQ ID NO: 9412111 - DNA, 22 bp, Homo sapiens
aagcgttggcctcccctgatga

SEQ ID NO: 9412112 - DNA, 22 bp, Homo sapiens
aagctagataacttttatattt

SEQ ID NO: 9412113 - DNA, 21 bp, Homo sapiens
aagctacagaaaataatttga

SEQ ID NO: 9412114 - DNA, 22 bp, Homo sapiens
aagctaggcctcagtttcctga

SEQ ID NO: 9412115 - DNA, 22 bp, Homo sapiens
aagctagattggcattcatttc

SEQ ID NO: 9412116 - DNA, 22 bp, Homo sapiens
aagccaaggttttggtcacagc

SEQ ID NO: 9412117 - DNA, 22 bp, Homo sapiens
aagccaaggttttggtcacagc

SEQ ID NO: 9412118 - DNA, 22 bp, Homo sapiens
aagccaaggagaatggcctcag

SEQ ID NO: 9412119 - DNA, 22 bp, Homo sapiens
aagccctgggatgttcagcagt

SEQ ID NO: 9412120 - DNA, 22 bp, Homo sapiens
aagccaacatgattactataat

SEQ ID NO: 9412121 - DNA, 22 bp, Homo sapiens
aagccaaataatgtaggtacat

SEQ ID NO: 9412122 - DNA, 22 bp, Homo sapiens
aagccaaaggctccagtgacct

SEQ ID NO: 9412123 - DNA, 22 bp, Homo sapiens
aagccctggggttgcacaaggc

SEQ ID NO: 9412124 - DNA, 22 bp, Homo sapiens
aagcgcagacacagagagtgga

SEQ ID NO: 9412125 - DNA, 22 bp, Homo sapiens
aagcgccatggttcctgcgcag

SEQ ID NO: 9412126 - DNA, 22 bp, Homo sapiens
aagcgcaatcttttctgtcttt

SEQ ID NO: 9412127 - DNA, 22 bp, Homo sapiens
aagcatttttcacagcaacagc

SEQ ID NO: 9412128 - DNA, 22 bp, Homo sapiens
aagcattttgttttaagaatga

SEQ ID NO: 9412129 - DNA, 22 bp, Homo sapiens
aagcattttgttttaagaatga

SEQ ID NO: 9412130 - DNA, 22 bp, Homo sapiens
aagcattttgttttaagaatga

SEQ ID NO: 9412131 - DNA, 22 bp, Homo sapiens
aagcattttagataaagcatca

SEQ ID NO: 9412132 - DNA, 22 bp, Homo sapiens
aagcattttagataaagcatca

SEQ ID NO: 9412133 - DNA, 22 bp, Homo sapiens
aagcatttgtgaaattcagatg

SEQ ID NO: 9412134 - DNA, 22 bp, Homo sapiens
aagcattttagataaagcatca

SEQ ID NO: 9412135 - DNA, 22 bp, Homo sapiens
aagcattttagataaagcatca

SEQ ID NO: 9412136 - DNA, 22 bp, Homo sapiens
aagcattttagtaatgaacttg

SEQ ID NO: 9412137 - DNA, 22 bp, Homo sapiens
aagcattttagtaatgaacttg

SEQ ID NO: 9412138 - DNA, 19 bp, Homo sapiens
acagcctgttggtggggct

SEQ ID NO: 9412139 - DNA, 22 bp, Homo sapiens
acagcctgtttgatctggtgct

SEQ ID NO: 9412140 - DNA, 22 bp, Homo sapiens
acagcctgtttgatctggtgct

SEQ ID NO: 9412141 - DNA, 22 bp, Homo sapiens
acagcctgtttgatctggtgct

SEQ ID NO: 9412142 - DNA, 22 bp, Homo sapiens
acagcctgtttgatctggtgct

SEQ ID NO: 9412143 - DNA, 19 bp, Homo sapiens
acagcctgttggtggggct

SEQ ID NO: 9412144 - DNA, 22 bp, Homo sapiens
acagcctgtgtaccagctggga

SEQ ID NO: 9412145 - DNA, 22 bp, Homo sapiens
acagcctgtgtaccagctggga

SEQ ID NO: 9412146 - DNA, 21 bp, Homo sapiens
acagcctgtcatctcatggtc

SEQ ID NO: 9412147 - DNA, 21 bp, Homo sapiens
acagcctgtcatctcatggtc

SEQ ID NO: 9412148 - DNA, 21 bp, Homo sapiens
acagcctgtcatctcatggtc

SEQ ID NO: 9412149 - DNA, 22 bp, Homo sapiens
acagcctggactggctctctgc

SEQ ID NO: 9412150 - DNA, 22 bp, Homo sapiens
acagcctggcctgagttaaggc

SEQ ID NO: 9412151 - DNA, 22 bp, Homo sapiens
acagcctggcctgagttaaggc

SEQ ID NO: 9412152 - DNA, 22 bp, Homo sapiens
acagcctggcctgagttaaggc

SEQ ID NO: 9412153 - DNA, 22 bp, Homo sapiens
acagcctggcctgagttaaggc

SEQ ID NO: 9412154 - DNA, 21 bp, Homo sapiens
accaggcttgtgggagggagc

SEQ ID NO: 9412155 - DNA, 22 bp, Homo sapiens
accaggcttgatgatttgctta

SEQ ID NO: 9412156 - DNA, 22 bp, Homo sapiens
accaggcttgataccaagaaat

SEQ ID NO: 9412157 - DNA, 21 bp, Homo sapiens
accaggcttgtgggagggagc

SEQ ID NO: 9412158 - DNA, 22 bp, Homo sapiens
aagggctgtaagccaagtaaag

SEQ ID NO: 9412159 - DNA, 22 bp, Homo sapiens
aagggctgtaagccaagtaaag

SEQ ID NO: 9412160 - DNA, 22 bp, Homo sapiens
aagggctggtctagaaagggag

SEQ ID NO: 9412161 - DNA, 22 bp, Homo sapiens
aaggggaaaaagtgttaggagt

SEQ ID NO: 9412162 - DNA, 22 bp, Homo sapiens
aagggcttaggattttgctgtg

SEQ ID NO: 9412163 - DNA, 22 bp, Homo sapiens
aagggctgtagtttgttgatca

SEQ ID NO: 9412164 - DNA, 22 bp, Homo sapiens
acccagagcccttagcacagac

SEQ ID NO: 9412165 - DNA, 22 bp, Homo sapiens
aaggggaaaaagtgttaggagt

SEQ ID NO: 9412166 - DNA, 22 bp, Homo sapiens
accatgttggccaagctggtct

SEQ ID NO: 9412167 - DNA, 19 bp, Homo sapiens
acccagagccctttgcagg

SEQ ID NO: 9412168 - DNA, 22 bp, Homo sapiens
acccagagcccttagcacagac

SEQ ID NO: 9412169 - DNA, 22 bp, Homo sapiens
acccagagcccttagcacagac

SEQ ID NO: 9412170 - DNA, 22 bp, Homo sapiens
acccagagctgggcttggcaaa

SEQ ID NO: 9412171 - DNA, 22 bp, Homo sapiens
acccagagctgggcttggcaaa

SEQ ID NO: 9412172 - DNA, 22 bp, Homo sapiens
acccagagctgggcttggcaaa

SEQ ID NO: 9412173 - DNA, 19 bp, Homo sapiens
accaggcttatggtcagtg

SEQ ID NO: 9412174 - DNA, 19 bp, Homo sapiens
accaggcttatggtcagtg

SEQ ID NO: 9412175 - DNA, 22 bp, Homo sapiens
acattttgaaagggaaattgtt

SEQ ID NO: 9412176 - DNA, 22 bp, Homo sapiens
acattttgaaagggaaattgtt

SEQ ID NO: 9412177 - DNA, 22 bp, Homo sapiens
acattttgaaagggaaattgtt

SEQ ID NO: 9412178 - DNA, 21 bp, Homo sapiens
acattttctgttttaggaagt

SEQ ID NO: 9412179 - DNA, 21 bp, Homo sapiens
acattttctgttttaggaagt

SEQ ID NO: 9412180 - DNA, 21 bp, Homo sapiens
acattttctgttttaggaagt

SEQ ID NO: 9412181 - DNA, 22 bp, Homo sapiens
accaggcccaccgcatgctcct

SEQ ID NO: 9412182 - DNA, 22 bp, Homo sapiens
accaggcccaccgcatgctcct

SEQ ID NO: 9412183 - DNA, 22 bp, Homo sapiens
acattttgagaaatgacaagct

SEQ ID NO: 9412184 - DNA, 21 bp, Homo sapiens
accaggccaggaggctggcac

SEQ ID NO: 9412185 - DNA, 22 bp, Homo sapiens
acatttgtttctctagagtagg

SEQ ID NO: 9412186 - DNA, 22 bp, Homo sapiens
acattttaatatgcttagtgtg

SEQ ID NO: 9412187 - DNA, 22 bp, Homo sapiens
acatttgtttctctagagtagg

SEQ ID NO: 9412188 - DNA, 22 bp, Homo sapiens
acatttgtttctctagagtagg

SEQ ID NO: 9412189 - DNA, 22 bp, Homo sapiens
acatttgttgccattcatggag

SEQ ID NO: 9412190 - DNA, 22 bp, Homo sapiens
acatttgtgcacatgtgcatgg

SEQ ID NO: 9412191 - DNA, 20 bp, Homo sapiens
acatttgtggatctgagaga

SEQ ID NO: 9412192 - DNA, 22 bp, Homo sapiens
acatttgtgggggaacaggata

SEQ ID NO: 9412193 - DNA, 22 bp, Homo sapiens
acatttgtgggggaacaggata

SEQ ID NO: 9412194 - DNA, 20 bp, Homo sapiens
acatttgtggatctgagaga

SEQ ID NO: 9412195 - DNA, 22 bp, Homo sapiens
acatttgttcagggctgaggaa

SEQ ID NO: 9412196 - DNA, 22 bp, Homo sapiens
acattttacagttgtctggcta

SEQ ID NO: 9412197 - DNA, 22 bp, Homo sapiens
acattttacaccaagacttctt

SEQ ID NO: 9412198 - DNA, 22 bp, Homo sapiens
acattttacaccaagacttctt

SEQ ID NO: 9412199 - DNA, 22 bp, Homo sapiens
acccagagtaacagatggattc

SEQ ID NO: 9412200 - DNA, 22 bp, Homo sapiens
acccagagtaacagatggattc

SEQ ID NO: 9412201 - DNA, 22 bp, Homo sapiens
acccagaggtgtctagcaagct

SEQ ID NO: 9412202 - DNA, 22 bp, Homo sapiens
acccagagctgggcttggcaaa

SEQ ID NO: 9412203 - DNA, 22 bp, Homo sapiens
acccagagctgggcttggcaaa

SEQ ID NO: 9412204 - DNA, 22 bp, Homo sapiens
acccagaggcggaggttgcagt

SEQ ID NO: 9412205 - DNA, 22 bp, Homo sapiens
acccagagctgggcttggcaaa

SEQ ID NO: 9412206 - DNA, 22 bp, Homo sapiens
acccagagtcagacagccatgg

SEQ ID NO: 9412207 - DNA, 22 bp, Homo sapiens
acccagagtaacagatggattc

SEQ ID NO: 9412208 - DNA, 22 bp, Homo sapiens
acccagagtcatggcacttagc

SEQ ID NO: 9412209 - DNA, 22 bp, Homo sapiens
acccagagtcagacagccatgg

SEQ ID NO: 9412210 - DNA, 22 bp, Homo sapiens
acccagagtcagacagccatgg

SEQ ID NO: 9412211 - DNA, 22 bp, Homo sapiens
acccagagtgtctgtctcagtc

SEQ ID NO: 9412212 - DNA, 22 bp, Homo sapiens
acccagagtcatggcacttagc

SEQ ID NO: 9412213 - DNA, 22 bp, Homo sapiens
acccagagtcatggcacttagc

SEQ ID NO: 9412214 - DNA, 22 bp, Homo sapiens
acccagagtcatgtttattccc

SEQ ID NO: 9412215 - DNA, 22 bp, Homo sapiens
acccagagtgtctgtctcagtc

SEQ ID NO: 9412216 - DNA, 22 bp, Homo sapiens
acccaggaggcaaggttgcagt

SEQ ID NO: 9412217 - DNA, 22 bp, Homo sapiens
acccaggaggcaaggttgcagt

SEQ ID NO: 9412218 - DNA, 22 bp, Homo sapiens
acccaggaggcaaggttgcagt

SEQ ID NO: 9412219 - DNA, 22 bp, Homo sapiens
acccaggaggcagaggttgcag

SEQ ID NO: 9412220 - DNA, 22 bp, Homo sapiens
acccaggagctctggggtcctc

SEQ ID NO: 9412221 - DNA, 22 bp, Homo sapiens
acccaggagccgtgagaggtta

SEQ ID NO: 9412222 - DNA, 22 bp, Homo sapiens
acccaggagccgtgagaggtta

SEQ ID NO: 9412223 - DNA, 22 bp, Homo sapiens
acccaggataatctgtgtatct

SEQ ID NO: 9412224 - DNA, 22 bp, Homo sapiens
acccaggaggtggaggctgcag

SEQ ID NO: 9412225 - DNA, 22 bp, Homo sapiens
acccaggataatctgtgtatct

SEQ ID NO: 9412226 - DNA, 22 bp, Homo sapiens
acccaggaggtgacacagggct

SEQ ID NO: 9412227 - DNA, 22 bp, Homo sapiens
acccaggaggtggaggctgcag

SEQ ID NO: 9412228 - DNA, 22 bp, Homo sapiens
acccccttcgcacactctttca

SEQ ID NO: 9412229 - DNA, 22 bp, Homo sapiens
acccaggatagagtgctgcagt

SEQ ID NO: 9412230 - DNA, 22 bp, Homo sapiens
acccaggatagagtgctgcagt

SEQ ID NO: 9412231 - DNA, 22 bp, Homo sapiens
accccttctcctggctgttcca

SEQ ID NO: 9412232 - DNA, 22 bp, Homo sapiens
acccctccattctgaaggctgc

SEQ ID NO: 9412233 - DNA, 22 bp, Homo sapiens
accctgagaaagtcacatgcat

SEQ ID NO: 9412234 - DNA, 22 bp, Homo sapiens
accctcttgagggaagcacttt

SEQ ID NO: 9412235 - DNA, 22 bp, Homo sapiens
accctgaaagcatcctcctgtc

SEQ ID NO: 9412236 - DNA, 22 bp, Homo sapiens
accctgaagaaacttctaagtg

SEQ ID NO: 9412237 - DNA, 22 bp, Homo sapiens
accctgaagcaggcactcagct

SEQ ID NO: 9412238 - DNA, 22 bp, Homo sapiens
accctgagaaagtcacatgcat

SEQ ID NO: 9412239 - DNA, 22 bp, Homo sapiens
accctgagaaagtcacatgcat

SEQ ID NO: 9412240 - DNA, 22 bp, Homo sapiens
accctgagaaagtcacatgcat

SEQ ID NO: 9412241 - DNA, 22 bp, Homo sapiens
accctgagaaagtcacatgcat

SEQ ID NO: 9412242 - DNA, 19 bp, Homo sapiens
accctgagaggtggtccgg

SEQ ID NO: 9412243 - DNA, 22 bp, Homo sapiens
accctgagaatgagtgtctcct

SEQ ID NO: 9412244 - DNA, 22 bp, Homo sapiens
accctgagatgccacagcatga

SEQ ID NO: 9412245 - DNA, 22 bp, Homo sapiens
accctgagatgccacagcatga

SEQ ID NO: 9412246 - DNA, 22 bp, Homo sapiens
accctgagatgccacagcatga

SEQ ID NO: 9412247 - DNA, 22 bp, Homo sapiens
accctgagatgccacagcatga

SEQ ID NO: 9412248 - DNA, 22 bp, Homo sapiens
accctgagccaaaccagttaga

SEQ ID NO: 9412249 - DNA, 22 bp, Homo sapiens
accctgagccgccaggaaggcc

SEQ ID NO: 9412250 - DNA, 22 bp, Homo sapiens
accctgagccgccaggaaggcc

SEQ ID NO: 9412251 - DNA, 22 bp, Homo sapiens
accctgagccgccaggaaggcc

SEQ ID NO: 9412252 - DNA, 22 bp, Homo sapiens
accctgagggatgagagttgca

SEQ ID NO: 9412253 - DNA, 22 bp, Homo sapiens
accctgagccgccaggaaggcc

SEQ ID NO: 9412254 - DNA, 20 bp, Homo sapiens
accctgaggctccccagcct

SEQ ID NO: 9412255 - DNA, 22 bp, Homo sapiens
accgggaagtcctgcactgggc

SEQ ID NO: 9412256 - DNA, 22 bp, Homo sapiens
accgggaagtcctgcactgggc

SEQ ID NO: 9412257 - DNA, 21 bp, Homo sapiens
accctttgtttatgaatcagc

SEQ ID NO: 9412258 - DNA, 22 bp, Homo sapiens
acccttttgcctttaattcatg

SEQ ID NO: 9412259 - DNA, 22 bp, Homo sapiens
accctgccctctccagctcagg

SEQ ID NO: 9412260 - DNA, 20 bp, Homo sapiens
accctgcatactggaaggct

SEQ ID NO: 9412261 - DNA, 22 bp, Homo sapiens
accctgatggccagattgtgga

SEQ ID NO: 9412262 - DNA, 22 bp, Homo sapiens
accctgcagggcagaggctggt

SEQ ID NO: 9412263 - DNA, 22 bp, Homo sapiens
accctgagtgcaacggtgagga

SEQ ID NO: 9412264 - DNA, 22 bp, Homo sapiens
accctgagtcagacagcctgac

SEQ ID NO: 9412265 - DNA, 22 bp, Homo sapiens
accctgagtgcaacggtgagga

SEQ ID NO: 9412266 - DNA, 22 bp, Homo sapiens
accctgagtcagacagcctgac

SEQ ID NO: 9412267 - DNA, 22 bp, Homo sapiens
accctgagggtgctgggtttct

SEQ ID NO: 9412268 - DNA, 22 bp, Homo sapiens
accctgagggtgctgggtttct

SEQ ID NO: 9412269 - DNA, 22 bp, Homo sapiens
accctgagtcactgtctgtctg

SEQ ID NO: 9412270 - DNA, 22 bp, Homo sapiens
accctgaggggtatagcagaag

SEQ ID NO: 9412271 - DNA, 22 bp, Homo sapiens
accctgaggggtatagcagaag

SEQ ID NO: 9412272 - DNA, 22 bp, Homo sapiens
accctgaggggtatagcagaag

SEQ ID NO: 9412273 - DNA, 22 bp, Homo sapiens
accctgaggggtatagcagaag

SEQ ID NO: 9412274 - DNA, 22 bp, Homo sapiens
acattgttgcctagccatgagt

SEQ ID NO: 9412275 - DNA, 22 bp, Homo sapiens
acattgttgtgcaattatagtt

SEQ ID NO: 9412276 - DNA, 22 bp, Homo sapiens
acattgtttgagaatacagatg

SEQ ID NO: 9412277 - DNA, 22 bp, Homo sapiens
acatttaaatacctatgtttct

SEQ ID NO: 9412278 - DNA, 22 bp, Homo sapiens
acatttaaatacctatgtttct

SEQ ID NO: 9412279 - DNA, 22 bp, Homo sapiens
acatttaaatatgccttatatt

SEQ ID NO: 9412280 - DNA, 22 bp, Homo sapiens
acatttaaatatgccttatatt

SEQ ID NO: 9412281 - DNA, 19 bp, Homo sapiens
aaggctggagaaggcctct

SEQ ID NO: 9412282 - DNA, 22 bp, Homo sapiens
aaggctggacctggatgaatct

SEQ ID NO: 9412283 - DNA, 22 bp, Homo sapiens
aaggctggacctggatgaatct

SEQ ID NO: 9412284 - DNA, 22 bp, Homo sapiens
aaggctgcttttaacatgcata

SEQ ID NO: 9412285 - DNA, 19 bp, Homo sapiens
acatttaaattcagatctc

SEQ ID NO: 9412286 - DNA, 21 bp, Homo sapiens
aaggctggagatgcaggtctg

SEQ ID NO: 9412287 - DNA, 19 bp, Homo sapiens
aaggctggagaaggcctct

SEQ ID NO: 9412288 - DNA, 19 bp, Homo sapiens
aaggctggagaaggcctct

SEQ ID NO: 9412289 - DNA, 22 bp, Homo sapiens
aaggctggagatggttggaatg

SEQ ID NO: 9412290 - DNA, 22 bp, Homo sapiens
aaggctggagatggttggaatg

SEQ ID NO: 9412291 - DNA, 21 bp, Homo sapiens
aaggctggagatgcaggtctg

SEQ ID NO: 9412292 - DNA, 21 bp, Homo sapiens
aaggctggagatgcaggtctg

SEQ ID NO: 9412293 - DNA, 22 bp, Homo sapiens
acatttctgtcttagggactgt

SEQ ID NO: 9412294 - DNA, 22 bp, Homo sapiens
acatttcttagcctagttccag

SEQ ID NO: 9412295 - DNA, 22 bp, Homo sapiens
acatttcttccctttagcagaa

SEQ ID NO: 9412296 - DNA, 22 bp, Homo sapiens
acatttgtgcaacgtatccaca

SEQ ID NO: 9412297 - DNA, 22 bp, Homo sapiens
acatttgtgcaacgtatccaca

SEQ ID NO: 9412298 - DNA, 22 bp, Homo sapiens
acatttctggagtttctcaaca

SEQ ID NO: 9412299 - DNA, 22 bp, Homo sapiens
acatttctggagtttctcaaca

SEQ ID NO: 9412300 - DNA, 22 bp, Homo sapiens
acatttctggagtttctcaaca

SEQ ID NO: 9412301 - DNA, 22 bp, Homo sapiens
acatttctggagtttctcaaca

SEQ ID NO: 9412302 - DNA, 22 bp, Homo sapiens
aaggctggcaatatatttgtta

SEQ ID NO: 9412303 - DNA, 22 bp, Homo sapiens
acatttcatgttttccagagca

SEQ ID NO: 9412304 - DNA, 23 bp, Homo sapiens
acatttcatataaaagggatcag

SEQ ID NO: 9412305 - DNA, 23 bp, Homo sapiens
acatttcatataaaagggatcag

SEQ ID NO: 9412306 - DNA, 22 bp, Homo sapiens
aaggctgggaaacatgcaggcc

SEQ ID NO: 9412307 - DNA, 22 bp, Homo sapiens
acatttctcttgatgtctctat

SEQ ID NO: 9412308 - DNA, 22 bp, Homo sapiens
acatttctcttgatgtctctat

SEQ ID NO: 9412309 - DNA, 22 bp, Homo sapiens
acatttctcttgatgtctctat

SEQ ID NO: 9412310 - DNA, 22 bp, Homo sapiens
aaggcctccctctttcatggga

SEQ ID NO: 9412311 - DNA, 22 bp, Homo sapiens
aaggcctccctgtgtgcaggtg

SEQ ID NO: 9412312 - DNA, 22 bp, Homo sapiens
aaggcctccgccaatggcagag

SEQ ID NO: 9412313 - DNA, 22 bp, Homo sapiens
aaggcctcttctctctggagat

SEQ ID NO: 9412314 - DNA, 22 bp, Homo sapiens
aaggcctcaggtgaggctgccc

SEQ ID NO: 9412315 - DNA, 22 bp, Homo sapiens
aaggccctttagcagaggaggg

SEQ ID NO: 9412316 - DNA, 22 bp, Homo sapiens
aaggccctttagcagaggaggg

SEQ ID NO: 9412317 - DNA, 22 bp, Homo sapiens
aaggcccttcggcttcctcagc

SEQ ID NO: 9412318 - DNA, 22 bp, Homo sapiens
aaggccctttagcagaggaggg

SEQ ID NO: 9412319 - DNA, 22 bp, Homo sapiens
aaggcccttggaaaatgcagta

SEQ ID NO: 9412320 - DNA, 22 bp, Homo sapiens
aaggcccttggaaaatgcagta

SEQ ID NO: 9412321 - DNA, 22 bp, Homo sapiens
aaggcccttggaaaatgcagta

SEQ ID NO: 9412322 - DNA, 22 bp, Homo sapiens
aaggccagggatgccagctcgg

SEQ ID NO: 9412323 - DNA, 22 bp, Homo sapiens
aaggccagggatgccagctcgg

SEQ ID NO: 9412324 - DNA, 22 bp, Homo sapiens
aaggccaggggctggcgcctcc

SEQ ID NO: 9412325 - DNA, 22 bp, Homo sapiens
aaggcagataagaattcagcaa

SEQ ID NO: 9412326 - DNA, 20 bp, Homo sapiens
aaggcagagtgggttggagc

SEQ ID NO: 9412327 - DNA, 22 bp, Homo sapiens
aaggcctgctcagctgtctgtg

SEQ ID NO: 9412328 - DNA, 22 bp, Homo sapiens
aaggcctgaacatgaggagatg

SEQ ID NO: 9412329 - DNA, 22 bp, Homo sapiens
aaggcctggatttaggttgtga

SEQ ID NO: 9412330 - DNA, 21 bp, Homo sapiens
aaggcctgcttactgctagtt

SEQ ID NO: 9412331 - DNA, 22 bp, Homo sapiens
aaggccttgcctgacagcacca

SEQ ID NO: 9412332 - DNA, 22 bp, Homo sapiens
aaggccttgccgaaggatgcca

SEQ ID NO: 9412333 - DNA, 22 bp, Homo sapiens
aaggccttgcctgacagcacca

SEQ ID NO: 9412334 - DNA, 22 bp, Homo sapiens
aaggccttgcctgacagcacca

SEQ ID NO: 9412335 - DNA, 22 bp, Homo sapiens
aaggcctttcttatcagtagat

SEQ ID NO: 9412336 - DNA, 22 bp, Homo sapiens
aaggctctgggtttcataggtg

SEQ ID NO: 9412337 - DNA, 22 bp, Homo sapiens
acattcttccagctggctgttg

SEQ ID NO: 9412338 - DNA, 22 bp, Homo sapiens
acattcttccagctggctgttg

SEQ ID NO: 9412339 - DNA, 22 bp, Homo sapiens
acattcttcttgtgaatttact

SEQ ID NO: 9412340 - DNA, 22 bp, Homo sapiens
aaggctctgcaaaacctccaag

SEQ ID NO: 9412341 - DNA, 22 bp, Homo sapiens
aaggctctgcaaaacctccaag

SEQ ID NO: 9412342 - DNA, 22 bp, Homo sapiens
aaggctctgcaaaacctccaag

SEQ ID NO: 9412343 - DNA, 22 bp, Homo sapiens
aaggctccgtgactggggctga

SEQ ID NO: 9412344 - DNA, 21 bp, Homo sapiens
aaggctcctcctctaggcctc

SEQ ID NO: 9412345 - DNA, 22 bp, Homo sapiens
aaggctcctttgtagttctttt

SEQ ID NO: 9412346 - DNA, 22 bp, Homo sapiens
aaggctctccaaatgatataat

SEQ ID NO: 9412347 - DNA, 22 bp, Homo sapiens
aaggctccaccctcatggatgc

SEQ ID NO: 9412348 - DNA, 22 bp, Homo sapiens
aaggctccagtgaatgctggca

SEQ ID NO: 9412349 - DNA, 22 bp, Homo sapiens
aaggctccctcttctcgagtgt

SEQ ID NO: 9412350 - DNA, 22 bp, Homo sapiens
aaggctcagagcctggagctgc

SEQ ID NO: 9412351 - DNA, 22 bp, Homo sapiens
aaggctcagctactcagcctgc

SEQ ID NO: 9412352 - DNA, 22 bp, Homo sapiens
aaggctcaaagaagctaagtga

SEQ ID NO: 9412353 - DNA, 22 bp, Homo sapiens
aaggctcactgaaatgtaggca

SEQ ID NO: 9412354 - DNA, 22 bp, Homo sapiens
aaggcgctgggctaaggcacca

SEQ ID NO: 9412355 - DNA, 22 bp, Homo sapiens
aaggcgctgggctaaggcacca

SEQ ID NO: 9412356 - DNA, 20 bp, Homo sapiens
aaggctatgctgtggtctgc

SEQ ID NO: 9412357 - DNA, 22 bp, Homo sapiens
aaggctatctggcctccttgcc

SEQ ID NO: 9412358 - DNA, 22 bp, Homo sapiens
aaggctatctggcctccttgcc

SEQ ID NO: 9412359 - DNA, 22 bp, Homo sapiens
aaggctattgggaagaaaaatg

SEQ ID NO: 9412360 - DNA, 23 bp, Homo sapiens
aaggctatgtggaatgaaggtgt

SEQ ID NO: 9412361 - DNA, 22 bp, Homo sapiens
aaggctatttcctgtgaatcaa

SEQ ID NO: 9412362 - DNA, 22 bp, Homo sapiens
aaggctatgtgttaaggcagat

SEQ ID NO: 9412363 - DNA, 22 bp, Homo sapiens
aaggctaaattctgtactgcat

SEQ ID NO: 9412364 - DNA, 22 bp, Homo sapiens
aaggctagagaggtattcaagt

SEQ ID NO: 9412365 - DNA, 22 bp, Homo sapiens
aaggctatatctcaatactatt

SEQ ID NO: 9412366 - DNA, 22 bp, Homo sapiens
actagttttccataatatagga

SEQ ID NO: 9412367 - DNA, 22 bp, Homo sapiens
actataaaaggataaaccagaa

SEQ ID NO: 9412368 - DNA, 22 bp, Homo sapiens
actataaaaggataaaccagaa

SEQ ID NO: 9412369 - DNA, 22 bp, Homo sapiens
actataaaaggataaaccagaa

SEQ ID NO: 9412370 - DNA, 22 bp, Homo sapiens
actatacaccaaaatattaagg

SEQ ID NO: 9412371 - DNA, 22 bp, Homo sapiens
actatacaccaaaatattaagg

SEQ ID NO: 9412372 - DNA, 22 bp, Homo sapiens
actcagaagatataatgactca

SEQ ID NO: 9412373 - DNA, 22 bp, Homo sapiens
actcagaagatgtgggtagata

SEQ ID NO: 9412374 - DNA, 22 bp, Homo sapiens
actcagaagatgtgggtagata

SEQ ID NO: 9412375 - DNA, 22 bp, Homo sapiens
actcagaatgtcactgagggac

SEQ ID NO: 9412376 - DNA, 22 bp, Homo sapiens
actcagaatgactgatgctgtg

SEQ ID NO: 9412377 - DNA, 22 bp, Homo sapiens
actcagaatgactgatgctgtg

SEQ ID NO: 9412378 - DNA, 22 bp, Homo sapiens
actcacttcttttactataaaa

SEQ ID NO: 9412379 - DNA, 22 bp, Homo sapiens
actcagaaccatttactctgag

SEQ ID NO: 9412380 - DNA, 22 bp, Homo sapiens
actcactcttaatcagactccc

SEQ ID NO: 9412381 - DNA, 22 bp, Homo sapiens
actatacagtatgtacgtgcac

SEQ ID NO: 9412382 - DNA, 19 bp, Homo sapiens
actctacagtgtgtacaac

SEQ ID NO: 9412383 - DNA, 22 bp, Homo sapiens
actctacagaatgaatacctgt

SEQ ID NO: 9412384 - DNA, 22 bp, Homo sapiens
actctaccatgccactccatag

SEQ ID NO: 9412385 - DNA, 19 bp, Homo sapiens
actctacagtgtgtacaac

SEQ ID NO: 9412386 - DNA, 22 bp, Homo sapiens
actctaaatagcctcttaaaca

SEQ ID NO: 9412387 - DNA, 22 bp, Homo sapiens
actctaaattgtgccaatatgc

SEQ ID NO: 9412388 - DNA, 22 bp, Homo sapiens
actccctccaaatctgcacagt

SEQ ID NO: 9412389 - DNA, 22 bp, Homo sapiens
actccctccaaatctgcacagt

SEQ ID NO: 9412390 - DNA, 23 bp, Homo sapiens
actccccagtctcttcttgccaa

SEQ ID NO: 9412391 - DNA, 22 bp, Homo sapiens
actctccctgctatccacttcc

SEQ ID NO: 9412392 - DNA, 22 bp, Homo sapiens
actctccctgctatccacttcc

SEQ ID NO: 9412393 - DNA, 22 bp, Homo sapiens
actctccctgagagggaggcat

SEQ ID NO: 9412394 - DNA, 22 bp, Homo sapiens
actctcccagctatatgtggtg

SEQ ID NO: 9412395 - DNA, 22 bp, Homo sapiens
actctccctgagagggaggcat

SEQ ID NO: 9412396 - DNA, 22 bp, Homo sapiens
actctcccacgttcgactctaa

SEQ ID NO: 9412397 - DNA, 22 bp, Homo sapiens
actctcccacgttcgactctaa

SEQ ID NO: 9412398 - DNA, 22 bp, Homo sapiens
actctataaagatacctcaatt

SEQ ID NO: 9412399 - DNA, 22 bp, Homo sapiens
actctcaaatattaatctttgg

SEQ ID NO: 9412400 - DNA, 22 bp, Homo sapiens
actctcagagggtggcagcaat

SEQ ID NO: 9412401 - DNA, 22 bp, Homo sapiens
actctcagagggtggcagcaat

SEQ ID NO: 9412402 - DNA, 22 bp, Homo sapiens
actctcagggacagggtctggg

SEQ ID NO: 9412403 - DNA, 20 bp, Homo sapiens
acgtggccaccagtggctta

SEQ ID NO: 9412404 - DNA, 20 bp, Homo sapiens
acgtggccaccagtggctta

SEQ ID NO: 9412405 - DNA, 20 bp, Homo sapiens
acgtggccaccagtggctta

SEQ ID NO: 9412406 - DNA, 22 bp, Homo sapiens
acgtggagagaatagggcacca

SEQ ID NO: 9412407 - DNA, 22 bp, Homo sapiens
acgtggagagaatagggcacca

SEQ ID NO: 9412408 - DNA, 22 bp, Homo sapiens
acgtggagccacagatggagca

SEQ ID NO: 9412409 - DNA, 18 bp, Homo sapiens
acgtgctgtgccttttgc

SEQ ID NO: 9412410 - DNA, 22 bp, Homo sapiens
acgtgctgaagttatccctgtt

SEQ ID NO: 9412411 - DNA, 22 bp, Homo sapiens
acgtgcgtgtgcgcacacatac

SEQ ID NO: 9412412 - DNA, 22 bp, Homo sapiens
aagtctcagaaaactagtgtgg

SEQ ID NO: 9412413 - DNA, 22 bp, Homo sapiens
aagtcctttaatatcacatagt

SEQ ID NO: 9412414 - DNA, 22 bp, Homo sapiens
aagtcgtggcaggcttgcacga

SEQ ID NO: 9412415 - DNA, 22 bp, Homo sapiens
aagtctcatccgtgtagctcca

SEQ ID NO: 9412416 - DNA, 22 bp, Homo sapiens
aagtctctcatggctgacagca

SEQ ID NO: 9412417 - DNA, 22 bp, Homo sapiens
aagtctctttacctctccaggc

SEQ ID NO: 9412418 - DNA, 22 bp, Homo sapiens
aagtctctttacctctccaggc

SEQ ID NO: 9412419 - DNA, 22 bp, Homo sapiens
aagtctctttacctctccaggc

SEQ ID NO: 9412420 - DNA, 22 bp, Homo sapiens
actacactccaattttctaggt

SEQ ID NO: 9412421 - DNA, 22 bp, Homo sapiens
aagtctctggttgcttgcatgg

SEQ ID NO: 9412422 - DNA, 22 bp, Homo sapiens
aagtctctggtgatgcaggaaa

SEQ ID NO: 9412423 - DNA, 22 bp, Homo sapiens
acgtagcactgagagatgcagg

SEQ ID NO: 9412424 - DNA, 22 bp, Homo sapiens
acggtgctgggtattggggttc

SEQ ID NO: 9412425 - DNA, 22 bp, Homo sapiens
acggtgctgggtattggggttc

SEQ ID NO: 9412426 - DNA, 22 bp, Homo sapiens
acgtgcaggatctggttggcga

SEQ ID NO: 9412427 - DNA, 22 bp, Homo sapiens
acctttatgtttgattacaatt

SEQ ID NO: 9412428 - DNA, 22 bp, Homo sapiens
acctttatgattcacaatgtat

SEQ ID NO: 9412429 - DNA, 22 bp, Homo sapiens
acctttatgattcacaatgtat

SEQ ID NO: 9412430 - DNA, 22 bp, Homo sapiens
acctttatgattcacaatgtat

SEQ ID NO: 9412431 - DNA, 22 bp, Homo sapiens
acggggctagagaaggtttctt

SEQ ID NO: 9412432 - DNA, 22 bp, Homo sapiens
acctaaattctggctgattagg

SEQ ID NO: 9412433 - DNA, 22 bp, Homo sapiens
acctaaattctggctgattagg

SEQ ID NO: 9412434 - DNA, 22 bp, Homo sapiens
acctaaatctacctcatgtttt

SEQ ID NO: 9412435 - DNA, 22 bp, Homo sapiens
accgggctaatttttgtatctt

SEQ ID NO: 9412436 - DNA, 22 bp, Homo sapiens
acctaagagatcttctggtcca

SEQ ID NO: 9412437 - DNA, 22 bp, Homo sapiens
acctaataaaggtaaattctgt

SEQ ID NO: 9412438 - DNA, 22 bp, Homo sapiens
acctacatagttaagtaacaaa

SEQ ID NO: 9412439 - DNA, 22 bp, Homo sapiens
acctacatacggaaatatttac

SEQ ID NO: 9412440 - DNA, 22 bp, Homo sapiens
acctacatagttaagtaacaaa

SEQ ID NO: 9412441 - DNA, 22 bp, Homo sapiens
acctacatggctttaagtaagt

SEQ ID NO: 9412442 - DNA, 22 bp, Homo sapiens
acctacatggctttaagtaagt

SEQ ID NO: 9412443 - DNA, 23 bp, Homo sapiens
acctacattatagggatatgggt

SEQ ID NO: 9412444 - DNA, 22 bp, Homo sapiens
acctacatgttccacatagttg

SEQ ID NO: 9412445 - DNA, 22 bp, Homo sapiens
acctagaatttaaaacattgct

SEQ ID NO: 9412446 - DNA, 22 bp, Homo sapiens
acctagaatttaaaacattgct

SEQ ID NO: 9412447 - DNA, 22 bp, Homo sapiens
acctagaatttaaaacattgct

SEQ ID NO: 9412448 - DNA, 22 bp, Homo sapiens
acctagaactgcaggctatttt

SEQ ID NO: 9412449 - DNA, 23 bp, Homo sapiens
acctagaaatacgttttacatgg

SEQ ID NO: 9412450 - DNA, 22 bp, Homo sapiens
acctagaaactgacagaatatt

SEQ ID NO: 9412451 - DNA, 23 bp, Homo sapiens
acctagaaatacgttttacatgg

SEQ ID NO: 9412452 - DNA, 21 bp, Homo sapiens
actggccaccactggcagggg

SEQ ID NO: 9412453 - DNA, 20 bp, Homo sapiens
actggagtaccctagagaag

SEQ ID NO: 9412454 - DNA, 22 bp, Homo sapiens
actggaggggaaaatggtagta

SEQ ID NO: 9412455 - DNA, 22 bp, Homo sapiens
actggaggcccctcccagtgaa

SEQ ID NO: 9412456 - DNA, 22 bp, Homo sapiens
actggaggggaaaatggtagta

SEQ ID NO: 9412457 - DNA, 22 bp, Homo sapiens
actggagctgagagcatgggta

SEQ ID NO: 9412458 - DNA, 22 bp, Homo sapiens
actggaggattcctggaaggcg

SEQ ID NO: 9412459 - DNA, 22 bp, Homo sapiens
actggacagaggaaatatggag

SEQ ID NO: 9412460 - DNA, 22 bp, Homo sapiens
actggacagaggaaatatggag

SEQ ID NO: 9412461 - DNA, 22 bp, Homo sapiens
actggagcccgtggaggcgcag

SEQ ID NO: 9412462 - DNA, 22 bp, Homo sapiens
actggagactgtgtcttttgat

SEQ ID NO: 9412463 - DNA, 22 bp, Homo sapiens
actgcactccagcctgggtgac

SEQ ID NO: 9412464 - DNA, 22 bp, Homo sapiens
actgcactccagcctgggtgac

SEQ ID NO: 9412465 - DNA, 22 bp, Homo sapiens
actgcactccagcctgggtgac

SEQ ID NO: 9412466 - DNA, 22 bp, Homo sapiens
actgcactccagcctgggtgac

SEQ ID NO: 9412467 - DNA, 22 bp, Homo sapiens
actgcactccagcctgggtgac

SEQ ID NO: 9412468 - DNA, 22 bp, Homo sapiens
actgcactccagcctgggtgac

SEQ ID NO: 9412469 - DNA, 22 bp, Homo sapiens
actgcgtggggagctgtgacta

SEQ ID NO: 9412470 - DNA, 22 bp, Homo sapiens
actgcgctccagcctgggtgac

SEQ ID NO: 9412471 - DNA, 22 bp, Homo sapiens
actgctagtgagaaaataacca

SEQ ID NO: 9412472 - DNA, 22 bp, Homo sapiens
actggcccttgattgcatcagc

SEQ ID NO: 9412473 - DNA, 22 bp, Homo sapiens
actggcccgggagcagaggcct

SEQ ID NO: 9412474 - DNA, 22 bp, Homo sapiens
actggctgaaagtaaagaacac

SEQ ID NO: 9412475 - DNA, 22 bp, Homo sapiens
actggccaggcagcagtagctt

SEQ ID NO: 9412476 - DNA, 22 bp, Homo sapiens
actggccaggcagcagtagctt

SEQ ID NO: 9412477 - DNA, 22 bp, Homo sapiens
actggccaggcgaaccacactg

SEQ ID NO: 9412478 - DNA, 22 bp, Homo sapiens
actggccaggcgaaccacactg

SEQ ID NO: 9412479 - DNA, 22 bp, Homo sapiens
actggccagaactaagtcacat

SEQ ID NO: 9412480 - DNA, 22 bp, Homo sapiens
actggccaggagctggaaatac

SEQ ID NO: 9412481 - DNA, 22 bp, Homo sapiens
actggccaggcacagctgtggg

SEQ ID NO: 9412482 - DNA, 22 bp, Homo sapiens
actggccaggcacagctgtggg

SEQ ID NO: 9412483 - DNA, 22 bp, Homo sapiens
aatacagaggaaacatttaata

SEQ ID NO: 9412484 - DNA, 22 bp, Homo sapiens
aatacagaggcttccagtaaaa

SEQ ID NO: 9412485 - DNA, 22 bp, Homo sapiens
aataccttccaacatcaagaca

SEQ ID NO: 9412486 - DNA, 22 bp, Homo sapiens
aataccagagacagtgtttacc

SEQ ID NO: 9412487 - DNA, 22 bp, Homo sapiens
aataccttttcagtgcacaaaa

SEQ ID NO: 9412488 - DNA, 22 bp, Homo sapiens
actctggccctcctgctgccag

SEQ ID NO: 9412489 - DNA, 22 bp, Homo sapiens
actctggccccaggatctgtgt

SEQ ID NO: 9412490 - DNA, 22 bp, Homo sapiens
actctggccatcttggaccttg

SEQ ID NO: 9412491 - DNA, 22 bp, Homo sapiens
actctggccaggtgcggtatgt

SEQ ID NO: 9412492 - DNA, 22 bp, Homo sapiens
actctggccatcttggaccttg

SEQ ID NO: 9412493 - DNA, 22 bp, Homo sapiens
actgagactttgttgagttctt

SEQ ID NO: 9412494 - DNA, 22 bp, Homo sapiens
actgagagaacgggctgctccc

SEQ ID NO: 9412495 - DNA, 22 bp, Homo sapiens
actctggcgggcgggcgagcca

SEQ ID NO: 9412496 - DNA, 22 bp, Homo sapiens
actctggctattcactataata

SEQ ID NO: 9412497 - DNA, 22 bp, Homo sapiens
actgaggtagggcacacctagg

SEQ ID NO: 9412498 - DNA, 22 bp, Homo sapiens
actgaggtcaggggtatgtgat

SEQ ID NO: 9412499 - DNA, 22 bp, Homo sapiens
actgagagaagggattttaagt

SEQ ID NO: 9412500 - DNA, 22 bp, Homo sapiens
actgagagagctgggtatctcc

SEQ ID NO: 9412501 - DNA, 22 bp, Homo sapiens
actctggagatggatgtcagga

SEQ ID NO: 9412502 - DNA, 22 bp, Homo sapiens
actctggagatggatgtcagga

SEQ ID NO: 9412503 - DNA, 22 bp, Homo sapiens
actctggcaagcttccacttcc

SEQ ID NO: 9412504 - DNA, 22 bp, Homo sapiens
actctggcagcagaaccagtgt

SEQ ID NO: 9412505 - DNA, 22 bp, Homo sapiens
actctggcactgggtacctcag

SEQ ID NO: 9412506 - DNA, 22 bp, Homo sapiens
actctgcttgggccatatctgg

SEQ ID NO: 9412507 - DNA, 22 bp, Homo sapiens
actctgctcttatagtgttata

SEQ ID NO: 9412508 - DNA, 22 bp, Homo sapiens
actctgctctgtatttcactgt

SEQ ID NO: 9412509 - DNA, 22 bp, Homo sapiens
actctcccttatctaactttac

SEQ ID NO: 9412510 - DNA, 22 bp, Homo sapiens
actctgctgtttactctctata

SEQ ID NO: 9412511 - DNA, 22 bp, Homo sapiens
actgcactccaacctgggtgac

SEQ ID NO: 9412512 - DNA, 22 bp, Homo sapiens
actgcactccaacctgggtgac

SEQ ID NO: 9412513 - DNA, 22 bp, Homo sapiens
actgcactccaacctgggtgac

SEQ ID NO: 9412514 - DNA, 22 bp, Homo sapiens
actgcactccaacctgggtgac

SEQ ID NO: 9412515 - DNA, 22 bp, Homo sapiens
actgcactccaacctgggtgac

SEQ ID NO: 9412516 - DNA, 22 bp, Homo sapiens
actgcactccaacctgggtgac

SEQ ID NO: 9412517 - DNA, 22 bp, Homo sapiens
actgcactccagcctcggggtc

SEQ ID NO: 9412518 - DNA, 22 bp, Homo sapiens
actgcactccagcctcggggtc

SEQ ID NO: 9412519 - DNA, 22 bp, Homo sapiens
actgcactccagcccgggtgac

SEQ ID NO: 9412520 - DNA, 22 bp, Homo sapiens
actgcactccagcctgggtaac

SEQ ID NO: 9412521 - DNA, 22 bp, Homo sapiens
actgcactccagcctgggtaac

SEQ ID NO: 9412522 - DNA, 22 bp, Homo sapiens
actgcactccagcctgggtaac

SEQ ID NO: 9412523 - DNA, 22 bp, Homo sapiens
actgcactccagcctgggtaac

SEQ ID NO: 9412524 - DNA, 22 bp, Homo sapiens
actgcactccagcctgggtaac

SEQ ID NO: 9412525 - DNA, 22 bp, Homo sapiens
actgcactccagcctcggggtc

SEQ ID NO: 9412526 - DNA, 22 bp, Homo sapiens
actgagtggctggggagtggca

SEQ ID NO: 9412527 - DNA, 22 bp, Homo sapiens
actgagtgggaggtttgtgtga

SEQ ID NO: 9412528 - DNA, 22 bp, Homo sapiens
actgatacggttttagagtcca

SEQ ID NO: 9412529 - DNA, 22 bp, Homo sapiens
actgcactccaacctgggtgac

SEQ ID NO: 9412530 - DNA, 22 bp, Homo sapiens
actgcactccaacctgggtgac

SEQ ID NO: 9412531 - DNA, 22 bp, Homo sapiens
actgatcaagggtttaatttta

SEQ ID NO: 9412532 - DNA, 22 bp, Homo sapiens
aatatagttctagaaatatttt

SEQ ID NO: 9412533 - DNA, 22 bp, Homo sapiens
aatatagttctagaaatatttt

SEQ ID NO: 9412534 - DNA, 22 bp, Homo sapiens
aatatagctcactataccatgg

SEQ ID NO: 9412535 - DNA, 22 bp, Homo sapiens
aatatagctcactataccatgg

SEQ ID NO: 9412536 - DNA, 22 bp, Homo sapiens
aatagtctctcccacaccatcc

SEQ ID NO: 9412537 - DNA, 22 bp, Homo sapiens
aatagtcctgatttaatctggg

SEQ ID NO: 9412538 - DNA, 22 bp, Homo sapiens
aatagtatttatttggaaaaag

SEQ ID NO: 9412539 - DNA, 19 bp, Homo sapiens
actgggcttgtcctcgtgg

SEQ ID NO: 9412540 - DNA, 22 bp, Homo sapiens
actgggcttcacttggcacatc

SEQ ID NO: 9412541 - DNA, 22 bp, Homo sapiens
aatagtatttatttggaaaaag

SEQ ID NO: 9412542 - DNA, 22 bp, Homo sapiens
aatatactatactactttctgg

SEQ ID NO: 9412543 - DNA, 22 bp, Homo sapiens
aatatactatactactttctgg

SEQ ID NO: 9412544 - DNA, 22 bp, Homo sapiens
aatatactatactactttctgg

SEQ ID NO: 9412545 - DNA, 22 bp, Homo sapiens
aatatactatactactttctgg

SEQ ID NO: 9412546 - DNA, 22 bp, Homo sapiens
aatatactatactactttctgg

SEQ ID NO: 9412547 - DNA, 22 bp, Homo sapiens
aatatagaatcactttccttca

SEQ ID NO: 9412548 - DNA, 22 bp, Homo sapiens
aatatagcattgtatgactgtg

SEQ ID NO: 9412549 - DNA, 22 bp, Homo sapiens
aatatagcattgtatgactgtg

SEQ ID NO: 9412550 - DNA, 22 bp, Homo sapiens
aatatagatttactcaagagaa

SEQ ID NO: 9412551 - DNA, 22 bp, Homo sapiens
actgggctggttagttttacta

SEQ ID NO: 9412552 - DNA, 22 bp, Homo sapiens
actgggctggggctcattctcc

SEQ ID NO: 9412553 - DNA, 22 bp, Homo sapiens
actgggctgcttgagtgccttc

SEQ ID NO: 9412554 - DNA, 22 bp, Homo sapiens
actgggctgcttgagtgccttc

SEQ ID NO: 9412555 - DNA, 22 bp, Homo sapiens
actgggctgtaaagagaggcaa

SEQ ID NO: 9412556 - DNA, 22 bp, Homo sapiens
actgggctgtggacacccagcg

SEQ ID NO: 9412557 - DNA, 22 bp, Homo sapiens
actgggctgtaaagagaggcaa

SEQ ID NO: 9412558 - DNA, 22 bp, Homo sapiens
actgggctgtggacacccagcg

SEQ ID NO: 9412559 - DNA, 22 bp, Homo sapiens
actgggctgttccttatttcta

SEQ ID NO: 9412560 - DNA, 22 bp, Homo sapiens
actgggctgtggacacccagcg

SEQ ID NO: 9412561 - DNA, 23 bp, Homo sapiens
actgggcttatgaggaggcttgt

SEQ ID NO: 9412562 - DNA, 23 bp, Homo sapiens
actgggcttatgaggaggcttgt

SEQ ID NO: 9412563 - DNA, 23 bp, Homo sapiens
actgggcttatgaggaggcttgt

SEQ ID NO: 9412564 - DNA, 23 bp, Homo sapiens
actgggcttatgaggaggcttgt

SEQ ID NO: 9412565 - DNA, 22 bp, Homo sapiens
actgggctgttttttgagtgga

SEQ ID NO: 9412566 - DNA, 22 bp, Homo sapiens
actgggcttatgctgtggagta

SEQ ID NO: 9412567 - DNA, 22 bp, Homo sapiens
actgggcttatgctgtggagta

SEQ ID NO: 9412568 - DNA, 22 bp, Homo sapiens
actgggcttatgctgtggagta

SEQ ID NO: 9412569 - DNA, 22 bp, Homo sapiens
actgggcttatgctgtggagta

SEQ ID NO: 9412570 - DNA, 22 bp, Homo sapiens
actgggcttatttcttgtgaac

SEQ ID NO: 9412571 - DNA, 22 bp, Homo sapiens
actgggcttatttcttgtgaac

SEQ ID NO: 9412572 - DNA, 22 bp, Homo sapiens
actgggcttatttcttgtgaac

SEQ ID NO: 9412573 - DNA, 22 bp, Homo sapiens
aatactgaaagtattttcaaat

SEQ ID NO: 9412574 - DNA, 22 bp, Homo sapiens
aatactgagatcccacaaagca

SEQ ID NO: 9412575 - DNA, 22 bp, Homo sapiens
aatactatgttgtgacacatga

SEQ ID NO: 9412576 - DNA, 22 bp, Homo sapiens
actgggctgcctggttcttcta

SEQ ID NO: 9412577 - DNA, 22 bp, Homo sapiens
actgggctgcctggttcttcta

SEQ ID NO: 9412578 - DNA, 22 bp, Homo sapiens
aatactgcatacagtttctcat

SEQ ID NO: 9412579 - DNA, 20 bp, Homo sapiens
aatactaaacacaaagcagt

SEQ ID NO: 9412580 - DNA, 20 bp, Homo sapiens
aatactaaacacaaagcagt

SEQ ID NO: 9412581 - DNA, 22 bp, Homo sapiens
aatactatgtagccaaaataat

SEQ ID NO: 9412582 - DNA, 22 bp, Homo sapiens
aatactatgtagccaaaataat

SEQ ID NO: 9412583 - DNA, 22 bp, Homo sapiens
aatactatgtagccaaaataat

SEQ ID NO: 9412584 - DNA, 22 bp, Homo sapiens
aatactatgtagccaaaataat

SEQ ID NO: 9412585 - DNA, 22 bp, Homo sapiens
actgttctgcatgtacctgagg

SEQ ID NO: 9412586 - DNA, 22 bp, Homo sapiens
actgttctgcatgctgtgaggg

SEQ ID NO: 9412587 - DNA, 19 bp, Homo sapiens
actgttctgtatgttgatt

SEQ ID NO: 9412588 - DNA, 22 bp, Homo sapiens
actgttctgccaagatcaacgt

SEQ ID NO: 9412589 - DNA, 22 bp, Homo sapiens
actgttctgccaagatcaacgt

SEQ ID NO: 9412590 - DNA, 22 bp, Homo sapiens
actgttctgccaagatcaacgt

SEQ ID NO: 9412591 - DNA, 22 bp, Homo sapiens
actgttctgccaactttggtta

SEQ ID NO: 9412592 - DNA, 22 bp, Homo sapiens
actgttctccagcatggctgta

SEQ ID NO: 9412593 - DNA, 22 bp, Homo sapiens
actgttctcctttggctatatc

SEQ ID NO: 9412594 - DNA, 18 bp, Homo sapiens
actgttctctcctgccct

SEQ ID NO: 9412595 - DNA, 22 bp, Homo sapiens
actgttctcctttggctatatc

SEQ ID NO: 9412596 - DNA, 22 bp, Homo sapiens
actgttcccagattctcacatt

SEQ ID NO: 9412597 - DNA, 19 bp, Homo sapiens
actgttctaacttgcagct

SEQ ID NO: 9412598 - DNA, 22 bp, Homo sapiens
actgttcttcatttagcaaaga

SEQ ID NO: 9412599 - DNA, 19 bp, Homo sapiens
actgttctgtatgttgatt

SEQ ID NO: 9412600 - DNA, 22 bp, Homo sapiens
actgttcttcatttagcaaaga

SEQ ID NO: 9412601 - DNA, 22 bp, Homo sapiens
actgttcttcccatttatattg

SEQ ID NO: 9412602 - DNA, 22 bp, Homo sapiens
actgttcttcccatttatattg

SEQ ID NO: 9412603 - DNA, 22 bp, Homo sapiens
actgttcttgtaacacttaaat

SEQ ID NO: 9412604 - DNA, 22 bp, Homo sapiens
actttaaaaagagccttctaac

SEQ ID NO: 9412605 - DNA, 22 bp, Homo sapiens
actgttgaagtgccagcttgat

SEQ ID NO: 9412606 - DNA, 22 bp, Homo sapiens
actttaaaaagagccttctaac

SEQ ID NO: 9412607 - DNA, 22 bp, Homo sapiens
actttaaaactgatcatcagag

SEQ ID NO: 9412608 - DNA, 20 bp, Homo sapiens
actttatgagttcaattttg

SEQ ID NO: 9412609 - DNA, 20 bp, Homo sapiens
actttatgagttcaattttg

SEQ ID NO: 9412610 - DNA, 22 bp, Homo sapiens
actttatgtttgatatctatgg

SEQ ID NO: 9412611 - DNA, 22 bp, Homo sapiens
actttatgctaaactttactct

SEQ ID NO: 9412612 - DNA, 22 bp, Homo sapiens
actttatgtttgatatctatgg

SEQ ID NO: 9412613 - DNA, 23 bp, Homo sapiens
actttattgaccccaggtcagtt

SEQ ID NO: 9412614 - DNA, 22 bp, Homo sapiens
actttcttaggctgtataaatg

SEQ ID NO: 9412615 - DNA, 22 bp, Homo sapiens
actttcttaggctgtataaatg

SEQ ID NO: 9412616 - DNA, 22 bp, Homo sapiens
actttcttaggctgtataaatg

SEQ ID NO: 9412617 - DNA, 22 bp, Homo sapiens
actttcttaggctgtataaatg

SEQ ID NO: 9412618 - DNA, 22 bp, Homo sapiens
actttctgttagatgaatggat

SEQ ID NO: 9412619 - DNA, 21 bp, Homo sapiens
actttctgtgggttcaagcat

SEQ ID NO: 9412620 - DNA, 22 bp, Homo sapiens
actttctgtggttaccagggag

SEQ ID NO: 9412621 - DNA, 21 bp, Homo sapiens
actttctgtgggttcaagcat

SEQ ID NO: 9412622 - DNA, 22 bp, Homo sapiens
actttatttcctattgcatcca

SEQ ID NO: 9412623 - DNA, 22 bp, Homo sapiens
actttcttatccatgatctcac

SEQ ID NO: 9412624 - DNA, 22 bp, Homo sapiens
actttcttatccatgatctcac

SEQ ID NO: 9412625 - DNA, 22 bp, Homo sapiens
actttcttggtcccatgtttga

SEQ ID NO: 9412626 - DNA, 22 bp, Homo sapiens
actttcttctactacttggaga

SEQ ID NO: 9412627 - DNA, 22 bp, Homo sapiens
actttcttcttatgcattaagg

SEQ ID NO: 9412628 - DNA, 22 bp, Homo sapiens
aatcacatgaaaactgtgtgtt

SEQ ID NO: 9412629 - DNA, 20 bp, Homo sapiens
aatcagaaagtgtgagctct

SEQ ID NO: 9412630 - DNA, 19 bp, Homo sapiens
aatcagaaatatcgaggcc

SEQ ID NO: 9412631 - DNA, 22 bp, Homo sapiens
aatcagaaaggctaaggaagca

SEQ ID NO: 9412632 - DNA, 22 bp, Homo sapiens
aatcagaaaggctaaggaagca

SEQ ID NO: 9412633 - DNA, 22 bp, Homo sapiens
aatcagaaaggctaaggaagca

SEQ ID NO: 9412634 - DNA, 22 bp, Homo sapiens
aatcagaaagatcttgatgaga

SEQ ID NO: 9412635 - DNA, 22 bp, Homo sapiens
aatcagaaagatcttgatgaga

SEQ ID NO: 9412636 - DNA, 22 bp, Homo sapiens
actttgaaactaaaattcatta

SEQ ID NO: 9412637 - DNA, 22 bp, Homo sapiens
aatcacatctcattcaacagcc

SEQ ID NO: 9412638 - DNA, 22 bp, Homo sapiens
aatcacatctcattcaacagcc

SEQ ID NO: 9412639 - DNA, 22 bp, Homo sapiens
aatcacatctcattcaacagcc

SEQ ID NO: 9412640 - DNA, 22 bp, Homo sapiens
aatcagactattaaagtctctt

SEQ ID NO: 9412641 - DNA, 22 bp, Homo sapiens
aatcagaatttattgaatcttt

SEQ ID NO: 9412642 - DNA, 22 bp, Homo sapiens
aatcagaatttattgaatcttt

SEQ ID NO: 9412643 - DNA, 17 bp, Homo sapiens
aatcagatttctgagga

SEQ ID NO: 9412644 - DNA, 22 bp, Homo sapiens
aatcagaaattctacatcacaa

SEQ ID NO: 9412645 - DNA, 22 bp, Homo sapiens
aatcagaatttattgaatcttt

SEQ ID NO: 9412646 - DNA, 22 bp, Homo sapiens
aatcagaatcagttgacacagc

SEQ ID NO: 9412647 - DNA, 22 bp, Homo sapiens
aatcagaatcagttgacacagc

SEQ ID NO: 9412648 - DNA, 22 bp, Homo sapiens
aatcagaatcagttgacacagc

SEQ ID NO: 9412649 - DNA, 22 bp, Homo sapiens
aatcagaacttctcagggtggg

SEQ ID NO: 9412650 - DNA, 22 bp, Homo sapiens
aatcagcaggcttctaaatttt

SEQ ID NO: 9412651 - DNA, 22 bp, Homo sapiens
aatcagcaggcttctaaatttt

SEQ ID NO: 9412652 - DNA, 22 bp, Homo sapiens
aatcagcaaatgcttactcagg

SEQ ID NO: 9412653 - DNA, 22 bp, Homo sapiens
aatcagcaaatgcttactcagg

SEQ ID NO: 9412654 - DNA, 22 bp, Homo sapiens
aatcagcaaatgcttactcagg

SEQ ID NO: 9412655 - DNA, 22 bp, Homo sapiens
aatcagcagttggaattagata

SEQ ID NO: 9412656 - DNA, 22 bp, Homo sapiens
aatcagctaaataaactagtca

SEQ ID NO: 9412657 - DNA, 22 bp, Homo sapiens
aatcaggaaactatcaacacat

SEQ ID NO: 9412658 - DNA, 22 bp, Homo sapiens
aatcaggacccactctacagtt

SEQ ID NO: 9412659 - DNA, 22 bp, Homo sapiens
aatcaggacccactctacagtt

SEQ ID NO: 9412660 - DNA, 22 bp, Homo sapiens
aatcaggagtgtgcactttgat

SEQ ID NO: 9412661 - DNA, 22 bp, Homo sapiens
agaaatgacaagactgatcagg

SEQ ID NO: 9412662 - DNA, 22 bp, Homo sapiens
agaaatgacaagactgatcagg

SEQ ID NO: 9412663 - DNA, 22 bp, Homo sapiens
agaaatgacaagactgatcagg

SEQ ID NO: 9412664 - DNA, 22 bp, Homo sapiens
agaaatgacaagactgatcagg

SEQ ID NO: 9412665 - DNA, 22 bp, Homo sapiens
agaaatgaatatgtagtggtta

SEQ ID NO: 9412666 - DNA, 22 bp, Homo sapiens
agaaatgaagagagtcaaggtt

SEQ ID NO: 9412667 - DNA, 22 bp, Homo sapiens
agaaatgaagcaggagttatta

SEQ ID NO: 9412668 - DNA, 22 bp, Homo sapiens
agaaatctttgaagtgtaatgt

SEQ ID NO: 9412669 - DNA, 22 bp, Homo sapiens
agaaatgaaaccaaagcctaga

SEQ ID NO: 9412670 - DNA, 22 bp, Homo sapiens
agaaatgaaaccaaagcctaga

SEQ ID NO: 9412671 - DNA, 22 bp, Homo sapiens
aatcataattcaaataagctta

SEQ ID NO: 9412672 - DNA, 22 bp, Homo sapiens
agaaatactttgtaaatctcac

SEQ ID NO: 9412673 - DNA, 22 bp, Homo sapiens
aatcataattcaaataagctta

SEQ ID NO: 9412674 - DNA, 22 bp, Homo sapiens
aatcataattcaaataagctta

SEQ ID NO: 9412675 - DNA, 22 bp, Homo sapiens
aatcataattcaaataagctta

SEQ ID NO: 9412676 - DNA, 22 bp, Homo sapiens
aatcataattcaaataagctta

SEQ ID NO: 9412677 - DNA, 22 bp, Homo sapiens
aatcagtgcaaaggagagggta

SEQ ID NO: 9412678 - DNA, 22 bp, Homo sapiens
aatcagtggttcccagcccagg

SEQ ID NO: 9412679 - DNA, 23 bp, Homo sapiens
aatcagtgcagttttatgccaag

SEQ ID NO: 9412680 - DNA, 22 bp, Homo sapiens
aatcagtgtggtgacttgtctg

SEQ ID NO: 9412681 - DNA, 21 bp, Homo sapiens
aatcagtgttctcaggggcaa

SEQ ID NO: 9412682 - DNA, 22 bp, Homo sapiens
aatcagtgtgtaaagtggctgc

SEQ ID NO: 9412683 - DNA, 22 bp, Homo sapiens
aatcaggccgaggacatcagcc

SEQ ID NO: 9412684 - DNA, 23 bp, Homo sapiens
aatgatttcatgatgatagcagc

SEQ ID NO: 9412685 - DNA, 22 bp, Homo sapiens
aatgattgtcattccaaaaagt

SEQ ID NO: 9412686 - DNA, 22 bp, Homo sapiens
aatgattactgatcgcatagga

SEQ ID NO: 9412687 - DNA, 22 bp, Homo sapiens
aatgatgtttttaaagaacata

SEQ ID NO: 9412688 - DNA, 22 bp, Homo sapiens
aatgatgtggtgggaaggacat

SEQ ID NO: 9412689 - DNA, 22 bp, Homo sapiens
aatgatgtttttaaagaacata

SEQ ID NO: 9412690 - DNA, 23 bp, Homo sapiens
aatgatgtcagaagatgaagtct

SEQ ID NO: 9412691 - DNA, 22 bp, Homo sapiens
aatgatgtcgaaaagtaagctc

SEQ ID NO: 9412692 - DNA, 22 bp, Homo sapiens
aatgatggtttcatcacttgaa

SEQ ID NO: 9412693 - DNA, 22 bp, Homo sapiens
aatgatggttaaacactggagg

SEQ ID NO: 9412694 - DNA, 22 bp, Homo sapiens
aatgatggatttagacaagctg

SEQ ID NO: 9412695 - DNA, 22 bp, Homo sapiens
aatgatgggaaggagaaaagca

SEQ ID NO: 9412696 - DNA, 22 bp, Homo sapiens
aatgatggtattgatgagctaa

SEQ ID NO: 9412697 - DNA, 22 bp, Homo sapiens
aatgatgagttctaatagaccc

SEQ ID NO: 9412698 - DNA, 22 bp, Homo sapiens
aatgatgccctggagttttgca

SEQ ID NO: 9412699 - DNA, 23 bp, Homo sapiens
aatgatttcatgatgatagcagc

SEQ ID NO: 9412700 - DNA, 22 bp, Homo sapiens
aatgatttcccctacacagaag

SEQ ID NO: 9412701 - DNA, 22 bp, Homo sapiens
aatgatttcccctacacagaag

SEQ ID NO: 9412702 - DNA, 22 bp, Homo sapiens
aatgcaaacagcccagaatcca

SEQ ID NO: 9412703 - DNA, 22 bp, Homo sapiens
aatgcaaacagcccagaatcca

SEQ ID NO: 9412704 - DNA, 22 bp, Homo sapiens
agaagcagaaggaagcagggcc

SEQ ID NO: 9412705 - DNA, 22 bp, Homo sapiens
agaagcagaaggaagcagggcc

SEQ ID NO: 9412706 - DNA, 22 bp, Homo sapiens
agaagcagaaggaagcagggcc

SEQ ID NO: 9412707 - DNA, 22 bp, Homo sapiens
agaagcagaaggaagcagggcc

SEQ ID NO: 9412708 - DNA, 22 bp, Homo sapiens
agaagcagaaggaagcagggcc

SEQ ID NO: 9412709 - DNA, 23 bp, Homo sapiens
aatgagttgggcagcatacaggc

SEQ ID NO: 9412710 - DNA, 22 bp, Homo sapiens
aatgagtttgttctattatttg

SEQ ID NO: 9412711 - DNA, 22 bp, Homo sapiens
aatgatgacaggataaagaaca

SEQ ID NO: 9412712 - DNA, 22 bp, Homo sapiens
agaacaaaattagaggagtgca

SEQ ID NO: 9412713 - DNA, 22 bp, Homo sapiens
agaaattgccagaatgtcaggc

SEQ ID NO: 9412714 - DNA, 22 bp, Homo sapiens
agaacaaatcgatggaagcctg

SEQ ID NO: 9412715 - DNA, 20 bp, Homo sapiens
agaacaagtactaaaggaga

SEQ ID NO: 9412716 - DNA, 22 bp, Homo sapiens
agaacaaatcgatggaagcctg

SEQ ID NO: 9412717 - DNA, 22 bp, Homo sapiens
agaacaaggctgtttccaatgc

SEQ ID NO: 9412718 - DNA, 22 bp, Homo sapiens
agaaatgacacacatgagacat

SEQ ID NO: 9412719 - DNA, 22 bp, Homo sapiens
agaaatgacacacatgagacat

SEQ ID NO: 9412720 - DNA, 22 bp, Homo sapiens
agaaattatgcagtagttttat

SEQ ID NO: 9412721 - DNA, 22 bp, Homo sapiens
agaaattatgcagtagttttat

SEQ ID NO: 9412722 - DNA, 22 bp, Homo sapiens
agaaattatgcagtagttttat

SEQ ID NO: 9412723 - DNA, 22 bp, Homo sapiens
agaaattattagtgaatagtct

SEQ ID NO: 9412724 - DNA, 22 bp, Homo sapiens
agaaattattagtgaatagtct

SEQ ID NO: 9412725 - DNA, 22 bp, Homo sapiens
agaaattcaattctaattagct

SEQ ID NO: 9412726 - DNA, 22 bp, Homo sapiens
agaaattcaattctaattagct

SEQ ID NO: 9412727 - DNA, 22 bp, Homo sapiens
agaaattcctaaggtacacaag

SEQ ID NO: 9412728 - DNA, 22 bp, Homo sapiens
agaaattctaagcatcaatagc

SEQ ID NO: 9412729 - DNA, 22 bp, Homo sapiens
agaaattctaagcatcaatagc

SEQ ID NO: 9412730 - DNA, 22 bp, Homo sapiens
accctcagacagctgtggccag

SEQ ID NO: 9412731 - DNA, 22 bp, Homo sapiens
accctcagacatattccatcat

SEQ ID NO: 9412732 - DNA, 22 bp, Homo sapiens
accctcagacatattccatcat

SEQ ID NO: 9412733 - DNA, 16 bp, Homo sapiens
accctcagaaactgct

SEQ ID NO: 9412734 - DNA, 22 bp, Homo sapiens
accctcaacaaattcactctat

SEQ ID NO: 9412735 - DNA, 22 bp, Homo sapiens
accctcaacaaattcactctat

SEQ ID NO: 9412736 - DNA, 22 bp, Homo sapiens
accctcaacaaattcactctat

SEQ ID NO: 9412737 - DNA, 22 bp, Homo sapiens
accctcaacaaattcactctat

SEQ ID NO: 9412738 - DNA, 22 bp, Homo sapiens
accctcaacaaattcactctat

SEQ ID NO: 9412739 - DNA, 22 bp, Homo sapiens
accctaataatcacagactagt

SEQ ID NO: 9412740 - DNA, 22 bp, Homo sapiens
accctactaaatgtggtatgtc

SEQ ID NO: 9412741 - DNA, 22 bp, Homo sapiens
acccgggaggcaggagtcatag

SEQ ID NO: 9412742 - DNA, 22 bp, Homo sapiens
accccagctctgagccacacca

SEQ ID NO: 9412743 - DNA, 22 bp, Homo sapiens
accccagctctgagccacacca

SEQ ID NO: 9412744 - DNA, 22 bp, Homo sapiens
accccttttatagaagaacaga

SEQ ID NO: 9412745 - DNA, 22 bp, Homo sapiens
accccttgaaggcagagaagct

SEQ ID NO: 9412746 - DNA, 22 bp, Homo sapiens
accccttggagtccgcgcccag

SEQ ID NO: 9412747 - DNA, 22 bp, Homo sapiens
accccaggaagtggaggtcatg

SEQ ID NO: 9412748 - DNA, 22 bp, Homo sapiens
agggcctgggtctgtactcctc

SEQ ID NO: 9412749 - DNA, 22 bp, Homo sapiens
agggcctggtgacctgggtcct

SEQ ID NO: 9412750 - DNA, 22 bp, Homo sapiens
acccaggcctgagagacaggag

SEQ ID NO: 9412751 - DNA, 22 bp, Homo sapiens
acccaggcctgagagacaggag

SEQ ID NO: 9412752 - DNA, 22 bp, Homo sapiens
acccaggcgggagtgcagtgtc

SEQ ID NO: 9412753 - DNA, 22 bp, Homo sapiens
acccaggcgggagtgcagtgtc

SEQ ID NO: 9412754 - DNA, 22 bp, Homo sapiens
acccaggctagagtgcagtggt

SEQ ID NO: 9412755 - DNA, 22 bp, Homo sapiens
acccaggctagaagtgaattat

SEQ ID NO: 9412756 - DNA, 18 bp, Homo sapiens
acccaggctcatggtcct

SEQ ID NO: 9412757 - DNA, 18 bp, Homo sapiens
acccaggctcatggtcct

SEQ ID NO: 9412758 - DNA, 22 bp, Homo sapiens
acccaggctagggtgcagtggc

SEQ ID NO: 9412759 - DNA, 22 bp, Homo sapiens
acccaggctagggtgcagtggc

SEQ ID NO: 9412760 - DNA, 22 bp, Homo sapiens
acccaggctagagtgcagtggt

SEQ ID NO: 9412761 - DNA, 22 bp, Homo sapiens
acccaggctggagtgcagtagc

SEQ ID NO: 9412762 - DNA, 22 bp, Homo sapiens
acccaggctgcttctcagtggc

SEQ ID NO: 9412763 - DNA, 22 bp, Homo sapiens
acccaggctgcttctcagtggc

SEQ ID NO: 9412764 - DNA, 22 bp, Homo sapiens
acccaggctgcttctcagtggc

SEQ ID NO: 9412765 - DNA, 22 bp, Homo sapiens
agggcctgggaagaggaaccct

SEQ ID NO: 9412766 - DNA, 22 bp, Homo sapiens
agggcctgggaagaggaaccct

SEQ ID NO: 9412767 - DNA, 22 bp, Homo sapiens
agggcctgggaagaggaaccct

SEQ ID NO: 9412768 - DNA, 22 bp, Homo sapiens
agggcctgggaagaggaaccct

SEQ ID NO: 9412769 - DNA, 22 bp, Homo sapiens
agggcctgggaagaggaaccct

SEQ ID NO: 9412770 - DNA, 22 bp, Homo sapiens
acccaggctggagtgcagtagc

SEQ ID NO: 9412771 - DNA, 22 bp, Homo sapiens
acccaggctggagtgcagtagc

SEQ ID NO: 9412772 - DNA, 22 bp, Homo sapiens
agggcctgggccagcacccttt

SEQ ID NO: 9412773 - DNA, 22 bp, Homo sapiens
agggcctgggccagcacccttt

SEQ ID NO: 9412774 - DNA, 22 bp, Homo sapiens
agggcctgggccagcacccttt

SEQ ID NO: 9412775 - DNA, 22 bp, Homo sapiens
agggcctgggatgtcctcctag

SEQ ID NO: 9412776 - DNA, 20 bp, Homo sapiens
agggcagcttgaggagccgg

SEQ ID NO: 9412777 - DNA, 22 bp, Homo sapiens
agggcagcttccatagtctggc

SEQ ID NO: 9412778 - DNA, 22 bp, Homo sapiens
acccacagaacctgtgacaaca

SEQ ID NO: 9412779 - DNA, 20 bp, Homo sapiens
agggcagcttgaggagccgg

SEQ ID NO: 9412780 - DNA, 20 bp, Homo sapiens
agggcagcttgaggagccgg

SEQ ID NO: 9412781 - DNA, 20 bp, Homo sapiens
agggcagcttgaggagccgg

SEQ ID NO: 9412782 - DNA, 22 bp, Homo sapiens
acccacacatctctaattcagt

SEQ ID NO: 9412783 - DNA, 22 bp, Homo sapiens
acccacacctccgtatatcact

SEQ ID NO: 9412784 - DNA, 22 bp, Homo sapiens
acccaaagcaatattcatcagt

SEQ ID NO: 9412785 - DNA, 22 bp, Homo sapiens
accattttgggtattttcagag

SEQ ID NO: 9412786 - DNA, 22 bp, Homo sapiens
accatttactcccattggaagt

SEQ ID NO: 9412787 - DNA, 22 bp, Homo sapiens
accatttactcccattggaagt

SEQ ID NO: 9412788 - DNA, 22 bp, Homo sapiens
agggcagtgggaaagcctgctc

SEQ ID NO: 9412789 - DNA, 23 bp, Homo sapiens
agggcatgaagcagaggacgtgg

SEQ ID NO: 9412790 - DNA, 22 bp, Homo sapiens
agggcatgaagcagtggacagc

SEQ ID NO: 9412791 - DNA, 23 bp, Homo sapiens
agggcatgaagcagaggacgtgg

SEQ ID NO: 9412792 - DNA, 22 bp, Homo sapiens
acccaggagcaggctgggcagt

SEQ ID NO: 9412793 - DNA, 22 bp, Homo sapiens
acccaggagcaggctgggcagt

SEQ ID NO: 9412794 - DNA, 22 bp, Homo sapiens
agggagctctttggtcttgccg

SEQ ID NO: 9412795 - DNA, 22 bp, Homo sapiens
agggagctctttggtcttgccg

SEQ ID NO: 9412796 - DNA, 22 bp, Homo sapiens
accatcaagaccttatctagtt

SEQ ID NO: 9412797 - DNA, 22 bp, Homo sapiens
agggagctctaagtagagggac

SEQ ID NO: 9412798 - DNA, 22 bp, Homo sapiens
agggagctctaagtagagggac

SEQ ID NO: 9412799 - DNA, 22 bp, Homo sapiens
agggagctctaagtagagggac

SEQ ID NO: 9412800 - DNA, 22 bp, Homo sapiens
agggagctctgggggcacacgg

SEQ ID NO: 9412801 - DNA, 22 bp, Homo sapiens
agggagctcgatgcctgagtgt

SEQ ID NO: 9412802 - DNA, 22 bp, Homo sapiens
agggagctcgatgcctgagtgt

SEQ ID NO: 9412803 - DNA, 22 bp, Homo sapiens
agggagctctaagtagagggac

SEQ ID NO: 9412804 - DNA, 22 bp, Homo sapiens
agggagctcacagtccagtaga

SEQ ID NO: 9412805 - DNA, 22 bp, Homo sapiens
agggagctcagttggaagcggt

SEQ ID NO: 9412806 - DNA, 22 bp, Homo sapiens
agggagctatttcagggttatt

SEQ ID NO: 9412807 - DNA, 22 bp, Homo sapiens
agggagctatttcagggttatt

SEQ ID NO: 9412808 - DNA, 22 bp, Homo sapiens
agggagctcacagtccagtaga

SEQ ID NO: 9412809 - DNA, 22 bp, Homo sapiens
accatgttggccaagctggtct

SEQ ID NO: 9412810 - DNA, 22 bp, Homo sapiens
accatgttggccaagctggtct

SEQ ID NO: 9412811 - DNA, 22 bp, Homo sapiens
accatgttggccaagctggtct

SEQ ID NO: 9412812 - DNA, 22 bp, Homo sapiens
accatgttggccaagctggtct

SEQ ID NO: 9412813 - DNA, 22 bp, Homo sapiens
accatgttggccaagctggtct

SEQ ID NO: 9412814 - DNA, 21 bp, Homo sapiens
accattctgcacatgctgtca

SEQ ID NO: 9412815 - DNA, 21 bp, Homo sapiens
accattctgcacatgctgtca

SEQ ID NO: 9412816 - DNA, 22 bp, Homo sapiens
accattctggtccatactgttc

SEQ ID NO: 9412817 - DNA, 22 bp, Homo sapiens
accattctgtctctttacaaat

SEQ ID NO: 9412818 - DNA, 22 bp, Homo sapiens
accattacatgatccttaccca

SEQ ID NO: 9412819 - DNA, 22 bp, Homo sapiens
accattgccccctagtgtctgt

SEQ ID NO: 9412820 - DNA, 22 bp, Homo sapiens
accattgatataactcagtctc

SEQ ID NO: 9412821 - DNA, 22 bp, Homo sapiens
accattgcactctagcctgggc

SEQ ID NO: 9412822 - DNA, 22 bp, Homo sapiens
accattctttacacttatttct

SEQ ID NO: 9412823 - DNA, 22 bp, Homo sapiens
accattgccccctagtgtctgt

SEQ ID NO: 9412824 - DNA, 22 bp, Homo sapiens
accatttaaaattgatgccttc

SEQ ID NO: 9412825 - DNA, 22 bp, Homo sapiens
accatttaaggaaaatgtatca

SEQ ID NO: 9412826 - DNA, 22 bp, Homo sapiens
accatttaaggaaaatgtatca

SEQ ID NO: 9412827 - DNA, 22 bp, Homo sapiens
accatttaaggaaaatgtatca

SEQ ID NO: 9412828 - DNA, 22 bp, Homo sapiens
agggacacgaggtcctgctggg

SEQ ID NO: 9412829 - DNA, 22 bp, Homo sapiens
agggacacatgtgattatttat

SEQ ID NO: 9412830 - DNA, 22 bp, Homo sapiens
agggaatgtagcaagatgccaa

SEQ ID NO: 9412831 - DNA, 20 bp, Homo sapiens
agggacacaatatttctgtg

SEQ ID NO: 9412832 - DNA, 22 bp, Homo sapiens
agggaattcactggaacgccct

SEQ ID NO: 9412833 - DNA, 22 bp, Homo sapiens
agggacagatgaatgactgagt

SEQ ID NO: 9412834 - DNA, 22 bp, Homo sapiens
agggacagatgaatgactgagt

SEQ ID NO: 9412835 - DNA, 22 bp, Homo sapiens
agggacacttgctttcaggccc

SEQ ID NO: 9412836 - DNA, 22 bp, Homo sapiens
agggacagatgaatgactgagt

SEQ ID NO: 9412837 - DNA, 22 bp, Homo sapiens
agggacagatgaatgactgagt

SEQ ID NO: 9412838 - DNA, 22 bp, Homo sapiens
agggacagatgaatgactgagt

SEQ ID NO: 9412839 - DNA, 22 bp, Homo sapiens
agggacagatgaatgactgagt

SEQ ID NO: 9412840 - DNA, 22 bp, Homo sapiens
agggacagatgaatgactgagt

SEQ ID NO: 9412841 - DNA, 17 bp, Homo sapiens
agggacagcagtttagg

SEQ ID NO: 9412842 - DNA, 17 bp, Homo sapiens
agggacagcagtttagg

SEQ ID NO: 9412843 - DNA, 17 bp, Homo sapiens
agggacagcagtttagg

SEQ ID NO: 9412844 - DNA, 22 bp, Homo sapiens
agggaagaggaccagagtctct

SEQ ID NO: 9412845 - DNA, 22 bp, Homo sapiens
agggaagaggaccagagtctct

SEQ ID NO: 9412846 - DNA, 22 bp, Homo sapiens
agggaagaggaccagagtctct

SEQ ID NO: 9412847 - DNA, 22 bp, Homo sapiens
agggaagaggcaaggtttatgg

SEQ ID NO: 9412848 - DNA, 22 bp, Homo sapiens
agggaagaggaccagagtctct

SEQ ID NO: 9412849 - DNA, 22 bp, Homo sapiens
agggaagcaatattagatatca

SEQ ID NO: 9412850 - DNA, 22 bp, Homo sapiens
agggaagcaatgattattattc

SEQ ID NO: 9412851 - DNA, 22 bp, Homo sapiens
agggaagcaggaatagctctga

SEQ ID NO: 9412852 - DNA, 22 bp, Homo sapiens
agggaagcaggaatagctctga

SEQ ID NO: 9412853 - DNA, 22 bp, Homo sapiens
agggaagcagcagccgcctgtc

SEQ ID NO: 9412854 - DNA, 22 bp, Homo sapiens
agggaagcttgttactgagaag

SEQ ID NO: 9412855 - DNA, 22 bp, Homo sapiens
agggaatggatgatggcaggtt

SEQ ID NO: 9412856 - DNA, 22 bp, Homo sapiens
agggaagctgctgggtccacct

SEQ ID NO: 9412857 - DNA, 22 bp, Homo sapiens
agggaagccctggctgagaccc

SEQ ID NO: 9412858 - DNA, 22 bp, Homo sapiens
agggaagctgctgggtccacct

SEQ ID NO: 9412859 - DNA, 22 bp, Homo sapiens
agggaagctgctgggtccacct

SEQ ID NO: 9412860 - DNA, 22 bp, Homo sapiens
agggaagccaagccttagagaa

SEQ ID NO: 9412861 - DNA, 22 bp, Homo sapiens
agggaagccaagccttagagaa

SEQ ID NO: 9412862 - DNA, 22 bp, Homo sapiens
agggaagccccgaggaggcacc

SEQ ID NO: 9412863 - DNA, 22 bp, Homo sapiens
agggaagccaagccttagagaa

SEQ ID NO: 9412864 - DNA, 22 bp, Homo sapiens
agggaagccctggctgagaccc

SEQ ID NO: 9412865 - DNA, 22 bp, Homo sapiens
agggaagccccgaggaggcacc

SEQ ID NO: 9412866 - DNA, 22 bp, Homo sapiens
agggagctattgtgttactttg

SEQ ID NO: 9412867 - DNA, 22 bp, Homo sapiens
agggagctaggatcctgaaggt

SEQ ID NO: 9412868 - DNA, 21 bp, Homo sapiens
agggagctatttatagtaagc

SEQ ID NO: 9412869 - DNA, 22 bp, Homo sapiens
agggagctaggatcctgaaggt

SEQ ID NO: 9412870 - DNA, 23 bp, Homo sapiens
agggagctaaaaggctggagcag

SEQ ID NO: 9412871 - DNA, 23 bp, Homo sapiens
agggagctaaaaggctggagcag

SEQ ID NO: 9412872 - DNA, 22 bp, Homo sapiens
agggagccttcctggctgtggt

SEQ ID NO: 9412873 - DNA, 22 bp, Homo sapiens
agggagccttcctggctgtggt

SEQ ID NO: 9412874 - DNA, 22 bp, Homo sapiens
accaggcctagcaagtacatta

SEQ ID NO: 9412875 - DNA, 22 bp, Homo sapiens
accaggcctagcaagtacatta

SEQ ID NO: 9412876 - DNA, 22 bp, Homo sapiens
accaggcctagcaagtacatta

SEQ ID NO: 9412877 - DNA, 19 bp, Homo sapiens
accaggcctcagaggccct

SEQ ID NO: 9412878 - DNA, 20 bp, Homo sapiens
accaggcccggtgtctcctc

SEQ ID NO: 9412879 - DNA, 22 bp, Homo sapiens
accaggccctccagctgcgtgg

SEQ ID NO: 9412880 - DNA, 22 bp, Homo sapiens
accaggccctccagctgcgtgg

SEQ ID NO: 9412881 - DNA, 22 bp, Homo sapiens
agggacagtatccatctcacag

SEQ ID NO: 9412882 - DNA, 22 bp, Homo sapiens
agggacagtatccatctcacag

SEQ ID NO: 9412883 - DNA, 22 bp, Homo sapiens
agggacagtatccatctcacag

SEQ ID NO: 9412884 - DNA, 22 bp, Homo sapiens
agggacagtatccatctcacag

SEQ ID NO: 9412885 - DNA, 22 bp, Homo sapiens
agggacagtatccatctcacag

SEQ ID NO: 9412886 - DNA, 22 bp, Homo sapiens
accaggcccaccgcatgctcct

SEQ ID NO: 9412887 - DNA, 23 bp, Homo sapiens
accaggagttgtctcaggaaaca

SEQ ID NO: 9412888 - DNA, 22 bp, Homo sapiens
accaggcccaccgcatgctcct

SEQ ID NO: 9412889 - DNA, 22 bp, Homo sapiens
accaggcccgctgctatggtgg

SEQ ID NO: 9412890 - DNA, 22 bp, Homo sapiens
accaggcccgctgctatggtgg

SEQ ID NO: 9412891 - DNA, 20 bp, Homo sapiens
accaggcccggtgtctcctc

SEQ ID NO: 9412892 - DNA, 20 bp, Homo sapiens
accaggccccgggccctgca

SEQ ID NO: 9412893 - DNA, 20 bp, Homo sapiens
accaggccccgggccctgca

SEQ ID NO: 9412894 - DNA, 22 bp, Homo sapiens
accaggcccatgtggattacta

SEQ ID NO: 9412895 - DNA, 22 bp, Homo sapiens
acatttttgggttgatgtctga

SEQ ID NO: 9412896 - DNA, 22 bp, Homo sapiens
acattttttagagtcccacatt

SEQ ID NO: 9412897 - DNA, 19 bp, Homo sapiens
accaaacagtggacggagc

SEQ ID NO: 9412898 - DNA, 22 bp, Homo sapiens
accaaaacctgctactaaagga

SEQ ID NO: 9412899 - DNA, 22 bp, Homo sapiens
accaaaacctgctactaaagga

SEQ ID NO: 9412900 - DNA, 21 bp, Homo sapiens
accaaaacctatactttctgt

SEQ ID NO: 9412901 - DNA, 21 bp, Homo sapiens
accaaaacctatactttctgt

SEQ ID NO: 9412902 - DNA, 22 bp, Homo sapiens
acatttgtctggctagaaagtt

SEQ ID NO: 9412903 - DNA, 22 bp, Homo sapiens
acatttgtcttcctcctcagtg

SEQ ID NO: 9412904 - DNA, 22 bp, Homo sapiens
acatttgtctggctagaaagtt

SEQ ID NO: 9412905 - DNA, 22 bp, Homo sapiens
acatttgtcttctttcagatta

SEQ ID NO: 9412906 - DNA, 22 bp, Homo sapiens
acatttgtcttctttcagatta

SEQ ID NO: 9412907 - DNA, 22 bp, Homo sapiens
acatttgtcttctttcagatta

SEQ ID NO: 9412908 - DNA, 22 bp, Homo sapiens
acatttttatcctgagtgccag

SEQ ID NO: 9412909 - DNA, 22 bp, Homo sapiens
acatttttactgggcatctgca

SEQ ID NO: 9412910 - DNA, 22 bp, Homo sapiens
acatttttactgggcatctgca

SEQ ID NO: 9412911 - DNA, 22 bp, Homo sapiens
acatttgtgattatctagggct

SEQ ID NO: 9412912 - DNA, 20 bp, Homo sapiens
acattttggcatactctcaa

SEQ ID NO: 9412913 - DNA, 22 bp, Homo sapiens
acatttttattcatcaaagcag

SEQ ID NO: 9412914 - DNA, 22 bp, Homo sapiens
acatttttattcatcaaagcag

SEQ ID NO: 9412915 - DNA, 22 bp, Homo sapiens
acatttttctaggaggcaaggt

SEQ ID NO: 9412916 - DNA, 22 bp, Homo sapiens
aggctggatttatggggacttc

SEQ ID NO: 9412917 - DNA, 22 bp, Homo sapiens
aggctggcaaggcagatgtgtg

SEQ ID NO: 9412918 - DNA, 22 bp, Homo sapiens
aggctggcaaggcagatgtgtg

SEQ ID NO: 9412919 - DNA, 20 bp, Homo sapiens
aggctggcactcctggccag

SEQ ID NO: 9412920 - DNA, 20 bp, Homo sapiens
aggctggcactcctggccag

SEQ ID NO: 9412921 - DNA, 22 bp, Homo sapiens
aggctggatctctgttgccttc

SEQ ID NO: 9412922 - DNA, 22 bp, Homo sapiens
aggctggatttatggggacttc

SEQ ID NO: 9412923 - DNA, 22 bp, Homo sapiens
aggctggagtgtgcagtggcgc

SEQ ID NO: 9412924 - DNA, 22 bp, Homo sapiens
aggctggagtgtgcagtggcgc

SEQ ID NO: 9412925 - DNA, 22 bp, Homo sapiens
aggctttactgcctcaggactc

SEQ ID NO: 9412926 - DNA, 22 bp, Homo sapiens
aggctggcagccacctcagcag

SEQ ID NO: 9412927 - DNA, 22 bp, Homo sapiens
agggaagaatcactgggatgtt

SEQ ID NO: 9412928 - DNA, 22 bp, Homo sapiens
agggaagaatcactgggatgtt

SEQ ID NO: 9412929 - DNA, 22 bp, Homo sapiens
agggaagaatcactgggatgtt

SEQ ID NO: 9412930 - DNA, 22 bp, Homo sapiens
agggaagagcttgcaagaaacc

SEQ ID NO: 9412931 - DNA, 22 bp, Homo sapiens
agggaagagcttgcaagaaacc

SEQ ID NO: 9412932 - DNA, 22 bp, Homo sapiens
agggaagaggaccagagtctct

SEQ ID NO: 9412933 - DNA, 22 bp, Homo sapiens
agggaagaggaccagagtctct

SEQ ID NO: 9412934 - DNA, 22 bp, Homo sapiens
agggaagagcttgcaagaaacc

SEQ ID NO: 9412935 - DNA, 22 bp, Homo sapiens
agggaagagcttgcaagaaacc

SEQ ID NO: 9412936 - DNA, 22 bp, Homo sapiens
agggaagagcttgcaagaaacc

SEQ ID NO: 9412937 - DNA, 22 bp, Homo sapiens
agggaagaggaccagagtctct

SEQ ID NO: 9412938 - DNA, 22 bp, Homo sapiens
acatttattttcagctgggaaa

SEQ ID NO: 9412939 - DNA, 22 bp, Homo sapiens
acatttattttggcacggcaca

SEQ ID NO: 9412940 - DNA, 23 bp, Homo sapiens
acatttcaatactgagggtctga

SEQ ID NO: 9412941 - DNA, 22 bp, Homo sapiens
acatttcactgttcacagcagg

SEQ ID NO: 9412942 - DNA, 22 bp, Homo sapiens
acatttatataactcactagga

SEQ ID NO: 9412943 - DNA, 22 bp, Homo sapiens
acatttatataactcactagga

SEQ ID NO: 9412944 - DNA, 22 bp, Homo sapiens
acatttattactcaggttgttg

SEQ ID NO: 9412945 - DNA, 22 bp, Homo sapiens
acatttatatttagtggggaat

SEQ ID NO: 9412946 - DNA, 22 bp, Homo sapiens
acatttacagtgctagacaatc

SEQ ID NO: 9412947 - DNA, 22 bp, Homo sapiens
acatttaatgatcctactgtga

SEQ ID NO: 9412948 - DNA, 22 bp, Homo sapiens
acatttacctagttaagtcaat

SEQ ID NO: 9412949 - DNA, 22 bp, Homo sapiens
acatttacttatcaaaagtcag

SEQ ID NO: 9412950 - DNA, 22 bp, Homo sapiens
acatttacctagttaagtcaat

SEQ ID NO: 9412951 - DNA, 22 bp, Homo sapiens
acatttaccctggaacattgga

SEQ ID NO: 9412952 - DNA, 22 bp, Homo sapiens
acatttacattttctctggcct

SEQ ID NO: 9412953 - DNA, 22 bp, Homo sapiens
acatttacctagttaagtcaat

SEQ ID NO: 9412954 - DNA, 22 bp, Homo sapiens
acatttatataactcactagga

SEQ ID NO: 9412955 - DNA, 22 bp, Homo sapiens
acatttatataactcactagga

SEQ ID NO: 9412956 - DNA, 18 bp, Homo sapiens
acatttaggagagtcaat

SEQ ID NO: 9412957 - DNA, 22 bp, Homo sapiens
acatttagagttctttactcca

SEQ ID NO: 9412958 - DNA, 22 bp, Homo sapiens
acatttagctgtacaatctatg

SEQ ID NO: 9412959 - DNA, 22 bp, Homo sapiens
acatttagctgtacaatctatg

SEQ ID NO: 9412960 - DNA, 19 bp, Homo sapiens
acatttagaatgtacttgc

SEQ ID NO: 9412961 - DNA, 19 bp, Homo sapiens
acatttagaatgtacttgc

SEQ ID NO: 9412962 - DNA, 19 bp, Homo sapiens
acatttagaatgtacttgc

SEQ ID NO: 9412963 - DNA, 22 bp, Homo sapiens
acatttagagttctttactcca

SEQ ID NO: 9412964 - DNA, 22 bp, Homo sapiens
aggctgaggctggcagctccag

SEQ ID NO: 9412965 - DNA, 22 bp, Homo sapiens
aggctgaggcgggtagatcacc

SEQ ID NO: 9412966 - DNA, 22 bp, Homo sapiens
aggctgaggatccctgtgttct

SEQ ID NO: 9412967 - DNA, 22 bp, Homo sapiens
aggctgaggatccctgtgttct

SEQ ID NO: 9412968 - DNA, 22 bp, Homo sapiens
acatttcactgttcacagcagg

SEQ ID NO: 9412969 - DNA, 22 bp, Homo sapiens
aggctgaggctggcagctccag

SEQ ID NO: 9412970 - DNA, 22 bp, Homo sapiens
aggctgaggctggcagctccag

SEQ ID NO: 9412971 - DNA, 22 bp, Homo sapiens
aggctgagggctcctgagggca

SEQ ID NO: 9412972 - DNA, 22 bp, Homo sapiens
aggctgagggctcctgagggca

SEQ ID NO: 9412973 - DNA, 22 bp, Homo sapiens
aggctgaggctttccttggaga

SEQ ID NO: 9412974 - DNA, 22 bp, Homo sapiens
aggctgaggctttccttggaga

SEQ ID NO: 9412975 - DNA, 22 bp, Homo sapiens
aggctgagggctcctgagggca

SEQ ID NO: 9412976 - DNA, 22 bp, Homo sapiens
aggctgagggctcctgagggca

SEQ ID NO: 9412977 - DNA, 22 bp, Homo sapiens
aggctgagggctcctgagggca

SEQ ID NO: 9412978 - DNA, 22 bp, Homo sapiens
aggctgagggctcctgagggca

SEQ ID NO: 9412979 - DNA, 22 bp, Homo sapiens
aggctgagggctcctgagggca

SEQ ID NO: 9412980 - DNA, 20 bp, Homo sapiens
aggctgagttctatgcactt

SEQ ID NO: 9412981 - DNA, 20 bp, Homo sapiens
aggctgagttctatgcactt

SEQ ID NO: 9412982 - DNA, 20 bp, Homo sapiens
aggctgagttctatgcactt

SEQ ID NO: 9412983 - DNA, 22 bp, Homo sapiens
aggctgagtttctcattctcgc

SEQ ID NO: 9412984 - DNA, 22 bp, Homo sapiens
aggctgagtttctcattctcgc

SEQ ID NO: 9412985 - DNA, 22 bp, Homo sapiens
aggctgatgctggctgaggctg

SEQ ID NO: 9412986 - DNA, 22 bp, Homo sapiens
aggcgcagacatacagggtctg

SEQ ID NO: 9412987 - DNA, 22 bp, Homo sapiens
aggcgcagacatacagggtctg

SEQ ID NO: 9412988 - DNA, 22 bp, Homo sapiens
aggcgcagaaggccaggggcct

SEQ ID NO: 9412989 - DNA, 23 bp, Homo sapiens
aggcgagctcttctccagcacgt

SEQ ID NO: 9412990 - DNA, 22 bp, Homo sapiens
aggcctttgtacaataatcata

SEQ ID NO: 9412991 - DNA, 22 bp, Homo sapiens
aggctagctgattgccttagaa

SEQ ID NO: 9412992 - DNA, 22 bp, Homo sapiens
aggcgcctgcgggatccttgcc

SEQ ID NO: 9412993 - DNA, 22 bp, Homo sapiens
aggcgctgagtaggcaaggagg

SEQ ID NO: 9412994 - DNA, 22 bp, Homo sapiens
aggcgcagggtttggacccagg

SEQ ID NO: 9412995 - DNA, 22 bp, Homo sapiens
aggcgcagggtttggacccagg

SEQ ID NO: 9412996 - DNA, 22 bp, Homo sapiens
aggccttgccaatgagagaact

SEQ ID NO: 9412997 - DNA, 22 bp, Homo sapiens
aggccttggaagccagggagcc

SEQ ID NO: 9412998 - DNA, 22 bp, Homo sapiens
aggccttcctcggagacaggga

SEQ ID NO: 9412999 - DNA, 22 bp, Homo sapiens
aggccttgtgagaagcagagaa

SEQ ID NO: 9413000 - DNA, 22 bp, Homo sapiens
aggccttggcatgctgccctgc

SEQ ID NO: 9413001 - DNA, 22 bp, Homo sapiens
aggccttggcagaggccaggct

SEQ ID NO: 9413002 - DNA, 22 bp, Homo sapiens
aggccttcctcggagacaggga

SEQ ID NO: 9413003 - DNA, 22 bp, Homo sapiens
aggcctgtttcttgtccagctc

SEQ ID NO: 9413004 - DNA, 22 bp, Homo sapiens
aggcctgcctggatcacacaga

SEQ ID NO: 9413005 - DNA, 22 bp, Homo sapiens
aggcctgcctggagcctggctg

SEQ ID NO: 9413006 - DNA, 22 bp, Homo sapiens
aggcctgtttccttgggttgct

SEQ ID NO: 9413007 - DNA, 22 bp, Homo sapiens
aggcctgttggcgtgggctcta

SEQ ID NO: 9413008 - DNA, 22 bp, Homo sapiens
aggcctgttccaggcccctttt

SEQ ID NO: 9413009 - DNA, 22 bp, Homo sapiens
aggcctgttccttcctgggcac

SEQ ID NO: 9413010 - DNA, 22 bp, Homo sapiens
acattgtatacagacttagtca

SEQ ID NO: 9413011 - DNA, 22 bp, Homo sapiens
aggctaggggcagtgccagcat

SEQ ID NO: 9413012 - DNA, 22 bp, Homo sapiens
aggctagtcaagtcaagcagtg

SEQ ID NO: 9413013 - DNA, 22 bp, Homo sapiens
aggctaggaatcaagcctttct

SEQ ID NO: 9413014 - DNA, 22 bp, Homo sapiens
aggctaggccttgccctggaac

SEQ ID NO: 9413015 - DNA, 22 bp, Homo sapiens
aggctaggcatgtgctaccaca

SEQ ID NO: 9413016 - DNA, 22 bp, Homo sapiens
aggctagggccatggctggtga

SEQ ID NO: 9413017 - DNA, 22 bp, Homo sapiens
aggctaggctgatgcctcttcc

SEQ ID NO: 9413018 - DNA, 22 bp, Homo sapiens
aggctaggctgatgcctcttcc

SEQ ID NO: 9413019 - DNA, 22 bp, Homo sapiens
aggctaggggaacactagaatc

SEQ ID NO: 9413020 - DNA, 22 bp, Homo sapiens
acatttaaccctcaggtttctg

SEQ ID NO: 9413021 - DNA, 22 bp, Homo sapiens
acatttaaccctcaggtttctg

SEQ ID NO: 9413022 - DNA, 22 bp, Homo sapiens
acatttaaccctcaggtttctg

SEQ ID NO: 9413023 - DNA, 22 bp, Homo sapiens
acatttaacctttgaggaactg

SEQ ID NO: 9413024 - DNA, 22 bp, Homo sapiens
acatttaatgatcctactgtga

SEQ ID NO: 9413025 - DNA, 22 bp, Homo sapiens
acatttaatgatcctactgtga

SEQ ID NO: 9413026 - DNA, 22 bp, Homo sapiens
acatttaagttaaaacctcagt

SEQ ID NO: 9413027 - DNA, 22 bp, Homo sapiens
acatttaatgatcctactgtga

SEQ ID NO: 9413028 - DNA, 22 bp, Homo sapiens
acatttaagttaaaacctcagt

SEQ ID NO: 9413029 - DNA, 22 bp, Homo sapiens
acatttaagttaaaacctcagt

SEQ ID NO: 9413030 - DNA, 22 bp, Homo sapiens
acatttaagttaaaacctcagt

SEQ ID NO: 9413031 - DNA, 22 bp, Homo sapiens
acatttaagttaaaacctcagt

SEQ ID NO: 9413032 - DNA, 22 bp, Homo sapiens
acatttaagttaaaacctcagt

SEQ ID NO: 9413033 - DNA, 19 bp, Homo sapiens
acatttaaattcagatctc

SEQ ID NO: 9413034 - DNA, 22 bp, Homo sapiens
aggctatgtaaagactagcttg

SEQ ID NO: 9413035 - DNA, 22 bp, Homo sapiens
acatttaaccaaactgtttaat

SEQ ID NO: 9413036 - DNA, 22 bp, Homo sapiens
acatttaaccaaactgtttaat

SEQ ID NO: 9413037 - DNA, 22 bp, Homo sapiens
acatttaaccaaactgtttaat

SEQ ID NO: 9413038 - DNA, 22 bp, Homo sapiens
acatttaaccaaactgtttaat

SEQ ID NO: 9413039 - DNA, 22 bp, Homo sapiens
acatttaaccctcaggtttctg

SEQ ID NO: 9413040 - DNA, 22 bp, Homo sapiens
aggcaggctggtctgaagagtg

SEQ ID NO: 9413041 - DNA, 22 bp, Homo sapiens
aggcaggctggtctgaagagtg

SEQ ID NO: 9413042 - DNA, 22 bp, Homo sapiens
aggcagggctcatttcttaggc

SEQ ID NO: 9413043 - DNA, 22 bp, Homo sapiens
aggcagggaccagttgttttct

SEQ ID NO: 9413044 - DNA, 22 bp, Homo sapiens
aggcagggaccagttgttttct

SEQ ID NO: 9413045 - DNA, 22 bp, Homo sapiens
aggcaggcactccggaagtgtc

SEQ ID NO: 9413046 - DNA, 17 bp, Homo sapiens
aggcaggcagagcggga

SEQ ID NO: 9413047 - DNA, 17 bp, Homo sapiens
aggcaggcagagcggga

SEQ ID NO: 9413048 - DNA, 22 bp, Homo sapiens
aggcaggcagctgtcaccactc

SEQ ID NO: 9413049 - DNA, 22 bp, Homo sapiens
aggcaggcagctgtcaccactc

SEQ ID NO: 9413050 - DNA, 22 bp, Homo sapiens
aggcaggcagggctcactgtct

SEQ ID NO: 9413051 - DNA, 22 bp, Homo sapiens
aggcaggcagggctcactgtct

SEQ ID NO: 9413052 - DNA, 22 bp, Homo sapiens
aggcagggctgggattagactc

SEQ ID NO: 9413053 - DNA, 22 bp, Homo sapiens
aggcagggctcatttcttaggc

SEQ ID NO: 9413054 - DNA, 22 bp, Homo sapiens
aggcagggctgggattagactc

SEQ ID NO: 9413055 - DNA, 22 bp, Homo sapiens
aggcaggggagctggaagggta

SEQ ID NO: 9413056 - DNA, 22 bp, Homo sapiens
aggcaggggagctggaagggta

SEQ ID NO: 9413057 - DNA, 22 bp, Homo sapiens
aggcaggggagctggaagggta

SEQ ID NO: 9413058 - DNA, 22 bp, Homo sapiens
acatgaaagttattctgagttg

SEQ ID NO: 9413059 - DNA, 22 bp, Homo sapiens
acatgagactgggtttgtaggg

SEQ ID NO: 9413060 - DNA, 21 bp, Homo sapiens
acatgagacacacatatatgt

SEQ ID NO: 9413061 - DNA, 19 bp, Homo sapiens
acatgcaaggcacctgcag

SEQ ID NO: 9413062 - DNA, 22 bp, Homo sapiens
acatgcacacctatatacatgt

SEQ ID NO: 9413063 - DNA, 22 bp, Homo sapiens
acatgcacacctatatacatgt

SEQ ID NO: 9413064 - DNA, 22 bp, Homo sapiens
acatgcacacgattcagtctgg

SEQ ID NO: 9413065 - DNA, 22 bp, Homo sapiens
acatgatttgcatgatttgtaa

SEQ ID NO: 9413066 - DNA, 23 bp, Homo sapiens
acatgcaaaaatcacagtctcct

SEQ ID NO: 9413067 - DNA, 22 bp, Homo sapiens
acatgatttcagggaattctca

SEQ ID NO: 9413068 - DNA, 22 bp, Homo sapiens
acatgattcttgataggcattg

SEQ ID NO: 9413069 - DNA, 22 bp, Homo sapiens
acatgattaaaagattttaaag

SEQ ID NO: 9413070 - DNA, 22 bp, Homo sapiens
acatgatcttatgtagaagatc

SEQ ID NO: 9413071 - DNA, 23 bp, Homo sapiens
acatgatacacaattagcaaacc

SEQ ID NO: 9413072 - DNA, 22 bp, Homo sapiens
acatgatcttatgtagaagatc

SEQ ID NO: 9413073 - DNA, 22 bp, Homo sapiens
acatgatctgacttgcttttta

SEQ ID NO: 9413074 - DNA, 22 bp, Homo sapiens
acatgatcccacctgcctataa

SEQ ID NO: 9413075 - DNA, 22 bp, Homo sapiens
acatgagaggctgtggagtaca

SEQ ID NO: 9413076 - DNA, 22 bp, Homo sapiens
acatgagattagctcacccact

SEQ ID NO: 9413077 - DNA, 22 bp, Homo sapiens
acatgagaggctgtggagtaca

SEQ ID NO: 9413078 - DNA, 22 bp, Homo sapiens
acatgaggtgctataggtctac

SEQ ID NO: 9413079 - DNA, 22 bp, Homo sapiens
acatgaggaactcaggagtcac

SEQ ID NO: 9413080 - DNA, 20 bp, Homo sapiens
aggccctgccagggacggag

SEQ ID NO: 9413081 - DNA, 20 bp, Homo sapiens
acatgcagtggtcatttcag

SEQ ID NO: 9413082 - DNA, 22 bp, Homo sapiens
acatgcaggaaaatgcacagat

SEQ ID NO: 9413083 - DNA, 22 bp, Homo sapiens
acatgcacggcaccatcttctg

SEQ ID NO: 9413084 - DNA, 22 bp, Homo sapiens
aggccctgtccatggtgctgaa

SEQ ID NO: 9413085 - DNA, 22 bp, Homo sapiens
aggccctgtccatggtgctgaa

SEQ ID NO: 9413086 - DNA, 22 bp, Homo sapiens
aggccctgtccatggtgctgaa

SEQ ID NO: 9413087 - DNA, 22 bp, Homo sapiens
aggccctgtccatggtgctgaa

SEQ ID NO: 9413088 - DNA, 22 bp, Homo sapiens
aggccctgttatgagccactgt

SEQ ID NO: 9413089 - DNA, 20 bp, Homo sapiens
aggccctgtgcatcttgttt

SEQ ID NO: 9413090 - DNA, 20 bp, Homo sapiens
aggccctgtgcatcttgttt

SEQ ID NO: 9413091 - DNA, 22 bp, Homo sapiens
aggccctgttatgagccactgt

SEQ ID NO: 9413092 - DNA, 22 bp, Homo sapiens
aggccctgttatgagccactgt

SEQ ID NO: 9413093 - DNA, 22 bp, Homo sapiens
aggccctgtaaggtgtggagat

SEQ ID NO: 9413094 - DNA, 22 bp, Homo sapiens
aggccctgtaaggtgtggagat

SEQ ID NO: 9413095 - DNA, 22 bp, Homo sapiens
aggccctgtaaggtgtggagat

SEQ ID NO: 9413096 - DNA, 22 bp, Homo sapiens
aggccctgtaaggtgtggagat

SEQ ID NO: 9413097 - DNA, 22 bp, Homo sapiens
aggccctggtcaggtctggctg

SEQ ID NO: 9413098 - DNA, 22 bp, Homo sapiens
aggccctgcccagagctcctcg

SEQ ID NO: 9413099 - DNA, 22 bp, Homo sapiens
aggccctgcccagagctcctcg

SEQ ID NO: 9413100 - DNA, 21 bp, Homo sapiens
acatggactgtgaatggggac

SEQ ID NO: 9413101 - DNA, 22 bp, Homo sapiens
acatggagctcaaacatgagtg

SEQ ID NO: 9413102 - DNA, 22 bp, Homo sapiens
acatggagaccagatggaagta

SEQ ID NO: 9413103 - DNA, 22 bp, Homo sapiens
acatggattgttttaaaagatg

SEQ ID NO: 9413104 - DNA, 17 bp, Homo sapiens
acatggcagttcacgct

SEQ ID NO: 9413105 - DNA, 22 bp, Homo sapiens
acatggcacccagatctcaaaa

SEQ ID NO: 9413106 - DNA, 22 bp, Homo sapiens
acatggcaggaatcatgtgttt

SEQ ID NO: 9413107 - DNA, 22 bp, Homo sapiens
aggcctgcctggagcctggctg

SEQ ID NO: 9413108 - DNA, 22 bp, Homo sapiens
aggcccttggagtagaggctga

SEQ ID NO: 9413109 - DNA, 22 bp, Homo sapiens
aggcccttggactcatgctcga

SEQ ID NO: 9413110 - DNA, 22 bp, Homo sapiens
aggcccttggactcatgctcga

SEQ ID NO: 9413111 - DNA, 22 bp, Homo sapiens
acatggaaaactaactgctttt

SEQ ID NO: 9413112 - DNA, 22 bp, Homo sapiens
aggcccttgggtcctctccaca

SEQ ID NO: 9413113 - DNA, 22 bp, Homo sapiens
aggcccttggactcatgctcga

SEQ ID NO: 9413114 - DNA, 22 bp, Homo sapiens
aggcccttcttggtggctcagg

SEQ ID NO: 9413115 - DNA, 22 bp, Homo sapiens
aggcccttaggacccctgcgtg

SEQ ID NO: 9413116 - DNA, 22 bp, Homo sapiens
aggccctgttgtagcattttgg

SEQ ID NO: 9413117 - DNA, 22 bp, Homo sapiens
aggccctgttgtagcattttgg

SEQ ID NO: 9413118 - DNA, 21 bp, Homo sapiens
acatggaagagaaattaacca

SEQ ID NO: 9413119 - DNA, 22 bp, Homo sapiens
acatggaagataaaaatactca

SEQ ID NO: 9413120 - DNA, 22 bp, Homo sapiens
acatggaagataaaaatactca

SEQ ID NO: 9413121 - DNA, 22 bp, Homo sapiens
acatggaatgtgtactaagtta

SEQ ID NO: 9413122 - DNA, 20 bp, Homo sapiens
acatggaaggtcaaactatc

SEQ ID NO: 9413123 - DNA, 20 bp, Homo sapiens
acatggaaggtcaaactatc

SEQ ID NO: 9413124 - DNA, 22 bp, Homo sapiens
acatggaagcaaagttctattt

SEQ ID NO: 9413125 - DNA, 22 bp, Homo sapiens
acatggaagcaaagttctattt

SEQ ID NO: 9413126 - DNA, 22 bp, Homo sapiens
acagctgtgaagcaagcactct

SEQ ID NO: 9413127 - DNA, 22 bp, Homo sapiens
acagctgtgacttagagaagtt

SEQ ID NO: 9413128 - DNA, 22 bp, Homo sapiens
acagctgtgacttagagaagtt

SEQ ID NO: 9413129 - DNA, 22 bp, Homo sapiens
acagctgtgacttagagaagtt

SEQ ID NO: 9413130 - DNA, 22 bp, Homo sapiens
acagctgtgagggtcacttgta

SEQ ID NO: 9413131 - DNA, 22 bp, Homo sapiens
acagctgtgagggtcacttgta

SEQ ID NO: 9413132 - DNA, 22 bp, Homo sapiens
acagctgtgggctctgcatata

SEQ ID NO: 9413133 - DNA, 22 bp, Homo sapiens
acagctgtgggctctgcatata

SEQ ID NO: 9413134 - DNA, 22 bp, Homo sapiens
acagctgtgggctctgcatata

SEQ ID NO: 9413135 - DNA, 22 bp, Homo sapiens
acagctgtgggctctgcatata

SEQ ID NO: 9413136 - DNA, 22 bp, Homo sapiens
acagctgtggccacttgcatcc

SEQ ID NO: 9413137 - DNA, 22 bp, Homo sapiens
acagctgtgatttctatcatga

SEQ ID NO: 9413138 - DNA, 22 bp, Homo sapiens
acagctgtgatttctatcatga

SEQ ID NO: 9413139 - DNA, 22 bp, Homo sapiens
acagctgtgaagcaagcactct

SEQ ID NO: 9413140 - DNA, 22 bp, Homo sapiens
acagctgtgaaaatccacagga

SEQ ID NO: 9413141 - DNA, 22 bp, Homo sapiens
acagctgtgaagcaagcactct

SEQ ID NO: 9413142 - DNA, 22 bp, Homo sapiens
acagctgtattcaagttgcaag

SEQ ID NO: 9413143 - DNA, 22 bp, Homo sapiens
agctgggtgaaggcagatggct

SEQ ID NO: 9413144 - DNA, 21 bp, Homo sapiens
acagctgtcttagcttgggct

SEQ ID NO: 9413145 - DNA, 22 bp, Homo sapiens
acagctgtgaaaatccacagga

SEQ ID NO: 9413146 - DNA, 22 bp, Homo sapiens
agctgggtcttgggccaggaga

SEQ ID NO: 9413147 - DNA, 22 bp, Homo sapiens
agctgggtccctctgctgatgg

SEQ ID NO: 9413148 - DNA, 22 bp, Homo sapiens
agctgggtcttgggccaggaga

SEQ ID NO: 9413149 - DNA, 22 bp, Homo sapiens
agctgggtgaaggcagatggct

SEQ ID NO: 9413150 - DNA, 22 bp, Homo sapiens
acaggccataaaggcaggccct

SEQ ID NO: 9413151 - DNA, 22 bp, Homo sapiens
acaggcaggtaatttacatatt

SEQ ID NO: 9413152 - DNA, 22 bp, Homo sapiens
acaggcccagctcttcaccaga

SEQ ID NO: 9413153 - DNA, 22 bp, Homo sapiens
acaggcccagctcttcaccaga

SEQ ID NO: 9413154 - DNA, 22 bp, Homo sapiens
acaggccataaaggcaggccct

SEQ ID NO: 9413155 - DNA, 22 bp, Homo sapiens
acagctgtgttttataatcagc

SEQ ID NO: 9413156 - DNA, 23 bp, Homo sapiens
acagctgttgaaatttcagtggg

SEQ ID NO: 9413157 - DNA, 22 bp, Homo sapiens
acagcttagccagtcaagctct

SEQ ID NO: 9413158 - DNA, 22 bp, Homo sapiens
acagctgtggggactcttgccc

SEQ ID NO: 9413159 - DNA, 22 bp, Homo sapiens
acagctgtggggactcttgccc

SEQ ID NO: 9413160 - DNA, 22 bp, Homo sapiens
acagctgtggtctccttagtgt

SEQ ID NO: 9413161 - DNA, 22 bp, Homo sapiens
acagctgtggggactcttgccc

SEQ ID NO: 9413162 - DNA, 22 bp, Homo sapiens
acagctgtgttttataatcagc

SEQ ID NO: 9413163 - DNA, 22 bp, Homo sapiens
acagctgtgttttataatcagc

SEQ ID NO: 9413164 - DNA, 22 bp, Homo sapiens
acagctgtggtctccttagtgt

SEQ ID NO: 9413165 - DNA, 22 bp, Homo sapiens
agctttatgcttcctacaagct

SEQ ID NO: 9413166 - DNA, 22 bp, Homo sapiens
acaggcctgggttcaaatttgg

SEQ ID NO: 9413167 - DNA, 22 bp, Homo sapiens
agctttatatttaatgaattct

SEQ ID NO: 9413168 - DNA, 22 bp, Homo sapiens
acaggcctggggtacaagttct

SEQ ID NO: 9413169 - DNA, 22 bp, Homo sapiens
acaggcctggaaaggaaggagt

SEQ ID NO: 9413170 - DNA, 22 bp, Homo sapiens
agctttatcacaatattggcta

SEQ ID NO: 9413171 - DNA, 17 bp, Homo sapiens
acaggcctgcttgcact

SEQ ID NO: 9413172 - DNA, 22 bp, Homo sapiens
acaggcctgatgttatcctatt

SEQ ID NO: 9413173 - DNA, 17 bp, Homo sapiens
acaggcctgcttgcact

SEQ ID NO: 9413174 - DNA, 22 bp, Homo sapiens
acaggcctgagattttgcattt

SEQ ID NO: 9413175 - DNA, 22 bp, Homo sapiens
acaggcctgagattttgcattt

SEQ ID NO: 9413176 - DNA, 22 bp, Homo sapiens
acaggcctgatgccttggctgg

SEQ ID NO: 9413177 - DNA, 22 bp, Homo sapiens
acaggcctcccatccggagccc

SEQ ID NO: 9413178 - DNA, 22 bp, Homo sapiens
acaggcctgacacacagagggc

SEQ ID NO: 9413179 - DNA, 18 bp, Homo sapiens
acaggcctcagtcctgca

SEQ ID NO: 9413180 - DNA, 22 bp, Homo sapiens
acaggcctcaagacacccaggt

SEQ ID NO: 9413181 - DNA, 22 bp, Homo sapiens
acaggcctcaaatagggtgcct

SEQ ID NO: 9413182 - DNA, 22 bp, Homo sapiens
acaggcctatgttccattgcag

SEQ ID NO: 9413183 - DNA, 22 bp, Homo sapiens
acaggcctagggtcaatttcct

SEQ ID NO: 9413184 - DNA, 22 bp, Homo sapiens
acaggcctagctaatgctttcc

SEQ ID NO: 9413185 - DNA, 22 bp, Homo sapiens
acaggcctagctaatgctttcc

SEQ ID NO: 9413186 - DNA, 22 bp, Homo sapiens
acaggcctacgaagtcaggtgc

SEQ ID NO: 9413187 - DNA, 22 bp, Homo sapiens
acaggcctacgaagtcaggtgc

SEQ ID NO: 9413188 - DNA, 22 bp, Homo sapiens
aggaatgtcatagaataatcat

SEQ ID NO: 9413189 - DNA, 22 bp, Homo sapiens
aggaatgtcatagaataatcat

SEQ ID NO: 9413190 - DNA, 22 bp, Homo sapiens
aggaatggtgctcagcagaaat

SEQ ID NO: 9413191 - DNA, 22 bp, Homo sapiens
aggaatggttatggggatagta

SEQ ID NO: 9413192 - DNA, 19 bp, Homo sapiens
aggaatggaattaattctg

SEQ ID NO: 9413193 - DNA, 19 bp, Homo sapiens
aggaatggaattaattctg

SEQ ID NO: 9413194 - DNA, 19 bp, Homo sapiens
aggaatggaattaattctg

SEQ ID NO: 9413195 - DNA, 19 bp, Homo sapiens
aggaatggaattaattctg

SEQ ID NO: 9413196 - DNA, 19 bp, Homo sapiens
aggaatggaattaattctg

SEQ ID NO: 9413197 - DNA, 19 bp, Homo sapiens
aggaatggaattaattctg

SEQ ID NO: 9413198 - DNA, 18 bp, Homo sapiens
acaggctgtgggaatggt

SEQ ID NO: 9413199 - DNA, 18 bp, Homo sapiens
acaggctgtgggaatggt

SEQ ID NO: 9413200 - DNA, 22 bp, Homo sapiens
acaggctgttggggtccagggt

SEQ ID NO: 9413201 - DNA, 18 bp, Homo sapiens
acaggctgtgggaatggt

SEQ ID NO: 9413202 - DNA, 22 bp, Homo sapiens
aggaatgacttgtagctctgag

SEQ ID NO: 9413203 - DNA, 22 bp, Homo sapiens
aggaatgacttgtagctctgag

SEQ ID NO: 9413204 - DNA, 22 bp, Homo sapiens
aggaatgacttgtagctctgag

SEQ ID NO: 9413205 - DNA, 22 bp, Homo sapiens
aggaatgatagtaaaagagaat

SEQ ID NO: 9413206 - DNA, 22 bp, Homo sapiens
aggaatgatagtaaaagagaat

SEQ ID NO: 9413207 - DNA, 22 bp, Homo sapiens
aggaatgattcaagacttggct

SEQ ID NO: 9413208 - DNA, 22 bp, Homo sapiens
aggaatgacatagaaaggggag

SEQ ID NO: 9413209 - DNA, 22 bp, Homo sapiens
aggaatgacaggcctcccgcag

SEQ ID NO: 9413210 - DNA, 22 bp, Homo sapiens
aggaagggctgtttctccaaga

SEQ ID NO: 9413211 - DNA, 22 bp, Homo sapiens
acaggctgctgagccatttgct

SEQ ID NO: 9413212 - DNA, 22 bp, Homo sapiens
acaggctgcctaccaagtatca

SEQ ID NO: 9413213 - DNA, 22 bp, Homo sapiens
acaggctgctgagccatttgct

SEQ ID NO: 9413214 - DNA, 22 bp, Homo sapiens
acaggctgcccgctccccacct

SEQ ID NO: 9413215 - DNA, 22 bp, Homo sapiens
acaggctgccacttgcatccaa

SEQ ID NO: 9413216 - DNA, 22 bp, Homo sapiens
acaggctctggggcaggatggc

SEQ ID NO: 9413217 - DNA, 22 bp, Homo sapiens
acaggctctggggcaggatggc

SEQ ID NO: 9413218 - DNA, 22 bp, Homo sapiens
acaggctggtggtcctggccat

SEQ ID NO: 9413219 - DNA, 22 bp, Homo sapiens
acaggctgggcgcttcctgcgg

SEQ ID NO: 9413220 - DNA, 22 bp, Homo sapiens
acaggctgggcgcttcctgcgg

SEQ ID NO: 9413221 - DNA, 22 bp, Homo sapiens
acaggctgggcgcttcctgcgg

SEQ ID NO: 9413222 - DNA, 22 bp, Homo sapiens
acaggctgggcgcttcctgcgg

SEQ ID NO: 9413223 - DNA, 22 bp, Homo sapiens
acaggctgctgggctccgtgct

SEQ ID NO: 9413224 - DNA, 22 bp, Homo sapiens
acaggctgctgggctccgtgct

SEQ ID NO: 9413225 - DNA, 22 bp, Homo sapiens
acaggctgctgggctccgtgct

SEQ ID NO: 9413226 - DNA, 22 bp, Homo sapiens
acaggctgctgggctccgtgct

SEQ ID NO: 9413227 - DNA, 22 bp, Homo sapiens
acaggctggaggaggaccaaga

SEQ ID NO: 9413228 - DNA, 17 bp, Homo sapiens
agctgccttgcttgagc

SEQ ID NO: 9413229 - DNA, 22 bp, Homo sapiens
agctgccttccctctcattagg

SEQ ID NO: 9413230 - DNA, 20 bp, Homo sapiens
agctgccttcattttctaga

SEQ ID NO: 9413231 - DNA, 21 bp, Homo sapiens
agctgcctttagagagaacca

SEQ ID NO: 9413232 - DNA, 17 bp, Homo sapiens
agctgccttgcttgagc

SEQ ID NO: 9413233 - DNA, 22 bp, Homo sapiens
agctgccttttgagaaagctca

SEQ ID NO: 9413234 - DNA, 21 bp, Homo sapiens
agctgcctttagagagaacca

SEQ ID NO: 9413235 - DNA, 22 bp, Homo sapiens
agctgcctttgcatcactttaa

SEQ ID NO: 9413236 - DNA, 22 bp, Homo sapiens
acagcctgcagccccaggtcgc

SEQ ID NO: 9413237 - DNA, 22 bp, Homo sapiens
acagcctgctgcctgcttcttg

SEQ ID NO: 9413238 - DNA, 22 bp, Homo sapiens
acagcctgctgcctgcttcttg

SEQ ID NO: 9413239 - DNA, 22 bp, Homo sapiens
acagccttgggttctctggggg

SEQ ID NO: 9413240 - DNA, 23 bp, Homo sapiens
acagccttctggggcttctgggc

SEQ ID NO: 9413241 - DNA, 22 bp, Homo sapiens
agctgcctgtcctaggccatca

SEQ ID NO: 9413242 - DNA, 22 bp, Homo sapiens
agctgcctgtcctaggccatca

SEQ ID NO: 9413243 - DNA, 19 bp, Homo sapiens
agctgcctgtgcgcgcccg

SEQ ID NO: 9413244 - DNA, 22 bp, Homo sapiens
agctgcctgtgtagaaccatct

SEQ ID NO: 9413245 - DNA, 22 bp, Homo sapiens
agctgcctgtgctgggagccca

SEQ ID NO: 9413246 - DNA, 19 bp, Homo sapiens
agctgcctgtgcgcgcccg

SEQ ID NO: 9413247 - DNA, 22 bp, Homo sapiens
agctgcctgtgctgggagccca

SEQ ID NO: 9413248 - DNA, 22 bp, Homo sapiens
agctgcctgtgctgggagccca

SEQ ID NO: 9413249 - DNA, 22 bp, Homo sapiens
agctgccttaaattactttgtg

SEQ ID NO: 9413250 - DNA, 22 bp, Homo sapiens
agctgccttatggagtatgaaa

SEQ ID NO: 9413251 - DNA, 22 bp, Homo sapiens
agctgccttatggagtatgaaa

SEQ ID NO: 9413252 - DNA, 22 bp, Homo sapiens
agctgcctgtgtagaaccatct

SEQ ID NO: 9413253 - DNA, 22 bp, Homo sapiens
agctgcctgtaaaatgtgtgat

SEQ ID NO: 9413254 - DNA, 22 bp, Homo sapiens
agctgcctgtcctaggccatca

SEQ ID NO: 9413255 - DNA, 22 bp, Homo sapiens
agctgcctgtcctaggccatca

SEQ ID NO: 9413256 - DNA, 22 bp, Homo sapiens
agctgcctgggcttgtacacct

SEQ ID NO: 9413257 - DNA, 15 bp, Homo sapiens
agctgcctgggtgct

SEQ ID NO: 9413258 - DNA, 22 bp, Homo sapiens
agctgccccatgagaggcaggt

SEQ ID NO: 9413259 - DNA, 22 bp, Homo sapiens
agctgcccagctaggaagaagg

SEQ ID NO: 9413260 - DNA, 22 bp, Homo sapiens
agctgccccatgagaggcaggt

SEQ ID NO: 9413261 - DNA, 22 bp, Homo sapiens
agctgccagcatcccggaaggg

SEQ ID NO: 9413262 - DNA, 21 bp, Homo sapiens
acagcagacaggcttaggacc

SEQ ID NO: 9413263 - DNA, 22 bp, Homo sapiens
acagcagacacaggcacgctgt

SEQ ID NO: 9413264 - DNA, 22 bp, Homo sapiens
acagcacttgggttttcctgtt

SEQ ID NO: 9413265 - DNA, 22 bp, Homo sapiens
acagcactggtcccgcaagcct

SEQ ID NO: 9413266 - DNA, 22 bp, Homo sapiens
acagcacaggagttgaatgggc

SEQ ID NO: 9413267 - DNA, 23 bp, Homo sapiens
acagcacccatgtcatctggctc

SEQ ID NO: 9413268 - DNA, 22 bp, Homo sapiens
agctgccatcctgttcagcacc

SEQ ID NO: 9413269 - DNA, 22 bp, Homo sapiens
agctgcccagataggaggaggc

SEQ ID NO: 9413270 - DNA, 21 bp, Homo sapiens
agctgcccagagtagggaagg

SEQ ID NO: 9413271 - DNA, 22 bp, Homo sapiens
agctgcccaatcctgcagggcg

SEQ ID NO: 9413272 - DNA, 22 bp, Homo sapiens
agctgcccaaggtcacagagct

SEQ ID NO: 9413273 - DNA, 22 bp, Homo sapiens
agctgccatctgaagaactgca

SEQ ID NO: 9413274 - DNA, 22 bp, Homo sapiens
agctgcccaatcctgcagggcg

SEQ ID NO: 9413275 - DNA, 22 bp, Homo sapiens
agctgcccaaggtcacagagct

SEQ ID NO: 9413276 - DNA, 22 bp, Homo sapiens
acagctcagacatcactgctct

SEQ ID NO: 9413277 - DNA, 22 bp, Homo sapiens
acagctcatttgtaaaacggag

SEQ ID NO: 9413278 - DNA, 22 bp, Homo sapiens
acagctcagacatcactgctct

SEQ ID NO: 9413279 - DNA, 22 bp, Homo sapiens
acagctaggaaatggaagaact

SEQ ID NO: 9413280 - DNA, 22 bp, Homo sapiens
acagctcactcacagggctagt

SEQ ID NO: 9413281 - DNA, 22 bp, Homo sapiens
acagctacatggaatttcattt

SEQ ID NO: 9413282 - DNA, 22 bp, Homo sapiens
acagctactctgcagataaatc

SEQ ID NO: 9413283 - DNA, 22 bp, Homo sapiens
acagctaatccccctagattct

SEQ ID NO: 9413284 - DNA, 22 bp, Homo sapiens
acagctctgggtgcaggaggtg

SEQ ID NO: 9413285 - DNA, 22 bp, Homo sapiens
acagctctgcattttgggttaa

SEQ ID NO: 9413286 - DNA, 22 bp, Homo sapiens
acagctctgcatggcagttatt

SEQ ID NO: 9413287 - DNA, 22 bp, Homo sapiens
acagctctccctcagagaaatg

SEQ ID NO: 9413288 - DNA, 22 bp, Homo sapiens
acagctctgagatattactatt

SEQ ID NO: 9413289 - DNA, 22 bp, Homo sapiens
acagctctgagatattactatt

SEQ ID NO: 9413290 - DNA, 22 bp, Homo sapiens
acagctcctaacaaaggctctc

SEQ ID NO: 9413291 - DNA, 22 bp, Homo sapiens
acagctcctaacaaaggctctc

SEQ ID NO: 9413292 - DNA, 22 bp, Homo sapiens
acagctctccctcagagaaatg

SEQ ID NO: 9413293 - DNA, 22 bp, Homo sapiens
acagctcttcttcaagcctggc

SEQ ID NO: 9413294 - DNA, 22 bp, Homo sapiens
acagctcttcttcaagcctggc

SEQ ID NO: 9413295 - DNA, 22 bp, Homo sapiens
acagctgattggatcaaggaca

SEQ ID NO: 9413296 - DNA, 22 bp, Homo sapiens
acagctgatagttacctctgtc

SEQ ID NO: 9413297 - DNA, 22 bp, Homo sapiens
acagctctgtgtattgtcatct

SEQ ID NO: 9413298 - DNA, 22 bp, Homo sapiens
acagctcttaggcagaaccaac

SEQ ID NO: 9413299 - DNA, 22 bp, Homo sapiens
acagctcttaggcagaaccaac

SEQ ID NO: 9413300 - DNA, 22 bp, Homo sapiens
agctggggctgtggttgtgatt

SEQ ID NO: 9413301 - DNA, 22 bp, Homo sapiens
agctggggctgtggttgtgatt

SEQ ID NO: 9413302 - DNA, 22 bp, Homo sapiens
agctggggctgtggttgtgatt

SEQ ID NO: 9413303 - DNA, 22 bp, Homo sapiens
agctggggctgtggttgtgatt

SEQ ID NO: 9413304 - DNA, 22 bp, Homo sapiens
agctgggggttggataagggta

SEQ ID NO: 9413305 - DNA, 22 bp, Homo sapiens
agctgggtacagcctgtgccta

SEQ ID NO: 9413306 - DNA, 22 bp, Homo sapiens
agctgggtcaataggaaatgta

SEQ ID NO: 9413307 - DNA, 22 bp, Homo sapiens
acagctgcatgatggtccagat

SEQ ID NO: 9413308 - DNA, 23 bp, Homo sapiens
acagctgcacctggccgcctggc

SEQ ID NO: 9413309 - DNA, 22 bp, Homo sapiens
acagctgcacactgaacttggt

SEQ ID NO: 9413310 - DNA, 22 bp, Homo sapiens
acagctgattggatcaaggaca

SEQ ID NO: 9413311 - DNA, 22 bp, Homo sapiens
acagctgcaaattgttagagga

SEQ ID NO: 9413312 - DNA, 22 bp, Homo sapiens
acagctgcacactgaacttggt

SEQ ID NO: 9413313 - DNA, 22 bp, Homo sapiens
agctggggctgcagagaacagg

SEQ ID NO: 9413314 - DNA, 22 bp, Homo sapiens
agctggggctgcagagaacagg

SEQ ID NO: 9413315 - DNA, 19 bp, Homo sapiens
agctggggcggtgtgtgtt

SEQ ID NO: 9413316 - DNA, 22 bp, Homo sapiens
acagggcaacctctgggagact

SEQ ID NO: 9413317 - DNA, 18 bp, Homo sapiens
acagggatggggtaagtg

SEQ ID NO: 9413318 - DNA, 18 bp, Homo sapiens
acagggatggggtaagtg

SEQ ID NO: 9413319 - DNA, 22 bp, Homo sapiens
acagggcaacctctgggagact

SEQ ID NO: 9413320 - DNA, 18 bp, Homo sapiens
acagggagggcgctgggg

SEQ ID NO: 9413321 - DNA, 18 bp, Homo sapiens
acagggagggcgctgggg

SEQ ID NO: 9413322 - DNA, 18 bp, Homo sapiens
acagggagggcgctgggg

SEQ ID NO: 9413323 - DNA, 18 bp, Homo sapiens
acagggagggcgctgggg

SEQ ID NO: 9413324 - DNA, 22 bp, Homo sapiens
acagggagtctgaggggatagt

SEQ ID NO: 9413325 - DNA, 22 bp, Homo sapiens
acagggagtctgaggggatagt

SEQ ID NO: 9413326 - DNA, 22 bp, Homo sapiens
acagggagtctgaggggatagt

SEQ ID NO: 9413327 - DNA, 22 bp, Homo sapiens
acagggagtgcaattcatattg

SEQ ID NO: 9413328 - DNA, 22 bp, Homo sapiens
acagggagtgcaattcatattg

SEQ ID NO: 9413329 - DNA, 22 bp, Homo sapiens
acaggtggacacagcagcagtc

SEQ ID NO: 9413330 - DNA, 22 bp, Homo sapiens
acaggtggaggctttaggaggt

SEQ ID NO: 9413331 - DNA, 22 bp, Homo sapiens
acaggtggacacagcagcagtc

SEQ ID NO: 9413332 - DNA, 22 bp, Homo sapiens
acagggttgtggccttaaaggc

SEQ ID NO: 9413333 - DNA, 22 bp, Homo sapiens
acagggcacctgaggtaggaag

SEQ ID NO: 9413334 - DNA, 22 bp, Homo sapiens
acagggttgccaaatactaatt

SEQ ID NO: 9413335 - DNA, 22 bp, Homo sapiens
acagggttgaagagcataaagt

SEQ ID NO: 9413336 - DNA, 22 bp, Homo sapiens
acaggtgggcttaagagtcggc

SEQ ID NO: 9413337 - DNA, 22 bp, Homo sapiens
acaggtggggaggctgaggttc

SEQ ID NO: 9413338 - DNA, 22 bp, Homo sapiens
acaggtggggcacttggagcct

SEQ ID NO: 9413339 - DNA, 22 bp, Homo sapiens
acaggtggtaaaatggactgtc

SEQ ID NO: 9413340 - DNA, 22 bp, Homo sapiens
acaggtggtagagtggaaagag

SEQ ID NO: 9413341 - DNA, 22 bp, Homo sapiens
acaggtggtaaaatggactgtc

SEQ ID NO: 9413342 - DNA, 22 bp, Homo sapiens
acaggtggcttattggctgatt

SEQ ID NO: 9413343 - DNA, 22 bp, Homo sapiens
acaggtgggcttaagagtcggc

SEQ ID NO: 9413344 - DNA, 22 bp, Homo sapiens
acaggtggccccgagggagtgg

SEQ ID NO: 9413345 - DNA, 22 bp, Homo sapiens
acaggtggcttattggctgatt

SEQ ID NO: 9413346 - DNA, 22 bp, Homo sapiens
acaggtggcttattggctgatt

SEQ ID NO: 9413347 - DNA, 22 bp, Homo sapiens
acaggtggccccgagggagtgg

SEQ ID NO: 9413348 - DNA, 21 bp, Homo sapiens
aggagctgtgttagctggtcg

SEQ ID NO: 9413349 - DNA, 21 bp, Homo sapiens
aggagctgtgttagctggtcg

SEQ ID NO: 9413350 - DNA, 22 bp, Homo sapiens
aggagctgttttgttcagcaaa

SEQ ID NO: 9413351 - DNA, 21 bp, Homo sapiens
aggagctgtgttagctggtcg

SEQ ID NO: 9413352 - DNA, 22 bp, Homo sapiens
aggagctgttttgttcagcaaa

SEQ ID NO: 9413353 - DNA, 22 bp, Homo sapiens
acaggtggtctttgctcctttt

SEQ ID NO: 9413354 - DNA, 22 bp, Homo sapiens
aggagctggagtccaggcaagt

SEQ ID NO: 9413355 - DNA, 22 bp, Homo sapiens
aggagctggagtccaggcaagt

SEQ ID NO: 9413356 - DNA, 21 bp, Homo sapiens
aggagctgtgtgcttcctttc

SEQ ID NO: 9413357 - DNA, 22 bp, Homo sapiens
aggagtgcaaatagtccagaga

SEQ ID NO: 9413358 - DNA, 22 bp, Homo sapiens
aggagtggaattactgggttct

SEQ ID NO: 9413359 - DNA, 22 bp, Homo sapiens
aggagtggaattactgggttct

SEQ ID NO: 9413360 - DNA, 22 bp, Homo sapiens
acagtgaggacagggactgtgt

SEQ ID NO: 9413361 - DNA, 22 bp, Homo sapiens
aggagtcctcatgtctgtgcga

SEQ ID NO: 9413362 - DNA, 22 bp, Homo sapiens
aggagtgagtgtcctcagcaga

SEQ ID NO: 9413363 - DNA, 22 bp, Homo sapiens
aggagtgagctttggggtcaga

SEQ ID NO: 9413364 - DNA, 17 bp, Homo sapiens
aggagtctcagatgagc

SEQ ID NO: 9413365 - DNA, 22 bp, Homo sapiens
aggagtctgttgaaatgtctat

SEQ ID NO: 9413366 - DNA, 22 bp, Homo sapiens
aggagtctgttgaaatgtctat

SEQ ID NO: 9413367 - DNA, 22 bp, Homo sapiens
acagtacaaaacccaccagagg

SEQ ID NO: 9413368 - DNA, 22 bp, Homo sapiens
acagtaattgtgtacgaggaca

SEQ ID NO: 9413369 - DNA, 22 bp, Homo sapiens
acagtaatttattgaacacctt

SEQ ID NO: 9413370 - DNA, 22 bp, Homo sapiens
acagtacaccactgtgtacagt

SEQ ID NO: 9413371 - DNA, 22 bp, Homo sapiens
acagtacaagcatgatacataa

SEQ ID NO: 9413372 - DNA, 22 bp, Homo sapiens
aggagtcaggaccaaatggaaa

SEQ ID NO: 9413373 - DNA, 22 bp, Homo sapiens
aggagtcagatatgggaaagtt

SEQ ID NO: 9413374 - DNA, 19 bp, Homo sapiens
aggagtcaggaacttcctt

SEQ ID NO: 9413375 - DNA, 22 bp, Homo sapiens
aggagtcagatatgggaaagtt

SEQ ID NO: 9413376 - DNA, 22 bp, Homo sapiens
aggagtcactcagggcttcatc

SEQ ID NO: 9413377 - DNA, 21 bp, Homo sapiens
aggaggaacccgtggctgggc

SEQ ID NO: 9413378 - DNA, 22 bp, Homo sapiens
aggaggaaagaaggcccccagc

SEQ ID NO: 9413379 - DNA, 22 bp, Homo sapiens
aggaggaaagaaggcccccagc

SEQ ID NO: 9413380 - DNA, 22 bp, Homo sapiens
aggaggaaaaaggccacagcaa

SEQ ID NO: 9413381 - DNA, 22 bp, Homo sapiens
aggaggaaaaaggccacagcaa

SEQ ID NO: 9413382 - DNA, 20 bp, Homo sapiens
aggaggaaaaaatgacgagc

SEQ ID NO: 9413383 - DNA, 22 bp, Homo sapiens
aggaggaaaaaggccacagcaa

SEQ ID NO: 9413384 - DNA, 21 bp, Homo sapiens
aggaggaacccgtggctgggc

SEQ ID NO: 9413385 - DNA, 22 bp, Homo sapiens
aggaggaactcagaaagaaggt

SEQ ID NO: 9413386 - DNA, 22 bp, Homo sapiens
aggaggaactcagaaagaaggt

SEQ ID NO: 9413387 - DNA, 22 bp, Homo sapiens
aggaggaactcagaaagaaggt

SEQ ID NO: 9413388 - DNA, 20 bp, Homo sapiens
aggaggaagaaagcacactg

SEQ ID NO: 9413389 - DNA, 20 bp, Homo sapiens
aggaggaagaaagcacactg

SEQ ID NO: 9413390 - DNA, 20 bp, Homo sapiens
aggaggaagaaagcacactg

SEQ ID NO: 9413391 - DNA, 22 bp, Homo sapiens
acagtaattaaaatggatctgc

SEQ ID NO: 9413392 - DNA, 22 bp, Homo sapiens
acagtaatgcatacaagttagt

SEQ ID NO: 9413393 - DNA, 22 bp, Homo sapiens
acagtaatgcatacaagttagt

SEQ ID NO: 9413394 - DNA, 22 bp, Homo sapiens
acagtaatgcatacaagttagt

SEQ ID NO: 9413395 - DNA, 22 bp, Homo sapiens
acagtaattaaggtctgaaacg

SEQ ID NO: 9413396 - DNA, 22 bp, Homo sapiens
acagtaattaaacattctgatt

SEQ ID NO: 9413397 - DNA, 22 bp, Homo sapiens
acagtaattgtgaacttaacgt

SEQ ID NO: 9413398 - DNA, 22 bp, Homo sapiens
acagtaatattgatgctcgtca

SEQ ID NO: 9413399 - DNA, 22 bp, Homo sapiens
acagtaatcatatgattttctc

SEQ ID NO: 9413400 - DNA, 22 bp, Homo sapiens
acagtaatctgggaacttgtta

SEQ ID NO: 9413401 - DNA, 22 bp, Homo sapiens
acagtaatattgatgctcgtca

SEQ ID NO: 9413402 - DNA, 22 bp, Homo sapiens
acagtaatctgggaacttgtta

SEQ ID NO: 9413403 - DNA, 22 bp, Homo sapiens
acagtaatgataaccagcattt

SEQ ID NO: 9413404 - DNA, 22 bp, Homo sapiens
acagtaatgattctgagtctct

SEQ ID NO: 9413405 - DNA, 22 bp, Homo sapiens
acagtaataagtgttggtgagg

SEQ ID NO: 9413406 - DNA, 22 bp, Homo sapiens
acagtaagggtaaataagaaca

SEQ ID NO: 9413407 - DNA, 17 bp, Homo sapiens
acagtaactatgttatg

SEQ ID NO: 9413408 - DNA, 21 bp, Homo sapiens
acagtaaattccctgcaaaga

SEQ ID NO: 9413409 - DNA, 21 bp, Homo sapiens
acagtaaattccctgcaaaga

SEQ ID NO: 9413410 - DNA, 22 bp, Homo sapiens
aggcagcatgggcccagagtcc

SEQ ID NO: 9413411 - DNA, 22 bp, Homo sapiens
aggcagcatgggcccagagtcc

SEQ ID NO: 9413412 - DNA, 22 bp, Homo sapiens
aggcagcatgggcccagagtcc

SEQ ID NO: 9413413 - DNA, 22 bp, Homo sapiens
aggcagcatgggcccagagtcc

SEQ ID NO: 9413414 - DNA, 22 bp, Homo sapiens
aggcagcatgggccccagctcc

SEQ ID NO: 9413415 - DNA, 22 bp, Homo sapiens
aggcagcatgggccccagctcc

SEQ ID NO: 9413416 - DNA, 22 bp, Homo sapiens
aggcagcattcaggggtgatga

SEQ ID NO: 9413417 - DNA, 16 bp, Homo sapiens
aggcagcatgttagtg

SEQ ID NO: 9413418 - DNA, 22 bp, Homo sapiens
aggcagcatgggccccagctcc

SEQ ID NO: 9413419 - DNA, 22 bp, Homo sapiens
acagtttggcagtttcttacta

SEQ ID NO: 9413420 - DNA, 22 bp, Homo sapiens
acagtttgccctgacattctcc

SEQ ID NO: 9413421 - DNA, 22 bp, Homo sapiens
aggcagcattcaggggtgatga

SEQ ID NO: 9413422 - DNA, 22 bp, Homo sapiens
aggcagcattcaggggtgatga

SEQ ID NO: 9413423 - DNA, 22 bp, Homo sapiens
aggcagcattcaggggtgatga

SEQ ID NO: 9413424 - DNA, 22 bp, Homo sapiens
aggcagcatccagaggagaatg

SEQ ID NO: 9413425 - DNA, 22 bp, Homo sapiens
aggcagcagtgataagatagga

SEQ ID NO: 9413426 - DNA, 19 bp, Homo sapiens
aggcagcacccagtccttg

SEQ ID NO: 9413427 - DNA, 22 bp, Homo sapiens
aggcagcagtcatgaggaaaga

SEQ ID NO: 9413428 - DNA, 22 bp, Homo sapiens
aggcagcaatgaatgaaatgga

SEQ ID NO: 9413429 - DNA, 22 bp, Homo sapiens
aggcagcaattgaaatcattgt

SEQ ID NO: 9413430 - DNA, 22 bp, Homo sapiens
aggcagcatccagaggagaatg

SEQ ID NO: 9413431 - DNA, 22 bp, Homo sapiens
aggcagcatccagaggagaatg

SEQ ID NO: 9413432 - DNA, 22 bp, Homo sapiens
aggcagcatgctctgcttctac

SEQ ID NO: 9413433 - DNA, 22 bp, Homo sapiens
aggcagcatgggcccagagtcc

SEQ ID NO: 9413434 - DNA, 22 bp, Homo sapiens
aggcagcatgggcccagagtcc

SEQ ID NO: 9413435 - DNA, 22 bp, Homo sapiens
aggcagcatgctctgcttctac

SEQ ID NO: 9413436 - DNA, 22 bp, Homo sapiens
aggcagcatgctctgcttctac

SEQ ID NO: 9413437 - DNA, 21 bp, Homo sapiens
aggcagcatctgatttatatg

SEQ ID NO: 9413438 - DNA, 22 bp, Homo sapiens
acataaatagattattgggagg

SEQ ID NO: 9413439 - DNA, 22 bp, Homo sapiens
acataaatagattattgggagg

SEQ ID NO: 9413440 - DNA, 22 bp, Homo sapiens
acataaatagattattgggagg

SEQ ID NO: 9413441 - DNA, 22 bp, Homo sapiens
acataaatagattattgggagg

SEQ ID NO: 9413442 - DNA, 22 bp, Homo sapiens
aggcagctggaggcagagacta

SEQ ID NO: 9413443 - DNA, 22 bp, Homo sapiens
aggcagctggaggcagagacta

SEQ ID NO: 9413444 - DNA, 21 bp, Homo sapiens
aggcaggattcaaacacagag

SEQ ID NO: 9413445 - DNA, 21 bp, Homo sapiens
aggcaggattcaaacacagag

SEQ ID NO: 9413446 - DNA, 22 bp, Homo sapiens
aggcagctggcaaattctagag

SEQ ID NO: 9413447 - DNA, 23 bp, Homo sapiens
acataaacagaaggtgtgcttcc

SEQ ID NO: 9413448 - DNA, 22 bp, Homo sapiens
acagttttttcaacattggaat

SEQ ID NO: 9413449 - DNA, 22 bp, Homo sapiens
acagtttgttccttttcattgc

SEQ ID NO: 9413450 - DNA, 22 bp, Homo sapiens
acagtttgttccttttcattgc

SEQ ID NO: 9413451 - DNA, 21 bp, Homo sapiens
acagttttaaggagcacatgg

SEQ ID NO: 9413452 - DNA, 22 bp, Homo sapiens
aggcaggcaagttcatatgagg

SEQ ID NO: 9413453 - DNA, 22 bp, Homo sapiens
aggcaggcacacttcctccagg

SEQ ID NO: 9413454 - DNA, 22 bp, Homo sapiens
aggcaggcactccggaagtgtc

SEQ ID NO: 9413455 - DNA, 22 bp, Homo sapiens
aggcaggcaaccacctgggaag

SEQ ID NO: 9413456 - DNA, 22 bp, Homo sapiens
aggcaggcaaccacctgggaag

SEQ ID NO: 9413457 - DNA, 22 bp, Homo sapiens
aggcaggcaaccacctgggaag

SEQ ID NO: 9413458 - DNA, 22 bp, Homo sapiens
aggcaggcaaccacctgggaag

SEQ ID NO: 9413459 - DNA, 22 bp, Homo sapiens
aggcaggattgctgacaacaat

SEQ ID NO: 9413460 - DNA, 22 bp, Homo sapiens
aggcaggattgctgacaacaat

SEQ ID NO: 9413461 - DNA, 22 bp, Homo sapiens
acagttcaagacatcagtatga

SEQ ID NO: 9413462 - DNA, 22 bp, Homo sapiens
acagttatttactgcataaact

SEQ ID NO: 9413463 - DNA, 22 bp, Homo sapiens
acagttcactttttatatcaaa

SEQ ID NO: 9413464 - DNA, 22 bp, Homo sapiens
acagttcaagtcttagacaaca

SEQ ID NO: 9413465 - DNA, 22 bp, Homo sapiens
acagttcaagtcttagacaaca

SEQ ID NO: 9413466 - DNA, 22 bp, Homo sapiens
acagttcaagtcttagacaaca

SEQ ID NO: 9413467 - DNA, 22 bp, Homo sapiens
acagttcaagtcttagacaaca

SEQ ID NO: 9413468 - DNA, 23 bp, Homo sapiens
acagttatagctgtgaataacat

SEQ ID NO: 9413469 - DNA, 22 bp, Homo sapiens
acagttatctttgaaatagaga

SEQ ID NO: 9413470 - DNA, 22 bp, Homo sapiens
acagttatctttgaaatagaga

SEQ ID NO: 9413471 - DNA, 22 bp, Homo sapiens
acagttattctttatgcaacca

SEQ ID NO: 9413472 - DNA, 22 bp, Homo sapiens
acagttatctttgaaatagaga

SEQ ID NO: 9413473 - DNA, 22 bp, Homo sapiens
acagttaggcacgggtacagca

SEQ ID NO: 9413474 - DNA, 22 bp, Homo sapiens
acagttaataagtagtaagtca

SEQ ID NO: 9413475 - DNA, 22 bp, Homo sapiens
acagttaagcagtatgatcaca

SEQ ID NO: 9413476 - DNA, 22 bp, Homo sapiens
acagtgattttttcgagcagaa

SEQ ID NO: 9413477 - DNA, 22 bp, Homo sapiens
acagtgattttaggatagatgg

SEQ ID NO: 9413478 - DNA, 18 bp, Homo sapiens
acagtgattgttctatgc

SEQ ID NO: 9413479 - DNA, 22 bp, Homo sapiens
acagtgatttctgcaagggctc

SEQ ID NO: 9413480 - DNA, 22 bp, Homo sapiens
acagtgcaaaccctcgggaaag

SEQ ID NO: 9413481 - DNA, 22 bp, Homo sapiens
acagtgattctgcaaaccatat

SEQ ID NO: 9413482 - DNA, 22 bp, Homo sapiens
acagtgattctgcaaaccatat

SEQ ID NO: 9413483 - DNA, 22 bp, Homo sapiens
acagtgattggcactgattcag

SEQ ID NO: 9413484 - DNA, 22 bp, Homo sapiens
acagtgaggacagggactgtgt

SEQ ID NO: 9413485 - DNA, 22 bp, Homo sapiens
acagtgataaaatttcacatgt

SEQ ID NO: 9413486 - DNA, 22 bp, Homo sapiens
acagtgataaaatttcacatgt

SEQ ID NO: 9413487 - DNA, 22 bp, Homo sapiens
acagtgatatttttactcaaat

SEQ ID NO: 9413488 - DNA, 22 bp, Homo sapiens
acagtgataaaatttcacatgt

SEQ ID NO: 9413489 - DNA, 22 bp, Homo sapiens
acagtgatgggggtgcaggaag

SEQ ID NO: 9413490 - DNA, 22 bp, Homo sapiens
acagtgatgggggtgcaggaag

SEQ ID NO: 9413491 - DNA, 22 bp, Homo sapiens
acagtgcaaacttttgtctcct

SEQ ID NO: 9413492 - DNA, 22 bp, Homo sapiens
acagtgcaaataggactgtctt

SEQ ID NO: 9413493 - DNA, 22 bp, Homo sapiens
acagtgcacatcctgagtgatt

SEQ ID NO: 9413494 - DNA, 22 bp, Homo sapiens
acagtgcacatcctgagtgatt

SEQ ID NO: 9413495 - DNA, 22 bp, Homo sapiens
acagtgcacatcctgagtgatt

SEQ ID NO: 9413496 - DNA, 22 bp, Homo sapiens
acagtgttttcttaaggagaaa

SEQ ID NO: 9413497 - DNA, 22 bp, Homo sapiens
acagttaaatatttctactggg

SEQ ID NO: 9413498 - DNA, 19 bp, Homo sapiens
agtctctgaggcctaagtt

SEQ ID NO: 9413499 - DNA, 19 bp, Homo sapiens
agtctctgaggcctaagtt

SEQ ID NO: 9413500 - DNA, 22 bp, Homo sapiens
agtctctgaggttcagatgcct

SEQ ID NO: 9413501 - DNA, 22 bp, Homo sapiens
agtctctgaggttcagatgcct

SEQ ID NO: 9413502 - DNA, 20 bp, Homo sapiens
agtctctgcaacatagtgca

SEQ ID NO: 9413503 - DNA, 22 bp, Homo sapiens
agtcgcagacatggtccccttt

SEQ ID NO: 9413504 - DNA, 23 bp, Homo sapiens
agtcctttttataaaattgagga

SEQ ID NO: 9413505 - DNA, 22 bp, Homo sapiens
actccagggctccatcccttgt

SEQ ID NO: 9413506 - DNA, 22 bp, Homo sapiens
actccagggctccatcccttgt

SEQ ID NO: 9413507 - DNA, 22 bp, Homo sapiens
actccagggctccaccccagat

SEQ ID NO: 9413508 - DNA, 22 bp, Homo sapiens
actccagggctgaacgaggccc

SEQ ID NO: 9413509 - DNA, 22 bp, Homo sapiens
actccaggggttgctatttaca

SEQ ID NO: 9413510 - DNA, 22 bp, Homo sapiens
actccagggcttctatgatggt

SEQ ID NO: 9413511 - DNA, 22 bp, Homo sapiens
agtctcttaaagacagtgttga

SEQ ID NO: 9413512 - DNA, 20 bp, Homo sapiens
agtctctgtagtgcctgaga

SEQ ID NO: 9413513 - DNA, 20 bp, Homo sapiens
agtctctgtagtgcctgaga

SEQ ID NO: 9413514 - DNA, 20 bp, Homo sapiens
agtctctgtagtgcctgaga

SEQ ID NO: 9413515 - DNA, 22 bp, Homo sapiens
agtctctgccagcttgtcctct

SEQ ID NO: 9413516 - DNA, 22 bp, Homo sapiens
agtctctggactgggagatggc

SEQ ID NO: 9413517 - DNA, 22 bp, Homo sapiens
agtctctgctggttgtgcctat

SEQ ID NO: 9413518 - DNA, 22 bp, Homo sapiens
agtctctgcatgcctgctgtgc

SEQ ID NO: 9413519 - DNA, 22 bp, Homo sapiens
agtctctgcatgatgcagcaca

SEQ ID NO: 9413520 - DNA, 22 bp, Homo sapiens
agtctctgcacagtaagaagca

SEQ ID NO: 9413521 - DNA, 22 bp, Homo sapiens
actccacaccacgggggccgcc

SEQ ID NO: 9413522 - DNA, 22 bp, Homo sapiens
actccacaccacgggggccgcc

SEQ ID NO: 9413523 - DNA, 22 bp, Homo sapiens
actccacatttgaacacagttc

SEQ ID NO: 9413524 - DNA, 22 bp, Homo sapiens
actccagaatcctagggtcagc

SEQ ID NO: 9413525 - DNA, 22 bp, Homo sapiens
actccacatttgaacacagttc

SEQ ID NO: 9413526 - DNA, 22 bp, Homo sapiens
actccaaggccacatgcattcc

SEQ ID NO: 9413527 - DNA, 21 bp, Homo sapiens
actccaaacaagttaagctgt

SEQ ID NO: 9413528 - DNA, 22 bp, Homo sapiens
actccacaccacgggggccgcc

SEQ ID NO: 9413529 - DNA, 22 bp, Homo sapiens
actcattttataacactgtagt

SEQ ID NO: 9413530 - DNA, 22 bp, Homo sapiens
actcatttttactgcaattgag

SEQ ID NO: 9413531 - DNA, 22 bp, Homo sapiens
actcattttataacactgtagt

SEQ ID NO: 9413532 - DNA, 21 bp, Homo sapiens
actcatttgtctgcatctaat

SEQ ID NO: 9413533 - DNA, 20 bp, Homo sapiens
actcatttccagcatctgat

SEQ ID NO: 9413534 - DNA, 22 bp, Homo sapiens
actcatttgcatgatgtgctat

SEQ ID NO: 9413535 - DNA, 22 bp, Homo sapiens
actcatttgcatgatgtgctat

SEQ ID NO: 9413536 - DNA, 22 bp, Homo sapiens
actccaggcatctgcttctgct

SEQ ID NO: 9413537 - DNA, 22 bp, Homo sapiens
actccaggcatctgcttctgct

SEQ ID NO: 9413538 - DNA, 22 bp, Homo sapiens
actccaggcatctgcttctgct

SEQ ID NO: 9413539 - DNA, 19 bp, Homo sapiens
actccagggatgacagaag

SEQ ID NO: 9413540 - DNA, 19 bp, Homo sapiens
actccagggatgacagaag

SEQ ID NO: 9413541 - DNA, 22 bp, Homo sapiens
actccagggaggtgagtgtgcg

SEQ ID NO: 9413542 - DNA, 22 bp, Homo sapiens
actccagagctcacatgtctaa

SEQ ID NO: 9413543 - DNA, 22 bp, Homo sapiens
actccagagctcacatgtctaa

SEQ ID NO: 9413544 - DNA, 22 bp, Homo sapiens
actccagacacagacactatga

SEQ ID NO: 9413545 - DNA, 22 bp, Homo sapiens
actccagaggcagctgtgctga

SEQ ID NO: 9413546 - DNA, 22 bp, Homo sapiens
actccagaggcagctgtgctga

SEQ ID NO: 9413547 - DNA, 22 bp, Homo sapiens
actccaggatgtagaatcagag

SEQ ID NO: 9413548 - DNA, 22 bp, Homo sapiens
actccaggaaacttaggggaaa

SEQ ID NO: 9413549 - DNA, 22 bp, Homo sapiens
actccagatgataagggacagt

SEQ ID NO: 9413550 - DNA, 22 bp, Homo sapiens
actgaaaatgaattagaaacag

SEQ ID NO: 9413551 - DNA, 22 bp, Homo sapiens
actcttcatgctatgctcaact

SEQ ID NO: 9413552 - DNA, 22 bp, Homo sapiens
actgaaatactgctcttggatt

SEQ ID NO: 9413553 - DNA, 23 bp, Homo sapiens
actgaaaggatcctagcagagac

SEQ ID NO: 9413554 - DNA, 22 bp, Homo sapiens
actgaacacttttgaaagatta

SEQ ID NO: 9413555 - DNA, 22 bp, Homo sapiens
actgaaatatttagaagtgaag

SEQ ID NO: 9413556 - DNA, 18 bp, Homo sapiens
actgaagatgcaagacct

SEQ ID NO: 9413557 - DNA, 22 bp, Homo sapiens
actgaacatccataagattttt

SEQ ID NO: 9413558 - DNA, 22 bp, Homo sapiens
actgaagaacgcatcagtggtt

SEQ ID NO: 9413559 - DNA, 22 bp, Homo sapiens
actgaacttggtgaatgccaca

SEQ ID NO: 9413560 - DNA, 22 bp, Homo sapiens
actgaagcttgggtggaactta

SEQ ID NO: 9413561 - DNA, 22 bp, Homo sapiens
actgaagcacatttgccatgaa

SEQ ID NO: 9413562 - DNA, 23 bp, Homo sapiens
actgaagatgtcttagtggccct

SEQ ID NO: 9413563 - DNA, 22 bp, Homo sapiens
agtctcttcctcatgcatatgt

SEQ ID NO: 9413564 - DNA, 22 bp, Homo sapiens
agtctcttaattttttctaagt

SEQ ID NO: 9413565 - DNA, 22 bp, Homo sapiens
agtctgggaactgggaacgttt

SEQ ID NO: 9413566 - DNA, 22 bp, Homo sapiens
agtctggccttgccttgtcgag

SEQ ID NO: 9413567 - DNA, 17 bp, Homo sapiens
agtctgggacctgcgtg

SEQ ID NO: 9413568 - DNA, 20 bp, Homo sapiens
agtctggcacctattcctgt

SEQ ID NO: 9413569 - DNA, 22 bp, Homo sapiens
agtctggctttttgatgagctt

SEQ ID NO: 9413570 - DNA, 22 bp, Homo sapiens
agtctgggagggatgccagtgt

SEQ ID NO: 9413571 - DNA, 22 bp, Homo sapiens
agtctgggaggcttataaacag

SEQ ID NO: 9413572 - DNA, 22 bp, Homo sapiens
agtctgggagaaggtgagatta

SEQ ID NO: 9413573 - DNA, 21 bp, Homo sapiens
agtctggggaagggatcccag

SEQ ID NO: 9413574 - DNA, 21 bp, Homo sapiens
agtctggggaagggatcccag

SEQ ID NO: 9413575 - DNA, 22 bp, Homo sapiens
agtctgggctgtctgcaggagt

SEQ ID NO: 9413576 - DNA, 22 bp, Homo sapiens
agtctgggctgtctgcaggagt

SEQ ID NO: 9413577 - DNA, 22 bp, Homo sapiens
agtctgggcatttaggatgttg

SEQ ID NO: 9413578 - DNA, 22 bp, Homo sapiens
agtctgggctgtctgcaggagt

SEQ ID NO: 9413579 - DNA, 22 bp, Homo sapiens
agtctgggagggatgccagtgt

SEQ ID NO: 9413580 - DNA, 22 bp, Homo sapiens
agtctgggagggatgccagtgt

SEQ ID NO: 9413581 - DNA, 22 bp, Homo sapiens
agtctgggcatttaggatgttg

SEQ ID NO: 9413582 - DNA, 22 bp, Homo sapiens
actcttcatacagtcatctaat

SEQ ID NO: 9413583 - DNA, 22 bp, Homo sapiens
actcttcagtacaataatatct

SEQ ID NO: 9413584 - DNA, 22 bp, Homo sapiens
agtctgggtggctgagctacag

SEQ ID NO: 9413585 - DNA, 22 bp, Homo sapiens
agtctgggtgtgaatgaacttg

SEQ ID NO: 9413586 - DNA, 22 bp, Homo sapiens
agtctgggtgtgaatgaacttg

SEQ ID NO: 9413587 - DNA, 22 bp, Homo sapiens
actgcaacctccacctcctggg

SEQ ID NO: 9413588 - DNA, 22 bp, Homo sapiens
actgcaacacctcctgggttca

SEQ ID NO: 9413589 - DNA, 22 bp, Homo sapiens
actgcaacctccacctcctggg

SEQ ID NO: 9413590 - DNA, 22 bp, Homo sapiens
actgcaacctccacctcctggg

SEQ ID NO: 9413591 - DNA, 22 bp, Homo sapiens
actgcaacctccacctcctggg

SEQ ID NO: 9413592 - DNA, 22 bp, Homo sapiens
actgcaacctccacctcctggg

SEQ ID NO: 9413593 - DNA, 22 bp, Homo sapiens
actgcaaaaatgggtgcattca

SEQ ID NO: 9413594 - DNA, 22 bp, Homo sapiens
actgcaaaaatgggtgcattca

SEQ ID NO: 9413595 - DNA, 22 bp, Homo sapiens
actgcaaagggaagccctttct

SEQ ID NO: 9413596 - DNA, 22 bp, Homo sapiens
actgcaacacctcctgggttca

SEQ ID NO: 9413597 - DNA, 22 bp, Homo sapiens
actgcaaagggaagccctttct

SEQ ID NO: 9413598 - DNA, 22 bp, Homo sapiens
actgcacagaattatggttggt

SEQ ID NO: 9413599 - DNA, 22 bp, Homo sapiens
actgcctgtagctcttcatctc

SEQ ID NO: 9413600 - DNA, 21 bp, Homo sapiens
actgcctgtctccatagtcta

SEQ ID NO: 9413601 - DNA, 22 bp, Homo sapiens
actgcctgtgcactggtctttt

SEQ ID NO: 9413602 - DNA, 21 bp, Homo sapiens
actgcctgtctccatagtcta

SEQ ID NO: 9413603 - DNA, 23 bp, Homo sapiens
actgcctgtgccgatctctctca

SEQ ID NO: 9413604 - DNA, 23 bp, Homo sapiens
actgcctgtgccgatctctctca

SEQ ID NO: 9413605 - DNA, 22 bp, Homo sapiens
actgcacacctccagggcacta

SEQ ID NO: 9413606 - DNA, 22 bp, Homo sapiens
actgcacagaagaaactatcaa

SEQ ID NO: 9413607 - DNA, 22 bp, Homo sapiens
actgcaaggaggtggggtatca

SEQ ID NO: 9413608 - DNA, 22 bp, Homo sapiens
actgcacacatgtttaagtgga

SEQ ID NO: 9413609 - DNA, 22 bp, Homo sapiens
actgcaacctccgcctgccagg

SEQ ID NO: 9413610 - DNA, 22 bp, Homo sapiens
actgcaacctccgcctgccagg

SEQ ID NO: 9413611 - DNA, 22 bp, Homo sapiens
actgcaacctccgcctgccagg

SEQ ID NO: 9413612 - DNA, 22 bp, Homo sapiens
actgatggcccaccttggtctc

SEQ ID NO: 9413613 - DNA, 22 bp, Homo sapiens
actgattaaaaacagacattta

SEQ ID NO: 9413614 - DNA, 22 bp, Homo sapiens
actgattacacgagttctgact

SEQ ID NO: 9413615 - DNA, 22 bp, Homo sapiens
actgatttcagggatgagaaga

SEQ ID NO: 9413616 - DNA, 22 bp, Homo sapiens
actgattgcattcatagggttt

SEQ ID NO: 9413617 - DNA, 22 bp, Homo sapiens
actgattgcattcatagggttt

SEQ ID NO: 9413618 - DNA, 22 bp, Homo sapiens
actgattcaagttatgcatctt

SEQ ID NO: 9413619 - DNA, 22 bp, Homo sapiens
actgatggcagggtaggggtca

SEQ ID NO: 9413620 - DNA, 22 bp, Homo sapiens
actgatgaaaactaataaatta

SEQ ID NO: 9413621 - DNA, 22 bp, Homo sapiens
actgatgaagagtaccactgtt

SEQ ID NO: 9413622 - DNA, 22 bp, Homo sapiens
actgatgaaaactaataaatta

SEQ ID NO: 9413623 - DNA, 22 bp, Homo sapiens
actgatcacagatatgtatatt

SEQ ID NO: 9413624 - DNA, 22 bp, Homo sapiens
actgaattacagtctgcatttt

SEQ ID NO: 9413625 - DNA, 22 bp, Homo sapiens
actgaattagggaacactgaac

SEQ ID NO: 9413626 - DNA, 22 bp, Homo sapiens
actgaattacagtctgcatttt

SEQ ID NO: 9413627 - DNA, 22 bp, Homo sapiens
actgaatagtgctgcattgtac

SEQ ID NO: 9413628 - DNA, 22 bp, Homo sapiens
actgaatatattccattgcatg

SEQ ID NO: 9413629 - DNA, 22 bp, Homo sapiens
actgaatttatgtttaaaaaca

SEQ ID NO: 9413630 - DNA, 22 bp, Homo sapiens
actgagggtgcacaggcaggca

SEQ ID NO: 9413631 - DNA, 22 bp, Homo sapiens
actgagggtgcacaggcaggca

SEQ ID NO: 9413632 - DNA, 22 bp, Homo sapiens
actgaataaggtgaatgctctg

SEQ ID NO: 9413633 - DNA, 22 bp, Homo sapiens
actgaataaggtgaatgctctg

SEQ ID NO: 9413634 - DNA, 22 bp, Homo sapiens
actgaagttcatacaacagact

SEQ ID NO: 9413635 - DNA, 22 bp, Homo sapiens
actgaatagaaatgctcatagg

SEQ ID NO: 9413636 - DNA, 22 bp, Homo sapiens
actgaataatggtctgtgatct

SEQ ID NO: 9413637 - DNA, 22 bp, Homo sapiens
actgaatagcccttctgtctcc

SEQ ID NO: 9413638 - DNA, 22 bp, Homo sapiens
actgaagtagtcattgtcatta

SEQ ID NO: 9413639 - DNA, 19 bp, Homo sapiens
actgaagttacccaaatgg

SEQ ID NO: 9413640 - DNA, 22 bp, Homo sapiens
actgaagtgtaggtgttttcct

SEQ ID NO: 9413641 - DNA, 22 bp, Homo sapiens
actgctgcaggtccagcccctt

SEQ ID NO: 9413642 - DNA, 22 bp, Homo sapiens
actgctggcatgcatatacaaa

SEQ ID NO: 9413643 - DNA, 22 bp, Homo sapiens
actgctgtgatctgatgtaatt

SEQ ID NO: 9413644 - DNA, 23 bp, Homo sapiens
actgctgtctttgaagtgcttga

SEQ ID NO: 9413645 - DNA, 22 bp, Homo sapiens
actgctgattatgaaagtgaca

SEQ ID NO: 9413646 - DNA, 22 bp, Homo sapiens
actgctgattatgaaagtgaca

SEQ ID NO: 9413647 - DNA, 22 bp, Homo sapiens
actgctgatataagaaaagatt

SEQ ID NO: 9413648 - DNA, 22 bp, Homo sapiens
actgctgatttagctttgtggg

SEQ ID NO: 9413649 - DNA, 22 bp, Homo sapiens
actgctgattattgaagtagag

SEQ ID NO: 9413650 - DNA, 22 bp, Homo sapiens
actgctgatttagctttgtggg

SEQ ID NO: 9413651 - DNA, 22 bp, Homo sapiens
actgctgattttaggactgtta

SEQ ID NO: 9413652 - DNA, 22 bp, Homo sapiens
actgctctgttttcatatgttt

SEQ ID NO: 9413653 - DNA, 22 bp, Homo sapiens
actgctccaccctggggcccag

SEQ ID NO: 9413654 - DNA, 22 bp, Homo sapiens
actgctctctttgcaggggcta

SEQ ID NO: 9413655 - DNA, 22 bp, Homo sapiens
actgctctgttttcatatgttt

SEQ ID NO: 9413656 - DNA, 22 bp, Homo sapiens
actgctgacctcaggtcatcct

SEQ ID NO: 9413657 - DNA, 22 bp, Homo sapiens
actgctgagcacacaagagtgt

SEQ ID NO: 9413658 - DNA, 22 bp, Homo sapiens
actgctgagagcaatcccaaac

SEQ ID NO: 9413659 - DNA, 22 bp, Homo sapiens
actgctcaaggatctggtaggg

SEQ ID NO: 9413660 - DNA, 22 bp, Homo sapiens
agtggctgatgtaggcagtggg

SEQ ID NO: 9413661 - DNA, 22 bp, Homo sapiens
agtggctgatgtaggcagtggg

SEQ ID NO: 9413662 - DNA, 22 bp, Homo sapiens
agtggctgagtgactgtgactc

SEQ ID NO: 9413663 - DNA, 20 bp, Homo sapiens
agtggctgatggaaagaagc

SEQ ID NO: 9413664 - DNA, 22 bp, Homo sapiens
agtggctgagtgactgtgactc

SEQ ID NO: 9413665 - DNA, 22 bp, Homo sapiens
agtggctgagtgactgtgactc

SEQ ID NO: 9413666 - DNA, 23 bp, Homo sapiens
agtggctgagagtgtttcatatg

SEQ ID NO: 9413667 - DNA, 22 bp, Homo sapiens
actgcttacttctagaactctt

SEQ ID NO: 9413668 - DNA, 22 bp, Homo sapiens
actgcttacccggcctgacttc

SEQ ID NO: 9413669 - DNA, 22 bp, Homo sapiens
actgcttacccggcctgacttc

SEQ ID NO: 9413670 - DNA, 22 bp, Homo sapiens
actgcttagtattattaatgtc

SEQ ID NO: 9413671 - DNA, 22 bp, Homo sapiens
actgcttacttctagaactctt

SEQ ID NO: 9413672 - DNA, 22 bp, Homo sapiens
actgcttctccaatgaattaga

SEQ ID NO: 9413673 - DNA, 20 bp, Homo sapiens
actgcttctttctctgacct

SEQ ID NO: 9413674 - DNA, 22 bp, Homo sapiens
actgctttaaaaaagcaagctt

SEQ ID NO: 9413675 - DNA, 22 bp, Homo sapiens
actgctttaaaaaagcaagctt

SEQ ID NO: 9413676 - DNA, 22 bp, Homo sapiens
agtggctgacaactgggttaac

SEQ ID NO: 9413677 - DNA, 22 bp, Homo sapiens
actggcagccacaactggcagg

SEQ ID NO: 9413678 - DNA, 22 bp, Homo sapiens
actggcagccacaactggcagg

SEQ ID NO: 9413679 - DNA, 22 bp, Homo sapiens
actggcagccacaactggcagg

SEQ ID NO: 9413680 - DNA, 22 bp, Homo sapiens
actggcagaggttggacaccat

SEQ ID NO: 9413681 - DNA, 22 bp, Homo sapiens
actggcagaattgaatagttgt

SEQ ID NO: 9413682 - DNA, 22 bp, Homo sapiens
actggcaatagcaaatgcttgg

SEQ ID NO: 9413683 - DNA, 19 bp, Homo sapiens
actggcaaaaaaggttaat

SEQ ID NO: 9413684 - DNA, 22 bp, Homo sapiens
actggatgaggggaaagagaca

SEQ ID NO: 9413685 - DNA, 22 bp, Homo sapiens
actggattccattgtgcaaaga

SEQ ID NO: 9413686 - DNA, 19 bp, Homo sapiens
actggcaaaaaaggttaat

SEQ ID NO: 9413687 - DNA, 22 bp, Homo sapiens
agtggctgcttctggttgctcc

SEQ ID NO: 9413688 - DNA, 22 bp, Homo sapiens
agtggctgctggagtggagatg

SEQ ID NO: 9413689 - DNA, 22 bp, Homo sapiens
agtggctgctggagtggagatg

SEQ ID NO: 9413690 - DNA, 22 bp, Homo sapiens
agtggctgctgactttaataca

SEQ ID NO: 9413691 - DNA, 22 bp, Homo sapiens
agtggctgctgactttaataca

SEQ ID NO: 9413692 - DNA, 22 bp, Homo sapiens
agtggctgctatgatcaggaca

SEQ ID NO: 9413693 - DNA, 22 bp, Homo sapiens
agtggctgccaagatataattc

SEQ ID NO: 9413694 - DNA, 22 bp, Homo sapiens
agtggctgattacaaactgagt

SEQ ID NO: 9413695 - DNA, 22 bp, Homo sapiens
agtggctgccaagagcaatgct

SEQ ID NO: 9413696 - DNA, 22 bp, Homo sapiens
actaaagaagccaaagttttct

SEQ ID NO: 9413697 - DNA, 22 bp, Homo sapiens
actaaagaagccaaagttttct

SEQ ID NO: 9413698 - DNA, 22 bp, Homo sapiens
actaaagatgtctaaatatatt

SEQ ID NO: 9413699 - DNA, 22 bp, Homo sapiens
actaaagctcacagagttgaac

SEQ ID NO: 9413700 - DNA, 22 bp, Homo sapiens
actaaagtcagactgcattgat

SEQ ID NO: 9413701 - DNA, 22 bp, Homo sapiens
actaaagctcacagagttgaac

SEQ ID NO: 9413702 - DNA, 19 bp, Homo sapiens
actaaaaatgatgtttgag

SEQ ID NO: 9413703 - DNA, 22 bp, Homo sapiens
actaaaacagtggctagtagac

SEQ ID NO: 9413704 - DNA, 19 bp, Homo sapiens
actaaaaatgatgtttgag

SEQ ID NO: 9413705 - DNA, 19 bp, Homo sapiens
actaaaaatgatgtttgag

SEQ ID NO: 9413706 - DNA, 22 bp, Homo sapiens
actaaaacatagccagtcagtg

SEQ ID NO: 9413707 - DNA, 22 bp, Homo sapiens
actaaaacagtggctagtagac

SEQ ID NO: 9413708 - DNA, 22 bp, Homo sapiens
actaaaaactactgccaatagc

SEQ ID NO: 9413709 - DNA, 22 bp, Homo sapiens
actaaaaactactgccaatagc

SEQ ID NO: 9413710 - DNA, 22 bp, Homo sapiens
acgttttattcccatgcagcat

SEQ ID NO: 9413711 - DNA, 22 bp, Homo sapiens
acgttatatctgaaaaaagtga

SEQ ID NO: 9413712 - DNA, 22 bp, Homo sapiens
acgtttatggagtgcctatcat

SEQ ID NO: 9413713 - DNA, 22 bp, Homo sapiens
acgtttgctttctttggcctgg

SEQ ID NO: 9413714 - DNA, 22 bp, Homo sapiens
acgtgtgttggtcagggggccc

SEQ ID NO: 9413715 - DNA, 22 bp, Homo sapiens
acgtgtgtgacattgggaacgt

SEQ ID NO: 9413716 - DNA, 20 bp, Homo sapiens
acgtgtgtgtgcacgcgcgc

SEQ ID NO: 9413717 - DNA, 22 bp, Homo sapiens
acgttaaacatttagcatagta

SEQ ID NO: 9413718 - DNA, 22 bp, Homo sapiens
acgtgtgtttaacaaacctgca

SEQ ID NO: 9413719 - DNA, 22 bp, Homo sapiens
acgggctgggacggggaagctc

SEQ ID NO: 9413720 - DNA, 22 bp, Homo sapiens
acgtgtgtatgagtgtacatat

SEQ ID NO: 9413721 - DNA, 22 bp, Homo sapiens
acgtggcggccgccgtgagcgg

SEQ ID NO: 9413722 - DNA, 22 bp, Homo sapiens
acgtggcggccgccgtgagcgg

SEQ ID NO: 9413723 - DNA, 22 bp, Homo sapiens
accttagaaaatcaaaattaga

SEQ ID NO: 9413724 - DNA, 22 bp, Homo sapiens
accttaaatgtgacatagtcta

SEQ ID NO: 9413725 - DNA, 22 bp, Homo sapiens
accttaaaactgacacatggag

SEQ ID NO: 9413726 - DNA, 22 bp, Homo sapiens
accttaaactttacagccaagt

SEQ ID NO: 9413727 - DNA, 22 bp, Homo sapiens
accttaaaggccgaagtaaaga

SEQ ID NO: 9413728 - DNA, 22 bp, Homo sapiens
accttaaaggccgaagtaaaga

SEQ ID NO: 9413729 - DNA, 22 bp, Homo sapiens
accttaaaggccgaagtaaaga

SEQ ID NO: 9413730 - DNA, 22 bp, Homo sapiens
accttaaaggccgaagtaaaga

SEQ ID NO: 9413731 - DNA, 22 bp, Homo sapiens
acctgttttcagaaaatgcaga

SEQ ID NO: 9413732 - DNA, 22 bp, Homo sapiens
acctgttttagtctttaatcat

SEQ ID NO: 9413733 - DNA, 22 bp, Homo sapiens
acctgtttacctgcacctgttt

SEQ ID NO: 9413734 - DNA, 19 bp, Homo sapiens
accttcagagtggcacaaa

SEQ ID NO: 9413735 - DNA, 22 bp, Homo sapiens
acgggcagacagagctactcgc

SEQ ID NO: 9413736 - DNA, 21 bp, Homo sapiens
accttcagtgttctcagctgc

SEQ ID NO: 9413737 - DNA, 22 bp, Homo sapiens
accttatttggaaatataatta

SEQ ID NO: 9413738 - DNA, 22 bp, Homo sapiens
accttattttgaaatagattgt

SEQ ID NO: 9413739 - DNA, 22 bp, Homo sapiens
accttattcttgcccttagatg

SEQ ID NO: 9413740 - DNA, 22 bp, Homo sapiens
accttcaactcaaagtgtccca

SEQ ID NO: 9413741 - DNA, 21 bp, Homo sapiens
accttcaagccagaggtggtc

SEQ ID NO: 9413742 - DNA, 22 bp, Homo sapiens
accttcaagaaacatttccttg

SEQ ID NO: 9413743 - DNA, 19 bp, Homo sapiens
actcaggcttcctctgagg

SEQ ID NO: 9413744 - DNA, 22 bp, Homo sapiens
actcacagcatgagcttggcag

SEQ ID NO: 9413745 - DNA, 19 bp, Homo sapiens
actcaggcttcctctgagg

SEQ ID NO: 9413746 - DNA, 22 bp, Homo sapiens
actcatttaaacatttactgaa

SEQ ID NO: 9413747 - DNA, 22 bp, Homo sapiens
actcatgttttctctagctgga

SEQ ID NO: 9413748 - DNA, 22 bp, Homo sapiens
actcattaaataggatgatttt

SEQ ID NO: 9413749 - DNA, 22 bp, Homo sapiens
actcatgtcctaggagtaaagc

SEQ ID NO: 9413750 - DNA, 22 bp, Homo sapiens
actcacagcagactatgaggga

SEQ ID NO: 9413751 - DNA, 22 bp, Homo sapiens
actcacagaataggcatgatgg

SEQ ID NO: 9413752 - DNA, 22 bp, Homo sapiens
actcacagaataggcatgatgg

SEQ ID NO: 9413753 - DNA, 22 bp, Homo sapiens
actcacagactgcaggtttatt

SEQ ID NO: 9413754 - DNA, 21 bp, Homo sapiens
actcaagtggagatgccaggt

SEQ ID NO: 9413755 - DNA, 22 bp, Homo sapiens
actcaagtggccttgatggctt

SEQ ID NO: 9413756 - DNA, 21 bp, Homo sapiens
actcaagtgggcatgcgcaga

SEQ ID NO: 9413757 - DNA, 23 bp, Homo sapiens
actcacaaagcaggatcatgttg

SEQ ID NO: 9413758 - DNA, 22 bp, Homo sapiens
actcacaagtgatgtgaatggc

SEQ ID NO: 9413759 - DNA, 23 bp, Homo sapiens
actcacaaagcaggatcatgttg

SEQ ID NO: 9413760 - DNA, 23 bp, Homo sapiens
actcacaaagcaggatcatgttg

SEQ ID NO: 9413761 - DNA, 22 bp, Homo sapiens
actcaaatttgtcaactgaagc

SEQ ID NO: 9413762 - DNA, 22 bp, Homo sapiens
actcaacagggaacaagatcag

SEQ ID NO: 9413763 - DNA, 22 bp, Homo sapiens
actcaagtagatattaacaaaa

SEQ ID NO: 9413764 - DNA, 22 bp, Homo sapiens
actcaagatagggaaagtacaa

SEQ ID NO: 9413765 - DNA, 22 bp, Homo sapiens
actcaacagggaacaagatcag

SEQ ID NO: 9413766 - DNA, 18 bp, Homo sapiens
actattgaggtattcttg

SEQ ID NO: 9413767 - DNA, 22 bp, Homo sapiens
actatttgtaaagagcaaacgg

SEQ ID NO: 9413768 - DNA, 22 bp, Homo sapiens
actatttactcaaatgaggttg

SEQ ID NO: 9413769 - DNA, 22 bp, Homo sapiens
actatgaatccacattgatttt

SEQ ID NO: 9413770 - DNA, 19 bp, Homo sapiens
actatgcatttatttgttt

SEQ ID NO: 9413771 - DNA, 22 bp, Homo sapiens
actatgaaagtataatattgaa

SEQ ID NO: 9413772 - DNA, 22 bp, Homo sapiens
actatgaaagtataatattgaa

SEQ ID NO: 9413773 - DNA, 22 bp, Homo sapiens
actatcttccttatgcctatca

SEQ ID NO: 9413774 - DNA, 21 bp, Homo sapiens
actatgtcatttaagtcactg

SEQ ID NO: 9413775 - DNA, 18 bp, Homo sapiens
actatgctgaataaatgg

SEQ ID NO: 9413776 - DNA, 22 bp, Homo sapiens
actatatacacattatcttgtt

SEQ ID NO: 9413777 - DNA, 22 bp, Homo sapiens
actatatacacattatcttgtt

SEQ ID NO: 9413778 - DNA, 22 bp, Homo sapiens
actatcaacatcattgctctag

SEQ ID NO: 9413779 - DNA, 22 bp, Homo sapiens
actatccttatcctccaaagtt

SEQ ID NO: 9413780 - DNA, 22 bp, Homo sapiens
actagtgtccttatataagagg

SEQ ID NO: 9413781 - DNA, 22 bp, Homo sapiens
actaaatagttttgacagaaca

SEQ ID NO: 9413782 - DNA, 22 bp, Homo sapiens
actaaatagttttgacagaaca

SEQ ID NO: 9413783 - DNA, 22 bp, Homo sapiens
actaaatagttttgacagaaca

SEQ ID NO: 9413784 - DNA, 22 bp, Homo sapiens
actaaatagttttgacagaaca

SEQ ID NO: 9413785 - DNA, 22 bp, Homo sapiens
actaaatagttttgacagaaca

SEQ ID NO: 9413786 - DNA, 22 bp, Homo sapiens
actatacattgaatgttaaggt

SEQ ID NO: 9413787 - DNA, 22 bp, Homo sapiens
actatacattgaatgttaaggt

SEQ ID NO: 9413788 - DNA, 22 bp, Homo sapiens
actaaatagttttgacagaaca

SEQ ID NO: 9413789 - DNA, 22 bp, Homo sapiens
actaaatacacacatttgttca

SEQ ID NO: 9413790 - DNA, 22 bp, Homo sapiens
actaaatacacacatttgttca

SEQ ID NO: 9413791 - DNA, 22 bp, Homo sapiens
actaaagtcctgttgtagcata

SEQ ID NO: 9413792 - DNA, 22 bp, Homo sapiens
actaaagtcctgttgtagcata

SEQ ID NO: 9413793 - DNA, 22 bp, Homo sapiens
actaaagtgttggagaatgagg

SEQ ID NO: 9413794 - DNA, 22 bp, Homo sapiens
actaaagtgttggagaatgagg

SEQ ID NO: 9413795 - DNA, 22 bp, Homo sapiens
actaaagttcacggtcagcttt

SEQ ID NO: 9413796 - DNA, 22 bp, Homo sapiens
accctcagctggagattgaatt

SEQ ID NO: 9413797 - DNA, 22 bp, Homo sapiens
accctcagctggagattgaatt

SEQ ID NO: 9413798 - DNA, 22 bp, Homo sapiens
accctcagagtaggcactgctg

SEQ ID NO: 9413799 - DNA, 22 bp, Homo sapiens
accctcagagtaggcactgctg

SEQ ID NO: 9413800 - DNA, 22 bp, Homo sapiens
accctcaggcagaatgtattct

SEQ ID NO: 9413801 - DNA, 22 bp, Homo sapiens
accctcagcttcttggattaat

SEQ ID NO: 9413802 - DNA, 22 bp, Homo sapiens
agggctggtatgtccatgaaag

SEQ ID NO: 9413803 - DNA, 22 bp, Homo sapiens
accctcaggcagaatgtattct

SEQ ID NO: 9413804 - DNA, 22 bp, Homo sapiens
agggctggtatgtccatgaaag

SEQ ID NO: 9413805 - DNA, 22 bp, Homo sapiens
agggctggtatgtccatgaaag

SEQ ID NO: 9413806 - DNA, 22 bp, Homo sapiens
agggctggtatgtccatgaaag

SEQ ID NO: 9413807 - DNA, 22 bp, Homo sapiens
agggctggtatgtccatgaaag

SEQ ID NO: 9413808 - DNA, 22 bp, Homo sapiens
agggctggtatgtccatgaaag

SEQ ID NO: 9413809 - DNA, 22 bp, Homo sapiens
agggctgtcagactgaggaggc

SEQ ID NO: 9413810 - DNA, 22 bp, Homo sapiens
agggctgtgtttgcaccctctg

SEQ ID NO: 9413811 - DNA, 22 bp, Homo sapiens
agggctgtttttggcacctggg

SEQ ID NO: 9413812 - DNA, 22 bp, Homo sapiens
agggcttgcagaaatgagaaat

SEQ ID NO: 9413813 - DNA, 22 bp, Homo sapiens
agggtgcctggaagccactcac

SEQ ID NO: 9413814 - DNA, 22 bp, Homo sapiens
agggtgcctggaagccactcac

SEQ ID NO: 9413815 - DNA, 22 bp, Homo sapiens
agggtgcctggaagccactcac

SEQ ID NO: 9413816 - DNA, 22 bp, Homo sapiens
agggtgggctagactcttcccc

SEQ ID NO: 9413817 - DNA, 22 bp, Homo sapiens
agggtgggctagactcttcccc

SEQ ID NO: 9413818 - DNA, 20 bp, Homo sapiens
agggtggggacgttctgact

SEQ ID NO: 9413819 - DNA, 20 bp, Homo sapiens
agggtggggacgttctgact

SEQ ID NO: 9413820 - DNA, 20 bp, Homo sapiens
agggtggggacgttctgact

SEQ ID NO: 9413821 - DNA, 20 bp, Homo sapiens
agggtggggacgttctgact

SEQ ID NO: 9413822 - DNA, 22 bp, Homo sapiens
agggcttgccattgcctgttag

SEQ ID NO: 9413823 - DNA, 22 bp, Homo sapiens
agggcttgctgatttaaagagc

SEQ ID NO: 9413824 - DNA, 22 bp, Homo sapiens
agggcttgttaacatagagatt

SEQ ID NO: 9413825 - DNA, 22 bp, Homo sapiens
agggtgcctgctgcaggttcag

SEQ ID NO: 9413826 - DNA, 22 bp, Homo sapiens
agggcttgtttcctgtttcata

SEQ ID NO: 9413827 - DNA, 22 bp, Homo sapiens
acctccccgggagcagcctcct

SEQ ID NO: 9413828 - DNA, 22 bp, Homo sapiens
acctccccgggagcagcctcct

SEQ ID NO: 9413829 - DNA, 22 bp, Homo sapiens
acctcccctcaccaatctggtt

SEQ ID NO: 9413830 - DNA, 22 bp, Homo sapiens
acctccccgggagcagcctcct

SEQ ID NO: 9413831 - DNA, 22 bp, Homo sapiens
acctccccattaggtcacccac

SEQ ID NO: 9413832 - DNA, 22 bp, Homo sapiens
acctccccattaggtcacccac

SEQ ID NO: 9413833 - DNA, 18 bp, Homo sapiens
acctccccattttctgaa

SEQ ID NO: 9413834 - DNA, 22 bp, Homo sapiens
acctccccattaggtcacccac

SEQ ID NO: 9413835 - DNA, 22 bp, Homo sapiens
acctcccctcaccaatctggtt

SEQ ID NO: 9413836 - DNA, 22 bp, Homo sapiens
acctcccctgactcgaaaccca

SEQ ID NO: 9413837 - DNA, 22 bp, Homo sapiens
acctccctcgccgtccactctg

SEQ ID NO: 9413838 - DNA, 20 bp, Homo sapiens
acctccctctgtgggtggga

SEQ ID NO: 9413839 - DNA, 22 bp, Homo sapiens
acctccctcgccgtccactctg

SEQ ID NO: 9413840 - DNA, 22 bp, Homo sapiens
agggtggggtgctacatcttta

SEQ ID NO: 9413841 - DNA, 22 bp, Homo sapiens
agggtggggtgctacatcttta

SEQ ID NO: 9413842 - DNA, 22 bp, Homo sapiens
agggtggggtgctacatcttta

SEQ ID NO: 9413843 - DNA, 22 bp, Homo sapiens
agggtgtcagccacggaatggg

SEQ ID NO: 9413844 - DNA, 22 bp, Homo sapiens
agggtggggtgctacatcttta

SEQ ID NO: 9413845 - DNA, 22 bp, Homo sapiens
agggtggggtgctacatcttta

SEQ ID NO: 9413846 - DNA, 22 bp, Homo sapiens
agggtggttcttttagtggaag

SEQ ID NO: 9413847 - DNA, 22 bp, Homo sapiens
agggtgtacatttgttggtgaa

SEQ ID NO: 9413848 - DNA, 22 bp, Homo sapiens
agggtgtgttctcctatgagaa

SEQ ID NO: 9413849 - DNA, 20 bp, Homo sapiens
agggtgtgggccttagccat

SEQ ID NO: 9413850 - DNA, 22 bp, Homo sapiens
agggtgtgttctcctatgagaa

SEQ ID NO: 9413851 - DNA, 22 bp, Homo sapiens
acctcccagctctgagcttggg

SEQ ID NO: 9413852 - DNA, 19 bp, Homo sapiens
agggttacccgctgccacc

SEQ ID NO: 9413853 - DNA, 22 bp, Homo sapiens
acctccccacatggtagtgagt

SEQ ID NO: 9413854 - DNA, 22 bp, Homo sapiens
acctccccacatggtagtgagt

SEQ ID NO: 9413855 - DNA, 19 bp, Homo sapiens
agggttacccgctgccacc

SEQ ID NO: 9413856 - DNA, 22 bp, Homo sapiens
aggtagaggcctccaggcagca

SEQ ID NO: 9413857 - DNA, 22 bp, Homo sapiens
aggtagaagagcaaggaataac

SEQ ID NO: 9413858 - DNA, 22 bp, Homo sapiens
aggtactgaaaaaatgtttgca

SEQ ID NO: 9413859 - DNA, 22 bp, Homo sapiens
aggtagaggcctccaggcagca

SEQ ID NO: 9413860 - DNA, 22 bp, Homo sapiens
aggtacatggggtgtgtgcacg

SEQ ID NO: 9413861 - DNA, 22 bp, Homo sapiens
aggtacatgaagcttgtgttgg

SEQ ID NO: 9413862 - DNA, 22 bp, Homo sapiens
aggtacatgaggctaatagact

SEQ ID NO: 9413863 - DNA, 22 bp, Homo sapiens
aggtacagtagacagacagtta

SEQ ID NO: 9413864 - DNA, 22 bp, Homo sapiens
aggtactaccagggattttcag

SEQ ID NO: 9413865 - DNA, 21 bp, Homo sapiens
aggtactaatgaaaagtgatt

SEQ ID NO: 9413866 - DNA, 23 bp, Homo sapiens
acctggctgctcaacctgcaggg

SEQ ID NO: 9413867 - DNA, 22 bp, Homo sapiens
acctggctgagaacgtgcagct

SEQ ID NO: 9413868 - DNA, 22 bp, Homo sapiens
aggtagcgcaatttcctgggac

SEQ ID NO: 9413869 - DNA, 22 bp, Homo sapiens
acctgggttgctggcgtgaggg

SEQ ID NO: 9413870 - DNA, 19 bp, Homo sapiens
acctggctggcgcacttgt

SEQ ID NO: 9413871 - DNA, 22 bp, Homo sapiens
acctggtaactctccaggggag

SEQ ID NO: 9413872 - DNA, 22 bp, Homo sapiens
acctgtctataaaagtgaatac

SEQ ID NO: 9413873 - DNA, 22 bp, Homo sapiens
acctgtctataaaagtgaatac

SEQ ID NO: 9413874 - DNA, 22 bp, Homo sapiens
acctgtctgggctacatttgca

SEQ ID NO: 9413875 - DNA, 23 bp, Homo sapiens
acctgtctgcctcccaccatcaa

SEQ ID NO: 9413876 - DNA, 22 bp, Homo sapiens
acctgtctgcatgatctaaaac

SEQ ID NO: 9413877 - DNA, 22 bp, Homo sapiens
acctgtctgcatgatctaaaac

SEQ ID NO: 9413878 - DNA, 22 bp, Homo sapiens
acctccctgcctcttggcgtca

SEQ ID NO: 9413879 - DNA, 22 bp, Homo sapiens
acctgctgaggagggggaatta

SEQ ID NO: 9413880 - DNA, 18 bp, Homo sapiens
acctgctgagtctaagca

SEQ ID NO: 9413881 - DNA, 18 bp, Homo sapiens
acctgctgagtctaagca

SEQ ID NO: 9413882 - DNA, 22 bp, Homo sapiens
acctgctgtcttgggggaatgc

SEQ ID NO: 9413883 - DNA, 22 bp, Homo sapiens
acctgctttgtagtgtttgctg

SEQ ID NO: 9413884 - DNA, 22 bp, Homo sapiens
acctgctttattcctcctgcct

SEQ ID NO: 9413885 - DNA, 22 bp, Homo sapiens
acctgctttgtagtgtttgctg

SEQ ID NO: 9413886 - DNA, 22 bp, Homo sapiens
acctgcttgagccagtatgaga

SEQ ID NO: 9413887 - DNA, 22 bp, Homo sapiens
acctgctgtgattctaattggc

SEQ ID NO: 9413888 - DNA, 22 bp, Homo sapiens
acctgccttctcaaggacatga

SEQ ID NO: 9413889 - DNA, 22 bp, Homo sapiens
aggtacagtagacagacagtta

SEQ ID NO: 9413890 - DNA, 22 bp, Homo sapiens
acctggaagtgggtgctatggc

SEQ ID NO: 9413891 - DNA, 22 bp, Homo sapiens
acctggacacctgctgtcatct

SEQ ID NO: 9413892 - DNA, 22 bp, Homo sapiens
acctggacacctgctgtcatct

SEQ ID NO: 9413893 - DNA, 22 bp, Homo sapiens
acctggacacctgctgtcatct

SEQ ID NO: 9413894 - DNA, 22 bp, Homo sapiens
acctggagaaagcctctccctg

SEQ ID NO: 9413895 - DNA, 22 bp, Homo sapiens
actgtcttgttccaagactaaa

SEQ ID NO: 9413896 - DNA, 22 bp, Homo sapiens
actgtctttgagctggaggagg

SEQ ID NO: 9413897 - DNA, 22 bp, Homo sapiens
actgtcttcaaatgaatatatt

SEQ ID NO: 9413898 - DNA, 22 bp, Homo sapiens
actgtgaacggactgaagccca

SEQ ID NO: 9413899 - DNA, 22 bp, Homo sapiens
actgtgaacggactgaagccca

SEQ ID NO: 9413900 - DNA, 17 bp, Homo sapiens
actgtcttttacaccct

SEQ ID NO: 9413901 - DNA, 22 bp, Homo sapiens
actgtcttcaaatgaatatatt

SEQ ID NO: 9413902 - DNA, 22 bp, Homo sapiens
actgtctgtgccagatgctggg

SEQ ID NO: 9413903 - DNA, 22 bp, Homo sapiens
actgtctgtctcccaattatgc

SEQ ID NO: 9413904 - DNA, 22 bp, Homo sapiens
actgtctgtgccagatgctggg

SEQ ID NO: 9413905 - DNA, 22 bp, Homo sapiens
actgtctgtcctgctctccgtg

SEQ ID NO: 9413906 - DNA, 22 bp, Homo sapiens
actgtctggaggcagagaggga

SEQ ID NO: 9413907 - DNA, 22 bp, Homo sapiens
actgtctggatggaagccagcg

SEQ ID NO: 9413908 - DNA, 20 bp, Homo sapiens
actgtctggggacctcatta

SEQ ID NO: 9413909 - DNA, 22 bp, Homo sapiens
actgtctgtacttcttgcaagg

SEQ ID NO: 9413910 - DNA, 22 bp, Homo sapiens
actgtctgctggcccctggtta

SEQ ID NO: 9413911 - DNA, 22 bp, Homo sapiens
actgtctgctggcccctggtta

SEQ ID NO: 9413912 - DNA, 22 bp, Homo sapiens
actgtaaaggtgattagaagtt

SEQ ID NO: 9413913 - DNA, 22 bp, Homo sapiens
actgtaaagaggtgtatcttta

SEQ ID NO: 9413914 - DNA, 22 bp, Homo sapiens
actgtaaattacataagaacag

SEQ ID NO: 9413915 - DNA, 22 bp, Homo sapiens
actgtaaattacataagaacag

SEQ ID NO: 9413916 - DNA, 22 bp, Homo sapiens
actgtcatcttgtaagcaatgt

SEQ ID NO: 9413917 - DNA, 21 bp, Homo sapiens
agtttcctcatctgcatagga

SEQ ID NO: 9413918 - DNA, 23 bp, Homo sapiens
agtttccacccagggtagaaggg

SEQ ID NO: 9413919 - DNA, 22 bp, Homo sapiens
agtttccactggagacactgtg

SEQ ID NO: 9413920 - DNA, 22 bp, Homo sapiens
agtttccactggagacactgtg

SEQ ID NO: 9413921 - DNA, 22 bp, Homo sapiens
agtttccagcacagggcaagct

SEQ ID NO: 9413922 - DNA, 22 bp, Homo sapiens
agtttccatcccacacttgctt

SEQ ID NO: 9413923 - DNA, 22 bp, Homo sapiens
agtttccaggcaggagctaatt

SEQ ID NO: 9413924 - DNA, 22 bp, Homo sapiens
agtttcatttcttagtaccagt

SEQ ID NO: 9413925 - DNA, 22 bp, Homo sapiens
agtttccaaaaggagacaggga

SEQ ID NO: 9413926 - DNA, 22 bp, Homo sapiens
agtttccaaaaggagacaggga

SEQ ID NO: 9413927 - DNA, 22 bp, Homo sapiens
agtttccaaagcatgttcacac

SEQ ID NO: 9413928 - DNA, 22 bp, Homo sapiens
agtttccaaatattgttttagc

SEQ ID NO: 9413929 - DNA, 22 bp, Homo sapiens
actgtgggtcccagctgtgtct

SEQ ID NO: 9413930 - DNA, 22 bp, Homo sapiens
actgtggtgcacggcctgctcc

SEQ ID NO: 9413931 - DNA, 22 bp, Homo sapiens
actgtgtatgatatgtactggg

SEQ ID NO: 9413932 - DNA, 20 bp, Homo sapiens
actgtgtaaacatgattcat

SEQ ID NO: 9413933 - DNA, 22 bp, Homo sapiens
actgtgtattctaatgactaaa

SEQ ID NO: 9413934 - DNA, 22 bp, Homo sapiens
actgtgtattcctatatagtaa

SEQ ID NO: 9413935 - DNA, 22 bp, Homo sapiens
agtttctaacatatagcattgg

SEQ ID NO: 9413936 - DNA, 21 bp, Homo sapiens
actgtgccaggcacaaaaaca

SEQ ID NO: 9413937 - DNA, 22 bp, Homo sapiens
actgtgcctttcacttgcactt

SEQ ID NO: 9413938 - DNA, 22 bp, Homo sapiens
actgtgccttcagttttggggt

SEQ ID NO: 9413939 - DNA, 22 bp, Homo sapiens
actgtgccttcttattgggtcc

SEQ ID NO: 9413940 - DNA, 22 bp, Homo sapiens
agtttcctcatgttaatatgga

SEQ ID NO: 9413941 - DNA, 22 bp, Homo sapiens
agtttcctgggagattcttaca

SEQ ID NO: 9413942 - DNA, 22 bp, Homo sapiens
agtttccttgggcatttgttta

SEQ ID NO: 9413943 - DNA, 22 bp, Homo sapiens
agtttacatcttcaatctcatt

SEQ ID NO: 9413944 - DNA, 22 bp, Homo sapiens
agtttacatcttcaatctcatt

SEQ ID NO: 9413945 - DNA, 22 bp, Homo sapiens
agtttacatcttcaatctcatt

SEQ ID NO: 9413946 - DNA, 22 bp, Homo sapiens
agtttacataaaaaggcagagg

SEQ ID NO: 9413947 - DNA, 22 bp, Homo sapiens
agtttacataaaaaggcagagg

SEQ ID NO: 9413948 - DNA, 22 bp, Homo sapiens
agtttacataaaaaggcagagg

SEQ ID NO: 9413949 - DNA, 22 bp, Homo sapiens
agtttactctggtgacaattta

SEQ ID NO: 9413950 - DNA, 22 bp, Homo sapiens
agtttacatgacgtgtatttca

SEQ ID NO: 9413951 - DNA, 22 bp, Homo sapiens
agtttacatgacgtgtatttca

SEQ ID NO: 9413952 - DNA, 22 bp, Homo sapiens
agtttacatgacgtgtatttca

SEQ ID NO: 9413953 - DNA, 22 bp, Homo sapiens
agtttactctggtgacaattta

SEQ ID NO: 9413954 - DNA, 22 bp, Homo sapiens
agtttagtataccagtacatct

SEQ ID NO: 9413955 - DNA, 17 bp, Homo sapiens
actggttttggcagcat

SEQ ID NO: 9413956 - DNA, 22 bp, Homo sapiens
actgtaaaacaggtttcatcat

SEQ ID NO: 9413957 - DNA, 22 bp, Homo sapiens
actgtaaaactgctttggaaac

SEQ ID NO: 9413958 - DNA, 22 bp, Homo sapiens
actgtaaaatgagatatgtata

SEQ ID NO: 9413959 - DNA, 22 bp, Homo sapiens
actgtaaagagaactgtgggct

SEQ ID NO: 9413960 - DNA, 22 bp, Homo sapiens
actggcagtagagggagcgcat

SEQ ID NO: 9413961 - DNA, 22 bp, Homo sapiens
actggcaggctgctggccggcg

SEQ ID NO: 9413962 - DNA, 22 bp, Homo sapiens
actggcagctgtaggatgcatg

SEQ ID NO: 9413963 - DNA, 22 bp, Homo sapiens
agttgctatcgtgaagcacgtg

SEQ ID NO: 9413964 - DNA, 22 bp, Homo sapiens
agttgcatgtccaagggggtag

SEQ ID NO: 9413965 - DNA, 22 bp, Homo sapiens
actggcagtttgagaatgcatt

SEQ ID NO: 9413966 - DNA, 19 bp, Homo sapiens
actggcagtttctgcatgg

SEQ ID NO: 9413967 - DNA, 22 bp, Homo sapiens
agtttacagatgctacaggagc

SEQ ID NO: 9413968 - DNA, 22 bp, Homo sapiens
agtttacagatgctacaggagc

SEQ ID NO: 9413969 - DNA, 22 bp, Homo sapiens
agtttacagatgctacaggagc

SEQ ID NO: 9413970 - DNA, 22 bp, Homo sapiens
agtttacagttctcatcgcaac

SEQ ID NO: 9413971 - DNA, 22 bp, Homo sapiens
agtttacactatgaaaagacta

SEQ ID NO: 9413972 - DNA, 22 bp, Homo sapiens
agtttacactatgaaaagacta

SEQ ID NO: 9413973 - DNA, 22 bp, Homo sapiens
agtttacactatgaaaagacta

SEQ ID NO: 9413974 - DNA, 22 bp, Homo sapiens
agtttacacttttgattcttat

SEQ ID NO: 9413975 - DNA, 22 bp, Homo sapiens
acttggcttttccatctctgca

SEQ ID NO: 9413976 - DNA, 22 bp, Homo sapiens
acttgggaaagaagtttcaccg

SEQ ID NO: 9413977 - DNA, 22 bp, Homo sapiens
acttggctttaggcatccacat

SEQ ID NO: 9413978 - DNA, 21 bp, Homo sapiens
acttggctttgttagaactag

SEQ ID NO: 9413979 - DNA, 22 bp, Homo sapiens
acttggctttagtagtaactga

SEQ ID NO: 9413980 - DNA, 22 bp, Homo sapiens
acttggcttttccatctctgca

SEQ ID NO: 9413981 - DNA, 22 bp, Homo sapiens
acttggcttttccatctctgca

SEQ ID NO: 9413982 - DNA, 22 bp, Homo sapiens
acttggctagagccaggaggct

SEQ ID NO: 9413983 - DNA, 22 bp, Homo sapiens
acttggctagtgatgcagggtg

SEQ ID NO: 9413984 - DNA, 22 bp, Homo sapiens
acttggctattttcattcatca

SEQ ID NO: 9413985 - DNA, 22 bp, Homo sapiens
acttggcttaaagtagtgatcg

SEQ ID NO: 9413986 - DNA, 22 bp, Homo sapiens
acttggcttcaaggttaaggtc

SEQ ID NO: 9413987 - DNA, 22 bp, Homo sapiens
acttggctgggagagttgaaga

SEQ ID NO: 9413988 - DNA, 22 bp, Homo sapiens
acttggctgcagagaacgtgtg

SEQ ID NO: 9413989 - DNA, 22 bp, Homo sapiens
acttggctcagataccatgccc

SEQ ID NO: 9413990 - DNA, 22 bp, Homo sapiens
acttggagagcattgctgggga

SEQ ID NO: 9413991 - DNA, 23 bp, Homo sapiens
acttggaagcagtgaacaacttt

SEQ ID NO: 9413992 - DNA, 23 bp, Homo sapiens
acttggaagcagtgaacaacttt

SEQ ID NO: 9413993 - DNA, 21 bp, Homo sapiens
acttggccaggcccccacctg

SEQ ID NO: 9413994 - DNA, 22 bp, Homo sapiens
acttggccttatttccacagaa

SEQ ID NO: 9413995 - DNA, 21 bp, Homo sapiens
acttggcagaacgcagaaggc

SEQ ID NO: 9413996 - DNA, 22 bp, Homo sapiens
acttggaaagatgcaacacagt

SEQ ID NO: 9413997 - DNA, 22 bp, Homo sapiens
acttggaaaattcaaaatggca

SEQ ID NO: 9413998 - DNA, 22 bp, Homo sapiens
acttggaaagatgcaacacagt

SEQ ID NO: 9413999 - DNA, 20 bp, Homo sapiens
acttgcttttgtcaggaaaa

SEQ ID NO: 9414000 - DNA, 22 bp, Homo sapiens
acttgctcaatgcttgaagcca

SEQ ID NO: 9414001 - DNA, 22 bp, Homo sapiens
acttgccccagaattgctgctg

SEQ ID NO: 9414002 - DNA, 22 bp, Homo sapiens
acttgcctgttacatttctagt

SEQ ID NO: 9414003 - DNA, 22 bp, Homo sapiens
acttgctcaatgcttgaagcca

SEQ ID NO: 9414004 - DNA, 22 bp, Homo sapiens
acttgcttagtttgcaacagag

SEQ ID NO: 9414005 - DNA, 22 bp, Homo sapiens
acttgccccagaattgctgctg

SEQ ID NO: 9414006 - DNA, 22 bp, Homo sapiens
acttgccataaatgaaaatact

SEQ ID NO: 9414007 - DNA, 22 bp, Homo sapiens
acttgcatgttatttttatagg

SEQ ID NO: 9414008 - DNA, 22 bp, Homo sapiens
acttccagatggccccatctaa

SEQ ID NO: 9414009 - DNA, 22 bp, Homo sapiens
acttccagaattagaatttaag

SEQ ID NO: 9414010 - DNA, 22 bp, Homo sapiens
acttccaagtttattcatgtga

SEQ ID NO: 9414011 - DNA, 22 bp, Homo sapiens
acttccaaataccatcacattg

SEQ ID NO: 9414012 - DNA, 22 bp, Homo sapiens
acttccaacttcagtcctgagc

SEQ ID NO: 9414013 - DNA, 22 bp, Homo sapiens
acttgattttgaacctttctac

SEQ ID NO: 9414014 - DNA, 22 bp, Homo sapiens
acttgatttttataataaatgg

SEQ ID NO: 9414015 - DNA, 22 bp, Homo sapiens
acttgatttttataataaatgg

SEQ ID NO: 9414016 - DNA, 22 bp, Homo sapiens
acttgcaaggttgcagttagaa

SEQ ID NO: 9414017 - DNA, 22 bp, Homo sapiens
acttgcagcagcagctattggc

SEQ ID NO: 9414018 - DNA, 22 bp, Homo sapiens
acttcattgtaatattatagca

SEQ ID NO: 9414019 - DNA, 22 bp, Homo sapiens
acttccaaaacacagcatggca

SEQ ID NO: 9414020 - DNA, 22 bp, Homo sapiens
acttccaaagaagtgattacag

SEQ ID NO: 9414021 - DNA, 22 bp, Homo sapiens
acttccaaagaagtgattacag

SEQ ID NO: 9414022 - DNA, 22 bp, Homo sapiens
acttccaaagaagtgattacag

SEQ ID NO: 9414023 - DNA, 22 bp, Homo sapiens
acttcattcattttcacgaatg

SEQ ID NO: 9414024 - DNA, 22 bp, Homo sapiens
acttcattgctaagaacaaggt

SEQ ID NO: 9414025 - DNA, 22 bp, Homo sapiens
acttcatattgtttccactaga

SEQ ID NO: 9414026 - DNA, 22 bp, Homo sapiens
acttcatattgtttccactaga

SEQ ID NO: 9414027 - DNA, 22 bp, Homo sapiens
acttcagtgtggtataaaacgt

SEQ ID NO: 9414028 - DNA, 22 bp, Homo sapiens
acttcagtaggtgatatgtgca

SEQ ID NO: 9414029 - DNA, 22 bp, Homo sapiens
acttcatagaatgagcttggaa

SEQ ID NO: 9414030 - DNA, 22 bp, Homo sapiens
acttatttcatggatcataatg

SEQ ID NO: 9414031 - DNA, 22 bp, Homo sapiens
acttcaaaaataagtgagaggt

SEQ ID NO: 9414032 - DNA, 22 bp, Homo sapiens
actgttatgttattacccatgt

SEQ ID NO: 9414033 - DNA, 22 bp, Homo sapiens
acttagaattaaatatttttgg

SEQ ID NO: 9414034 - DNA, 22 bp, Homo sapiens
acttcaaacaattaacagagaa

SEQ ID NO: 9414035 - DNA, 22 bp, Homo sapiens
acttcaaaatgagtttcctggt

SEQ ID NO: 9414036 - DNA, 22 bp, Homo sapiens
acttcaaaatgagtttcctggt

SEQ ID NO: 9414037 - DNA, 22 bp, Homo sapiens
acttcaaaaataagtgagaggt

SEQ ID NO: 9414038 - DNA, 22 bp, Homo sapiens
acttcaaatctcttgaaagcaa

SEQ ID NO: 9414039 - DNA, 22 bp, Homo sapiens
acttcaaacaattaacagagaa

SEQ ID NO: 9414040 - DNA, 22 bp, Homo sapiens
acttcaaattctgggggaagag

SEQ ID NO: 9414041 - DNA, 22 bp, Homo sapiens
acttcaaatgtgacaatgtgaa

SEQ ID NO: 9414042 - DNA, 19 bp, Homo sapiens
acttcaaatcttagagaaa

SEQ ID NO: 9414043 - DNA, 19 bp, Homo sapiens
acttcaaatcttagagaaa

SEQ ID NO: 9414044 - DNA, 19 bp, Homo sapiens
acttcaaatcttagagaaa

SEQ ID NO: 9414045 - DNA, 22 bp, Homo sapiens
acttcaaatctcttgaaagcaa

SEQ ID NO: 9414046 - DNA, 22 bp, Homo sapiens
acttcaaacaattaacagagaa

SEQ ID NO: 9414047 - DNA, 22 bp, Homo sapiens
acttcacatttgcaagtcttgg

SEQ ID NO: 9414048 - DNA, 22 bp, Homo sapiens
acttcacaggttttcataaaac

SEQ ID NO: 9414049 - DNA, 22 bp, Homo sapiens
acttcacagatatttatttggt

SEQ ID NO: 9414050 - DNA, 22 bp, Homo sapiens
acttcacagaaattttatgagg

SEQ ID NO: 9414051 - DNA, 22 bp, Homo sapiens
acttcacattagctaaaaggga

SEQ ID NO: 9414052 - DNA, 22 bp, Homo sapiens
acttcacattagctaaaaggga

SEQ ID NO: 9414053 - DNA, 22 bp, Homo sapiens
acttcacaggttttcataaaac

SEQ ID NO: 9414054 - DNA, 22 bp, Homo sapiens
acttcacaggttttcataaaac

SEQ ID NO: 9414055 - DNA, 22 bp, Homo sapiens
acttcacaggttttcataaaac

SEQ ID NO: 9414056 - DNA, 22 bp, Homo sapiens
acttcaaattctgggggaagag

SEQ ID NO: 9414057 - DNA, 22 bp, Homo sapiens
acttcaaatgtgacaatgtgaa

SEQ ID NO: 9414058 - DNA, 22 bp, Homo sapiens
acttcaaattttcagaagaaat

SEQ ID NO: 9414059 - DNA, 17 bp, Homo sapiens
acttcaagttcagtgac

SEQ ID NO: 9414060 - DNA, 22 bp, Homo sapiens
acttcaaattttcagaagaaat

SEQ ID NO: 9414061 - DNA, 22 bp, Homo sapiens
acttcacagaaattttatgagg

SEQ ID NO: 9414062 - DNA, 22 bp, Homo sapiens
acttcacaaagagatcatctaa

SEQ ID NO: 9414063 - DNA, 22 bp, Homo sapiens
actgtgtcctcatgtggcagaa

SEQ ID NO: 9414064 - DNA, 22 bp, Homo sapiens
actgtgtgaggctgggtgagtc

SEQ ID NO: 9414065 - DNA, 20 bp, Homo sapiens
actgtgtgatctggaaagct

SEQ ID NO: 9414066 - DNA, 20 bp, Homo sapiens
actgtgtgatctggaaagct

SEQ ID NO: 9414067 - DNA, 22 bp, Homo sapiens
actgtgtgctggacatgatgtt

SEQ ID NO: 9414068 - DNA, 22 bp, Homo sapiens
actgtgtggaaatttgtgaggg

SEQ ID NO: 9414069 - DNA, 19 bp, Homo sapiens
actgtgtggaagtgtgatt

SEQ ID NO: 9414070 - DNA, 22 bp, Homo sapiens
actgtgtgctggacatgatgtt

SEQ ID NO: 9414071 - DNA, 22 bp, Homo sapiens
actgtgtgctggacatgatgtt

SEQ ID NO: 9414072 - DNA, 21 bp, Homo sapiens
actgttaagacgtagctgggg

SEQ ID NO: 9414073 - DNA, 22 bp, Homo sapiens
actgttaacggtatgatgctcg

SEQ ID NO: 9414074 - DNA, 22 bp, Homo sapiens
actgtgtttctgaaacaagagg

SEQ ID NO: 9414075 - DNA, 22 bp, Homo sapiens
actgttaattcaatcaacaggt

SEQ ID NO: 9414076 - DNA, 22 bp, Homo sapiens
actgttaagtatgaagtaaggc

SEQ ID NO: 9414077 - DNA, 22 bp, Homo sapiens
actgttacagagcaggaaattg

SEQ ID NO: 9414078 - DNA, 22 bp, Homo sapiens
actgttacagggcactgaacat

SEQ ID NO: 9414079 - DNA, 22 bp, Homo sapiens
actgtgttgtctcaacctgacc

SEQ ID NO: 9414080 - DNA, 22 bp, Homo sapiens
actgtgttcaattaaaaagctt

SEQ ID NO: 9414081 - DNA, 22 bp, Homo sapiens
atataattctcaggtttgacta

SEQ ID NO: 9414082 - DNA, 22 bp, Homo sapiens
atataattgttctgaagtgttt

SEQ ID NO: 9414083 - DNA, 22 bp, Homo sapiens
atataatagtttcataaaggct

SEQ ID NO: 9414084 - DNA, 22 bp, Homo sapiens
atataattaatttagctgcctc

SEQ ID NO: 9414085 - DNA, 22 bp, Homo sapiens
atataatgattttctggtgagt

SEQ ID NO: 9414086 - DNA, 22 bp, Homo sapiens
atatacaaagggcaacctcgct

SEQ ID NO: 9414087 - DNA, 22 bp, Homo sapiens
atatacaaagggcaacctcgct

SEQ ID NO: 9414088 - DNA, 22 bp, Homo sapiens
atatacaaagggcaacctcgct

SEQ ID NO: 9414089 - DNA, 22 bp, Homo sapiens
atatacacagagcttatggtga

SEQ ID NO: 9414090 - DNA, 22 bp, Homo sapiens
atatacacagagcttatggtga

SEQ ID NO: 9414091 - DNA, 22 bp, Homo sapiens
acttggtggaacgtgtatttta

SEQ ID NO: 9414092 - DNA, 22 bp, Homo sapiens
acttgggtcacatgacctacct

SEQ ID NO: 9414093 - DNA, 22 bp, Homo sapiens
acttgggatttcagatgctgtg

SEQ ID NO: 9414094 - DNA, 22 bp, Homo sapiens
acttgggtcaagtagctcacag

SEQ ID NO: 9414095 - DNA, 22 bp, Homo sapiens
acttgggaggctgaaggacatt

SEQ ID NO: 9414096 - DNA, 22 bp, Homo sapiens
acttgggaggctgaaggacatt

SEQ ID NO: 9414097 - DNA, 22 bp, Homo sapiens
acttgggagggtgtgggcagct

SEQ ID NO: 9414098 - DNA, 22 bp, Homo sapiens
acttgggatggtggccagagcg

SEQ ID NO: 9414099 - DNA, 22 bp, Homo sapiens
atagttgtgtggggattctggt

SEQ ID NO: 9414100 - DNA, 22 bp, Homo sapiens
atagtttacaaaaatgatgcat

SEQ ID NO: 9414101 - DNA, 22 bp, Homo sapiens
acttggttctaactagtgtata

SEQ ID NO: 9414102 - DNA, 22 bp, Homo sapiens
atataatagtttcataaaggct

SEQ ID NO: 9414103 - DNA, 22 bp, Homo sapiens
atataatagtttcataaaggct

SEQ ID NO: 9414104 - DNA, 22 bp, Homo sapiens
atagtttacaaaaatgatgcat

SEQ ID NO: 9414105 - DNA, 22 bp, Homo sapiens
atataatagtttcataaaggct

SEQ ID NO: 9414106 - DNA, 22 bp, Homo sapiens
atataatagtttcataaaggct

SEQ ID NO: 9414107 - DNA, 22 bp, Homo sapiens
actttggggatctacggctgga

SEQ ID NO: 9414108 - DNA, 22 bp, Homo sapiens
actttgggtaagccaggtgcta

SEQ ID NO: 9414109 - DNA, 22 bp, Homo sapiens
atatacacatgtgtatacattt

SEQ ID NO: 9414110 - DNA, 22 bp, Homo sapiens
atatacacatgtgtatacattt

SEQ ID NO: 9414111 - DNA, 22 bp, Homo sapiens
atatacacatctttttaaatat

SEQ ID NO: 9414112 - DNA, 22 bp, Homo sapiens
actttgggcacagtgaggccag

SEQ ID NO: 9414113 - DNA, 21 bp, Homo sapiens
actttgggaggtgtgaggggc

SEQ ID NO: 9414114 - DNA, 22 bp, Homo sapiens
actttgtaaattgttgtgactc

SEQ ID NO: 9414115 - DNA, 22 bp, Homo sapiens
actttgtaataactcctgagtt

SEQ ID NO: 9414116 - DNA, 22 bp, Homo sapiens
actttgtaggaaaaagtcacaa

SEQ ID NO: 9414117 - DNA, 22 bp, Homo sapiens
actttgtaggtttcagtgaaac

SEQ ID NO: 9414118 - DNA, 22 bp, Homo sapiens
actttgtataagacaataaaga

SEQ ID NO: 9414119 - DNA, 22 bp, Homo sapiens
atatataacctggataaggctt

SEQ ID NO: 9414120 - DNA, 22 bp, Homo sapiens
atatattcttaaagaatctgac

SEQ ID NO: 9414121 - DNA, 22 bp, Homo sapiens
agaaaataaattgatggtggaa

SEQ ID NO: 9414122 - DNA, 22 bp, Homo sapiens
atatgaaagtaagcatgtgtgt

SEQ ID NO: 9414123 - DNA, 22 bp, Homo sapiens
atatgaaaatgttttagctgta

SEQ ID NO: 9414124 - DNA, 22 bp, Homo sapiens
agaaaattactccagagacaag

SEQ ID NO: 9414125 - DNA, 22 bp, Homo sapiens
agaaaattagattttactgtgt

SEQ ID NO: 9414126 - DNA, 22 bp, Homo sapiens
agaaaattagattttactgtgt

SEQ ID NO: 9414127 - DNA, 22 bp, Homo sapiens
atatcttttagagcaagcttgt

SEQ ID NO: 9414128 - DNA, 22 bp, Homo sapiens
atatgaaaagaagtcaccattg

SEQ ID NO: 9414129 - DNA, 22 bp, Homo sapiens
atatgaaaagaagtcaccattg

SEQ ID NO: 9414130 - DNA, 22 bp, Homo sapiens
atatcttttagagcaagcttgt

SEQ ID NO: 9414131 - DNA, 22 bp, Homo sapiens
atatcttttagagcaagcttgt

SEQ ID NO: 9414132 - DNA, 22 bp, Homo sapiens
atatgaaaatgttttagctgta

SEQ ID NO: 9414133 - DNA, 22 bp, Homo sapiens
atatgaaaagaagtcaccattg

SEQ ID NO: 9414134 - DNA, 22 bp, Homo sapiens
agaaacagaaccaggtgtcatt

SEQ ID NO: 9414135 - DNA, 22 bp, Homo sapiens
agaaacaaggtgtaggttgacc

SEQ ID NO: 9414136 - DNA, 22 bp, Homo sapiens
agaaacaaggtgtaggttgacc

SEQ ID NO: 9414137 - DNA, 22 bp, Homo sapiens
agaaacagaaccaggtgtcatt

SEQ ID NO: 9414138 - DNA, 22 bp, Homo sapiens
agaaacagaaccaggtgtcatt

SEQ ID NO: 9414139 - DNA, 22 bp, Homo sapiens
agaaacaacttgtttctcttgc

SEQ ID NO: 9414140 - DNA, 22 bp, Homo sapiens
agaaacaacttgtttctcttgc

SEQ ID NO: 9414141 - DNA, 22 bp, Homo sapiens
agaaacaacttgtttctcttgc

SEQ ID NO: 9414142 - DNA, 22 bp, Homo sapiens
agaaacaaggtgtaggttgacc

SEQ ID NO: 9414143 - DNA, 22 bp, Homo sapiens
agaaacaaggtgtaggttgacc

SEQ ID NO: 9414144 - DNA, 22 bp, Homo sapiens
agaaaatttaaagagacacaca

SEQ ID NO: 9414145 - DNA, 22 bp, Homo sapiens
agaaaatttaaagagacacaca

SEQ ID NO: 9414146 - DNA, 22 bp, Homo sapiens
agaaacaacttgtttctcttgc

SEQ ID NO: 9414147 - DNA, 22 bp, Homo sapiens
agaaacaacttgtttctcttgc

SEQ ID NO: 9414148 - DNA, 22 bp, Homo sapiens
atatatttgagaatattcatga

SEQ ID NO: 9414149 - DNA, 22 bp, Homo sapiens
atatatttgagaatattcatga

SEQ ID NO: 9414150 - DNA, 22 bp, Homo sapiens
atatatttgagaatattcatga

SEQ ID NO: 9414151 - DNA, 22 bp, Homo sapiens
atatatttgagaatattcatga

SEQ ID NO: 9414152 - DNA, 22 bp, Homo sapiens
atatatttgagaatattcatga

SEQ ID NO: 9414153 - DNA, 22 bp, Homo sapiens
atatatttgagaatattcatga

SEQ ID NO: 9414154 - DNA, 22 bp, Homo sapiens
atatatttgagaatattcatga

SEQ ID NO: 9414155 - DNA, 22 bp, Homo sapiens
atatatttgagaatattcatga

SEQ ID NO: 9414156 - DNA, 22 bp, Homo sapiens
atatatttactctcctgttgca

SEQ ID NO: 9414157 - DNA, 22 bp, Homo sapiens
atatccatattacaagcagaaa

SEQ ID NO: 9414158 - DNA, 22 bp, Homo sapiens
atatccttgagacgtggctact

SEQ ID NO: 9414159 - DNA, 19 bp, Homo sapiens
atatccttgagaaagggaa

SEQ ID NO: 9414160 - DNA, 22 bp, Homo sapiens
atatccgagaccaaataactgg

SEQ ID NO: 9414161 - DNA, 22 bp, Homo sapiens
atatcttggccccaggatttta

SEQ ID NO: 9414162 - DNA, 22 bp, Homo sapiens
atatcttctttattttgtgagg

SEQ ID NO: 9414163 - DNA, 21 bp, Homo sapiens
atatcttcttcaaaccactca

SEQ ID NO: 9414164 - DNA, 21 bp, Homo sapiens
atatcttcttcaaaccactca

SEQ ID NO: 9414165 - DNA, 18 bp, Homo sapiens
atatctgtgggatggaga

SEQ ID NO: 9414166 - DNA, 22 bp, Homo sapiens
atatcctttactgtgtcacaga

SEQ ID NO: 9414167 - DNA, 22 bp, Homo sapiens
atatcctttactgtgtcacaga

SEQ ID NO: 9414168 - DNA, 22 bp, Homo sapiens
atcacattgccagtgattaccc

SEQ ID NO: 9414169 - DNA, 22 bp, Homo sapiens
atcacattgccagtgattaccc

SEQ ID NO: 9414170 - DNA, 22 bp, Homo sapiens
atcacattgccagtgattaccc

SEQ ID NO: 9414171 - DNA, 22 bp, Homo sapiens
atcacaaaggctgcttcatgat

SEQ ID NO: 9414172 - DNA, 21 bp, Homo sapiens
atcacattggctgttattatt

SEQ ID NO: 9414173 - DNA, 21 bp, Homo sapiens
atcacattggctgttattatt

SEQ ID NO: 9414174 - DNA, 22 bp, Homo sapiens
atcacattgccagtgattaccc

SEQ ID NO: 9414175 - DNA, 21 bp, Homo sapiens
agaaacatgatcaaaggaacc

SEQ ID NO: 9414176 - DNA, 21 bp, Homo sapiens
agaaacatgatcaaaggaacc

SEQ ID NO: 9414177 - DNA, 22 bp, Homo sapiens
agaaacatcctgctttccattt

SEQ ID NO: 9414178 - DNA, 22 bp, Homo sapiens
agaaacatcctgctttccattt

SEQ ID NO: 9414179 - DNA, 20 bp, Homo sapiens
agaaacagcacaattctgtt

SEQ ID NO: 9414180 - DNA, 20 bp, Homo sapiens
agaaacagcacaattctgtt

SEQ ID NO: 9414181 - DNA, 22 bp, Homo sapiens
agaaacagaagggaaagctttt

SEQ ID NO: 9414182 - DNA, 22 bp, Homo sapiens
agaaacagaagggaaagctttt

SEQ ID NO: 9414183 - DNA, 20 bp, Homo sapiens
agaaacagcacaattctgtt

SEQ ID NO: 9414184 - DNA, 22 bp, Homo sapiens
agaaacagcattagcatcaatt

SEQ ID NO: 9414185 - DNA, 22 bp, Homo sapiens
agaaacagcattagcatcaatt

SEQ ID NO: 9414186 - DNA, 22 bp, Homo sapiens
agaaacatcattggaacacaag

SEQ ID NO: 9414187 - DNA, 22 bp, Homo sapiens
agaaacatcattggaacacaag

SEQ ID NO: 9414188 - DNA, 22 bp, Homo sapiens
agaaacatcattggaacacaag

SEQ ID NO: 9414189 - DNA, 22 bp, Homo sapiens
agaaacagcattagcatcaatt

SEQ ID NO: 9414190 - DNA, 22 bp, Homo sapiens
agaaacatattcagtgagtaat

SEQ ID NO: 9414191 - DNA, 22 bp, Homo sapiens
atcagatatttaagttatcaac

SEQ ID NO: 9414192 - DNA, 22 bp, Homo sapiens
atcagagtgggtctggcatgag

SEQ ID NO: 9414193 - DNA, 22 bp, Homo sapiens
atcagagtgggtctggcatgag

SEQ ID NO: 9414194 - DNA, 22 bp, Homo sapiens
atcactgtggcccaaaacctca

SEQ ID NO: 9414195 - DNA, 22 bp, Homo sapiens
atcacctggccattgggttaac

SEQ ID NO: 9414196 - DNA, 22 bp, Homo sapiens
atcacctgcacaaatgtgttcc

SEQ ID NO: 9414197 - DNA, 20 bp, Homo sapiens
atcacctgtaggttctttgt

SEQ ID NO: 9414198 - DNA, 19 bp, Homo sapiens
atcacctggtgtttccttg

SEQ ID NO: 9414199 - DNA, 23 bp, Homo sapiens
atcaccagcggaagctgcagacc

SEQ ID NO: 9414200 - DNA, 21 bp, Homo sapiens
atcaccagcagaagctgcaga

SEQ ID NO: 9414201 - DNA, 22 bp, Homo sapiens
atcaccaggcaaaatgtcagag

SEQ ID NO: 9414202 - DNA, 21 bp, Homo sapiens
atcaccagcagaagctgcaga

SEQ ID NO: 9414203 - DNA, 22 bp, Homo sapiens
atcacatttatagtggcacgca

SEQ ID NO: 9414204 - DNA, 21 bp, Homo sapiens
atcacattggctgttattatt

SEQ ID NO: 9414205 - DNA, 22 bp, Homo sapiens
atcacattgttagcatagactg

SEQ ID NO: 9414206 - DNA, 22 bp, Homo sapiens
atcattctgatggtcaatgcta

SEQ ID NO: 9414207 - DNA, 22 bp, Homo sapiens
atcattctctgcttgagcactc

SEQ ID NO: 9414208 - DNA, 20 bp, Homo sapiens
atcatctttacaatgtcagt

SEQ ID NO: 9414209 - DNA, 20 bp, Homo sapiens
atcatctttacaatgtcagt

SEQ ID NO: 9414210 - DNA, 22 bp, Homo sapiens
atcatcttgctttctgtttact

SEQ ID NO: 9414211 - DNA, 22 bp, Homo sapiens
atcagcaagtcctgttaattct

SEQ ID NO: 9414212 - DNA, 22 bp, Homo sapiens
atcagcaaggcaatcactgcag

SEQ ID NO: 9414213 - DNA, 20 bp, Homo sapiens
atcagcaactgccactcagt

SEQ ID NO: 9414214 - DNA, 22 bp, Homo sapiens
atcagcaaaaatgccttcagaa

SEQ ID NO: 9414215 - DNA, 22 bp, Homo sapiens
atcagcaagcatttattgagtg

SEQ ID NO: 9414216 - DNA, 22 bp, Homo sapiens
atcagcaagcatggttaggtgt

SEQ ID NO: 9414217 - DNA, 21 bp, Homo sapiens
atcattctggaaaattcaagc

SEQ ID NO: 9414218 - DNA, 22 bp, Homo sapiens
atcattgaatataagtgctatt

SEQ ID NO: 9414219 - DNA, 22 bp, Homo sapiens
atcattgagtaaaatgaataca

SEQ ID NO: 9414220 - DNA, 22 bp, Homo sapiens
atcatttaaaacaagtctctat

SEQ ID NO: 9414221 - DNA, 22 bp, Homo sapiens
atcatttacaaactcagcattg

SEQ ID NO: 9414222 - DNA, 22 bp, Homo sapiens
atcatttaaaacaagtctctat

SEQ ID NO: 9414223 - DNA, 22 bp, Homo sapiens
atcatttacaaactcagcattg

SEQ ID NO: 9414224 - DNA, 22 bp, Homo sapiens
atcatttacaaactcagcattg

SEQ ID NO: 9414225 - DNA, 22 bp, Homo sapiens
atcatttacaaactcagcattg

SEQ ID NO: 9414226 - DNA, 22 bp, Homo sapiens
atcatttacaaactcagcattg

SEQ ID NO: 9414227 - DNA, 22 bp, Homo sapiens
atcatttatgccccaattagat

SEQ ID NO: 9414228 - DNA, 22 bp, Homo sapiens
atcatttatgccccaattagat

SEQ ID NO: 9414229 - DNA, 22 bp, Homo sapiens
atcatttatgccccaattagat

SEQ ID NO: 9414230 - DNA, 22 bp, Homo sapiens
atcatttatgccccaattagat

SEQ ID NO: 9414231 - DNA, 22 bp, Homo sapiens
atccagagttatatccaagcag

SEQ ID NO: 9414232 - DNA, 22 bp, Homo sapiens
agaagaaatgaggccgttctgc

SEQ ID NO: 9414233 - DNA, 22 bp, Homo sapiens
agaagaaatgaggccgttctgc

SEQ ID NO: 9414234 - DNA, 22 bp, Homo sapiens
atccagccagtgtggatgactt

SEQ ID NO: 9414235 - DNA, 23 bp, Homo sapiens
atccagcctgggggtttaaccac

SEQ ID NO: 9414236 - DNA, 22 bp, Homo sapiens
atcatttccctttagatcacaa

SEQ ID NO: 9414237 - DNA, 22 bp, Homo sapiens
atcatttgaacagaatttgttt

SEQ ID NO: 9414238 - DNA, 22 bp, Homo sapiens
atcatttccctttagatcacaa

SEQ ID NO: 9414239 - DNA, 22 bp, Homo sapiens
atcatttgtgcatagtaacaga

SEQ ID NO: 9414240 - DNA, 22 bp, Homo sapiens
atccactctcccattcatgcat

SEQ ID NO: 9414241 - DNA, 22 bp, Homo sapiens
atccagagacccaaggacagaa

SEQ ID NO: 9414242 - DNA, 22 bp, Homo sapiens
atccagagacccaaggacagaa

SEQ ID NO: 9414243 - DNA, 22 bp, Homo sapiens
atccacttggctggttgttcta

SEQ ID NO: 9414244 - DNA, 22 bp, Homo sapiens
atggcagatggctggagcaggt

SEQ ID NO: 9414245 - DNA, 18 bp, Homo sapiens
atggcagatgataagtgc

SEQ ID NO: 9414246 - DNA, 22 bp, Homo sapiens
atggcagatccacagtttgaag

SEQ ID NO: 9414247 - DNA, 22 bp, Homo sapiens
atggcagatccacagtttgaag

SEQ ID NO: 9414248 - DNA, 22 bp, Homo sapiens
atggcagagtcctaagccttta

SEQ ID NO: 9414249 - DNA, 22 bp, Homo sapiens
atggcagcaaatgtctggctgg

SEQ ID NO: 9414250 - DNA, 22 bp, Homo sapiens
atggcagcaaagaggccttctt

SEQ ID NO: 9414251 - DNA, 22 bp, Homo sapiens
atggcagatggctggagcaggt

SEQ ID NO: 9414252 - DNA, 22 bp, Homo sapiens
atggataatggtgatagttgca

SEQ ID NO: 9414253 - DNA, 22 bp, Homo sapiens
atggataatcatgaactttgag

SEQ ID NO: 9414254 - DNA, 22 bp, Homo sapiens
atggataagaacaaatatctga

SEQ ID NO: 9414255 - DNA, 22 bp, Homo sapiens
atggataagtcaaagagtatcc

SEQ ID NO: 9414256 - DNA, 22 bp, Homo sapiens
atggataagtcaaagagtatcc

SEQ ID NO: 9414257 - DNA, 22 bp, Homo sapiens
atggataagtcaaagagtatcc

SEQ ID NO: 9414258 - DNA, 22 bp, Homo sapiens
atggataagaacaaatatctga

SEQ ID NO: 9414259 - DNA, 22 bp, Homo sapiens
atggagtggtacttacttggct

SEQ ID NO: 9414260 - DNA, 22 bp, Homo sapiens
atggataacccagttcatttct

SEQ ID NO: 9414261 - DNA, 22 bp, Homo sapiens
atggataaatacttggtggtat

SEQ ID NO: 9414262 - DNA, 22 bp, Homo sapiens
atggagtgtcaccttcctggtt

SEQ ID NO: 9414263 - DNA, 22 bp, Homo sapiens
atggagtggtacttacttggct

SEQ ID NO: 9414264 - DNA, 22 bp, Homo sapiens
atggagttctgccagcgctgct

SEQ ID NO: 9414265 - DNA, 22 bp, Homo sapiens
atggagttctgccagcgctgct

SEQ ID NO: 9414266 - DNA, 22 bp, Homo sapiens
atggagtgggccaattttagtg

SEQ ID NO: 9414267 - DNA, 22 bp, Homo sapiens
atggacagtactgagtggacta

SEQ ID NO: 9414268 - DNA, 22 bp, Homo sapiens
atggaggtgccaggtgtgaggg

SEQ ID NO: 9414269 - DNA, 22 bp, Homo sapiens
atggagtgcctgtggcagtggg

SEQ ID NO: 9414270 - DNA, 20 bp, Homo sapiens
atggaggtggatgtgactgc

SEQ ID NO: 9414271 - DNA, 22 bp, Homo sapiens
atggaggtggaagaatgagtta

SEQ ID NO: 9414272 - DNA, 22 bp, Homo sapiens
atggctggtctcccatggaaaa

SEQ ID NO: 9414273 - DNA, 22 bp, Homo sapiens
atggctggtgatactggagtga

SEQ ID NO: 9414274 - DNA, 22 bp, Homo sapiens
atggctggtctcccatggaaaa

SEQ ID NO: 9414275 - DNA, 22 bp, Homo sapiens
atggctggtctcccatggaaaa

SEQ ID NO: 9414276 - DNA, 21 bp, Homo sapiens
atggctggtggctcagcctcc

SEQ ID NO: 9414277 - DNA, 21 bp, Homo sapiens
atggctggtggctcagcctcc

SEQ ID NO: 9414278 - DNA, 21 bp, Homo sapiens
atggctggtggctcagcctcc

SEQ ID NO: 9414279 - DNA, 22 bp, Homo sapiens
atggctgggcttttagtcagat

SEQ ID NO: 9414280 - DNA, 22 bp, Homo sapiens
atggctgggatttcctttgcgt

SEQ ID NO: 9414281 - DNA, 22 bp, Homo sapiens
atggctgggaggagagtatgat

SEQ ID NO: 9414282 - DNA, 22 bp, Homo sapiens
atggctgggatggggtagagaa

SEQ ID NO: 9414283 - DNA, 22 bp, Homo sapiens
atggctgggatttcctttgcgt

SEQ ID NO: 9414284 - DNA, 22 bp, Homo sapiens
atggcagcatgggattggtaga

SEQ ID NO: 9414285 - DNA, 22 bp, Homo sapiens
atggcagcatgggattggtaga

SEQ ID NO: 9414286 - DNA, 22 bp, Homo sapiens
atggcagcatgggattggtaga

SEQ ID NO: 9414287 - DNA, 22 bp, Homo sapiens
atggcagcatagtggcaagtta

SEQ ID NO: 9414288 - DNA, 22 bp, Homo sapiens
atggcagcagtttggagtcttt

SEQ ID NO: 9414289 - DNA, 22 bp, Homo sapiens
atggcagcagggcttgattatg

SEQ ID NO: 9414290 - DNA, 22 bp, Homo sapiens
atggcagcagtccattgcctca

SEQ ID NO: 9414291 - DNA, 22 bp, Homo sapiens
atggcagcagctttagctgtgg

SEQ ID NO: 9414292 - DNA, 22 bp, Homo sapiens
atggcagcagctttagctgtgg

SEQ ID NO: 9414293 - DNA, 19 bp, Homo sapiens
atggcagcagcagctctcc

SEQ ID NO: 9414294 - DNA, 22 bp, Homo sapiens
atggcagcaaatgtctggctgg

SEQ ID NO: 9414295 - DNA, 22 bp, Homo sapiens
atggcagcccacgatggcaatg

SEQ ID NO: 9414296 - DNA, 22 bp, Homo sapiens
atggcagccagtgttggaggaa

SEQ ID NO: 9414297 - DNA, 22 bp, Homo sapiens
atggcagccagtgttggaggaa

SEQ ID NO: 9414298 - DNA, 22 bp, Homo sapiens
atggcagcctgagcagaggaat

SEQ ID NO: 9414299 - DNA, 22 bp, Homo sapiens
atggctcagcgcctttctgtgg

SEQ ID NO: 9414300 - DNA, 22 bp, Homo sapiens
atggcagcctgaacacttcctg

SEQ ID NO: 9414301 - DNA, 22 bp, Homo sapiens
atggctcagcgcctttctgtgg

SEQ ID NO: 9414302 - DNA, 18 bp, Homo sapiens
atggctcaggaatggctt

SEQ ID NO: 9414303 - DNA, 18 bp, Homo sapiens
atggctcaggaatggctt

SEQ ID NO: 9414304 - DNA, 23 bp, Homo sapiens
atggaaatagcatgtgtcattta

SEQ ID NO: 9414305 - DNA, 23 bp, Homo sapiens
atggaaatagcatgtgtcattta

SEQ ID NO: 9414306 - DNA, 22 bp, Homo sapiens
atggaaatatctttagagctta

SEQ ID NO: 9414307 - DNA, 22 bp, Homo sapiens
atggaaatatctttagagctta

SEQ ID NO: 9414308 - DNA, 22 bp, Homo sapiens
atggaaatatctttagagctta

SEQ ID NO: 9414309 - DNA, 22 bp, Homo sapiens
atggaaatatctttagagctta

SEQ ID NO: 9414310 - DNA, 22 bp, Homo sapiens
atggaaatccaagtcaccgtag

SEQ ID NO: 9414311 - DNA, 22 bp, Homo sapiens
atggaaatcgatgtctaagtta

SEQ ID NO: 9414312 - DNA, 22 bp, Homo sapiens
atggaaatcaggttcatccaag

SEQ ID NO: 9414313 - DNA, 22 bp, Homo sapiens
atggaaatcaggttcatccaag

SEQ ID NO: 9414314 - DNA, 22 bp, Homo sapiens
atggaaatcaggttcatccaag

SEQ ID NO: 9414315 - DNA, 22 bp, Homo sapiens
agacggattacctgaggtcagg

SEQ ID NO: 9414316 - DNA, 22 bp, Homo sapiens
agacgctattttgaggggtcta

SEQ ID NO: 9414317 - DNA, 22 bp, Homo sapiens
agactaagcggttcttttcaat

SEQ ID NO: 9414318 - DNA, 22 bp, Homo sapiens
agactaaaagaaggaagctacc

SEQ ID NO: 9414319 - DNA, 22 bp, Homo sapiens
agactattacctaaaagataca

SEQ ID NO: 9414320 - DNA, 22 bp, Homo sapiens
agactcaagcagataggaatta

SEQ ID NO: 9414321 - DNA, 22 bp, Homo sapiens
agactagagagatataatatgg

SEQ ID NO: 9414322 - DNA, 23 bp, Homo sapiens
agactctgagagtgtgctttgca

SEQ ID NO: 9414323 - DNA, 22 bp, Homo sapiens
agactctgaagtcattgcatga

SEQ ID NO: 9414324 - DNA, 22 bp, Homo sapiens
agactctgaagtcattgcatga

SEQ ID NO: 9414325 - DNA, 22 bp, Homo sapiens
agactccttctcactgcctgta

SEQ ID NO: 9414326 - DNA, 22 bp, Homo sapiens
agactctgaaatctaggtgcaa

SEQ ID NO: 9414327 - DNA, 22 bp, Homo sapiens
agactcctcggaccaatcagcg

SEQ ID NO: 9414328 - DNA, 22 bp, Homo sapiens
agactattttgtgataactaat

SEQ ID NO: 9414329 - DNA, 20 bp, Homo sapiens
atgcttgagatcacaatcct

SEQ ID NO: 9414330 - DNA, 22 bp, Homo sapiens
atgcttggatgctgccatggga

SEQ ID NO: 9414331 - DNA, 22 bp, Homo sapiens
atgcttggatgctgccatggga

SEQ ID NO: 9414332 - DNA, 22 bp, Homo sapiens
atgcagggtctccgtgtgacga

SEQ ID NO: 9414333 - DNA, 23 bp, Homo sapiens
atgcagggttacagggctgactt

SEQ ID NO: 9414334 - DNA, 22 bp, Homo sapiens
atgcaggggcagcagagcctgg

SEQ ID NO: 9414335 - DNA, 22 bp, Homo sapiens
atgcaggggccgcctggccagg

SEQ ID NO: 9414336 - DNA, 22 bp, Homo sapiens
atgcaggggcagcagagcctgg

SEQ ID NO: 9414337 - DNA, 22 bp, Homo sapiens
atgcagggattaaatgactgcc

SEQ ID NO: 9414338 - DNA, 22 bp, Homo sapiens
atgcagggattaaatgactgcc

SEQ ID NO: 9414339 - DNA, 19 bp, Homo sapiens
atggaaaatgccagactga

SEQ ID NO: 9414340 - DNA, 19 bp, Homo sapiens
atggaaaatgccagactga

SEQ ID NO: 9414341 - DNA, 22 bp, Homo sapiens
atggaaagggaagcaaggaaca

SEQ ID NO: 9414342 - DNA, 22 bp, Homo sapiens
atggaaaggctgtggaaactta

SEQ ID NO: 9414343 - DNA, 22 bp, Homo sapiens
atggaaatacacaagaggtttc

SEQ ID NO: 9414344 - DNA, 22 bp, Homo sapiens
atggaaatacacaagaggtttc

SEQ ID NO: 9414345 - DNA, 23 bp, Homo sapiens
atggaaatagcatgtgtcattta

SEQ ID NO: 9414346 - DNA, 22 bp, Homo sapiens
atggaaatacagccagagcaga

SEQ ID NO: 9414347 - DNA, 22 bp, Homo sapiens
atggaaatacagccagagcaga

SEQ ID NO: 9414348 - DNA, 22 bp, Homo sapiens
atggaaatacagccagagcaga

SEQ ID NO: 9414349 - DNA, 22 bp, Homo sapiens
atggtttgtgtggcccagatga

SEQ ID NO: 9414350 - DNA, 20 bp, Homo sapiens
atgtaaaagacagggagtag

SEQ ID NO: 9414351 - DNA, 20 bp, Homo sapiens
atgtaaaagacagggagtag

SEQ ID NO: 9414352 - DNA, 22 bp, Homo sapiens
atggtttcacaaacaaaaggtt

SEQ ID NO: 9414353 - DNA, 22 bp, Homo sapiens
atggtttgtaacccaatactcc

SEQ ID NO: 9414354 - DNA, 22 bp, Homo sapiens
atggtttattgctttaatgaaa

SEQ ID NO: 9414355 - DNA, 22 bp, Homo sapiens
atggtttatcctttaccagtcg

SEQ ID NO: 9414356 - DNA, 22 bp, Homo sapiens
atggtttattagctgcacaggc

SEQ ID NO: 9414357 - DNA, 23 bp, Homo sapiens
atggtttatgttgttgtgaagca

SEQ ID NO: 9414358 - DNA, 23 bp, Homo sapiens
atggtttatgtcacacttttgat

SEQ ID NO: 9414359 - DNA, 22 bp, Homo sapiens
atgggtggccccgtgtgcagtc

SEQ ID NO: 9414360 - DNA, 22 bp, Homo sapiens
atgggtggagggtgacacggat

SEQ ID NO: 9414361 - DNA, 22 bp, Homo sapiens
atgggtggccccgtgtgcagtc

SEQ ID NO: 9414362 - DNA, 22 bp, Homo sapiens
atgtacacatgcatgcatgtgc

SEQ ID NO: 9414363 - DNA, 22 bp, Homo sapiens
atgtacacatgcatgcatgtgc

SEQ ID NO: 9414364 - DNA, 22 bp, Homo sapiens
atgtacacacacatctttgcgt

SEQ ID NO: 9414365 - DNA, 22 bp, Homo sapiens
atgtacacacaagtttgcacgc

SEQ ID NO: 9414366 - DNA, 22 bp, Homo sapiens
atgtacaatttttgcttagggg

SEQ ID NO: 9414367 - DNA, 22 bp, Homo sapiens
atgtacaatttttgcttagggg

SEQ ID NO: 9414368 - DNA, 22 bp, Homo sapiens
atgtaaactttaccagctctga

SEQ ID NO: 9414369 - DNA, 22 bp, Homo sapiens
atgtacaatttttgcttagggg

SEQ ID NO: 9414370 - DNA, 23 bp, Homo sapiens
atgtaaacttcagagtcattgcc

SEQ ID NO: 9414371 - DNA, 23 bp, Homo sapiens
atgtaaacttcagagtcattgcc

SEQ ID NO: 9414372 - DNA, 22 bp, Homo sapiens
atgtaaacttagataagcagta

SEQ ID NO: 9414373 - DNA, 22 bp, Homo sapiens
atgtaaactcacattttcttca

SEQ ID NO: 9414374 - DNA, 22 bp, Homo sapiens
atgtaaactactgactacacta

SEQ ID NO: 9414375 - DNA, 20 bp, Homo sapiens
atgtaaaattataaggctga

SEQ ID NO: 9414376 - DNA, 20 bp, Homo sapiens
atgtaaaattataaggctga

SEQ ID NO: 9414377 - DNA, 20 bp, Homo sapiens
atgtaaaattataaggctga

SEQ ID NO: 9414378 - DNA, 22 bp, Homo sapiens
atgtaaacaaagatcttcctgc

SEQ ID NO: 9414379 - DNA, 22 bp, Homo sapiens
atgtaaacaaggttattgtcca

SEQ ID NO: 9414380 - DNA, 22 bp, Homo sapiens
atgtaaaccgtgcactcccagg

SEQ ID NO: 9414381 - DNA, 22 bp, Homo sapiens
atgtaaacactcactgtgcccc

SEQ ID NO: 9414382 - DNA, 22 bp, Homo sapiens
atgtaaacaaggttattgtcca

SEQ ID NO: 9414383 - DNA, 20 bp, Homo sapiens
atgtaaaagacagggagtag

SEQ ID NO: 9414384 - DNA, 20 bp, Homo sapiens
atgtaaaattataaggctga

SEQ ID NO: 9414385 - DNA, 20 bp, Homo sapiens
atgtaaaattataaggctga

SEQ ID NO: 9414386 - DNA, 22 bp, Homo sapiens
atgtaaaagattattttcctgt

SEQ ID NO: 9414387 - DNA, 22 bp, Homo sapiens
atgtaaaagattattttcctgt

SEQ ID NO: 9414388 - DNA, 22 bp, Homo sapiens
atgggaggcaggctcagaaccg

SEQ ID NO: 9414389 - DNA, 22 bp, Homo sapiens
atgggaggcagcagagcccagc

SEQ ID NO: 9414390 - DNA, 22 bp, Homo sapiens
atgggaggcagcagagcccagc

SEQ ID NO: 9414391 - DNA, 22 bp, Homo sapiens
atgggtggagggtgacacggat

SEQ ID NO: 9414392 - DNA, 22 bp, Homo sapiens
atgggtggagggtgacacggat

SEQ ID NO: 9414393 - DNA, 22 bp, Homo sapiens
atgggaggcagacactaagttc

SEQ ID NO: 9414394 - DNA, 22 bp, Homo sapiens
atgggaggcaaagatcgcagaa

SEQ ID NO: 9414395 - DNA, 22 bp, Homo sapiens
atgggaggcaaagatcgcagaa

SEQ ID NO: 9414396 - DNA, 22 bp, Homo sapiens
atgggaggcaaagatcgcagaa

SEQ ID NO: 9414397 - DNA, 22 bp, Homo sapiens
atgggaggatgctcgggtgctc

SEQ ID NO: 9414398 - DNA, 22 bp, Homo sapiens
atgggaggatgctcgggtgctc

SEQ ID NO: 9414399 - DNA, 22 bp, Homo sapiens
atgggaggatcacttgaggcca

SEQ ID NO: 9414400 - DNA, 22 bp, Homo sapiens
atggctgtgttgttcctctgaa

SEQ ID NO: 9414401 - DNA, 22 bp, Homo sapiens
atgggaggaaggaggcccttga

SEQ ID NO: 9414402 - DNA, 22 bp, Homo sapiens
atgggaggatcacttgaggcca

SEQ ID NO: 9414403 - DNA, 22 bp, Homo sapiens
atgggaggatcacttgaggcca

SEQ ID NO: 9414404 - DNA, 22 bp, Homo sapiens
atggctgtcacgccactgtgag

SEQ ID NO: 9414405 - DNA, 22 bp, Homo sapiens
atggctgtccagtttctagaga

SEQ ID NO: 9414406 - DNA, 22 bp, Homo sapiens
atggctgtagtcatctgaaggc

SEQ ID NO: 9414407 - DNA, 22 bp, Homo sapiens
atggctgtgtgactgagttcta

SEQ ID NO: 9414408 - DNA, 22 bp, Homo sapiens
atggctgtgagcaggcagcttc

SEQ ID NO: 9414409 - DNA, 22 bp, Homo sapiens
atgtacaggatggtgctcatct

SEQ ID NO: 9414410 - DNA, 22 bp, Homo sapiens
atgtacagccacttcacagtta

SEQ ID NO: 9414411 - DNA, 22 bp, Homo sapiens
atgtacactttggaagagtcac

SEQ ID NO: 9414412 - DNA, 22 bp, Homo sapiens
atgtacagtttctagactcaaa

SEQ ID NO: 9414413 - DNA, 22 bp, Homo sapiens
atgtacagtttctagactcaaa

SEQ ID NO: 9414414 - DNA, 22 bp, Homo sapiens
atgtacatactgcattttcaaa

SEQ ID NO: 9414415 - DNA, 22 bp, Homo sapiens
atgtacagtggaaactaacaaa

SEQ ID NO: 9414416 - DNA, 22 bp, Homo sapiens
atgtacagtttctagactcaaa

SEQ ID NO: 9414417 - DNA, 22 bp, Homo sapiens
atgtccagagaacatttgcttt

SEQ ID NO: 9414418 - DNA, 22 bp, Homo sapiens
atgtccagaagggtcccctgtt

SEQ ID NO: 9414419 - DNA, 22 bp, Homo sapiens
atgtcaaatcagttttatcaga

SEQ ID NO: 9414420 - DNA, 22 bp, Homo sapiens
atgtcaaatgctgcaaactcat

SEQ ID NO: 9414421 - DNA, 22 bp, Homo sapiens
atgtccagagtaaagcacattc

SEQ ID NO: 9414422 - DNA, 22 bp, Homo sapiens
atgtccagctcatgatactatc

SEQ ID NO: 9414423 - DNA, 21 bp, Homo sapiens
atgtctgttctgattggtgcg

SEQ ID NO: 9414424 - DNA, 21 bp, Homo sapiens
atgtctgttctttctggcagg

SEQ ID NO: 9414425 - DNA, 22 bp, Homo sapiens
atgtctgtttatccttcaagat

SEQ ID NO: 9414426 - DNA, 19 bp, Homo sapiens
atgtctgttgaatttcata

SEQ ID NO: 9414427 - DNA, 22 bp, Homo sapiens
atgtctgttttcatatcagata

SEQ ID NO: 9414428 - DNA, 22 bp, Homo sapiens
atgtctgtttgctgagcccggc

SEQ ID NO: 9414429 - DNA, 22 bp, Homo sapiens
atgtcttcatagcttatatcca

SEQ ID NO: 9414430 - DNA, 22 bp, Homo sapiens
atgtctgtgttatctgtagaat

SEQ ID NO: 9414431 - DNA, 22 bp, Homo sapiens
atgtctgttaatcgaccctaat

SEQ ID NO: 9414432 - DNA, 22 bp, Homo sapiens
atgtctgttcattattaactgc

SEQ ID NO: 9414433 - DNA, 22 bp, Homo sapiens
atgtctgtggcattatatgttt

SEQ ID NO: 9414434 - DNA, 22 bp, Homo sapiens
atgtctgtgtgatcttggataa

SEQ ID NO: 9414435 - DNA, 18 bp, Homo sapiens
atgtctgtgcactggata

SEQ ID NO: 9414436 - DNA, 22 bp, Homo sapiens
atgtctgtggcaattgttgatg

SEQ ID NO: 9414437 - DNA, 18 bp, Homo sapiens
atgtctgtgcactggata

SEQ ID NO: 9414438 - DNA, 22 bp, Homo sapiens
atgtctgtctatagccatgaga

SEQ ID NO: 9414439 - DNA, 22 bp, Homo sapiens
atgtctgtctttgtactccaca

SEQ ID NO: 9414440 - DNA, 22 bp, Homo sapiens
atgtctgtcatcttccaggaag

SEQ ID NO: 9414441 - DNA, 22 bp, Homo sapiens
atgtctgtatgtggagaggggt

SEQ ID NO: 9414442 - DNA, 22 bp, Homo sapiens
atgtctgtatgtggagaggggt

SEQ ID NO: 9414443 - DNA, 22 bp, Homo sapiens
atgtctgtccaaccctgcaggg

SEQ ID NO: 9414444 - DNA, 22 bp, Homo sapiens
atgtctgtcccctagccctgat

SEQ ID NO: 9414445 - DNA, 22 bp, Homo sapiens
atgtctgtcccctagccctgat

SEQ ID NO: 9414446 - DNA, 22 bp, Homo sapiens
atgtcccaagatacagctagag

SEQ ID NO: 9414447 - DNA, 19 bp, Homo sapiens
atgtcccaccgcccctgag

SEQ ID NO: 9414448 - DNA, 22 bp, Homo sapiens
atgtcccaagatacagctagag

SEQ ID NO: 9414449 - DNA, 22 bp, Homo sapiens
atgtctgtacgagttacaatgg

SEQ ID NO: 9414450 - DNA, 22 bp, Homo sapiens
atgtcccagctgagagacaact

SEQ ID NO: 9414451 - DNA, 19 bp, Homo sapiens
atgtcccaccgcccctgag

SEQ ID NO: 9414452 - DNA, 22 bp, Homo sapiens
atgtccagtacttctaaatggt

SEQ ID NO: 9414453 - DNA, 23 bp, Homo sapiens
atgtccagtttacttcaggatga

SEQ ID NO: 9414454 - DNA, 23 bp, Homo sapiens
atgtccagtttacttcaggatga

SEQ ID NO: 9414455 - DNA, 22 bp, Homo sapiens
agacagtaataaaataggtaag

SEQ ID NO: 9414456 - DNA, 21 bp, Homo sapiens
agacaggtcagggagaggtga

SEQ ID NO: 9414457 - DNA, 22 bp, Homo sapiens
agacaggtgttttacaacttcg

SEQ ID NO: 9414458 - DNA, 22 bp, Homo sapiens
agacaggtgctcgcccaagtcc

SEQ ID NO: 9414459 - DNA, 21 bp, Homo sapiens
agacaggtcagggagaggtga

SEQ ID NO: 9414460 - DNA, 17 bp, Homo sapiens
agacagtgagtgccttg

SEQ ID NO: 9414461 - DNA, 22 bp, Homo sapiens
agacagtgagaatgagttgaaa

SEQ ID NO: 9414462 - DNA, 22 bp, Homo sapiens
agacagtatgatatatgaatac

SEQ ID NO: 9414463 - DNA, 22 bp, Homo sapiens
agacagtgatggacaggcagac

SEQ ID NO: 9414464 - DNA, 22 bp, Homo sapiens
atgcaggctcatgaatctgttt

SEQ ID NO: 9414465 - DNA, 22 bp, Homo sapiens
atgcaggcagacactgtgggca

SEQ ID NO: 9414466 - DNA, 22 bp, Homo sapiens
atgcaggatgtcaacgcatcct

SEQ ID NO: 9414467 - DNA, 22 bp, Homo sapiens
atgcagggaggtaagaggtgcc

SEQ ID NO: 9414468 - DNA, 22 bp, Homo sapiens
atgcagggacctttgctttggt

SEQ ID NO: 9414469 - DNA, 22 bp, Homo sapiens
agacagtgcaagaagagcaggc

SEQ ID NO: 9414470 - DNA, 22 bp, Homo sapiens
agacagtgcaagaagagcaggc

SEQ ID NO: 9414471 - DNA, 22 bp, Homo sapiens
agacagtgatgtaagcaggagt

SEQ ID NO: 9414472 - DNA, 22 bp, Homo sapiens
agacagtgcaagaagagcaggc

SEQ ID NO: 9414473 - DNA, 22 bp, Homo sapiens
agacacagtttgggatgggttg

SEQ ID NO: 9414474 - DNA, 22 bp, Homo sapiens
agacacagtttgggatgggttg

SEQ ID NO: 9414475 - DNA, 22 bp, Homo sapiens
agacacagtgttgaaggctagt

SEQ ID NO: 9414476 - DNA, 22 bp, Homo sapiens
agacacagtgctgggtgctgag

SEQ ID NO: 9414477 - DNA, 22 bp, Homo sapiens
agacacagtgttgaaggctagt

SEQ ID NO: 9414478 - DNA, 22 bp, Homo sapiens
agacacagtgctgggtgctgag

SEQ ID NO: 9414479 - DNA, 22 bp, Homo sapiens
agacacagtgctgggtgctgag

SEQ ID NO: 9414480 - DNA, 22 bp, Homo sapiens
agacaggcagggcatggaaaaa

SEQ ID NO: 9414481 - DNA, 22 bp, Homo sapiens
agacacataggaccacactgtg

SEQ ID NO: 9414482 - DNA, 22 bp, Homo sapiens
agacacagtttgggatgggttg

SEQ ID NO: 9414483 - DNA, 22 bp, Homo sapiens
agacacagctgcaggaggtggg

SEQ ID NO: 9414484 - DNA, 22 bp, Homo sapiens
agacacagctgcaggaggtggg

SEQ ID NO: 9414485 - DNA, 22 bp, Homo sapiens
agacacagctaccataatacca

SEQ ID NO: 9414486 - DNA, 22 bp, Homo sapiens
agacacagctaccataatacca

SEQ ID NO: 9414487 - DNA, 22 bp, Homo sapiens
agacacagctaccataatacca

SEQ ID NO: 9414488 - DNA, 22 bp, Homo sapiens
agacacagctgcaggaggtggg

SEQ ID NO: 9414489 - DNA, 22 bp, Homo sapiens
agacacaggattctgcatttct

SEQ ID NO: 9414490 - DNA, 22 bp, Homo sapiens
agacacagtctgtctggaggag

SEQ ID NO: 9414491 - DNA, 22 bp, Homo sapiens
agacacagtctgtctggaggag

SEQ ID NO: 9414492 - DNA, 22 bp, Homo sapiens
agacacagtataagcacaacaa

SEQ ID NO: 9414493 - DNA, 22 bp, Homo sapiens
agacacagtataagcacaacaa

SEQ ID NO: 9414494 - DNA, 22 bp, Homo sapiens
agacacagtacttgccctcatg

SEQ ID NO: 9414495 - DNA, 22 bp, Homo sapiens
agacacaggtgtaatttctgct

SEQ ID NO: 9414496 - DNA, 22 bp, Homo sapiens
agaatgcattttgtgtagctat

SEQ ID NO: 9414497 - DNA, 22 bp, Homo sapiens
agaatgcattttgtgtagctat

SEQ ID NO: 9414498 - DNA, 22 bp, Homo sapiens
agaatgctcttcaaaatctagc

SEQ ID NO: 9414499 - DNA, 22 bp, Homo sapiens
agaatgctcttcaaaatctagc

SEQ ID NO: 9414500 - DNA, 22 bp, Homo sapiens
agaatgctccagagctgaaaga

SEQ ID NO: 9414501 - DNA, 22 bp, Homo sapiens
agaatgctccagagctgaaaga

SEQ ID NO: 9414502 - DNA, 22 bp, Homo sapiens
agaatgggggctacaggccaca

SEQ ID NO: 9414503 - DNA, 22 bp, Homo sapiens
agaatgtagtcttggagattta

SEQ ID NO: 9414504 - DNA, 22 bp, Homo sapiens
agaatgtaagaatgcaaagatt

SEQ ID NO: 9414505 - DNA, 22 bp, Homo sapiens
agaatgttgatagcacctattt

SEQ ID NO: 9414506 - DNA, 22 bp, Homo sapiens
agaatgtgttattagagaagga

SEQ ID NO: 9414507 - DNA, 22 bp, Homo sapiens
agaatgtgaagattttgaatta

SEQ ID NO: 9414508 - DNA, 22 bp, Homo sapiens
agaatgcagtttgaaataaggt

SEQ ID NO: 9414509 - DNA, 22 bp, Homo sapiens
agaatgcagtttgaaataaggt

SEQ ID NO: 9414510 - DNA, 22 bp, Homo sapiens
agaatgcagtttgaaataaggt

SEQ ID NO: 9414511 - DNA, 22 bp, Homo sapiens
agaatgcatctaaaagcagaga

SEQ ID NO: 9414512 - DNA, 22 bp, Homo sapiens
agaatgcatctaaaagcagaga

SEQ ID NO: 9414513 - DNA, 17 bp, Homo sapiens
agaatgcaaagcaggct

SEQ ID NO: 9414514 - DNA, 22 bp, Homo sapiens
agaatgattttggacaatatgg

SEQ ID NO: 9414515 - DNA, 17 bp, Homo sapiens
agaatgcaaagcaggct

SEQ ID NO: 9414516 - DNA, 17 bp, Homo sapiens
agaatgcaaagcaggct

SEQ ID NO: 9414517 - DNA, 22 bp, Homo sapiens
agaatcaggaagacagcctggc

SEQ ID NO: 9414518 - DNA, 20 bp, Homo sapiens
agaatcagagtggaaaggaa

SEQ ID NO: 9414519 - DNA, 22 bp, Homo sapiens
agaatgatagctagtatttact

SEQ ID NO: 9414520 - DNA, 22 bp, Homo sapiens
agaatgaattaatcaactggaa

SEQ ID NO: 9414521 - DNA, 22 bp, Homo sapiens
agaatgaagatgacttcggaga

SEQ ID NO: 9414522 - DNA, 22 bp, Homo sapiens
agaattcataggaagtttccta

SEQ ID NO: 9414523 - DNA, 22 bp, Homo sapiens
agaattcagaatgcatttctaa

SEQ ID NO: 9414524 - DNA, 18 bp, Homo sapiens
agaattattcttgtcctc

SEQ ID NO: 9414525 - DNA, 22 bp, Homo sapiens
agaattaggtaagttcatctga

SEQ ID NO: 9414526 - DNA, 22 bp, Homo sapiens
agaattagctgggcagattcct

SEQ ID NO: 9414527 - DNA, 22 bp, Homo sapiens
agaattacataaatacatgaat

SEQ ID NO: 9414528 - DNA, 21 bp, Homo sapiens
agaattaaattggatttgtgt

SEQ ID NO: 9414529 - DNA, 22 bp, Homo sapiens
agacaatacatttattcccttt

SEQ ID NO: 9414530 - DNA, 22 bp, Homo sapiens
agacaatacatttattcccttt

SEQ ID NO: 9414531 - DNA, 22 bp, Homo sapiens
agaattctggagttgggaggaa

SEQ ID NO: 9414532 - DNA, 22 bp, Homo sapiens
agaattctgttcttcgggtgtg

SEQ ID NO: 9414533 - DNA, 22 bp, Homo sapiens
agaattctccttcagggcagga

SEQ ID NO: 9414534 - DNA, 22 bp, Homo sapiens
agaattctcttccattgaaaca

SEQ ID NO: 9414535 - DNA, 22 bp, Homo sapiens
agaattctgacaatagaattgg

SEQ ID NO: 9414536 - DNA, 22 bp, Homo sapiens
agacacagaagttgctgttggg

SEQ ID NO: 9414537 - DNA, 22 bp, Homo sapiens
agacacagaagttgctgttggg

SEQ ID NO: 9414538 - DNA, 22 bp, Homo sapiens
agacacagattttggaaaagat

SEQ ID NO: 9414539 - DNA, 22 bp, Homo sapiens
agacacagatggtacctgagcc

SEQ ID NO: 9414540 - DNA, 22 bp, Homo sapiens
agacacagcaataactactgtt

SEQ ID NO: 9414541 - DNA, 22 bp, Homo sapiens
agacacagcaataactactgtt

SEQ ID NO: 9414542 - DNA, 22 bp, Homo sapiens
agacacagcaataactactgtt

SEQ ID NO: 9414543 - DNA, 19 bp, Homo sapiens
agacacacttacgtggaat

SEQ ID NO: 9414544 - DNA, 22 bp, Homo sapiens
agacacagaacacaaaagcata

SEQ ID NO: 9414545 - DNA, 22 bp, Homo sapiens
agacaatttcaaagtaatatta

SEQ ID NO: 9414546 - DNA, 22 bp, Homo sapiens
agacaatttttggttttgcaag

SEQ ID NO: 9414547 - DNA, 22 bp, Homo sapiens
agacaatttttggttttgcaag

SEQ ID NO: 9414548 - DNA, 22 bp, Homo sapiens
agacaatttcaaagtaatatta

SEQ ID NO: 9414549 - DNA, 22 bp, Homo sapiens
agacaatatataattttagttg

SEQ ID NO: 9414550 - DNA, 22 bp, Homo sapiens
agacaatttcaaagtaatatta

SEQ ID NO: 9414551 - DNA, 22 bp, Homo sapiens
agaaggccagatggacggggct

SEQ ID NO: 9414552 - DNA, 22 bp, Homo sapiens
agaaggcctaacttgggggcaa

SEQ ID NO: 9414553 - DNA, 22 bp, Homo sapiens
agaaggctaaagaaacagattg

SEQ ID NO: 9414554 - DNA, 22 bp, Homo sapiens
agaaggctcactaagagtgact

SEQ ID NO: 9414555 - DNA, 22 bp, Homo sapiens
atctttatatatctcctctgaa

SEQ ID NO: 9414556 - DNA, 22 bp, Homo sapiens
atctttagtgtgaatttattga

SEQ ID NO: 9414557 - DNA, 22 bp, Homo sapiens
agaaggcatcagaagtgtgtag

SEQ ID NO: 9414558 - DNA, 21 bp, Homo sapiens
atctttattacgcagagaaga

SEQ ID NO: 9414559 - DNA, 22 bp, Homo sapiens
agaaggccaatagggtgcactg

SEQ ID NO: 9414560 - DNA, 22 bp, Homo sapiens
agaaggccagatggacggggct

SEQ ID NO: 9414561 - DNA, 20 bp, Homo sapiens
agaaggcattcctcattctt

SEQ ID NO: 9414562 - DNA, 22 bp, Homo sapiens
agaaggccaagaagaagcctat

SEQ ID NO: 9414563 - DNA, 22 bp, Homo sapiens
agaagtttggtccttttcaagg

SEQ ID NO: 9414564 - DNA, 22 bp, Homo sapiens
agaaggctggccatggtgccct

SEQ ID NO: 9414565 - DNA, 22 bp, Homo sapiens
agaagtttggtccttttcaagg

SEQ ID NO: 9414566 - DNA, 22 bp, Homo sapiens
agaagtttggtccttttcaagg

SEQ ID NO: 9414567 - DNA, 22 bp, Homo sapiens
agaaggctgagactgggatgaa

SEQ ID NO: 9414568 - DNA, 22 bp, Homo sapiens
agaaggctggccatggtgccct

SEQ ID NO: 9414569 - DNA, 22 bp, Homo sapiens
agaaggctcatttgactgcatt

SEQ ID NO: 9414570 - DNA, 19 bp, Homo sapiens
agaaggctcctgttggaga

SEQ ID NO: 9414571 - DNA, 22 bp, Homo sapiens
agaaggctgaagaagatccgtt

SEQ ID NO: 9414572 - DNA, 20 bp, Homo sapiens
agaaggctccttttgccaag

SEQ ID NO: 9414573 - DNA, 19 bp, Homo sapiens
agaaggctcctgttggaga

SEQ ID NO: 9414574 - DNA, 22 bp, Homo sapiens
agaagtttggtccttttcaagg

SEQ ID NO: 9414575 - DNA, 22 bp, Homo sapiens
agaagtttgttatgtaaacaaa

SEQ ID NO: 9414576 - DNA, 22 bp, Homo sapiens
agaatacaattgttcagtaata

SEQ ID NO: 9414577 - DNA, 22 bp, Homo sapiens
agaatacagtatgcaaaaagat

SEQ ID NO: 9414578 - DNA, 22 bp, Homo sapiens
agaatacaattgttcagtaata

SEQ ID NO: 9414579 - DNA, 22 bp, Homo sapiens
agaatcaattcactgctgcagc

SEQ ID NO: 9414580 - DNA, 22 bp, Homo sapiens
agaatcagatgaagactcctgc

SEQ ID NO: 9414581 - DNA, 22 bp, Homo sapiens
atctttggtgcttggtgctccc

SEQ ID NO: 9414582 - DNA, 22 bp, Homo sapiens
atctttggtgcttggtgctccc

SEQ ID NO: 9414583 - DNA, 19 bp, Homo sapiens
atctttgggtcctgaaggg

SEQ ID NO: 9414584 - DNA, 19 bp, Homo sapiens
atctttgggtcctgaaggg

SEQ ID NO: 9414585 - DNA, 22 bp, Homo sapiens
atctttgggtacaaacttgcct

SEQ ID NO: 9414586 - DNA, 22 bp, Homo sapiens
atctttggggcatccaggaaaa

SEQ ID NO: 9414587 - DNA, 22 bp, Homo sapiens
atctttggtactattcttatca

SEQ ID NO: 9414588 - DNA, 22 bp, Homo sapiens
atctttggtactattcttatca

SEQ ID NO: 9414589 - DNA, 22 bp, Homo sapiens
atctttggtcttgagtgcatct

SEQ ID NO: 9414590 - DNA, 22 bp, Homo sapiens
atctttggtgcatgatactttg

SEQ ID NO: 9414591 - DNA, 22 bp, Homo sapiens
agaatataaagataattctgtt

SEQ ID NO: 9414592 - DNA, 22 bp, Homo sapiens
agaatagagaaaaaggttattt

SEQ ID NO: 9414593 - DNA, 22 bp, Homo sapiens
agaataccataatatagaaaga

SEQ ID NO: 9414594 - DNA, 22 bp, Homo sapiens
agaatacccatcccttcaactc

SEQ ID NO: 9414595 - DNA, 22 bp, Homo sapiens
agaatagaattctcatagaatt

SEQ ID NO: 9414596 - DNA, 22 bp, Homo sapiens
agaatacagtatgcaaaaagat

SEQ ID NO: 9414597 - DNA, 22 bp, Homo sapiens
agaatacagtatgcaaaaagat

SEQ ID NO: 9414598 - DNA, 22 bp, Homo sapiens
agaatacagtatgcaaaaagat

SEQ ID NO: 9414599 - DNA, 22 bp, Homo sapiens
agaatacagtatgcaaaaagat

SEQ ID NO: 9414600 - DNA, 22 bp, Homo sapiens
agaatacagtatgcaaaaagat

SEQ ID NO: 9414601 - DNA, 22 bp, Homo sapiens
agaatacatcaatctattttct

SEQ ID NO: 9414602 - DNA, 22 bp, Homo sapiens
agaatacatcaatctattttct

SEQ ID NO: 9414603 - DNA, 22 bp, Homo sapiens
agaatacatctagtgctgcatg

SEQ ID NO: 9414604 - DNA, 22 bp, Homo sapiens
agaataccataatatagaaaga

SEQ ID NO: 9414605 - DNA, 22 bp, Homo sapiens
agaagaggggtgtccctgtggc

SEQ ID NO: 9414606 - DNA, 22 bp, Homo sapiens
agaagaggggtgtccctgtggc

SEQ ID NO: 9414607 - DNA, 20 bp, Homo sapiens
agaagaggatacaaccaggc

SEQ ID NO: 9414608 - DNA, 20 bp, Homo sapiens
agaagaggatacaaccaggc

SEQ ID NO: 9414609 - DNA, 22 bp, Homo sapiens
agaagattattagagactttgt

SEQ ID NO: 9414610 - DNA, 22 bp, Homo sapiens
agaagattatgaattagagcag

SEQ ID NO: 9414611 - DNA, 22 bp, Homo sapiens
agaagatgactttggagttgga

SEQ ID NO: 9414612 - DNA, 22 bp, Homo sapiens
agaagatgtcactgcagacagc

SEQ ID NO: 9414613 - DNA, 22 bp, Homo sapiens
agaagagcctggggaccatggc

SEQ ID NO: 9414614 - DNA, 22 bp, Homo sapiens
agaagagccctttaagggggaa

SEQ ID NO: 9414615 - DNA, 22 bp, Homo sapiens
agaagagccctttaagggggaa

SEQ ID NO: 9414616 - DNA, 20 bp, Homo sapiens
agaagaggatacaaccaggc

SEQ ID NO: 9414617 - DNA, 20 bp, Homo sapiens
agaagaggatacaaccaggc

SEQ ID NO: 9414618 - DNA, 21 bp, Homo sapiens
agaagagaagcaggaccctct

SEQ ID NO: 9414619 - DNA, 22 bp, Homo sapiens
agaagagaactgccaaacactt

SEQ ID NO: 9414620 - DNA, 21 bp, Homo sapiens
agaagagaagcaggaccctct

SEQ ID NO: 9414621 - DNA, 21 bp, Homo sapiens
agaagagaagcaggaccctct

SEQ ID NO: 9414622 - DNA, 22 bp, Homo sapiens
agaagagagtcctaccccatac

SEQ ID NO: 9414623 - DNA, 22 bp, Homo sapiens
agaagagagtcctaccccatac

SEQ ID NO: 9414624 - DNA, 22 bp, Homo sapiens
agaagagaactgccaaacactt

SEQ ID NO: 9414625 - DNA, 22 bp, Homo sapiens
agaagagaactgccaaacactt

SEQ ID NO: 9414626 - DNA, 22 bp, Homo sapiens
agaagagaactgccaaacactt

SEQ ID NO: 9414627 - DNA, 22 bp, Homo sapiens
agaagagaaatagtgccactgt

SEQ ID NO: 9414628 - DNA, 22 bp, Homo sapiens
agaagagaactgccaaacactt

SEQ ID NO: 9414629 - DNA, 22 bp, Homo sapiens
agaagagaaatagtgccactgt

SEQ ID NO: 9414630 - DNA, 22 bp, Homo sapiens
agaagaatttctctcatgattt

SEQ ID NO: 9414631 - DNA, 22 bp, Homo sapiens
agaagaatttctctcatgattt

SEQ ID NO: 9414632 - DNA, 22 bp, Homo sapiens
agaagagaaatagtgccactgt

SEQ ID NO: 9414633 - DNA, 22 bp, Homo sapiens
agaagagaaatagtgccactgt

SEQ ID NO: 9414634 - DNA, 22 bp, Homo sapiens
agaagaaatgtgaaggccactg

SEQ ID NO: 9414635 - DNA, 22 bp, Homo sapiens
agaagaaatgtgaaggccactg

SEQ ID NO: 9414636 - DNA, 22 bp, Homo sapiens
agaagaaatgtgaaggccactg

SEQ ID NO: 9414637 - DNA, 22 bp, Homo sapiens
agaagaaatgtgaaggccactg

SEQ ID NO: 9414638 - DNA, 22 bp, Homo sapiens
agaagaatacttgatgttcatg

SEQ ID NO: 9414639 - DNA, 22 bp, Homo sapiens
agaagaatacttgatgttcatg

SEQ ID NO: 9414640 - DNA, 22 bp, Homo sapiens
atcttgttctcccttgttctta

SEQ ID NO: 9414641 - DNA, 22 bp, Homo sapiens
atctttaaagacatgtgaactt

SEQ ID NO: 9414642 - DNA, 18 bp, Homo sapiens
atcttgtttttggattaa

SEQ ID NO: 9414643 - DNA, 22 bp, Homo sapiens
atctttaaagacatgtgaactt

SEQ ID NO: 9414644 - DNA, 22 bp, Homo sapiens
atctttaatttggatcagggcc

SEQ ID NO: 9414645 - DNA, 22 bp, Homo sapiens
atctttaatttggatcagggcc

SEQ ID NO: 9414646 - DNA, 22 bp, Homo sapiens
atctttagcattactttattca

SEQ ID NO: 9414647 - DNA, 19 bp, Homo sapiens
atctttagggatgtggctt

SEQ ID NO: 9414648 - DNA, 22 bp, Homo sapiens
atctttaggcaagttacttaac

SEQ ID NO: 9414649 - DNA, 22 bp, Homo sapiens
atctttaccaccaaagaatgct

SEQ ID NO: 9414650 - DNA, 22 bp, Homo sapiens
atctttagagtcatctgagtgt

SEQ ID NO: 9414651 - DNA, 22 bp, Homo sapiens
atctttagcattactttattca

SEQ ID NO: 9414652 - DNA, 19 bp, Homo sapiens
atctttagcaactttcaaa

SEQ ID NO: 9414653 - DNA, 22 bp, Homo sapiens
agaagatttaggttgacgctat

SEQ ID NO: 9414654 - DNA, 22 bp, Homo sapiens
agaagcaaggtctgtcagtata

SEQ ID NO: 9414655 - DNA, 23 bp, Homo sapiens
agaagcaatgctttttttcctct

SEQ ID NO: 9414656 - DNA, 22 bp, Homo sapiens
agaagcaaggtctgtcagtata

SEQ ID NO: 9414657 - DNA, 23 bp, Homo sapiens
agaagcaatgctttttttcctct

SEQ ID NO: 9414658 - DNA, 20 bp, Homo sapiens
atcttgggattgagattgcc

SEQ ID NO: 9414659 - DNA, 22 bp, Homo sapiens
atcttattgctgttgccagata

SEQ ID NO: 9414660 - DNA, 22 bp, Homo sapiens
atcttattgctgttgccagata

SEQ ID NO: 9414661 - DNA, 22 bp, Homo sapiens
atcttatgagacccataaagat

SEQ ID NO: 9414662 - DNA, 22 bp, Homo sapiens
atcttatgttgtattcaaaatc

SEQ ID NO: 9414663 - DNA, 22 bp, Homo sapiens
atcttggggatagcctaactca

SEQ ID NO: 9414664 - DNA, 22 bp, Homo sapiens
atcttggggactgtctcttgta

SEQ ID NO: 9414665 - DNA, 22 bp, Homo sapiens
atcttgggcccctgtaagatgg

SEQ ID NO: 9414666 - DNA, 22 bp, Homo sapiens
atcttgggccacaatgagccga

SEQ ID NO: 9414667 - DNA, 22 bp, Homo sapiens
atcttggggaatcctctgtgta

SEQ ID NO: 9414668 - DNA, 22 bp, Homo sapiens
agagtggggaaggtgttgagaa

SEQ ID NO: 9414669 - DNA, 22 bp, Homo sapiens
agagtggggaaggtgttgagaa

SEQ ID NO: 9414670 - DNA, 22 bp, Homo sapiens
agagtggggaaggtgttgagaa

SEQ ID NO: 9414671 - DNA, 22 bp, Homo sapiens
agagtgggcctctgagtcccag

SEQ ID NO: 9414672 - DNA, 22 bp, Homo sapiens
agagtgggcctctgagtcccag

SEQ ID NO: 9414673 - DNA, 22 bp, Homo sapiens
agagtgggcaggagcctcgact

SEQ ID NO: 9414674 - DNA, 22 bp, Homo sapiens
agagtgggcctctgagtcccag

SEQ ID NO: 9414675 - DNA, 22 bp, Homo sapiens
agagtgggcaggagcctcgact

SEQ ID NO: 9414676 - DNA, 22 bp, Homo sapiens
agagtgggcaggagcctcgact

SEQ ID NO: 9414677 - DNA, 22 bp, Homo sapiens
agagtgggacacgggcgctgtc

SEQ ID NO: 9414678 - DNA, 22 bp, Homo sapiens
agagtgggacacgggcgctgtc

SEQ ID NO: 9414679 - DNA, 22 bp, Homo sapiens
agagtggcttctttgacatgct

SEQ ID NO: 9414680 - DNA, 22 bp, Homo sapiens
agagtgggacacgggcgctgtc

SEQ ID NO: 9414681 - DNA, 23 bp, Homo sapiens
atttacaggttaaatgaaatcag

SEQ ID NO: 9414682 - DNA, 23 bp, Homo sapiens
atttacaggttaaatgaaatcag

SEQ ID NO: 9414683 - DNA, 22 bp, Homo sapiens
agagtggggacagggcctgtcc

SEQ ID NO: 9414684 - DNA, 22 bp, Homo sapiens
atttagaagttggagggcaaga

SEQ ID NO: 9414685 - DNA, 22 bp, Homo sapiens
atttagacttcccagcactgtg

SEQ ID NO: 9414686 - DNA, 22 bp, Homo sapiens
atttagcaagagtacaaaataa

SEQ ID NO: 9414687 - DNA, 22 bp, Homo sapiens
atttagcaagagtacaaaataa

SEQ ID NO: 9414688 - DNA, 22 bp, Homo sapiens
atttagcaaaaaatgatgaagc

SEQ ID NO: 9414689 - DNA, 22 bp, Homo sapiens
atttagcaaaaaatgatgaagc

SEQ ID NO: 9414690 - DNA, 22 bp, Homo sapiens
atttagagtgaaacattatgca

SEQ ID NO: 9414691 - DNA, 22 bp, Homo sapiens
atttagagaataagacataaat

SEQ ID NO: 9414692 - DNA, 22 bp, Homo sapiens
atttagagtgttcactctgagc

SEQ ID NO: 9414693 - DNA, 17 bp, Homo sapiens
atttagcaagtagacag

SEQ ID NO: 9414694 - DNA, 22 bp, Homo sapiens
atttagcttacctcgttactga

SEQ ID NO: 9414695 - DNA, 22 bp, Homo sapiens
atttagtagagaaattaagaaa

SEQ ID NO: 9414696 - DNA, 22 bp, Homo sapiens
atttagtagagaaattaagaaa

SEQ ID NO: 9414697 - DNA, 22 bp, Homo sapiens
atttattatgggatttggctca

SEQ ID NO: 9414698 - DNA, 22 bp, Homo sapiens
atttagtggctgtaatcacctt

SEQ ID NO: 9414699 - DNA, 22 bp, Homo sapiens
atttagtgaccagcactagaaa

SEQ ID NO: 9414700 - DNA, 22 bp, Homo sapiens
atttagtgaccagcactagaaa

SEQ ID NO: 9414701 - DNA, 22 bp, Homo sapiens
atttagtgtatcaatgtgatat

SEQ ID NO: 9414702 - DNA, 22 bp, Homo sapiens
atttattgaacactgactatgt

SEQ ID NO: 9414703 - DNA, 22 bp, Homo sapiens
atttattgaacactgactatgt

SEQ ID NO: 9414704 - DNA, 22 bp, Homo sapiens
atttattgaacactgactatgt

SEQ ID NO: 9414705 - DNA, 22 bp, Homo sapiens
atttattgaacactgactatgt

SEQ ID NO: 9414706 - DNA, 22 bp, Homo sapiens
atttattctccagatggcgaga

SEQ ID NO: 9414707 - DNA, 22 bp, Homo sapiens
atttattcctttatggctggag

SEQ ID NO: 9414708 - DNA, 22 bp, Homo sapiens
atttattattgtggttacttct

SEQ ID NO: 9414709 - DNA, 22 bp, Homo sapiens
atttattcctgattcctggctt

SEQ ID NO: 9414710 - DNA, 19 bp, Homo sapiens
attcttctcaaatatccat

SEQ ID NO: 9414711 - DNA, 22 bp, Homo sapiens
attcttctcccttagggcccag

SEQ ID NO: 9414712 - DNA, 22 bp, Homo sapiens
attcttctctgggttgggttca

SEQ ID NO: 9414713 - DNA, 19 bp, Homo sapiens
attcttctcaaatatccat

SEQ ID NO: 9414714 - DNA, 22 bp, Homo sapiens
attcttctaatatgatcgtgtt

SEQ ID NO: 9414715 - DNA, 22 bp, Homo sapiens
attcttcattgttgattcatgt

SEQ ID NO: 9414716 - DNA, 22 bp, Homo sapiens
attcttcatacctactgaggtt

SEQ ID NO: 9414717 - DNA, 22 bp, Homo sapiens
attcttcatcagagatgcacta

SEQ ID NO: 9414718 - DNA, 22 bp, Homo sapiens
attcttcatggctgtgagtcct

SEQ ID NO: 9414719 - DNA, 22 bp, Homo sapiens
agagggtggtgaggcctggttc

SEQ ID NO: 9414720 - DNA, 22 bp, Homo sapiens
agaggtaagcagtggcaagtgc

SEQ ID NO: 9414721 - DNA, 22 bp, Homo sapiens
agaggtaattatagcctggccg

SEQ ID NO: 9414722 - DNA, 22 bp, Homo sapiens
agagggtggtgaggcctggttc

SEQ ID NO: 9414723 - DNA, 22 bp, Homo sapiens
agagggtgggcacgtgatggat

SEQ ID NO: 9414724 - DNA, 22 bp, Homo sapiens
agaggtatatattctccatatt

SEQ ID NO: 9414725 - DNA, 22 bp, Homo sapiens
agaggtagaggttgcagtgagc

SEQ ID NO: 9414726 - DNA, 22 bp, Homo sapiens
atttaacaagacagagaactgg

SEQ ID NO: 9414727 - DNA, 22 bp, Homo sapiens
atttaacaagacagagaactgg

SEQ ID NO: 9414728 - DNA, 22 bp, Homo sapiens
atttaagactgacttcaccagt

SEQ ID NO: 9414729 - DNA, 22 bp, Homo sapiens
atttaagattgcgtattcatgt

SEQ ID NO: 9414730 - DNA, 22 bp, Homo sapiens
atttaagattgcgtattcatgt

SEQ ID NO: 9414731 - DNA, 22 bp, Homo sapiens
atttaagaggctgctagagtat

SEQ ID NO: 9414732 - DNA, 22 bp, Homo sapiens
atttaagaggctgctagagtat

SEQ ID NO: 9414733 - DNA, 22 bp, Homo sapiens
attgttaataactattacattg

SEQ ID NO: 9414734 - DNA, 18 bp, Homo sapiens
attgttaatagagtactt

SEQ ID NO: 9414735 - DNA, 22 bp, Homo sapiens
attgttaataactattacattg

SEQ ID NO: 9414736 - DNA, 22 bp, Homo sapiens
attgttaataactattacattg

SEQ ID NO: 9414737 - DNA, 19 bp, Homo sapiens
attcttctcttcctgctgt

SEQ ID NO: 9414738 - DNA, 22 bp, Homo sapiens
atttaaattttctgatggagag

SEQ ID NO: 9414739 - DNA, 22 bp, Homo sapiens
atttaaattttctgatggagag

SEQ ID NO: 9414740 - DNA, 22 bp, Homo sapiens
atttaaattttctgatggagag

SEQ ID NO: 9414741 - DNA, 22 bp, Homo sapiens
atttaaattttctgatggagag

SEQ ID NO: 9414742 - DNA, 22 bp, Homo sapiens
atttaagggatttggagaccaa

SEQ ID NO: 9414743 - DNA, 22 bp, Homo sapiens
atttaagggatttggagaccaa

SEQ ID NO: 9414744 - DNA, 18 bp, Homo sapiens
atttaatgaactgaaagc

SEQ ID NO: 9414745 - DNA, 18 bp, Homo sapiens
atttaatgaactgaaagc

SEQ ID NO: 9414746 - DNA, 18 bp, Homo sapiens
atttaatgaactgaaagc

SEQ ID NO: 9414747 - DNA, 18 bp, Homo sapiens
atttaatgaactgaaagc

SEQ ID NO: 9414748 - DNA, 23 bp, Homo sapiens
atttaatgctgagttgaatgtta

SEQ ID NO: 9414749 - DNA, 22 bp, Homo sapiens
atttaatgggtagacattgtta

SEQ ID NO: 9414750 - DNA, 23 bp, Homo sapiens
atttaatgctgagttgaatgtta

SEQ ID NO: 9414751 - DNA, 23 bp, Homo sapiens
atttaatgctgagttgaatgtta

SEQ ID NO: 9414752 - DNA, 22 bp, Homo sapiens
atttaatgggtagacattgtta

SEQ ID NO: 9414753 - DNA, 22 bp, Homo sapiens
agcaaacattcagcagattggc

SEQ ID NO: 9414754 - DNA, 22 bp, Homo sapiens
agcaaacagtgtgctaagaaat

SEQ ID NO: 9414755 - DNA, 22 bp, Homo sapiens
agcaaacagtgtgctaagaaat

SEQ ID NO: 9414756 - DNA, 22 bp, Homo sapiens
agcaaacagtgtgctaagaaat

SEQ ID NO: 9414757 - DNA, 22 bp, Homo sapiens
agcaaacagtgtgctaagaaat

SEQ ID NO: 9414758 - DNA, 22 bp, Homo sapiens
agcaaacacaagaggtaatttc

SEQ ID NO: 9414759 - DNA, 20 bp, Homo sapiens
agcaaaatgcaagattttca

SEQ ID NO: 9414760 - DNA, 22 bp, Homo sapiens
agcaaacagatgtctcctttag

SEQ ID NO: 9414761 - DNA, 22 bp, Homo sapiens
agcaaaataaggtaatttattg

SEQ ID NO: 9414762 - DNA, 22 bp, Homo sapiens
agcaaaataaggtaatttattg

SEQ ID NO: 9414763 - DNA, 22 bp, Homo sapiens
atttgctttcaggtataaaagg

SEQ ID NO: 9414764 - DNA, 22 bp, Homo sapiens
agatttcaatgtgagcattagt

SEQ ID NO: 9414765 - DNA, 22 bp, Homo sapiens
atttgctttcaggtataaaagg

SEQ ID NO: 9414766 - DNA, 22 bp, Homo sapiens
atttgcttgttcaccagtactt

SEQ ID NO: 9414767 - DNA, 22 bp, Homo sapiens
atttgctttaaggtataaaagg

SEQ ID NO: 9414768 - DNA, 22 bp, Homo sapiens
atttgctttaaggtataaaagg

SEQ ID NO: 9414769 - DNA, 17 bp, Homo sapiens
agcaaaagtatcaaagc

SEQ ID NO: 9414770 - DNA, 17 bp, Homo sapiens
agcaaaagtatcaaagc

SEQ ID NO: 9414771 - DNA, 17 bp, Homo sapiens
agcaaaagtatcaaagc

SEQ ID NO: 9414772 - DNA, 17 bp, Homo sapiens
agcaaaagtatcaaagc

SEQ ID NO: 9414773 - DNA, 17 bp, Homo sapiens
agcaaaagtatcaaagc

SEQ ID NO: 9414774 - DNA, 22 bp, Homo sapiens
agcaaaagatagattaacaaga

SEQ ID NO: 9414775 - DNA, 22 bp, Homo sapiens
agcaaaagatagattaacaaga

SEQ ID NO: 9414776 - DNA, 17 bp, Homo sapiens
agcaaaagtatcaaagc

SEQ ID NO: 9414777 - DNA, 22 bp, Homo sapiens
atttgcttgactatggcttgca

SEQ ID NO: 9414778 - DNA, 22 bp, Homo sapiens
atttgcttgtgctatgaaagtt

SEQ ID NO: 9414779 - DNA, 22 bp, Homo sapiens
atttgcttgtgctatgaaagtt

SEQ ID NO: 9414780 - DNA, 22 bp, Homo sapiens
atttgcttgtcctggtgactgt

SEQ ID NO: 9414781 - DNA, 22 bp, Homo sapiens
atttgcttgtaaatgtatgcct

SEQ ID NO: 9414782 - DNA, 22 bp, Homo sapiens
atttgcttcatagatctgtgga

SEQ ID NO: 9414783 - DNA, 22 bp, Homo sapiens
atttgcttatctccacagttgt

SEQ ID NO: 9414784 - DNA, 22 bp, Homo sapiens
atttgcttagattcagcacttt

SEQ ID NO: 9414785 - DNA, 22 bp, Homo sapiens
atttgcttctagtcagttccat

SEQ ID NO: 9414786 - DNA, 22 bp, Homo sapiens
atttgcttctgctaaacaactt

SEQ ID NO: 9414787 - DNA, 22 bp, Homo sapiens
atttgcttctgctaaacaactt

SEQ ID NO: 9414788 - DNA, 22 bp, Homo sapiens
atttgcttctgtgaaatcaagt

SEQ ID NO: 9414789 - DNA, 22 bp, Homo sapiens
agatgtggaaagaagttagaag

SEQ ID NO: 9414790 - DNA, 22 bp, Homo sapiens
agatgtggaacactagactgct

SEQ ID NO: 9414791 - DNA, 19 bp, Homo sapiens
agatgtctatttgactatc

SEQ ID NO: 9414792 - DNA, 22 bp, Homo sapiens
agatgtaagttgtttaaaagga

SEQ ID NO: 9414793 - DNA, 22 bp, Homo sapiens
atttgctggtgaaatagtgaca

SEQ ID NO: 9414794 - DNA, 22 bp, Homo sapiens
atttgctggtgaatgtatagct

SEQ ID NO: 9414795 - DNA, 22 bp, Homo sapiens
atttgctgatggcatttgagct

SEQ ID NO: 9414796 - DNA, 22 bp, Homo sapiens
atttgctgagctcaaagaaaag

SEQ ID NO: 9414797 - DNA, 22 bp, Homo sapiens
agatgtggaacactagactgct

SEQ ID NO: 9414798 - DNA, 22 bp, Homo sapiens
agatgtggaacactagactgct

SEQ ID NO: 9414799 - DNA, 19 bp, Homo sapiens
agatgtggagtttgatttc

SEQ ID NO: 9414800 - DNA, 22 bp, Homo sapiens
agatggtaatcacatttatctg

SEQ ID NO: 9414801 - DNA, 22 bp, Homo sapiens
agatgggcgcgctgctctgatg

SEQ ID NO: 9414802 - DNA, 19 bp, Homo sapiens
agatggggaagagtgtgag

SEQ ID NO: 9414803 - DNA, 22 bp, Homo sapiens
agatggtaatcacatttatctg

SEQ ID NO: 9414804 - DNA, 22 bp, Homo sapiens
agatgtaaactctcatgtcatt

SEQ ID NO: 9414805 - DNA, 22 bp, Homo sapiens
agatgtaagaccttcatgaggg

SEQ ID NO: 9414806 - DNA, 22 bp, Homo sapiens
agatgtagtagtgggtctttta

SEQ ID NO: 9414807 - DNA, 22 bp, Homo sapiens
agatgtaccaggtattacagga

SEQ ID NO: 9414808 - DNA, 22 bp, Homo sapiens
atttcattgaagttaattcttc

SEQ ID NO: 9414809 - DNA, 22 bp, Homo sapiens
atttccaactacccctccattt

SEQ ID NO: 9414810 - DNA, 21 bp, Homo sapiens
atttccaagggtacctaagat

SEQ ID NO: 9414811 - DNA, 22 bp, Homo sapiens
atttccaccatctctctgggcc

SEQ ID NO: 9414812 - DNA, 18 bp, Homo sapiens
agatgaaagcaaatgaca

SEQ ID NO: 9414813 - DNA, 22 bp, Homo sapiens
agatgaaagatttttatagaga

SEQ ID NO: 9414814 - DNA, 22 bp, Homo sapiens
agatgaaagatttttatagaga

SEQ ID NO: 9414815 - DNA, 22 bp, Homo sapiens
agatccagggttggatttgcat

SEQ ID NO: 9414816 - DNA, 22 bp, Homo sapiens
agatccaggatgtcccaaaata

SEQ ID NO: 9414817 - DNA, 22 bp, Homo sapiens
agatccagggttggatttgcat

SEQ ID NO: 9414818 - DNA, 22 bp, Homo sapiens
atttattgaagcttattacgtt

SEQ ID NO: 9414819 - DNA, 22 bp, Homo sapiens
agatgaagatatctgcaggggc

SEQ ID NO: 9414820 - DNA, 22 bp, Homo sapiens
agatgaagactcaggagcaggt

SEQ ID NO: 9414821 - DNA, 23 bp, Homo sapiens
agatgaaagcttcccatcacagt

SEQ ID NO: 9414822 - DNA, 22 bp, Homo sapiens
agatgaaatttgtgttgagttg

SEQ ID NO: 9414823 - DNA, 22 bp, Homo sapiens
atttcattgaagttaattcttc

SEQ ID NO: 9414824 - DNA, 22 bp, Homo sapiens
agatgaagatgccactaagacc

SEQ ID NO: 9414825 - DNA, 22 bp, Homo sapiens
atttcattgaagttaattcttc

SEQ ID NO: 9414826 - DNA, 22 bp, Homo sapiens
atttcattgaagttaattcttc

SEQ ID NO: 9414827 - DNA, 22 bp, Homo sapiens
atttcattgaagttaattcttc

SEQ ID NO: 9414828 - DNA, 22 bp, Homo sapiens
attaaactgagcaaattaacat

SEQ ID NO: 9414829 - DNA, 22 bp, Homo sapiens
attaaacaatgtaaagttcttg

SEQ ID NO: 9414830 - DNA, 22 bp, Homo sapiens
attaaacaatgtaaagttcttg

SEQ ID NO: 9414831 - DNA, 22 bp, Homo sapiens
attaaacaatgtaaagttcttg

SEQ ID NO: 9414832 - DNA, 22 bp, Homo sapiens
attaaacaatgtaaagttcttg

SEQ ID NO: 9414833 - DNA, 22 bp, Homo sapiens
attaaacaatgtaaagttcttg

SEQ ID NO: 9414834 - DNA, 22 bp, Homo sapiens
attaaagacagcagatggatgg

SEQ ID NO: 9414835 - DNA, 22 bp, Homo sapiens
attaaagctatccagtcatgaa

SEQ ID NO: 9414836 - DNA, 22 bp, Homo sapiens
attaaagtgaagttctcagatg

SEQ ID NO: 9414837 - DNA, 22 bp, Homo sapiens
attaaagtgaagttctcagatg

SEQ ID NO: 9414838 - DNA, 22 bp, Homo sapiens
attaaagaaacccagcatgtga

SEQ ID NO: 9414839 - DNA, 22 bp, Homo sapiens
attaaagaaacccagcatgtga

SEQ ID NO: 9414840 - DNA, 22 bp, Homo sapiens
atgtttgtcaggattgtaatta

SEQ ID NO: 9414841 - DNA, 22 bp, Homo sapiens
atgtttgtgggataaacaaatg

SEQ ID NO: 9414842 - DNA, 22 bp, Homo sapiens
atgtttgttgatcatttatgaa

SEQ ID NO: 9414843 - DNA, 22 bp, Homo sapiens
atgttttaaatatgtgtgtaaa

SEQ ID NO: 9414844 - DNA, 22 bp, Homo sapiens
atgtttgtgtttcccattcagg

SEQ ID NO: 9414845 - DNA, 22 bp, Homo sapiens
attaaagtgaagttctcagatg

SEQ ID NO: 9414846 - DNA, 22 bp, Homo sapiens
attaaagttgaaattgaactga

SEQ ID NO: 9414847 - DNA, 22 bp, Homo sapiens
attaaagttgaaattgaactga

SEQ ID NO: 9414848 - DNA, 22 bp, Homo sapiens
attaaatactgcaggctaagca

SEQ ID NO: 9414849 - DNA, 22 bp, Homo sapiens
attaaatactgcaggctaagca

SEQ ID NO: 9414850 - DNA, 22 bp, Homo sapiens
attagcaaggcagcatcaggca

SEQ ID NO: 9414851 - DNA, 22 bp, Homo sapiens
attagcaagttgttatcctttg

SEQ ID NO: 9414852 - DNA, 22 bp, Homo sapiens
attagcaaaacaacttttctat

SEQ ID NO: 9414853 - DNA, 22 bp, Homo sapiens
attagcatattaaatagtcatt

SEQ ID NO: 9414854 - DNA, 22 bp, Homo sapiens
attagctatatgctatgtgcca

SEQ ID NO: 9414855 - DNA, 22 bp, Homo sapiens
attagcattgctactctcaaga

SEQ ID NO: 9414856 - DNA, 22 bp, Homo sapiens
attagcatgccaagcttttaga

SEQ ID NO: 9414857 - DNA, 22 bp, Homo sapiens
attagctgacctctaaggagcc

SEQ ID NO: 9414858 - DNA, 22 bp, Homo sapiens
attagctgtgacgaggcattgt

SEQ ID NO: 9414859 - DNA, 22 bp, Homo sapiens
attataaacctttgagggtggg

SEQ ID NO: 9414860 - DNA, 20 bp, Homo sapiens
attagctcaggtgaggtcat

SEQ ID NO: 9414861 - DNA, 20 bp, Homo sapiens
attagctcaggtgaggtcat

SEQ ID NO: 9414862 - DNA, 22 bp, Homo sapiens
atgtttctgtcctacgagataa

SEQ ID NO: 9414863 - DNA, 22 bp, Homo sapiens
atgtttgaaattgtaagtatat

SEQ ID NO: 9414864 - DNA, 22 bp, Homo sapiens
atgtttctgagtgtatatacat

SEQ ID NO: 9414865 - DNA, 22 bp, Homo sapiens
atgtttctgagtgtatatacat

SEQ ID NO: 9414866 - DNA, 22 bp, Homo sapiens
atgtttgactgagtttggcaga

SEQ ID NO: 9414867 - DNA, 22 bp, Homo sapiens
atgtttgcattcttattatcgt

SEQ ID NO: 9414868 - DNA, 19 bp, Homo sapiens
atgtttgcttgagtaataa

SEQ ID NO: 9414869 - DNA, 22 bp, Homo sapiens
atgtttctgaagtttacagata

SEQ ID NO: 9414870 - DNA, 22 bp, Homo sapiens
atgtttatgttgggctatattt

SEQ ID NO: 9414871 - DNA, 22 bp, Homo sapiens
atgtttatgttgggctatattt

SEQ ID NO: 9414872 - DNA, 22 bp, Homo sapiens
atgttacacataggcataaatg

SEQ ID NO: 9414873 - DNA, 22 bp, Homo sapiens
atgttacacataggcataaatg

SEQ ID NO: 9414874 - DNA, 22 bp, Homo sapiens
atgttaaatggtttattattaa

SEQ ID NO: 9414875 - DNA, 22 bp, Homo sapiens
atgttaaatagccatttgtttg

SEQ ID NO: 9414876 - DNA, 22 bp, Homo sapiens
atgttaaataatcccttaaagc

SEQ ID NO: 9414877 - DNA, 22 bp, Homo sapiens
atgttaaataatcccttaaagc

SEQ ID NO: 9414878 - DNA, 20 bp, Homo sapiens
atgttaaatagcatttagag

SEQ ID NO: 9414879 - DNA, 23 bp, Homo sapiens
atgttaagtgaaataggccagga

SEQ ID NO: 9414880 - DNA, 22 bp, Homo sapiens
atgttaaatggtttattattaa

SEQ ID NO: 9414881 - DNA, 17 bp, Homo sapiens
atgttaatttcacattt

SEQ ID NO: 9414882 - DNA, 17 bp, Homo sapiens
atgttaatttcacattt

SEQ ID NO: 9414883 - DNA, 22 bp, Homo sapiens
atgtgtgcatcaatgatagatc

SEQ ID NO: 9414884 - DNA, 22 bp, Homo sapiens
atgtgtctttgagactctgcta

SEQ ID NO: 9414885 - DNA, 22 bp, Homo sapiens
atgtgtgcaatgctattttggc

SEQ ID NO: 9414886 - DNA, 22 bp, Homo sapiens
atgtgtgcatattctgccacct

SEQ ID NO: 9414887 - DNA, 22 bp, Homo sapiens
atgtgtgcatgttagagagagt

SEQ ID NO: 9414888 - DNA, 22 bp, Homo sapiens
atgtgtgccccttttactcttt

SEQ ID NO: 9414889 - DNA, 22 bp, Homo sapiens
atgtgtgcgggaaggaaagtga

SEQ ID NO: 9414890 - DNA, 22 bp, Homo sapiens
atgtgtgctacaggtgtgggaa

SEQ ID NO: 9414891 - DNA, 22 bp, Homo sapiens
atgtgtgcctgagtgatggact

SEQ ID NO: 9414892 - DNA, 18 bp, Homo sapiens
atgtgtctttcttgtttg

SEQ ID NO: 9414893 - DNA, 22 bp, Homo sapiens
atgtgtctttgagactctgcta

SEQ ID NO: 9414894 - DNA, 22 bp, Homo sapiens
atgtgtctttcaaggtatagaa

SEQ ID NO: 9414895 - DNA, 22 bp, Homo sapiens
atgtgtatccatctgtctattt

SEQ ID NO: 9414896 - DNA, 22 bp, Homo sapiens
atgtcttctaagctctaagctg

SEQ ID NO: 9414897 - DNA, 22 bp, Homo sapiens
atgtgtgctcttgagccttcac

SEQ ID NO: 9414898 - DNA, 21 bp, Homo sapiens
atgtgtgctagaggactactg

SEQ ID NO: 9414899 - DNA, 23 bp, Homo sapiens
atgtgtgggaggtcagagagcca

SEQ ID NO: 9414900 - DNA, 22 bp, Homo sapiens
atgtgtgtaaacaagtataatt

SEQ ID NO: 9414901 - DNA, 22 bp, Homo sapiens
atgtgtgtaaacaagtataatt

SEQ ID NO: 9414902 - DNA, 22 bp, Homo sapiens
atgtgtgtaaacaagtataatt

SEQ ID NO: 9414903 - DNA, 22 bp, Homo sapiens
atgtgtgtacacacgtgactct

SEQ ID NO: 9414904 - DNA, 22 bp, Homo sapiens
atgttaaataatcccttaaagc

SEQ ID NO: 9414905 - DNA, 22 bp, Homo sapiens
atgtgtgtaaacaagtataatt

SEQ ID NO: 9414906 - DNA, 22 bp, Homo sapiens
atgtgtgtacacacgtgactct

SEQ ID NO: 9414907 - DNA, 22 bp, Homo sapiens
atgtgtgtaaacaagtataatt

SEQ ID NO: 9414908 - DNA, 22 bp, Homo sapiens
atgtgtgtacacacgtgactct

SEQ ID NO: 9414909 - DNA, 22 bp, Homo sapiens
atgtgtgtacacacgtgactct

SEQ ID NO: 9414910 - DNA, 22 bp, Homo sapiens
attatacattttgtgtagagat

SEQ ID NO: 9414911 - DNA, 22 bp, Homo sapiens
attataaatattttctaggggt

SEQ ID NO: 9414912 - DNA, 22 bp, Homo sapiens
attataaatattttctaggggt

SEQ ID NO: 9414913 - DNA, 22 bp, Homo sapiens
attataaatattttctaggggt

SEQ ID NO: 9414914 - DNA, 22 bp, Homo sapiens
attataaatattttctaggggt

SEQ ID NO: 9414915 - DNA, 22 bp, Homo sapiens
attataaatattttctaggggt

SEQ ID NO: 9414916 - DNA, 22 bp, Homo sapiens
attataaatattttctaggggt

SEQ ID NO: 9414917 - DNA, 22 bp, Homo sapiens
attataaatattttctaggggt

SEQ ID NO: 9414918 - DNA, 22 bp, Homo sapiens
attataaacctttgagggtggg

SEQ ID NO: 9414919 - DNA, 22 bp, Homo sapiens
attataaacctttgagggtggg

SEQ ID NO: 9414920 - DNA, 22 bp, Homo sapiens
attataaacctttgagggtggg

SEQ ID NO: 9414921 - DNA, 22 bp, Homo sapiens
attataaagaacatgtgtgtgg

SEQ ID NO: 9414922 - DNA, 22 bp, Homo sapiens
attataaagaacatgtgtgtgg

SEQ ID NO: 9414923 - DNA, 22 bp, Homo sapiens
attataaagaacatgtgtgtgg

SEQ ID NO: 9414924 - DNA, 22 bp, Homo sapiens
attataaagaacatgtgtgtgg

SEQ ID NO: 9414925 - DNA, 22 bp, Homo sapiens
attataaagaacatgtgtgtgg

SEQ ID NO: 9414926 - DNA, 22 bp, Homo sapiens
attataaagaacatgtgtgtgg

SEQ ID NO: 9414927 - DNA, 22 bp, Homo sapiens
attataaagaacatgtgtgtgg

SEQ ID NO: 9414928 - DNA, 22 bp, Homo sapiens
attataaagaacatgtgtgtgg

SEQ ID NO: 9414929 - DNA, 22 bp, Homo sapiens
attataaagaacatgtgtgtgg

SEQ ID NO: 9414930 - DNA, 22 bp, Homo sapiens
attataaagaacatgtgtgtgg

SEQ ID NO: 9414931 - DNA, 22 bp, Homo sapiens
attcacactgtatacacaggat

SEQ ID NO: 9414932 - DNA, 22 bp, Homo sapiens
attcacactgtatacacaggat

SEQ ID NO: 9414933 - DNA, 22 bp, Homo sapiens
attcacactgtatacacaggat

SEQ ID NO: 9414934 - DNA, 22 bp, Homo sapiens
attcacactgtatacacaggat

SEQ ID NO: 9414935 - DNA, 22 bp, Homo sapiens
attcacagaatagttttaccag

SEQ ID NO: 9414936 - DNA, 22 bp, Homo sapiens
attcacactttacttctttcca

SEQ ID NO: 9414937 - DNA, 22 bp, Homo sapiens
attcacagaatagttttaccag

SEQ ID NO: 9414938 - DNA, 22 bp, Homo sapiens
attcacagagtggttagtggta

SEQ ID NO: 9414939 - DNA, 22 bp, Homo sapiens
attcacaattagaagtagataa

SEQ ID NO: 9414940 - DNA, 22 bp, Homo sapiens
attcaaagcccagtaaacattg

SEQ ID NO: 9414941 - DNA, 22 bp, Homo sapiens
attcaaagatcatgatctctac

SEQ ID NO: 9414942 - DNA, 22 bp, Homo sapiens
attatagagggttacagttaat

SEQ ID NO: 9414943 - DNA, 22 bp, Homo sapiens
attcacagttcattagctgtaa

SEQ ID NO: 9414944 - DNA, 22 bp, Homo sapiens
attcacagttactgctgaacca

SEQ ID NO: 9414945 - DNA, 22 bp, Homo sapiens
attcacagttactgctgaacca

SEQ ID NO: 9414946 - DNA, 22 bp, Homo sapiens
attcacagttactgctgaacca

SEQ ID NO: 9414947 - DNA, 22 bp, Homo sapiens
attcacagttcattagctgtaa

SEQ ID NO: 9414948 - DNA, 20 bp, Homo sapiens
attcacaggcacaaaaccct

SEQ ID NO: 9414949 - DNA, 22 bp, Homo sapiens
attcacagggacaatgggagag

SEQ ID NO: 9414950 - DNA, 22 bp, Homo sapiens
attcacagggctttccgcatgg

SEQ ID NO: 9414951 - DNA, 22 bp, Homo sapiens
attcacagggacaatgggagag

SEQ ID NO: 9414952 - DNA, 22 bp, Homo sapiens
attcacagggggagaagggtat

SEQ ID NO: 9414953 - DNA, 22 bp, Homo sapiens
attcacagggggagaagggtat

SEQ ID NO: 9414954 - DNA, 22 bp, Homo sapiens
attcacagtatggacgaaatga

SEQ ID NO: 9414955 - DNA, 21 bp, Homo sapiens
attcacaggtatcctctccct

SEQ ID NO: 9414956 - DNA, 22 bp, Homo sapiens
attcagattggtttaagctagt

SEQ ID NO: 9414957 - DNA, 22 bp, Homo sapiens
attcagattggtttaagctagt

SEQ ID NO: 9414958 - DNA, 22 bp, Homo sapiens
attcagattggtttaagctagt

SEQ ID NO: 9414959 - DNA, 22 bp, Homo sapiens
attcagatcatatttatagctt

SEQ ID NO: 9414960 - DNA, 22 bp, Homo sapiens
attcagcataatcagtagcttg

SEQ ID NO: 9414961 - DNA, 22 bp, Homo sapiens
attcagcattcatttccaactt

SEQ ID NO: 9414962 - DNA, 22 bp, Homo sapiens
attcagcattcatttccaactt

SEQ ID NO: 9414963 - DNA, 22 bp, Homo sapiens
attcagcattcatttccaactt

SEQ ID NO: 9414964 - DNA, 22 bp, Homo sapiens
attcagcacatctttgtacagc

SEQ ID NO: 9414965 - DNA, 22 bp, Homo sapiens
attcagcacatctttgtacagc

SEQ ID NO: 9414966 - DNA, 22 bp, Homo sapiens
attcagcagttcctgcttcagt

SEQ ID NO: 9414967 - DNA, 22 bp, Homo sapiens
attcagcagttcctgcttcagt

SEQ ID NO: 9414968 - DNA, 22 bp, Homo sapiens
attctggattatcagtccacca

SEQ ID NO: 9414969 - DNA, 22 bp, Homo sapiens
attctggacaatgagaaactgg

SEQ ID NO: 9414970 - DNA, 22 bp, Homo sapiens
attctggacaatgagaaactgg

SEQ ID NO: 9414971 - DNA, 22 bp, Homo sapiens
attctggacaatgagaaactgg

SEQ ID NO: 9414972 - DNA, 22 bp, Homo sapiens
attctggacaaggcaagctcct

SEQ ID NO: 9414973 - DNA, 22 bp, Homo sapiens
attctggacaaggcaagctcct

SEQ ID NO: 9414974 - DNA, 22 bp, Homo sapiens
attctggatattacttatctat

SEQ ID NO: 9414975 - DNA, 22 bp, Homo sapiens
attctggattatcagtccacca

SEQ ID NO: 9414976 - DNA, 22 bp, Homo sapiens
attctggatattacttatctat

SEQ ID NO: 9414977 - DNA, 22 bp, Homo sapiens
attctggacaaggcaagctcct

SEQ ID NO: 9414978 - DNA, 22 bp, Homo sapiens
attctggacaaggcaagctcct

SEQ ID NO: 9414979 - DNA, 22 bp, Homo sapiens
attctggacaaggcaagctcct

SEQ ID NO: 9414980 - DNA, 22 bp, Homo sapiens
attctctgtgtctgctttccca

SEQ ID NO: 9414981 - DNA, 22 bp, Homo sapiens
attcagctaagtgcttcatgct

SEQ ID NO: 9414982 - DNA, 22 bp, Homo sapiens
attcagcattggcaccatggat

SEQ ID NO: 9414983 - DNA, 22 bp, Homo sapiens
attcagctgactttgattcatt

SEQ ID NO: 9414984 - DNA, 22 bp, Homo sapiens
attcagctgactttgattcatt

SEQ ID NO: 9414985 - DNA, 22 bp, Homo sapiens
attcagctctgaatcagcagac

SEQ ID NO: 9414986 - DNA, 22 bp, Homo sapiens
attcagcttcaatgtcttcacc

SEQ ID NO: 9414987 - DNA, 22 bp, Homo sapiens
attcaggagtgtgccaggaagg

SEQ ID NO: 9414988 - DNA, 22 bp, Homo sapiens
attctgtaattgaactgtgttg

SEQ ID NO: 9414989 - DNA, 17 bp, Homo sapiens
attctgtaaggttggat

SEQ ID NO: 9414990 - DNA, 22 bp, Homo sapiens
attctgtagggcttgctgacac

SEQ ID NO: 9414991 - DNA, 22 bp, Homo sapiens
attctgtatggaaaagcactat

SEQ ID NO: 9414992 - DNA, 22 bp, Homo sapiens
attctgtatggaaaagcactat

SEQ ID NO: 9414993 - DNA, 22 bp, Homo sapiens
attctgtatggggaaactagag

SEQ ID NO: 9414994 - DNA, 22 bp, Homo sapiens
attctgtatttctaataagatc

SEQ ID NO: 9414995 - DNA, 22 bp, Homo sapiens
attctgtatttggatataaggg

SEQ ID NO: 9414996 - DNA, 22 bp, Homo sapiens
attctgtatttggatataaggg

SEQ ID NO: 9414997 - DNA, 22 bp, Homo sapiens
attctgtatttctaataagatc

SEQ ID NO: 9414998 - DNA, 21 bp, Homo sapiens
agagggagagtggcccttcca

SEQ ID NO: 9414999 - DNA, 21 bp, Homo sapiens
agagggagagtggcccttcca

SEQ ID NO: 9415000 - DNA, 21 bp, Homo sapiens
agagggagagtggcccttcca

SEQ ID NO: 9415001 - DNA, 23 bp, Homo sapiens
agagggagatgtttttctcaaga

SEQ ID NO: 9415002 - DNA, 23 bp, Homo sapiens
agagggagatgtttttctcaaga

SEQ ID NO: 9415003 - DNA, 22 bp, Homo sapiens
agagggtagaagacagggttgc

SEQ ID NO: 9415004 - DNA, 22 bp, Homo sapiens
agaggggctcatatcctgtcat

SEQ ID NO: 9415005 - DNA, 22 bp, Homo sapiens
agaggggctcatatcctgtcat

SEQ ID NO: 9415006 - DNA, 22 bp, Homo sapiens
agagggtgaatgagatagaaaa

SEQ ID NO: 9415007 - DNA, 22 bp, Homo sapiens
agagggtgggcacgtgatggat

SEQ ID NO: 9415008 - DNA, 22 bp, Homo sapiens
agagggtgctggagagacattg

SEQ ID NO: 9415009 - DNA, 23 bp, Homo sapiens
agagggtgcaacatggggatcta

SEQ ID NO: 9415010 - DNA, 22 bp, Homo sapiens
agagggagtgaaatggaataga

SEQ ID NO: 9415011 - DNA, 22 bp, Homo sapiens
agagggagtgaaatggaataga

SEQ ID NO: 9415012 - DNA, 22 bp, Homo sapiens
agagggagctttatttttctgt

SEQ ID NO: 9415013 - DNA, 22 bp, Homo sapiens
agagggagctttatttttctgt

SEQ ID NO: 9415014 - DNA, 22 bp, Homo sapiens
agagggagcccagtcatagctg

SEQ ID NO: 9415015 - DNA, 22 bp, Homo sapiens
agagggagcccagtcatagctg

SEQ ID NO: 9415016 - DNA, 22 bp, Homo sapiens
agagggagcccagtcatagctg

SEQ ID NO: 9415017 - DNA, 22 bp, Homo sapiens
agagggagcccagtcatagctg

SEQ ID NO: 9415018 - DNA, 22 bp, Homo sapiens
agagggcaagtgtagtccagta

SEQ ID NO: 9415019 - DNA, 22 bp, Homo sapiens
agagggcaagtgtagtccagta

SEQ ID NO: 9415020 - DNA, 22 bp, Homo sapiens
agagggcaagtgtagtccagta

SEQ ID NO: 9415021 - DNA, 22 bp, Homo sapiens
agagggcaagtgtagtccagta

SEQ ID NO: 9415022 - DNA, 22 bp, Homo sapiens
agagggatcaccctgtttctgg

SEQ ID NO: 9415023 - DNA, 22 bp, Homo sapiens
agagggagtgaaatggaataga

SEQ ID NO: 9415024 - DNA, 22 bp, Homo sapiens
agagggatcaccctgtttctgg

SEQ ID NO: 9415025 - DNA, 22 bp, Homo sapiens
agagggatcaccctgtttctgg

SEQ ID NO: 9415026 - DNA, 22 bp, Homo sapiens
cagaggctaagagtgtccaaag

SEQ ID NO: 9415027 - DNA, 22 bp, Homo sapiens
cagaggcctttctacagtgata

SEQ ID NO: 9415028 - DNA, 22 bp, Homo sapiens
cagaggcctttctacagtgata

SEQ ID NO: 9415029 - DNA, 22 bp, Homo sapiens
cagaggcctttctacagtgata

SEQ ID NO: 9415030 - DNA, 22 bp, Homo sapiens
cagaggcgaggcagctgaacct

SEQ ID NO: 9415031 - DNA, 22 bp, Homo sapiens
agccctccatctgtgctcaggc

SEQ ID NO: 9415032 - DNA, 22 bp, Homo sapiens
agccctccatctgtgctcaggc

SEQ ID NO: 9415033 - DNA, 19 bp, Homo sapiens
cagcaagaatgaaggcata

SEQ ID NO: 9415034 - DNA, 22 bp, Homo sapiens
cagaggctcagatggccctggc

SEQ ID NO: 9415035 - DNA, 22 bp, Homo sapiens
cagaggctcagatggccctggc

SEQ ID NO: 9415036 - DNA, 22 bp, Homo sapiens
cagaggctcagatggccctggc

SEQ ID NO: 9415037 - DNA, 22 bp, Homo sapiens
cagcacagcacagcggtgactc

SEQ ID NO: 9415038 - DNA, 22 bp, Homo sapiens
cagcacagctgaggggctgtct

SEQ ID NO: 9415039 - DNA, 22 bp, Homo sapiens
cagcacagcacagcggtgactc

SEQ ID NO: 9415040 - DNA, 22 bp, Homo sapiens
cagcacacagtgactcgcacct

SEQ ID NO: 9415041 - DNA, 19 bp, Homo sapiens
cagcaagaatgaaggcata

SEQ ID NO: 9415042 - DNA, 19 bp, Homo sapiens
cagcaagaatgaaggcata

SEQ ID NO: 9415043 - DNA, 19 bp, Homo sapiens
cagcaagaatgaaggcata

SEQ ID NO: 9415044 - DNA, 19 bp, Homo sapiens
cagcaagaatgaaggcata

SEQ ID NO: 9415045 - DNA, 22 bp, Homo sapiens
cagcacacagtgactcgcacct

SEQ ID NO: 9415046 - DNA, 22 bp, Homo sapiens
cagcacagtacaaggcacggat

SEQ ID NO: 9415047 - DNA, 22 bp, Homo sapiens
cagcacagtacaaggcacggat

SEQ ID NO: 9415048 - DNA, 22 bp, Homo sapiens
cagcacagggcttgagaggtgt

SEQ ID NO: 9415049 - DNA, 22 bp, Homo sapiens
cagcacagggcttgagaggtgt

SEQ ID NO: 9415050 - DNA, 22 bp, Homo sapiens
cagcacagggcttgagaggtgt

SEQ ID NO: 9415051 - DNA, 22 bp, Homo sapiens
cagcacagggcttgagaggtgt

SEQ ID NO: 9415052 - DNA, 22 bp, Homo sapiens
cagcacagggcttgagaggtgt

SEQ ID NO: 9415053 - DNA, 22 bp, Homo sapiens
agcctcagggctctgcgcagac

SEQ ID NO: 9415054 - DNA, 23 bp, Homo sapiens
agcctcagccggtggcagaagtg

SEQ ID NO: 9415055 - DNA, 23 bp, Homo sapiens
agcctcagccggtggcagaagtg

SEQ ID NO: 9415056 - DNA, 23 bp, Homo sapiens
agcctcagccggtggcagaagtg

SEQ ID NO: 9415057 - DNA, 22 bp, Homo sapiens
cagcacaggaagtgggccttca

SEQ ID NO: 9415058 - DNA, 22 bp, Homo sapiens
cagcacaggaatatggtggaca

SEQ ID NO: 9415059 - DNA, 22 bp, Homo sapiens
cagcacaggcaggggaactata

SEQ ID NO: 9415060 - DNA, 22 bp, Homo sapiens
cagcacagctgaggggctgtct

SEQ ID NO: 9415061 - DNA, 22 bp, Homo sapiens
cagcacagggacaatagcagat

SEQ ID NO: 9415062 - DNA, 22 bp, Homo sapiens
cagcacagggcttgagaggtgt

SEQ ID NO: 9415063 - DNA, 22 bp, Homo sapiens
cagcacagggcttgagaggtgt

SEQ ID NO: 9415064 - DNA, 22 bp, Homo sapiens
cagcacaggcccctctctccca

SEQ ID NO: 9415065 - DNA, 22 bp, Homo sapiens
cagcacaggaatatggtggaca

SEQ ID NO: 9415066 - DNA, 22 bp, Homo sapiens
cagcagaggttttgctccatga

SEQ ID NO: 9415067 - DNA, 22 bp, Homo sapiens
cagcagaggttttgctccatga

SEQ ID NO: 9415068 - DNA, 22 bp, Homo sapiens
cagcagaggttttgctccatga

SEQ ID NO: 9415069 - DNA, 22 bp, Homo sapiens
cagcagaggttttgctccatga

SEQ ID NO: 9415070 - DNA, 22 bp, Homo sapiens
cagcagaggttttgctccatga

SEQ ID NO: 9415071 - DNA, 22 bp, Homo sapiens
cagcagcagcttagtggtcccc

SEQ ID NO: 9415072 - DNA, 22 bp, Homo sapiens
cagcagcagccccaggaaggtt

SEQ ID NO: 9415073 - DNA, 22 bp, Homo sapiens
cagcagcagccccaggaaggtt

SEQ ID NO: 9415074 - DNA, 22 bp, Homo sapiens
cagcagcagtggctgcagaaca

SEQ ID NO: 9415075 - DNA, 22 bp, Homo sapiens
cagcagcagtggctgcagaaca

SEQ ID NO: 9415076 - DNA, 22 bp, Homo sapiens
cagcagcagtggctgcagaaca

SEQ ID NO: 9415077 - DNA, 22 bp, Homo sapiens
cagcagcaggcgcacggccgtc

SEQ ID NO: 9415078 - DNA, 22 bp, Homo sapiens
cagcagcagcttagtggtcccc

SEQ ID NO: 9415079 - DNA, 22 bp, Homo sapiens
cagcagcagcttagtggtcccc

SEQ ID NO: 9415080 - DNA, 22 bp, Homo sapiens
agcctggtttaagcattttata

SEQ ID NO: 9415081 - DNA, 22 bp, Homo sapiens
cagcagcatcaggtctgtggtt

SEQ ID NO: 9415082 - DNA, 22 bp, Homo sapiens
cagcagcatcaggtctgtggtt

SEQ ID NO: 9415083 - DNA, 22 bp, Homo sapiens
cagcagcagtgttctagaatct

SEQ ID NO: 9415084 - DNA, 22 bp, Homo sapiens
cagcagcagtgttctagaatct

SEQ ID NO: 9415085 - DNA, 22 bp, Homo sapiens
cagcagcatgaattcgagccac

SEQ ID NO: 9415086 - DNA, 22 bp, Homo sapiens
cagcagcatgaattcgagccac

SEQ ID NO: 9415087 - DNA, 22 bp, Homo sapiens
cagcagcatgaattcgagccac

SEQ ID NO: 9415088 - DNA, 22 bp, Homo sapiens
cagcagaggttggaacagttct

SEQ ID NO: 9415089 - DNA, 22 bp, Homo sapiens
cagcagaggttggaacagttct

SEQ ID NO: 9415090 - DNA, 22 bp, Homo sapiens
cagcagaggttggaacagttct

SEQ ID NO: 9415091 - DNA, 22 bp, Homo sapiens
cagcagaggtggttcacattgt

SEQ ID NO: 9415092 - DNA, 22 bp, Homo sapiens
cagcagaggtggttcacattgt

SEQ ID NO: 9415093 - DNA, 22 bp, Homo sapiens
cagcagaggttggaacagttct

SEQ ID NO: 9415094 - DNA, 22 bp, Homo sapiens
cagcagaggtggttcacattgt

SEQ ID NO: 9415095 - DNA, 22 bp, Homo sapiens
cagcagaggttggaacagttct

SEQ ID NO: 9415096 - DNA, 22 bp, Homo sapiens
cagcagagggagccattgaaat

SEQ ID NO: 9415097 - DNA, 22 bp, Homo sapiens
cagcagagggagccattgaaat

SEQ ID NO: 9415098 - DNA, 22 bp, Homo sapiens
cagcagaggtggttcacattgt

SEQ ID NO: 9415099 - DNA, 22 bp, Homo sapiens
cagcagaggtggttcacattgt

SEQ ID NO: 9415100 - DNA, 22 bp, Homo sapiens
cagcagagggagccattgaaat

SEQ ID NO: 9415101 - DNA, 22 bp, Homo sapiens
cagcagaggtggttcacattgt

SEQ ID NO: 9415102 - DNA, 22 bp, Homo sapiens
cagcagaggaaagcaaatctaa

SEQ ID NO: 9415103 - DNA, 22 bp, Homo sapiens
cagcagaggaaagcaaatctaa

SEQ ID NO: 9415104 - DNA, 22 bp, Homo sapiens
cagcagaggaaagcaaatctaa

SEQ ID NO: 9415105 - DNA, 22 bp, Homo sapiens
cagcagaggaaagcaaatctaa

SEQ ID NO: 9415106 - DNA, 22 bp, Homo sapiens
cagcagaggcacgtctgtgaat

SEQ ID NO: 9415107 - DNA, 22 bp, Homo sapiens
cagcagagggagccattgaaat

SEQ ID NO: 9415108 - DNA, 22 bp, Homo sapiens
cagcagaggcacgtctgtgaat

SEQ ID NO: 9415109 - DNA, 22 bp, Homo sapiens
cagcagaggcacgtctgtgaat

SEQ ID NO: 9415110 - DNA, 22 bp, Homo sapiens
cagcagaggcacgtctgtgaat

SEQ ID NO: 9415111 - DNA, 22 bp, Homo sapiens
cagcagaaacccagcaaagcca

SEQ ID NO: 9415112 - DNA, 22 bp, Homo sapiens
cagcagaaacccagcaaagcca

SEQ ID NO: 9415113 - DNA, 22 bp, Homo sapiens
cagcagaaatggattttgagat

SEQ ID NO: 9415114 - DNA, 22 bp, Homo sapiens
agcctccatctcccatctgtga

SEQ ID NO: 9415115 - DNA, 20 bp, Homo sapiens
cagcagaaatggggtgggaa

SEQ ID NO: 9415116 - DNA, 22 bp, Homo sapiens
cagcagagcttattaactaaaa

SEQ ID NO: 9415117 - DNA, 22 bp, Homo sapiens
cagcagagcttatgttgggtca

SEQ ID NO: 9415118 - DNA, 22 bp, Homo sapiens
cagcagagcttatgttgggtca

SEQ ID NO: 9415119 - DNA, 22 bp, Homo sapiens
cagcagagcttattaactaaaa

SEQ ID NO: 9415120 - DNA, 22 bp, Homo sapiens
agcctcagtgtcaccatctacc

SEQ ID NO: 9415121 - DNA, 22 bp, Homo sapiens
agcctcagtttcaggcctcctc

SEQ ID NO: 9415122 - DNA, 22 bp, Homo sapiens
agcctcagtgtcaccatctacc

SEQ ID NO: 9415123 - DNA, 22 bp, Homo sapiens
agcctccacagatgcaaagggc

SEQ ID NO: 9415124 - DNA, 22 bp, Homo sapiens
agccttgatcttggtaacagga

SEQ ID NO: 9415125 - DNA, 22 bp, Homo sapiens
agccttgagttcaagtgctggc

SEQ ID NO: 9415126 - DNA, 22 bp, Homo sapiens
agccttctctgaaattctgttt

SEQ ID NO: 9415127 - DNA, 22 bp, Homo sapiens
agccttgaacactgactgaagg

SEQ ID NO: 9415128 - DNA, 22 bp, Homo sapiens
agccttggccgtaaggtatgct

SEQ ID NO: 9415129 - DNA, 23 bp, Homo sapiens
agccttggaggttgaggctgcag

SEQ ID NO: 9415130 - DNA, 22 bp, Homo sapiens
agccttggtcccgcgtcagcca

SEQ ID NO: 9415131 - DNA, 22 bp, Homo sapiens
agcctttaacacttcacattga

SEQ ID NO: 9415132 - DNA, 22 bp, Homo sapiens
cagcaggacgtccaagtgctat

SEQ ID NO: 9415133 - DNA, 22 bp, Homo sapiens
cagcaggacgtccaagtgctat

SEQ ID NO: 9415134 - DNA, 22 bp, Homo sapiens
cagcaggacgtccaagtgctat

SEQ ID NO: 9415135 - DNA, 22 bp, Homo sapiens
cagcaggacgtccaagtgctat

SEQ ID NO: 9415136 - DNA, 22 bp, Homo sapiens
cagcaggacccaggaatcctgc

SEQ ID NO: 9415137 - DNA, 22 bp, Homo sapiens
cagcaggaccattgaggcatca

SEQ ID NO: 9415138 - DNA, 22 bp, Homo sapiens
cagcaggaccattgaggcatca

SEQ ID NO: 9415139 - DNA, 22 bp, Homo sapiens
cagcaggaccattgaggcatca

SEQ ID NO: 9415140 - DNA, 22 bp, Homo sapiens
agccttttggagttattctggg

SEQ ID NO: 9415141 - DNA, 22 bp, Homo sapiens
cagcaggaggcatggcttccct

SEQ ID NO: 9415142 - DNA, 22 bp, Homo sapiens
cagcaggaggcatggcttccct

SEQ ID NO: 9415143 - DNA, 23 bp, Homo sapiens
cagcaggagggtgcctgggctgc

SEQ ID NO: 9415144 - DNA, 23 bp, Homo sapiens
cagcaggagggtgcctgggctgc

SEQ ID NO: 9415145 - DNA, 23 bp, Homo sapiens
cagcaggagggtgcctgggctgc

SEQ ID NO: 9415146 - DNA, 22 bp, Homo sapiens
cagcaggagcagtcagactcct

SEQ ID NO: 9415147 - DNA, 22 bp, Homo sapiens
cagcaggagcagtcagactcct

SEQ ID NO: 9415148 - DNA, 22 bp, Homo sapiens
agctcagaactgcagacatgtg

SEQ ID NO: 9415149 - DNA, 22 bp, Homo sapiens
agctcagaactgcagacatgtg

SEQ ID NO: 9415150 - DNA, 22 bp, Homo sapiens
agctcagaactgcagacatgtg

SEQ ID NO: 9415151 - DNA, 22 bp, Homo sapiens
agctcagaagcctatgcatagt

SEQ ID NO: 9415152 - DNA, 22 bp, Homo sapiens
agctcagaacctcctcatccca

SEQ ID NO: 9415153 - DNA, 22 bp, Homo sapiens
agctcaccacaacctccgcctc

SEQ ID NO: 9415154 - DNA, 22 bp, Homo sapiens
cagcaggataggtttctttgga

SEQ ID NO: 9415155 - DNA, 22 bp, Homo sapiens
cagcaggaggtgagtagcaggt

SEQ ID NO: 9415156 - DNA, 22 bp, Homo sapiens
cagcaggaggtgagtagcaggt

SEQ ID NO: 9415157 - DNA, 23 bp, Homo sapiens
cagcaggagggtgcctgggctgc

SEQ ID NO: 9415158 - DNA, 23 bp, Homo sapiens
cagcaggagggtgcctgggctgc

SEQ ID NO: 9415159 - DNA, 22 bp, Homo sapiens
cagcaggaggtgagatgtgacc

SEQ ID NO: 9415160 - DNA, 22 bp, Homo sapiens
cagcaggaggtgagatgtgacc

SEQ ID NO: 9415161 - DNA, 22 bp, Homo sapiens
cagcaggaggtgagatgtgacc

SEQ ID NO: 9415162 - DNA, 22 bp, Homo sapiens
agctaggagattttgtgaggct

SEQ ID NO: 9415163 - DNA, 22 bp, Homo sapiens
agctcaagttcttttaccatat

SEQ ID NO: 9415164 - DNA, 22 bp, Homo sapiens
agctcaagttttcaaatattat

SEQ ID NO: 9415165 - DNA, 22 bp, Homo sapiens
agctcaatgcaacctccgcctc

SEQ ID NO: 9415166 - DNA, 22 bp, Homo sapiens
agctcacacctcatcagggtgg

SEQ ID NO: 9415167 - DNA, 22 bp, Homo sapiens
agctcacaagactccctcccct

SEQ ID NO: 9415168 - DNA, 22 bp, Homo sapiens
agctcaatttaaggcttggctt

SEQ ID NO: 9415169 - DNA, 22 bp, Homo sapiens
cagccctgggatcttagtgcct

SEQ ID NO: 9415170 - DNA, 22 bp, Homo sapiens
cagccctgggtccctgccctgg

SEQ ID NO: 9415171 - DNA, 22 bp, Homo sapiens
cagccctgggagttggggccga

SEQ ID NO: 9415172 - DNA, 22 bp, Homo sapiens
cagccctgggtccctgccctgg

SEQ ID NO: 9415173 - DNA, 22 bp, Homo sapiens
cagccctgggtccctgccctgg

SEQ ID NO: 9415174 - DNA, 22 bp, Homo sapiens
cagccctgggagttggggccga

SEQ ID NO: 9415175 - DNA, 22 bp, Homo sapiens
cagccctggctagggcgagggc

SEQ ID NO: 9415176 - DNA, 22 bp, Homo sapiens
cagccctggctagggcgagggc

SEQ ID NO: 9415177 - DNA, 22 bp, Homo sapiens
cagccctggcgcccccagatct

SEQ ID NO: 9415178 - DNA, 22 bp, Homo sapiens
cagccctggcgcccccagatct

SEQ ID NO: 9415179 - DNA, 22 bp, Homo sapiens
cagccctggcgcccccagatct

SEQ ID NO: 9415180 - DNA, 21 bp, Homo sapiens
agctccctgtttcctcactct

SEQ ID NO: 9415181 - DNA, 21 bp, Homo sapiens
agctccctgtttcctcactct

SEQ ID NO: 9415182 - DNA, 21 bp, Homo sapiens
agctccctgtttcctcactct

SEQ ID NO: 9415183 - DNA, 22 bp, Homo sapiens
agctccctgcacgaccctgccc

SEQ ID NO: 9415184 - DNA, 21 bp, Homo sapiens
agctccctgtttcctcactct

SEQ ID NO: 9415185 - DNA, 20 bp, Homo sapiens
agctcctcatcactggaggt

SEQ ID NO: 9415186 - DNA, 22 bp, Homo sapiens
agctcctcctgtgccaggccag

SEQ ID NO: 9415187 - DNA, 22 bp, Homo sapiens
cagccctggcctcttcgctttc

SEQ ID NO: 9415188 - DNA, 22 bp, Homo sapiens
cagccctggcgcccccagatct

SEQ ID NO: 9415189 - DNA, 22 bp, Homo sapiens
cagccagagaggaaggaatgca

SEQ ID NO: 9415190 - DNA, 22 bp, Homo sapiens
cagccagagaaagggcactgcc

SEQ ID NO: 9415191 - DNA, 22 bp, Homo sapiens
cagccagagaaagggcactgcc

SEQ ID NO: 9415192 - DNA, 22 bp, Homo sapiens
cagccagagaaagggcactgcc

SEQ ID NO: 9415193 - DNA, 22 bp, Homo sapiens
cagccagaggggccagagtcgg

SEQ ID NO: 9415194 - DNA, 22 bp, Homo sapiens
cagccagaggggccagagtcgg

SEQ ID NO: 9415195 - DNA, 22 bp, Homo sapiens
cagccagaggctgcgaggggcc

SEQ ID NO: 9415196 - DNA, 22 bp, Homo sapiens
cagccagaggctgcgaggggcc

SEQ ID NO: 9415197 - DNA, 22 bp, Homo sapiens
cagccagaggggccagagtcgg

SEQ ID NO: 9415198 - DNA, 22 bp, Homo sapiens
cagccagatcaaactcagatgt

SEQ ID NO: 9415199 - DNA, 22 bp, Homo sapiens
cagccagatcagggcaggggtt

SEQ ID NO: 9415200 - DNA, 22 bp, Homo sapiens
cagccagatcagggcaggggtt

SEQ ID NO: 9415201 - DNA, 22 bp, Homo sapiens
cagccagctcaggaaggatttt

SEQ ID NO: 9415202 - DNA, 22 bp, Homo sapiens
cagccagctgaatgtaccatga

SEQ ID NO: 9415203 - DNA, 22 bp, Homo sapiens
cagccagctcaggaaggatttt

SEQ ID NO: 9415204 - DNA, 22 bp, Homo sapiens
cagccagcctctcaaccatgca

SEQ ID NO: 9415205 - DNA, 22 bp, Homo sapiens
cagccagctggcactgtgagta

SEQ ID NO: 9415206 - DNA, 22 bp, Homo sapiens
agctccagggaaagagtggatc

SEQ ID NO: 9415207 - DNA, 22 bp, Homo sapiens
agctcccaggcagtcatgagga

SEQ ID NO: 9415208 - DNA, 22 bp, Homo sapiens
agctcccattatcttctgaaac

SEQ ID NO: 9415209 - DNA, 22 bp, Homo sapiens
agctccccacgtctctgtcttt

SEQ ID NO: 9415210 - DNA, 22 bp, Homo sapiens
agctcccagtctcctctccatg

SEQ ID NO: 9415211 - DNA, 22 bp, Homo sapiens
agctcccagtctcctctccatg

SEQ ID NO: 9415212 - DNA, 22 bp, Homo sapiens
agcccagcctgattctacaccc

SEQ ID NO: 9415213 - DNA, 22 bp, Homo sapiens
agcccagcctgattctacaccc

SEQ ID NO: 9415214 - DNA, 22 bp, Homo sapiens
agcccaggaagttgaggcttgc

SEQ ID NO: 9415215 - DNA, 22 bp, Homo sapiens
agcccaggaatctgcatcttga

SEQ ID NO: 9415216 - DNA, 22 bp, Homo sapiens
agcccaggaatctgcatcttga

SEQ ID NO: 9415217 - DNA, 22 bp, Homo sapiens
agcccaggaagttgaggcttgc

SEQ ID NO: 9415218 - DNA, 22 bp, Homo sapiens
agcccaggaggtggaggttgca

SEQ ID NO: 9415219 - DNA, 22 bp, Homo sapiens
agcccaggaggtggaggttgca

SEQ ID NO: 9415220 - DNA, 22 bp, Homo sapiens
agcccaggagtccttaaggacc

SEQ ID NO: 9415221 - DNA, 22 bp, Homo sapiens
agcccaggaggtggaggttgca

SEQ ID NO: 9415222 - DNA, 22 bp, Homo sapiens
agcccaggagcctttggagggt

SEQ ID NO: 9415223 - DNA, 22 bp, Homo sapiens
agcccaggagcctttggagggt

SEQ ID NO: 9415224 - DNA, 22 bp, Homo sapiens
cagagctggagcttgaatggag

SEQ ID NO: 9415225 - DNA, 22 bp, Homo sapiens
cagagctggagcttgaatggag

SEQ ID NO: 9415226 - DNA, 22 bp, Homo sapiens
cagagctgcttcccagtttgtg

SEQ ID NO: 9415227 - DNA, 22 bp, Homo sapiens
agcccaggagtttgaggctgtg

SEQ ID NO: 9415228 - DNA, 22 bp, Homo sapiens
agcccaggagtccttaaggacc

SEQ ID NO: 9415229 - DNA, 22 bp, Homo sapiens
agcccaggagtccttaaggacc

SEQ ID NO: 9415230 - DNA, 22 bp, Homo sapiens
agcccaggagtccttaaggacc

SEQ ID NO: 9415231 - DNA, 22 bp, Homo sapiens
agcccaggagtttgaggctgtg

SEQ ID NO: 9415232 - DNA, 22 bp, Homo sapiens
agccctcaggctttgctgggcc

SEQ ID NO: 9415233 - DNA, 22 bp, Homo sapiens
agccctcaggctttgctgggcc

SEQ ID NO: 9415234 - DNA, 22 bp, Homo sapiens
agccctcatggaacagctccta

SEQ ID NO: 9415235 - DNA, 22 bp, Homo sapiens
agcccggcttccccggttgcta

SEQ ID NO: 9415236 - DNA, 22 bp, Homo sapiens
agcccggcttccccggttgcta

SEQ ID NO: 9415237 - DNA, 22 bp, Homo sapiens
agcccggcttccccggttgcta

SEQ ID NO: 9415238 - DNA, 22 bp, Homo sapiens
agcccggcttccccggttgcta

SEQ ID NO: 9415239 - DNA, 22 bp, Homo sapiens
agccctaaattatctttatttt

SEQ ID NO: 9415240 - DNA, 22 bp, Homo sapiens
agccctagagaaccagcctgtg

SEQ ID NO: 9415241 - DNA, 22 bp, Homo sapiens
agccctagagctggaggtcagt

SEQ ID NO: 9415242 - DNA, 22 bp, Homo sapiens
agccctaaattatctttatttt

SEQ ID NO: 9415243 - DNA, 22 bp, Homo sapiens
agcccggcttccccggttgcta

SEQ ID NO: 9415244 - DNA, 22 bp, Homo sapiens
agcccggcttccccggttgcta

SEQ ID NO: 9415245 - DNA, 22 bp, Homo sapiens
agcccgcatctcgctaaagata

SEQ ID NO: 9415246 - DNA, 22 bp, Homo sapiens
agcccgcatctcgctaaagata

SEQ ID NO: 9415247 - DNA, 22 bp, Homo sapiens
cagagctggagggaaccctggc

SEQ ID NO: 9415248 - DNA, 22 bp, Homo sapiens
cagagctggagggaaccctggc

SEQ ID NO: 9415249 - DNA, 23 bp, Homo sapiens
cagagctggctcagagctgcctg

SEQ ID NO: 9415250 - DNA, 22 bp, Homo sapiens
cagagctggcggtgagaagaca

SEQ ID NO: 9415251 - DNA, 22 bp, Homo sapiens
cagagctggcctgtgatttttg

SEQ ID NO: 9415252 - DNA, 19 bp, Homo sapiens
agcccccagacagcaggcc

SEQ ID NO: 9415253 - DNA, 19 bp, Homo sapiens
agcccccagacagcaggcc

SEQ ID NO: 9415254 - DNA, 19 bp, Homo sapiens
agcccccagacagcaggcc

SEQ ID NO: 9415255 - DNA, 22 bp, Homo sapiens
agcccctgtttttccagtcaga

SEQ ID NO: 9415256 - DNA, 19 bp, Homo sapiens
agcccccagacagcaggcc

SEQ ID NO: 9415257 - DNA, 23 bp, Homo sapiens
cagagctggctcagagctgcctg

SEQ ID NO: 9415258 - DNA, 22 bp, Homo sapiens
cagacagagctcacaagtcttt

SEQ ID NO: 9415259 - DNA, 22 bp, Homo sapiens
cagacagagctcacaagtcttt

SEQ ID NO: 9415260 - DNA, 22 bp, Homo sapiens
cagacagacctgcaagggcaca

SEQ ID NO: 9415261 - DNA, 22 bp, Homo sapiens
cagacagctgctttcttgctgt

SEQ ID NO: 9415262 - DNA, 22 bp, Homo sapiens
cagacagcaaatctgcttgcat

SEQ ID NO: 9415263 - DNA, 22 bp, Homo sapiens
cagacagagtcttcccatcagt

SEQ ID NO: 9415264 - DNA, 22 bp, Homo sapiens
cagacagagtcttcccatcagt

SEQ ID NO: 9415265 - DNA, 17 bp, Homo sapiens
cagacagatatcctggg

SEQ ID NO: 9415266 - DNA, 22 bp, Homo sapiens
agccaggtactcttgtgaccat

SEQ ID NO: 9415267 - DNA, 17 bp, Homo sapiens
agccaggtacaagtcca

SEQ ID NO: 9415268 - DNA, 22 bp, Homo sapiens
agccaggtcagctcaccctgct

SEQ ID NO: 9415269 - DNA, 22 bp, Homo sapiens
agccaggtcaggaaaggtccca

SEQ ID NO: 9415270 - DNA, 22 bp, Homo sapiens
agccaggtctaaggacatcagg

SEQ ID NO: 9415271 - DNA, 22 bp, Homo sapiens
agccaggtgcagtggcacacac

SEQ ID NO: 9415272 - DNA, 22 bp, Homo sapiens
agccaggttaaaccacagtcaa

SEQ ID NO: 9415273 - DNA, 22 bp, Homo sapiens
agccaggttgggccttttcttt

SEQ ID NO: 9415274 - DNA, 22 bp, Homo sapiens
agccaggtttctttagctgtca

SEQ ID NO: 9415275 - DNA, 22 bp, Homo sapiens
agccaggttaaaccacagtcaa

SEQ ID NO: 9415276 - DNA, 22 bp, Homo sapiens
agccaggttaaaccacagtcaa

SEQ ID NO: 9415277 - DNA, 22 bp, Homo sapiens
agccaggggattcatcagggac

SEQ ID NO: 9415278 - DNA, 22 bp, Homo sapiens
agccagggtgggtgaatgctat

SEQ ID NO: 9415279 - DNA, 20 bp, Homo sapiens
agccagggttctggatgcac

SEQ ID NO: 9415280 - DNA, 20 bp, Homo sapiens
agccagggttctggatgcac

SEQ ID NO: 9415281 - DNA, 20 bp, Homo sapiens
agccagggttctggatgcac

SEQ ID NO: 9415282 - DNA, 20 bp, Homo sapiens
agccagggttctggatgcac

SEQ ID NO: 9415283 - DNA, 22 bp, Homo sapiens
agccagtcggggccatgctggg

SEQ ID NO: 9415284 - DNA, 22 bp, Homo sapiens
agccagtactgtgcaaggataa

SEQ ID NO: 9415285 - DNA, 22 bp, Homo sapiens
agccagtagatcgggaggatgt

SEQ ID NO: 9415286 - DNA, 22 bp, Homo sapiens
agccagtagatcgggaggatgt

SEQ ID NO: 9415287 - DNA, 19 bp, Homo sapiens
agccagtgagcctctgggt

SEQ ID NO: 9415288 - DNA, 22 bp, Homo sapiens
cagagagggagcagtagtctct

SEQ ID NO: 9415289 - DNA, 22 bp, Homo sapiens
cagagagggagcagtagtctct

SEQ ID NO: 9415290 - DNA, 22 bp, Homo sapiens
cagagagggagcagtagtctct

SEQ ID NO: 9415291 - DNA, 22 bp, Homo sapiens
agccagtgatgaagactctgga

SEQ ID NO: 9415292 - DNA, 22 bp, Homo sapiens
cagagagggcggccctggcttc

SEQ ID NO: 9415293 - DNA, 22 bp, Homo sapiens
cagagagggcggccctggcttc

SEQ ID NO: 9415294 - DNA, 22 bp, Homo sapiens
cagagagggcggccctggcttc

SEQ ID NO: 9415295 - DNA, 22 bp, Homo sapiens
cagagagggcggccctggcttc

SEQ ID NO: 9415296 - DNA, 22 bp, Homo sapiens
cagagagtggcagttactgaag

SEQ ID NO: 9415297 - DNA, 22 bp, Homo sapiens
cagagagtggcagttactgaag

SEQ ID NO: 9415298 - DNA, 22 bp, Homo sapiens
cagagatggggccagctgctcc

SEQ ID NO: 9415299 - DNA, 22 bp, Homo sapiens
cagagatggcggctgttgtgtt

SEQ ID NO: 9415300 - DNA, 22 bp, Homo sapiens
agcccagccggattcccagttc

SEQ ID NO: 9415301 - DNA, 22 bp, Homo sapiens
cagagatgggtcgcagagatgg

SEQ ID NO: 9415302 - DNA, 22 bp, Homo sapiens
cagagatggggccagctgctcc

SEQ ID NO: 9415303 - DNA, 22 bp, Homo sapiens
cagagatgggtcgcagagatgg

SEQ ID NO: 9415304 - DNA, 22 bp, Homo sapiens
cagagatgtgatccagctgtct

SEQ ID NO: 9415305 - DNA, 22 bp, Homo sapiens
cagaaccaggaactgatggaga

SEQ ID NO: 9415306 - DNA, 22 bp, Homo sapiens
cagaacctgagagcacaatcct

SEQ ID NO: 9415307 - DNA, 22 bp, Homo sapiens
cagaactgggcagggagcagag

SEQ ID NO: 9415308 - DNA, 22 bp, Homo sapiens
agccacagcctgacttaactgt

SEQ ID NO: 9415309 - DNA, 22 bp, Homo sapiens
agccacagcgaacctctcttcc

SEQ ID NO: 9415310 - DNA, 22 bp, Homo sapiens
agccacagcctgacttaactgt

SEQ ID NO: 9415311 - DNA, 22 bp, Homo sapiens
agccacagctccttggtggaga

SEQ ID NO: 9415312 - DNA, 22 bp, Homo sapiens
agccacagctccttggtggaga

SEQ ID NO: 9415313 - DNA, 22 bp, Homo sapiens
agccacagctccttggtggaga

SEQ ID NO: 9415314 - DNA, 23 bp, Homo sapiens
cagaaatctgaaatctagaaatg

SEQ ID NO: 9415315 - DNA, 23 bp, Homo sapiens
cagaaatctgaaatctagaaatg

SEQ ID NO: 9415316 - DNA, 22 bp, Homo sapiens
cagaaatgacaaagtaagagga

SEQ ID NO: 9415317 - DNA, 22 bp, Homo sapiens
cagaaatgacaaagtaagagga

SEQ ID NO: 9415318 - DNA, 22 bp, Homo sapiens
agccacagcacattgtaagaaa

SEQ ID NO: 9415319 - DNA, 22 bp, Homo sapiens
agccacagcacattgtaagaaa

SEQ ID NO: 9415320 - DNA, 23 bp, Homo sapiens
agccacagccagagctatctcca

SEQ ID NO: 9415321 - DNA, 22 bp, Homo sapiens
agccacagcatgtgtgtatgta

SEQ ID NO: 9415322 - DNA, 22 bp, Homo sapiens
agccacagcccacaggactctt

SEQ ID NO: 9415323 - DNA, 22 bp, Homo sapiens
cactgaaaggaaaccagagcat

SEQ ID NO: 9415324 - DNA, 22 bp, Homo sapiens
cactgaaacaggtattgctggt

SEQ ID NO: 9415325 - DNA, 22 bp, Homo sapiens
agccacacctgtcctgccagct

SEQ ID NO: 9415326 - DNA, 22 bp, Homo sapiens
agccacacctgtcctgccagct

SEQ ID NO: 9415327 - DNA, 22 bp, Homo sapiens
agccaaggacacggagcctcct

SEQ ID NO: 9415328 - DNA, 22 bp, Homo sapiens
agccacaaaggcttgcctcgga

SEQ ID NO: 9415329 - DNA, 22 bp, Homo sapiens
agccaaggaaagccctttgctg

SEQ ID NO: 9415330 - DNA, 21 bp, Homo sapiens
agccaagccttgggagccagg

SEQ ID NO: 9415331 - DNA, 22 bp, Homo sapiens
agccacagagcaggagaccttt

SEQ ID NO: 9415332 - DNA, 22 bp, Homo sapiens
agccacagagagggagctgcaa

SEQ ID NO: 9415333 - DNA, 22 bp, Homo sapiens
agccacagagagggagctgcaa

SEQ ID NO: 9415334 - DNA, 22 bp, Homo sapiens
agccacagaggttgatgtggtt

SEQ ID NO: 9415335 - DNA, 22 bp, Homo sapiens
agccacagagcaggagaccttt

SEQ ID NO: 9415336 - DNA, 19 bp, Homo sapiens
agccacagaacttgcagga

SEQ ID NO: 9415337 - DNA, 19 bp, Homo sapiens
agccacagaacttgcagga

SEQ ID NO: 9415338 - DNA, 19 bp, Homo sapiens
agccacagaacttgcagga

SEQ ID NO: 9415339 - DNA, 19 bp, Homo sapiens
agccacagaacttgcagga

SEQ ID NO: 9415340 - DNA, 22 bp, Homo sapiens
agccacagagagggagctgcaa

SEQ ID NO: 9415341 - DNA, 22 bp, Homo sapiens
agccacagagagggagctgcaa

SEQ ID NO: 9415342 - DNA, 22 bp, Homo sapiens
cagaagaaagtggggagacaag

SEQ ID NO: 9415343 - DNA, 22 bp, Homo sapiens
cagaacttcatattgacgttag

SEQ ID NO: 9415344 - DNA, 22 bp, Homo sapiens
cagaactgggctcgctctggtt

SEQ ID NO: 9415345 - DNA, 22 bp, Homo sapiens
cagaactgggctcgctctggtt

SEQ ID NO: 9415346 - DNA, 22 bp, Homo sapiens
cagaactgttataacagctgtt

SEQ ID NO: 9415347 - DNA, 22 bp, Homo sapiens
cagaagaaagtggggagacaag

SEQ ID NO: 9415348 - DNA, 22 bp, Homo sapiens
cagaagaaagtggggagacaag

SEQ ID NO: 9415349 - DNA, 22 bp, Homo sapiens
cagaagaaagtggggagacaag

SEQ ID NO: 9415350 - DNA, 22 bp, Homo sapiens
cagaagaaatcattatctggac

SEQ ID NO: 9415351 - DNA, 22 bp, Homo sapiens
cagaagaatggtgtctgagctc

SEQ ID NO: 9415352 - DNA, 22 bp, Homo sapiens
cagaagaaatcattatctggac

SEQ ID NO: 9415353 - DNA, 22 bp, Homo sapiens
cagaagaatggtgtctgagctc

SEQ ID NO: 9415354 - DNA, 22 bp, Homo sapiens
cagaagagatgaaatagtatta

SEQ ID NO: 9415355 - DNA, 22 bp, Homo sapiens
cagaagcagtgagagatgtgca

SEQ ID NO: 9415356 - DNA, 22 bp, Homo sapiens
cagaagagatgaaatagtatta

SEQ ID NO: 9415357 - DNA, 22 bp, Homo sapiens
cagaagagatgaaatagtatta

SEQ ID NO: 9415358 - DNA, 22 bp, Homo sapiens
cagaagagatgaaatagtatta

SEQ ID NO: 9415359 - DNA, 22 bp, Homo sapiens
cagaagcattgactccttgctc

SEQ ID NO: 9415360 - DNA, 19 bp, Homo sapiens
cagaagctgcagtcggata

SEQ ID NO: 9415361 - DNA, 22 bp, Homo sapiens
cagaagctgaggagtgaggcaa

SEQ ID NO: 9415362 - DNA, 22 bp, Homo sapiens
cagaagcctaaatagtgcacca

SEQ ID NO: 9415363 - DNA, 22 bp, Homo sapiens
cagaagcattgactccttgctc

SEQ ID NO: 9415364 - DNA, 22 bp, Homo sapiens
cagaagcattgactccttgctc

SEQ ID NO: 9415365 - DNA, 22 bp, Homo sapiens
cagaagcattccagcaaatagt

SEQ ID NO: 9415366 - DNA, 22 bp, Homo sapiens
cagaagcattccagcaaatagt

SEQ ID NO: 9415367 - DNA, 21 bp, Homo sapiens
agccaggcaagcacccccact

SEQ ID NO: 9415368 - DNA, 21 bp, Homo sapiens
agccaggcaagcacccccact

SEQ ID NO: 9415369 - DNA, 22 bp, Homo sapiens
agccaggcagactctctttctt

SEQ ID NO: 9415370 - DNA, 22 bp, Homo sapiens
agccaggcagactctctttctt

SEQ ID NO: 9415371 - DNA, 21 bp, Homo sapiens
agccaggcaagcacccccact

SEQ ID NO: 9415372 - DNA, 22 bp, Homo sapiens
agccaggcagggctctcgctct

SEQ ID NO: 9415373 - DNA, 22 bp, Homo sapiens
cagacagaaggctccttgaggt

SEQ ID NO: 9415374 - DNA, 22 bp, Homo sapiens
agccaggcagggctctcgctct

SEQ ID NO: 9415375 - DNA, 22 bp, Homo sapiens
agccaggcagactctctttctt

SEQ ID NO: 9415376 - DNA, 17 bp, Homo sapiens
cagaaggaagcatggca

SEQ ID NO: 9415377 - DNA, 17 bp, Homo sapiens
cagaaggaagcatggca

SEQ ID NO: 9415378 - DNA, 22 bp, Homo sapiens
agccagctctgagttgaagtac

SEQ ID NO: 9415379 - DNA, 22 bp, Homo sapiens
agccagctccctcccctgcagg

SEQ ID NO: 9415380 - DNA, 22 bp, Homo sapiens
agccagctccctcccctgcagg

SEQ ID NO: 9415381 - DNA, 22 bp, Homo sapiens
agccaggacatctctagctgct

SEQ ID NO: 9415382 - DNA, 22 bp, Homo sapiens
agccaggatcacccggggctgt

SEQ ID NO: 9415383 - DNA, 22 bp, Homo sapiens
agccaggatggtctcgatcggc

SEQ ID NO: 9415384 - DNA, 22 bp, Homo sapiens
agccaggatggtctcgatcggc

SEQ ID NO: 9415385 - DNA, 22 bp, Homo sapiens
cacatcttcttaactccaaagt

SEQ ID NO: 9415386 - DNA, 22 bp, Homo sapiens
cacatcttccagagtagctaaa

SEQ ID NO: 9415387 - DNA, 23 bp, Homo sapiens
agcaggtaggttgaaattttcct

SEQ ID NO: 9415388 - DNA, 22 bp, Homo sapiens
cacatctgacttccagtgcagg

SEQ ID NO: 9415389 - DNA, 22 bp, Homo sapiens
cacatctgacttccagtgcagg

SEQ ID NO: 9415390 - DNA, 22 bp, Homo sapiens
cacatctgacttccagtgcagg

SEQ ID NO: 9415391 - DNA, 22 bp, Homo sapiens
cacatctgaaaagatgcacaag

SEQ ID NO: 9415392 - DNA, 22 bp, Homo sapiens
cacatctgctctgggcagcact

SEQ ID NO: 9415393 - DNA, 22 bp, Homo sapiens
agcaggtgatgtgagtctggaa

SEQ ID NO: 9415394 - DNA, 22 bp, Homo sapiens
agcaggtgatgtgagtctggaa

SEQ ID NO: 9415395 - DNA, 22 bp, Homo sapiens
agcaggtgcatggcgagcgcgg

SEQ ID NO: 9415396 - DNA, 22 bp, Homo sapiens
agcaggtgatgtgagtctggaa

SEQ ID NO: 9415397 - DNA, 22 bp, Homo sapiens
agcaggtgatcgcgtgtgctcc

SEQ ID NO: 9415398 - DNA, 22 bp, Homo sapiens
agcaggtgatcgcgtgtgctcc

SEQ ID NO: 9415399 - DNA, 22 bp, Homo sapiens
agcaggtgatcgcgtgtgctcc

SEQ ID NO: 9415400 - DNA, 22 bp, Homo sapiens
cacatatttgatgaagctttgt

SEQ ID NO: 9415401 - DNA, 22 bp, Homo sapiens
cacatcaagcatccatgagttt

SEQ ID NO: 9415402 - DNA, 22 bp, Homo sapiens
cacatccttcatactcagctct

SEQ ID NO: 9415403 - DNA, 22 bp, Homo sapiens
cacatccttcatactcagctct

SEQ ID NO: 9415404 - DNA, 22 bp, Homo sapiens
cacatccttcagctgagcccag

SEQ ID NO: 9415405 - DNA, 22 bp, Homo sapiens
cacatcctgtgtaaacttggtg

SEQ ID NO: 9415406 - DNA, 22 bp, Homo sapiens
cacatcctgtgtaaacttggtg

SEQ ID NO: 9415407 - DNA, 22 bp, Homo sapiens
cacatctcagggctacaggcag

SEQ ID NO: 9415408 - DNA, 22 bp, Homo sapiens
cacatctactgatattccagga

SEQ ID NO: 9415409 - DNA, 22 bp, Homo sapiens
cacagtcaccttatcaggatgt

SEQ ID NO: 9415410 - DNA, 22 bp, Homo sapiens
cacagtcaccttatcaggatgt

SEQ ID NO: 9415411 - DNA, 23 bp, Homo sapiens
cacagtcatttactttgccatca

SEQ ID NO: 9415412 - DNA, 23 bp, Homo sapiens
cacagtcatttactttgccatca

SEQ ID NO: 9415413 - DNA, 22 bp, Homo sapiens
cacagtcacatatctatgtgtg

SEQ ID NO: 9415414 - DNA, 22 bp, Homo sapiens
cacagtcacatatctatgtgtg

SEQ ID NO: 9415415 - DNA, 22 bp, Homo sapiens
cacagtcacatatctatgtgtg

SEQ ID NO: 9415416 - DNA, 22 bp, Homo sapiens
cacagtcaatgtagaaatatga

SEQ ID NO: 9415417 - DNA, 22 bp, Homo sapiens
cacagtcaatgtagaaatatga

SEQ ID NO: 9415418 - DNA, 22 bp, Homo sapiens
cacagtatttgtttttctgagt

SEQ ID NO: 9415419 - DNA, 22 bp, Homo sapiens
agcagggcagtgatcagaaagg

SEQ ID NO: 9415420 - DNA, 22 bp, Homo sapiens
agcagggcctctggcactggtc

SEQ ID NO: 9415421 - DNA, 22 bp, Homo sapiens
agcagggcctctggcactggtc

SEQ ID NO: 9415422 - DNA, 22 bp, Homo sapiens
agcagggcagtgcttcagctct

SEQ ID NO: 9415423 - DNA, 22 bp, Homo sapiens
agcagggcctctggcactggtc

SEQ ID NO: 9415424 - DNA, 22 bp, Homo sapiens
agcagggctctgccatgggccc

SEQ ID NO: 9415425 - DNA, 22 bp, Homo sapiens
agcagggctcctgaaagccgcg

SEQ ID NO: 9415426 - DNA, 22 bp, Homo sapiens
agcagggctccatttcactgcc

SEQ ID NO: 9415427 - DNA, 22 bp, Homo sapiens
agcagggcctgagtgacctaac

SEQ ID NO: 9415428 - DNA, 22 bp, Homo sapiens
agcagggcctggcactcctggg

SEQ ID NO: 9415429 - DNA, 22 bp, Homo sapiens
agcagggcctggcactcctggg

SEQ ID NO: 9415430 - DNA, 16 bp, Homo sapiens
agcagggcgggaagga

SEQ ID NO: 9415431 - DNA, 16 bp, Homo sapiens
agcagggcgggaagga

SEQ ID NO: 9415432 - DNA, 23 bp, Homo sapiens
agcataaacctctgtggctttag

SEQ ID NO: 9415433 - DNA, 22 bp, Homo sapiens
agcataaaataaatagtttgca

SEQ ID NO: 9415434 - DNA, 22 bp, Homo sapiens
agcagtttttataacactggaa

SEQ ID NO: 9415435 - DNA, 22 bp, Homo sapiens
agcataaaataaatagtttgca

SEQ ID NO: 9415436 - DNA, 22 bp, Homo sapiens
agcagttttcctgagctcctca

SEQ ID NO: 9415437 - DNA, 22 bp, Homo sapiens
agcataaaggcactagaaagag

SEQ ID NO: 9415438 - DNA, 22 bp, Homo sapiens
agcataaactcagggacacaca

SEQ ID NO: 9415439 - DNA, 22 bp, Homo sapiens
agcataaaggacatttgtcact

SEQ ID NO: 9415440 - DNA, 22 bp, Homo sapiens
agcataaaggcactagaaagag

SEQ ID NO: 9415441 - DNA, 22 bp, Homo sapiens
agcagtttggcccgagcagttc

SEQ ID NO: 9415442 - DNA, 22 bp, Homo sapiens
agcagttttagggagacacatt

SEQ ID NO: 9415443 - DNA, 22 bp, Homo sapiens
agcagtttggcccgagcagttc

SEQ ID NO: 9415444 - DNA, 22 bp, Homo sapiens
agcagtttggaaaatactagaa

SEQ ID NO: 9415445 - DNA, 22 bp, Homo sapiens
agcagttttatgcgattgtttc

SEQ ID NO: 9415446 - DNA, 20 bp, Homo sapiens
agcagtttcctaactcagct

SEQ ID NO: 9415447 - DNA, 22 bp, Homo sapiens
agcagtttccacaacctcccct

SEQ ID NO: 9415448 - DNA, 20 bp, Homo sapiens
agcagtttcctaactcagct

SEQ ID NO: 9415449 - DNA, 22 bp, Homo sapiens
agcagtttggaaaatactagaa

SEQ ID NO: 9415450 - DNA, 22 bp, Homo sapiens
agcagtttgaatcaatggccag

SEQ ID NO: 9415451 - DNA, 22 bp, Homo sapiens
agcagtttctcttgtatcttca

SEQ ID NO: 9415452 - DNA, 22 bp, Homo sapiens
agcagtttgaatcaatggccag

SEQ ID NO: 9415453 - DNA, 20 bp, Homo sapiens
cactctgagggagtccatgt

SEQ ID NO: 9415454 - DNA, 22 bp, Homo sapiens
cactctgatggtttctgttcaa

SEQ ID NO: 9415455 - DNA, 22 bp, Homo sapiens
cactctgatggtttctgttcaa

SEQ ID NO: 9415456 - DNA, 22 bp, Homo sapiens
cactctgatggtttctgttcaa

SEQ ID NO: 9415457 - DNA, 22 bp, Homo sapiens
cactctgctgaaatcgccttgt

SEQ ID NO: 9415458 - DNA, 22 bp, Homo sapiens
cactctggttagtttaagcatg

SEQ ID NO: 9415459 - DNA, 22 bp, Homo sapiens
cactctggttctgaacaggatc

SEQ ID NO: 9415460 - DNA, 22 bp, Homo sapiens
cactctgggggctgccgctgcc

SEQ ID NO: 9415461 - DNA, 22 bp, Homo sapiens
cactctgggctcttgtttcaga

SEQ ID NO: 9415462 - DNA, 22 bp, Homo sapiens
agcataaaggtcaacgttttag

SEQ ID NO: 9415463 - DNA, 22 bp, Homo sapiens
agcataagttggtacagccact

SEQ ID NO: 9415464 - DNA, 22 bp, Homo sapiens
caccaggtgctggaggacatca

SEQ ID NO: 9415465 - DNA, 22 bp, Homo sapiens
caccagggctctgagctctgaa

SEQ ID NO: 9415466 - DNA, 22 bp, Homo sapiens
caccagggctctgagctctgaa

SEQ ID NO: 9415467 - DNA, 22 bp, Homo sapiens
caccagggctctgagctctgaa

SEQ ID NO: 9415468 - DNA, 22 bp, Homo sapiens
caccagggccccaggctgtgcc

SEQ ID NO: 9415469 - DNA, 22 bp, Homo sapiens
caccagggcagcagcctagtct

SEQ ID NO: 9415470 - DNA, 22 bp, Homo sapiens
caccagggcagcagcctagtct

SEQ ID NO: 9415471 - DNA, 22 bp, Homo sapiens
agcagttgtagtcatggaaaat

SEQ ID NO: 9415472 - DNA, 22 bp, Homo sapiens
agcagttgtagtcatggaaaat

SEQ ID NO: 9415473 - DNA, 22 bp, Homo sapiens
agcagttcataaacattttgag

SEQ ID NO: 9415474 - DNA, 22 bp, Homo sapiens
agcagttgagtgggaatcaggc

SEQ ID NO: 9415475 - DNA, 22 bp, Homo sapiens
agcagtttagctatactgcttg

SEQ ID NO: 9415476 - DNA, 22 bp, Homo sapiens
agcagtttatcctcataatgga

SEQ ID NO: 9415477 - DNA, 22 bp, Homo sapiens
agcagtttagctatactgcttg

SEQ ID NO: 9415478 - DNA, 22 bp, Homo sapiens
agcagtggcctggggctctgtg

SEQ ID NO: 9415479 - DNA, 22 bp, Homo sapiens
caccagggcagcagcctagtct

SEQ ID NO: 9415480 - DNA, 22 bp, Homo sapiens
caccagggacaatgctaggggt

SEQ ID NO: 9415481 - DNA, 22 bp, Homo sapiens
caccaggctggagtgcagtggc

SEQ ID NO: 9415482 - DNA, 22 bp, Homo sapiens
caccagggacaatgctaggggt

SEQ ID NO: 9415483 - DNA, 22 bp, Homo sapiens
caccaggctggagtgcagtggc

SEQ ID NO: 9415484 - DNA, 22 bp, Homo sapiens
caccagggacaatgctaggggt

SEQ ID NO: 9415485 - DNA, 22 bp, Homo sapiens
agcaggtggacagaggaagaaa

SEQ ID NO: 9415486 - DNA, 22 bp, Homo sapiens
agcaggtggacagaggaagaaa

SEQ ID NO: 9415487 - DNA, 22 bp, Homo sapiens
agcaggtgccaggtgtacccgc

SEQ ID NO: 9415488 - DNA, 22 bp, Homo sapiens
agcaggtgccaggtgtacccgc

SEQ ID NO: 9415489 - DNA, 21 bp, Homo sapiens
agcaggtgctgttggaggaaa

SEQ ID NO: 9415490 - DNA, 21 bp, Homo sapiens
agcaggtgctgttggaggaaa

SEQ ID NO: 9415491 - DNA, 21 bp, Homo sapiens
agcaggtgctgttggaggaaa

SEQ ID NO: 9415492 - DNA, 21 bp, Homo sapiens
agcaggtgctgttggaggaaa

SEQ ID NO: 9415493 - DNA, 21 bp, Homo sapiens
agcaggtgctgttggaggaaa

SEQ ID NO: 9415494 - DNA, 22 bp, Homo sapiens
cacagtatgatctaaagtaagt

SEQ ID NO: 9415495 - DNA, 22 bp, Homo sapiens
cacagtatgatctaaagtaagt

SEQ ID NO: 9415496 - DNA, 22 bp, Homo sapiens
cacagtacttaattctctaaat

SEQ ID NO: 9415497 - DNA, 22 bp, Homo sapiens
cacagtagccatgtctcaagta

SEQ ID NO: 9415498 - DNA, 22 bp, Homo sapiens
cacagggcttctcatggggtgc

SEQ ID NO: 9415499 - DNA, 22 bp, Homo sapiens
cacagggctttgatggctgagt

SEQ ID NO: 9415500 - DNA, 22 bp, Homo sapiens
cacagggctaaatgaagggttg

SEQ ID NO: 9415501 - DNA, 22 bp, Homo sapiens
cacagggcttctcatggggtgc

SEQ ID NO: 9415502 - DNA, 22 bp, Homo sapiens
cacagggctaaatgaagggttg

SEQ ID NO: 9415503 - DNA, 22 bp, Homo sapiens
cacagggccttgtgtgactgca

SEQ ID NO: 9415504 - DNA, 22 bp, Homo sapiens
cacagggctaaatgaagggttg

SEQ ID NO: 9415505 - DNA, 22 bp, Homo sapiens
cacagggcagtgattgtccaca

SEQ ID NO: 9415506 - DNA, 22 bp, Homo sapiens
cacagggcagtgattgtccaca

SEQ ID NO: 9415507 - DNA, 22 bp, Homo sapiens
cacagggcagtgctgcccactc

SEQ ID NO: 9415508 - DNA, 22 bp, Homo sapiens
cacagggcagtgctgcccactc

SEQ ID NO: 9415509 - DNA, 22 bp, Homo sapiens
cacagggcagtgctgcccactc

SEQ ID NO: 9415510 - DNA, 19 bp, Homo sapiens
cacagggcaggtctcatgt

SEQ ID NO: 9415511 - DNA, 22 bp, Homo sapiens
cacaggctgcccgcagctggga

SEQ ID NO: 9415512 - DNA, 22 bp, Homo sapiens
cacaggctgcccgcagctggga

SEQ ID NO: 9415513 - DNA, 22 bp, Homo sapiens
cacagggccttgtgtgactgca

SEQ ID NO: 9415514 - DNA, 22 bp, Homo sapiens
cacagggcctggggcagctgct

SEQ ID NO: 9415515 - DNA, 22 bp, Homo sapiens
cacagggccactttcccagtaa

SEQ ID NO: 9415516 - DNA, 22 bp, Homo sapiens
cacagggcagtgctgcccactc

SEQ ID NO: 9415517 - DNA, 22 bp, Homo sapiens
cacaggaggaggccagagcgta

SEQ ID NO: 9415518 - DNA, 22 bp, Homo sapiens
cacaggaggaggtgcccgggcc

SEQ ID NO: 9415519 - DNA, 22 bp, Homo sapiens
cacaggaggaggccagagcgta

SEQ ID NO: 9415520 - DNA, 22 bp, Homo sapiens
cacaggaggcaatggtaagatt

SEQ ID NO: 9415521 - DNA, 22 bp, Homo sapiens
cacaggaggaggtgcccgggcc

SEQ ID NO: 9415522 - DNA, 22 bp, Homo sapiens
agcaggagaacactgtggctct

SEQ ID NO: 9415523 - DNA, 22 bp, Homo sapiens
agcaggagaacactgtggctct

SEQ ID NO: 9415524 - DNA, 22 bp, Homo sapiens
cacaggagggagcgggcagcca

SEQ ID NO: 9415525 - DNA, 22 bp, Homo sapiens
cacaggagggagcgggcagcca

SEQ ID NO: 9415526 - DNA, 22 bp, Homo sapiens
agcaggagcatttccatgattc

SEQ ID NO: 9415527 - DNA, 22 bp, Homo sapiens
agcaggagatggggcgtgatgt

SEQ ID NO: 9415528 - DNA, 22 bp, Homo sapiens
agcaggagagcagtgcgtggtc

SEQ ID NO: 9415529 - DNA, 22 bp, Homo sapiens
agcaggagagcagtgcgtggtc

SEQ ID NO: 9415530 - DNA, 22 bp, Homo sapiens
agcaggagagcagtgcgtggtc

SEQ ID NO: 9415531 - DNA, 22 bp, Homo sapiens
agcaggagatggggcgtgatgt

SEQ ID NO: 9415532 - DNA, 22 bp, Homo sapiens
agcaggagatggggcgtgatgt

SEQ ID NO: 9415533 - DNA, 22 bp, Homo sapiens
agcaggagatggggcgtgatgt

SEQ ID NO: 9415534 - DNA, 22 bp, Homo sapiens
agcaggagacatgggggtggtg

SEQ ID NO: 9415535 - DNA, 22 bp, Homo sapiens
agcaggagaacactgtggctct

SEQ ID NO: 9415536 - DNA, 22 bp, Homo sapiens
agcaggagaacactgtggctct

SEQ ID NO: 9415537 - DNA, 22 bp, Homo sapiens
agcaggagacatgggggtggtg

SEQ ID NO: 9415538 - DNA, 22 bp, Homo sapiens
agcaggagagcagtgcgtggtc

SEQ ID NO: 9415539 - DNA, 22 bp, Homo sapiens
agcaggagacatgggggtggtg

SEQ ID NO: 9415540 - DNA, 22 bp, Homo sapiens
agcaggagagcagtgcgtggtc

SEQ ID NO: 9415541 - DNA, 22 bp, Homo sapiens
agcagctgtcccttaacatcag

SEQ ID NO: 9415542 - DNA, 22 bp, Homo sapiens
agcagctgtcccttaacatcag

SEQ ID NO: 9415543 - DNA, 18 bp, Homo sapiens
agcagctgtcagaatgcc

SEQ ID NO: 9415544 - DNA, 18 bp, Homo sapiens
agcagctgtcagaatgcc

SEQ ID NO: 9415545 - DNA, 18 bp, Homo sapiens
agcagctgtcagaatgcc

SEQ ID NO: 9415546 - DNA, 18 bp, Homo sapiens
agcagctgtcagaatgcc

SEQ ID NO: 9415547 - DNA, 18 bp, Homo sapiens
agcagctgtcagaatgcc

SEQ ID NO: 9415548 - DNA, 19 bp, Homo sapiens
agcagctgtagatagacac

SEQ ID NO: 9415549 - DNA, 19 bp, Homo sapiens
agcagctgtagatagacac

SEQ ID NO: 9415550 - DNA, 23 bp, Homo sapiens
agcagctgtggagttttgcattt

SEQ ID NO: 9415551 - DNA, 23 bp, Homo sapiens
agcagctgtggagttttgcattt

SEQ ID NO: 9415552 - DNA, 22 bp, Homo sapiens
agcagctgtggaaaagtaacta

SEQ ID NO: 9415553 - DNA, 23 bp, Homo sapiens
agcagctgtggagttttgcattt

SEQ ID NO: 9415554 - DNA, 18 bp, Homo sapiens
agcagctgtgccacactg

SEQ ID NO: 9415555 - DNA, 18 bp, Homo sapiens
agcagctgtgccacactg

SEQ ID NO: 9415556 - DNA, 22 bp, Homo sapiens
agcagctgtactttcatctgtt

SEQ ID NO: 9415557 - DNA, 22 bp, Homo sapiens
agcagctgtactttcatctgtt

SEQ ID NO: 9415558 - DNA, 22 bp, Homo sapiens
agcagctgggctcagagctggg

SEQ ID NO: 9415559 - DNA, 21 bp, Homo sapiens
agcagctgggcaacatggagg

SEQ ID NO: 9415560 - DNA, 21 bp, Homo sapiens
agcagctgggcaacatggagg

SEQ ID NO: 9415561 - DNA, 22 bp, Homo sapiens
caatgacactctgcacagtgct

SEQ ID NO: 9415562 - DNA, 22 bp, Homo sapiens
caatgacaggttcatgactcct

SEQ ID NO: 9415563 - DNA, 22 bp, Homo sapiens
caatgacatctccctgctctaa

SEQ ID NO: 9415564 - DNA, 22 bp, Homo sapiens
caatgacaggttcatgactcct

SEQ ID NO: 9415565 - DNA, 22 bp, Homo sapiens
caatgacactctgcacagtgct

SEQ ID NO: 9415566 - DNA, 22 bp, Homo sapiens
caatgaacacagcaatttcata

SEQ ID NO: 9415567 - DNA, 22 bp, Homo sapiens
caatgaaattgagatccagaga

SEQ ID NO: 9415568 - DNA, 22 bp, Homo sapiens
caatgacatggataatcatatt

SEQ ID NO: 9415569 - DNA, 22 bp, Homo sapiens
caatgacatggataatcatatt

SEQ ID NO: 9415570 - DNA, 22 bp, Homo sapiens
caatgacatctccctgctctaa

SEQ ID NO: 9415571 - DNA, 22 bp, Homo sapiens
caatgacatggataatcatatt

SEQ ID NO: 9415572 - DNA, 19 bp, Homo sapiens
agcagcttaattttgtagc

SEQ ID NO: 9415573 - DNA, 22 bp, Homo sapiens
agcagctgtttgttgaattggt

SEQ ID NO: 9415574 - DNA, 22 bp, Homo sapiens
agcagcttacatgtggcctatc

SEQ ID NO: 9415575 - DNA, 22 bp, Homo sapiens
agcagctgttagaaacaggaag

SEQ ID NO: 9415576 - DNA, 22 bp, Homo sapiens
agcagctgtttgttgaattggt

SEQ ID NO: 9415577 - DNA, 22 bp, Homo sapiens
agcagctgtttgttgaattggt

SEQ ID NO: 9415578 - DNA, 22 bp, Homo sapiens
agcagctgtggggacaagggta

SEQ ID NO: 9415579 - DNA, 22 bp, Homo sapiens
agcagctgtggggacaagggta

SEQ ID NO: 9415580 - DNA, 22 bp, Homo sapiens
agcagctgtggggacaagggta

SEQ ID NO: 9415581 - DNA, 22 bp, Homo sapiens
agcagctgtgggcaatatgtaa

SEQ ID NO: 9415582 - DNA, 23 bp, Homo sapiens
agcagctgtggtttaccttagta

SEQ ID NO: 9415583 - DNA, 20 bp, Homo sapiens
agcagctgtgttttcatcct

SEQ ID NO: 9415584 - DNA, 18 bp, Homo sapiens
cacaggagccacactcac

SEQ ID NO: 9415585 - DNA, 22 bp, Homo sapiens
cacaggagccctgaggcctccc

SEQ ID NO: 9415586 - DNA, 22 bp, Homo sapiens
cacaggagccctgaggcctccc

SEQ ID NO: 9415587 - DNA, 22 bp, Homo sapiens
cacaggagccctgaggcctccc

SEQ ID NO: 9415588 - DNA, 22 bp, Homo sapiens
cacaggagctgtggggcagtgt

SEQ ID NO: 9415589 - DNA, 22 bp, Homo sapiens
cacaggaggaggccagagcgta

SEQ ID NO: 9415590 - DNA, 22 bp, Homo sapiens
agcagcttcctgctcttcgcct

SEQ ID NO: 9415591 - DNA, 22 bp, Homo sapiens
agcagcttcaattttctaagtg

SEQ ID NO: 9415592 - DNA, 22 bp, Homo sapiens
cacaggaagctgactgctggca

SEQ ID NO: 9415593 - DNA, 22 bp, Homo sapiens
agcagcttctattttcttggtt

SEQ ID NO: 9415594 - DNA, 22 bp, Homo sapiens
cacaggaagcaagcctggggcc

SEQ ID NO: 9415595 - DNA, 22 bp, Homo sapiens
cacaggaagctgactgctggca

SEQ ID NO: 9415596 - DNA, 21 bp, Homo sapiens
agcagacacttgtgaccttcc

SEQ ID NO: 9415597 - DNA, 22 bp, Homo sapiens
caactatatagaaattgattgt

SEQ ID NO: 9415598 - DNA, 22 bp, Homo sapiens
caactatatagaaattgattgt

SEQ ID NO: 9415599 - DNA, 22 bp, Homo sapiens
agcagacaccaggagtaaagaa

SEQ ID NO: 9415600 - DNA, 22 bp, Homo sapiens
agcagacaattgcctggatgga

SEQ ID NO: 9415601 - DNA, 22 bp, Homo sapiens
agcagaatctgtccttggaaga

SEQ ID NO: 9415602 - DNA, 22 bp, Homo sapiens
agcagaatctgtccttggaaga

SEQ ID NO: 9415603 - DNA, 22 bp, Homo sapiens
agcagacaacccagatgaccca

SEQ ID NO: 9415604 - DNA, 22 bp, Homo sapiens
caactgtcacagctgatctgtt

SEQ ID NO: 9415605 - DNA, 22 bp, Homo sapiens
caactgttataaatcaacagag

SEQ ID NO: 9415606 - DNA, 22 bp, Homo sapiens
caactgtaagctccttatgggg

SEQ ID NO: 9415607 - DNA, 22 bp, Homo sapiens
caactgtaatattggaagatca

SEQ ID NO: 9415608 - DNA, 22 bp, Homo sapiens
caactgagcagtagcgtctgga

SEQ ID NO: 9415609 - DNA, 22 bp, Homo sapiens
caactcctggctgttaggcaca

SEQ ID NO: 9415610 - DNA, 22 bp, Homo sapiens
caactcctccccagcatgccaa

SEQ ID NO: 9415611 - DNA, 18 bp, Homo sapiens
agcagcaatttgggatga

SEQ ID NO: 9415612 - DNA, 22 bp, Homo sapiens
agcagcacacgggagaaagaca

SEQ ID NO: 9415613 - DNA, 22 bp, Homo sapiens
agcagcaattttcactgtcaat

SEQ ID NO: 9415614 - DNA, 22 bp, Homo sapiens
agcagcaatggaaagcaacaca

SEQ ID NO: 9415615 - DNA, 22 bp, Homo sapiens
agcagcaatggaaagcaacaca

SEQ ID NO: 9415616 - DNA, 22 bp, Homo sapiens
agcagcaatggaaagcaacaca

SEQ ID NO: 9415617 - DNA, 22 bp, Homo sapiens
agcagcaagtgtaactgaatat

SEQ ID NO: 9415618 - DNA, 22 bp, Homo sapiens
agcagcaataataaagtaatac

SEQ ID NO: 9415619 - DNA, 22 bp, Homo sapiens
agcagcaaggaacagaatggac

SEQ ID NO: 9415620 - DNA, 22 bp, Homo sapiens
caacttcactgtgcctctagtt

SEQ ID NO: 9415621 - DNA, 22 bp, Homo sapiens
caacttcaccagggttcctaga

SEQ ID NO: 9415622 - DNA, 22 bp, Homo sapiens
agcagagtgccccatcacaagg

SEQ ID NO: 9415623 - DNA, 21 bp, Homo sapiens
agcagagtgctttgactttgt

SEQ ID NO: 9415624 - DNA, 22 bp, Homo sapiens
agcagcagaagggagacccagg

SEQ ID NO: 9415625 - DNA, 22 bp, Homo sapiens
agcagcagaagggagacccagg

SEQ ID NO: 9415626 - DNA, 22 bp, Homo sapiens
agcagcagaagggagacccagg

SEQ ID NO: 9415627 - DNA, 22 bp, Homo sapiens
caaggcaggcagttcacttgag

SEQ ID NO: 9415628 - DNA, 22 bp, Homo sapiens
agcagcacccagagccatgtct

SEQ ID NO: 9415629 - DNA, 22 bp, Homo sapiens
agcagcacatggggctggcaac

SEQ ID NO: 9415630 - DNA, 22 bp, Homo sapiens
agcagcacctgtcctcgctgct

SEQ ID NO: 9415631 - DNA, 22 bp, Homo sapiens
agcagcacctggctatctgatc

SEQ ID NO: 9415632 - DNA, 22 bp, Homo sapiens
agcagcacccagagccatgtct

SEQ ID NO: 9415633 - DNA, 22 bp, Homo sapiens
agcagcagaaagttgatggcag

SEQ ID NO: 9415634 - DNA, 22 bp, Homo sapiens
agcagcagaaagttgatggcag

SEQ ID NO: 9415635 - DNA, 22 bp, Homo sapiens
agcagcagaaagttgatggcag

SEQ ID NO: 9415636 - DNA, 22 bp, Homo sapiens
agcagcacgagtccacaaatcc

SEQ ID NO: 9415637 - DNA, 22 bp, Homo sapiens
caaggcagtccctactccctgc

SEQ ID NO: 9415638 - DNA, 22 bp, Homo sapiens
caaggcagtccctactccctgc

SEQ ID NO: 9415639 - DNA, 22 bp, Homo sapiens
caaggcagtccctactccctgc

SEQ ID NO: 9415640 - DNA, 22 bp, Homo sapiens
caaggcagtgggctaggaacct

SEQ ID NO: 9415641 - DNA, 22 bp, Homo sapiens
caaggcagtccctactccctgc

SEQ ID NO: 9415642 - DNA, 22 bp, Homo sapiens
caaggcagttccccagagggct

SEQ ID NO: 9415643 - DNA, 22 bp, Homo sapiens
caaggcagttccccagagggct

SEQ ID NO: 9415644 - DNA, 22 bp, Homo sapiens
caaggcaggccagtttcaaggc

SEQ ID NO: 9415645 - DNA, 22 bp, Homo sapiens
caaggcaggtctgaggaggttg

SEQ ID NO: 9415646 - DNA, 22 bp, Homo sapiens
caaggcaggtctgaggaggttg

SEQ ID NO: 9415647 - DNA, 22 bp, Homo sapiens
caaggcaggtctgaggaggttg

SEQ ID NO: 9415648 - DNA, 21 bp, Homo sapiens
agcagcatcagcctcacctga

SEQ ID NO: 9415649 - DNA, 22 bp, Homo sapiens
agcagcatattgtgtcttcata

SEQ ID NO: 9415650 - DNA, 22 bp, Homo sapiens
agcagcatattgtgtcttcata

SEQ ID NO: 9415651 - DNA, 22 bp, Homo sapiens
agcagcatcaaccctcccgtgt

SEQ ID NO: 9415652 - DNA, 22 bp, Homo sapiens
agcagcatatcagagaaagtca

SEQ ID NO: 9415653 - DNA, 22 bp, Homo sapiens
agcagcatagatgctatccgag

SEQ ID NO: 9415654 - DNA, 22 bp, Homo sapiens
agcagcatagaagctgggagga

SEQ ID NO: 9415655 - DNA, 22 bp, Homo sapiens
agcagcagggtgtaattgggca

SEQ ID NO: 9415656 - DNA, 22 bp, Homo sapiens
caaggcatgcacaagaaggggg

SEQ ID NO: 9415657 - DNA, 22 bp, Homo sapiens
caaggcatgcaatgtcttcagg

SEQ ID NO: 9415658 - DNA, 22 bp, Homo sapiens
caaggcatgtaacaatggcttt

SEQ ID NO: 9415659 - DNA, 22 bp, Homo sapiens
agcagcattatgatatatctta

SEQ ID NO: 9415660 - DNA, 22 bp, Homo sapiens
agcagcattcctggcttctatc

SEQ ID NO: 9415661 - DNA, 22 bp, Homo sapiens
agcagcatgttcattacattat

SEQ ID NO: 9415662 - DNA, 22 bp, Homo sapiens
agcagcatgttcattacattat

SEQ ID NO: 9415663 - DNA, 22 bp, Homo sapiens
agcagcatgttgggatgtgaaa

SEQ ID NO: 9415664 - DNA, 22 bp, Homo sapiens
agcagcatgatgacagagtctc

SEQ ID NO: 9415665 - DNA, 22 bp, Homo sapiens
agcagcatggctgactaaagac

SEQ ID NO: 9415666 - DNA, 22 bp, Homo sapiens
agcagcatgatgacagagtctc

SEQ ID NO: 9415667 - DNA, 22 bp, Homo sapiens
agcagcatcttctgttctccgc

SEQ ID NO: 9415668 - DNA, 22 bp, Homo sapiens
agcagcatctggttctgatgtg

SEQ ID NO: 9415669 - DNA, 22 bp, Homo sapiens
caatgaaattgagatccagaga

SEQ ID NO: 9415670 - DNA, 22 bp, Homo sapiens
caatgaaattgagatccagaga

SEQ ID NO: 9415671 - DNA, 22 bp, Homo sapiens
caatgaaaatttaagttgcagc

SEQ ID NO: 9415672 - DNA, 22 bp, Homo sapiens
caatgaaaatttaagttgcagc

SEQ ID NO: 9415673 - DNA, 22 bp, Homo sapiens
caatgaaaatttaagttgcagc

SEQ ID NO: 9415674 - DNA, 22 bp, Homo sapiens
caatgaaaatgaggactcctgt

SEQ ID NO: 9415675 - DNA, 22 bp, Homo sapiens
caatcttagtggcttacaaaga

SEQ ID NO: 9415676 - DNA, 22 bp, Homo sapiens
caatgaaaatttaagttgcagc

SEQ ID NO: 9415677 - DNA, 22 bp, Homo sapiens
caatcttagtggcttacaaaga

SEQ ID NO: 9415678 - DNA, 22 bp, Homo sapiens
caatcttagagagattctttta

SEQ ID NO: 9415679 - DNA, 22 bp, Homo sapiens
caatgaaaatgaggactcctgt

SEQ ID NO: 9415680 - DNA, 22 bp, Homo sapiens
caatctgtacttgaaaaattat

SEQ ID NO: 9415681 - DNA, 22 bp, Homo sapiens
caatctgttagaaatgcagaca

SEQ ID NO: 9415682 - DNA, 22 bp, Homo sapiens
caatcttacttttgaaaagtga

SEQ ID NO: 9415683 - DNA, 20 bp, Homo sapiens
agcagcattgttctagagca

SEQ ID NO: 9415684 - DNA, 22 bp, Homo sapiens
caaatgtttcttgaacaccaac

SEQ ID NO: 9415685 - DNA, 22 bp, Homo sapiens
caaatgtttcttgaacaccaac

SEQ ID NO: 9415686 - DNA, 22 bp, Homo sapiens
agcagaagaaagccacatgact

SEQ ID NO: 9415687 - DNA, 22 bp, Homo sapiens
agcagaagaaagccacatgact

SEQ ID NO: 9415688 - DNA, 22 bp, Homo sapiens
agcagaagaggtcttgttgctg

SEQ ID NO: 9415689 - DNA, 17 bp, Homo sapiens
agcagaagtcagaggga

SEQ ID NO: 9415690 - DNA, 17 bp, Homo sapiens
agcagaagtcagaggga

SEQ ID NO: 9415691 - DNA, 22 bp, Homo sapiens
agcactgttatgggatgactta

SEQ ID NO: 9415692 - DNA, 22 bp, Homo sapiens
agcactgtggtggaagcatcaa

SEQ ID NO: 9415693 - DNA, 22 bp, Homo sapiens
caaattaatgtgtctcaaaata

SEQ ID NO: 9415694 - DNA, 22 bp, Homo sapiens
caaatgttttttagtataagta

SEQ ID NO: 9415695 - DNA, 22 bp, Homo sapiens
caaattaatgtgtctcaaaata

SEQ ID NO: 9415696 - DNA, 22 bp, Homo sapiens
agcacagcaccatcctggtacc

SEQ ID NO: 9415697 - DNA, 22 bp, Homo sapiens
agcacagcagcgtctaaccgat

SEQ ID NO: 9415698 - DNA, 22 bp, Homo sapiens
agcacagcctctggtttctgac

SEQ ID NO: 9415699 - DNA, 22 bp, Homo sapiens
caaatgatagagccgattatca

SEQ ID NO: 9415700 - DNA, 22 bp, Homo sapiens
caaatgatagagccgattatca

SEQ ID NO: 9415701 - DNA, 22 bp, Homo sapiens
caaatgatccttgcaagctgtg

SEQ ID NO: 9415702 - DNA, 22 bp, Homo sapiens
caaatgatccttgcaagctgtg

SEQ ID NO: 9415703 - DNA, 22 bp, Homo sapiens
caaatgatccttgcaagctgtg

SEQ ID NO: 9415704 - DNA, 22 bp, Homo sapiens
caaatattccaggtacatccct

SEQ ID NO: 9415705 - DNA, 22 bp, Homo sapiens
caaatattccaggtacatccct

SEQ ID NO: 9415706 - DNA, 22 bp, Homo sapiens
caaatgatacctattactaggc

SEQ ID NO: 9415707 - DNA, 22 bp, Homo sapiens
caaatgatactgtttttagtct

SEQ ID NO: 9415708 - DNA, 22 bp, Homo sapiens
caaatgatactgtttttagtct

SEQ ID NO: 9415709 - DNA, 22 bp, Homo sapiens
caaatgcatagaaagatgaaac

SEQ ID NO: 9415710 - DNA, 22 bp, Homo sapiens
caaatgcatagaaagatgaaac

SEQ ID NO: 9415711 - DNA, 22 bp, Homo sapiens
caaatgcaggtcataacctgag

SEQ ID NO: 9415712 - DNA, 22 bp, Homo sapiens
caaatgcagattcaggagttct

SEQ ID NO: 9415713 - DNA, 22 bp, Homo sapiens
caaatgcaggtcagcaggtgtc

SEQ ID NO: 9415714 - DNA, 22 bp, Homo sapiens
caaatgcaggtcataacctgag

SEQ ID NO: 9415715 - DNA, 22 bp, Homo sapiens
caaatgcaggtcagcaggtgtc

SEQ ID NO: 9415716 - DNA, 22 bp, Homo sapiens
caaatgcagattcaggagttct

SEQ ID NO: 9415717 - DNA, 22 bp, Homo sapiens
caaatgcaaaatataaccctgt

SEQ ID NO: 9415718 - DNA, 22 bp, Homo sapiens
caaatgcaaaatataaccctgt

SEQ ID NO: 9415719 - DNA, 22 bp, Homo sapiens
caaatgatgcatggctagtgag

SEQ ID NO: 9415720 - DNA, 22 bp, Homo sapiens
caaatgatgcatggctagtgag

SEQ ID NO: 9415721 - DNA, 22 bp, Homo sapiens
agcacagagctaggagtggagg

SEQ ID NO: 9415722 - DNA, 22 bp, Homo sapiens
agcacagagagctctaggtaaa

SEQ ID NO: 9415723 - DNA, 22 bp, Homo sapiens
agcacagagaagatttcaatta

SEQ ID NO: 9415724 - DNA, 22 bp, Homo sapiens
agcacagagaagatttcaatta

SEQ ID NO: 9415725 - DNA, 22 bp, Homo sapiens
agcacagagaaactaagacatt

SEQ ID NO: 9415726 - DNA, 22 bp, Homo sapiens
agcacagagttgcagagagcgt

SEQ ID NO: 9415727 - DNA, 22 bp, Homo sapiens
agcacagagttgcagagagcgt

SEQ ID NO: 9415728 - DNA, 22 bp, Homo sapiens
agcacagagttgcagagagcgt

SEQ ID NO: 9415729 - DNA, 22 bp, Homo sapiens
agcacagagttgcagagagcgt

SEQ ID NO: 9415730 - DNA, 22 bp, Homo sapiens
agcacagaggtggaagtgtata

SEQ ID NO: 9415731 - DNA, 22 bp, Homo sapiens
agcacagagctcggggaatgga

SEQ ID NO: 9415732 - DNA, 22 bp, Homo sapiens
agcacagagctcggggaatgga

SEQ ID NO: 9415733 - DNA, 22 bp, Homo sapiens
agcacagagctcggggaatgga

SEQ ID NO: 9415734 - DNA, 22 bp, Homo sapiens
agcacagataacatggagtgga

SEQ ID NO: 9415735 - DNA, 22 bp, Homo sapiens
agcacagataacatggagtgga

SEQ ID NO: 9415736 - DNA, 22 bp, Homo sapiens
agcacagataacatggagtgga

SEQ ID NO: 9415737 - DNA, 22 bp, Homo sapiens
agcacagatgcatgatcaccag

SEQ ID NO: 9415738 - DNA, 22 bp, Homo sapiens
agcacagagttgctcactgccg

SEQ ID NO: 9415739 - DNA, 22 bp, Homo sapiens
agcacagagttgctcactgccg

SEQ ID NO: 9415740 - DNA, 22 bp, Homo sapiens
agcacagagttgcagagagcgt

SEQ ID NO: 9415741 - DNA, 22 bp, Homo sapiens
agcacagagttgcagagagcgt

SEQ ID NO: 9415742 - DNA, 22 bp, Homo sapiens
agcacagagttgcagagagcgt

SEQ ID NO: 9415743 - DNA, 22 bp, Homo sapiens
agcacagatgtgagtggaggct

SEQ ID NO: 9415744 - DNA, 22 bp, Homo sapiens
agcacagatgtgagtggaggct

SEQ ID NO: 9415745 - DNA, 22 bp, Homo sapiens
agcacagattctgaagagtcct

SEQ ID NO: 9415746 - DNA, 22 bp, Homo sapiens
agcacagattctgaagagtcct

SEQ ID NO: 9415747 - DNA, 22 bp, Homo sapiens
agcacagattctgaagagtcct

SEQ ID NO: 9415748 - DNA, 22 bp, Homo sapiens
attttctgagtccagaatttac

SEQ ID NO: 9415749 - DNA, 22 bp, Homo sapiens
attttctggttgaggtttaaca

SEQ ID NO: 9415750 - DNA, 21 bp, Homo sapiens
agcaatttttcctcctctgca

SEQ ID NO: 9415751 - DNA, 19 bp, Homo sapiens
agcacagacaagaccagca

SEQ ID NO: 9415752 - DNA, 19 bp, Homo sapiens
agcacagacaagaccagca

SEQ ID NO: 9415753 - DNA, 19 bp, Homo sapiens
agcacagacaagaccagca

SEQ ID NO: 9415754 - DNA, 22 bp, Homo sapiens
agcacagactggtcccaggtct

SEQ ID NO: 9415755 - DNA, 22 bp, Homo sapiens
agcacagagaaactaagacatt

SEQ ID NO: 9415756 - DNA, 22 bp, Homo sapiens
agcacagactggtcccaggtct

SEQ ID NO: 9415757 - DNA, 22 bp, Homo sapiens
attttctatgttgtaattgtta

SEQ ID NO: 9415758 - DNA, 22 bp, Homo sapiens
attttctatgttgtaattgtta

SEQ ID NO: 9415759 - DNA, 22 bp, Homo sapiens
attttctattctgctggtttag

SEQ ID NO: 9415760 - DNA, 22 bp, Homo sapiens
attttctctttgtatatgctag

SEQ ID NO: 9415761 - DNA, 22 bp, Homo sapiens
gacagcaacctcatgagaaact

SEQ ID NO: 9415762 - DNA, 22 bp, Homo sapiens
gacagcaacacatgcttagtgc

SEQ ID NO: 9415763 - DNA, 22 bp, Homo sapiens
gacagcaacacatgcttagtgc

SEQ ID NO: 9415764 - DNA, 22 bp, Homo sapiens
gacagcaacactcaattctgca

SEQ ID NO: 9415765 - DNA, 22 bp, Homo sapiens
gacagatgtgggtgacagcagc

SEQ ID NO: 9415766 - DNA, 22 bp, Homo sapiens
gacagatgtgggtgacagcagc

SEQ ID NO: 9415767 - DNA, 22 bp, Homo sapiens
gacagcaaagcagagccaaggc

SEQ ID NO: 9415768 - DNA, 22 bp, Homo sapiens
atgccactgcgctccagcctgg

SEQ ID NO: 9415769 - DNA, 22 bp, Homo sapiens
atgccactgcgctccagcctgg

SEQ ID NO: 9415770 - DNA, 22 bp, Homo sapiens
atgccactgcgctccagcctgg

SEQ ID NO: 9415771 - DNA, 22 bp, Homo sapiens
atgccactgcgctccagcctgg

SEQ ID NO: 9415772 - DNA, 22 bp, Homo sapiens
atgccactgcgctccagcctgg

SEQ ID NO: 9415773 - DNA, 22 bp, Homo sapiens
atgccactgcacttcagcttgg

SEQ ID NO: 9415774 - DNA, 22 bp, Homo sapiens
atgccactgcacttcagcttgg

SEQ ID NO: 9415775 - DNA, 22 bp, Homo sapiens
atgccactgcacttcagcttgg

SEQ ID NO: 9415776 - DNA, 23 bp, Homo sapiens
gacagagtgagaccttgtcttac

SEQ ID NO: 9415777 - DNA, 23 bp, Homo sapiens
gacagagtgagaccttgtcttac

SEQ ID NO: 9415778 - DNA, 23 bp, Homo sapiens
gacagagtgagaccttgtcttac

SEQ ID NO: 9415779 - DNA, 23 bp, Homo sapiens
gacagagtgagaccttgtcttac

SEQ ID NO: 9415780 - DNA, 23 bp, Homo sapiens
gacagagtgagaccttgtcttac

SEQ ID NO: 9415781 - DNA, 23 bp, Homo sapiens
gacagagtgagaccttgtcttac

SEQ ID NO: 9415782 - DNA, 23 bp, Homo sapiens
gacagagtgagaccttgtcttac

SEQ ID NO: 9415783 - DNA, 23 bp, Homo sapiens
gacagagtgagaccttgtcttac

SEQ ID NO: 9415784 - DNA, 22 bp, Homo sapiens
gacactgcactcggccgaaagg

SEQ ID NO: 9415785 - DNA, 22 bp, Homo sapiens
gacagaggcaagaccagaagcc

SEQ ID NO: 9415786 - DNA, 22 bp, Homo sapiens
gacagaggtgtccttgagtcca

SEQ ID NO: 9415787 - DNA, 22 bp, Homo sapiens
atgccactgcgctccagcctgg

SEQ ID NO: 9415788 - DNA, 22 bp, Homo sapiens
atgccactgcgctccagcctgg

SEQ ID NO: 9415789 - DNA, 22 bp, Homo sapiens
atgccactgcgctccagcctgg

SEQ ID NO: 9415790 - DNA, 22 bp, Homo sapiens
atgccacttcattccagcctcg

SEQ ID NO: 9415791 - DNA, 22 bp, Homo sapiens
atgccactgcgctctagcctgg

SEQ ID NO: 9415792 - DNA, 22 bp, Homo sapiens
atgccactgcgctctagcctgg

SEQ ID NO: 9415793 - DNA, 22 bp, Homo sapiens
atgccactgcgctctagcctgg

SEQ ID NO: 9415794 - DNA, 22 bp, Homo sapiens
atgccacttcattccagcctcg

SEQ ID NO: 9415795 - DNA, 22 bp, Homo sapiens
atgccacttcattccagcctcg

SEQ ID NO: 9415796 - DNA, 22 bp, Homo sapiens
atggaaaaggctgatttcatta

SEQ ID NO: 9415797 - DNA, 22 bp, Homo sapiens
atggaaatcgatgtctaagtta

SEQ ID NO: 9415798 - DNA, 22 bp, Homo sapiens
atggaaatcgatgtctaagtta

SEQ ID NO: 9415799 - DNA, 22 bp, Homo sapiens
atggaaatgatggaacattaaa

SEQ ID NO: 9415800 - DNA, 22 bp, Homo sapiens
atggaaatgatggaacattaaa

SEQ ID NO: 9415801 - DNA, 22 bp, Homo sapiens
atggaaatggagggtgctagaa

SEQ ID NO: 9415802 - DNA, 22 bp, Homo sapiens
atggaacatgaattaatatggt

SEQ ID NO: 9415803 - DNA, 22 bp, Homo sapiens
atggaacatgaattaatatggt

SEQ ID NO: 9415804 - DNA, 22 bp, Homo sapiens
atggaacatcaggttaagaaat

SEQ ID NO: 9415805 - DNA, 22 bp, Homo sapiens
atggaacatcaggttaagaaat

SEQ ID NO: 9415806 - DNA, 22 bp, Homo sapiens
atggaacaggctcagagatgct

SEQ ID NO: 9415807 - DNA, 22 bp, Homo sapiens
atggaacaggctcagagatgct

SEQ ID NO: 9415808 - DNA, 22 bp, Homo sapiens
atggaactgctaataatagttg

SEQ ID NO: 9415809 - DNA, 22 bp, Homo sapiens
atggaagaaagagacaatttga

SEQ ID NO: 9415810 - DNA, 22 bp, Homo sapiens
atggaactgatcaggagtgcca

SEQ ID NO: 9415811 - DNA, 22 bp, Homo sapiens
atggaacaagaactcagattta

SEQ ID NO: 9415812 - DNA, 22 bp, Homo sapiens
atggaacaagaactcagattta

SEQ ID NO: 9415813 - DNA, 22 bp, Homo sapiens
atggaacagattaaagtgaggg

SEQ ID NO: 9415814 - DNA, 22 bp, Homo sapiens
atggaacagacagctgagacaa

SEQ ID NO: 9415815 - DNA, 22 bp, Homo sapiens
atggaacagacagctgagacaa

SEQ ID NO: 9415816 - DNA, 21 bp, Homo sapiens
atggaaattggcaaatgctac

SEQ ID NO: 9415817 - DNA, 21 bp, Homo sapiens
atggaaattggcaaatgctac

SEQ ID NO: 9415818 - DNA, 21 bp, Homo sapiens
atggaaattggcaaatgctac

SEQ ID NO: 9415819 - DNA, 21 bp, Homo sapiens
atggaaattggcaaatgctac

SEQ ID NO: 9415820 - DNA, 22 bp, Homo sapiens
atggaaatgttccatatattga

SEQ ID NO: 9415821 - DNA, 22 bp, Homo sapiens
atggaaatgttccatatattga

SEQ ID NO: 9415822 - DNA, 22 bp, Homo sapiens
atggaaatgtaacttctgattc

SEQ ID NO: 9415823 - DNA, 22 bp, Homo sapiens
atggaaatgtaacttctgattc

SEQ ID NO: 9415824 - DNA, 22 bp, Homo sapiens
atggaaatgttaagtcagtccg

SEQ ID NO: 9415825 - DNA, 22 bp, Homo sapiens
atggaaatggagggtgctagaa

SEQ ID NO: 9415826 - DNA, 22 bp, Homo sapiens
atggaaatggagtgtgcttgct

SEQ ID NO: 9415827 - DNA, 22 bp, Homo sapiens
atggaaatggagtgtgcttgct

SEQ ID NO: 9415828 - DNA, 22 bp, Homo sapiens
atggaaatggagtgtgcttgct

SEQ ID NO: 9415829 - DNA, 22 bp, Homo sapiens
atggacttaagagtcagaagct

SEQ ID NO: 9415830 - DNA, 22 bp, Homo sapiens
atggactaggaaagataaagat

SEQ ID NO: 9415831 - DNA, 22 bp, Homo sapiens
atggactagccataagagaact

SEQ ID NO: 9415832 - DNA, 22 bp, Homo sapiens
atggactcactaattcctccac

SEQ ID NO: 9415833 - DNA, 22 bp, Homo sapiens
atggaccagagcctcattctgt

SEQ ID NO: 9415834 - DNA, 22 bp, Homo sapiens
atggaatgggaagcagagccat

SEQ ID NO: 9415835 - DNA, 22 bp, Homo sapiens
atggaatgtgaacatgatggca

SEQ ID NO: 9415836 - DNA, 22 bp, Homo sapiens
atggaatgtttatacacagttg

SEQ ID NO: 9415837 - DNA, 22 bp, Homo sapiens
atggaataggctgctctttaaa

SEQ ID NO: 9415838 - DNA, 22 bp, Homo sapiens
atggaatatagtcttatatctc

SEQ ID NO: 9415839 - DNA, 22 bp, Homo sapiens
atggaatatagtcttatatctc

SEQ ID NO: 9415840 - DNA, 22 bp, Homo sapiens
atggaataggctgctctttaaa

SEQ ID NO: 9415841 - DNA, 22 bp, Homo sapiens
atggaataggctgctctttaaa

SEQ ID NO: 9415842 - DNA, 22 bp, Homo sapiens
atggaataattgtttcacagaa

SEQ ID NO: 9415843 - DNA, 22 bp, Homo sapiens
atggaagtgcaacttgctcatc

SEQ ID NO: 9415844 - DNA, 22 bp, Homo sapiens
atggaatgggaagagtgtgtga

SEQ ID NO: 9415845 - DNA, 22 bp, Homo sapiens
atggaatggctccctgccccag

SEQ ID NO: 9415846 - DNA, 22 bp, Homo sapiens
atggaatggcctgtcataatct

SEQ ID NO: 9415847 - DNA, 22 bp, Homo sapiens
atggaatgctccctggggacat

SEQ ID NO: 9415848 - DNA, 22 bp, Homo sapiens
atggaatgcggtagtatgtgca

SEQ ID NO: 9415849 - DNA, 22 bp, Homo sapiens
atggaatgcggtagtatgtgca

SEQ ID NO: 9415850 - DNA, 22 bp, Homo sapiens
atggaatgaaaaacacatgcaa

SEQ ID NO: 9415851 - DNA, 22 bp, Homo sapiens
atggaatgccaagttcactgct

SEQ ID NO: 9415852 - DNA, 22 bp, Homo sapiens
atggaagacagataaggcagaa

SEQ ID NO: 9415853 - DNA, 22 bp, Homo sapiens
atggaagacagataaggcagaa

SEQ ID NO: 9415854 - DNA, 22 bp, Homo sapiens
atggaagacagataaggcagaa

SEQ ID NO: 9415855 - DNA, 22 bp, Homo sapiens
atggaagacagataaggcagaa

SEQ ID NO: 9415856 - DNA, 22 bp, Homo sapiens
atggaagacagataaggcagaa

SEQ ID NO: 9415857 - DNA, 22 bp, Homo sapiens
atggaagaaagagacaatttga

SEQ ID NO: 9415858 - DNA, 22 bp, Homo sapiens
atggaagactaacagaaacatg

SEQ ID NO: 9415859 - DNA, 22 bp, Homo sapiens
atggaagactaacagaaacatg

SEQ ID NO: 9415860 - DNA, 22 bp, Homo sapiens
atggaagactaacagaaacatg

SEQ ID NO: 9415861 - DNA, 22 bp, Homo sapiens
atggaagactaacagaaacatg

SEQ ID NO: 9415862 - DNA, 22 bp, Homo sapiens
atggaagagtccccatggatga

SEQ ID NO: 9415863 - DNA, 22 bp, Homo sapiens
atggaagagtccccatggatga

SEQ ID NO: 9415864 - DNA, 22 bp, Homo sapiens
atggaagactaacagaaacatg

SEQ ID NO: 9415865 - DNA, 22 bp, Homo sapiens
atggaagggacagaagggcaag

SEQ ID NO: 9415866 - DNA, 22 bp, Homo sapiens
atggaaggtcctacagagcgca

SEQ ID NO: 9415867 - DNA, 23 bp, Homo sapiens
atggaagtcactgttttcttgtc

SEQ ID NO: 9415868 - DNA, 22 bp, Homo sapiens
atggaagtgcaacttgctcatc

SEQ ID NO: 9415869 - DNA, 23 bp, Homo sapiens
atggaagtcactgttttcttgtc

SEQ ID NO: 9415870 - DNA, 20 bp, Homo sapiens
atggaagctgctcttctcct

SEQ ID NO: 9415871 - DNA, 22 bp, Homo sapiens
atggaagctgaaaaagacacgg

SEQ ID NO: 9415872 - DNA, 22 bp, Homo sapiens
atggaagcagacaggtaattcc

SEQ ID NO: 9415873 - DNA, 22 bp, Homo sapiens
atggaagagtccccatggatga

SEQ ID NO: 9415874 - DNA, 22 bp, Homo sapiens
atggagcaaatggggctgcagg

SEQ ID NO: 9415875 - DNA, 22 bp, Homo sapiens
atggagcaaatggggctgcagg

SEQ ID NO: 9415876 - DNA, 22 bp, Homo sapiens
atggagcaacagacctatcaca

SEQ ID NO: 9415877 - DNA, 22 bp, Homo sapiens
atggagcacacgccatcacata

SEQ ID NO: 9415878 - DNA, 22 bp, Homo sapiens
atggagcacacgccatcacata

SEQ ID NO: 9415879 - DNA, 22 bp, Homo sapiens
atggagagttcacttctaagtt

SEQ ID NO: 9415880 - DNA, 22 bp, Homo sapiens
atggagatttttagaattacag

SEQ ID NO: 9415881 - DNA, 22 bp, Homo sapiens
atggagagtgaaagtctctcta

SEQ ID NO: 9415882 - DNA, 22 bp, Homo sapiens
atggagagagaaggcttgctgt

SEQ ID NO: 9415883 - DNA, 22 bp, Homo sapiens
atggagagagaaggcttgctgt

SEQ ID NO: 9415884 - DNA, 22 bp, Homo sapiens
atggagagtgaaagtctctcta

SEQ ID NO: 9415885 - DNA, 20 bp, Homo sapiens
atggaggaagggcaagagaa

SEQ ID NO: 9415886 - DNA, 20 bp, Homo sapiens
atggaggaagggcaagagaa

SEQ ID NO: 9415887 - DNA, 20 bp, Homo sapiens
atggaggaagggcaagagaa

SEQ ID NO: 9415888 - DNA, 22 bp, Homo sapiens
atggagccattcctgaagactt

SEQ ID NO: 9415889 - DNA, 22 bp, Homo sapiens
atggagcagcagaaggggcttg

SEQ ID NO: 9415890 - DNA, 21 bp, Homo sapiens
atggagcctaagagtggaggt

SEQ ID NO: 9415891 - DNA, 22 bp, Homo sapiens
gagaaatagattcatggtagat

SEQ ID NO: 9415892 - DNA, 22 bp, Homo sapiens
gagaaataggcaatggtatcta

SEQ ID NO: 9415893 - DNA, 22 bp, Homo sapiens
gagaaatatggctcagttccac

SEQ ID NO: 9415894 - DNA, 22 bp, Homo sapiens
gagaaaggtactattccctcca

SEQ ID NO: 9415895 - DNA, 20 bp, Homo sapiens
atggaggaagggcaagagaa

SEQ ID NO: 9415896 - DNA, 22 bp, Homo sapiens
gagaaatgcatgcatgtcatca

SEQ ID NO: 9415897 - DNA, 22 bp, Homo sapiens
gagaaatgctagcttaggaatc

SEQ ID NO: 9415898 - DNA, 22 bp, Homo sapiens
gagaacacgaggaggcccagcg

SEQ ID NO: 9415899 - DNA, 22 bp, Homo sapiens
gagaaatgagtgattcactttt

SEQ ID NO: 9415900 - DNA, 22 bp, Homo sapiens
gagaaatgcatgcatgtcatca

SEQ ID NO: 9415901 - DNA, 22 bp, Homo sapiens
gagaaatgagtgattcactttt

SEQ ID NO: 9415902 - DNA, 22 bp, Homo sapiens
gagaaatgagtgattcactttt

SEQ ID NO: 9415903 - DNA, 22 bp, Homo sapiens
gagaaatatggctcagttccac

SEQ ID NO: 9415904 - DNA, 22 bp, Homo sapiens
atggccctaatgagttggtgtt

SEQ ID NO: 9415905 - DNA, 22 bp, Homo sapiens
atggccctatcacctttgcttc

SEQ ID NO: 9415906 - DNA, 22 bp, Homo sapiens
atggccctgaccttgatgacct

SEQ ID NO: 9415907 - DNA, 22 bp, Homo sapiens
atggccctctccttaggtcagc

SEQ ID NO: 9415908 - DNA, 22 bp, Homo sapiens
atggccctcagtccttccttgg

SEQ ID NO: 9415909 - DNA, 22 bp, Homo sapiens
atggccctgccaggaggaacaa

SEQ ID NO: 9415910 - DNA, 22 bp, Homo sapiens
atggccctgaccttgatgacct

SEQ ID NO: 9415911 - DNA, 22 bp, Homo sapiens
atggccctgctggtttgatcgt

SEQ ID NO: 9415912 - DNA, 22 bp, Homo sapiens
atggccctgctaccacttttct

SEQ ID NO: 9415913 - DNA, 22 bp, Homo sapiens
atggccctggcccagaccccac

SEQ ID NO: 9415914 - DNA, 22 bp, Homo sapiens
atggccctggaaagagcttgag

SEQ ID NO: 9415915 - DNA, 22 bp, Homo sapiens
gagcagtgactggagcatgaga

SEQ ID NO: 9415916 - DNA, 22 bp, Homo sapiens
gagccagcctccgcctctctcc

SEQ ID NO: 9415917 - DNA, 22 bp, Homo sapiens
gagccagcctccgcctctctcc

SEQ ID NO: 9415918 - DNA, 22 bp, Homo sapiens
gagccagccttcttctgaggtc

SEQ ID NO: 9415919 - DNA, 22 bp, Homo sapiens
gagccagcctccgcctctctcc

SEQ ID NO: 9415920 - DNA, 22 bp, Homo sapiens
gagccagcctccgcctctctcc

SEQ ID NO: 9415921 - DNA, 22 bp, Homo sapiens
gagccagccttcttctgaggtc

SEQ ID NO: 9415922 - DNA, 22 bp, Homo sapiens
gagccagccttcttctgaggtc

SEQ ID NO: 9415923 - DNA, 22 bp, Homo sapiens
gagccagccttcttctgaggtc

SEQ ID NO: 9415924 - DNA, 22 bp, Homo sapiens
gagccagcgccttgcctctggg

SEQ ID NO: 9415925 - DNA, 22 bp, Homo sapiens
atggccagtctgttggacagca

SEQ ID NO: 9415926 - DNA, 22 bp, Homo sapiens
atggccagtctgttggacagca

SEQ ID NO: 9415927 - DNA, 22 bp, Homo sapiens
atggccagtgttgagatcaggc

SEQ ID NO: 9415928 - DNA, 22 bp, Homo sapiens
atggccagtgttgagatcaggc

SEQ ID NO: 9415929 - DNA, 22 bp, Homo sapiens
atggccagtgtttccctcagtt

SEQ ID NO: 9415930 - DNA, 22 bp, Homo sapiens
atggccagtgtttccctcagtt

SEQ ID NO: 9415931 - DNA, 19 bp, Homo sapiens
atggccagtttagaggttt

SEQ ID NO: 9415932 - DNA, 22 bp, Homo sapiens
atggccagttagaaatcaaaaa

SEQ ID NO: 9415933 - DNA, 22 bp, Homo sapiens
atggccagtgtttccctcagtt

SEQ ID NO: 9415934 - DNA, 22 bp, Homo sapiens
atggcccaaaacctcctccctc

SEQ ID NO: 9415935 - DNA, 22 bp, Homo sapiens
atggcccaaaacctcctccctc

SEQ ID NO: 9415936 - DNA, 19 bp, Homo sapiens
atggccagtttagaggttt

SEQ ID NO: 9415937 - DNA, 19 bp, Homo sapiens
atggccagtttagaggttt

SEQ ID NO: 9415938 - DNA, 22 bp, Homo sapiens
atggcccaaactgcaattactt

SEQ ID NO: 9415939 - DNA, 22 bp, Homo sapiens
atggcccaagtgccctgacctg

SEQ ID NO: 9415940 - DNA, 22 bp, Homo sapiens
atggcccagactcagactggtg

SEQ ID NO: 9415941 - DNA, 22 bp, Homo sapiens
atggcccactctggtcccggca

SEQ ID NO: 9415942 - DNA, 22 bp, Homo sapiens
atggcccagaagtttggaaagg

SEQ ID NO: 9415943 - DNA, 22 bp, Homo sapiens
atggcccaggcaggctggtact

SEQ ID NO: 9415944 - DNA, 22 bp, Homo sapiens
atggcccaggccaggatccagc

SEQ ID NO: 9415945 - DNA, 22 bp, Homo sapiens
atggcccaggcctcctgtggct

SEQ ID NO: 9415946 - DNA, 22 bp, Homo sapiens
atggctggaagagtcgaagagt

SEQ ID NO: 9415947 - DNA, 22 bp, Homo sapiens
atggctggaagagtcgaagagt

SEQ ID NO: 9415948 - DNA, 22 bp, Homo sapiens
atggctgctttcccttagcacc

SEQ ID NO: 9415949 - DNA, 19 bp, Homo sapiens
atggctgctgattggggat

SEQ ID NO: 9415950 - DNA, 22 bp, Homo sapiens
atggctgccccaaattgttgct

SEQ ID NO: 9415951 - DNA, 22 bp, Homo sapiens
atggctgcctgggcgctggccg

SEQ ID NO: 9415952 - DNA, 22 bp, Homo sapiens
atggctgctctggatggagtcc

SEQ ID NO: 9415953 - DNA, 22 bp, Homo sapiens
atggctgcatcatcctggttga

SEQ ID NO: 9415954 - DNA, 22 bp, Homo sapiens
atggctgcccacgttggtgctt

SEQ ID NO: 9415955 - DNA, 22 bp, Homo sapiens
gagccagggagggtctggtata

SEQ ID NO: 9415956 - DNA, 22 bp, Homo sapiens
gagccagggagggtctggtata

SEQ ID NO: 9415957 - DNA, 22 bp, Homo sapiens
gagccagctatgtagcaagagg

SEQ ID NO: 9415958 - DNA, 22 bp, Homo sapiens
gagccagctacatggtctgcaa

SEQ ID NO: 9415959 - DNA, 22 bp, Homo sapiens
gagccagctacatggtctgcaa

SEQ ID NO: 9415960 - DNA, 22 bp, Homo sapiens
gagccagctgagctgcactgtc

SEQ ID NO: 9415961 - DNA, 22 bp, Homo sapiens
gagccagctgagctgcactgtc

SEQ ID NO: 9415962 - DNA, 22 bp, Homo sapiens
gagccagctgagctgcactgtc

SEQ ID NO: 9415963 - DNA, 22 bp, Homo sapiens
gagccagctatgtagcaagagg

SEQ ID NO: 9415964 - DNA, 22 bp, Homo sapiens
gagccaggagatacctaagggg

SEQ ID NO: 9415965 - DNA, 22 bp, Homo sapiens
gagccaggagatacctaagggg

SEQ ID NO: 9415966 - DNA, 22 bp, Homo sapiens
gagccaggaggcagagactgca

SEQ ID NO: 9415967 - DNA, 22 bp, Homo sapiens
gagccaggaagaaggccttact

SEQ ID NO: 9415968 - DNA, 22 bp, Homo sapiens
gagccagctgagctgcactgtc

SEQ ID NO: 9415969 - DNA, 22 bp, Homo sapiens
gagccaggaagaaggccttact

SEQ ID NO: 9415970 - DNA, 22 bp, Homo sapiens
atggcagtggaatgggatgagt

SEQ ID NO: 9415971 - DNA, 22 bp, Homo sapiens
atggcagtatttgtatcacaga

SEQ ID NO: 9415972 - DNA, 22 bp, Homo sapiens
atggcagggcacagctctagtt

SEQ ID NO: 9415973 - DNA, 22 bp, Homo sapiens
atggcagggcccttggctccca

SEQ ID NO: 9415974 - DNA, 22 bp, Homo sapiens
atggcagggcccttggctccca

SEQ ID NO: 9415975 - DNA, 22 bp, Homo sapiens
atggcagggactgtggcccttg

SEQ ID NO: 9415976 - DNA, 22 bp, Homo sapiens
gagaacagatttttctgctgtc

SEQ ID NO: 9415977 - DNA, 22 bp, Homo sapiens
gagaacagatttttctgctgtc

SEQ ID NO: 9415978 - DNA, 22 bp, Homo sapiens
gagaacagatttttctgctgtc

SEQ ID NO: 9415979 - DNA, 22 bp, Homo sapiens
gagaacactaatggtttcttaa

SEQ ID NO: 9415980 - DNA, 22 bp, Homo sapiens
gagaacacttatggattattct

SEQ ID NO: 9415981 - DNA, 22 bp, Homo sapiens
atggcagctttcattgtccaca

SEQ ID NO: 9415982 - DNA, 22 bp, Homo sapiens
atggcagctttgaatttcttga

SEQ ID NO: 9415983 - DNA, 22 bp, Homo sapiens
atggcagctggcttgggcacct

SEQ ID NO: 9415984 - DNA, 22 bp, Homo sapiens
atggcagcggagctggaaatga

SEQ ID NO: 9415985 - DNA, 22 bp, Homo sapiens
atggcagcggagctggaaatga

SEQ ID NO: 9415986 - DNA, 22 bp, Homo sapiens
gagagctgtccggctgagcagc

SEQ ID NO: 9415987 - DNA, 22 bp, Homo sapiens
gagagctgtgttcattctacca

SEQ ID NO: 9415988 - DNA, 22 bp, Homo sapiens
gagagctgtgttcattctacca

SEQ ID NO: 9415989 - DNA, 22 bp, Homo sapiens
gagagctgtggtttgaccaggc

SEQ ID NO: 9415990 - DNA, 22 bp, Homo sapiens
gagagctttcatgttgggaatg

SEQ ID NO: 9415991 - DNA, 22 bp, Homo sapiens
gagagctgtttatcttcttcaa

SEQ ID NO: 9415992 - DNA, 22 bp, Homo sapiens
gagagctgtttatcttcttcaa

SEQ ID NO: 9415993 - DNA, 22 bp, Homo sapiens
atggccagtctgactagtttcc

SEQ ID NO: 9415994 - DNA, 22 bp, Homo sapiens
atggccagtctgttggacagca

SEQ ID NO: 9415995 - DNA, 22 bp, Homo sapiens
atggccagtctgactagtttcc

SEQ ID NO: 9415996 - DNA, 22 bp, Homo sapiens
atggccagtctattcatggtta

SEQ ID NO: 9415997 - DNA, 22 bp, Homo sapiens
atggccagtcaagcctctggct

SEQ ID NO: 9415998 - DNA, 22 bp, Homo sapiens
atggccagattatatggttttt

SEQ ID NO: 9415999 - DNA, 22 bp, Homo sapiens
atggccagattatatggttttt

SEQ ID NO: 9416000 - DNA, 22 bp, Homo sapiens
atggccagtcaagcctctggct

SEQ ID NO: 9416001 - DNA, 22 bp, Homo sapiens
atggccagcaaggtagggcaat

SEQ ID NO: 9416002 - DNA, 21 bp, Homo sapiens
atggccagatctattaggtgg

SEQ ID NO: 9416003 - DNA, 22 bp, Homo sapiens
atggccagatgaaataatagag

SEQ ID NO: 9416004 - DNA, 22 bp, Homo sapiens
gagaggaaagatatatacttct

SEQ ID NO: 9416005 - DNA, 22 bp, Homo sapiens
gagaggaactcccagtgcctgg

SEQ ID NO: 9416006 - DNA, 22 bp, Homo sapiens
gagaggaactcccagtgcctgg

SEQ ID NO: 9416007 - DNA, 22 bp, Homo sapiens
gagaggaactcccagtgcctgg

SEQ ID NO: 9416008 - DNA, 22 bp, Homo sapiens
gaggagctggctgtcgggaggc

SEQ ID NO: 9416009 - DNA, 22 bp, Homo sapiens
gaggagctggcgctatttatga

SEQ ID NO: 9416010 - DNA, 22 bp, Homo sapiens
gaggccaggaggatctctctaa

SEQ ID NO: 9416011 - DNA, 22 bp, Homo sapiens
gaggccaccctatgggtcccag

SEQ ID NO: 9416012 - DNA, 22 bp, Homo sapiens
gaggccaccctatgggtcccag

SEQ ID NO: 9416013 - DNA, 23 bp, Homo sapiens
gaggccacattcccctgcttgag

SEQ ID NO: 9416014 - DNA, 22 bp, Homo sapiens
gaggagctgggctgagagggtc

SEQ ID NO: 9416015 - DNA, 22 bp, Homo sapiens
gaggccaggagtgctgtaagtt

SEQ ID NO: 9416016 - DNA, 22 bp, Homo sapiens
gaggccaggagtgctgtaagtt

SEQ ID NO: 9416017 - DNA, 22 bp, Homo sapiens
gaggccaggggtcagcaattgg

SEQ ID NO: 9416018 - DNA, 22 bp, Homo sapiens
gaggccagggtaccatcaacat

SEQ ID NO: 9416019 - DNA, 22 bp, Homo sapiens
gaggccaggggtcagcaattgg

SEQ ID NO: 9416020 - DNA, 22 bp, Homo sapiens
gaggccagggtaccatcaacat

SEQ ID NO: 9416021 - DNA, 22 bp, Homo sapiens
gaggccaggggcctggagatga

SEQ ID NO: 9416022 - DNA, 22 bp, Homo sapiens
gaggccaggggcctggagatga

SEQ ID NO: 9416023 - DNA, 22 bp, Homo sapiens
gaggccaggggcctggagatga

SEQ ID NO: 9416024 - DNA, 22 bp, Homo sapiens
gaggccagggatgcaatgagag

SEQ ID NO: 9416025 - DNA, 15 bp, Homo sapiens
gaggccaggcatgtg

SEQ ID NO: 9416026 - DNA, 22 bp, Homo sapiens
gaggccagggatgcaatgagag

SEQ ID NO: 9416027 - DNA, 22 bp, Homo sapiens
gaggccagggatgcaatgagag

SEQ ID NO: 9416028 - DNA, 22 bp, Homo sapiens
gaggccaggggagtcagcgtcc

SEQ ID NO: 9416029 - DNA, 22 bp, Homo sapiens
gaggccaggggagtcagcgtcc

SEQ ID NO: 9416030 - DNA, 22 bp, Homo sapiens
gaggccaggggagtcagcgtcc

SEQ ID NO: 9416031 - DNA, 22 bp, Homo sapiens
gaggccaggggagtcagcgtcc

SEQ ID NO: 9416032 - DNA, 22 bp, Homo sapiens
gaggccagggatgcaatgagag

SEQ ID NO: 9416033 - DNA, 22 bp, Homo sapiens
gaggccagggatgcaatgagag

SEQ ID NO: 9416034 - DNA, 22 bp, Homo sapiens
atgtactatgcagtcaactgtt

SEQ ID NO: 9416035 - DNA, 22 bp, Homo sapiens
atgtacctctgcattcctgcct

SEQ ID NO: 9416036 - DNA, 19 bp, Homo sapiens
atgtacccagtgtcaatcc

SEQ ID NO: 9416037 - DNA, 19 bp, Homo sapiens
atgtacccagtgtcaatcc

SEQ ID NO: 9416038 - DNA, 22 bp, Homo sapiens
gaggagctgcagggggagtcta

SEQ ID NO: 9416039 - DNA, 22 bp, Homo sapiens
gaggagctgaggctgaggcctc

SEQ ID NO: 9416040 - DNA, 22 bp, Homo sapiens
gaggagctgaggctgaggcctc

SEQ ID NO: 9416041 - DNA, 22 bp, Homo sapiens
gaggagctgatatttataatga

SEQ ID NO: 9416042 - DNA, 22 bp, Homo sapiens
gaggagctgaggctgaggcctc

SEQ ID NO: 9416043 - DNA, 22 bp, Homo sapiens
atgtacattttcctaatgtttt

SEQ ID NO: 9416044 - DNA, 22 bp, Homo sapiens
atgtacattttcctaatgtttt

SEQ ID NO: 9416045 - DNA, 22 bp, Homo sapiens
atgtaccagatgtatgttctca

SEQ ID NO: 9416046 - DNA, 18 bp, Homo sapiens
atgtacatttgctaaagc

SEQ ID NO: 9416047 - DNA, 22 bp, Homo sapiens
atgtacatttgtagtaatatca

SEQ ID NO: 9416048 - DNA, 22 bp, Homo sapiens
atgtacatttagatcatttctg

SEQ ID NO: 9416049 - DNA, 22 bp, Homo sapiens
atggtacaaaatgtataaagtc

SEQ ID NO: 9416050 - DNA, 22 bp, Homo sapiens
atggtaacagttgagtagaaac

SEQ ID NO: 9416051 - DNA, 22 bp, Homo sapiens
atggtaacagttgagtagaaac

SEQ ID NO: 9416052 - DNA, 22 bp, Homo sapiens
atggtcaaagataaagtgatct

SEQ ID NO: 9416053 - DNA, 22 bp, Homo sapiens
atggggctgaaacatggaagag

SEQ ID NO: 9416054 - DNA, 22 bp, Homo sapiens
atgggttcaagtgattctcctg

SEQ ID NO: 9416055 - DNA, 22 bp, Homo sapiens
atggtaaacatttaacaactag

SEQ ID NO: 9416056 - DNA, 22 bp, Homo sapiens
atggtaaacatttaacaactag

SEQ ID NO: 9416057 - DNA, 22 bp, Homo sapiens
atggtaaacatttaacaactag

SEQ ID NO: 9416058 - DNA, 22 bp, Homo sapiens
atggctggatagttgaagctct

SEQ ID NO: 9416059 - DNA, 23 bp, Homo sapiens
atggggctcaacacttagtagct

SEQ ID NO: 9416060 - DNA, 22 bp, Homo sapiens
atggctggatttgatccatggg

SEQ ID NO: 9416061 - DNA, 22 bp, Homo sapiens
atggctggcactggcctgggtt

SEQ ID NO: 9416062 - DNA, 21 bp, Homo sapiens
gagctgggcgaggctccgggg

SEQ ID NO: 9416063 - DNA, 21 bp, Homo sapiens
gagctgggcgaggctccgggg

SEQ ID NO: 9416064 - DNA, 22 bp, Homo sapiens
gagctgggctggcttcctccct

SEQ ID NO: 9416065 - DNA, 21 bp, Homo sapiens
gagctgggcgaggctccgggg

SEQ ID NO: 9416066 - DNA, 22 bp, Homo sapiens
atgtacaatctatcacaagaag

SEQ ID NO: 9416067 - DNA, 22 bp, Homo sapiens
atgtacaatctatcacaagaag

SEQ ID NO: 9416068 - DNA, 22 bp, Homo sapiens
gagctggggcagcttaggagtg

SEQ ID NO: 9416069 - DNA, 22 bp, Homo sapiens
atgtacaatctatcacaagaag

SEQ ID NO: 9416070 - DNA, 22 bp, Homo sapiens
atgtacatctttataacaagct

SEQ ID NO: 9416071 - DNA, 22 bp, Homo sapiens
atgtacatctttataacaagct

SEQ ID NO: 9416072 - DNA, 22 bp, Homo sapiens
atgtacaattctccttggtagg

SEQ ID NO: 9416073 - DNA, 22 bp, Homo sapiens
atgtacaattctccttggtagg

SEQ ID NO: 9416074 - DNA, 22 bp, Homo sapiens
atgtacaattctccttggtagg

SEQ ID NO: 9416075 - DNA, 22 bp, Homo sapiens
atgtacaatctatcacaagaag

SEQ ID NO: 9416076 - DNA, 22 bp, Homo sapiens
atgtacaatctatcacaagaag

SEQ ID NO: 9416077 - DNA, 22 bp, Homo sapiens
atggtccttatggccgtgatat

SEQ ID NO: 9416078 - DNA, 22 bp, Homo sapiens
gagctgggcctgcgagtgctgc

SEQ ID NO: 9416079 - DNA, 22 bp, Homo sapiens
gagctgggcctgcgagtgctgc

SEQ ID NO: 9416080 - DNA, 22 bp, Homo sapiens
gagctgggcgagccggggaagt

SEQ ID NO: 9416081 - DNA, 22 bp, Homo sapiens
gagctgggcctgcgagtgctgc

SEQ ID NO: 9416082 - DNA, 22 bp, Homo sapiens
gagctgggcctgcgagtgctgc

SEQ ID NO: 9416083 - DNA, 22 bp, Homo sapiens
gagctgggcctcagaacacagt

SEQ ID NO: 9416084 - DNA, 22 bp, Homo sapiens
atgtgtcaattttcaaatgctt

SEQ ID NO: 9416085 - DNA, 22 bp, Homo sapiens
atgtgtcaggcaatagaagcta

SEQ ID NO: 9416086 - DNA, 22 bp, Homo sapiens
atgtgtcaggtacactcattag

SEQ ID NO: 9416087 - DNA, 22 bp, Homo sapiens
atgtgtattttgtactattggg

SEQ ID NO: 9416088 - DNA, 22 bp, Homo sapiens
atgtgtattgagcacctactgc

SEQ ID NO: 9416089 - DNA, 22 bp, Homo sapiens
atgtgtcatttttctgtgcata

SEQ ID NO: 9416090 - DNA, 22 bp, Homo sapiens
atgtgtcattatccagaataac

SEQ ID NO: 9416091 - DNA, 22 bp, Homo sapiens
gaggggaagacttctggacagt

SEQ ID NO: 9416092 - DNA, 22 bp, Homo sapiens
gaggggaagacttctggacagt

SEQ ID NO: 9416093 - DNA, 22 bp, Homo sapiens
gaggggaagacttctggacagt

SEQ ID NO: 9416094 - DNA, 22 bp, Homo sapiens
gaggggaagacttctggacagt

SEQ ID NO: 9416095 - DNA, 22 bp, Homo sapiens
atgtgtattaccctttcattcc

SEQ ID NO: 9416096 - DNA, 22 bp, Homo sapiens
atgtggcttagttaggtgcccc

SEQ ID NO: 9416097 - DNA, 22 bp, Homo sapiens
atgtggcttagttaggtgcccc

SEQ ID NO: 9416098 - DNA, 22 bp, Homo sapiens
gaggctgctttcctcctatcct

SEQ ID NO: 9416099 - DNA, 22 bp, Homo sapiens
atgtgtcttgcggcagttggta

SEQ ID NO: 9416100 - DNA, 22 bp, Homo sapiens
atgtgtgtacacacgtgactct

SEQ ID NO: 9416101 - DNA, 22 bp, Homo sapiens
atgtgtcttggagttttaatgt

SEQ ID NO: 9416102 - DNA, 22 bp, Homo sapiens
atgtgtgtatatatagtcattt

SEQ ID NO: 9416103 - DNA, 22 bp, Homo sapiens
atgtgtgtatatatagtcattt

SEQ ID NO: 9416104 - DNA, 22 bp, Homo sapiens
atgtgtgtatatatagtcattt

SEQ ID NO: 9416105 - DNA, 22 bp, Homo sapiens
atgtgtgtatatatagtcattt

SEQ ID NO: 9416106 - DNA, 22 bp, Homo sapiens
atgtgtgtatatatagtcattt

SEQ ID NO: 9416107 - DNA, 22 bp, Homo sapiens
atgtgtgtatgtgcctatatct

SEQ ID NO: 9416108 - DNA, 22 bp, Homo sapiens
atgtgtgtatgtgcctatatct

SEQ ID NO: 9416109 - DNA, 22 bp, Homo sapiens
atgtgtgtgcatttctctccct

SEQ ID NO: 9416110 - DNA, 22 bp, Homo sapiens
atgtgtgtgcatttctctccct

SEQ ID NO: 9416111 - DNA, 22 bp, Homo sapiens
atgtgtgtgatgggcgccgcca

SEQ ID NO: 9416112 - DNA, 22 bp, Homo sapiens
atgtgtgtgatgggcgccgcca

SEQ ID NO: 9416113 - DNA, 22 bp, Homo sapiens
atgtgtgtgcatttctctccct

SEQ ID NO: 9416114 - DNA, 22 bp, Homo sapiens
atgtgtgtgcatttctctccct

SEQ ID NO: 9416115 - DNA, 22 bp, Homo sapiens
atgtgtgtatgtgcctatatct

SEQ ID NO: 9416116 - DNA, 22 bp, Homo sapiens
atgtgtgtatgtgcctatatct

SEQ ID NO: 9416117 - DNA, 22 bp, Homo sapiens
atgtgtgtgatgggcgccgcca

SEQ ID NO: 9416118 - DNA, 22 bp, Homo sapiens
atgtgtgtgatgggcgccgcca

SEQ ID NO: 9416119 - DNA, 22 bp, Homo sapiens
gaggggagaggcttatggatca

SEQ ID NO: 9416120 - DNA, 22 bp, Homo sapiens
gaggggagaggcttatggatca

SEQ ID NO: 9416121 - DNA, 22 bp, Homo sapiens
gaggggagacagggaaatcagt

SEQ ID NO: 9416122 - DNA, 22 bp, Homo sapiens
gaggggagacagggaaatcagt

SEQ ID NO: 9416123 - DNA, 22 bp, Homo sapiens
gaggggagacagggaaatcagt

SEQ ID NO: 9416124 - DNA, 22 bp, Homo sapiens
gaggggagcatgatctagattg

SEQ ID NO: 9416125 - DNA, 22 bp, Homo sapiens
atgtgtcttctgtgggtttgaa

SEQ ID NO: 9416126 - DNA, 22 bp, Homo sapiens
atgtgtcttgagggggatggag

SEQ ID NO: 9416127 - DNA, 22 bp, Homo sapiens
gaggggagcatgatctagattg

SEQ ID NO: 9416128 - DNA, 16 bp, Homo sapiens
gaggggagcagtaggc

SEQ ID NO: 9416129 - DNA, 16 bp, Homo sapiens
gaggggagcagtaggc

SEQ ID NO: 9416130 - DNA, 22 bp, Homo sapiens
gaggcctggctgtcagtcccca

SEQ ID NO: 9416131 - DNA, 22 bp, Homo sapiens
gaggcctggctgtcagtcccca

SEQ ID NO: 9416132 - DNA, 22 bp, Homo sapiens
gaggcctggctgtcagtcccca

SEQ ID NO: 9416133 - DNA, 22 bp, Homo sapiens
gaggcctggctgtcagtcccca

SEQ ID NO: 9416134 - DNA, 22 bp, Homo sapiens
gaggcctggctgggaggaggtg

SEQ ID NO: 9416135 - DNA, 22 bp, Homo sapiens
gaggcctggctctgccctcctg

SEQ ID NO: 9416136 - DNA, 22 bp, Homo sapiens
gaggcctggctctgccctcctg

SEQ ID NO: 9416137 - DNA, 22 bp, Homo sapiens
gaggcctggctctgccctcctg

SEQ ID NO: 9416138 - DNA, 22 bp, Homo sapiens
gaggcctggagccgcctaggcg

SEQ ID NO: 9416139 - DNA, 22 bp, Homo sapiens
gaggccagggtaccatcaacat

SEQ ID NO: 9416140 - DNA, 22 bp, Homo sapiens
gaggccagggtaccatcaacat

SEQ ID NO: 9416141 - DNA, 22 bp, Homo sapiens
gaggcctggagccgcctaggcg

SEQ ID NO: 9416142 - DNA, 22 bp, Homo sapiens
gaggcctgggcaagggggtctg

SEQ ID NO: 9416143 - DNA, 22 bp, Homo sapiens
gaggcctgggcaagggggtctg

SEQ ID NO: 9416144 - DNA, 22 bp, Homo sapiens
gaggcctgggagcctgtcctcc

SEQ ID NO: 9416145 - DNA, 22 bp, Homo sapiens
atgtctttataaatgtataatg

SEQ ID NO: 9416146 - DNA, 22 bp, Homo sapiens
atgtctttataaatgtataatg

SEQ ID NO: 9416147 - DNA, 22 bp, Homo sapiens
gaggctgccccttcctcagctg

SEQ ID NO: 9416148 - DNA, 22 bp, Homo sapiens
atgtgaaacctgtgagtagagt

SEQ ID NO: 9416149 - DNA, 21 bp, Homo sapiens
atgtgaaaccttccacgctga

SEQ ID NO: 9416150 - DNA, 22 bp, Homo sapiens
atgtgaaacctgtgagtagagt

SEQ ID NO: 9416151 - DNA, 20 bp, Homo sapiens
gaggctgcggactgctggac

SEQ ID NO: 9416152 - DNA, 22 bp, Homo sapiens
gaggctgccccttcctcagctg

SEQ ID NO: 9416153 - DNA, 22 bp, Homo sapiens
gaggctgccccttcctcagctg

SEQ ID NO: 9416154 - DNA, 22 bp, Homo sapiens
gaggctgctgccatcattaggt

SEQ ID NO: 9416155 - DNA, 20 bp, Homo sapiens
gaggctgcggactgctggac

SEQ ID NO: 9416156 - DNA, 22 bp, Homo sapiens
gaggctgcggggaggagcctgc

SEQ ID NO: 9416157 - DNA, 22 bp, Homo sapiens
atgtctttcttgtgtcccaaga

SEQ ID NO: 9416158 - DNA, 22 bp, Homo sapiens
atgtctttctagttaagagcta

SEQ ID NO: 9416159 - DNA, 22 bp, Homo sapiens
atgtctttggctttgacatggc

SEQ ID NO: 9416160 - DNA, 22 bp, Homo sapiens
atgtgaaaatccaatggcagca

SEQ ID NO: 9416161 - DNA, 22 bp, Homo sapiens
atgtgaaaaatttcttattaca

SEQ ID NO: 9416162 - DNA, 19 bp, Homo sapiens
atgaggaactgaggctcag

SEQ ID NO: 9416163 - DNA, 19 bp, Homo sapiens
atgaggaactgaggctcag

SEQ ID NO: 9416164 - DNA, 22 bp, Homo sapiens
atgagcttcccagacaggatgg

SEQ ID NO: 9416165 - DNA, 22 bp, Homo sapiens
atgaagcagcgttgtagagtga

SEQ ID NO: 9416166 - DNA, 22 bp, Homo sapiens
atgaagcagcctcttccctctg

SEQ ID NO: 9416167 - DNA, 22 bp, Homo sapiens
atgaagcagcgttgtagagtga

SEQ ID NO: 9416168 - DNA, 22 bp, Homo sapiens
atgaagcagcctcttccctctg

SEQ ID NO: 9416169 - DNA, 22 bp, Homo sapiens
atgaagcagcctcttccctctg

SEQ ID NO: 9416170 - DNA, 22 bp, Homo sapiens
atgaagcagatttattactcac

SEQ ID NO: 9416171 - DNA, 22 bp, Homo sapiens
atgaagcagatttattactcac

SEQ ID NO: 9416172 - DNA, 22 bp, Homo sapiens
atgaagatggttcaactggcct

SEQ ID NO: 9416173 - DNA, 22 bp, Homo sapiens
atgaagatattcttgttttctg

SEQ ID NO: 9416174 - DNA, 21 bp, Homo sapiens
atgaagatgacaatttgagag

SEQ ID NO: 9416175 - DNA, 22 bp, Homo sapiens
atgaagataatagcattggttg

SEQ ID NO: 9416176 - DNA, 22 bp, Homo sapiens
atgaagataatagcattggttg

SEQ ID NO: 9416177 - DNA, 22 bp, Homo sapiens
atgaagataagaccaggctgga

SEQ ID NO: 9416178 - DNA, 22 bp, Homo sapiens
atgaagcagaatttcccactct

SEQ ID NO: 9416179 - DNA, 22 bp, Homo sapiens
atgaagcagactcaggtggtgc

SEQ ID NO: 9416180 - DNA, 22 bp, Homo sapiens
atgaagcagaatttcccactct

SEQ ID NO: 9416181 - DNA, 22 bp, Homo sapiens
atgaagcaacagccctcctatt

SEQ ID NO: 9416182 - DNA, 19 bp, Homo sapiens
atgaagattggtaaattca

SEQ ID NO: 9416183 - DNA, 22 bp, Homo sapiens
atgaagattctatttatcactt

SEQ ID NO: 9416184 - DNA, 22 bp, Homo sapiens
atgaagatttcccagagacatg

SEQ ID NO: 9416185 - DNA, 22 bp, Homo sapiens
atgaagcaacagccctcctatt

SEQ ID NO: 9416186 - DNA, 18 bp, Homo sapiens
gaaagatgaacttttttc

SEQ ID NO: 9416187 - DNA, 22 bp, Homo sapiens
atgaggcagtacacacaaagcc

SEQ ID NO: 9416188 - DNA, 22 bp, Homo sapiens
atgaggcaggtggaggctgcca

SEQ ID NO: 9416189 - DNA, 22 bp, Homo sapiens
atgaggcaggagtgcagtggca

SEQ ID NO: 9416190 - DNA, 22 bp, Homo sapiens
atgaggcaggagcggggaccct

SEQ ID NO: 9416191 - DNA, 22 bp, Homo sapiens
atgaggcaggagcggggaccct

SEQ ID NO: 9416192 - DNA, 19 bp, Homo sapiens
gaaagatttcagttgagga

SEQ ID NO: 9416193 - DNA, 18 bp, Homo sapiens
gaaagatgaacttttttc

SEQ ID NO: 9416194 - DNA, 22 bp, Homo sapiens
gaaagcaagttgactgcagaat

SEQ ID NO: 9416195 - DNA, 22 bp, Homo sapiens
gaaagcaagttgactgcagaat

SEQ ID NO: 9416196 - DNA, 22 bp, Homo sapiens
gaaagcaagttgactgcagaat

SEQ ID NO: 9416197 - DNA, 22 bp, Homo sapiens
gaaagcaatttgtgtaatctgt

SEQ ID NO: 9416198 - DNA, 22 bp, Homo sapiens
gaaagcaatttgtgtaatctgt

SEQ ID NO: 9416199 - DNA, 22 bp, Homo sapiens
gaaagcaagttgactgcagaat

SEQ ID NO: 9416200 - DNA, 22 bp, Homo sapiens
gaaagcaatttgtgtaatctgt

SEQ ID NO: 9416201 - DNA, 22 bp, Homo sapiens
gaaagcaagttgactgcagaat

SEQ ID NO: 9416202 - DNA, 22 bp, Homo sapiens
gaaagcacgatagtagcaaaag

SEQ ID NO: 9416203 - DNA, 22 bp, Homo sapiens
gaaagcacagttctgaccatgt

SEQ ID NO: 9416204 - DNA, 22 bp, Homo sapiens
gaaagcacagttctgaccatgt

SEQ ID NO: 9416205 - DNA, 22 bp, Homo sapiens
gaaagcacagttctgaccatgt

SEQ ID NO: 9416206 - DNA, 22 bp, Homo sapiens
gaaagcacaggctcaggaacag

SEQ ID NO: 9416207 - DNA, 22 bp, Homo sapiens
gaaagcacagttcatgagacaa

SEQ ID NO: 9416208 - DNA, 22 bp, Homo sapiens
atgattcagcaattttatatct

SEQ ID NO: 9416209 - DNA, 22 bp, Homo sapiens
atgcaaaagtaactgtgatttt

SEQ ID NO: 9416210 - DNA, 22 bp, Homo sapiens
atgcaaaagtaactgtgatttt

SEQ ID NO: 9416211 - DNA, 22 bp, Homo sapiens
atgcaaaagtaactgtgatttt

SEQ ID NO: 9416212 - DNA, 22 bp, Homo sapiens
atgcaaaagtaactgtgatttt

SEQ ID NO: 9416213 - DNA, 22 bp, Homo sapiens
atgcaaaagtaattgcaatttt

SEQ ID NO: 9416214 - DNA, 22 bp, Homo sapiens
atgcaaaaactgcacttacgct

SEQ ID NO: 9416215 - DNA, 22 bp, Homo sapiens
atgcaaaagactatttgttgct

SEQ ID NO: 9416216 - DNA, 22 bp, Homo sapiens
atgcaaaagactatttgttgct

SEQ ID NO: 9416217 - DNA, 22 bp, Homo sapiens
atgattttttctaacacagtcg

SEQ ID NO: 9416218 - DNA, 22 bp, Homo sapiens
atgcaaaaactgcacttacgct

SEQ ID NO: 9416219 - DNA, 22 bp, Homo sapiens
atgagtgtttagaaaacactgg

SEQ ID NO: 9416220 - DNA, 22 bp, Homo sapiens
atgagttcaattgtttcagtca

SEQ ID NO: 9416221 - DNA, 22 bp, Homo sapiens
atgagttaggggcctgagtgga

SEQ ID NO: 9416222 - DNA, 22 bp, Homo sapiens
atgataagaacacagtatgggg

SEQ ID NO: 9416223 - DNA, 22 bp, Homo sapiens
atgataagccatgtcgtggtca

SEQ ID NO: 9416224 - DNA, 22 bp, Homo sapiens
atgattcaagaaaataggatgg

SEQ ID NO: 9416225 - DNA, 22 bp, Homo sapiens
atgatacaagcaaaactaatca

SEQ ID NO: 9416226 - DNA, 23 bp, Homo sapiens
atgataatgccattaactttgat

SEQ ID NO: 9416227 - DNA, 22 bp, Homo sapiens
atgaggccaccttctacatttc

SEQ ID NO: 9416228 - DNA, 22 bp, Homo sapiens
atgaggccaccttctacatttc

SEQ ID NO: 9416229 - DNA, 23 bp, Homo sapiens
atgaggtaaagatcagctttaaa

SEQ ID NO: 9416230 - DNA, 22 bp, Homo sapiens
atgaggccacagttatagattt

SEQ ID NO: 9416231 - DNA, 22 bp, Homo sapiens
gaaagcagtaaatgggtcccat

SEQ ID NO: 9416232 - DNA, 22 bp, Homo sapiens
gaaagcagtaaatgggtcccat

SEQ ID NO: 9416233 - DNA, 22 bp, Homo sapiens
gaaagcagctaagtcttatgat

SEQ ID NO: 9416234 - DNA, 22 bp, Homo sapiens
gaaagcagctaagtcttatgat

SEQ ID NO: 9416235 - DNA, 22 bp, Homo sapiens
gaaagcagatgaaattgcaaca

SEQ ID NO: 9416236 - DNA, 19 bp, Homo sapiens
atgaggtagcagctggtgc

SEQ ID NO: 9416237 - DNA, 22 bp, Homo sapiens
atgaggtatctcatttcctgaa

SEQ ID NO: 9416238 - DNA, 22 bp, Homo sapiens
atgaggtagtattagaaggaga

SEQ ID NO: 9416239 - DNA, 22 bp, Homo sapiens
atgaggtactagtatatacgta

SEQ ID NO: 9416240 - DNA, 22 bp, Homo sapiens
atgaggtattcgtaatatttcc

SEQ ID NO: 9416241 - DNA, 22 bp, Homo sapiens
atgaggttatatttaattcact

SEQ ID NO: 9416242 - DNA, 22 bp, Homo sapiens
atgaggtggtcttcagtaggtc

SEQ ID NO: 9416243 - DNA, 22 bp, Homo sapiens
atgaggtttgagcctcttgacc

SEQ ID NO: 9416244 - DNA, 22 bp, Homo sapiens
atgaggttttactgccattttc

SEQ ID NO: 9416245 - DNA, 22 bp, Homo sapiens
atgaggtttaggttcctcctct

SEQ ID NO: 9416246 - DNA, 22 bp, Homo sapiens
atgcagcttcaggattatgatg

SEQ ID NO: 9416247 - DNA, 22 bp, Homo sapiens
atgcagcttcaggattatgatg

SEQ ID NO: 9416248 - DNA, 22 bp, Homo sapiens
atgcagctatttgagcatgtca

SEQ ID NO: 9416249 - DNA, 22 bp, Homo sapiens
atgcagcagtttacaaagcaat

SEQ ID NO: 9416250 - DNA, 22 bp, Homo sapiens
atgcagctagattttccagtgt

SEQ ID NO: 9416251 - DNA, 19 bp, Homo sapiens
atgcatctgcattgacagg

SEQ ID NO: 9416252 - DNA, 22 bp, Homo sapiens
atgcatctatgacttagacatt

SEQ ID NO: 9416253 - DNA, 20 bp, Homo sapiens
atgcatctggtatctttcct

SEQ ID NO: 9416254 - DNA, 22 bp, Homo sapiens
atgcatcttatcaaaaattata

SEQ ID NO: 9416255 - DNA, 21 bp, Homo sapiens
atgcatctatcttctactcca

SEQ ID NO: 9416256 - DNA, 22 bp, Homo sapiens
atgcatatgcatggacactcag

SEQ ID NO: 9416257 - DNA, 22 bp, Homo sapiens
atgcatatgccgtagaataagt

SEQ ID NO: 9416258 - DNA, 22 bp, Homo sapiens
atgcatatgccgtagaataagt

SEQ ID NO: 9416259 - DNA, 22 bp, Homo sapiens
atgcatgcttcttatagtactt

SEQ ID NO: 9416260 - DNA, 22 bp, Homo sapiens
atgcatgcttcttatagtactt

SEQ ID NO: 9416261 - DNA, 22 bp, Homo sapiens
atgcatgcacacactgcattgc

SEQ ID NO: 9416262 - DNA, 22 bp, Homo sapiens
atgcatcttatcaaaaattata

SEQ ID NO: 9416263 - DNA, 22 bp, Homo sapiens
atgcatgatgaacttgctttca

SEQ ID NO: 9416264 - DNA, 22 bp, Homo sapiens
atgcattcagcggaatgcttag

SEQ ID NO: 9416265 - DNA, 22 bp, Homo sapiens
atgcattcagcggaatgcttag

SEQ ID NO: 9416266 - DNA, 22 bp, Homo sapiens
atgcatgttaagctcttaaaat

SEQ ID NO: 9416267 - DNA, 21 bp, Homo sapiens
atgcatgttccataaagtggg

SEQ ID NO: 9416268 - DNA, 22 bp, Homo sapiens
atgcatgtgtgaattatttgac

SEQ ID NO: 9416269 - DNA, 22 bp, Homo sapiens
atgcatgtgtgagagcaagagg

SEQ ID NO: 9416270 - DNA, 22 bp, Homo sapiens
atgcatgtgtgagagcaagagg

SEQ ID NO: 9416271 - DNA, 22 bp, Homo sapiens
atgcatgtcagctgtgcccatg

SEQ ID NO: 9416272 - DNA, 22 bp, Homo sapiens
atgcatgtgacatgatcctgga

SEQ ID NO: 9416273 - DNA, 22 bp, Homo sapiens
atgcatgtattcatgtgtgaca

SEQ ID NO: 9416274 - DNA, 22 bp, Homo sapiens
atgcatgtgcatggctctatct

SEQ ID NO: 9416275 - DNA, 22 bp, Homo sapiens
atgcatgtaacagtgttatgaa

SEQ ID NO: 9416276 - DNA, 22 bp, Homo sapiens
atgcatgtatatattacactca

SEQ ID NO: 9416277 - DNA, 22 bp, Homo sapiens
atgcatgtattatctagatgag

SEQ ID NO: 9416278 - DNA, 22 bp, Homo sapiens
atgcattgaggatgacatgagt

SEQ ID NO: 9416279 - DNA, 22 bp, Homo sapiens
atgcattctggaaagtagcaat

SEQ ID NO: 9416280 - DNA, 22 bp, Homo sapiens
atgcatttatgtgtgtacattg

SEQ ID NO: 9416281 - DNA, 22 bp, Homo sapiens
gacactctcctccagtggatag

SEQ ID NO: 9416282 - DNA, 22 bp, Homo sapiens
atgcatttatgtgtgtacattg

SEQ ID NO: 9416283 - DNA, 22 bp, Homo sapiens
atgcatttatgtgtgtacattg

SEQ ID NO: 9416284 - DNA, 22 bp, Homo sapiens
atgcaaaattaccattctgttc

SEQ ID NO: 9416285 - DNA, 22 bp, Homo sapiens
atgcaaaattaccattctgttc

SEQ ID NO: 9416286 - DNA, 22 bp, Homo sapiens
atgcaaaattaccattctgttc

SEQ ID NO: 9416287 - DNA, 20 bp, Homo sapiens
atgcaaactcacaaaatacc

SEQ ID NO: 9416288 - DNA, 22 bp, Homo sapiens
atgcaaacatgtttcctctaag

SEQ ID NO: 9416289 - DNA, 22 bp, Homo sapiens
atgcaaaattaccattctgttc

SEQ ID NO: 9416290 - DNA, 22 bp, Homo sapiens
atgcaaaagtagttgcagtttt

SEQ ID NO: 9416291 - DNA, 22 bp, Homo sapiens
atgcaaaagtaattgcaatttt

SEQ ID NO: 9416292 - DNA, 22 bp, Homo sapiens
atgcaaaagtaattgcaatttt

SEQ ID NO: 9416293 - DNA, 22 bp, Homo sapiens
atgcaaaagtaattgcaatttt

SEQ ID NO: 9416294 - DNA, 22 bp, Homo sapiens
atgcaaaataaggcagaaacat

SEQ ID NO: 9416295 - DNA, 22 bp, Homo sapiens
atgcaaaataaggcagaaacat

SEQ ID NO: 9416296 - DNA, 22 bp, Homo sapiens
atgcaaaagtagttgcagtttt

SEQ ID NO: 9416297 - DNA, 22 bp, Homo sapiens
atgcaaaagtagttgcagtttt

SEQ ID NO: 9416298 - DNA, 23 bp, Homo sapiens
atgcaaagtgctgtcatgtagac

SEQ ID NO: 9416299 - DNA, 22 bp, Homo sapiens
atgcaaagcaccacactaagat

SEQ ID NO: 9416300 - DNA, 22 bp, Homo sapiens
atgcaaagcacacacagaatcc

SEQ ID NO: 9416301 - DNA, 22 bp, Homo sapiens
atgcaaagcacacacagaatcc

SEQ ID NO: 9416302 - DNA, 22 bp, Homo sapiens
atgcaaataaagcaactataca

SEQ ID NO: 9416303 - DNA, 22 bp, Homo sapiens
atgcaaataaacagtctagttg

SEQ ID NO: 9416304 - DNA, 22 bp, Homo sapiens
atgcaaataaacagtctagttg

SEQ ID NO: 9416305 - DNA, 22 bp, Homo sapiens
atgcaaataaagcaactataca

SEQ ID NO: 9416306 - DNA, 22 bp, Homo sapiens
atgcaaataagtgcaggcgtgg

SEQ ID NO: 9416307 - DNA, 22 bp, Homo sapiens
atgcaaataaagcaactataca

SEQ ID NO: 9416308 - DNA, 22 bp, Homo sapiens
atgcaaatcttaagtatgtgtg

SEQ ID NO: 9416309 - DNA, 22 bp, Homo sapiens
atgcaaatcttaagtatgtgtg

SEQ ID NO: 9416310 - DNA, 22 bp, Homo sapiens
atgcaaatcttaagtatgtgtg

SEQ ID NO: 9416311 - DNA, 22 bp, Homo sapiens
atgcaaatgaacatgttgctag

SEQ ID NO: 9416312 - DNA, 19 bp, Homo sapiens
atgcaaatagatttggaat

SEQ ID NO: 9416313 - DNA, 22 bp, Homo sapiens
atgcaaataagtgcaggcgtgg

SEQ ID NO: 9416314 - DNA, 20 bp, Homo sapiens
atgcaaatcccaaaatcagg

SEQ ID NO: 9416315 - DNA, 20 bp, Homo sapiens
atgcaaatcccaaaatcagg

SEQ ID NO: 9416316 - DNA, 22 bp, Homo sapiens
atgcaaatattaatggtatgac

SEQ ID NO: 9416317 - DNA, 20 bp, Homo sapiens
atgcaaatcccaaaatcagg

SEQ ID NO: 9416318 - DNA, 22 bp, Homo sapiens
atgcacttcaagcatctctctg

SEQ ID NO: 9416319 - DNA, 22 bp, Homo sapiens
atgcacagtatgtagggtctat

SEQ ID NO: 9416320 - DNA, 22 bp, Homo sapiens
atgcacttaaataacataactt

SEQ ID NO: 9416321 - DNA, 22 bp, Homo sapiens
atgcagaaagcggcaaacaggt

SEQ ID NO: 9416322 - DNA, 22 bp, Homo sapiens
atgcagaaggagccatgcttgc

SEQ ID NO: 9416323 - DNA, 22 bp, Homo sapiens
atgcagaatcttgagaaaaatt

SEQ ID NO: 9416324 - DNA, 22 bp, Homo sapiens
atgcagaatgagttcacgatct

SEQ ID NO: 9416325 - DNA, 22 bp, Homo sapiens
atgcagaagcagaacttacaca

SEQ ID NO: 9416326 - DNA, 22 bp, Homo sapiens
atgcagaagactgaaaagctga

SEQ ID NO: 9416327 - DNA, 22 bp, Homo sapiens
atgcagaattgctaagtatctg

SEQ ID NO: 9416328 - DNA, 22 bp, Homo sapiens
atgcagaattgctaagtatctg

SEQ ID NO: 9416329 - DNA, 22 bp, Homo sapiens
atgcagacatgggagagttgag

SEQ ID NO: 9416330 - DNA, 23 bp, Homo sapiens
atgcagagaataacaaatgccat

SEQ ID NO: 9416331 - DNA, 21 bp, Homo sapiens
atgcagagaactccagggaag

SEQ ID NO: 9416332 - DNA, 19 bp, Homo sapiens
atgcagagaatggcagtag

SEQ ID NO: 9416333 - DNA, 22 bp, Homo sapiens
atgcagagcttccagtggcctg

SEQ ID NO: 9416334 - DNA, 22 bp, Homo sapiens
atgcagagacagatgtggcatg

SEQ ID NO: 9416335 - DNA, 22 bp, Homo sapiens
atgcagatttctttgctgcacc

SEQ ID NO: 9416336 - DNA, 22 bp, Homo sapiens
atgcagatgtttggttcattgt

SEQ ID NO: 9416337 - DNA, 22 bp, Homo sapiens
atgcagatgttcctactgtgtt

SEQ ID NO: 9416338 - DNA, 22 bp, Homo sapiens
atgcagatttaattagtatagg

SEQ ID NO: 9416339 - DNA, 22 bp, Homo sapiens
atgcagatttctttgctgcacc

SEQ ID NO: 9416340 - DNA, 22 bp, Homo sapiens
atgcagatgttcctactgtgtt

SEQ ID NO: 9416341 - DNA, 22 bp, Homo sapiens
atgcagatggtggatggagaaa

SEQ ID NO: 9416342 - DNA, 22 bp, Homo sapiens
atgcagatgggtgccaaagtct

SEQ ID NO: 9416343 - DNA, 22 bp, Homo sapiens
atgcagatatgcaaactgtagt

SEQ ID NO: 9416344 - DNA, 22 bp, Homo sapiens
atgcagataagaatcaggtttg

SEQ ID NO: 9416345 - DNA, 22 bp, Homo sapiens
atgcagataagaatcaggtttg

SEQ ID NO: 9416346 - DNA, 22 bp, Homo sapiens
atcttctcatgtgtaatgaggt

SEQ ID NO: 9416347 - DNA, 22 bp, Homo sapiens
atcttctgatttatggagcaat

SEQ ID NO: 9416348 - DNA, 22 bp, Homo sapiens
atcttctcaagcagcatcctgt

SEQ ID NO: 9416349 - DNA, 22 bp, Homo sapiens
atcttctcaagcagcatcctgt

SEQ ID NO: 9416350 - DNA, 22 bp, Homo sapiens
cttgtacactcagtacttctag

SEQ ID NO: 9416351 - DNA, 22 bp, Homo sapiens
atcttcctttgccatgggatag

SEQ ID NO: 9416352 - DNA, 22 bp, Homo sapiens
cttgtaaatgcagattctgatt

SEQ ID NO: 9416353 - DNA, 22 bp, Homo sapiens
atcttgaaatactttctagaat

SEQ ID NO: 9416354 - DNA, 22 bp, Homo sapiens
atcttgaaatactttctagaat

SEQ ID NO: 9416355 - DNA, 22 bp, Homo sapiens
atcttgaaggttctaccataca

SEQ ID NO: 9416356 - DNA, 22 bp, Homo sapiens
atcttcttcaaggatctggagc

SEQ ID NO: 9416357 - DNA, 22 bp, Homo sapiens
atcttcttcaaggatctggagc

SEQ ID NO: 9416358 - DNA, 20 bp, Homo sapiens
atcttcttggccagcttgct

SEQ ID NO: 9416359 - DNA, 22 bp, Homo sapiens
cttggtgccacagcagcttgcg

SEQ ID NO: 9416360 - DNA, 19 bp, Homo sapiens
cttggtgcttgcccttggc

SEQ ID NO: 9416361 - DNA, 16 bp, Homo sapiens
cttggtgttggcagag

SEQ ID NO: 9416362 - DNA, 22 bp, Homo sapiens
cttggttatactccaggaacca

SEQ ID NO: 9416363 - DNA, 22 bp, Homo sapiens
cttggttatactccaggaacca

SEQ ID NO: 9416364 - DNA, 22 bp, Homo sapiens
cttggtctagtgagtgagcata

SEQ ID NO: 9416365 - DNA, 22 bp, Homo sapiens
cttggtgagactcccacccacc

SEQ ID NO: 9416366 - DNA, 22 bp, Homo sapiens
cttggtttacctaaacaatagg

SEQ ID NO: 9416367 - DNA, 22 bp, Homo sapiens
cttggttaggttatgaatgccc

SEQ ID NO: 9416368 - DNA, 19 bp, Homo sapiens
cttggttatggtatgatgc

SEQ ID NO: 9416369 - DNA, 22 bp, Homo sapiens
cttgtaaaaggtacattatgct

SEQ ID NO: 9416370 - DNA, 22 bp, Homo sapiens
cttgtaaacttgagcagggcat

SEQ ID NO: 9416371 - DNA, 22 bp, Homo sapiens
cttgtaaactttctaggcctat

SEQ ID NO: 9416372 - DNA, 22 bp, Homo sapiens
cttgtaaacttgagcagggcat

SEQ ID NO: 9416373 - DNA, 22 bp, Homo sapiens
cttgtaaaatatccagttaagg

SEQ ID NO: 9416374 - DNA, 22 bp, Homo sapiens
cttgtaaaatatccagttaagg

SEQ ID NO: 9416375 - DNA, 22 bp, Homo sapiens
cttgtaaaaggtacattatgct

SEQ ID NO: 9416376 - DNA, 22 bp, Homo sapiens
cttgtaaaatatccagttaagg

SEQ ID NO: 9416377 - DNA, 22 bp, Homo sapiens
cttgtaaatgcagattctgatt

SEQ ID NO: 9416378 - DNA, 19 bp, Homo sapiens
cttgtaaagggctgtttct

SEQ ID NO: 9416379 - DNA, 22 bp, Homo sapiens
cttgtaaatgcagattctgatt

SEQ ID NO: 9416380 - DNA, 22 bp, Homo sapiens
cttgggtgtgaccttggcattg

SEQ ID NO: 9416381 - DNA, 22 bp, Homo sapiens
cttgggtgttttaaaactagat

SEQ ID NO: 9416382 - DNA, 22 bp, Homo sapiens
cttgggtgtgaccttggcattg

SEQ ID NO: 9416383 - DNA, 22 bp, Homo sapiens
cttggcctgcaggcagcagcgc

SEQ ID NO: 9416384 - DNA, 22 bp, Homo sapiens
cttggcctgcccagccagaagg

SEQ ID NO: 9416385 - DNA, 22 bp, Homo sapiens
cttggcctgtggctcaagaatt

SEQ ID NO: 9416386 - DNA, 22 bp, Homo sapiens
cttggctccaatcccagctctg

SEQ ID NO: 9416387 - DNA, 22 bp, Homo sapiens
cttggctccaatcccagctctg

SEQ ID NO: 9416388 - DNA, 22 bp, Homo sapiens
cttggctctgtgttgatgggac

SEQ ID NO: 9416389 - DNA, 22 bp, Homo sapiens
cttgctggctggcaacctgggc

SEQ ID NO: 9416390 - DNA, 22 bp, Homo sapiens
cttgctggggtaagtctgtgct

SEQ ID NO: 9416391 - DNA, 22 bp, Homo sapiens
cttgctggagcggagcgggtgt

SEQ ID NO: 9416392 - DNA, 22 bp, Homo sapiens
cttgctggagcggagcgggtgt

SEQ ID NO: 9416393 - DNA, 22 bp, Homo sapiens
cttggcccggagccccatgaag

SEQ ID NO: 9416394 - DNA, 22 bp, Homo sapiens
cttggcccagttgccaaggaaa

SEQ ID NO: 9416395 - DNA, 22 bp, Homo sapiens
cttggcccagttgccaaggaaa

SEQ ID NO: 9416396 - DNA, 19 bp, Homo sapiens
cttggcatctgtgaagtga

SEQ ID NO: 9416397 - DNA, 22 bp, Homo sapiens
cttggcatgcagcaggcactca

SEQ ID NO: 9416398 - DNA, 22 bp, Homo sapiens
cttggccagacagggagctcca

SEQ ID NO: 9416399 - DNA, 22 bp, Homo sapiens
atctacataaaacgaatacata

SEQ ID NO: 9416400 - DNA, 22 bp, Homo sapiens
atctacatgttgatttaaagaa

SEQ ID NO: 9416401 - DNA, 22 bp, Homo sapiens
atctactttacaaatcatctcc

SEQ ID NO: 9416402 - DNA, 22 bp, Homo sapiens
atctagaaaaggtgactaaaat

SEQ ID NO: 9416403 - DNA, 22 bp, Homo sapiens
atctacataaaacgaatacata

SEQ ID NO: 9416404 - DNA, 22 bp, Homo sapiens
atctacataaaacgaatacata

SEQ ID NO: 9416405 - DNA, 22 bp, Homo sapiens
atctacataaaacgaatacata

SEQ ID NO: 9416406 - DNA, 22 bp, Homo sapiens
atctacaggattttacagagtt

SEQ ID NO: 9416407 - DNA, 19 bp, Homo sapiens
atctacaattattctcagt

SEQ ID NO: 9416408 - DNA, 22 bp, Homo sapiens
atctacactataacagaatgct

SEQ ID NO: 9416409 - DNA, 22 bp, Homo sapiens
atctacagcagtgccaggtagc

SEQ ID NO: 9416410 - DNA, 22 bp, Homo sapiens
atctaggatttgaatgcacagt

SEQ ID NO: 9416411 - DNA, 22 bp, Homo sapiens
atctagcagtgttataattgga

SEQ ID NO: 9416412 - DNA, 22 bp, Homo sapiens
atctagaaagtgttgaagatca

SEQ ID NO: 9416413 - DNA, 22 bp, Homo sapiens
cttgctcacagtacctggcttg

SEQ ID NO: 9416414 - DNA, 22 bp, Homo sapiens
cttgctcacagtacctggcttg

SEQ ID NO: 9416415 - DNA, 22 bp, Homo sapiens
cttgctcattaagtagctcaca

SEQ ID NO: 9416416 - DNA, 22 bp, Homo sapiens
cttgctgctgcatctgagcatg

SEQ ID NO: 9416417 - DNA, 22 bp, Homo sapiens
cttgctggaaactctctctgcc

SEQ ID NO: 9416418 - DNA, 22 bp, Homo sapiens
cttgcctttgtcttcaaaggct

SEQ ID NO: 9416419 - DNA, 22 bp, Homo sapiens
cttgcctttgtcttcaaaggct

SEQ ID NO: 9416420 - DNA, 22 bp, Homo sapiens
cttgcctttgtcttcaaaggct

SEQ ID NO: 9416421 - DNA, 22 bp, Homo sapiens
atctatatcatggggtaaggta

SEQ ID NO: 9416422 - DNA, 22 bp, Homo sapiens
atctatacccatcatgatttaa

SEQ ID NO: 9416423 - DNA, 22 bp, Homo sapiens
atctatacccatcatgatttaa

SEQ ID NO: 9416424 - DNA, 22 bp, Homo sapiens
atctagggtgtaggtcactgat

SEQ ID NO: 9416425 - DNA, 22 bp, Homo sapiens
atctattatgctgagaaactgt

SEQ ID NO: 9416426 - DNA, 22 bp, Homo sapiens
atctattatgctgagaaactgt

SEQ ID NO: 9416427 - DNA, 22 bp, Homo sapiens
cttgagtattttaatccataat

SEQ ID NO: 9416428 - DNA, 22 bp, Homo sapiens
cttgagtcatataaagacagag

SEQ ID NO: 9416429 - DNA, 22 bp, Homo sapiens
cttgcctgctggagcagggctc

SEQ ID NO: 9416430 - DNA, 23 bp, Homo sapiens
cttgcctggcctctctgcccaga

SEQ ID NO: 9416431 - DNA, 22 bp, Homo sapiens
cttgatcctaggatggaaggga

SEQ ID NO: 9416432 - DNA, 22 bp, Homo sapiens
cttgatctacatagtgaaaccc

SEQ ID NO: 9416433 - DNA, 19 bp, Homo sapiens
cttgcctgttcctacagct

SEQ ID NO: 9416434 - DNA, 22 bp, Homo sapiens
atgaaatatttcagagcagagt

SEQ ID NO: 9416435 - DNA, 22 bp, Homo sapiens
atgaaatatttcagagcagagt

SEQ ID NO: 9416436 - DNA, 22 bp, Homo sapiens
atgaaatattctttggtaagaa

SEQ ID NO: 9416437 - DNA, 22 bp, Homo sapiens
atgaaatatcttgaagaaattc

SEQ ID NO: 9416438 - DNA, 22 bp, Homo sapiens
atgaaatatcttgaagaaattc

SEQ ID NO: 9416439 - DNA, 22 bp, Homo sapiens
atgaaatgattgaaatctttac

SEQ ID NO: 9416440 - DNA, 23 bp, Homo sapiens
atgaaatgatactttattcactg

SEQ ID NO: 9416441 - DNA, 22 bp, Homo sapiens
atgaaatatcttgaagaaattc

SEQ ID NO: 9416442 - DNA, 22 bp, Homo sapiens
atgaaatatcttgaagaaattc

SEQ ID NO: 9416443 - DNA, 22 bp, Homo sapiens
atgaaatatcttgaagaaattc

SEQ ID NO: 9416444 - DNA, 22 bp, Homo sapiens
atgaaatatcttgaagaaattc

SEQ ID NO: 9416445 - DNA, 22 bp, Homo sapiens
atgaaatatcttgaagaaattc

SEQ ID NO: 9416446 - DNA, 22 bp, Homo sapiens
atgaaatatcttgaagaaattc

SEQ ID NO: 9416447 - DNA, 22 bp, Homo sapiens
atgaaatatcttgaagaaattc

SEQ ID NO: 9416448 - DNA, 22 bp, Homo sapiens
atgaaatatcttgaagaaattc

SEQ ID NO: 9416449 - DNA, 22 bp, Homo sapiens
atgaaatatcttgaagaaattc

SEQ ID NO: 9416450 - DNA, 22 bp, Homo sapiens
atgaaatatcttgaagaaattc

SEQ ID NO: 9416451 - DNA, 22 bp, Homo sapiens
atgaaatatcttgaagaaattc

SEQ ID NO: 9416452 - DNA, 22 bp, Homo sapiens
atgaaatatcttgaagaaattc

SEQ ID NO: 9416453 - DNA, 23 bp, Homo sapiens
atgaaatgctggctcagggaggt

SEQ ID NO: 9416454 - DNA, 22 bp, Homo sapiens
atgaaatgtaagtagagagttt

SEQ ID NO: 9416455 - DNA, 22 bp, Homo sapiens
atgaaatgattgaaatctttac

SEQ ID NO: 9416456 - DNA, 22 bp, Homo sapiens
atgaaatgattgaaatctttac

SEQ ID NO: 9416457 - DNA, 22 bp, Homo sapiens
atgaaatgctgagaggtgcttc

SEQ ID NO: 9416458 - DNA, 22 bp, Homo sapiens
atgaaatgtaagtagagagttt

SEQ ID NO: 9416459 - DNA, 22 bp, Homo sapiens
atgaaatgtaagtagagagttt

SEQ ID NO: 9416460 - DNA, 22 bp, Homo sapiens
atgaaatgtatgagtctgggtt

SEQ ID NO: 9416461 - DNA, 22 bp, Homo sapiens
atgaaatgtattcagatatgta

SEQ ID NO: 9416462 - DNA, 22 bp, Homo sapiens
atgaaatgtattcagatatgta

SEQ ID NO: 9416463 - DNA, 19 bp, Homo sapiens
cttttcatcaacagccaat

SEQ ID NO: 9416464 - DNA, 22 bp, Homo sapiens
cttttcatgagtctgttatggg

SEQ ID NO: 9416465 - DNA, 19 bp, Homo sapiens
cttttcatcaacagccaat

SEQ ID NO: 9416466 - DNA, 22 bp, Homo sapiens
cttttcatgccagcccatcaca

SEQ ID NO: 9416467 - DNA, 22 bp, Homo sapiens
cttttcatgagtctgttatggg

SEQ ID NO: 9416468 - DNA, 22 bp, Homo sapiens
cttttcatgagtctgttatggg

SEQ ID NO: 9416469 - DNA, 23 bp, Homo sapiens
cttttcattgccttagcgcagag

SEQ ID NO: 9416470 - DNA, 22 bp, Homo sapiens
cttttcatgccagcccatcaca

SEQ ID NO: 9416471 - DNA, 22 bp, Homo sapiens
cttttcatgccagcccatcaca

SEQ ID NO: 9416472 - DNA, 23 bp, Homo sapiens
cttttcattgccttagcgcagag

SEQ ID NO: 9416473 - DNA, 22 bp, Homo sapiens
cttttcaaacgctgatgtcagt

SEQ ID NO: 9416474 - DNA, 22 bp, Homo sapiens
cttttcaggctacattatggga

SEQ ID NO: 9416475 - DNA, 19 bp, Homo sapiens
cttttcatcaacagccaat

SEQ ID NO: 9416476 - DNA, 19 bp, Homo sapiens
cttttcatcaacagccaat

SEQ ID NO: 9416477 - DNA, 22 bp, Homo sapiens
atgaaatgttggtcccaatcgc

SEQ ID NO: 9416478 - DNA, 22 bp, Homo sapiens
atgaaattaatcaacacataca

SEQ ID NO: 9416479 - DNA, 20 bp, Homo sapiens
ctttggtgggggtagcccag

SEQ ID NO: 9416480 - DNA, 22 bp, Homo sapiens
cttttacatttgttgaagagta

SEQ ID NO: 9416481 - DNA, 22 bp, Homo sapiens
cttttagtattctgatttgcca

SEQ ID NO: 9416482 - DNA, 22 bp, Homo sapiens
cttttattttgaattaagggct

SEQ ID NO: 9416483 - DNA, 22 bp, Homo sapiens
cttttagtattctgatttgcca

SEQ ID NO: 9416484 - DNA, 22 bp, Homo sapiens
cttttattttgaattaagggct

SEQ ID NO: 9416485 - DNA, 22 bp, Homo sapiens
cttttattttgaattaagggct

SEQ ID NO: 9416486 - DNA, 22 bp, Homo sapiens
cttttattttgaattaagggct

SEQ ID NO: 9416487 - DNA, 22 bp, Homo sapiens
atctttttgacatggtgatggt

SEQ ID NO: 9416488 - DNA, 22 bp, Homo sapiens
atctttttatctgtttggaaca

SEQ ID NO: 9416489 - DNA, 22 bp, Homo sapiens
atctttttatctgtttggaaca

SEQ ID NO: 9416490 - DNA, 22 bp, Homo sapiens
atctttttactaacactgctta

SEQ ID NO: 9416491 - DNA, 22 bp, Homo sapiens
atctttttactaacactgctta

SEQ ID NO: 9416492 - DNA, 22 bp, Homo sapiens
atgaaaacggaccagagctatt

SEQ ID NO: 9416493 - DNA, 22 bp, Homo sapiens
atgaaaacggaccagagctatt

SEQ ID NO: 9416494 - DNA, 22 bp, Homo sapiens
atgaaaacggaccagagctatt

SEQ ID NO: 9416495 - DNA, 22 bp, Homo sapiens
atgaaaacggaccagagctatt

SEQ ID NO: 9416496 - DNA, 22 bp, Homo sapiens
atgaaaactttagcctcattag

SEQ ID NO: 9416497 - DNA, 22 bp, Homo sapiens
atcttttttgtcttggtcactg

SEQ ID NO: 9416498 - DNA, 22 bp, Homo sapiens
atctttttgacatggtgatggt

SEQ ID NO: 9416499 - DNA, 22 bp, Homo sapiens
atcttttttgtcttggtcactg

SEQ ID NO: 9416500 - DNA, 22 bp, Homo sapiens
atcttttactacaaatcaggtg

SEQ ID NO: 9416501 - DNA, 22 bp, Homo sapiens
atcttttctgtttgctatgtct

SEQ ID NO: 9416502 - DNA, 22 bp, Homo sapiens
atctttgttgctctcatttctg

SEQ ID NO: 9416503 - DNA, 22 bp, Homo sapiens
atctttgggcaatgatgaggga

SEQ ID NO: 9416504 - DNA, 22 bp, Homo sapiens
atctttgttgctctcatttctg

SEQ ID NO: 9416505 - DNA, 22 bp, Homo sapiens
atcttgatcaaggctatcatga

SEQ ID NO: 9416506 - DNA, 22 bp, Homo sapiens
atcttgattccattatctttgt

SEQ ID NO: 9416507 - DNA, 22 bp, Homo sapiens
atcttgctgctacaaagtgccc

SEQ ID NO: 9416508 - DNA, 22 bp, Homo sapiens
atctttgggcaatgatgaggga

SEQ ID NO: 9416509 - DNA, 22 bp, Homo sapiens
atctttgggatcctgatttact

SEQ ID NO: 9416510 - DNA, 22 bp, Homo sapiens
cttgttatctccgtgtccttgt

SEQ ID NO: 9416511 - DNA, 22 bp, Homo sapiens
cttgttatctccgtgtccttgt

SEQ ID NO: 9416512 - DNA, 22 bp, Homo sapiens
cttgttatctccgtgtccttgt

SEQ ID NO: 9416513 - DNA, 22 bp, Homo sapiens
cttgttattggaaatgtcatgc

SEQ ID NO: 9416514 - DNA, 22 bp, Homo sapiens
cttgttatctgaaccaaaatta

SEQ ID NO: 9416515 - DNA, 22 bp, Homo sapiens
cttgttcagtcctgacttcctg

SEQ ID NO: 9416516 - DNA, 22 bp, Homo sapiens
cttgttcagttgcctctcctgc

SEQ ID NO: 9416517 - DNA, 22 bp, Homo sapiens
cttgttcatctgcataccaagt

SEQ ID NO: 9416518 - DNA, 22 bp, Homo sapiens
cttgtgtggtctggtcttgcta

SEQ ID NO: 9416519 - DNA, 22 bp, Homo sapiens
cttgttaaaatgccgattctga

SEQ ID NO: 9416520 - DNA, 22 bp, Homo sapiens
cttgttaaaatgcagattccaa

SEQ ID NO: 9416521 - DNA, 22 bp, Homo sapiens
cttgtgttgtacattctatggg

SEQ ID NO: 9416522 - DNA, 22 bp, Homo sapiens
cttgttaaattatataagcaga

SEQ ID NO: 9416523 - DNA, 22 bp, Homo sapiens
cttgtgtggtctggtcttgcta

SEQ ID NO: 9416524 - DNA, 22 bp, Homo sapiens
cttgtggcccatggcttcctgc

SEQ ID NO: 9416525 - DNA, 17 bp, Homo sapiens
cttgtggccagttttta

SEQ ID NO: 9416526 - DNA, 22 bp, Homo sapiens
atgaaaagcataaacgctgaag

SEQ ID NO: 9416527 - DNA, 22 bp, Homo sapiens
atgaaaagttcgatctagaagg

SEQ ID NO: 9416528 - DNA, 22 bp, Homo sapiens
atgaaagtttgcattcctcagt

SEQ ID NO: 9416529 - DNA, 22 bp, Homo sapiens
atgaaatatcttgaagaaattc

SEQ ID NO: 9416530 - DNA, 22 bp, Homo sapiens
atgaaataaatacccacacata

SEQ ID NO: 9416531 - DNA, 22 bp, Homo sapiens
cttgttgctgaattcaggattc

SEQ ID NO: 9416532 - DNA, 22 bp, Homo sapiens
gatgagggcctggtggctgtgc

SEQ ID NO: 9416533 - DNA, 18 bp, Homo sapiens
gatgaggctgtctgagaa

SEQ ID NO: 9416534 - DNA, 22 bp, Homo sapiens
gatgaggtctacattgttaaaa

SEQ ID NO: 9416535 - DNA, 22 bp, Homo sapiens
gatgaggtcatgttttacatat

SEQ ID NO: 9416536 - DNA, 22 bp, Homo sapiens
attaaatgttccttaaattata

SEQ ID NO: 9416537 - DNA, 22 bp, Homo sapiens
attaaatgttccttaaattata

SEQ ID NO: 9416538 - DNA, 22 bp, Homo sapiens
attaaatgttccttaaattata

SEQ ID NO: 9416539 - DNA, 22 bp, Homo sapiens
attaaatgttccttaaattata

SEQ ID NO: 9416540 - DNA, 22 bp, Homo sapiens
attaaatgttggacgtatacat

SEQ ID NO: 9416541 - DNA, 22 bp, Homo sapiens
attaaatgttggcatattttgt

SEQ ID NO: 9416542 - DNA, 22 bp, Homo sapiens
attaaattaagtggctaattta

SEQ ID NO: 9416543 - DNA, 22 bp, Homo sapiens
attaaattaagtggctaattta

SEQ ID NO: 9416544 - DNA, 22 bp, Homo sapiens
attaaattaagtggctaattta

SEQ ID NO: 9416545 - DNA, 22 bp, Homo sapiens
attaaattaagtggctaattta

SEQ ID NO: 9416546 - DNA, 22 bp, Homo sapiens
attaaattaagtggctaattta

SEQ ID NO: 9416547 - DNA, 22 bp, Homo sapiens
attaaattaagtggctaattta

SEQ ID NO: 9416548 - DNA, 22 bp, Homo sapiens
gatgaggaatttgaggttagaa

SEQ ID NO: 9416549 - DNA, 22 bp, Homo sapiens
gatgaggcaagccagaggactg

SEQ ID NO: 9416550 - DNA, 22 bp, Homo sapiens
attaaattagcaaactgtgaaa

SEQ ID NO: 9416551 - DNA, 22 bp, Homo sapiens
atgtttttggaaatgggaacat

SEQ ID NO: 9416552 - DNA, 22 bp, Homo sapiens
atgtttttggaaatgggaacat

SEQ ID NO: 9416553 - DNA, 22 bp, Homo sapiens
atgtttttggaaatgggaacat

SEQ ID NO: 9416554 - DNA, 22 bp, Homo sapiens
atgtttttggaaatgggaacat

SEQ ID NO: 9416555 - DNA, 22 bp, Homo sapiens
atgtttttggcttcaagtttct

SEQ ID NO: 9416556 - DNA, 22 bp, Homo sapiens
atgtttttggcttcaagtttct

SEQ ID NO: 9416557 - DNA, 22 bp, Homo sapiens
attaaaagagataatgtgtgtt

SEQ ID NO: 9416558 - DNA, 22 bp, Homo sapiens
attaaaagcttcccaagagtta

SEQ ID NO: 9416559 - DNA, 22 bp, Homo sapiens
atgtttttgagatacaaacaga

SEQ ID NO: 9416560 - DNA, 22 bp, Homo sapiens
atgtttttgagatacaaacaga

SEQ ID NO: 9416561 - DNA, 22 bp, Homo sapiens
atgtttttgagatacaaacaga

SEQ ID NO: 9416562 - DNA, 22 bp, Homo sapiens
atgtttttgagatacaaacaga

SEQ ID NO: 9416563 - DNA, 22 bp, Homo sapiens
atgtttttaaatagacttacag

SEQ ID NO: 9416564 - DNA, 22 bp, Homo sapiens
atgtttttcataccagtgttgg

SEQ ID NO: 9416565 - DNA, 22 bp, Homo sapiens
attaaatactgcaggctaagca

SEQ ID NO: 9416566 - DNA, 22 bp, Homo sapiens
attaaatactgcaggctaagca

SEQ ID NO: 9416567 - DNA, 22 bp, Homo sapiens
attaaatactgcaggctaagca

SEQ ID NO: 9416568 - DNA, 22 bp, Homo sapiens
attaaatactgcaggctaagca

SEQ ID NO: 9416569 - DNA, 22 bp, Homo sapiens
attaaatgatggcatgtcttat

SEQ ID NO: 9416570 - DNA, 22 bp, Homo sapiens
attaaatgatggcatgtcttat

SEQ ID NO: 9416571 - DNA, 22 bp, Homo sapiens
attaaatgttccttaaattata

SEQ ID NO: 9416572 - DNA, 22 bp, Homo sapiens
attaaatggtggtcattcattt

SEQ ID NO: 9416573 - DNA, 22 bp, Homo sapiens
attaaatggtggtcattcattt

SEQ ID NO: 9416574 - DNA, 22 bp, Homo sapiens
attaaatactgcaggctaagca

SEQ ID NO: 9416575 - DNA, 22 bp, Homo sapiens
attaaaattccaaggtatgcca

SEQ ID NO: 9416576 - DNA, 22 bp, Homo sapiens
attaaaagcttcccaagagtta

SEQ ID NO: 9416577 - DNA, 22 bp, Homo sapiens
attaaaagcttcccaagagtta

SEQ ID NO: 9416578 - DNA, 22 bp, Homo sapiens
attaaaagcttcccaagagtta

SEQ ID NO: 9416579 - DNA, 22 bp, Homo sapiens
atgttttctagagtttaaaatc

SEQ ID NO: 9416580 - DNA, 22 bp, Homo sapiens
atgttttcaaagtaaacttgta

SEQ ID NO: 9416581 - DNA, 19 bp, Homo sapiens
atgttttatgctgatggga

SEQ ID NO: 9416582 - DNA, 22 bp, Homo sapiens
atgttttatgcttcagatgagg

SEQ ID NO: 9416583 - DNA, 22 bp, Homo sapiens
atgttttatgcttcagatgagg

SEQ ID NO: 9416584 - DNA, 22 bp, Homo sapiens
atgttttatgttccactcaagg

SEQ ID NO: 9416585 - DNA, 20 bp, Homo sapiens
atgttttataaaagaacggg

SEQ ID NO: 9416586 - DNA, 20 bp, Homo sapiens
atgttttataaaagaacggg

SEQ ID NO: 9416587 - DNA, 22 bp, Homo sapiens
atgttttaccctttgcacaaac

SEQ ID NO: 9416588 - DNA, 22 bp, Homo sapiens
atgttttaccctttgcacaaac

SEQ ID NO: 9416589 - DNA, 22 bp, Homo sapiens
atgtttctgaagtttacagata

SEQ ID NO: 9416590 - DNA, 22 bp, Homo sapiens
atgtgtttggttatatggtatt

SEQ ID NO: 9416591 - DNA, 22 bp, Homo sapiens
atgtgtttgtacctttaaatat

SEQ ID NO: 9416592 - DNA, 22 bp, Homo sapiens
atgtgttttggtaatttctgct

SEQ ID NO: 9416593 - DNA, 22 bp, Homo sapiens
atgtgttttggtggatcattca

SEQ ID NO: 9416594 - DNA, 22 bp, Homo sapiens
atgtgtttttattctggcatgt

SEQ ID NO: 9416595 - DNA, 22 bp, Homo sapiens
atgtgtttttattctggcatgt

SEQ ID NO: 9416596 - DNA, 22 bp, Homo sapiens
atgttaaaaaccagtacagttg

SEQ ID NO: 9416597 - DNA, 22 bp, Homo sapiens
atgtgtgtgtttaatcctcaaa

SEQ ID NO: 9416598 - DNA, 22 bp, Homo sapiens
atgtgtgtgtttaatcctcaaa

SEQ ID NO: 9416599 - DNA, 22 bp, Homo sapiens
atgtgttaatgtcaaccagaaa

SEQ ID NO: 9416600 - DNA, 22 bp, Homo sapiens
atgtgtgtgtttaatcctcaaa

SEQ ID NO: 9416601 - DNA, 22 bp, Homo sapiens
atgtgttaatgagcaatgacct

SEQ ID NO: 9416602 - DNA, 22 bp, Homo sapiens
atgtgttcacgtgcacatgtgc

SEQ ID NO: 9416603 - DNA, 22 bp, Homo sapiens
atgtgttaatgtcaaccagaaa

SEQ ID NO: 9416604 - DNA, 22 bp, Homo sapiens
atgtgttagtttgtgattatac

SEQ ID NO: 9416605 - DNA, 22 bp, Homo sapiens
atgtgtgtgtgcgcgcgcagga

SEQ ID NO: 9416606 - DNA, 22 bp, Homo sapiens
atgtgtgtgtgcgcgcgcagga

SEQ ID NO: 9416607 - DNA, 22 bp, Homo sapiens
atgtgtgtgtgcgcgcgcagga

SEQ ID NO: 9416608 - DNA, 22 bp, Homo sapiens
atgtgtgtgtttaatcctcaaa

SEQ ID NO: 9416609 - DNA, 22 bp, Homo sapiens
atgtgtgtgtttaatcctcaaa

SEQ ID NO: 9416610 - DNA, 22 bp, Homo sapiens
atgtgtgtgtatatacacacat

SEQ ID NO: 9416611 - DNA, 22 bp, Homo sapiens
atgtgtgtgtatatacacacat

SEQ ID NO: 9416612 - DNA, 22 bp, Homo sapiens
atgtgtgtgtgcgcgcgcagga

SEQ ID NO: 9416613 - DNA, 22 bp, Homo sapiens
atgtgtgtgtatatacacacat

SEQ ID NO: 9416614 - DNA, 22 bp, Homo sapiens
atgtgtgtgtatatacacacat

SEQ ID NO: 9416615 - DNA, 22 bp, Homo sapiens
attacaactacataatctcaga

SEQ ID NO: 9416616 - DNA, 22 bp, Homo sapiens
attacaataaggtttatttgta

SEQ ID NO: 9416617 - DNA, 22 bp, Homo sapiens
attacaagtttcagtgttttgc

SEQ ID NO: 9416618 - DNA, 22 bp, Homo sapiens
attacaagtagactaactttca

SEQ ID NO: 9416619 - DNA, 22 bp, Homo sapiens
attacaagggtctgactggagg

SEQ ID NO: 9416620 - DNA, 22 bp, Homo sapiens
attacaaaagaagggagaaggt

SEQ ID NO: 9416621 - DNA, 22 bp, Homo sapiens
attacaaaagaagggagaaggt

SEQ ID NO: 9416622 - DNA, 22 bp, Homo sapiens
attaatttttctgacagccaca

SEQ ID NO: 9416623 - DNA, 22 bp, Homo sapiens
attaatttttctgacagccaca

SEQ ID NO: 9416624 - DNA, 22 bp, Homo sapiens
attacaaaagaagggagaaggt

SEQ ID NO: 9416625 - DNA, 22 bp, Homo sapiens
attacaaaagaagggagaaggt

SEQ ID NO: 9416626 - DNA, 22 bp, Homo sapiens
attacaaaagaagggagaaggt

SEQ ID NO: 9416627 - DNA, 22 bp, Homo sapiens
attacaaaagaagggagaaggt

SEQ ID NO: 9416628 - DNA, 22 bp, Homo sapiens
attacaaaagaagggagaaggt

SEQ ID NO: 9416629 - DNA, 22 bp, Homo sapiens
gcaaggctgacctctctagact

SEQ ID NO: 9416630 - DNA, 22 bp, Homo sapiens
gcaagaaaaaggcttcatgaac

SEQ ID NO: 9416631 - DNA, 22 bp, Homo sapiens
attacaataatacatgctcatt

SEQ ID NO: 9416632 - DNA, 22 bp, Homo sapiens
attacaataatacatgctcatt

SEQ ID NO: 9416633 - DNA, 22 bp, Homo sapiens
attacaataatacatgctcatt

SEQ ID NO: 9416634 - DNA, 22 bp, Homo sapiens
gcaactttagggccagcaagta

SEQ ID NO: 9416635 - DNA, 22 bp, Homo sapiens
gcaactttcaagcaccatgggg

SEQ ID NO: 9416636 - DNA, 22 bp, Homo sapiens
gcaactttcaagcaccatgggg

SEQ ID NO: 9416637 - DNA, 22 bp, Homo sapiens
gcaacttaggagttagagcatg

SEQ ID NO: 9416638 - DNA, 22 bp, Homo sapiens
attacaataaggtttatttgta

SEQ ID NO: 9416639 - DNA, 22 bp, Homo sapiens
attacaataaggtttatttgta

SEQ ID NO: 9416640 - DNA, 22 bp, Homo sapiens
attacaataatacatgctcatt

SEQ ID NO: 9416641 - DNA, 22 bp, Homo sapiens
attaatgacgcagataataatt

SEQ ID NO: 9416642 - DNA, 20 bp, Homo sapiens
attaatgaatacattttgat

SEQ ID NO: 9416643 - DNA, 22 bp, Homo sapiens
attaatcatttctgcattatct

SEQ ID NO: 9416644 - DNA, 18 bp, Homo sapiens
attaatcataaaatgctg

SEQ ID NO: 9416645 - DNA, 22 bp, Homo sapiens
attaatcatttctgcattatct

SEQ ID NO: 9416646 - DNA, 22 bp, Homo sapiens
attaatattggttcattagctg

SEQ ID NO: 9416647 - DNA, 22 bp, Homo sapiens
attaatatttgcaccttctgtc

SEQ ID NO: 9416648 - DNA, 22 bp, Homo sapiens
attaattgggaacttgttgaaa

SEQ ID NO: 9416649 - DNA, 22 bp, Homo sapiens
attaatgtctaccagttgtgtg

SEQ ID NO: 9416650 - DNA, 22 bp, Homo sapiens
attaatgtgtagccaacttaat

SEQ ID NO: 9416651 - DNA, 22 bp, Homo sapiens
attaatgtgtagccaacttaat

SEQ ID NO: 9416652 - DNA, 22 bp, Homo sapiens
attaattttacctttgtaaaca

SEQ ID NO: 9416653 - DNA, 22 bp, Homo sapiens
gatgatgctctagtggagtttt

SEQ ID NO: 9416654 - DNA, 22 bp, Homo sapiens
attaagatcattgtagaagatt

SEQ ID NO: 9416655 - DNA, 22 bp, Homo sapiens
gatgatctgcaagaactacatg

SEQ ID NO: 9416656 - DNA, 22 bp, Homo sapiens
attaagatgtgggaaaatttaa

SEQ ID NO: 9416657 - DNA, 22 bp, Homo sapiens
attaatatacactgttagcatg

SEQ ID NO: 9416658 - DNA, 22 bp, Homo sapiens
attaatatacactgttagcatg

SEQ ID NO: 9416659 - DNA, 22 bp, Homo sapiens
attaatatacactgttagcatg

SEQ ID NO: 9416660 - DNA, 22 bp, Homo sapiens
attaatatacactgttagcatg

SEQ ID NO: 9416661 - DNA, 22 bp, Homo sapiens
attaatatcctgctggctaaat

SEQ ID NO: 9416662 - DNA, 22 bp, Homo sapiens
attaatatcctgctggctaaat

SEQ ID NO: 9416663 - DNA, 22 bp, Homo sapiens
attaatattggttcattagctg

SEQ ID NO: 9416664 - DNA, 22 bp, Homo sapiens
attagaagcgtgaatcctttca

SEQ ID NO: 9416665 - DNA, 21 bp, Homo sapiens
attagaaggtatttagggcct

SEQ ID NO: 9416666 - DNA, 22 bp, Homo sapiens
attagaagatagtgatttctgc

SEQ ID NO: 9416667 - DNA, 22 bp, Homo sapiens
attagaagaggctgacgaatgt

SEQ ID NO: 9416668 - DNA, 21 bp, Homo sapiens
gcaagtgtttctgacagtggc

SEQ ID NO: 9416669 - DNA, 22 bp, Homo sapiens
gcaagttggagactcatgagaa

SEQ ID NO: 9416670 - DNA, 22 bp, Homo sapiens
attagaagaggctgacgaatgt

SEQ ID NO: 9416671 - DNA, 22 bp, Homo sapiens
attagaattatgcttgctaatg

SEQ ID NO: 9416672 - DNA, 22 bp, Homo sapiens
attagacatcatatgattcagc

SEQ ID NO: 9416673 - DNA, 22 bp, Homo sapiens
attagaatgcagggttcattgt

SEQ ID NO: 9416674 - DNA, 22 bp, Homo sapiens
attagaattatgcttgctaatg

SEQ ID NO: 9416675 - DNA, 22 bp, Homo sapiens
attagaatgcagggttcattgt

SEQ ID NO: 9416676 - DNA, 17 bp, Homo sapiens
gcaagggatgggagatt

SEQ ID NO: 9416677 - DNA, 22 bp, Homo sapiens
gcaagggcatggctctgatcaa

SEQ ID NO: 9416678 - DNA, 22 bp, Homo sapiens
gcaagggtgtgaaccaatgaga

SEQ ID NO: 9416679 - DNA, 17 bp, Homo sapiens
gcaagggatgggagatt

SEQ ID NO: 9416680 - DNA, 22 bp, Homo sapiens
gcaaggctttgtgaattttaaa

SEQ ID NO: 9416681 - DNA, 19 bp, Homo sapiens
gcaaggttcactcccagag

SEQ ID NO: 9416682 - DNA, 21 bp, Homo sapiens
gcaagtactatcatcattatc

SEQ ID NO: 9416683 - DNA, 22 bp, Homo sapiens
gcaaggtgttttataggcagga

SEQ ID NO: 9416684 - DNA, 22 bp, Homo sapiens
attagagaaatgttgccaagat

SEQ ID NO: 9416685 - DNA, 22 bp, Homo sapiens
attattaaagctacatcaagga

SEQ ID NO: 9416686 - DNA, 22 bp, Homo sapiens
attattaaagctacatcaagga

SEQ ID NO: 9416687 - DNA, 22 bp, Homo sapiens
attattaaaatgtgtttctctt

SEQ ID NO: 9416688 - DNA, 22 bp, Homo sapiens
attattcaatcatattaaaagt

SEQ ID NO: 9416689 - DNA, 22 bp, Homo sapiens
attattcaatcatattaaaagt

SEQ ID NO: 9416690 - DNA, 22 bp, Homo sapiens
attattcaatcatattaaaagt

SEQ ID NO: 9416691 - DNA, 22 bp, Homo sapiens
attattcaatgttatttcagtg

SEQ ID NO: 9416692 - DNA, 22 bp, Homo sapiens
attattcagtcttgtaaggagt

SEQ ID NO: 9416693 - DNA, 22 bp, Homo sapiens
attattcaatgttatttcagtg

SEQ ID NO: 9416694 - DNA, 22 bp, Homo sapiens
attattcaatcatattaaaagt

SEQ ID NO: 9416695 - DNA, 22 bp, Homo sapiens
attattcttatgtcatcatggc

SEQ ID NO: 9416696 - DNA, 22 bp, Homo sapiens
attattcttatgtcatcatggc

SEQ ID NO: 9416697 - DNA, 22 bp, Homo sapiens
attattcttgaggtgtttattg

SEQ ID NO: 9416698 - DNA, 22 bp, Homo sapiens
attattcttatgtcatcatggc

SEQ ID NO: 9416699 - DNA, 22 bp, Homo sapiens
attattcttaatgcagggatta

SEQ ID NO: 9416700 - DNA, 22 bp, Homo sapiens
attattcttaatgcagggatta

SEQ ID NO: 9416701 - DNA, 22 bp, Homo sapiens
attattcttaatgcagggatta

SEQ ID NO: 9416702 - DNA, 22 bp, Homo sapiens
attattctttgataaatggcag

SEQ ID NO: 9416703 - DNA, 22 bp, Homo sapiens
attattctttgataaatggcag

SEQ ID NO: 9416704 - DNA, 22 bp, Homo sapiens
attattcttgaggtgtttattg

SEQ ID NO: 9416705 - DNA, 22 bp, Homo sapiens
attattgcaatttgacattcag

SEQ ID NO: 9416706 - DNA, 22 bp, Homo sapiens
attattctctggaggaaagatt

SEQ ID NO: 9416707 - DNA, 22 bp, Homo sapiens
attattctctggaggaaagatt

SEQ ID NO: 9416708 - DNA, 22 bp, Homo sapiens
attattcagtcttgtaaggagt

SEQ ID NO: 9416709 - DNA, 20 bp, Homo sapiens
attattcatacatgtgtgac

SEQ ID NO: 9416710 - DNA, 22 bp, Homo sapiens
attgaatagatgcattatacta

SEQ ID NO: 9416711 - DNA, 22 bp, Homo sapiens
attgaagggtgaccagccatcc

SEQ ID NO: 9416712 - DNA, 22 bp, Homo sapiens
attgacaaaaacaggtggttga

SEQ ID NO: 9416713 - DNA, 22 bp, Homo sapiens
attgacaaatctgaacatacgg

SEQ ID NO: 9416714 - DNA, 22 bp, Homo sapiens
attgacaaatctgaacatacgg

SEQ ID NO: 9416715 - DNA, 22 bp, Homo sapiens
attgaagattctgacatcagaa

SEQ ID NO: 9416716 - DNA, 22 bp, Homo sapiens
attgaagatcagggaaagattc

SEQ ID NO: 9416717 - DNA, 22 bp, Homo sapiens
attgaagaaacccaaataatgg

SEQ ID NO: 9416718 - DNA, 22 bp, Homo sapiens
attgaagagaagctaaatagag

SEQ ID NO: 9416719 - DNA, 22 bp, Homo sapiens
attgaagagaagctaaatagag

SEQ ID NO: 9416720 - DNA, 22 bp, Homo sapiens
attgaagaaacccaaataatgg

SEQ ID NO: 9416721 - DNA, 22 bp, Homo sapiens
attgaagaaacccaaataatgg

SEQ ID NO: 9416722 - DNA, 23 bp, Homo sapiens
attgaacagagagaaaaacatcc

SEQ ID NO: 9416723 - DNA, 22 bp, Homo sapiens
attgaaaaatgactattgctta

SEQ ID NO: 9416724 - DNA, 22 bp, Homo sapiens
attgaaattgatgaaattcttg

SEQ ID NO: 9416725 - DNA, 22 bp, Homo sapiens
attgaaattgatgaaattcttg

SEQ ID NO: 9416726 - DNA, 22 bp, Homo sapiens
attgaaaaatgactattgctta

SEQ ID NO: 9416727 - DNA, 22 bp, Homo sapiens
attgacatgtaggctacaagga

SEQ ID NO: 9416728 - DNA, 22 bp, Homo sapiens
attgcacttcagcctgggtgac

SEQ ID NO: 9416729 - DNA, 22 bp, Homo sapiens
attgcagaacatgaggtcttct

SEQ ID NO: 9416730 - DNA, 22 bp, Homo sapiens
attgctggcagctggatctgca

SEQ ID NO: 9416731 - DNA, 22 bp, Homo sapiens
attgctggatgagctcttggat

SEQ ID NO: 9416732 - DNA, 22 bp, Homo sapiens
attgctggcccagatgctttag

SEQ ID NO: 9416733 - DNA, 22 bp, Homo sapiens
attgctggctgccatcttgccc

SEQ ID NO: 9416734 - DNA, 22 bp, Homo sapiens
attgctgggaggatgtgtgttc

SEQ ID NO: 9416735 - DNA, 22 bp, Homo sapiens
attgctggtagtcagtgtccct

SEQ ID NO: 9416736 - DNA, 22 bp, Homo sapiens
attgcttactaatcatcttcag

SEQ ID NO: 9416737 - DNA, 22 bp, Homo sapiens
attgacaatgtatttgtatctg

SEQ ID NO: 9416738 - DNA, 22 bp, Homo sapiens
attgacaatgtatttgtatctg

SEQ ID NO: 9416739 - DNA, 22 bp, Homo sapiens
attgacaattctatgcagagca

SEQ ID NO: 9416740 - DNA, 22 bp, Homo sapiens
attgacaattctatgcagagca

SEQ ID NO: 9416741 - DNA, 22 bp, Homo sapiens
attgacacacttccaggaccag

SEQ ID NO: 9416742 - DNA, 20 bp, Homo sapiens
attgacagaaagtgttcacc

SEQ ID NO: 9416743 - DNA, 22 bp, Homo sapiens
attgacagcaggggctgtcact

SEQ ID NO: 9416744 - DNA, 22 bp, Homo sapiens
attgacaagaaagatattttta

SEQ ID NO: 9416745 - DNA, 22 bp, Homo sapiens
attgacaagacaatggctctta

SEQ ID NO: 9416746 - DNA, 22 bp, Homo sapiens
attgacaagaaagatattttta

SEQ ID NO: 9416747 - DNA, 22 bp, Homo sapiens
attgacaaatggatgttgacat

SEQ ID NO: 9416748 - DNA, 22 bp, Homo sapiens
attgacaaatggatgttgacat

SEQ ID NO: 9416749 - DNA, 22 bp, Homo sapiens
attgacaatctactatgttctg

SEQ ID NO: 9416750 - DNA, 22 bp, Homo sapiens
attgacaagtgagctgggctgc

SEQ ID NO: 9416751 - DNA, 22 bp, Homo sapiens
attgacaagcagtatgtcttag

SEQ ID NO: 9416752 - DNA, 22 bp, Homo sapiens
attcttattaaatagccagaag

SEQ ID NO: 9416753 - DNA, 22 bp, Homo sapiens
attcttattatagtaaaacagt

SEQ ID NO: 9416754 - DNA, 22 bp, Homo sapiens
attcttattatagtaaaacagt

SEQ ID NO: 9416755 - DNA, 22 bp, Homo sapiens
attcttattatagtaaaacagt

SEQ ID NO: 9416756 - DNA, 22 bp, Homo sapiens
attcttaattgccatgctgtat

SEQ ID NO: 9416757 - DNA, 22 bp, Homo sapiens
attcttacaaagcagagtctgt

SEQ ID NO: 9416758 - DNA, 22 bp, Homo sapiens
attcttaattgccatgctgtat

SEQ ID NO: 9416759 - DNA, 22 bp, Homo sapiens
attcttaattccaaagactgag

SEQ ID NO: 9416760 - DNA, 22 bp, Homo sapiens
attcttaattccaaagactgag

SEQ ID NO: 9416761 - DNA, 22 bp, Homo sapiens
attcttaattccaaagactgag

SEQ ID NO: 9416762 - DNA, 22 bp, Homo sapiens
attcttaaatttaggtctgtga

SEQ ID NO: 9416763 - DNA, 22 bp, Homo sapiens
attcttaaatttaggtctgtga

SEQ ID NO: 9416764 - DNA, 22 bp, Homo sapiens
attcttatttaaatagagtctg

SEQ ID NO: 9416765 - DNA, 22 bp, Homo sapiens
attcttatttaaatagagtctg

SEQ ID NO: 9416766 - DNA, 22 bp, Homo sapiens
attcttcacaaatatatagaag

SEQ ID NO: 9416767 - DNA, 22 bp, Homo sapiens
attcttcacacctgttcctgtt

SEQ ID NO: 9416768 - DNA, 22 bp, Homo sapiens
attcttcacctgagtcagtcta

SEQ ID NO: 9416769 - DNA, 22 bp, Homo sapiens
attcttcaccatggataatttg

SEQ ID NO: 9416770 - DNA, 22 bp, Homo sapiens
attcttcacatggataggatct

SEQ ID NO: 9416771 - DNA, 22 bp, Homo sapiens
attctcaaacaagtggtttgat

SEQ ID NO: 9416772 - DNA, 22 bp, Homo sapiens
attctcaatggctactttcata

SEQ ID NO: 9416773 - DNA, 22 bp, Homo sapiens
attctcaatggctactttcata

SEQ ID NO: 9416774 - DNA, 22 bp, Homo sapiens
attctcaatggctactttcata

SEQ ID NO: 9416775 - DNA, 22 bp, Homo sapiens
attctcagctttcaaatagaca

SEQ ID NO: 9416776 - DNA, 20 bp, Homo sapiens
attctcacatggctccgggc

SEQ ID NO: 9416777 - DNA, 22 bp, Homo sapiens
attctgtctttttatacatcta

SEQ ID NO: 9416778 - DNA, 22 bp, Homo sapiens
attctgtgatagttgatcctta

SEQ ID NO: 9416779 - DNA, 22 bp, Homo sapiens
attctgtctaagctggctacgt

SEQ ID NO: 9416780 - DNA, 22 bp, Homo sapiens
attctggaattctaagattctg

SEQ ID NO: 9416781 - DNA, 22 bp, Homo sapiens
attctggaattctaagattctg

SEQ ID NO: 9416782 - DNA, 22 bp, Homo sapiens
attctgtcagatcttactggat

SEQ ID NO: 9416783 - DNA, 21 bp, Homo sapiens
attctgtcatcccagctactt

SEQ ID NO: 9416784 - DNA, 22 bp, Homo sapiens
attctgtcattacaaaaggcag

SEQ ID NO: 9416785 - DNA, 22 bp, Homo sapiens
attctggaagcaagcttttaaa

SEQ ID NO: 9416786 - DNA, 22 bp, Homo sapiens
attctggaattctaagattctg

SEQ ID NO: 9416787 - DNA, 22 bp, Homo sapiens
attctcagggagtattttctat

SEQ ID NO: 9416788 - DNA, 22 bp, Homo sapiens
attctaggcttgaaacatgaag

SEQ ID NO: 9416789 - DNA, 22 bp, Homo sapiens
attctatagacagaaggtcaat

SEQ ID NO: 9416790 - DNA, 22 bp, Homo sapiens
attctcaaaacataacttcact

SEQ ID NO: 9416791 - DNA, 22 bp, Homo sapiens
attctcaaaacataacttcact

SEQ ID NO: 9416792 - DNA, 22 bp, Homo sapiens
attctattttttaagaagtagt

SEQ ID NO: 9416793 - DNA, 22 bp, Homo sapiens
attctattttttaagaagtagt

SEQ ID NO: 9416794 - DNA, 22 bp, Homo sapiens
attctagagtttcaatccaagg

SEQ ID NO: 9416795 - DNA, 22 bp, Homo sapiens
attctaggacttgagagctaag

SEQ ID NO: 9416796 - DNA, 22 bp, Homo sapiens
attctagctcatctactttcca

SEQ ID NO: 9416797 - DNA, 22 bp, Homo sapiens
attctagatgctgtaagtagca

SEQ ID NO: 9416798 - DNA, 22 bp, Homo sapiens
attctagccaaccatctgagat

SEQ ID NO: 9416799 - DNA, 22 bp, Homo sapiens
attcctaaagtaatacactaga

SEQ ID NO: 9416800 - DNA, 22 bp, Homo sapiens
attcctagatgaattacattgc

SEQ ID NO: 9416801 - DNA, 22 bp, Homo sapiens
attcctcaaaggtagcccatta

SEQ ID NO: 9416802 - DNA, 22 bp, Homo sapiens
attcccatttgtgtggtctgga

SEQ ID NO: 9416803 - DNA, 20 bp, Homo sapiens
attcccttctccctgtttga

SEQ ID NO: 9416804 - DNA, 16 bp, Homo sapiens
gcagaggaaaggggag

SEQ ID NO: 9416805 - DNA, 16 bp, Homo sapiens
gcagaggaaaggggag

SEQ ID NO: 9416806 - DNA, 22 bp, Homo sapiens
attccttctaaaacgctgccct

SEQ ID NO: 9416807 - DNA, 22 bp, Homo sapiens
gcagcaggcatggccgccctgg

SEQ ID NO: 9416808 - DNA, 22 bp, Homo sapiens
gcagcaggcttttcataccttg

SEQ ID NO: 9416809 - DNA, 22 bp, Homo sapiens
attcctgagacttatctgtttc

SEQ ID NO: 9416810 - DNA, 22 bp, Homo sapiens
attcctcatttgttgagaacca

SEQ ID NO: 9416811 - DNA, 22 bp, Homo sapiens
attctacaatcatgtagatcct

SEQ ID NO: 9416812 - DNA, 22 bp, Homo sapiens
attctacacaaagcaagaagac

SEQ ID NO: 9416813 - DNA, 22 bp, Homo sapiens
attccttgtttcactgaaaagg

SEQ ID NO: 9416814 - DNA, 22 bp, Homo sapiens
attcctttggactcctccttgc

SEQ ID NO: 9416815 - DNA, 22 bp, Homo sapiens
attcctttggactcctccttgc

SEQ ID NO: 9416816 - DNA, 22 bp, Homo sapiens
attcctttggactcctccttgc

SEQ ID NO: 9416817 - DNA, 22 bp, Homo sapiens
attccttgtttcactgaaaagg

SEQ ID NO: 9416818 - DNA, 22 bp, Homo sapiens
gcagcagggagcaggggtgtca

SEQ ID NO: 9416819 - DNA, 22 bp, Homo sapiens
gcagcaggtccgcatcatcatc

SEQ ID NO: 9416820 - DNA, 22 bp, Homo sapiens
gcagcagggtgccagctttgca

SEQ ID NO: 9416821 - DNA, 22 bp, Homo sapiens
gcagcaggcttttcataccttg

SEQ ID NO: 9416822 - DNA, 22 bp, Homo sapiens
gcagcaggcttttcataccttg

SEQ ID NO: 9416823 - DNA, 22 bp, Homo sapiens
gcagcagggagcaggggtgtca

SEQ ID NO: 9416824 - DNA, 22 bp, Homo sapiens
attctacagatgaaagcggctg

SEQ ID NO: 9416825 - DNA, 22 bp, Homo sapiens
attctacaggactggcaatccc

SEQ ID NO: 9416826 - DNA, 22 bp, Homo sapiens
attctacacctctctcatttag

SEQ ID NO: 9416827 - DNA, 22 bp, Homo sapiens
attctacaggactggcaatccc

SEQ ID NO: 9416828 - DNA, 22 bp, Homo sapiens
attctacacaacatgatgatgg

SEQ ID NO: 9416829 - DNA, 22 bp, Homo sapiens
attctacacctctctcatttag

SEQ ID NO: 9416830 - DNA, 18 bp, Homo sapiens
attctagaagatgccttg

SEQ ID NO: 9416831 - DNA, 22 bp, Homo sapiens
attctagaaggcaaagcaaggg

SEQ ID NO: 9416832 - DNA, 21 bp, Homo sapiens
attctagacaacactgaaatc

SEQ ID NO: 9416833 - DNA, 22 bp, Homo sapiens
attatttacagtgtgctcgaag

SEQ ID NO: 9416834 - DNA, 22 bp, Homo sapiens
attatttacagtgtgctcgaag

SEQ ID NO: 9416835 - DNA, 22 bp, Homo sapiens
attatttagaaatcgattgaaa

SEQ ID NO: 9416836 - DNA, 22 bp, Homo sapiens
attatttagaaatcgattgaaa

SEQ ID NO: 9416837 - DNA, 22 bp, Homo sapiens
attattgttttaatagtagaga

SEQ ID NO: 9416838 - DNA, 22 bp, Homo sapiens
attattgttagtgacagggtga

SEQ ID NO: 9416839 - DNA, 22 bp, Homo sapiens
attattgttgcggctgttaccg

SEQ ID NO: 9416840 - DNA, 22 bp, Homo sapiens
attattgtactttcaataaggt

SEQ ID NO: 9416841 - DNA, 22 bp, Homo sapiens
attattgtcatcttaatcttaa

SEQ ID NO: 9416842 - DNA, 22 bp, Homo sapiens
attattgtactttcaataaggt

SEQ ID NO: 9416843 - DNA, 22 bp, Homo sapiens
attattgtcatcttaatcttaa

SEQ ID NO: 9416844 - DNA, 22 bp, Homo sapiens
attattgtgataggtgtcagtg

SEQ ID NO: 9416845 - DNA, 22 bp, Homo sapiens
attattgtgtaaaatgaggctt

SEQ ID NO: 9416846 - DNA, 22 bp, Homo sapiens
attattggacacttcttctgca

SEQ ID NO: 9416847 - DNA, 22 bp, Homo sapiens
attattggtacaccgtagtcat

SEQ ID NO: 9416848 - DNA, 22 bp, Homo sapiens
attattggacacttcttctgca

SEQ ID NO: 9416849 - DNA, 22 bp, Homo sapiens
attattggacacttcttctgca

SEQ ID NO: 9416850 - DNA, 22 bp, Homo sapiens
attcagtgctgtaatacgctaa

SEQ ID NO: 9416851 - DNA, 22 bp, Homo sapiens
attcagtgccaaggagaacttg

SEQ ID NO: 9416852 - DNA, 22 bp, Homo sapiens
attcagtgccaaggagaacttg

SEQ ID NO: 9416853 - DNA, 22 bp, Homo sapiens
attcagactgtctaaatggttt

SEQ ID NO: 9416854 - DNA, 22 bp, Homo sapiens
attcagactgtctaaatggttt

SEQ ID NO: 9416855 - DNA, 22 bp, Homo sapiens
attatttatcctcttggtctat

SEQ ID NO: 9416856 - DNA, 22 bp, Homo sapiens
attatttatcctcttggtctat

SEQ ID NO: 9416857 - DNA, 22 bp, Homo sapiens
attatttagaaatcgattgaaa

SEQ ID NO: 9416858 - DNA, 22 bp, Homo sapiens
attatttatcctcttggtctat

SEQ ID NO: 9416859 - DNA, 19 bp, Homo sapiens
attcagtgtctctgacttc

SEQ ID NO: 9416860 - DNA, 22 bp, Homo sapiens
attcagtgtatcaatgaatgct

SEQ ID NO: 9416861 - DNA, 22 bp, Homo sapiens
attcagtgggtgctcagcacaa

SEQ ID NO: 9416862 - DNA, 22 bp, Homo sapiens
attcagtgggtgctcagcacaa

SEQ ID NO: 9416863 - DNA, 22 bp, Homo sapiens
attcagtgtttgcagcaacttt

SEQ ID NO: 9416864 - DNA, 22 bp, Homo sapiens
attcagttaaaaactgtacttc

SEQ ID NO: 9416865 - DNA, 22 bp, Homo sapiens
attcagttagccacagctattc

SEQ ID NO: 9416866 - DNA, 22 bp, Homo sapiens
attcagttagatcatcctaatt

SEQ ID NO: 9416867 - DNA, 22 bp, Homo sapiens
attcagttagatcatcctaatt

SEQ ID NO: 9416868 - DNA, 22 bp, Homo sapiens
attcagttaagggtcttgagat

SEQ ID NO: 9416869 - DNA, 22 bp, Homo sapiens
attcagttactctagacacttc

SEQ ID NO: 9416870 - DNA, 22 bp, Homo sapiens
attcagttactctagacacttc

SEQ ID NO: 9416871 - DNA, 22 bp, Homo sapiens
attcagttatttactttgctat

SEQ ID NO: 9416872 - DNA, 22 bp, Homo sapiens
attcagttccttgagggtatag

SEQ ID NO: 9416873 - DNA, 22 bp, Homo sapiens
attcagttattcagagaaggga

SEQ ID NO: 9416874 - DNA, 22 bp, Homo sapiens
attcagttagccacagctattc

SEQ ID NO: 9416875 - DNA, 22 bp, Homo sapiens
attcagttagtagatttggtca

SEQ ID NO: 9416876 - DNA, 22 bp, Homo sapiens
gctcaggacccaggtgtgacct

SEQ ID NO: 9416877 - DNA, 22 bp, Homo sapiens
gctcagcttgggagcgcccggt

SEQ ID NO: 9416878 - DNA, 22 bp, Homo sapiens
gctcagcttgggagcgcccggt

SEQ ID NO: 9416879 - DNA, 22 bp, Homo sapiens
caaactttcagttataacatga

SEQ ID NO: 9416880 - DNA, 22 bp, Homo sapiens
caaactttcagttataacatga

SEQ ID NO: 9416881 - DNA, 22 bp, Homo sapiens
caaactttgcaaaacttacagt

SEQ ID NO: 9416882 - DNA, 22 bp, Homo sapiens
caaacttttcctggaaaagatt

SEQ ID NO: 9416883 - DNA, 22 bp, Homo sapiens
caaacttttcctggaaaagatt

SEQ ID NO: 9416884 - DNA, 22 bp, Homo sapiens
gctcaggcaaatttctggtgaa

SEQ ID NO: 9416885 - DNA, 22 bp, Homo sapiens
gctcaggcaccatatgatgtgt

SEQ ID NO: 9416886 - DNA, 22 bp, Homo sapiens
gctcaggcaccatatgatgtgt

SEQ ID NO: 9416887 - DNA, 22 bp, Homo sapiens
gctcaggcaggagtgcagtggc

SEQ ID NO: 9416888 - DNA, 22 bp, Homo sapiens
gctcaggcaggagtgcagtggc

SEQ ID NO: 9416889 - DNA, 22 bp, Homo sapiens
caaaggcacacatacctttctg

SEQ ID NO: 9416890 - DNA, 22 bp, Homo sapiens
caaaggtattctcattttggaa

SEQ ID NO: 9416891 - DNA, 22 bp, Homo sapiens
caaaggcaggccccctgtgcag

SEQ ID NO: 9416892 - DNA, 22 bp, Homo sapiens
caaaggcaatcttgttctctgg

SEQ ID NO: 9416893 - DNA, 22 bp, Homo sapiens
caaaggcaacatatacttgttt

SEQ ID NO: 9416894 - DNA, 22 bp, Homo sapiens
gctcaggcaaatttctggtgaa

SEQ ID NO: 9416895 - DNA, 22 bp, Homo sapiens
gctcaggatttcatccatgtgt

SEQ ID NO: 9416896 - DNA, 22 bp, Homo sapiens
gctcaggatcagccacctcttt

SEQ ID NO: 9416897 - DNA, 22 bp, Homo sapiens
gctcaggagctgacagcctcaa

SEQ ID NO: 9416898 - DNA, 22 bp, Homo sapiens
caaacattgcactttctgctat

SEQ ID NO: 9416899 - DNA, 22 bp, Homo sapiens
caaacattccgcttctcccagg

SEQ ID NO: 9416900 - DNA, 22 bp, Homo sapiens
gcgcagctcagtgagggaactt

SEQ ID NO: 9416901 - DNA, 22 bp, Homo sapiens
gcgaggcagccctcaggtgtta

SEQ ID NO: 9416902 - DNA, 22 bp, Homo sapiens
gcgagggcacgcggttgaaggc

SEQ ID NO: 9416903 - DNA, 22 bp, Homo sapiens
gcgagtgccgagagggcagggc

SEQ ID NO: 9416904 - DNA, 22 bp, Homo sapiens
caaaccttgttccagtcaactc

SEQ ID NO: 9416905 - DNA, 22 bp, Homo sapiens
caaaccttgtaaatgccaaact

SEQ ID NO: 9416906 - DNA, 22 bp, Homo sapiens
caaaccttgttccagtcaactc

SEQ ID NO: 9416907 - DNA, 22 bp, Homo sapiens
caaaccttgtaaatgccaaact

SEQ ID NO: 9416908 - DNA, 22 bp, Homo sapiens
caaaccattaagcatgttgagt

SEQ ID NO: 9416909 - DNA, 22 bp, Homo sapiens
caaaccatgacatgaagcgtga

SEQ ID NO: 9416910 - DNA, 22 bp, Homo sapiens
caaactctgtaggacagttcaa

SEQ ID NO: 9416911 - DNA, 22 bp, Homo sapiens
caaactgagcatcagaaagttt

SEQ ID NO: 9416912 - DNA, 22 bp, Homo sapiens
caaactgaacacgaaagtcttt

SEQ ID NO: 9416913 - DNA, 22 bp, Homo sapiens
caaactgcaacatgaagtgtcc

SEQ ID NO: 9416914 - DNA, 22 bp, Homo sapiens
caaaaaacacagatgtctgtgt

SEQ ID NO: 9416915 - DNA, 22 bp, Homo sapiens
attttttagaacctggcctgat

SEQ ID NO: 9416916 - DNA, 22 bp, Homo sapiens
caaaaaacacagatgtctgtgt

SEQ ID NO: 9416917 - DNA, 22 bp, Homo sapiens
caaaaaacacagatgtctgtgt

SEQ ID NO: 9416918 - DNA, 22 bp, Homo sapiens
caaaaaacacctgtgtgagtat

SEQ ID NO: 9416919 - DNA, 22 bp, Homo sapiens
caaaaaacacctgtgtgagtat

SEQ ID NO: 9416920 - DNA, 22 bp, Homo sapiens
caaaaaacacctgtgtgagtat

SEQ ID NO: 9416921 - DNA, 22 bp, Homo sapiens
caaaaactgcaattacttttac

SEQ ID NO: 9416922 - DNA, 22 bp, Homo sapiens
caaaaactgcaattacttttac

SEQ ID NO: 9416923 - DNA, 22 bp, Homo sapiens
caaaaagcttaggtaacaagcc

SEQ ID NO: 9416924 - DNA, 22 bp, Homo sapiens
caaaaagcttaggtaacaagcc

SEQ ID NO: 9416925 - DNA, 22 bp, Homo sapiens
caaaacattcagagagctcact

SEQ ID NO: 9416926 - DNA, 22 bp, Homo sapiens
caaaactatcaggctcaaagct

SEQ ID NO: 9416927 - DNA, 19 bp, Homo sapiens
gcgaggaagtcactgtggc

SEQ ID NO: 9416928 - DNA, 22 bp, Homo sapiens
gcgagcctctggagtcctctgg

SEQ ID NO: 9416929 - DNA, 19 bp, Homo sapiens
gcgaggaagtcactgtggt

SEQ ID NO: 9416930 - DNA, 22 bp, Homo sapiens
caaaacattctctgcagcaggg

SEQ ID NO: 9416931 - DNA, 22 bp, Homo sapiens
caaaaccaagaacattcatttc

SEQ ID NO: 9416932 - DNA, 22 bp, Homo sapiens
caaaacattctctgcagcaggg

SEQ ID NO: 9416933 - DNA, 22 bp, Homo sapiens
caaaacattctctgcagcaggg

SEQ ID NO: 9416934 - DNA, 22 bp, Homo sapiens
caaaaccaagaacattcatttc

SEQ ID NO: 9416935 - DNA, 22 bp, Homo sapiens
caaaacctaaacagactgtcca

SEQ ID NO: 9416936 - DNA, 22 bp, Homo sapiens
caaaactgtctagagagagaag

SEQ ID NO: 9416937 - DNA, 22 bp, Homo sapiens
caaaactatcaggctcaaagct

SEQ ID NO: 9416938 - DNA, 22 bp, Homo sapiens
gcctgggagggcagcagtgtgg

SEQ ID NO: 9416939 - DNA, 22 bp, Homo sapiens
gcctgggagggcagcagtgtgg

SEQ ID NO: 9416940 - DNA, 22 bp, Homo sapiens
gcctgtccccaggagagtccgg

SEQ ID NO: 9416941 - DNA, 22 bp, Homo sapiens
gcctgtcccgcaccggagcccg

SEQ ID NO: 9416942 - DNA, 19 bp, Homo sapiens
gcctgtccagtagcatttt

SEQ ID NO: 9416943 - DNA, 22 bp, Homo sapiens
gcctgtccactaaacagccaag

SEQ ID NO: 9416944 - DNA, 23 bp, Homo sapiens
gcctgggagttgcgatctgcccg

SEQ ID NO: 9416945 - DNA, 22 bp, Homo sapiens
gcctgtccactaaacagccaag

SEQ ID NO: 9416946 - DNA, 22 bp, Homo sapiens
gcctgtgcatagcagcggactc

SEQ ID NO: 9416947 - DNA, 22 bp, Homo sapiens
gcctgtgcctcagcctgcagcc

SEQ ID NO: 9416948 - DNA, 23 bp, Homo sapiens
gcctgtgcctatgcccagctctg

SEQ ID NO: 9416949 - DNA, 23 bp, Homo sapiens
gcctgtgcctatgcccagctctg

SEQ ID NO: 9416950 - DNA, 22 bp, Homo sapiens
gcctgtgcctcaattttctact

SEQ ID NO: 9416951 - DNA, 22 bp, Homo sapiens
gcctgtgcatagcagcggactc

SEQ ID NO: 9416952 - DNA, 22 bp, Homo sapiens
gcctgtctgcagggctgtcatt

SEQ ID NO: 9416953 - DNA, 22 bp, Homo sapiens
gcctgtctgcgtcacgcttatt

SEQ ID NO: 9416954 - DNA, 22 bp, Homo sapiens
gcctgtccttgtgaggtcccag

SEQ ID NO: 9416955 - DNA, 22 bp, Homo sapiens
gcctgtcctggatgctctgcaa

SEQ ID NO: 9416956 - DNA, 22 bp, Homo sapiens
gcctgtccttgtgaggtcccag

SEQ ID NO: 9416957 - DNA, 22 bp, Homo sapiens
gcctgtcctgctaatgacacgt

SEQ ID NO: 9416958 - DNA, 20 bp, Homo sapiens
gcctgtcctgagtgtcatgg

SEQ ID NO: 9416959 - DNA, 22 bp, Homo sapiens
gcctgtcctcccctgcgctgag

SEQ ID NO: 9416960 - DNA, 22 bp, Homo sapiens
gcctgtcctatacaggcggctg

SEQ ID NO: 9416961 - DNA, 22 bp, Homo sapiens
gcctctgagctcctttgaccac

SEQ ID NO: 9416962 - DNA, 15 bp, Homo sapiens
gcctctgagagccac

SEQ ID NO: 9416963 - DNA, 19 bp, Homo sapiens
gcctctgagggcaggacac

SEQ ID NO: 9416964 - DNA, 18 bp, Homo sapiens
gcctgcctagagcttgcc

SEQ ID NO: 9416965 - DNA, 22 bp, Homo sapiens
gcctgctgaacctcatgcagtc

SEQ ID NO: 9416966 - DNA, 22 bp, Homo sapiens
gcctgctgaacctcatgcagtc

SEQ ID NO: 9416967 - DNA, 22 bp, Homo sapiens
gcctgctctggaatccatgtaa

SEQ ID NO: 9416968 - DNA, 22 bp, Homo sapiens
gcctgctctggaatccatgtaa

SEQ ID NO: 9416969 - DNA, 22 bp, Homo sapiens
gcctgctgaacctcatgcagtc

SEQ ID NO: 9416970 - DNA, 22 bp, Homo sapiens
gcctgctgaacctcatgcagtc

SEQ ID NO: 9416971 - DNA, 22 bp, Homo sapiens
gcctgctgaacctcatgcagtc

SEQ ID NO: 9416972 - DNA, 22 bp, Homo sapiens
gcctgctgaacctcatgcagtc

SEQ ID NO: 9416973 - DNA, 22 bp, Homo sapiens
gcctgctgaagccagagtgtgt

SEQ ID NO: 9416974 - DNA, 22 bp, Homo sapiens
gcctgctgagggaagttgggca

SEQ ID NO: 9416975 - DNA, 22 bp, Homo sapiens
gcctgctggatgtggccaggcc

SEQ ID NO: 9416976 - DNA, 22 bp, Homo sapiens
gcctgctggatgtggccaggcc

SEQ ID NO: 9416977 - DNA, 22 bp, Homo sapiens
gcctgctggatgtggccaggcc

SEQ ID NO: 9416978 - DNA, 22 bp, Homo sapiens
gcctgctggatgtggccaggcc

SEQ ID NO: 9416979 - DNA, 22 bp, Homo sapiens
gcctgctggctgtccattgcag

SEQ ID NO: 9416980 - DNA, 22 bp, Homo sapiens
gcctgctggctggaaattctcc

SEQ ID NO: 9416981 - DNA, 22 bp, Homo sapiens
gcctgctggaggagcctcaggg

SEQ ID NO: 9416982 - DNA, 22 bp, Homo sapiens
gcctgctggaggagcctcaggg

SEQ ID NO: 9416983 - DNA, 22 bp, Homo sapiens
gcctgctggatcaagcttatgc

SEQ ID NO: 9416984 - DNA, 22 bp, Homo sapiens
gcctgctggaggagcctcaggg

SEQ ID NO: 9416985 - DNA, 22 bp, Homo sapiens
gcctgctgccaccctggctccg

SEQ ID NO: 9416986 - DNA, 22 bp, Homo sapiens
gcctgctgccaccctggctccg

SEQ ID NO: 9416987 - DNA, 22 bp, Homo sapiens
gcctgctgcatccaggctattg

SEQ ID NO: 9416988 - DNA, 22 bp, Homo sapiens
gcctgctgcatccaggctattg

SEQ ID NO: 9416989 - DNA, 22 bp, Homo sapiens
gcctgctggacattggccggcc

SEQ ID NO: 9416990 - DNA, 22 bp, Homo sapiens
gcctgctggacattggccggcc

SEQ ID NO: 9416991 - DNA, 22 bp, Homo sapiens
gcctgctgccagaggcaaacac

SEQ ID NO: 9416992 - DNA, 22 bp, Homo sapiens
gcctgctgccagaggcaaacac

SEQ ID NO: 9416993 - DNA, 21 bp, Homo sapiens
gcctgctgcctgtggccggtc

SEQ ID NO: 9416994 - DNA, 21 bp, Homo sapiens
gcctgctgcctgtggccggtc

SEQ ID NO: 9416995 - DNA, 22 bp, Homo sapiens
gcctggagctactggacactga

SEQ ID NO: 9416996 - DNA, 22 bp, Homo sapiens
gcctgctggctgtccattgcag

SEQ ID NO: 9416997 - DNA, 22 bp, Homo sapiens
gcctggagcctcagcaaggagg

SEQ ID NO: 9416998 - DNA, 22 bp, Homo sapiens
gcctggagctactggacactga

SEQ ID NO: 9416999 - DNA, 22 bp, Homo sapiens
gcctggagctcatgtgggcatt

SEQ ID NO: 9417000 - DNA, 22 bp, Homo sapiens
gcctggagctcggctgagggcg

SEQ ID NO: 9417001 - DNA, 22 bp, Homo sapiens
gcctggagctcggctgagggcg

SEQ ID NO: 9417002 - DNA, 22 bp, Homo sapiens
gcctgggagcacatcggggtcc

SEQ ID NO: 9417003 - DNA, 22 bp, Homo sapiens
gcctggagctctccacttgggg

SEQ ID NO: 9417004 - DNA, 22 bp, Homo sapiens
gcctccagcccacgcaggcctg

SEQ ID NO: 9417005 - DNA, 21 bp, Homo sapiens
gcctccagccagatggcctcc

SEQ ID NO: 9417006 - DNA, 22 bp, Homo sapiens
gcctccacttttgctggcttct

SEQ ID NO: 9417007 - DNA, 21 bp, Homo sapiens
gcctcaccatgtcaagccagg

SEQ ID NO: 9417008 - DNA, 22 bp, Homo sapiens
atttctcaaccaggtcaaaaag

SEQ ID NO: 9417009 - DNA, 22 bp, Homo sapiens
atttctcacaaagttgcttatc

SEQ ID NO: 9417010 - DNA, 22 bp, Homo sapiens
atttctcaccctacctcactcc

SEQ ID NO: 9417011 - DNA, 22 bp, Homo sapiens
atttctcagcacttcctatctc

SEQ ID NO: 9417012 - DNA, 22 bp, Homo sapiens
atttctcactgagcagataaaa

SEQ ID NO: 9417013 - DNA, 22 bp, Homo sapiens
atttctcactgagcagataaaa

SEQ ID NO: 9417014 - DNA, 22 bp, Homo sapiens
atttctcagtaatctcagcaat

SEQ ID NO: 9417015 - DNA, 22 bp, Homo sapiens
gcctccccaagcagcagggatt

SEQ ID NO: 9417016 - DNA, 22 bp, Homo sapiens
gcctccccaagcagcagggatt

SEQ ID NO: 9417017 - DNA, 22 bp, Homo sapiens
gcctccccaagcagcagggatt

SEQ ID NO: 9417018 - DNA, 22 bp, Homo sapiens
gcctccccaggggtgtcatgag

SEQ ID NO: 9417019 - DNA, 22 bp, Homo sapiens
gcctccccaaagtgctgacagc

SEQ ID NO: 9417020 - DNA, 22 bp, Homo sapiens
gcctccccaagcagcagggatt

SEQ ID NO: 9417021 - DNA, 22 bp, Homo sapiens
gcctccccaaagtgctgacagc

SEQ ID NO: 9417022 - DNA, 22 bp, Homo sapiens
gcctccccaaagtgctgacagc

SEQ ID NO: 9417023 - DNA, 22 bp, Homo sapiens
gcctccccaaagtgctgacagc

SEQ ID NO: 9417024 - DNA, 22 bp, Homo sapiens
gcctccccaaagtgctgacagc

SEQ ID NO: 9417025 - DNA, 22 bp, Homo sapiens
gcctccagctggggcatttcag

SEQ ID NO: 9417026 - DNA, 22 bp, Homo sapiens
gcctccagcccacgcaggcctg

SEQ ID NO: 9417027 - DNA, 22 bp, Homo sapiens
gcctccagtttttttctgaact

SEQ ID NO: 9417028 - DNA, 22 bp, Homo sapiens
gcctccagggtagaggaggaag

SEQ ID NO: 9417029 - DNA, 22 bp, Homo sapiens
gcctccagtttttttctgaact

SEQ ID NO: 9417030 - DNA, 21 bp, Homo sapiens
gcctctccaaatcctgccttc

SEQ ID NO: 9417031 - DNA, 21 bp, Homo sapiens
gcctctccaaatcctgccttc

SEQ ID NO: 9417032 - DNA, 21 bp, Homo sapiens
gcctctccaaatcctgccttc

SEQ ID NO: 9417033 - DNA, 22 bp, Homo sapiens
gcctcgaggctgagaaggcaca

SEQ ID NO: 9417034 - DNA, 22 bp, Homo sapiens
gcctccccaggggtgtcatgag

SEQ ID NO: 9417035 - DNA, 22 bp, Homo sapiens
gcctctccgagccactgcctct

SEQ ID NO: 9417036 - DNA, 22 bp, Homo sapiens
gcctctccgagccactgcctct

SEQ ID NO: 9417037 - DNA, 21 bp, Homo sapiens
gcctctccaaatcctgccttc

SEQ ID NO: 9417038 - DNA, 21 bp, Homo sapiens
gcctctccaaatcctgccttc

SEQ ID NO: 9417039 - DNA, 22 bp, Homo sapiens
gcctctcctggagaaggcaggg

SEQ ID NO: 9417040 - DNA, 22 bp, Homo sapiens
gcctctcctcttaataccatta

SEQ ID NO: 9417041 - DNA, 22 bp, Homo sapiens
gcctctccgagccactgcctct

SEQ ID NO: 9417042 - DNA, 22 bp, Homo sapiens
gcctctccgagccactgcctct

SEQ ID NO: 9417043 - DNA, 22 bp, Homo sapiens
gcctctctccttggcttgcagt

SEQ ID NO: 9417044 - DNA, 22 bp, Homo sapiens
atttaatttggagagagaaacc

SEQ ID NO: 9417045 - DNA, 22 bp, Homo sapiens
atttaatttggagagagaaacc

SEQ ID NO: 9417046 - DNA, 22 bp, Homo sapiens
atttaatttggagagagaaacc

SEQ ID NO: 9417047 - DNA, 22 bp, Homo sapiens
atttaatttatagatgtggata

SEQ ID NO: 9417048 - DNA, 22 bp, Homo sapiens
atttaattttctcaacagtgct

SEQ ID NO: 9417049 - DNA, 22 bp, Homo sapiens
atttaattttctcaacagtgct

SEQ ID NO: 9417050 - DNA, 22 bp, Homo sapiens
atttaattttctcaacagtgct

SEQ ID NO: 9417051 - DNA, 21 bp, Homo sapiens
atttacaaaacagtcccttcc

SEQ ID NO: 9417052 - DNA, 22 bp, Homo sapiens
atttaaattttctgatggagag

SEQ ID NO: 9417053 - DNA, 22 bp, Homo sapiens
atttaaattttctgatggagag

SEQ ID NO: 9417054 - DNA, 22 bp, Homo sapiens
atttaaattttctgatggagag

SEQ ID NO: 9417055 - DNA, 22 bp, Homo sapiens
atttaaattttctgatggagag

SEQ ID NO: 9417056 - DNA, 22 bp, Homo sapiens
atttaatgtcgagctattgtag

SEQ ID NO: 9417057 - DNA, 22 bp, Homo sapiens
attggcaatagagaataaattg

SEQ ID NO: 9417058 - DNA, 22 bp, Homo sapiens
attggcactgcacatgattgct

SEQ ID NO: 9417059 - DNA, 22 bp, Homo sapiens
atttaatttacatttgacagag

SEQ ID NO: 9417060 - DNA, 22 bp, Homo sapiens
atttaatttacatttgacagag

SEQ ID NO: 9417061 - DNA, 22 bp, Homo sapiens
atttaatttacatttgacagag

SEQ ID NO: 9417062 - DNA, 22 bp, Homo sapiens
atttaatttacatttgacagag

SEQ ID NO: 9417063 - DNA, 22 bp, Homo sapiens
atttaattaatcatggtgaatt

SEQ ID NO: 9417064 - DNA, 22 bp, Homo sapiens
atttaatgtcgagctattgtag

SEQ ID NO: 9417065 - DNA, 22 bp, Homo sapiens
atttaattaatcatggtgaatt

SEQ ID NO: 9417066 - DNA, 22 bp, Homo sapiens
atttaattaatcatggtgaatt

SEQ ID NO: 9417067 - DNA, 22 bp, Homo sapiens
attggaaatacagtagaaaaat

SEQ ID NO: 9417068 - DNA, 22 bp, Homo sapiens
attggaaaatatggtttctgga

SEQ ID NO: 9417069 - DNA, 22 bp, Homo sapiens
attggaaagtgtctagtgtggt

SEQ ID NO: 9417070 - DNA, 21 bp, Homo sapiens
attggaaaaggtagttggctt

SEQ ID NO: 9417071 - DNA, 22 bp, Homo sapiens
attgcttttgagctagaatttt

SEQ ID NO: 9417072 - DNA, 22 bp, Homo sapiens
attgcttttccttaacacatgc

SEQ ID NO: 9417073 - DNA, 22 bp, Homo sapiens
attgcttttgagctagaatttt

SEQ ID NO: 9417074 - DNA, 18 bp, Homo sapiens
attgcttttgtaccaacc

SEQ ID NO: 9417075 - DNA, 22 bp, Homo sapiens
attgcttttgagctagaatttt

SEQ ID NO: 9417076 - DNA, 18 bp, Homo sapiens
attgcttttgtaccaacc

SEQ ID NO: 9417077 - DNA, 22 bp, Homo sapiens
attgcttttccttaacacatgc

SEQ ID NO: 9417078 - DNA, 22 bp, Homo sapiens
attgcttttagtgaaattatat

SEQ ID NO: 9417079 - DNA, 22 bp, Homo sapiens
attgctttagaaagaaaaatat

SEQ ID NO: 9417080 - DNA, 22 bp, Homo sapiens
attgcttttagtgaaattatat

SEQ ID NO: 9417081 - DNA, 22 bp, Homo sapiens
attgcttcaactgttcaatggg

SEQ ID NO: 9417082 - DNA, 22 bp, Homo sapiens
attgcttcccacaaagatgtat

SEQ ID NO: 9417083 - DNA, 22 bp, Homo sapiens
attgcttcaactgttcaatggg

SEQ ID NO: 9417084 - DNA, 22 bp, Homo sapiens
attgcttatctatctttaagtc

SEQ ID NO: 9417085 - DNA, 22 bp, Homo sapiens
attgcttcaactgttcaatggg

SEQ ID NO: 9417086 - DNA, 22 bp, Homo sapiens
attgctttagaaagaaaaatat

SEQ ID NO: 9417087 - DNA, 22 bp, Homo sapiens
attgctttagaaagaaaaatat

SEQ ID NO: 9417088 - DNA, 22 bp, Homo sapiens
attgcttcccacaaagatgtat

SEQ ID NO: 9417089 - DNA, 22 bp, Homo sapiens
gccagctggctgcaggtcccag

SEQ ID NO: 9417090 - DNA, 22 bp, Homo sapiens
gccagctggctgcaggtcccag

SEQ ID NO: 9417091 - DNA, 22 bp, Homo sapiens
gccaggaggcttaactggacag

SEQ ID NO: 9417092 - DNA, 22 bp, Homo sapiens
gccaggaggcttaactggacag

SEQ ID NO: 9417093 - DNA, 22 bp, Homo sapiens
atttacagaagcatgtaatagc

SEQ ID NO: 9417094 - DNA, 22 bp, Homo sapiens
gccagctggagtgagagtgggc

SEQ ID NO: 9417095 - DNA, 22 bp, Homo sapiens
atttacagaagcatgtaatagc

SEQ ID NO: 9417096 - DNA, 22 bp, Homo sapiens
gccaggagggaaaggacaattt

SEQ ID NO: 9417097 - DNA, 22 bp, Homo sapiens
gccaggaggcttaactggacag

SEQ ID NO: 9417098 - DNA, 22 bp, Homo sapiens
gccaggaggcttaactggacag

SEQ ID NO: 9417099 - DNA, 22 bp, Homo sapiens
atttacagaagcatgtaatagc

SEQ ID NO: 9417100 - DNA, 22 bp, Homo sapiens
atttacagaaacttaatcatag

SEQ ID NO: 9417101 - DNA, 22 bp, Homo sapiens
atttacagaaacttaatcatag

SEQ ID NO: 9417102 - DNA, 22 bp, Homo sapiens
atttacagaaacttaatcatag

SEQ ID NO: 9417103 - DNA, 22 bp, Homo sapiens
atttacacttggtttactagag

SEQ ID NO: 9417104 - DNA, 22 bp, Homo sapiens
atttacacttggtttactagag

SEQ ID NO: 9417105 - DNA, 22 bp, Homo sapiens
atttacactggttctcagagct

SEQ ID NO: 9417106 - DNA, 22 bp, Homo sapiens
atttacactggttctcagagct

SEQ ID NO: 9417107 - DNA, 21 bp, Homo sapiens
atttacaaaacagtcccttcc

SEQ ID NO: 9417108 - DNA, 22 bp, Homo sapiens
atttacacattcataagatttc

SEQ ID NO: 9417109 - DNA, 19 bp, Homo sapiens
atttactgcctaaaatctc

SEQ ID NO: 9417110 - DNA, 22 bp, Homo sapiens
atttactgaagggtaggttgtt

SEQ ID NO: 9417111 - DNA, 22 bp, Homo sapiens
atttactgcttgacacattggt

SEQ ID NO: 9417112 - DNA, 22 bp, Homo sapiens
atttactgaggtaaataaactg

SEQ ID NO: 9417113 - DNA, 22 bp, Homo sapiens
atttactgagcagctaccatgt

SEQ ID NO: 9417114 - DNA, 22 bp, Homo sapiens
atttactggaaaaactatgagc

SEQ ID NO: 9417115 - DNA, 22 bp, Homo sapiens
atttactggaaaaactatgagc

SEQ ID NO: 9417116 - DNA, 22 bp, Homo sapiens
atttagaaattccaaaagtatt

SEQ ID NO: 9417117 - DNA, 22 bp, Homo sapiens
atttagaaattccaaaagtatt

SEQ ID NO: 9417118 - DNA, 22 bp, Homo sapiens
atttagaaattccaaaagtatt

SEQ ID NO: 9417119 - DNA, 22 bp, Homo sapiens
atttagaactttgtttgccaat

SEQ ID NO: 9417120 - DNA, 22 bp, Homo sapiens
atttagaagctaatttttcaga

SEQ ID NO: 9417121 - DNA, 22 bp, Homo sapiens
atttagaagctaatttttcaga

SEQ ID NO: 9417122 - DNA, 22 bp, Homo sapiens
atttagaaattccaaaagtatt

SEQ ID NO: 9417123 - DNA, 22 bp, Homo sapiens
atttagaaattccaaaagtatt

SEQ ID NO: 9417124 - DNA, 22 bp, Homo sapiens
atttagaaccccttccaacctg

SEQ ID NO: 9417125 - DNA, 20 bp, Homo sapiens
gccaggagggtgtgatgagc

SEQ ID NO: 9417126 - DNA, 20 bp, Homo sapiens
gccaggagggtgtgatgagc

SEQ ID NO: 9417127 - DNA, 22 bp, Homo sapiens
gccaggaggtcagcccctcaac

SEQ ID NO: 9417128 - DNA, 22 bp, Homo sapiens
atttactagggctgtttaagta

SEQ ID NO: 9417129 - DNA, 22 bp, Homo sapiens
atttactactgctatctagaag

SEQ ID NO: 9417130 - DNA, 21 bp, Homo sapiens
atttcagagcacacaagtaaa

SEQ ID NO: 9417131 - DNA, 21 bp, Homo sapiens
atttcagagcacacaagtaaa

SEQ ID NO: 9417132 - DNA, 22 bp, Homo sapiens
atttcagaatgtcctaatttag

SEQ ID NO: 9417133 - DNA, 21 bp, Homo sapiens
atttcagaaatattggtggga

SEQ ID NO: 9417134 - DNA, 22 bp, Homo sapiens
atttcagactgtgttggaaaat

SEQ ID NO: 9417135 - DNA, 22 bp, Homo sapiens
atttcagatgaccaaatggaaa

SEQ ID NO: 9417136 - DNA, 22 bp, Homo sapiens
atttcagagtgagagtgctcaa

SEQ ID NO: 9417137 - DNA, 22 bp, Homo sapiens
atttcagatgaccaaatggaaa

SEQ ID NO: 9417138 - DNA, 22 bp, Homo sapiens
atttcagagtgagagtgctcaa

SEQ ID NO: 9417139 - DNA, 22 bp, Homo sapiens
atttcagattcagaaatgtagg

SEQ ID NO: 9417140 - DNA, 22 bp, Homo sapiens
atttcagattcagaaatgtagg

SEQ ID NO: 9417141 - DNA, 22 bp, Homo sapiens
atttcagattcgagaggaagtg

SEQ ID NO: 9417142 - DNA, 22 bp, Homo sapiens
atttcagatgaccaaatggaaa

SEQ ID NO: 9417143 - DNA, 19 bp, Homo sapiens
gccaggcctggacctgcag

SEQ ID NO: 9417144 - DNA, 22 bp, Homo sapiens
gccaggcctgcaagtgctggtg

SEQ ID NO: 9417145 - DNA, 22 bp, Homo sapiens
gccaggcctgcaagtgctggtg

SEQ ID NO: 9417146 - DNA, 22 bp, Homo sapiens
atttcacaaaccatcctgattt

SEQ ID NO: 9417147 - DNA, 21 bp, Homo sapiens
atttcagaaatattggtggga

SEQ ID NO: 9417148 - DNA, 22 bp, Homo sapiens
atttcaagtgttgagctcataa

SEQ ID NO: 9417149 - DNA, 19 bp, Homo sapiens
gccaggcctggacctgcag

SEQ ID NO: 9417150 - DNA, 22 bp, Homo sapiens
gccaggccctgggcacttcgtg

SEQ ID NO: 9417151 - DNA, 22 bp, Homo sapiens
gccaggccctgggcacttcgtg

SEQ ID NO: 9417152 - DNA, 22 bp, Homo sapiens
gccaggcctgcaagtgctggtg

SEQ ID NO: 9417153 - DNA, 22 bp, Homo sapiens
gccaggcctgcaagtgctggtg

SEQ ID NO: 9417154 - DNA, 22 bp, Homo sapiens
gccaggccactcccgggtcctg

SEQ ID NO: 9417155 - DNA, 22 bp, Homo sapiens
gccaggccactcccgggtcctg

SEQ ID NO: 9417156 - DNA, 22 bp, Homo sapiens
atttattggatgcttacttggg

SEQ ID NO: 9417157 - DNA, 22 bp, Homo sapiens
atttattggatgcttacttggg

SEQ ID NO: 9417158 - DNA, 22 bp, Homo sapiens
atttattggatgcttacttggg

SEQ ID NO: 9417159 - DNA, 22 bp, Homo sapiens
atttattgagcctttcctatgt

SEQ ID NO: 9417160 - DNA, 22 bp, Homo sapiens
gccaggcatttgttaggtgctg

SEQ ID NO: 9417161 - DNA, 22 bp, Homo sapiens
gccaggcatttgttaggtgctg

SEQ ID NO: 9417162 - DNA, 22 bp, Homo sapiens
atttattgagacttaacaaccc

SEQ ID NO: 9417163 - DNA, 22 bp, Homo sapiens
atttattgagacttaacaaccc

SEQ ID NO: 9417164 - DNA, 22 bp, Homo sapiens
atttattgagacttaacaaccc

SEQ ID NO: 9417165 - DNA, 22 bp, Homo sapiens
atttattgagacttaacaaccc

SEQ ID NO: 9417166 - DNA, 22 bp, Homo sapiens
atttattatgggatttggcaca

SEQ ID NO: 9417167 - DNA, 22 bp, Homo sapiens
atttattgagcctttcctatgt

SEQ ID NO: 9417168 - DNA, 22 bp, Homo sapiens
atttattgagcctttcctatgt

SEQ ID NO: 9417169 - DNA, 22 bp, Homo sapiens
atttattgagacttaacaaccc

SEQ ID NO: 9417170 - DNA, 22 bp, Homo sapiens
atttattgagagggaggggaat

SEQ ID NO: 9417171 - DNA, 22 bp, Homo sapiens
atttattgagagggaggggaat

SEQ ID NO: 9417172 - DNA, 22 bp, Homo sapiens
atttattgagagggaggggaat

SEQ ID NO: 9417173 - DNA, 22 bp, Homo sapiens
atttcagtgagaaagcaatcaa

SEQ ID NO: 9417174 - DNA, 22 bp, Homo sapiens
atttcagtgagaaagcaatcaa

SEQ ID NO: 9417175 - DNA, 22 bp, Homo sapiens
atttcagattcgagaggaagtg

SEQ ID NO: 9417176 - DNA, 22 bp, Homo sapiens
atttcagcagcccatgtttgga

SEQ ID NO: 9417177 - DNA, 22 bp, Homo sapiens
atttcagtgttttaagagttca

SEQ ID NO: 9417178 - DNA, 22 bp, Homo sapiens
atttcatactaaggctcaaaaa

SEQ ID NO: 9417179 - DNA, 22 bp, Homo sapiens
atttcatactaaggctcaaaaa

SEQ ID NO: 9417180 - DNA, 22 bp, Homo sapiens
atttcatatgtatcacctagcc

SEQ ID NO: 9417181 - DNA, 22 bp, Homo sapiens
atttcatagattgtaaatccct

SEQ ID NO: 9417182 - DNA, 22 bp, Homo sapiens
atttcatgagttattatagtgg

SEQ ID NO: 9417183 - DNA, 22 bp, Homo sapiens
atttcatctctggaacataact

SEQ ID NO: 9417184 - DNA, 22 bp, Homo sapiens
atttcatgagttattatagtgg

SEQ ID NO: 9417185 - DNA, 21 bp, Homo sapiens
atttcatggtgcttttaagaa

SEQ ID NO: 9417186 - DNA, 22 bp, Homo sapiens
atttcgttcagtccttactgtg

SEQ ID NO: 9417187 - DNA, 22 bp, Homo sapiens
atttctaaagagggtggtttgg

SEQ ID NO: 9417188 - DNA, 22 bp, Homo sapiens
atttctaaagagggtggtttgg

SEQ ID NO: 9417189 - DNA, 22 bp, Homo sapiens
atttctagacttagaactctta

SEQ ID NO: 9417190 - DNA, 22 bp, Homo sapiens
atttctagcagggcaggaaaga

SEQ ID NO: 9417191 - DNA, 22 bp, Homo sapiens
atttctataggaggacagtatt

SEQ ID NO: 9417192 - DNA, 22 bp, Homo sapiens
atttcctagggtagatgtcaca

SEQ ID NO: 9417193 - DNA, 22 bp, Homo sapiens
atttccttcccagatttggttc

SEQ ID NO: 9417194 - DNA, 22 bp, Homo sapiens
atttccttcccagatttggttc

SEQ ID NO: 9417195 - DNA, 22 bp, Homo sapiens
atttccttcggacagtttgggt

SEQ ID NO: 9417196 - DNA, 22 bp, Homo sapiens
atttcatgtgaagaagagataa

SEQ ID NO: 9417197 - DNA, 22 bp, Homo sapiens
atttcatgtgaagaagagataa

SEQ ID NO: 9417198 - DNA, 22 bp, Homo sapiens
atttccttgcaagtttctgtaa

SEQ ID NO: 9417199 - DNA, 22 bp, Homo sapiens
atttccttgcaagtttctgtaa

SEQ ID NO: 9417200 - DNA, 22 bp, Homo sapiens
atttccttcggacagtttgggt

SEQ ID NO: 9417201 - DNA, 22 bp, Homo sapiens
atttccttcggacagtttgggt

SEQ ID NO: 9417202 - DNA, 22 bp, Homo sapiens
atttccttgcaacttaggcatg

SEQ ID NO: 9417203 - DNA, 22 bp, Homo sapiens
atttcctttgcaaagactgtgc

SEQ ID NO: 9417204 - DNA, 22 bp, Homo sapiens
atttcctttgcaaagactgtgc

SEQ ID NO: 9417205 - DNA, 22 bp, Homo sapiens
atttccttgcaagtttctgtaa

SEQ ID NO: 9417206 - DNA, 16 bp, Homo sapiens
atttccttgtgagttt

SEQ ID NO: 9417207 - DNA, 22 bp, Homo sapiens
cagcagcagacatttgatcttc

SEQ ID NO: 9417208 - DNA, 22 bp, Homo sapiens
cagcagcagagatactggtttc

SEQ ID NO: 9417209 - DNA, 22 bp, Homo sapiens
cagcagcagattcagcgtctgg

SEQ ID NO: 9417210 - DNA, 22 bp, Homo sapiens
cagcagcagagatactggtttc

SEQ ID NO: 9417211 - DNA, 22 bp, Homo sapiens
cagcagcactctgcgggtcccc

SEQ ID NO: 9417212 - DNA, 22 bp, Homo sapiens
cagcagcactctgcgggtcccc

SEQ ID NO: 9417213 - DNA, 22 bp, Homo sapiens
cagcagcagacatttgatcttc

SEQ ID NO: 9417214 - DNA, 22 bp, Homo sapiens
cagcagcacctattatagtgtt

SEQ ID NO: 9417215 - DNA, 22 bp, Homo sapiens
cagcagcaaggtgagggtggag

SEQ ID NO: 9417216 - DNA, 22 bp, Homo sapiens
cagcagcaaggtgagggtggag

SEQ ID NO: 9417217 - DNA, 22 bp, Homo sapiens
gtatccatgggggattggttcc

SEQ ID NO: 9417218 - DNA, 22 bp, Homo sapiens
gtatccatgggggattggttcc

SEQ ID NO: 9417219 - DNA, 22 bp, Homo sapiens
gtatcatatgcatcaggcttgc

SEQ ID NO: 9417220 - DNA, 22 bp, Homo sapiens
gtatctgtggattttggtatcc

SEQ ID NO: 9417221 - DNA, 22 bp, Homo sapiens
gtatctttccacatcttcagta

SEQ ID NO: 9417222 - DNA, 22 bp, Homo sapiens
gtatcacttttgagagtgagaa

SEQ ID NO: 9417223 - DNA, 21 bp, Homo sapiens
gtatcacatttgcatgcttat

SEQ ID NO: 9417224 - DNA, 22 bp, Homo sapiens
cagcagagctgtgtgggaaggg

SEQ ID NO: 9417225 - DNA, 22 bp, Homo sapiens
cagcagagctgtgtgggaaggg

SEQ ID NO: 9417226 - DNA, 22 bp, Homo sapiens
cagcagagctgtgtgggaaggg

SEQ ID NO: 9417227 - DNA, 21 bp, Homo sapiens
cagcagagtaatgcattcgta

SEQ ID NO: 9417228 - DNA, 21 bp, Homo sapiens
cagcagagtaatgcattcgta

SEQ ID NO: 9417229 - DNA, 21 bp, Homo sapiens
cagcagagtaatgcattcgta

SEQ ID NO: 9417230 - DNA, 22 bp, Homo sapiens
cagcagagcttatgttgggtca

SEQ ID NO: 9417231 - DNA, 22 bp, Homo sapiens
cagcagagtaattctcacctct

SEQ ID NO: 9417232 - DNA, 22 bp, Homo sapiens
cagcagagtaattctcacctct

SEQ ID NO: 9417233 - DNA, 22 bp, Homo sapiens
cagcagagtaattctcacctct

SEQ ID NO: 9417234 - DNA, 22 bp, Homo sapiens
cagcagagtatggcactcaact

SEQ ID NO: 9417235 - DNA, 22 bp, Homo sapiens
cagcagagtatggcactcaact

SEQ ID NO: 9417236 - DNA, 22 bp, Homo sapiens
cagcagagtttggcttctaatg

SEQ ID NO: 9417237 - DNA, 22 bp, Homo sapiens
cagcagagtttggcttctaatg

SEQ ID NO: 9417238 - DNA, 22 bp, Homo sapiens
cagcagagtaggtgctacttct

SEQ ID NO: 9417239 - DNA, 22 bp, Homo sapiens
cagcagagtaggtgctacttct

SEQ ID NO: 9417240 - DNA, 22 bp, Homo sapiens
cagcagagtaattctcacctct

SEQ ID NO: 9417241 - DNA, 22 bp, Homo sapiens
cagcagagtatggcactcaact

SEQ ID NO: 9417242 - DNA, 22 bp, Homo sapiens
cagcagagtatggcactcaact

SEQ ID NO: 9417243 - DNA, 22 bp, Homo sapiens
cagcagagtaggtgctacttct

SEQ ID NO: 9417244 - DNA, 22 bp, Homo sapiens
cagcagagtatggcactcaact

SEQ ID NO: 9417245 - DNA, 22 bp, Homo sapiens
cagcagagtatggcactcaact

SEQ ID NO: 9417246 - DNA, 22 bp, Homo sapiens
cagcagcaaatctagaagagga

SEQ ID NO: 9417247 - DNA, 22 bp, Homo sapiens
cagcagcaacaacggaagcctt

SEQ ID NO: 9417248 - DNA, 22 bp, Homo sapiens
cagcagcaaatctagaagagga

SEQ ID NO: 9417249 - DNA, 22 bp, Homo sapiens
cagcagcaaatctagaagagga

SEQ ID NO: 9417250 - DNA, 22 bp, Homo sapiens
cagcagatcaatgtagaatatt

SEQ ID NO: 9417251 - DNA, 22 bp, Homo sapiens
cagcagcaaatctagaagagga

SEQ ID NO: 9417252 - DNA, 22 bp, Homo sapiens
cagcagatttgggaaacactgt

SEQ ID NO: 9417253 - DNA, 22 bp, Homo sapiens
cagcagcaacaatagcggtcac

SEQ ID NO: 9417254 - DNA, 22 bp, Homo sapiens
cagcagcaacaatagcggtcac

SEQ ID NO: 9417255 - DNA, 22 bp, Homo sapiens
cagcagcaacaatagcggtcac

SEQ ID NO: 9417256 - DNA, 22 bp, Homo sapiens
cagcagcaaggtgagggtggag

SEQ ID NO: 9417257 - DNA, 22 bp, Homo sapiens
cagcagcaacaacggaagcctt

SEQ ID NO: 9417258 - DNA, 22 bp, Homo sapiens
cagcagcaacaacggaagcctt

SEQ ID NO: 9417259 - DNA, 22 bp, Homo sapiens
cagcagcaacaacggaagcctt

SEQ ID NO: 9417260 - DNA, 22 bp, Homo sapiens
cagcagctaaggcatgttcctg

SEQ ID NO: 9417261 - DNA, 22 bp, Homo sapiens
cagcagcctggcccctcctcgg

SEQ ID NO: 9417262 - DNA, 22 bp, Homo sapiens
cagcagcctggagggggccacg

SEQ ID NO: 9417263 - DNA, 22 bp, Homo sapiens
cagcaggacatggaggagtaaa

SEQ ID NO: 9417264 - DNA, 22 bp, Homo sapiens
cagcaggacatggaggagtaaa

SEQ ID NO: 9417265 - DNA, 22 bp, Homo sapiens
cagcaggaccattgaggcatca

SEQ ID NO: 9417266 - DNA, 22 bp, Homo sapiens
cagcagctacctgctcttgtgg

SEQ ID NO: 9417267 - DNA, 22 bp, Homo sapiens
cagcagctacttggagcagcag

SEQ ID NO: 9417268 - DNA, 22 bp, Homo sapiens
gtatgaaagcatcattcctgct

SEQ ID NO: 9417269 - DNA, 22 bp, Homo sapiens
gtatgaaggcgagagcccacta

SEQ ID NO: 9417270 - DNA, 22 bp, Homo sapiens
gtatgaaaattgtaaagttctt

SEQ ID NO: 9417271 - DNA, 22 bp, Homo sapiens
gtatctttgtcttcatgttgga

SEQ ID NO: 9417272 - DNA, 22 bp, Homo sapiens
cagcagcctgccttgggagctt

SEQ ID NO: 9417273 - DNA, 22 bp, Homo sapiens
cagcagcctccactcgccccac

SEQ ID NO: 9417274 - DNA, 22 bp, Homo sapiens
cagcagcctcaagtttattttc

SEQ ID NO: 9417275 - DNA, 22 bp, Homo sapiens
gtatgcatttggcatattgtcc

SEQ ID NO: 9417276 - DNA, 22 bp, Homo sapiens
cagcagcctagggttccatcat

SEQ ID NO: 9417277 - DNA, 22 bp, Homo sapiens
cagcaggattggatacatctca

SEQ ID NO: 9417278 - DNA, 22 bp, Homo sapiens
cagcaggatttgaaaggaagag

SEQ ID NO: 9417279 - DNA, 22 bp, Homo sapiens
cagcaggatttgaaaggaagag

SEQ ID NO: 9417280 - DNA, 22 bp, Homo sapiens
cagcaggatttgaaaggaagag

SEQ ID NO: 9417281 - DNA, 22 bp, Homo sapiens
cagcaggatttgaaaggaagag

SEQ ID NO: 9417282 - DNA, 22 bp, Homo sapiens
cagcaggccatgctgcttttca

SEQ ID NO: 9417283 - DNA, 22 bp, Homo sapiens
cagcaggcaggtgggccaagtc

SEQ ID NO: 9417284 - DNA, 22 bp, Homo sapiens
cagcaggccatgctgcttttca

SEQ ID NO: 9417285 - DNA, 22 bp, Homo sapiens
cagcaggcaggtgggccaagtc

SEQ ID NO: 9417286 - DNA, 22 bp, Homo sapiens
cagcaggcaggtgggccaagtc

SEQ ID NO: 9417287 - DNA, 22 bp, Homo sapiens
cagcaggcccaggtgctggtga

SEQ ID NO: 9417288 - DNA, 22 bp, Homo sapiens
cagcaggcccaggtgctggtga

SEQ ID NO: 9417289 - DNA, 22 bp, Homo sapiens
gtatttctagaaaatgcagatt

SEQ ID NO: 9417290 - DNA, 22 bp, Homo sapiens
gtatttctagaaaatgcagatt

SEQ ID NO: 9417291 - DNA, 22 bp, Homo sapiens
cagcaggcggcccgcgggcccg

SEQ ID NO: 9417292 - DNA, 22 bp, Homo sapiens
cagcaggcggcccgcgggcccg

SEQ ID NO: 9417293 - DNA, 22 bp, Homo sapiens
gtatttctggttaaatgtgcta

SEQ ID NO: 9417294 - DNA, 22 bp, Homo sapiens
gtatttctggtaactgctgcta

SEQ ID NO: 9417295 - DNA, 22 bp, Homo sapiens
gtatttctggtaactgctgcta

SEQ ID NO: 9417296 - DNA, 22 bp, Homo sapiens
gtatttcttggaaatcctttta

SEQ ID NO: 9417297 - DNA, 18 bp, Homo sapiens
ggttgataacttgtgatt

SEQ ID NO: 9417298 - DNA, 22 bp, Homo sapiens
ggttgcaaactcctgggatcaa

SEQ ID NO: 9417299 - DNA, 22 bp, Homo sapiens
ggttgcaaactcctgggatcaa

SEQ ID NO: 9417300 - DNA, 22 bp, Homo sapiens
ggttggacactaggtaggagcg

SEQ ID NO: 9417301 - DNA, 22 bp, Homo sapiens
gtaaaatagaataacgtggcta

SEQ ID NO: 9417302 - DNA, 19 bp, Homo sapiens
ggttggagaagagcggccc

SEQ ID NO: 9417303 - DNA, 20 bp, Homo sapiens
gtaaaatatggtctttgggt

SEQ ID NO: 9417304 - DNA, 22 bp, Homo sapiens
gtaaaattctagcatctgaaag

SEQ ID NO: 9417305 - DNA, 22 bp, Homo sapiens
gtaaaattctagcatctgaaag

SEQ ID NO: 9417306 - DNA, 22 bp, Homo sapiens
gtaaaattctagcatctgaaag

SEQ ID NO: 9417307 - DNA, 22 bp, Homo sapiens
gtaaaattgcaattacttttgc

SEQ ID NO: 9417308 - DNA, 22 bp, Homo sapiens
gtaaaattgcaattacttttgc

SEQ ID NO: 9417309 - DNA, 22 bp, Homo sapiens
gtaaaattgcaattacttttgc

SEQ ID NO: 9417310 - DNA, 22 bp, Homo sapiens
gtaaacactacaaatcaaggct

SEQ ID NO: 9417311 - DNA, 22 bp, Homo sapiens
gtaaacaaactctcaggccagt

SEQ ID NO: 9417312 - DNA, 22 bp, Homo sapiens
gtaaaattgcaattacttttgc

SEQ ID NO: 9417313 - DNA, 22 bp, Homo sapiens
gtaaacaacacaaatcatttga

SEQ ID NO: 9417314 - DNA, 22 bp, Homo sapiens
gtaaacaacacaaatcatttga

SEQ ID NO: 9417315 - DNA, 22 bp, Homo sapiens
ggttctctaactttgactggag

SEQ ID NO: 9417316 - DNA, 22 bp, Homo sapiens
ggttcctgtgcctctagctggc

SEQ ID NO: 9417317 - DNA, 22 bp, Homo sapiens
ggttccttctgaggtccctgta

SEQ ID NO: 9417318 - DNA, 22 bp, Homo sapiens
ggttccttctgaggtccctgta

SEQ ID NO: 9417319 - DNA, 23 bp, Homo sapiens
ggttcctgagcagggatctggaa

SEQ ID NO: 9417320 - DNA, 19 bp, Homo sapiens
ggttcctcacgctaagggc

SEQ ID NO: 9417321 - DNA, 23 bp, Homo sapiens
ggttcctgagcagggatctggaa

SEQ ID NO: 9417322 - DNA, 22 bp, Homo sapiens
ggttcctgatcgttgtctctct

SEQ ID NO: 9417323 - DNA, 22 bp, Homo sapiens
ggttccccaggcggcccttgga

SEQ ID NO: 9417324 - DNA, 22 bp, Homo sapiens
ggttccagagtatttcatttca

SEQ ID NO: 9417325 - DNA, 22 bp, Homo sapiens
cagcaataactcaaagccattt

SEQ ID NO: 9417326 - DNA, 22 bp, Homo sapiens
cagcaataaggtaagcttctcc

SEQ ID NO: 9417327 - DNA, 22 bp, Homo sapiens
cagcaataaggtaagcttctcc

SEQ ID NO: 9417328 - DNA, 22 bp, Homo sapiens
cagcaataatgtctacaaatct

SEQ ID NO: 9417329 - DNA, 22 bp, Homo sapiens
cagcaaggtctgtcaatagtgg

SEQ ID NO: 9417330 - DNA, 22 bp, Homo sapiens
cagcaatccaagctttctttaa

SEQ ID NO: 9417331 - DNA, 22 bp, Homo sapiens
cagcaatcgggtgatatgcaat

SEQ ID NO: 9417332 - DNA, 22 bp, Homo sapiens
cagcaatggcaggcggagagtg

SEQ ID NO: 9417333 - DNA, 22 bp, Homo sapiens
ggttccacctggcgaggggtat

SEQ ID NO: 9417334 - DNA, 22 bp, Homo sapiens
cagcaagggttatatcaaagat

SEQ ID NO: 9417335 - DNA, 22 bp, Homo sapiens
cagcaaggtctgtcaatagtgg

SEQ ID NO: 9417336 - DNA, 22 bp, Homo sapiens
cagcaagggttatatcaaagat

SEQ ID NO: 9417337 - DNA, 22 bp, Homo sapiens
cagcaagggataaagagttact

SEQ ID NO: 9417338 - DNA, 22 bp, Homo sapiens
cagcaagggataaagagttact

SEQ ID NO: 9417339 - DNA, 22 bp, Homo sapiens
cagcaagggataaacaaggacg

SEQ ID NO: 9417340 - DNA, 22 bp, Homo sapiens
cagcaaggccattggatgcagt

SEQ ID NO: 9417341 - DNA, 22 bp, Homo sapiens
cagcaaggccattggatgcagt

SEQ ID NO: 9417342 - DNA, 22 bp, Homo sapiens
cagcaaggccattggatgcagt

SEQ ID NO: 9417343 - DNA, 22 bp, Homo sapiens
cagcaagggataaacaaggacg

SEQ ID NO: 9417344 - DNA, 22 bp, Homo sapiens
cagcaaggccattggatgcagt

SEQ ID NO: 9417345 - DNA, 22 bp, Homo sapiens
cagcaaggccattggatgcagt

SEQ ID NO: 9417346 - DNA, 22 bp, Homo sapiens
cagcaaggcattctgtggatta

SEQ ID NO: 9417347 - DNA, 22 bp, Homo sapiens
ggtgggtgaaatctaggtgtgt

SEQ ID NO: 9417348 - DNA, 22 bp, Homo sapiens
cagcaaggactgggcatgtgaa

SEQ ID NO: 9417349 - DNA, 22 bp, Homo sapiens
cagcaaggcattctgtggatta

SEQ ID NO: 9417350 - DNA, 22 bp, Homo sapiens
ggtgggtattgaatacaggtgt

SEQ ID NO: 9417351 - DNA, 22 bp, Homo sapiens
ggtgggtgaaatctaggtgtgt

SEQ ID NO: 9417352 - DNA, 22 bp, Homo sapiens
ggtgggtgaaatctaggtgtgt

SEQ ID NO: 9417353 - DNA, 16 bp, Homo sapiens
ggtggggtagttagaa

SEQ ID NO: 9417354 - DNA, 22 bp, Homo sapiens
ggtggggtcacgacagagggaa

SEQ ID NO: 9417355 - DNA, 22 bp, Homo sapiens
ggtggggtcacgacagagggaa

SEQ ID NO: 9417356 - DNA, 22 bp, Homo sapiens
ggtggggtcacgacagagggaa

SEQ ID NO: 9417357 - DNA, 22 bp, Homo sapiens
ggtggggttttaggctgctgca

SEQ ID NO: 9417358 - DNA, 22 bp, Homo sapiens
ggtggggttttaggctgctgca

SEQ ID NO: 9417359 - DNA, 22 bp, Homo sapiens
ggtgggtaaaactgctggcact

SEQ ID NO: 9417360 - DNA, 22 bp, Homo sapiens
ggtgggtaaaactgctggcact

SEQ ID NO: 9417361 - DNA, 22 bp, Homo sapiens
ggtggggctgcaagcagttcgg

SEQ ID NO: 9417362 - DNA, 22 bp, Homo sapiens
ggtggggctgcaagcagttcgg

SEQ ID NO: 9417363 - DNA, 22 bp, Homo sapiens
ggtggggctgcaagcagttcgg

SEQ ID NO: 9417364 - DNA, 22 bp, Homo sapiens
ggtggggctcagcaatctgtgt

SEQ ID NO: 9417365 - DNA, 21 bp, Homo sapiens
ggtggggtacctaaggtagct

SEQ ID NO: 9417366 - DNA, 22 bp, Homo sapiens
ggtgggggagacttggtcaaga

SEQ ID NO: 9417367 - DNA, 22 bp, Homo sapiens
ggtgggggagacttggtcaaga

SEQ ID NO: 9417368 - DNA, 22 bp, Homo sapiens
ggtgggggagacttggtcaaga

SEQ ID NO: 9417369 - DNA, 22 bp, Homo sapiens
ggtgggggagacttggtcaaga

SEQ ID NO: 9417370 - DNA, 21 bp, Homo sapiens
gggtgggaggacacagcaggc

SEQ ID NO: 9417371 - DNA, 21 bp, Homo sapiens
gggtgggaggacacagcaggc

SEQ ID NO: 9417372 - DNA, 21 bp, Homo sapiens
gggtgggaggacacagcaggc

SEQ ID NO: 9417373 - DNA, 20 bp, Homo sapiens
gggtgggagagtctgagggt

SEQ ID NO: 9417374 - DNA, 20 bp, Homo sapiens
gggtgggagagtctgagggt

SEQ ID NO: 9417375 - DNA, 20 bp, Homo sapiens
gggtgggagagtctgagggt

SEQ ID NO: 9417376 - DNA, 22 bp, Homo sapiens
gggtgggagtctggccctcaaa

SEQ ID NO: 9417377 - DNA, 22 bp, Homo sapiens
ggtgggacaggtaggagtggct

SEQ ID NO: 9417378 - DNA, 22 bp, Homo sapiens
ggtggggctaggacctcaggat

SEQ ID NO: 9417379 - DNA, 22 bp, Homo sapiens
ggtggggctaggacctcaggat

SEQ ID NO: 9417380 - DNA, 22 bp, Homo sapiens
ggtggggctaggacctcaggat

SEQ ID NO: 9417381 - DNA, 22 bp, Homo sapiens
ggtggggctaggacctcaggat

SEQ ID NO: 9417382 - DNA, 22 bp, Homo sapiens
ggtgggagagctctgtctccag

SEQ ID NO: 9417383 - DNA, 22 bp, Homo sapiens
cagagtcagagcacctgggatt

SEQ ID NO: 9417384 - DNA, 20 bp, Homo sapiens
cagagtaattattacccttt

SEQ ID NO: 9417385 - DNA, 22 bp, Homo sapiens
cagagtatccctttagaattaa

SEQ ID NO: 9417386 - DNA, 22 bp, Homo sapiens
cagagtcaatgtccaagaagct

SEQ ID NO: 9417387 - DNA, 22 bp, Homo sapiens
gggtgggactctttggcctgag

SEQ ID NO: 9417388 - DNA, 22 bp, Homo sapiens
gggtgggactctttggcctgag

SEQ ID NO: 9417389 - DNA, 22 bp, Homo sapiens
gggtgggaaggctaagggattg

SEQ ID NO: 9417390 - DNA, 22 bp, Homo sapiens
gggtgggactctttggcctgag

SEQ ID NO: 9417391 - DNA, 22 bp, Homo sapiens
gggtgggactgaagtctgaggg

SEQ ID NO: 9417392 - DNA, 22 bp, Homo sapiens
gggtgggactgaagtctgaggg

SEQ ID NO: 9417393 - DNA, 22 bp, Homo sapiens
cagccactgaactcctggctat

SEQ ID NO: 9417394 - DNA, 22 bp, Homo sapiens
cagccactgaactcctggctat

SEQ ID NO: 9417395 - DNA, 22 bp, Homo sapiens
cagccaccatacagcagaagct

SEQ ID NO: 9417396 - DNA, 22 bp, Homo sapiens
cagccacagctgggtgcctgac

SEQ ID NO: 9417397 - DNA, 22 bp, Homo sapiens
cagccaagaaccacagacccag

SEQ ID NO: 9417398 - DNA, 22 bp, Homo sapiens
cagccacagctgggtgcctgac

SEQ ID NO: 9417399 - DNA, 22 bp, Homo sapiens
cagccaagaaagcagtgctcca

SEQ ID NO: 9417400 - DNA, 22 bp, Homo sapiens
cagccaagaaagcagtgctcca

SEQ ID NO: 9417401 - DNA, 22 bp, Homo sapiens
cagcattttcttaatgtaggtg

SEQ ID NO: 9417402 - DNA, 22 bp, Homo sapiens
cagccaaatgagtcataaatgt

SEQ ID NO: 9417403 - DNA, 22 bp, Homo sapiens
cagcattttcttaatgtaggtg

SEQ ID NO: 9417404 - DNA, 22 bp, Homo sapiens
cagccacttcgagcttcctgat

SEQ ID NO: 9417405 - DNA, 21 bp, Homo sapiens
cagcccagagcagtggggcca

SEQ ID NO: 9417406 - DNA, 21 bp, Homo sapiens
cagcccagagcagtggggcca

SEQ ID NO: 9417407 - DNA, 22 bp, Homo sapiens
cagccaggttcaagtccttata

SEQ ID NO: 9417408 - DNA, 22 bp, Homo sapiens
cagccacttcccctctatgggt

SEQ ID NO: 9417409 - DNA, 22 bp, Homo sapiens
cagccacttcccctctatgggt

SEQ ID NO: 9417410 - DNA, 22 bp, Homo sapiens
cagccactgtggaatagccccc

SEQ ID NO: 9417411 - DNA, 22 bp, Homo sapiens
cagccactgtggaatagccccc

SEQ ID NO: 9417412 - DNA, 22 bp, Homo sapiens
cagccactgtggtctagctgca

SEQ ID NO: 9417413 - DNA, 22 bp, Homo sapiens
cagccactggtgccaggctgtt

SEQ ID NO: 9417414 - DNA, 22 bp, Homo sapiens
cagccactggtgccaggctgtt

SEQ ID NO: 9417415 - DNA, 22 bp, Homo sapiens
cagccactgacaggaatggtcc

SEQ ID NO: 9417416 - DNA, 22 bp, Homo sapiens
cagcatgcccagactgagctaa

SEQ ID NO: 9417417 - DNA, 22 bp, Homo sapiens
gtattttactgctcaaagctct

SEQ ID NO: 9417418 - DNA, 22 bp, Homo sapiens
gtattttactgctcaaagctct

SEQ ID NO: 9417419 - DNA, 22 bp, Homo sapiens
gtattttaagtgactactaggt

SEQ ID NO: 9417420 - DNA, 22 bp, Homo sapiens
gtatttgatcattagaatgatt

SEQ ID NO: 9417421 - DNA, 22 bp, Homo sapiens
gtatttgatacatgaaatggtg

SEQ ID NO: 9417422 - DNA, 22 bp, Homo sapiens
gtatttgatagatttcaaagga

SEQ ID NO: 9417423 - DNA, 22 bp, Homo sapiens
cagcattttccatagaaagaag

SEQ ID NO: 9417424 - DNA, 22 bp, Homo sapiens
cagcatttggtgatcatcttaa

SEQ ID NO: 9417425 - DNA, 22 bp, Homo sapiens
cagcatttggtgatcatcttaa

SEQ ID NO: 9417426 - DNA, 22 bp, Homo sapiens
cagcatttggtgatcatcttaa

SEQ ID NO: 9417427 - DNA, 22 bp, Homo sapiens
cagcatttggtgatcatcttaa

SEQ ID NO: 9417428 - DNA, 22 bp, Homo sapiens
cagcatttggaggagaggcttt

SEQ ID NO: 9417429 - DNA, 22 bp, Homo sapiens
cagcatttggaggagaggcttt

SEQ ID NO: 9417430 - DNA, 22 bp, Homo sapiens
cagcatttggaggagaggcttt

SEQ ID NO: 9417431 - DNA, 22 bp, Homo sapiens
cagcatttatcttgtagcagga

SEQ ID NO: 9417432 - DNA, 22 bp, Homo sapiens
cagcatttagaatttgaagtgt

SEQ ID NO: 9417433 - DNA, 22 bp, Homo sapiens
cagcatttcaggaggctgaggt

SEQ ID NO: 9417434 - DNA, 22 bp, Homo sapiens
cagcatttcaggaggctgaggt

SEQ ID NO: 9417435 - DNA, 22 bp, Homo sapiens
cagcatttcaggaggctgaggt

SEQ ID NO: 9417436 - DNA, 22 bp, Homo sapiens
cagcatttatcttgtagcagga

SEQ ID NO: 9417437 - DNA, 22 bp, Homo sapiens
cagcatttaatgcagtgcttcc

SEQ ID NO: 9417438 - DNA, 22 bp, Homo sapiens
cagcatttagaatttgaagtgt

SEQ ID NO: 9417439 - DNA, 22 bp, Homo sapiens
cagcatttaatgcagtgcttcc

SEQ ID NO: 9417440 - DNA, 22 bp, Homo sapiens
cagcatgcctgggctgcctgcc

SEQ ID NO: 9417441 - DNA, 22 bp, Homo sapiens
cagcatgcttgggggagggagc

SEQ ID NO: 9417442 - DNA, 22 bp, Homo sapiens
cagcattctactttgtgaactg

SEQ ID NO: 9417443 - DNA, 22 bp, Homo sapiens
cagcccagcagggtctggccct

SEQ ID NO: 9417444 - DNA, 22 bp, Homo sapiens
cagcccagcagggtctggccct

SEQ ID NO: 9417445 - DNA, 22 bp, Homo sapiens
cagcccagcagggtctggccct

SEQ ID NO: 9417446 - DNA, 22 bp, Homo sapiens
cagcccagcagactgttaccac

SEQ ID NO: 9417447 - DNA, 22 bp, Homo sapiens
cagcccagcagactgttaccac

SEQ ID NO: 9417448 - DNA, 22 bp, Homo sapiens
cagcccagcactaagtagattt

SEQ ID NO: 9417449 - DNA, 22 bp, Homo sapiens
cagcccagagccagttcccgct

SEQ ID NO: 9417450 - DNA, 22 bp, Homo sapiens
cagcccagagccagttcccgct

SEQ ID NO: 9417451 - DNA, 22 bp, Homo sapiens
cagcccagagccagttcccgct

SEQ ID NO: 9417452 - DNA, 22 bp, Homo sapiens
cagcccagagccagttcccgct

SEQ ID NO: 9417453 - DNA, 21 bp, Homo sapiens
cagcccagcccattgacagtg

SEQ ID NO: 9417454 - DNA, 21 bp, Homo sapiens
cagcccagcccattgacagtg

SEQ ID NO: 9417455 - DNA, 21 bp, Homo sapiens
cagcccagcccattgacagtg

SEQ ID NO: 9417456 - DNA, 22 bp, Homo sapiens
gggcgagggcgaaagcgagagc

SEQ ID NO: 9417457 - DNA, 22 bp, Homo sapiens
gggccttccgactcccaaggcc

SEQ ID NO: 9417458 - DNA, 22 bp, Homo sapiens
gggccttcagccttggactgag

SEQ ID NO: 9417459 - DNA, 22 bp, Homo sapiens
gggccttctagttagccccaat

SEQ ID NO: 9417460 - DNA, 21 bp, Homo sapiens
gggccttgagtgtgcggtggg

SEQ ID NO: 9417461 - DNA, 22 bp, Homo sapiens
gggcgaggactgactctgggca

SEQ ID NO: 9417462 - DNA, 22 bp, Homo sapiens
gggccttggcgaagtgtggtgg

SEQ ID NO: 9417463 - DNA, 22 bp, Homo sapiens
cagagccctgggcacatggtag

SEQ ID NO: 9417464 - DNA, 22 bp, Homo sapiens
cagagccctgggcacatggtag

SEQ ID NO: 9417465 - DNA, 22 bp, Homo sapiens
cagagccctgcatgctccatct

SEQ ID NO: 9417466 - DNA, 22 bp, Homo sapiens
cagagccctgtgtgccatgtga

SEQ ID NO: 9417467 - DNA, 22 bp, Homo sapiens
cagagccctgtgtgccatgtga

SEQ ID NO: 9417468 - DNA, 22 bp, Homo sapiens
cagagccctgcatgctccatct

SEQ ID NO: 9417469 - DNA, 22 bp, Homo sapiens
cagagccctcaaggccgatgca

SEQ ID NO: 9417470 - DNA, 22 bp, Homo sapiens
cagagccctcaaggccgatgca

SEQ ID NO: 9417471 - DNA, 22 bp, Homo sapiens
cagagccccccttctgatcaca

SEQ ID NO: 9417472 - DNA, 22 bp, Homo sapiens
cagagcccctcagctctctccc

SEQ ID NO: 9417473 - DNA, 22 bp, Homo sapiens
cagagccccccttctgatcaca

SEQ ID NO: 9417474 - DNA, 22 bp, Homo sapiens
cagagcccctcagctctctccc

SEQ ID NO: 9417475 - DNA, 22 bp, Homo sapiens
cagagcccctgggttgggagct

SEQ ID NO: 9417476 - DNA, 22 bp, Homo sapiens
gggcacagagggtcttgaagaa

SEQ ID NO: 9417477 - DNA, 22 bp, Homo sapiens
gggcacagagggtcttgaagaa

SEQ ID NO: 9417478 - DNA, 22 bp, Homo sapiens
gggcacagagggtcttgaagaa

SEQ ID NO: 9417479 - DNA, 22 bp, Homo sapiens
gggcacagagggtcttgaagaa

SEQ ID NO: 9417480 - DNA, 22 bp, Homo sapiens
gggcactgtgttcagagtgcag

SEQ ID NO: 9417481 - DNA, 22 bp, Homo sapiens
gggcactgtggggcccatgctg

SEQ ID NO: 9417482 - DNA, 22 bp, Homo sapiens
gggcactgtgttcagagtgcag

SEQ ID NO: 9417483 - DNA, 22 bp, Homo sapiens
gggcactgtgctgggtgcttta

SEQ ID NO: 9417484 - DNA, 22 bp, Homo sapiens
gggcagaatttgtagatgacat

SEQ ID NO: 9417485 - DNA, 19 bp, Homo sapiens
gggcagaatggcatctcag

SEQ ID NO: 9417486 - DNA, 22 bp, Homo sapiens
gggcagactggttatacacggg

SEQ ID NO: 9417487 - DNA, 22 bp, Homo sapiens
gggcagagaaatggacagttgg

SEQ ID NO: 9417488 - DNA, 22 bp, Homo sapiens
cagagcccagggcctacgtccc

SEQ ID NO: 9417489 - DNA, 22 bp, Homo sapiens
cagagcccatcctatactctcc

SEQ ID NO: 9417490 - DNA, 22 bp, Homo sapiens
cagagcccatggcacatgtgga

SEQ ID NO: 9417491 - DNA, 22 bp, Homo sapiens
cagagcccatggcacatgtgga

SEQ ID NO: 9417492 - DNA, 22 bp, Homo sapiens
cagagcccagggcctacgtccc

SEQ ID NO: 9417493 - DNA, 22 bp, Homo sapiens
cagagccagctgtccttggcat

SEQ ID NO: 9417494 - DNA, 22 bp, Homo sapiens
cagagccagcccactgttcccg

SEQ ID NO: 9417495 - DNA, 20 bp, Homo sapiens
ggggaagaaaaggatgtgat

SEQ ID NO: 9417496 - DNA, 20 bp, Homo sapiens
ggggaagaaaaggatgtgat

SEQ ID NO: 9417497 - DNA, 22 bp, Homo sapiens
ggggaacaccgggcagaggcgc

SEQ ID NO: 9417498 - DNA, 22 bp, Homo sapiens
ggggaacaccgggcagaggcgc

SEQ ID NO: 9417499 - DNA, 22 bp, Homo sapiens
ggggaaattgtggctgacagtg

SEQ ID NO: 9417500 - DNA, 22 bp, Homo sapiens
ggggaaagtgaattgtgtagtg

SEQ ID NO: 9417501 - DNA, 22 bp, Homo sapiens
ggggaaaggccatggcaagaac

SEQ ID NO: 9417502 - DNA, 22 bp, Homo sapiens
ggggaaagtgaattgtgtagtg

SEQ ID NO: 9417503 - DNA, 22 bp, Homo sapiens
ggggaaaggccatggcaagaac

SEQ ID NO: 9417504 - DNA, 22 bp, Homo sapiens
ggggaaaggccatggcaagaac

SEQ ID NO: 9417505 - DNA, 22 bp, Homo sapiens
ggggaaaggccatggcaagaac

SEQ ID NO: 9417506 - DNA, 22 bp, Homo sapiens
gggctgtgtactatgaggaggg

SEQ ID NO: 9417507 - DNA, 23 bp, Homo sapiens
ggggaaagaccatgcttgaggac

SEQ ID NO: 9417508 - DNA, 23 bp, Homo sapiens
ggggaaagaccatgcttgaggac

SEQ ID NO: 9417509 - DNA, 22 bp, Homo sapiens
ggggaaagccagccctgcttcc

SEQ ID NO: 9417510 - DNA, 22 bp, Homo sapiens
cagagctgcgctttttcctggt

SEQ ID NO: 9417511 - DNA, 22 bp, Homo sapiens
cagagctgcgctttttcctggt

SEQ ID NO: 9417512 - DNA, 22 bp, Homo sapiens
cagagctgcagattgaaggcat

SEQ ID NO: 9417513 - DNA, 22 bp, Homo sapiens
cagagctgcagattgaaggcat

SEQ ID NO: 9417514 - DNA, 19 bp, Homo sapiens
cagagctgctggcctcgtc

SEQ ID NO: 9417515 - DNA, 19 bp, Homo sapiens
cagagctgctggcctcgtc

SEQ ID NO: 9417516 - DNA, 19 bp, Homo sapiens
cagagctgctggcctcgtc

SEQ ID NO: 9417517 - DNA, 22 bp, Homo sapiens
cagagctgctcatggtggccag

SEQ ID NO: 9417518 - DNA, 22 bp, Homo sapiens
cagagctgagaatgttgatgct

SEQ ID NO: 9417519 - DNA, 22 bp, Homo sapiens
cagagctgagaatgttgatgct

SEQ ID NO: 9417520 - DNA, 22 bp, Homo sapiens
cagagctgagtcttcaaggttg

SEQ ID NO: 9417521 - DNA, 22 bp, Homo sapiens
cagagctgcacattctatgatg

SEQ ID NO: 9417522 - DNA, 22 bp, Homo sapiens
cagagctgcacattctatgatg

SEQ ID NO: 9417523 - DNA, 22 bp, Homo sapiens
cagagctgcaaatgcccctccg

SEQ ID NO: 9417524 - DNA, 22 bp, Homo sapiens
cagagctgcaaatgcccctccg

SEQ ID NO: 9417525 - DNA, 22 bp, Homo sapiens
cagagctgattggatccagaga

SEQ ID NO: 9417526 - DNA, 22 bp, Homo sapiens
cagagcctgctgccttctgaag

SEQ ID NO: 9417527 - DNA, 22 bp, Homo sapiens
cagagcctgctgccttctgaag

SEQ ID NO: 9417528 - DNA, 22 bp, Homo sapiens
gggcgccgtgggaaacagccgg

SEQ ID NO: 9417529 - DNA, 22 bp, Homo sapiens
cagagcctgctcacgtctctgt

SEQ ID NO: 9417530 - DNA, 22 bp, Homo sapiens
gggcgcagccaatcctggccct

SEQ ID NO: 9417531 - DNA, 22 bp, Homo sapiens
gggcgcatcacctgaggtcagg

SEQ ID NO: 9417532 - DNA, 22 bp, Homo sapiens
gggcgcatcacctgaggtcagg

SEQ ID NO: 9417533 - DNA, 22 bp, Homo sapiens
gggcgcatcacctgaggtcagg

SEQ ID NO: 9417534 - DNA, 22 bp, Homo sapiens
cagagctgagaatgttgatgct

SEQ ID NO: 9417535 - DNA, 21 bp, Homo sapiens
cagagctgaagggtgtagtgt

SEQ ID NO: 9417536 - DNA, 21 bp, Homo sapiens
cagagctgaagggtgtagtgt

SEQ ID NO: 9417537 - DNA, 21 bp, Homo sapiens
cagagctgaagggtgtagtgt

SEQ ID NO: 9417538 - DNA, 22 bp, Homo sapiens
gggtgccctgggtaggtcagtt

SEQ ID NO: 9417539 - DNA, 22 bp, Homo sapiens
gggtgcagtggttcacgcctgt

SEQ ID NO: 9417540 - DNA, 22 bp, Homo sapiens
gggtgcagtggttcacgcctgt

SEQ ID NO: 9417541 - DNA, 22 bp, Homo sapiens
gggtgcagtggttcacgcctgt

SEQ ID NO: 9417542 - DNA, 22 bp, Homo sapiens
gggtgctcctggcggcctcttt

SEQ ID NO: 9417543 - DNA, 22 bp, Homo sapiens
gggtgctgaggaagacagcagg

SEQ ID NO: 9417544 - DNA, 22 bp, Homo sapiens
gggtgctgaggaagacagcagg

SEQ ID NO: 9417545 - DNA, 22 bp, Homo sapiens
gggtgctgactggggcctgaaa

SEQ ID NO: 9417546 - DNA, 22 bp, Homo sapiens
gggtgctgactggggcctgaaa

SEQ ID NO: 9417547 - DNA, 22 bp, Homo sapiens
gggtgctgactggggcctgaaa

SEQ ID NO: 9417548 - DNA, 22 bp, Homo sapiens
cagaggctgctctgggtggcat

SEQ ID NO: 9417549 - DNA, 22 bp, Homo sapiens
cagaggctgctctgggtggcat

SEQ ID NO: 9417550 - DNA, 22 bp, Homo sapiens
gggtgctgaggaagacagcagg

SEQ ID NO: 9417551 - DNA, 22 bp, Homo sapiens
gggtgctgaggaagacagcagg

SEQ ID NO: 9417552 - DNA, 23 bp, Homo sapiens
gggtgctgcctgtagtcatgctg

SEQ ID NO: 9417553 - DNA, 23 bp, Homo sapiens
gggtgctgcctgtagtcatgctg

SEQ ID NO: 9417554 - DNA, 22 bp, Homo sapiens
gggtgcagggtctccagcagct

SEQ ID NO: 9417555 - DNA, 22 bp, Homo sapiens
gggtgcagggtctccagcagct

SEQ ID NO: 9417556 - DNA, 22 bp, Homo sapiens
gggtgcagggtctccagcagct

SEQ ID NO: 9417557 - DNA, 22 bp, Homo sapiens
gggtgcaggcagcccaggcagg

SEQ ID NO: 9417558 - DNA, 22 bp, Homo sapiens
gggtgcaggggaccctagggac

SEQ ID NO: 9417559 - DNA, 22 bp, Homo sapiens
gggtgcaggggaccctagggac

SEQ ID NO: 9417560 - DNA, 22 bp, Homo sapiens
cagaggcctggcttggacacct

SEQ ID NO: 9417561 - DNA, 22 bp, Homo sapiens
cagaggcctggcttggacacct

SEQ ID NO: 9417562 - DNA, 22 bp, Homo sapiens
cagaggcctggcttggacacct

SEQ ID NO: 9417563 - DNA, 22 bp, Homo sapiens
cagaggctgggacctcaggcat

SEQ ID NO: 9417564 - DNA, 22 bp, Homo sapiens
cagaggctgggacctcaggcat

SEQ ID NO: 9417565 - DNA, 22 bp, Homo sapiens
cagaggcttcaagtcattctcc

SEQ ID NO: 9417566 - DNA, 22 bp, Homo sapiens
cagaggtagccgagtgcaatcg

SEQ ID NO: 9417567 - DNA, 22 bp, Homo sapiens
cagaggcttcaagtcattctcc

SEQ ID NO: 9417568 - DNA, 22 bp, Homo sapiens
cagaggctgtgtaggcagactg

SEQ ID NO: 9417569 - DNA, 22 bp, Homo sapiens
cagaggctgtgtaggcagactg

SEQ ID NO: 9417570 - DNA, 22 bp, Homo sapiens
cagagtaaggagctgtcaaacg

SEQ ID NO: 9417571 - DNA, 22 bp, Homo sapiens
cagagtaaacctgtcatcaaga

SEQ ID NO: 9417572 - DNA, 22 bp, Homo sapiens
cagaggttacctagagcaagaa

SEQ ID NO: 9417573 - DNA, 22 bp, Homo sapiens
cagaggtgttggtgaatggaga

SEQ ID NO: 9417574 - DNA, 22 bp, Homo sapiens
cagaggtgttggtgaatggaga

SEQ ID NO: 9417575 - DNA, 23 bp, Homo sapiens
cagaggtgtcagtgcccagtgtc

SEQ ID NO: 9417576 - DNA, 23 bp, Homo sapiens
cagaggtgtcagtgcccagtgtc

SEQ ID NO: 9417577 - DNA, 23 bp, Homo sapiens
cagaggtgtcagtgcccagtgtc

SEQ ID NO: 9417578 - DNA, 23 bp, Homo sapiens
cagaggtgtcagtgcccagtgtc

SEQ ID NO: 9417579 - DNA, 22 bp, Homo sapiens
cagaggtgtacagagggaggcc

SEQ ID NO: 9417580 - DNA, 22 bp, Homo sapiens
cagaggtgtacagagggaggcc

SEQ ID NO: 9417581 - DNA, 22 bp, Homo sapiens
cagaggtagggagctatgttat

SEQ ID NO: 9417582 - DNA, 22 bp, Homo sapiens
cagaggtgtacagagggaggcc

SEQ ID NO: 9417583 - DNA, 21 bp, Homo sapiens
cagaggtggcctgacctctga

SEQ ID NO: 9417584 - DNA, 22 bp, Homo sapiens
cagaggtggggagtatttcaag

SEQ ID NO: 9417585 - DNA, 22 bp, Homo sapiens
cagaggcaggataagaactgcg

SEQ ID NO: 9417586 - DNA, 22 bp, Homo sapiens
cagaggcaggataagaactgcg

SEQ ID NO: 9417587 - DNA, 22 bp, Homo sapiens
cagagctgtcatttgccagtga

SEQ ID NO: 9417588 - DNA, 22 bp, Homo sapiens
cagaggcaggataagaactgcg

SEQ ID NO: 9417589 - DNA, 20 bp, Homo sapiens
cagaggcattttcagactct

SEQ ID NO: 9417590 - DNA, 22 bp, Homo sapiens
cagagctggtgttacaagtcca

SEQ ID NO: 9417591 - DNA, 22 bp, Homo sapiens
cagagctggtgtgtcctggcat

SEQ ID NO: 9417592 - DNA, 22 bp, Homo sapiens
cagagctggtgttacaagtcca

SEQ ID NO: 9417593 - DNA, 22 bp, Homo sapiens
cagagctggtgttacaagtcca

SEQ ID NO: 9417594 - DNA, 22 bp, Homo sapiens
cagagctggtgtgtcctggcat

SEQ ID NO: 9417595 - DNA, 22 bp, Homo sapiens
cagagctggtgtgtcctggcat

SEQ ID NO: 9417596 - DNA, 22 bp, Homo sapiens
cagagctggtaagtggtagagg

SEQ ID NO: 9417597 - DNA, 22 bp, Homo sapiens
cagagctggtaagtggtagagg

SEQ ID NO: 9417598 - DNA, 22 bp, Homo sapiens
cagagctggtaagtggtagagg

SEQ ID NO: 9417599 - DNA, 22 bp, Homo sapiens
ggggaagaaatctgggttcttc

SEQ ID NO: 9417600 - DNA, 22 bp, Homo sapiens
ggggaagaaccgggattcccat

SEQ ID NO: 9417601 - DNA, 22 bp, Homo sapiens
ggggaagaatgctctctagaga

SEQ ID NO: 9417602 - DNA, 22 bp, Homo sapiens
cagagctgggtttgggaaacct

SEQ ID NO: 9417603 - DNA, 20 bp, Homo sapiens
ggggaagaaaaggatgtgat

SEQ ID NO: 9417604 - DNA, 20 bp, Homo sapiens
ggggaagaaaaggatgtgat

SEQ ID NO: 9417605 - DNA, 21 bp, Homo sapiens
cagaggcctatcacagactcc

SEQ ID NO: 9417606 - DNA, 21 bp, Homo sapiens
cagaggcctatcacagactcc

SEQ ID NO: 9417607 - DNA, 22 bp, Homo sapiens
cagaggccccagaactagctct

SEQ ID NO: 9417608 - DNA, 22 bp, Homo sapiens
cagaggcccagtgagagggctg

SEQ ID NO: 9417609 - DNA, 22 bp, Homo sapiens
cagaggcccagtgagagggctg

SEQ ID NO: 9417610 - DNA, 22 bp, Homo sapiens
cagaggcccagtgagagggctg

SEQ ID NO: 9417611 - DNA, 22 bp, Homo sapiens
cagaggcccagtgagagggctg

SEQ ID NO: 9417612 - DNA, 22 bp, Homo sapiens
cagaggcctatccagtgtccat

SEQ ID NO: 9417613 - DNA, 22 bp, Homo sapiens
cagaggcctcacttccagccag

SEQ ID NO: 9417614 - DNA, 21 bp, Homo sapiens
cagaggcctcatgctctgtgc

SEQ ID NO: 9417615 - DNA, 22 bp, Homo sapiens
cagaggccaggctgcctgactg

SEQ ID NO: 9417616 - DNA, 19 bp, Homo sapiens
cagaggccagaagcacagg

SEQ ID NO: 9417617 - DNA, 19 bp, Homo sapiens
cagaggccagaagcacagg

SEQ ID NO: 9417618 - DNA, 19 bp, Homo sapiens
cagaggccagaagcacagg

SEQ ID NO: 9417619 - DNA, 19 bp, Homo sapiens
cagaggccagaagcacagg

SEQ ID NO: 9417620 - DNA, 19 bp, Homo sapiens
cagaggccagaagcacagg

SEQ ID NO: 9417621 - DNA, 22 bp, Homo sapiens
cagaggccagtggacaagggcc

SEQ ID NO: 9417622 - DNA, 22 bp, Homo sapiens
cagaggccagggggctcacaaa

SEQ ID NO: 9417623 - DNA, 22 bp, Homo sapiens
cagaggccagtggacaagggcc

SEQ ID NO: 9417624 - DNA, 22 bp, Homo sapiens
cagaggccatatttcttcactc

SEQ ID NO: 9417625 - DNA, 22 bp, Homo sapiens
gggagcaggacataatagcaat

SEQ ID NO: 9417626 - DNA, 22 bp, Homo sapiens
gggagcaggacataatagcaat

SEQ ID NO: 9417627 - DNA, 19 bp, Homo sapiens
gggagcaggaaagctgtgg

SEQ ID NO: 9417628 - DNA, 22 bp, Homo sapiens
gggagcaggacataatagcaat

SEQ ID NO: 9417629 - DNA, 22 bp, Homo sapiens
gggagcaggacataatagcaat

SEQ ID NO: 9417630 - DNA, 22 bp, Homo sapiens
gggagcaggagcctgcctgcca

SEQ ID NO: 9417631 - DNA, 22 bp, Homo sapiens
gggagcaggagcctgcctgcca

SEQ ID NO: 9417632 - DNA, 22 bp, Homo sapiens
gggagcaggagcctgcctgcca

SEQ ID NO: 9417633 - DNA, 22 bp, Homo sapiens
gggagcaggagcctgcctgcca

SEQ ID NO: 9417634 - DNA, 22 bp, Homo sapiens
gggagcagcctgcctcccacct

SEQ ID NO: 9417635 - DNA, 22 bp, Homo sapiens
gggagcagcctgcctcccacct

SEQ ID NO: 9417636 - DNA, 19 bp, Homo sapiens
gggagcaggaaagctgtgg

SEQ ID NO: 9417637 - DNA, 22 bp, Homo sapiens
cagacaggcaggtgagagctcc

SEQ ID NO: 9417638 - DNA, 22 bp, Homo sapiens
cagacaggcaggtgagagctcc

SEQ ID NO: 9417639 - DNA, 22 bp, Homo sapiens
cagacaggcaggtgctgctttg

SEQ ID NO: 9417640 - DNA, 22 bp, Homo sapiens
gggagcaagccggaggtactgt

SEQ ID NO: 9417641 - DNA, 23 bp, Homo sapiens
gggagatgggaaatgaaggctct

SEQ ID NO: 9417642 - DNA, 22 bp, Homo sapiens
cagacaggctagccagactcac

SEQ ID NO: 9417643 - DNA, 22 bp, Homo sapiens
cagacaggcaggtgagagctcc

SEQ ID NO: 9417644 - DNA, 22 bp, Homo sapiens
cagacaggagactggatcatgg

SEQ ID NO: 9417645 - DNA, 22 bp, Homo sapiens
cagacaggcaggtgagagctcc

SEQ ID NO: 9417646 - DNA, 22 bp, Homo sapiens
cagacaggaattctggcgtggt

SEQ ID NO: 9417647 - DNA, 22 bp, Homo sapiens
cagacaggaagttcagaagaaa

SEQ ID NO: 9417648 - DNA, 22 bp, Homo sapiens
cagacaggagactggatcatgg

SEQ ID NO: 9417649 - DNA, 22 bp, Homo sapiens
cagacaggaattctggcgtggt

SEQ ID NO: 9417650 - DNA, 22 bp, Homo sapiens
cagaagttagtgtctgccagta

SEQ ID NO: 9417651 - DNA, 22 bp, Homo sapiens
cagaagttgatcctgcgtttcc

SEQ ID NO: 9417652 - DNA, 22 bp, Homo sapiens
gggactgtcctctgtgtctgtg

SEQ ID NO: 9417653 - DNA, 22 bp, Homo sapiens
cagaagtgaatgtgataaacca

SEQ ID NO: 9417654 - DNA, 22 bp, Homo sapiens
gggactgggagatcctcctggc

SEQ ID NO: 9417655 - DNA, 22 bp, Homo sapiens
gggactgtcctctgtgtctgtg

SEQ ID NO: 9417656 - DNA, 22 bp, Homo sapiens
cagaagtggcctcagagggagt

SEQ ID NO: 9417657 - DNA, 22 bp, Homo sapiens
cagaagtggcctcagagggagt

SEQ ID NO: 9417658 - DNA, 22 bp, Homo sapiens
cagaagtggtattaattagatt

SEQ ID NO: 9417659 - DNA, 22 bp, Homo sapiens
cagaagtgatgttgagctagtc

SEQ ID NO: 9417660 - DNA, 22 bp, Homo sapiens
cagaagtgcaatttaaattagg

SEQ ID NO: 9417661 - DNA, 22 bp, Homo sapiens
cagaagtggcatcattcaagag

SEQ ID NO: 9417662 - DNA, 22 bp, Homo sapiens
cagaagtggcatcattcaagag

SEQ ID NO: 9417663 - DNA, 22 bp, Homo sapiens
gggcacaccttgtctgagcaca

SEQ ID NO: 9417664 - DNA, 22 bp, Homo sapiens
gggcacaaaatttcagaaagct

SEQ ID NO: 9417665 - DNA, 22 bp, Homo sapiens
gggcaatgtggcaaaaccctgt

SEQ ID NO: 9417666 - DNA, 22 bp, Homo sapiens
gggcaatgtgtgttcactatat

SEQ ID NO: 9417667 - DNA, 22 bp, Homo sapiens
gggcaatgggcttttctgtaag

SEQ ID NO: 9417668 - DNA, 22 bp, Homo sapiens
gggcaatggatgtgatgactcc

SEQ ID NO: 9417669 - DNA, 22 bp, Homo sapiens
gggcaatgtctgtggccactaa

SEQ ID NO: 9417670 - DNA, 22 bp, Homo sapiens
gggcaatggtcacatagagtga

SEQ ID NO: 9417671 - DNA, 22 bp, Homo sapiens
gggcaatgctatgaagagctaa

SEQ ID NO: 9417672 - DNA, 22 bp, Homo sapiens
gggcaagtgtcaagcatgtcat

SEQ ID NO: 9417673 - DNA, 22 bp, Homo sapiens
gggcaagtgttttgtctgcctg

SEQ ID NO: 9417674 - DNA, 22 bp, Homo sapiens
gggcaagtaactctcgtgcggg

SEQ ID NO: 9417675 - DNA, 22 bp, Homo sapiens
gggcaagcagtgaggacagcac

SEQ ID NO: 9417676 - DNA, 22 bp, Homo sapiens
gggcaaggcagaagagttggag

SEQ ID NO: 9417677 - DNA, 22 bp, Homo sapiens
gggcaaggcagaagagttggag

SEQ ID NO: 9417678 - DNA, 22 bp, Homo sapiens
cagacagggacctcgctccaga

SEQ ID NO: 9417679 - DNA, 22 bp, Homo sapiens
cagacagggacctcgctccaga

SEQ ID NO: 9417680 - DNA, 22 bp, Homo sapiens
cagacagggccctgtgatggta

SEQ ID NO: 9417681 - DNA, 22 bp, Homo sapiens
cagacagggacctcgctccaga

SEQ ID NO: 9417682 - DNA, 22 bp, Homo sapiens
cagacaggctagccagactcac

SEQ ID NO: 9417683 - DNA, 22 bp, Homo sapiens
cagacaggctagccagactcac

SEQ ID NO: 9417684 - DNA, 17 bp, Homo sapiens
cagacaggctgtcaccc

SEQ ID NO: 9417685 - DNA, 17 bp, Homo sapiens
cagacaggctgtcaccc

SEQ ID NO: 9417686 - DNA, 17 bp, Homo sapiens
cagacaggctgtcaccc

SEQ ID NO: 9417687 - DNA, 22 bp, Homo sapiens
gggaggggttgcatgtttgagt

SEQ ID NO: 9417688 - DNA, 22 bp, Homo sapiens
gggaggggttgcatgtttgagt

SEQ ID NO: 9417689 - DNA, 22 bp, Homo sapiens
gggaggggttgcatgtttgagt

SEQ ID NO: 9417690 - DNA, 22 bp, Homo sapiens
gggaggggttgcatgtttgagt

SEQ ID NO: 9417691 - DNA, 22 bp, Homo sapiens
gggagcagttaaaatgattcct

SEQ ID NO: 9417692 - DNA, 22 bp, Homo sapiens
gggagcagttaaaatgattcct

SEQ ID NO: 9417693 - DNA, 20 bp, Homo sapiens
gggaggccagcctcagagaa

SEQ ID NO: 9417694 - DNA, 22 bp, Homo sapiens
gggagcagttaaaatgattcct

SEQ ID NO: 9417695 - DNA, 22 bp, Homo sapiens
gggagggccaggctcacccagg

SEQ ID NO: 9417696 - DNA, 20 bp, Homo sapiens
gggaggccagcctcagagaa

SEQ ID NO: 9417697 - DNA, 20 bp, Homo sapiens
gggaggccagcctcagagaa

SEQ ID NO: 9417698 - DNA, 22 bp, Homo sapiens
gggagggtgttctcccaagaac

SEQ ID NO: 9417699 - DNA, 22 bp, Homo sapiens
gggagggtctgccatgctccct

SEQ ID NO: 9417700 - DNA, 22 bp, Homo sapiens
gggagggtctgagagctgcacc

SEQ ID NO: 9417701 - DNA, 22 bp, Homo sapiens
gggaggtgaaaggtcatgtgtg

SEQ ID NO: 9417702 - DNA, 22 bp, Homo sapiens
gggaggtcagggtgcctgctgg

SEQ ID NO: 9417703 - DNA, 22 bp, Homo sapiens
cagacaggctagccagactcac

SEQ ID NO: 9417704 - DNA, 22 bp, Homo sapiens
cagacaggctagccagactcac

SEQ ID NO: 9417705 - DNA, 22 bp, Homo sapiens
gggaggtgaaaggtcatgtgtg

SEQ ID NO: 9417706 - DNA, 22 bp, Homo sapiens
gggaggtgaaaggtcatgtgtg

SEQ ID NO: 9417707 - DNA, 22 bp, Homo sapiens
gggaggtgaaaggtcatgtgtg

SEQ ID NO: 9417708 - DNA, 22 bp, Homo sapiens
gggaagctgcgtggtctagggc

SEQ ID NO: 9417709 - DNA, 22 bp, Homo sapiens
gggaaggaaagttattagcaga

SEQ ID NO: 9417710 - DNA, 22 bp, Homo sapiens
gggaagctgaagctagagaaaa

SEQ ID NO: 9417711 - DNA, 22 bp, Homo sapiens
gggaagctgaagctagagaaaa

SEQ ID NO: 9417712 - DNA, 23 bp, Homo sapiens
gggaagctccatggaggtgctgg

SEQ ID NO: 9417713 - DNA, 23 bp, Homo sapiens
gggaagctccatggaggtgctgg

SEQ ID NO: 9417714 - DNA, 23 bp, Homo sapiens
gggaagctccatggaggtgctgg

SEQ ID NO: 9417715 - DNA, 22 bp, Homo sapiens
gggaaagagtgcttgtccagag

SEQ ID NO: 9417716 - DNA, 18 bp, Homo sapiens
gggaagccgggaagccgg

SEQ ID NO: 9417717 - DNA, 22 bp, Homo sapiens
gggaaggacacagccatgactg

SEQ ID NO: 9417718 - DNA, 22 bp, Homo sapiens
gggaaggacacagccatgactg

SEQ ID NO: 9417719 - DNA, 22 bp, Homo sapiens
gggaaggacacagccatgactg

SEQ ID NO: 9417720 - DNA, 22 bp, Homo sapiens
gggaaggacacagccatgactg

SEQ ID NO: 9417721 - DNA, 22 bp, Homo sapiens
gggaaggacacagccatgactg

SEQ ID NO: 9417722 - DNA, 22 bp, Homo sapiens
gggaaggaaatcttgcttgtga

SEQ ID NO: 9417723 - DNA, 22 bp, Homo sapiens
gggaaggaaagttattagcaga

SEQ ID NO: 9417724 - DNA, 22 bp, Homo sapiens
gggaaggaaatcttgcttgtga

SEQ ID NO: 9417725 - DNA, 22 bp, Homo sapiens
gggaaggaaatcttgcttgtga

SEQ ID NO: 9417726 - DNA, 22 bp, Homo sapiens
gggaaggaaagttattagcaga

SEQ ID NO: 9417727 - DNA, 22 bp, Homo sapiens
gggaaggaaagttattagcaga

SEQ ID NO: 9417728 - DNA, 22 bp, Homo sapiens
gggaaggaggtggacctgcccc

SEQ ID NO: 9417729 - DNA, 22 bp, Homo sapiens
gggaaggaggtggcttgaagtg

SEQ ID NO: 9417730 - DNA, 22 bp, Homo sapiens
gggaaggaggtggcttgaagtg

SEQ ID NO: 9417731 - DNA, 22 bp, Homo sapiens
gggaaggaggtggacctgcccc

SEQ ID NO: 9417732 - DNA, 22 bp, Homo sapiens
gggaaggaggtggacctgcccc

SEQ ID NO: 9417733 - DNA, 22 bp, Homo sapiens
gggaaggagcctgcttgctaga

SEQ ID NO: 9417734 - DNA, 22 bp, Homo sapiens
gggaaggagcctgcttgctaga

SEQ ID NO: 9417735 - DNA, 22 bp, Homo sapiens
gggaaggagcctgcttgctaga

SEQ ID NO: 9417736 - DNA, 22 bp, Homo sapiens
gggaaggacattctgggctcag

SEQ ID NO: 9417737 - DNA, 22 bp, Homo sapiens
gggacaatggaggcctctctcc

SEQ ID NO: 9417738 - DNA, 22 bp, Homo sapiens
gggacaatggaggcctctctcc

SEQ ID NO: 9417739 - DNA, 22 bp, Homo sapiens
gggacacagagaaactggagaa

SEQ ID NO: 9417740 - DNA, 22 bp, Homo sapiens
gggaatgtgcctggagtgttca

SEQ ID NO: 9417741 - DNA, 22 bp, Homo sapiens
gggaaggaggtggacctgcccc

SEQ ID NO: 9417742 - DNA, 22 bp, Homo sapiens
gggaaggaggtggcttgaagtg

SEQ ID NO: 9417743 - DNA, 22 bp, Homo sapiens
gggacacagccatctgtgtttt

SEQ ID NO: 9417744 - DNA, 22 bp, Homo sapiens
gggacacagagaaactggagaa

SEQ ID NO: 9417745 - DNA, 22 bp, Homo sapiens
gggacacaggtatctcaaatga

SEQ ID NO: 9417746 - DNA, 22 bp, Homo sapiens
gggacacaggtatctcaaatga

SEQ ID NO: 9417747 - DNA, 22 bp, Homo sapiens
gggacactggacccagtgtcca

SEQ ID NO: 9417748 - DNA, 22 bp, Homo sapiens
gggacagaggcaaactagcaga

SEQ ID NO: 9417749 - DNA, 22 bp, Homo sapiens
gggacagaggcaaactagcaga

SEQ ID NO: 9417750 - DNA, 22 bp, Homo sapiens
gggacagaggcaaactagcaga

SEQ ID NO: 9417751 - DNA, 22 bp, Homo sapiens
gggacagaggcaaactagcaga

SEQ ID NO: 9417752 - DNA, 22 bp, Homo sapiens
gggacagacccatgggccaggt

SEQ ID NO: 9417753 - DNA, 22 bp, Homo sapiens
gggacagacccatgggccaggt

SEQ ID NO: 9417754 - DNA, 22 bp, Homo sapiens
gggacagacccatgggccaggt

SEQ ID NO: 9417755 - DNA, 22 bp, Homo sapiens
gggacagacccatgggccaggt

SEQ ID NO: 9417756 - DNA, 22 bp, Homo sapiens
gggacagacccatgggccaggt

SEQ ID NO: 9417757 - DNA, 19 bp, Homo sapiens
gggactggaggatgtggag

SEQ ID NO: 9417758 - DNA, 19 bp, Homo sapiens
gggactggaggatgtggag

SEQ ID NO: 9417759 - DNA, 22 bp, Homo sapiens
gggactggagtagaggccggtg

SEQ ID NO: 9417760 - DNA, 22 bp, Homo sapiens
gggactggaactactggtgcag

SEQ ID NO: 9417761 - DNA, 22 bp, Homo sapiens
gggactggccagggtttggaat

SEQ ID NO: 9417762 - DNA, 22 bp, Homo sapiens
gggactggcacagggctgggag

SEQ ID NO: 9417763 - DNA, 22 bp, Homo sapiens
gggactggcacagggctgggag

SEQ ID NO: 9417764 - DNA, 22 bp, Homo sapiens
gggactggatagatgtgggtga

SEQ ID NO: 9417765 - DNA, 22 bp, Homo sapiens
gggactggatagatgtgggtga

SEQ ID NO: 9417766 - DNA, 22 bp, Homo sapiens
gggactggagtagaggccggtg

SEQ ID NO: 9417767 - DNA, 21 bp, Homo sapiens
cagaagtaagggtaacttctc

SEQ ID NO: 9417768 - DNA, 22 bp, Homo sapiens
cagaagtaagattactgtgagt

SEQ ID NO: 9417769 - DNA, 22 bp, Homo sapiens
cagaagtaagattactgtgaga

SEQ ID NO: 9417770 - DNA, 22 bp, Homo sapiens
gggaaactagaagcagggttat

SEQ ID NO: 9417771 - DNA, 22 bp, Homo sapiens
gggaaactcacaggtgcagggg

SEQ ID NO: 9417772 - DNA, 22 bp, Homo sapiens
gggaaactcaggcatttccact

SEQ ID NO: 9417773 - DNA, 22 bp, Homo sapiens
gggaaaaataatgcacagatat

SEQ ID NO: 9417774 - DNA, 22 bp, Homo sapiens
gggaaagaccctgagtcttatt

SEQ ID NO: 9417775 - DNA, 22 bp, Homo sapiens
gggaaagagaggtggacgcagg

SEQ ID NO: 9417776 - DNA, 22 bp, Homo sapiens
gggaaagagaggtggacgcagg

SEQ ID NO: 9417777 - DNA, 22 bp, Homo sapiens
gggaaagagaggtggacgcagg

SEQ ID NO: 9417778 - DNA, 22 bp, Homo sapiens
gggaaagagtgcttgtccagag

SEQ ID NO: 9417779 - DNA, 22 bp, Homo sapiens
gggaaagagaggtggacgcagg

SEQ ID NO: 9417780 - DNA, 21 bp, Homo sapiens
gggaaactctgcttaacagag

SEQ ID NO: 9417781 - DNA, 22 bp, Homo sapiens
gggaaactgcaactcagagagg

SEQ ID NO: 9417782 - DNA, 22 bp, Homo sapiens
gggaaactgaattcaggactct

SEQ ID NO: 9417783 - DNA, 22 bp, Homo sapiens
gggaaactggggactgaatctg

SEQ ID NO: 9417784 - DNA, 22 bp, Homo sapiens
gggaaactgtccagttctcccc

SEQ ID NO: 9417785 - DNA, 22 bp, Homo sapiens
gggaaacttctgctaaaaccag

SEQ ID NO: 9417786 - DNA, 22 bp, Homo sapiens
gggaaactttcacaatgtccag

SEQ ID NO: 9417787 - DNA, 22 bp, Homo sapiens
gggaaagaagaagagccatttt

SEQ ID NO: 9417788 - DNA, 22 bp, Homo sapiens
cagaaggcaaacaaaaggattt

SEQ ID NO: 9417789 - DNA, 22 bp, Homo sapiens
cagaaggcaaacaaaaggattt

SEQ ID NO: 9417790 - DNA, 22 bp, Homo sapiens
cactgggagagctggacttggg

SEQ ID NO: 9417791 - DNA, 22 bp, Homo sapiens
cactgggagagctggacttggg

SEQ ID NO: 9417792 - DNA, 22 bp, Homo sapiens
cagaagcagtgagagatgtgca

SEQ ID NO: 9417793 - DNA, 22 bp, Homo sapiens
cagaaggcatagatgaaggcct

SEQ ID NO: 9417794 - DNA, 22 bp, Homo sapiens
cagaaggcatagatgaaggcct

SEQ ID NO: 9417795 - DNA, 22 bp, Homo sapiens
cagaaggcagcaaatgaaaacc

SEQ ID NO: 9417796 - DNA, 22 bp, Homo sapiens
cagaaggcaaggcctgccacgc

SEQ ID NO: 9417797 - DNA, 22 bp, Homo sapiens
cagaaggcaaggcctgccacgc

SEQ ID NO: 9417798 - DNA, 22 bp, Homo sapiens
cagaagggcagcactgggaagg

SEQ ID NO: 9417799 - DNA, 22 bp, Homo sapiens
cagaaggctttgtggagtagac

SEQ ID NO: 9417800 - DNA, 22 bp, Homo sapiens
cagaaggcatagatgaaggcct

SEQ ID NO: 9417801 - DNA, 22 bp, Homo sapiens
cactggcttgatgggtaatgcc

SEQ ID NO: 9417802 - DNA, 22 bp, Homo sapiens
cactggctgggccagcactcct

SEQ ID NO: 9417803 - DNA, 22 bp, Homo sapiens
cactgggaatctgggaaagaga

SEQ ID NO: 9417804 - DNA, 22 bp, Homo sapiens
cactgggacctaggactgagct

SEQ ID NO: 9417805 - DNA, 22 bp, Homo sapiens
cactgggacctaggactgagct

SEQ ID NO: 9417806 - DNA, 22 bp, Homo sapiens
cactggctgagcttctctaggg

SEQ ID NO: 9417807 - DNA, 22 bp, Homo sapiens
cactggctgagcttctctaggg

SEQ ID NO: 9417808 - DNA, 22 bp, Homo sapiens
cactggctaaagataagctcaa

SEQ ID NO: 9417809 - DNA, 22 bp, Homo sapiens
cactggctatgagggagatggg

SEQ ID NO: 9417810 - DNA, 22 bp, Homo sapiens
cactggcctaagcgcctcagcc

SEQ ID NO: 9417811 - DNA, 22 bp, Homo sapiens
cactggcctaagcgcctcagcc

SEQ ID NO: 9417812 - DNA, 22 bp, Homo sapiens
cactggcctaagcgcctcagcc

SEQ ID NO: 9417813 - DNA, 22 bp, Homo sapiens
cactggctaaaaaagaggcaga

SEQ ID NO: 9417814 - DNA, 22 bp, Homo sapiens
cactggcccataaaggcctggg

SEQ ID NO: 9417815 - DNA, 22 bp, Homo sapiens
cactggcccataaaggcctggg

SEQ ID NO: 9417816 - DNA, 22 bp, Homo sapiens
cactggcccattcctgtctggc

SEQ ID NO: 9417817 - DNA, 22 bp, Homo sapiens
cactggcccagccaggcctgtt

SEQ ID NO: 9417818 - DNA, 22 bp, Homo sapiens
cactggcccagccaggcctgtt

SEQ ID NO: 9417819 - DNA, 22 bp, Homo sapiens
cacagtggcaaaggggcttggg

SEQ ID NO: 9417820 - DNA, 22 bp, Homo sapiens
cacagtggattgggtgatgccc

SEQ ID NO: 9417821 - DNA, 22 bp, Homo sapiens
cacagtgctttatgagagatct

SEQ ID NO: 9417822 - DNA, 22 bp, Homo sapiens
cacagtgctttatgagagatct

SEQ ID NO: 9417823 - DNA, 22 bp, Homo sapiens
cacagtggaagtccaggatccc

SEQ ID NO: 9417824 - DNA, 22 bp, Homo sapiens
ggcagagcttgcagtgagccga

SEQ ID NO: 9417825 - DNA, 22 bp, Homo sapiens
cacagtgctgtttgtaaagaga

SEQ ID NO: 9417826 - DNA, 22 bp, Homo sapiens
ggcagagctctggactgagaac

SEQ ID NO: 9417827 - DNA, 17 bp, Homo sapiens
ggcagagctgacagggc

SEQ ID NO: 9417828 - DNA, 17 bp, Homo sapiens
ggcagagctgacagggc

SEQ ID NO: 9417829 - DNA, 22 bp, Homo sapiens
ggcagagctagtggcttctctt

SEQ ID NO: 9417830 - DNA, 22 bp, Homo sapiens
ggcagagctagtggcttctctt

SEQ ID NO: 9417831 - DNA, 20 bp, Homo sapiens
ggcagagctatgtctgttgc

SEQ ID NO: 9417832 - DNA, 19 bp, Homo sapiens
ggcagagctcctgctttct

SEQ ID NO: 9417833 - DNA, 19 bp, Homo sapiens
ggcagagctcctgctttct

SEQ ID NO: 9417834 - DNA, 22 bp, Homo sapiens
ggcagagctctggactgagaac

SEQ ID NO: 9417835 - DNA, 22 bp, Homo sapiens
ggcagagctctggactgagaac

SEQ ID NO: 9417836 - DNA, 22 bp, Homo sapiens
ggcagatggaaggacagacgga

SEQ ID NO: 9417837 - DNA, 22 bp, Homo sapiens
ggcagcagtggctgctattgtc

SEQ ID NO: 9417838 - DNA, 22 bp, Homo sapiens
ggcagcagttacaaatgtgcag

SEQ ID NO: 9417839 - DNA, 22 bp, Homo sapiens
ggcagcagtggctgctattgtc

SEQ ID NO: 9417840 - DNA, 22 bp, Homo sapiens
cacagtgtagttaatgtgacat

SEQ ID NO: 9417841 - DNA, 20 bp, Homo sapiens
ggcagccaatcagcgtgccg

SEQ ID NO: 9417842 - DNA, 22 bp, Homo sapiens
ggcagccaccctgggaggcaga

SEQ ID NO: 9417843 - DNA, 22 bp, Homo sapiens
ggcagcatttagagcacagtgt

SEQ ID NO: 9417844 - DNA, 22 bp, Homo sapiens
ggcagcattgcctttgcagtga

SEQ ID NO: 9417845 - DNA, 22 bp, Homo sapiens
ggcagcattgccaatccagaca

SEQ ID NO: 9417846 - DNA, 22 bp, Homo sapiens
ggcagcatgggtgcctttgtga

SEQ ID NO: 9417847 - DNA, 22 bp, Homo sapiens
ggcagcatgagcctggtgaatt

SEQ ID NO: 9417848 - DNA, 22 bp, Homo sapiens
ggcagcatgtgtggtccgctgg

SEQ ID NO: 9417849 - DNA, 22 bp, Homo sapiens
ggcagcatgtgtggtccgctgg

SEQ ID NO: 9417850 - DNA, 22 bp, Homo sapiens
ggcagcatatattcagtgggca

SEQ ID NO: 9417851 - DNA, 22 bp, Homo sapiens
ggcagcagttacaaatgtgcag

SEQ ID NO: 9417852 - DNA, 22 bp, Homo sapiens
ggcagcagttacaaatgtgcag

SEQ ID NO: 9417853 - DNA, 22 bp, Homo sapiens
ggcagcagttacaaatgtgcag

SEQ ID NO: 9417854 - DNA, 22 bp, Homo sapiens
ggcagcatcacttgtctccagc

SEQ ID NO: 9417855 - DNA, 22 bp, Homo sapiens
ggcagcatctctggcagcagct

SEQ ID NO: 9417856 - DNA, 22 bp, Homo sapiens
ggcagcatcttgatattggttt

SEQ ID NO: 9417857 - DNA, 22 bp, Homo sapiens
ggcagcatccgcccggcaccct

SEQ ID NO: 9417858 - DNA, 22 bp, Homo sapiens
ggcagcatcccatggaccgcat

SEQ ID NO: 9417859 - DNA, 22 bp, Homo sapiens
ggcacagggggctgaggactag

SEQ ID NO: 9417860 - DNA, 22 bp, Homo sapiens
ggcacagggggctgaggactag

SEQ ID NO: 9417861 - DNA, 22 bp, Homo sapiens
ggcacagggggctgaggactag

SEQ ID NO: 9417862 - DNA, 22 bp, Homo sapiens
ggcacagttttctacatatgct

SEQ ID NO: 9417863 - DNA, 22 bp, Homo sapiens
ggcacagggtgatgttgcagtt

SEQ ID NO: 9417864 - DNA, 22 bp, Homo sapiens
ggcacagtccctggcacagagt

SEQ ID NO: 9417865 - DNA, 22 bp, Homo sapiens
ggcacagggggctgaggactag

SEQ ID NO: 9417866 - DNA, 22 bp, Homo sapiens
ggcacagggaggccctggtgtg

SEQ ID NO: 9417867 - DNA, 22 bp, Homo sapiens
ggcacagggaggccctggtgtg

SEQ ID NO: 9417868 - DNA, 22 bp, Homo sapiens
ggcacagggagccgcagttgca

SEQ ID NO: 9417869 - DNA, 22 bp, Homo sapiens
ggcacagggagccgcagttgca

SEQ ID NO: 9417870 - DNA, 22 bp, Homo sapiens
ggcacagggagccgcagttgca

SEQ ID NO: 9417871 - DNA, 22 bp, Homo sapiens
ggcacagggagccgcagttgca

SEQ ID NO: 9417872 - DNA, 22 bp, Homo sapiens
ggcacagggagaggcggatttt

SEQ ID NO: 9417873 - DNA, 22 bp, Homo sapiens
ggcacagggagccgcagttgca

SEQ ID NO: 9417874 - DNA, 22 bp, Homo sapiens
ggcacaggagtcacagcatttc

SEQ ID NO: 9417875 - DNA, 22 bp, Homo sapiens
ggcacaggagtcacagcatttc

SEQ ID NO: 9417876 - DNA, 22 bp, Homo sapiens
ggcacaggagtcacagcatttc

SEQ ID NO: 9417877 - DNA, 22 bp, Homo sapiens
cacagggcagagggtccgtggc

SEQ ID NO: 9417878 - DNA, 22 bp, Homo sapiens
cacagggcagagacctgggtgc

SEQ ID NO: 9417879 - DNA, 22 bp, Homo sapiens
cacagggcagagacctgggtgc

SEQ ID NO: 9417880 - DNA, 22 bp, Homo sapiens
ggcactggcctggggccaagag

SEQ ID NO: 9417881 - DNA, 22 bp, Homo sapiens
ggcactggaaggatcatgtgag

SEQ ID NO: 9417882 - DNA, 22 bp, Homo sapiens
ggcactggaaggatcatgtgag

SEQ ID NO: 9417883 - DNA, 22 bp, Homo sapiens
ggcactggaaggatcatgtgag

SEQ ID NO: 9417884 - DNA, 22 bp, Homo sapiens
ggcacatggagacttggcatca

SEQ ID NO: 9417885 - DNA, 20 bp, Homo sapiens
ggcacagtttttgcacctgc

SEQ ID NO: 9417886 - DNA, 22 bp, Homo sapiens
ggcactgcttcctgagcctgag

SEQ ID NO: 9417887 - DNA, 22 bp, Homo sapiens
ggcacatgtatgtgggagtgtg

SEQ ID NO: 9417888 - DNA, 20 bp, Homo sapiens
ggcactggaagcacacagga

SEQ ID NO: 9417889 - DNA, 20 bp, Homo sapiens
ggcactggaagcacacagga

SEQ ID NO: 9417890 - DNA, 20 bp, Homo sapiens
ggcactggaagcacacagga

SEQ ID NO: 9417891 - DNA, 22 bp, Homo sapiens
ggcagagcagccccagggtttg

SEQ ID NO: 9417892 - DNA, 22 bp, Homo sapiens
ggcagagatgtgggtcagaatc

SEQ ID NO: 9417893 - DNA, 22 bp, Homo sapiens
ggcactgggcaccggctgaggg

SEQ ID NO: 9417894 - DNA, 22 bp, Homo sapiens
ggcactgggagaggtgagacgg

SEQ ID NO: 9417895 - DNA, 22 bp, Homo sapiens
ggcactgggaatgcagtgatga

SEQ ID NO: 9417896 - DNA, 22 bp, Homo sapiens
ggcactgggaatgcagtgatga

SEQ ID NO: 9417897 - DNA, 22 bp, Homo sapiens
cacagctgtgagaagggagcct

SEQ ID NO: 9417898 - DNA, 22 bp, Homo sapiens
cacagctgtgagaagggagcct

SEQ ID NO: 9417899 - DNA, 22 bp, Homo sapiens
cacagctgtgagaagggagcct

SEQ ID NO: 9417900 - DNA, 22 bp, Homo sapiens
cacagctgttttctccaggcag

SEQ ID NO: 9417901 - DNA, 22 bp, Homo sapiens
cacagctgttttctccaggcag

SEQ ID NO: 9417902 - DNA, 22 bp, Homo sapiens
cacagctgtatccaggagatcc

SEQ ID NO: 9417903 - DNA, 22 bp, Homo sapiens
cacagctggtgcactagctctg

SEQ ID NO: 9417904 - DNA, 22 bp, Homo sapiens
cacagctgtcagctgacctagg

SEQ ID NO: 9417905 - DNA, 22 bp, Homo sapiens
cacagctgtcagctgacctagg

SEQ ID NO: 9417906 - DNA, 22 bp, Homo sapiens
cacagctgtatccaggagatcc

SEQ ID NO: 9417907 - DNA, 22 bp, Homo sapiens
cacagctgtcagctgacctagg

SEQ ID NO: 9417908 - DNA, 22 bp, Homo sapiens
cacagcttagaaaagaagccat

SEQ ID NO: 9417909 - DNA, 22 bp, Homo sapiens
cacagctgttttctccaggcag

SEQ ID NO: 9417910 - DNA, 22 bp, Homo sapiens
cacagcttatgccactgattgg

SEQ ID NO: 9417911 - DNA, 22 bp, Homo sapiens
cacagcttcagtttctgacttg

SEQ ID NO: 9417912 - DNA, 22 bp, Homo sapiens
cacagcttccattagaatgaga

SEQ ID NO: 9417913 - DNA, 22 bp, Homo sapiens
cacagcttcccgtgcatggaga

SEQ ID NO: 9417914 - DNA, 22 bp, Homo sapiens
cacagcttcccaaagtggacct

SEQ ID NO: 9417915 - DNA, 22 bp, Homo sapiens
cacactgtcaggtaaataacac

SEQ ID NO: 9417916 - DNA, 22 bp, Homo sapiens
cacactgcttacacaaaatgat

SEQ ID NO: 9417917 - DNA, 22 bp, Homo sapiens
cacactgccacattcactcttc

SEQ ID NO: 9417918 - DNA, 22 bp, Homo sapiens
cacagctggtgcactagctctg

SEQ ID NO: 9417919 - DNA, 22 bp, Homo sapiens
cacactgtcaggtaaataacac

SEQ ID NO: 9417920 - DNA, 22 bp, Homo sapiens
cacactgtcaggtaaataacac

SEQ ID NO: 9417921 - DNA, 22 bp, Homo sapiens
cacactgccacattcactcttc

SEQ ID NO: 9417922 - DNA, 22 bp, Homo sapiens
cacactgataggcttgacaggc

SEQ ID NO: 9417923 - DNA, 22 bp, Homo sapiens
cacactgactggaatcaaggat

SEQ ID NO: 9417924 - DNA, 22 bp, Homo sapiens
cacactcattagtcatttctct

SEQ ID NO: 9417925 - DNA, 22 bp, Homo sapiens
cacactcattagtcatttctct

SEQ ID NO: 9417926 - DNA, 22 bp, Homo sapiens
cacactcattagtcatttctct

SEQ ID NO: 9417927 - DNA, 22 bp, Homo sapiens
ggaggccttgcctgcaggcaca

SEQ ID NO: 9417928 - DNA, 22 bp, Homo sapiens
ggaggccaaggcaggtggatcg

SEQ ID NO: 9417929 - DNA, 22 bp, Homo sapiens
cacagcttgtttagtgactcac

SEQ ID NO: 9417930 - DNA, 22 bp, Homo sapiens
ggaggccaaggcaggtggatca

SEQ ID NO: 9417931 - DNA, 22 bp, Homo sapiens
cacagcttgggctctgacaata

SEQ ID NO: 9417932 - DNA, 20 bp, Homo sapiens
cacagcttgccttttatgac

SEQ ID NO: 9417933 - DNA, 22 bp, Homo sapiens
cacagcttctgtctgacccatg

SEQ ID NO: 9417934 - DNA, 22 bp, Homo sapiens
cacagcttcttccattccactc

SEQ ID NO: 9417935 - DNA, 22 bp, Homo sapiens
cacagcttctgagtgaggattt

SEQ ID NO: 9417936 - DNA, 22 bp, Homo sapiens
cacagcttctccccgctgcggc

SEQ ID NO: 9417937 - DNA, 22 bp, Homo sapiens
cacagcttctccttgatatcgc

SEQ ID NO: 9417938 - DNA, 22 bp, Homo sapiens
ggaggcggaagttgcagtgagc

SEQ ID NO: 9417939 - DNA, 22 bp, Homo sapiens
ggaggcggaagttgcagtgagc

SEQ ID NO: 9417940 - DNA, 22 bp, Homo sapiens
ggaggcggacacaggtagtgtt

SEQ ID NO: 9417941 - DNA, 22 bp, Homo sapiens
ggaggcggacacaggtagtgtt

SEQ ID NO: 9417942 - DNA, 22 bp, Homo sapiens
ggaggcggagcttgcagtgagc

SEQ ID NO: 9417943 - DNA, 22 bp, Homo sapiens
ggaggcggagcttgcagtgagc

SEQ ID NO: 9417944 - DNA, 22 bp, Homo sapiens
ggatgggaacttggtagggcat

SEQ ID NO: 9417945 - DNA, 22 bp, Homo sapiens
ggatgggaacttggtagggcat

SEQ ID NO: 9417946 - DNA, 22 bp, Homo sapiens
ggatgggaacttggtagggcat

SEQ ID NO: 9417947 - DNA, 22 bp, Homo sapiens
ggatgggaacttggtagggcat

SEQ ID NO: 9417948 - DNA, 22 bp, Homo sapiens
ggatctgggctctgccaatcag

SEQ ID NO: 9417949 - DNA, 22 bp, Homo sapiens
ggatgggagcagaggacgacca

SEQ ID NO: 9417950 - DNA, 23 bp, Homo sapiens
ggatgggcaagcctagtgcctac

SEQ ID NO: 9417951 - DNA, 22 bp, Homo sapiens
ggatccttctttgacctcacag

SEQ ID NO: 9417952 - DNA, 22 bp, Homo sapiens
ggatccttaactatcacagtga

SEQ ID NO: 9417953 - DNA, 22 bp, Homo sapiens
ggagggagtttcattcctgccc

SEQ ID NO: 9417954 - DNA, 22 bp, Homo sapiens
ggagggagtttcattcctgccc

SEQ ID NO: 9417955 - DNA, 22 bp, Homo sapiens
ggagggagtttcattcctgccc

SEQ ID NO: 9417956 - DNA, 22 bp, Homo sapiens
ggagggagtcagctgattagaa

SEQ ID NO: 9417957 - DNA, 22 bp, Homo sapiens
ggagggagtcagctgattagaa

SEQ ID NO: 9417958 - DNA, 22 bp, Homo sapiens
ggagggagtcagctgattagaa

SEQ ID NO: 9417959 - DNA, 22 bp, Homo sapiens
ggagggagtcagctgattagaa

SEQ ID NO: 9417960 - DNA, 22 bp, Homo sapiens
ggagggagtcagctgattagaa

SEQ ID NO: 9417961 - DNA, 22 bp, Homo sapiens
ggagggagcatccccttgctga

SEQ ID NO: 9417962 - DNA, 22 bp, Homo sapiens
ggagggagcatccccttgctga

SEQ ID NO: 9417963 - DNA, 22 bp, Homo sapiens
ggagggagcagagaacccaacc

SEQ ID NO: 9417964 - DNA, 22 bp, Homo sapiens
ggagggagcagagaacccaacc

SEQ ID NO: 9417965 - DNA, 22 bp, Homo sapiens
ggaggcggaggctgcagtgagc

SEQ ID NO: 9417966 - DNA, 22 bp, Homo sapiens
ggaggcggaggctgcagtgagc

SEQ ID NO: 9417967 - DNA, 22 bp, Homo sapiens
ggagggagggctagaccaaaga

SEQ ID NO: 9417968 - DNA, 22 bp, Homo sapiens
ggagggagggctagaccaaaga

SEQ ID NO: 9417969 - DNA, 22 bp, Homo sapiens
ggagggagggctagaccaaaga

SEQ ID NO: 9417970 - DNA, 22 bp, Homo sapiens
ggagggagcatccccttgctga

SEQ ID NO: 9417971 - DNA, 22 bp, Homo sapiens
ggagggagcatccccttgctga

SEQ ID NO: 9417972 - DNA, 22 bp, Homo sapiens
ggagggagcatccccttgctga

SEQ ID NO: 9417973 - DNA, 22 bp, Homo sapiens
ggagggaggttagattcaagct

SEQ ID NO: 9417974 - DNA, 22 bp, Homo sapiens
ggagggaggttagattcaagct

SEQ ID NO: 9417975 - DNA, 22 bp, Homo sapiens
ggagggaggttagattcaagct

SEQ ID NO: 9417976 - DNA, 22 bp, Homo sapiens
cacagggaggacatcaacagtg

SEQ ID NO: 9417977 - DNA, 22 bp, Homo sapiens
cacagggaggacatcaacagtg

SEQ ID NO: 9417978 - DNA, 22 bp, Homo sapiens
cacagggaggacatcaacagtg

SEQ ID NO: 9417979 - DNA, 22 bp, Homo sapiens
cacagggaggacatcaacagtg

SEQ ID NO: 9417980 - DNA, 22 bp, Homo sapiens
ggatgttctggggttctcttgt

SEQ ID NO: 9417981 - DNA, 19 bp, Homo sapiens
cacagggagaccacatgtc

SEQ ID NO: 9417982 - DNA, 22 bp, Homo sapiens
cacagggagaggaacagcgcag

SEQ ID NO: 9417983 - DNA, 22 bp, Homo sapiens
cacagggagaggaacagcgcag

SEQ ID NO: 9417984 - DNA, 22 bp, Homo sapiens
cacagggagttacagaagcact

SEQ ID NO: 9417985 - DNA, 22 bp, Homo sapiens
cacagggagttacagaagcact

SEQ ID NO: 9417986 - DNA, 22 bp, Homo sapiens
cacagggagttacagaagcact

SEQ ID NO: 9417987 - DNA, 22 bp, Homo sapiens
cacagggcaccagttggccatc

SEQ ID NO: 9417988 - DNA, 22 bp, Homo sapiens
cacagggcagagacctgggtgc

SEQ ID NO: 9417989 - DNA, 22 bp, Homo sapiens
cacagggaggcggtcactggct

SEQ ID NO: 9417990 - DNA, 22 bp, Homo sapiens
cacagggaggcggtcactggct

SEQ ID NO: 9417991 - DNA, 22 bp, Homo sapiens
cacagggaggcggtcactggct

SEQ ID NO: 9417992 - DNA, 23 bp, Homo sapiens
cacagggagggaaactctttcag

SEQ ID NO: 9417993 - DNA, 22 bp, Homo sapiens
cacagggagttacagaagcact

SEQ ID NO: 9417994 - DNA, 22 bp, Homo sapiens
ggatgggcccgggacggcgctg

SEQ ID NO: 9417995 - DNA, 22 bp, Homo sapiens
ggatgggctgaaaggtagcccc

SEQ ID NO: 9417996 - DNA, 19 bp, Homo sapiens
ggatggtggggtgcccatc

SEQ ID NO: 9417997 - DNA, 22 bp, Homo sapiens
ggatgttctggggttctcttgt

SEQ ID NO: 9417998 - DNA, 22 bp, Homo sapiens
ggatgtgtcctctagggctcca

SEQ ID NO: 9417999 - DNA, 22 bp, Homo sapiens
ggatgtgtcactctcaggaggt

SEQ ID NO: 9418000 - DNA, 22 bp, Homo sapiens
ggatgtgaatctgggctgagac

SEQ ID NO: 9418001 - DNA, 22 bp, Homo sapiens
cactgaccatggccaattggca

SEQ ID NO: 9418002 - DNA, 22 bp, Homo sapiens
cactgaaggctaggattagatg

SEQ ID NO: 9418003 - DNA, 22 bp, Homo sapiens
cactgaagcctgggagtaagac

SEQ ID NO: 9418004 - DNA, 17 bp, Homo sapiens
cactgacttaaaatctt

SEQ ID NO: 9418005 - DNA, 22 bp, Homo sapiens
cactgagaaagtgacctgccaa

SEQ ID NO: 9418006 - DNA, 22 bp, Homo sapiens
cactgactccaaaaataaagaa

SEQ ID NO: 9418007 - DNA, 22 bp, Homo sapiens
cactgactgcccgctgtacatt

SEQ ID NO: 9418008 - DNA, 22 bp, Homo sapiens
cactgactaggtcggtgacctc

SEQ ID NO: 9418009 - DNA, 22 bp, Homo sapiens
cactgactaggtcggtgacctc

SEQ ID NO: 9418010 - DNA, 22 bp, Homo sapiens
cactgagaggtctcatttccaa

SEQ ID NO: 9418011 - DNA, 22 bp, Homo sapiens
cactgagagatgtgtcacagca

SEQ ID NO: 9418012 - DNA, 22 bp, Homo sapiens
cactgaggctgggggagaaggt

SEQ ID NO: 9418013 - DNA, 22 bp, Homo sapiens
cactgagagtagggcacaagtg

SEQ ID NO: 9418014 - DNA, 22 bp, Homo sapiens
cactgagagtagggcacaagtg

SEQ ID NO: 9418015 - DNA, 22 bp, Homo sapiens
cactgagctgatttcaggtgcc

SEQ ID NO: 9418016 - DNA, 21 bp, Homo sapiens
cactgaggaggaaaaggagct

SEQ ID NO: 9418017 - DNA, 23 bp, Homo sapiens
ggcctctcaccagggtcctttca

SEQ ID NO: 9418018 - DNA, 22 bp, Homo sapiens
ggcctctcatgcccagagccaa

SEQ ID NO: 9418019 - DNA, 22 bp, Homo sapiens
ggcctcggcccactgctgcggt

SEQ ID NO: 9418020 - DNA, 22 bp, Homo sapiens
ggcctcggcccactgctgcggt

SEQ ID NO: 9418021 - DNA, 22 bp, Homo sapiens
ggcctcgcggcttctggtggct

SEQ ID NO: 9418022 - DNA, 22 bp, Homo sapiens
ggcctctctagcatccagcctg

SEQ ID NO: 9418023 - DNA, 22 bp, Homo sapiens
cactgcactccagcttgggtga

SEQ ID NO: 9418024 - DNA, 22 bp, Homo sapiens
ggcctctcattctccctggtcc

SEQ ID NO: 9418025 - DNA, 22 bp, Homo sapiens
ggcctctcgaagcttcagtcca

SEQ ID NO: 9418026 - DNA, 22 bp, Homo sapiens
ggcctctcattctccctggtcc

SEQ ID NO: 9418027 - DNA, 22 bp, Homo sapiens
ggcctctctagcatccagcctg

SEQ ID NO: 9418028 - DNA, 22 bp, Homo sapiens
cactgcagcaccatgcagggct

SEQ ID NO: 9418029 - DNA, 22 bp, Homo sapiens
cactgcagccacatagatgacg

SEQ ID NO: 9418030 - DNA, 22 bp, Homo sapiens
cactgcagcaccatgcagggct

SEQ ID NO: 9418031 - DNA, 22 bp, Homo sapiens
cactgcagatcagaggctgaga

SEQ ID NO: 9418032 - DNA, 22 bp, Homo sapiens
cactgcagcctcgctctcctga

SEQ ID NO: 9418033 - DNA, 22 bp, Homo sapiens
cactgcaggtctgagatggggg

SEQ ID NO: 9418034 - DNA, 22 bp, Homo sapiens
cactggaaccaagacccagggc

SEQ ID NO: 9418035 - DNA, 22 bp, Homo sapiens
cactgcttttttggctatgtac

SEQ ID NO: 9418036 - DNA, 22 bp, Homo sapiens
cactgcttttttggctatgtac

SEQ ID NO: 9418037 - DNA, 22 bp, Homo sapiens
cactggaatggatagagcagag

SEQ ID NO: 9418038 - DNA, 22 bp, Homo sapiens
cactggaatggatagagcagag

SEQ ID NO: 9418039 - DNA, 22 bp, Homo sapiens
cactgctttttctcctcactgg

SEQ ID NO: 9418040 - DNA, 22 bp, Homo sapiens
cactgctttttctcctcactgg

SEQ ID NO: 9418041 - DNA, 22 bp, Homo sapiens
cactgctttgcccaagagggca

SEQ ID NO: 9418042 - DNA, 22 bp, Homo sapiens
cactgcttttcagacagttatt

SEQ ID NO: 9418043 - DNA, 22 bp, Homo sapiens
cactgcttttcagacagttatt

SEQ ID NO: 9418044 - DNA, 22 bp, Homo sapiens
cactgcctgctggctgtcactt

SEQ ID NO: 9418045 - DNA, 22 bp, Homo sapiens
cactgcctgctggctgtcactt

SEQ ID NO: 9418046 - DNA, 22 bp, Homo sapiens
cactgctttaaggctgagtaac

SEQ ID NO: 9418047 - DNA, 22 bp, Homo sapiens
cactgcctggaaggagagacat

SEQ ID NO: 9418048 - DNA, 22 bp, Homo sapiens
cactgctttaaggctgagtaac

SEQ ID NO: 9418049 - DNA, 18 bp, Homo sapiens
cactggacctcatgagag

SEQ ID NO: 9418050 - DNA, 22 bp, Homo sapiens
cactggacctgctttgatcctg

SEQ ID NO: 9418051 - DNA, 22 bp, Homo sapiens
cactggaggtcagtggagcact

SEQ ID NO: 9418052 - DNA, 22 bp, Homo sapiens
cactggaggtcagtggagcact

SEQ ID NO: 9418053 - DNA, 22 bp, Homo sapiens
cactggcatgtgaggcggtggc

SEQ ID NO: 9418054 - DNA, 22 bp, Homo sapiens
cactggcattagtcacgaggca

SEQ ID NO: 9418055 - DNA, 22 bp, Homo sapiens
cactggcatctagtgggttgag

SEQ ID NO: 9418056 - DNA, 22 bp, Homo sapiens
cactggataaaaatttggaagt

SEQ ID NO: 9418057 - DNA, 22 bp, Homo sapiens
cactggcaaagcctgttcctta

SEQ ID NO: 9418058 - DNA, 22 bp, Homo sapiens
cactggcaaatggagagaatgt

SEQ ID NO: 9418059 - DNA, 22 bp, Homo sapiens
cactggcagatttgggatctgg

SEQ ID NO: 9418060 - DNA, 22 bp, Homo sapiens
cactggcatctaagggtggtag

SEQ ID NO: 9418061 - DNA, 21 bp, Homo sapiens
ggctatgattaatgactagga

SEQ ID NO: 9418062 - DNA, 22 bp, Homo sapiens
ggctcaatgcaacttctgcctc

SEQ ID NO: 9418063 - DNA, 19 bp, Homo sapiens
ggctcaagcatccaggtag

SEQ ID NO: 9418064 - DNA, 22 bp, Homo sapiens
ggctagggatctagaccaggac

SEQ ID NO: 9418065 - DNA, 22 bp, Homo sapiens
ggctaggggaataatctgtggt

SEQ ID NO: 9418066 - DNA, 22 bp, Homo sapiens
ggctagggagacagagggcatg

SEQ ID NO: 9418067 - DNA, 22 bp, Homo sapiens
ggctagggatctagaccaggac

SEQ ID NO: 9418068 - DNA, 22 bp, Homo sapiens
cactgccatgttgatagatgtg

SEQ ID NO: 9418069 - DNA, 22 bp, Homo sapiens
cactgcccagagggcagcattg

SEQ ID NO: 9418070 - DNA, 22 bp, Homo sapiens
ggctagggagacagagggcatg

SEQ ID NO: 9418071 - DNA, 22 bp, Homo sapiens
ggctagggagacagagggcatg

SEQ ID NO: 9418072 - DNA, 20 bp, Homo sapiens
cactgccagaatacactgtc

SEQ ID NO: 9418073 - DNA, 22 bp, Homo sapiens
cactgcatggatgatggctgta

SEQ ID NO: 9418074 - DNA, 22 bp, Homo sapiens
cactgcagtcttcatcaaccaa

SEQ ID NO: 9418075 - DNA, 22 bp, Homo sapiens
cactgcagttccccagtgcgca

SEQ ID NO: 9418076 - DNA, 22 bp, Homo sapiens
cactgcagttccccagtgcgca

SEQ ID NO: 9418077 - DNA, 22 bp, Homo sapiens
caccccagcttctcaggataga

SEQ ID NO: 9418078 - DNA, 22 bp, Homo sapiens
caccccagcttctcaggataga

SEQ ID NO: 9418079 - DNA, 23 bp, Homo sapiens
caccccaccctgaggaggaggga

SEQ ID NO: 9418080 - DNA, 22 bp, Homo sapiens
caccccaagttctgtccactgc

SEQ ID NO: 9418081 - DNA, 22 bp, Homo sapiens
caccccaagttctgtccactgc

SEQ ID NO: 9418082 - DNA, 22 bp, Homo sapiens
caccccagtctaaaaccagcct

SEQ ID NO: 9418083 - DNA, 22 bp, Homo sapiens
cacccagttgactacaaagggg

SEQ ID NO: 9418084 - DNA, 22 bp, Homo sapiens
cacccagttgactacaaagggg

SEQ ID NO: 9418085 - DNA, 22 bp, Homo sapiens
cacccattaaccaaagagtgaa

SEQ ID NO: 9418086 - DNA, 22 bp, Homo sapiens
cacccatgtttccctctgtctt

SEQ ID NO: 9418087 - DNA, 22 bp, Homo sapiens
cacccagtgaaggagcaagagg

SEQ ID NO: 9418088 - DNA, 22 bp, Homo sapiens
cacccagtaagcatgaggccct

SEQ ID NO: 9418089 - DNA, 22 bp, Homo sapiens
cacccagtgaaggagcaagagg

SEQ ID NO: 9418090 - DNA, 22 bp, Homo sapiens
cacccagtaagcatgaggccct

SEQ ID NO: 9418091 - DNA, 22 bp, Homo sapiens
cacccaggctggaatgcagtgg

SEQ ID NO: 9418092 - DNA, 22 bp, Homo sapiens
cacccaggttggagtgcagtgg

SEQ ID NO: 9418093 - DNA, 22 bp, Homo sapiens
cacccaggttggagtgcagtgg

SEQ ID NO: 9418094 - DNA, 22 bp, Homo sapiens
cacccaggctggaatgcaatgg

SEQ ID NO: 9418095 - DNA, 22 bp, Homo sapiens
cacccaggctggaatgcaatgg

SEQ ID NO: 9418096 - DNA, 22 bp, Homo sapiens
ggcatagatttctttaggttta

SEQ ID NO: 9418097 - DNA, 22 bp, Homo sapiens
ggcataaagttagagattaaga

SEQ ID NO: 9418098 - DNA, 22 bp, Homo sapiens
ggcagttttctcagtggggtac

SEQ ID NO: 9418099 - DNA, 22 bp, Homo sapiens
ggcatacaagagaaatataaga

SEQ ID NO: 9418100 - DNA, 22 bp, Homo sapiens
ggcagttgttggccacgggtgg

SEQ ID NO: 9418101 - DNA, 22 bp, Homo sapiens
ggcagtttcatcaggagaaaag

SEQ ID NO: 9418102 - DNA, 22 bp, Homo sapiens
ggcagtttatattatgtgtgtg

SEQ ID NO: 9418103 - DNA, 22 bp, Homo sapiens
ggcagtttctcaggcaggggta

SEQ ID NO: 9418104 - DNA, 22 bp, Homo sapiens
ggcagtttggcaggatggaggg

SEQ ID NO: 9418105 - DNA, 18 bp, Homo sapiens
ggcagtttgtgtagggga

SEQ ID NO: 9418106 - DNA, 22 bp, Homo sapiens
ggcagttttaacagaggtagta

SEQ ID NO: 9418107 - DNA, 20 bp, Homo sapiens
caccctacggcctcacctcc

SEQ ID NO: 9418108 - DNA, 22 bp, Homo sapiens
caccccttgtctttggggtcgt

SEQ ID NO: 9418109 - DNA, 20 bp, Homo sapiens
caccctacggcctcacctcc

SEQ ID NO: 9418110 - DNA, 20 bp, Homo sapiens
caccctcccagcacctatgc

SEQ ID NO: 9418111 - DNA, 20 bp, Homo sapiens
caccctcccagcacctatgc

SEQ ID NO: 9418112 - DNA, 22 bp, Homo sapiens
caccctcccgtcagcccctggg

SEQ ID NO: 9418113 - DNA, 22 bp, Homo sapiens
caccctcccgtcagcccctggg

SEQ ID NO: 9418114 - DNA, 22 bp, Homo sapiens
caccctcccgtcagcccctggg

SEQ ID NO: 9418115 - DNA, 18 bp, Homo sapiens
caccctccgcggctgccc

SEQ ID NO: 9418116 - DNA, 20 bp, Homo sapiens
caccctcccagcacctatgc

SEQ ID NO: 9418117 - DNA, 22 bp, Homo sapiens
caccctcccgtcagcccctggg

SEQ ID NO: 9418118 - DNA, 22 bp, Homo sapiens
cacccccagcagggaaaggagg

SEQ ID NO: 9418119 - DNA, 22 bp, Homo sapiens
caccccccaattctgccagctg

SEQ ID NO: 9418120 - DNA, 22 bp, Homo sapiens
caccccccaattctgccagctg

SEQ ID NO: 9418121 - DNA, 22 bp, Homo sapiens
cacccctacctgagtcaggagt

SEQ ID NO: 9418122 - DNA, 22 bp, Homo sapiens
cacccctgtggagcatggtggc

SEQ ID NO: 9418123 - DNA, 22 bp, Homo sapiens
cacccctgtggagcatggtggc

SEQ ID NO: 9418124 - DNA, 18 bp, Homo sapiens
caccctccgcggctgccc

SEQ ID NO: 9418125 - DNA, 18 bp, Homo sapiens
caccctccgcggctgccc

SEQ ID NO: 9418126 - DNA, 22 bp, Homo sapiens
caccctgactggccctgcagga

SEQ ID NO: 9418127 - DNA, 22 bp, Homo sapiens
caccctggaaagaaggtctggg

SEQ ID NO: 9418128 - DNA, 22 bp, Homo sapiens
caccctggaaagaaggtctggg

SEQ ID NO: 9418129 - DNA, 22 bp, Homo sapiens
caccctgctacaaagcctcctg

SEQ ID NO: 9418130 - DNA, 22 bp, Homo sapiens
cactctgagaaacactaaacca

SEQ ID NO: 9418131 - DNA, 22 bp, Homo sapiens
cactctgagaaacactaaacca

SEQ ID NO: 9418132 - DNA, 22 bp, Homo sapiens
caccctggctggaggtgcagtg

SEQ ID NO: 9418133 - DNA, 22 bp, Homo sapiens
cactctgagaagtacaagctcc

SEQ ID NO: 9418134 - DNA, 22 bp, Homo sapiens
cactctgagaagtacaagctcc

SEQ ID NO: 9418135 - DNA, 22 bp, Homo sapiens
cactctgagaagtacaagctcc

SEQ ID NO: 9418136 - DNA, 22 bp, Homo sapiens
caccctggctggaggtgcagtg

SEQ ID NO: 9418137 - DNA, 22 bp, Homo sapiens
cacccactgagctcatgtccca

SEQ ID NO: 9418138 - DNA, 22 bp, Homo sapiens
cacccacattccatcactctgc

SEQ ID NO: 9418139 - DNA, 22 bp, Homo sapiens
cacccacattccatcactctgc

SEQ ID NO: 9418140 - DNA, 22 bp, Homo sapiens
cacccacatggaaattcacagt

SEQ ID NO: 9418141 - DNA, 22 bp, Homo sapiens
cacccacatggaaattcacagt

SEQ ID NO: 9418142 - DNA, 22 bp, Homo sapiens
caccatttagtagcaagagctc

SEQ ID NO: 9418143 - DNA, 22 bp, Homo sapiens
caccattttctaaaaatatgac

SEQ ID NO: 9418144 - DNA, 22 bp, Homo sapiens
caccatgtattcagtttggcac

SEQ ID NO: 9418145 - DNA, 22 bp, Homo sapiens
caccatttaagaaagccaaatt

SEQ ID NO: 9418146 - DNA, 22 bp, Homo sapiens
caccatctggtaggcattagtg

SEQ ID NO: 9418147 - DNA, 22 bp, Homo sapiens
caccatctagcagagagatgga

SEQ ID NO: 9418148 - DNA, 22 bp, Homo sapiens
ggcagtggttagaaacatgagc

SEQ ID NO: 9418149 - DNA, 22 bp, Homo sapiens
ggcagtgtcaaaataggcagaa

SEQ ID NO: 9418150 - DNA, 22 bp, Homo sapiens
ggcagtgtcaaaataggcagaa

SEQ ID NO: 9418151 - DNA, 22 bp, Homo sapiens
cacccagagcctgagagggata

SEQ ID NO: 9418152 - DNA, 22 bp, Homo sapiens
cacccagagcagacactgtcca

SEQ ID NO: 9418153 - DNA, 22 bp, Homo sapiens
cacccagagggcttgctgaaca

SEQ ID NO: 9418154 - DNA, 22 bp, Homo sapiens
cacccagagggcttgctgaaca

SEQ ID NO: 9418155 - DNA, 22 bp, Homo sapiens
ggcagtgttccagaccttcacc

SEQ ID NO: 9418156 - DNA, 22 bp, Homo sapiens
ggcagtgtgcatctgtgtggcc

SEQ ID NO: 9418157 - DNA, 22 bp, Homo sapiens
ggcagttgcgtgcatcagtggt

SEQ ID NO: 9418158 - DNA, 22 bp, Homo sapiens
ggcagttgcgtgcatcagtggt

SEQ ID NO: 9418159 - DNA, 22 bp, Homo sapiens
ggcagttgctgtggatgaggtt

SEQ ID NO: 9418160 - DNA, 22 bp, Homo sapiens
ggcagttgcgtgcatcagtggt

SEQ ID NO: 9418161 - DNA, 22 bp, Homo sapiens
ggcagctgagatcatgctgttg

SEQ ID NO: 9418162 - DNA, 22 bp, Homo sapiens
ggcagctgagatcatgctgttg

SEQ ID NO: 9418163 - DNA, 22 bp, Homo sapiens
ggcagctgagatcatgctgttg

SEQ ID NO: 9418164 - DNA, 21 bp, Homo sapiens
ggcagctgaccgcgcggtgca

SEQ ID NO: 9418165 - DNA, 22 bp, Homo sapiens
ggcagctgacctagcaccatcc

SEQ ID NO: 9418166 - DNA, 22 bp, Homo sapiens
ggcagctgaagaggaactttgg

SEQ ID NO: 9418167 - DNA, 22 bp, Homo sapiens
ggcagctgaagaggaactttgg

SEQ ID NO: 9418168 - DNA, 19 bp, Homo sapiens
ggcagctcttgtcttctgc

SEQ ID NO: 9418169 - DNA, 22 bp, Homo sapiens
ggcagctgagcatggctacctt

SEQ ID NO: 9418170 - DNA, 22 bp, Homo sapiens
ggcagctgagcatggctacctt

SEQ ID NO: 9418171 - DNA, 22 bp, Homo sapiens
ggcagctgagcatggctacctt

SEQ ID NO: 9418172 - DNA, 22 bp, Homo sapiens
ggcagctgattagcatcaagga

SEQ ID NO: 9418173 - DNA, 22 bp, Homo sapiens
ggcagctgagcatggctacctt

SEQ ID NO: 9418174 - DNA, 22 bp, Homo sapiens
ggcagctgattagcatcaagga

SEQ ID NO: 9418175 - DNA, 22 bp, Homo sapiens
caccaggctggagtgcagaggt

SEQ ID NO: 9418176 - DNA, 22 bp, Homo sapiens
ggcagctgattagcatcaagga

SEQ ID NO: 9418177 - DNA, 22 bp, Homo sapiens
ggcagctgattagcatcaagga

SEQ ID NO: 9418178 - DNA, 22 bp, Homo sapiens
caccaggttccgggcagagctg

SEQ ID NO: 9418179 - DNA, 22 bp, Homo sapiens
caccaggttccgggcagagctg

SEQ ID NO: 9418180 - DNA, 22 bp, Homo sapiens
caccataaccaacatgtcagtt

SEQ ID NO: 9418181 - DNA, 20 bp, Homo sapiens
caccagtcatgagtcaatac

SEQ ID NO: 9418182 - DNA, 16 bp, Homo sapiens
caccagtccttcctgc

SEQ ID NO: 9418183 - DNA, 22 bp, Homo sapiens
caccagtctttattttgttatt

SEQ ID NO: 9418184 - DNA, 22 bp, Homo sapiens
gcttggctttgtcttgttcact

SEQ ID NO: 9418185 - DNA, 22 bp, Homo sapiens
gcttggcttgggctcagaggcc

SEQ ID NO: 9418186 - DNA, 22 bp, Homo sapiens
gcttggctttactagggggaca

SEQ ID NO: 9418187 - DNA, 22 bp, Homo sapiens
gcttggcttgggctcagaggcc

SEQ ID NO: 9418188 - DNA, 22 bp, Homo sapiens
gcttggctggagaaagttacct

SEQ ID NO: 9418189 - DNA, 22 bp, Homo sapiens
gcttggctgtgttcaagggcgg

SEQ ID NO: 9418190 - DNA, 22 bp, Homo sapiens
gcttggctgtgagctttgctgt

SEQ ID NO: 9418191 - DNA, 19 bp, Homo sapiens
gcttgggagagggagctaa

SEQ ID NO: 9418192 - DNA, 22 bp, Homo sapiens
caatttctctttatatctcaca

SEQ ID NO: 9418193 - DNA, 22 bp, Homo sapiens
cacaaaagtaggaggcaggcgg

SEQ ID NO: 9418194 - DNA, 22 bp, Homo sapiens
gcttgggagagggtccccagga

SEQ ID NO: 9418195 - DNA, 22 bp, Homo sapiens
gcttgggatatgctgatgtaaa

SEQ ID NO: 9418196 - DNA, 18 bp, Homo sapiens
gcttggctgcagagagag

SEQ ID NO: 9418197 - DNA, 22 bp, Homo sapiens
gcttggctctaagacacctatt

SEQ ID NO: 9418198 - DNA, 22 bp, Homo sapiens
gcttggctcctggctcacaggt

SEQ ID NO: 9418199 - DNA, 22 bp, Homo sapiens
gcttggctcctggctcacaggt

SEQ ID NO: 9418200 - DNA, 18 bp, Homo sapiens
gcttggctgcagagagag

SEQ ID NO: 9418201 - DNA, 22 bp, Homo sapiens
gcttggctgcctttggatgttg

SEQ ID NO: 9418202 - DNA, 22 bp, Homo sapiens
gcttggctggaaataggttgag

SEQ ID NO: 9418203 - DNA, 22 bp, Homo sapiens
gcttggccagcagccgggatgc

SEQ ID NO: 9418204 - DNA, 22 bp, Homo sapiens
gcttggccagcagccgggatgc

SEQ ID NO: 9418205 - DNA, 22 bp, Homo sapiens
gcttggccagcagccgggatgc

SEQ ID NO: 9418206 - DNA, 22 bp, Homo sapiens
gcttggccctgccgcctgggtc

SEQ ID NO: 9418207 - DNA, 22 bp, Homo sapiens
gcttctctttctcccctggcgg

SEQ ID NO: 9418208 - DNA, 22 bp, Homo sapiens
gcttctgaggaaggctcagcct

SEQ ID NO: 9418209 - DNA, 22 bp, Homo sapiens
gcttctctttctcccctggcgg

SEQ ID NO: 9418210 - DNA, 22 bp, Homo sapiens
gcttctcttaatgcctggcttt

SEQ ID NO: 9418211 - DNA, 22 bp, Homo sapiens
gcttctcttcgcctaggtcctt

SEQ ID NO: 9418212 - DNA, 22 bp, Homo sapiens
gcttctcttgtccaagggcagg

SEQ ID NO: 9418213 - DNA, 22 bp, Homo sapiens
gcttctctcaggagcatcagcc

SEQ ID NO: 9418214 - DNA, 22 bp, Homo sapiens
gcttctctcaggagcatcagcc

SEQ ID NO: 9418215 - DNA, 22 bp, Homo sapiens
gcttctctggcctgcagggcat

SEQ ID NO: 9418216 - DNA, 22 bp, Homo sapiens
gcttctctctcagactgcaagc

SEQ ID NO: 9418217 - DNA, 22 bp, Homo sapiens
gcttctctggctggtctgccac

SEQ ID NO: 9418218 - DNA, 22 bp, Homo sapiens
gcttctctggctggtctgccac

SEQ ID NO: 9418219 - DNA, 22 bp, Homo sapiens
gcttctcttaatgcctggcttt

SEQ ID NO: 9418220 - DNA, 22 bp, Homo sapiens
gcttctcctcccgctcccaggc

SEQ ID NO: 9418221 - DNA, 22 bp, Homo sapiens
gcttctctcaggagcatcagcc

SEQ ID NO: 9418222 - DNA, 22 bp, Homo sapiens
gcttctcctcccgctcccaggc

SEQ ID NO: 9418223 - DNA, 22 bp, Homo sapiens
gcttctccagaccttcatcccc

SEQ ID NO: 9418224 - DNA, 15 bp, Homo sapiens
gcttctccagatgac

SEQ ID NO: 9418225 - DNA, 22 bp, Homo sapiens
gcttctccctacagatgtcagt

SEQ ID NO: 9418226 - DNA, 22 bp, Homo sapiens
gcttctcctcccgctcccaggc

SEQ ID NO: 9418227 - DNA, 22 bp, Homo sapiens
gctgtggccgggcccaggccgc

SEQ ID NO: 9418228 - DNA, 22 bp, Homo sapiens
gctgtggcccttggcatctgcg

SEQ ID NO: 9418229 - DNA, 22 bp, Homo sapiens
gctgtggcccttggcatctgcg

SEQ ID NO: 9418230 - DNA, 22 bp, Homo sapiens
gctgtggcctccagcactcccc

SEQ ID NO: 9418231 - DNA, 22 bp, Homo sapiens
gctgtggcctagtttgttatat

SEQ ID NO: 9418232 - DNA, 20 bp, Homo sapiens
gctgtggccgtgccagactc

SEQ ID NO: 9418233 - DNA, 22 bp, Homo sapiens
gcttctccagaccttcatcccc

SEQ ID NO: 9418234 - DNA, 18 bp, Homo sapiens
gcttctcatttctaagca

SEQ ID NO: 9418235 - DNA, 18 bp, Homo sapiens
gcttctcatttctaagca

SEQ ID NO: 9418236 - DNA, 22 bp, Homo sapiens
gcttctcatgtttatttttaca

SEQ ID NO: 9418237 - DNA, 20 bp, Homo sapiens
gcttctcagggcttctctga

SEQ ID NO: 9418238 - DNA, 20 bp, Homo sapiens
gcttctcagggcttctctga

SEQ ID NO: 9418239 - DNA, 22 bp, Homo sapiens
gcttccaggtcattctcaccct

SEQ ID NO: 9418240 - DNA, 20 bp, Homo sapiens
gcttctcagggcttctctga

SEQ ID NO: 9418241 - DNA, 22 bp, Homo sapiens
gctgtggagtacagagctggtt

SEQ ID NO: 9418242 - DNA, 22 bp, Homo sapiens
gctgtggagtacagagctggtt

SEQ ID NO: 9418243 - DNA, 20 bp, Homo sapiens
gctgtggcaaagctttgtgt

SEQ ID NO: 9418244 - DNA, 20 bp, Homo sapiens
gctgtggcaaagctttgtgt

SEQ ID NO: 9418245 - DNA, 20 bp, Homo sapiens
gctgtggcaagtgctcactg

SEQ ID NO: 9418246 - DNA, 22 bp, Homo sapiens
gctgtggcaatgtttataatta

SEQ ID NO: 9418247 - DNA, 18 bp, Homo sapiens
gctgtggaagtctttata

SEQ ID NO: 9418248 - DNA, 22 bp, Homo sapiens
gctgtgcttgcatgagtgtctg

SEQ ID NO: 9418249 - DNA, 22 bp, Homo sapiens
gctgtctgccgcaggctgccac

SEQ ID NO: 9418250 - DNA, 22 bp, Homo sapiens
gctgtctgccgcaggctgccac

SEQ ID NO: 9418251 - DNA, 19 bp, Homo sapiens
gctgtctgatgctgaggtc

SEQ ID NO: 9418252 - DNA, 19 bp, Homo sapiens
gctgtctgatgctgaggtc

SEQ ID NO: 9418253 - DNA, 19 bp, Homo sapiens
gctgtctgatgctgaggtc

SEQ ID NO: 9418254 - DNA, 19 bp, Homo sapiens
gctgtctgatgctgaggtc

SEQ ID NO: 9418255 - DNA, 19 bp, Homo sapiens
gctgtctgatgctgaggtc

SEQ ID NO: 9418256 - DNA, 22 bp, Homo sapiens
gctgtctgccgcaggctgccac

SEQ ID NO: 9418257 - DNA, 22 bp, Homo sapiens
gctgtctgcatctctagagctt

SEQ ID NO: 9418258 - DNA, 22 bp, Homo sapiens
gctgtctgcatctctagagctt

SEQ ID NO: 9418259 - DNA, 22 bp, Homo sapiens
gctgtctgcatctctagagctt

SEQ ID NO: 9418260 - DNA, 22 bp, Homo sapiens
gctgtctgcatctctagagctt

SEQ ID NO: 9418261 - DNA, 22 bp, Homo sapiens
gctgtctgcatctctagagctt

SEQ ID NO: 9418262 - DNA, 21 bp, Homo sapiens
gctgtctctggctcctgggaa

SEQ ID NO: 9418263 - DNA, 21 bp, Homo sapiens
gctgtctctggctcctgggaa

SEQ ID NO: 9418264 - DNA, 22 bp, Homo sapiens
gctgtctcggggctttctcctg

SEQ ID NO: 9418265 - DNA, 22 bp, Homo sapiens
gctgtctcgcctgacactggct

SEQ ID NO: 9418266 - DNA, 22 bp, Homo sapiens
gctgtctcgcctgacactggct

SEQ ID NO: 9418267 - DNA, 22 bp, Homo sapiens
gctgtctgagaacatggtggaa

SEQ ID NO: 9418268 - DNA, 22 bp, Homo sapiens
gctgtctgagaacatggtggaa

SEQ ID NO: 9418269 - DNA, 22 bp, Homo sapiens
gctgtctgactccaagttggag

SEQ ID NO: 9418270 - DNA, 20 bp, Homo sapiens
gctgtctgacagttcccaga

SEQ ID NO: 9418271 - DNA, 20 bp, Homo sapiens
gctgtctgacagttcccaga

SEQ ID NO: 9418272 - DNA, 22 bp, Homo sapiens
caaggatttcactggaaagcct

SEQ ID NO: 9418273 - DNA, 22 bp, Homo sapiens
caaggattctcactagactaga

SEQ ID NO: 9418274 - DNA, 22 bp, Homo sapiens
caaggaggcagtgggacttgaa

SEQ ID NO: 9418275 - DNA, 22 bp, Homo sapiens
caaggcagaattcagactcagg

SEQ ID NO: 9418276 - DNA, 22 bp, Homo sapiens
caaggcagaattcagactcagg

SEQ ID NO: 9418277 - DNA, 22 bp, Homo sapiens
caaggcagaattcagactcagg

SEQ ID NO: 9418278 - DNA, 22 bp, Homo sapiens
caaggcagcgttcctttctgga

SEQ ID NO: 9418279 - DNA, 22 bp, Homo sapiens
caaggcagcccgctgaaccaca

SEQ ID NO: 9418280 - DNA, 22 bp, Homo sapiens
caaggcagcccgctgaaccaca

SEQ ID NO: 9418281 - DNA, 20 bp, Homo sapiens
caaggcagaccagagtgagt

SEQ ID NO: 9418282 - DNA, 20 bp, Homo sapiens
caaggcagaccagagtgagt

SEQ ID NO: 9418283 - DNA, 21 bp, Homo sapiens
gctgtctcctccttgcaccag

SEQ ID NO: 9418284 - DNA, 22 bp, Homo sapiens
gctgtctccatagctgtgtgtc

SEQ ID NO: 9418285 - DNA, 21 bp, Homo sapiens
gctgtctcctccttgcaccag

SEQ ID NO: 9418286 - DNA, 22 bp, Homo sapiens
caaggcagcgttcctttctgga

SEQ ID NO: 9418287 - DNA, 22 bp, Homo sapiens
caaggcagctattgtctccata

SEQ ID NO: 9418288 - DNA, 22 bp, Homo sapiens
caaggcagctgtagggatttgg

SEQ ID NO: 9418289 - DNA, 22 bp, Homo sapiens
caaggcagctattgtctccata

SEQ ID NO: 9418290 - DNA, 22 bp, Homo sapiens
caaggcagctattgtctccata

SEQ ID NO: 9418291 - DNA, 22 bp, Homo sapiens
cacaagtcattttcagcaggct

SEQ ID NO: 9418292 - DNA, 22 bp, Homo sapiens
cacaataaatgtttgctgatga

SEQ ID NO: 9418293 - DNA, 18 bp, Homo sapiens
cacaatagacaccgataa

SEQ ID NO: 9418294 - DNA, 22 bp, Homo sapiens
cacaataaatgtttgctgatga

SEQ ID NO: 9418295 - DNA, 22 bp, Homo sapiens
cacaatgcagcatgtaaatgca

SEQ ID NO: 9418296 - DNA, 22 bp, Homo sapiens
cacaatgtctggtaggccactt

SEQ ID NO: 9418297 - DNA, 22 bp, Homo sapiens
cacaatgtatatgtatatcaaa

SEQ ID NO: 9418298 - DNA, 22 bp, Homo sapiens
cacaatgcgtacatatatcaaa

SEQ ID NO: 9418299 - DNA, 22 bp, Homo sapiens
cacaatgcagcatgtaaatgca

SEQ ID NO: 9418300 - DNA, 22 bp, Homo sapiens
cacaatgcagcatgtaaatgca

SEQ ID NO: 9418301 - DNA, 22 bp, Homo sapiens
cacaattagcagctctttattt

SEQ ID NO: 9418302 - DNA, 22 bp, Homo sapiens
cacaattacttttgcaccaaca

SEQ ID NO: 9418303 - DNA, 22 bp, Homo sapiens
ggaaaatactgattcatgccat

SEQ ID NO: 9418304 - DNA, 19 bp, Homo sapiens
cacaacttcgcttgattcc

SEQ ID NO: 9418305 - DNA, 22 bp, Homo sapiens
cacaagggagcttagaaaacat

SEQ ID NO: 9418306 - DNA, 20 bp, Homo sapiens
ggaaaagtactcctccttaa

SEQ ID NO: 9418307 - DNA, 22 bp, Homo sapiens
ggaaaaggccacagggacacat

SEQ ID NO: 9418308 - DNA, 22 bp, Homo sapiens
ggaaaaggccacagggacacat

SEQ ID NO: 9418309 - DNA, 17 bp, Homo sapiens
ggaaaaggatgatacag

SEQ ID NO: 9418310 - DNA, 17 bp, Homo sapiens
ggaaaaggatgatacag

SEQ ID NO: 9418311 - DNA, 22 bp, Homo sapiens
ggaaaagacagaattctagaat

SEQ ID NO: 9418312 - DNA, 22 bp, Homo sapiens
ggaaaagacaggttaactgtga

SEQ ID NO: 9418313 - DNA, 18 bp, Homo sapiens
ggaaaaggagtgtctagc

SEQ ID NO: 9418314 - DNA, 22 bp, Homo sapiens
ggaaaagacaggttaactgtga

SEQ ID NO: 9418315 - DNA, 22 bp, Homo sapiens
cacaaagccctccctgcgccag

SEQ ID NO: 9418316 - DNA, 22 bp, Homo sapiens
cacaaaggagaatgtcagcata

SEQ ID NO: 9418317 - DNA, 22 bp, Homo sapiens
cacaaacatcaatcctgttttc

SEQ ID NO: 9418318 - DNA, 22 bp, Homo sapiens
cacaaacatcaatcctgttttc

SEQ ID NO: 9418319 - DNA, 22 bp, Homo sapiens
cacaaacctgccagccctgccc

SEQ ID NO: 9418320 - DNA, 22 bp, Homo sapiens
cacaaaccttctgcagcctgta

SEQ ID NO: 9418321 - DNA, 22 bp, Homo sapiens
cacaaacctgccagccctgccc

SEQ ID NO: 9418322 - DNA, 22 bp, Homo sapiens
cacaaaatctttctcgattatt

SEQ ID NO: 9418323 - DNA, 22 bp, Homo sapiens
cacaaaatctttctcgattatt

SEQ ID NO: 9418324 - DNA, 22 bp, Homo sapiens
cacaaaatatcaagcactttta

SEQ ID NO: 9418325 - DNA, 22 bp, Homo sapiens
cacaaaatatcaagcactttta

SEQ ID NO: 9418326 - DNA, 22 bp, Homo sapiens
ggaaaagacagaattctagaat

SEQ ID NO: 9418327 - DNA, 22 bp, Homo sapiens
ggaaaagacagaattctagaat

SEQ ID NO: 9418328 - DNA, 22 bp, Homo sapiens
ggaaaagaattgcagtgaagta

SEQ ID NO: 9418329 - DNA, 22 bp, Homo sapiens
ggaaaagaattgcagtgaagta

SEQ ID NO: 9418330 - DNA, 17 bp, Homo sapiens
ggaaaagaagagtagga

SEQ ID NO: 9418331 - DNA, 17 bp, Homo sapiens
ggaaaagaagagtagga

SEQ ID NO: 9418332 - DNA, 22 bp, Homo sapiens
ggaaaagaaagggactgattgg

SEQ ID NO: 9418333 - DNA, 22 bp, Homo sapiens
ggaaaagaaagggactgattgg

SEQ ID NO: 9418334 - DNA, 17 bp, Homo sapiens
ggaaaagaagagtagga

SEQ ID NO: 9418335 - DNA, 22 bp, Homo sapiens
ggaaaactgtatttgaataact

SEQ ID NO: 9418336 - DNA, 22 bp, Homo sapiens
ggaaaagaaagggactgattgg

SEQ ID NO: 9418337 - DNA, 22 bp, Homo sapiens
cacaaagtgggtggaaaactaa

SEQ ID NO: 9418338 - DNA, 22 bp, Homo sapiens
cacaaagtggcaggagaggaga

SEQ ID NO: 9418339 - DNA, 22 bp, Homo sapiens
cacaattatagaagaaagcata

SEQ ID NO: 9418340 - DNA, 22 bp, Homo sapiens
cacaattagcagctctttattt

SEQ ID NO: 9418341 - DNA, 22 bp, Homo sapiens
cacaattagcagctctttattt

SEQ ID NO: 9418342 - DNA, 22 bp, Homo sapiens
cacaattatagaagaaagcata

SEQ ID NO: 9418343 - DNA, 19 bp, Homo sapiens
cacaattatgagacactta

SEQ ID NO: 9418344 - DNA, 19 bp, Homo sapiens
cacaattatgagacactta

SEQ ID NO: 9418345 - DNA, 22 bp, Homo sapiens
cacaattattatctctttctac

SEQ ID NO: 9418346 - DNA, 22 bp, Homo sapiens
cacaattccatggcattctttg

SEQ ID NO: 9418347 - DNA, 22 bp, Homo sapiens
cacaattattatctctttctac

SEQ ID NO: 9418348 - DNA, 22 bp, Homo sapiens
cacaattctatcagaaagcaga

SEQ ID NO: 9418349 - DNA, 22 bp, Homo sapiens
cacaattattatctctttctac

SEQ ID NO: 9418350 - DNA, 22 bp, Homo sapiens
cacaatttccaagtcatgttat

SEQ ID NO: 9418351 - DNA, 22 bp, Homo sapiens
cacaatttcagttgcatgcaac

SEQ ID NO: 9418352 - DNA, 22 bp, Homo sapiens
cacaatttcagttgcatgcaac

SEQ ID NO: 9418353 - DNA, 22 bp, Homo sapiens
cacacattaatatcaaaggctc

SEQ ID NO: 9418354 - DNA, 22 bp, Homo sapiens
cacacattaatatcaaaggctc

SEQ ID NO: 9418355 - DNA, 22 bp, Homo sapiens
cacaatttgtattttgcatcca

SEQ ID NO: 9418356 - DNA, 22 bp, Homo sapiens
cacaatttccttgcttcacttt

SEQ ID NO: 9418357 - DNA, 22 bp, Homo sapiens
cacaatttggtgctaaagaaag

SEQ ID NO: 9418358 - DNA, 22 bp, Homo sapiens
cacaccagaggttacctgcaaa

SEQ ID NO: 9418359 - DNA, 21 bp, Homo sapiens
cacaccaaacaggaacaggga

SEQ ID NO: 9418360 - DNA, 22 bp, Homo sapiens
cacaccagatggcagcgtggga

SEQ ID NO: 9418361 - DNA, 21 bp, Homo sapiens
cacaccaggcatgtcttgagc

SEQ ID NO: 9418362 - DNA, 22 bp, Homo sapiens
cacacattgagcagctgtttgt

SEQ ID NO: 9418363 - DNA, 22 bp, Homo sapiens
cacacattgagcagctgtttgt

SEQ ID NO: 9418364 - DNA, 23 bp, Homo sapiens
cacacccatcactaagagctcct

SEQ ID NO: 9418365 - DNA, 22 bp, Homo sapiens
cacacccaaatttctctctcag

SEQ ID NO: 9418366 - DNA, 21 bp, Homo sapiens
cacaccaggcatgtcttgagc

SEQ ID NO: 9418367 - DNA, 22 bp, Homo sapiens
cacaccatatgattccatttag

SEQ ID NO: 9418368 - DNA, 22 bp, Homo sapiens
cacacccaaattctaacagtag

SEQ ID NO: 9418369 - DNA, 22 bp, Homo sapiens
cacacccaaattctaacagtag

SEQ ID NO: 9418370 - DNA, 22 bp, Homo sapiens
cacacccaaatttctctctcag

SEQ ID NO: 9418371 - DNA, 22 bp, Homo sapiens
cacacccaaatttctctctcag

SEQ ID NO: 9418372 - DNA, 23 bp, Homo sapiens
cacacccatcactaagagctcct

SEQ ID NO: 9418373 - DNA, 19 bp, Homo sapiens
cacacccatgcttgccaag

SEQ ID NO: 9418374 - DNA, 19 bp, Homo sapiens
cacacccatgcttgccaag

SEQ ID NO: 9418375 - DNA, 19 bp, Homo sapiens
cacacccatgcttgccaag

SEQ ID NO: 9418376 - DNA, 22 bp, Homo sapiens
cacacctcacacctcgcatgct

SEQ ID NO: 9418377 - DNA, 22 bp, Homo sapiens
cacacctgcctgccgtgtgctg

SEQ ID NO: 9418378 - DNA, 22 bp, Homo sapiens
cacacctgtaataccagctact

SEQ ID NO: 9418379 - DNA, 22 bp, Homo sapiens
cacacctgtaatcctagcactt

SEQ ID NO: 9418380 - DNA, 22 bp, Homo sapiens
cacacctgtgagtctcggcttg

SEQ ID NO: 9418381 - DNA, 22 bp, Homo sapiens
cacacctgtaatcctagcactt

SEQ ID NO: 9418382 - DNA, 23 bp, Homo sapiens
cacacctgttaagaagagtgcct

SEQ ID NO: 9418383 - DNA, 23 bp, Homo sapiens
cacacctgttaagaagagtgcct

SEQ ID NO: 9418384 - DNA, 22 bp, Homo sapiens
cacaccttaggcctgagcgctt

SEQ ID NO: 9418385 - DNA, 22 bp, Homo sapiens
caagaggcaaattgtctagaag

SEQ ID NO: 9418386 - DNA, 22 bp, Homo sapiens
caagagttgaggttcaaatggg

SEQ ID NO: 9418387 - DNA, 22 bp, Homo sapiens
caagagttgagggatgtcagtt

SEQ ID NO: 9418388 - DNA, 22 bp, Homo sapiens
caagaggagcaggcaggtgtgc

SEQ ID NO: 9418389 - DNA, 18 bp, Homo sapiens
caagagctgctcctggcc

SEQ ID NO: 9418390 - DNA, 22 bp, Homo sapiens
caagagctgggtggcaagctag

SEQ ID NO: 9418391 - DNA, 22 bp, Homo sapiens
caagatatgtgttgttagctct

SEQ ID NO: 9418392 - DNA, 22 bp, Homo sapiens
caagatactcagaaaggcattg

SEQ ID NO: 9418393 - DNA, 22 bp, Homo sapiens
caagatatatgtatgattccat

SEQ ID NO: 9418394 - DNA, 22 bp, Homo sapiens
caagatatcaatgacatagtat

SEQ ID NO: 9418395 - DNA, 22 bp, Homo sapiens
caagatcagggtgccagaatgg

SEQ ID NO: 9418396 - DNA, 22 bp, Homo sapiens
caagatcaagtgtagtatcaaa

SEQ ID NO: 9418397 - DNA, 22 bp, Homo sapiens
caagctgccaccagaagagcat

SEQ ID NO: 9418398 - DNA, 22 bp, Homo sapiens
caagatgtgcctaatcagacct

SEQ ID NO: 9418399 - DNA, 22 bp, Homo sapiens
caaggaatatttaagaacgtca

SEQ ID NO: 9418400 - DNA, 22 bp, Homo sapiens
caaggacagcgtcaggtgcaac

SEQ ID NO: 9418401 - DNA, 22 bp, Homo sapiens
caaggacactgatgttcatcct

SEQ ID NO: 9418402 - DNA, 22 bp, Homo sapiens
caaggacactgatgttcatcct

SEQ ID NO: 9418403 - DNA, 22 bp, Homo sapiens
caaggagaaaacggcttctgaa

SEQ ID NO: 9418404 - DNA, 21 bp, Homo sapiens
caaggacaggttgcagggcaa

SEQ ID NO: 9418405 - DNA, 22 bp, Homo sapiens
caaggagagtaattgaatgaga

SEQ ID NO: 9418406 - DNA, 22 bp, Homo sapiens
caaggaggaagatgcaggggac

SEQ ID NO: 9418407 - DNA, 22 bp, Homo sapiens
caaggaggaagatgcaggggac

SEQ ID NO: 9418408 - DNA, 22 bp, Homo sapiens
gctgctggcactggagtgagcc

SEQ ID NO: 9418409 - DNA, 22 bp, Homo sapiens
gctgctggcactggagtgagcc

SEQ ID NO: 9418410 - DNA, 22 bp, Homo sapiens
gctgctggcactggagtgagcc

SEQ ID NO: 9418411 - DNA, 22 bp, Homo sapiens
gctgctggcactggagtgagcc

SEQ ID NO: 9418412 - DNA, 22 bp, Homo sapiens
gctgctggagctttgcagaagg

SEQ ID NO: 9418413 - DNA, 22 bp, Homo sapiens
gctgctggagctttgcagaagg

SEQ ID NO: 9418414 - DNA, 22 bp, Homo sapiens
gctgctggagctttgcagaagg

SEQ ID NO: 9418415 - DNA, 22 bp, Homo sapiens
gctgctggagctttgcagaagg

SEQ ID NO: 9418416 - DNA, 22 bp, Homo sapiens
gctgctggatgcgcttgatggt

SEQ ID NO: 9418417 - DNA, 22 bp, Homo sapiens
gctgctggaagcatgcgatgaa

SEQ ID NO: 9418418 - DNA, 22 bp, Homo sapiens
gctgccttttgctcctcccacc

SEQ ID NO: 9418419 - DNA, 22 bp, Homo sapiens
gctgcctttgtgagccaagggg

SEQ ID NO: 9418420 - DNA, 22 bp, Homo sapiens
gctgctggagagcgagactgtt

SEQ ID NO: 9418421 - DNA, 22 bp, Homo sapiens
gctgctggagagcgagactgtt

SEQ ID NO: 9418422 - DNA, 22 bp, Homo sapiens
gctgctggagagcgagactgtt

SEQ ID NO: 9418423 - DNA, 22 bp, Homo sapiens
gctgctggagagcgagactgtt

SEQ ID NO: 9418424 - DNA, 22 bp, Homo sapiens
gctgctggccccacatgctcca

SEQ ID NO: 9418425 - DNA, 22 bp, Homo sapiens
gctgctggcatctagggggtgg

SEQ ID NO: 9418426 - DNA, 22 bp, Homo sapiens
gctgctggcatctagggggtgg

SEQ ID NO: 9418427 - DNA, 22 bp, Homo sapiens
caagagctcaccggagagcatt

SEQ ID NO: 9418428 - DNA, 22 bp, Homo sapiens
caagagctctccactaggttgg

SEQ ID NO: 9418429 - DNA, 22 bp, Homo sapiens
caagagctgaggctggagaggt

SEQ ID NO: 9418430 - DNA, 22 bp, Homo sapiens
caagagctgcaaatagcgtgac

SEQ ID NO: 9418431 - DNA, 22 bp, Homo sapiens
caagagctgcaaatagcgtgac

SEQ ID NO: 9418432 - DNA, 22 bp, Homo sapiens
gctgccttgccctcttcccata

SEQ ID NO: 9418433 - DNA, 22 bp, Homo sapiens
gctgccttgccctcttcccata

SEQ ID NO: 9418434 - DNA, 22 bp, Homo sapiens
gctgcctttgtgagccaagggg

SEQ ID NO: 9418435 - DNA, 22 bp, Homo sapiens
gctgcctttagggggtgctcag

SEQ ID NO: 9418436 - DNA, 22 bp, Homo sapiens
gctgccttctggaggaagtgaa

SEQ ID NO: 9418437 - DNA, 22 bp, Homo sapiens
gctgccttctggaggaagtgaa

SEQ ID NO: 9418438 - DNA, 22 bp, Homo sapiens
gctgccttgaacatcctaagta

SEQ ID NO: 9418439 - DNA, 22 bp, Homo sapiens
gctgccttgaacatcctaagta

SEQ ID NO: 9418440 - DNA, 22 bp, Homo sapiens
gctgccttcccggaatgtcatc

SEQ ID NO: 9418441 - DNA, 18 bp, Homo sapiens
gctgccttcccagtcaag

SEQ ID NO: 9418442 - DNA, 22 bp, Homo sapiens
caactaatcctttgaaaagaag

SEQ ID NO: 9418443 - DNA, 22 bp, Homo sapiens
caactacaggaaaagtcattca

SEQ ID NO: 9418444 - DNA, 22 bp, Homo sapiens
gctgcctgccttgcctggagga

SEQ ID NO: 9418445 - DNA, 22 bp, Homo sapiens
caactaatcctttgaaaagaag

SEQ ID NO: 9418446 - DNA, 22 bp, Homo sapiens
gctgcctgccttgcctggagga

SEQ ID NO: 9418447 - DNA, 22 bp, Homo sapiens
gctgcctgccttgcctggagga

SEQ ID NO: 9418448 - DNA, 22 bp, Homo sapiens
caaccccactacacgttggaga

SEQ ID NO: 9418449 - DNA, 22 bp, Homo sapiens
caacctcatagaaagaaaatgt

SEQ ID NO: 9418450 - DNA, 22 bp, Homo sapiens
caacctctatcggtcaggaagc

SEQ ID NO: 9418451 - DNA, 22 bp, Homo sapiens
caacctctggaaagtatggaca

SEQ ID NO: 9418452 - DNA, 22 bp, Homo sapiens
caacctctatcggtcaggaagc

SEQ ID NO: 9418453 - DNA, 22 bp, Homo sapiens
caacctgatgaattgaatttaa

SEQ ID NO: 9418454 - DNA, 22 bp, Homo sapiens
caacctgatgaattgaatttaa

SEQ ID NO: 9418455 - DNA, 22 bp, Homo sapiens
caacctgacaagactatgagta

SEQ ID NO: 9418456 - DNA, 22 bp, Homo sapiens
caacctctgtaatgttctagga

SEQ ID NO: 9418457 - DNA, 22 bp, Homo sapiens
caacctctttgggccttggttt

SEQ ID NO: 9418458 - DNA, 22 bp, Homo sapiens
gctgcagcaagccctccagggg

SEQ ID NO: 9418459 - DNA, 22 bp, Homo sapiens
gctgcagcagaagttctcagag

SEQ ID NO: 9418460 - DNA, 22 bp, Homo sapiens
gctgcagcagaagttctcagag

SEQ ID NO: 9418461 - DNA, 22 bp, Homo sapiens
gctgcagcccggcgcgcctgag

SEQ ID NO: 9418462 - DNA, 22 bp, Homo sapiens
gctgcagagatgggtgcccttt

SEQ ID NO: 9418463 - DNA, 22 bp, Homo sapiens
gctgcagagggaggggctcgca

SEQ ID NO: 9418464 - DNA, 22 bp, Homo sapiens
gctgcagagtgatgaagtgggg

SEQ ID NO: 9418465 - DNA, 19 bp, Homo sapiens
gctgcagagtattcttggg

SEQ ID NO: 9418466 - DNA, 22 bp, Homo sapiens
gctgcagatcccacccattccc

SEQ ID NO: 9418467 - DNA, 19 bp, Homo sapiens
gctcctggatgacctgtgg

SEQ ID NO: 9418468 - DNA, 20 bp, Homo sapiens
gctgaggtggaggaaggaga

SEQ ID NO: 9418469 - DNA, 20 bp, Homo sapiens
gctgaggtggaggaaggaga

SEQ ID NO: 9418470 - DNA, 22 bp, Homo sapiens
gctgaggtggaggaaggagacc

SEQ ID NO: 9418471 - DNA, 22 bp, Homo sapiens
gctgcagagacagctgccgatg

SEQ ID NO: 9418472 - DNA, 22 bp, Homo sapiens
gctgcagacttctcatctcatt

SEQ ID NO: 9418473 - DNA, 22 bp, Homo sapiens
gctgaggtggaggaaggagacc

SEQ ID NO: 9418474 - DNA, 22 bp, Homo sapiens
gctcctggagagattgagaaag

SEQ ID NO: 9418475 - DNA, 22 bp, Homo sapiens
gctcctggagagattgagaaag

SEQ ID NO: 9418476 - DNA, 18 bp, Homo sapiens
gctcctggaccaggtcac

SEQ ID NO: 9418477 - DNA, 19 bp, Homo sapiens
gctcctggatgacctgtgg

SEQ ID NO: 9418478 - DNA, 22 bp, Homo sapiens
caaagtaatttggagatatata

SEQ ID NO: 9418479 - DNA, 22 bp, Homo sapiens
caaagtaactgcctttccaatt

SEQ ID NO: 9418480 - DNA, 22 bp, Homo sapiens
caaagtaatatggtcccagtga

SEQ ID NO: 9418481 - DNA, 22 bp, Homo sapiens
caaagtaactgcctttccaatt

SEQ ID NO: 9418482 - DNA, 22 bp, Homo sapiens
caaagtaactgcctttccaatt

SEQ ID NO: 9418483 - DNA, 22 bp, Homo sapiens
caaagtaaactaccactgtttc

SEQ ID NO: 9418484 - DNA, 22 bp, Homo sapiens
caaagtaaactaccactgtttc

SEQ ID NO: 9418485 - DNA, 22 bp, Homo sapiens
caaagtaatttggagatatata

SEQ ID NO: 9418486 - DNA, 22 bp, Homo sapiens
caaagtaatttggagatatata

SEQ ID NO: 9418487 - DNA, 22 bp, Homo sapiens
caaagtaatttggagatatata

SEQ ID NO: 9418488 - DNA, 22 bp, Homo sapiens
caaagtatattggattgaatgg

SEQ ID NO: 9418489 - DNA, 22 bp, Homo sapiens
caaagtatagtgtaggatggca

SEQ ID NO: 9418490 - DNA, 22 bp, Homo sapiens
caaagtatagtgtaggatggca

SEQ ID NO: 9418491 - DNA, 22 bp, Homo sapiens
caaagtatatttcatagtctca

SEQ ID NO: 9418492 - DNA, 22 bp, Homo sapiens
caaagtatatttcatagtctca

SEQ ID NO: 9418493 - DNA, 22 bp, Homo sapiens
caaagtatattggattgaatgg

SEQ ID NO: 9418494 - DNA, 22 bp, Homo sapiens
caaagtatattggattgaatgg

SEQ ID NO: 9418495 - DNA, 22 bp, Homo sapiens
caaagtatattggattgaatgg

SEQ ID NO: 9418496 - DNA, 22 bp, Homo sapiens
gctcctgaaggctctgcagggt

SEQ ID NO: 9418497 - DNA, 22 bp, Homo sapiens
gctcctgaaggctctgcagggt

SEQ ID NO: 9418498 - DNA, 22 bp, Homo sapiens
gctcctcttatttcatcagggc

SEQ ID NO: 9418499 - DNA, 22 bp, Homo sapiens
caaagtatatttcatagtctca

SEQ ID NO: 9418500 - DNA, 22 bp, Homo sapiens
caaagtatatttcatagtctca

SEQ ID NO: 9418501 - DNA, 22 bp, Homo sapiens
caaagtatcaactcccacactg

SEQ ID NO: 9418502 - DNA, 22 bp, Homo sapiens
caaagtatgaaccagtttctct

SEQ ID NO: 9418503 - DNA, 22 bp, Homo sapiens
caaagtatcaactcccacactg

SEQ ID NO: 9418504 - DNA, 22 bp, Homo sapiens
caaagtatgaaccagtttctct

SEQ ID NO: 9418505 - DNA, 22 bp, Homo sapiens
gctcctgcaggacccaggagac

SEQ ID NO: 9418506 - DNA, 22 bp, Homo sapiens
gctgcagccttcttgccattaa

SEQ ID NO: 9418507 - DNA, 22 bp, Homo sapiens
gctgcagccctgcggatcactt

SEQ ID NO: 9418508 - DNA, 22 bp, Homo sapiens
gctgcagtgagccaagatcgtg

SEQ ID NO: 9418509 - DNA, 22 bp, Homo sapiens
gctgcagtgagccaagatcgtg

SEQ ID NO: 9418510 - DNA, 22 bp, Homo sapiens
gctgcagtgttggacctcaggg

SEQ ID NO: 9418511 - DNA, 22 bp, Homo sapiens
gctgcagtgagccaagatcgtg

SEQ ID NO: 9418512 - DNA, 22 bp, Homo sapiens
caacagtctctatagctccttg

SEQ ID NO: 9418513 - DNA, 19 bp, Homo sapiens
caacagtactggtttgtcc

SEQ ID NO: 9418514 - DNA, 22 bp, Homo sapiens
caacactgacaatggactgatt

SEQ ID NO: 9418515 - DNA, 22 bp, Homo sapiens
caacactgattatggctgagct

SEQ ID NO: 9418516 - DNA, 23 bp, Homo sapiens
gctgccacagggctcaggcaggt

SEQ ID NO: 9418517 - DNA, 22 bp, Homo sapiens
gctgccacattttcaggactaa

SEQ ID NO: 9418518 - DNA, 21 bp, Homo sapiens
gctgccaccgcgtgctccagg

SEQ ID NO: 9418519 - DNA, 21 bp, Homo sapiens
gctgccaccgcgtgctccagg

SEQ ID NO: 9418520 - DNA, 22 bp, Homo sapiens
caacatgtgttagacaatagac

SEQ ID NO: 9418521 - DNA, 22 bp, Homo sapiens
caacattatatagccacatgcc

SEQ ID NO: 9418522 - DNA, 22 bp, Homo sapiens
caacatgtgttagacaatagac

SEQ ID NO: 9418523 - DNA, 22 bp, Homo sapiens
caacattcaaccaacatttatg

SEQ ID NO: 9418524 - DNA, 22 bp, Homo sapiens
caacatttgtgatgagcaaact

SEQ ID NO: 9418525 - DNA, 22 bp, Homo sapiens
caacatttgagtaaagaaatgg

SEQ ID NO: 9418526 - DNA, 19 bp, Homo sapiens
caacagttgcaacactgtc

SEQ ID NO: 9418527 - DNA, 22 bp, Homo sapiens
caacagtttatagtgttatctt

SEQ ID NO: 9418528 - DNA, 22 bp, Homo sapiens
caacagtgttgcaatctgaaaa

SEQ ID NO: 9418529 - DNA, 22 bp, Homo sapiens
caacagtgttgcaatctgaaaa

SEQ ID NO: 9418530 - DNA, 22 bp, Homo sapiens
caacagtgattctgcatgagga

SEQ ID NO: 9418531 - DNA, 22 bp, Homo sapiens
caacagttcctccatcctctct

SEQ ID NO: 9418532 - DNA, 22 bp, Homo sapiens
caacagttcagttgagctcaac

SEQ ID NO: 9418533 - DNA, 22 bp, Homo sapiens
caacagttctcatagcagattc

SEQ ID NO: 9418534 - DNA, 22 bp, Homo sapiens
caacatatgctttcatgaggta

SEQ ID NO: 9418535 - DNA, 22 bp, Homo sapiens
caacatattttccaagagtgaa

SEQ ID NO: 9418536 - DNA, 22 bp, Homo sapiens
caacatcagtcctcatgagaca

SEQ ID NO: 9418537 - DNA, 22 bp, Homo sapiens
caacatcagtcctcatgagaca

SEQ ID NO: 9418538 - DNA, 20 bp, Homo sapiens
agtgaatttaaataatattc

SEQ ID NO: 9418539 - DNA, 20 bp, Homo sapiens
agtgaatttaaataatattc

SEQ ID NO: 9418540 - DNA, 22 bp, Homo sapiens
agtgaattctccacccagtagg

SEQ ID NO: 9418541 - DNA, 22 bp, Homo sapiens
agtgaatttaaaacactgagga

SEQ ID NO: 9418542 - DNA, 22 bp, Homo sapiens
agtgaaattgctgtaagaggaa

SEQ ID NO: 9418543 - DNA, 22 bp, Homo sapiens
ctcagtgttaaagactttccag

SEQ ID NO: 9418544 - DNA, 22 bp, Homo sapiens
ctcagtgttaaatataaggtat

SEQ ID NO: 9418545 - DNA, 22 bp, Homo sapiens
ctcagtgttaaatataaggtat

SEQ ID NO: 9418546 - DNA, 23 bp, Homo sapiens
agtgacaatgggccagaggtggc

SEQ ID NO: 9418547 - DNA, 22 bp, Homo sapiens
agtgacacggagagacagcatg

SEQ ID NO: 9418548 - DNA, 22 bp, Homo sapiens
agtgacaaggtggtaatgaagc

SEQ ID NO: 9418549 - DNA, 22 bp, Homo sapiens
agtgacaaagattctccttgtt

SEQ ID NO: 9418550 - DNA, 22 bp, Homo sapiens
agtgacaaagattctccttgtt

SEQ ID NO: 9418551 - DNA, 22 bp, Homo sapiens
agtgacaagagctaggcttttt

SEQ ID NO: 9418552 - DNA, 22 bp, Homo sapiens
agtgacaacaagttgactagaa

SEQ ID NO: 9418553 - DNA, 22 bp, Homo sapiens
agtgacaaggcctgaagctcct

SEQ ID NO: 9418554 - DNA, 22 bp, Homo sapiens
ctcagtgtgagtgagaagtgca

SEQ ID NO: 9418555 - DNA, 22 bp, Homo sapiens
ctcagtgtgagtgagaagtgca

SEQ ID NO: 9418556 - DNA, 20 bp, Homo sapiens
ctcagtgtggcctgagtgtt

SEQ ID NO: 9418557 - DNA, 20 bp, Homo sapiens
ctcagtgtggcctgagtgtt

SEQ ID NO: 9418558 - DNA, 23 bp, Homo sapiens
ctcagtgtgtgacccatggcctc

SEQ ID NO: 9418559 - DNA, 22 bp, Homo sapiens
ctcagtgtgagtgagaagtgca

SEQ ID NO: 9418560 - DNA, 22 bp, Homo sapiens
ctcagtgtgaatgctcagtaaa

SEQ ID NO: 9418561 - DNA, 22 bp, Homo sapiens
ctcagtgtcttattgtacacat

SEQ ID NO: 9418562 - DNA, 22 bp, Homo sapiens
ctcagtgtcttatttgagttct

SEQ ID NO: 9418563 - DNA, 22 bp, Homo sapiens
ctcagtgtcttattgtacacat

SEQ ID NO: 9418564 - DNA, 22 bp, Homo sapiens
ctcagtgtcttattgtacacat

SEQ ID NO: 9418565 - DNA, 22 bp, Homo sapiens
ctcagtggttgagagcctgggc

SEQ ID NO: 9418566 - DNA, 22 bp, Homo sapiens
ctcagtggttgagagcctgggc

SEQ ID NO: 9418567 - DNA, 20 bp, Homo sapiens
ctcagtgtattctgggtgct

SEQ ID NO: 9418568 - DNA, 20 bp, Homo sapiens
ctcagtgtattctgggtgct

SEQ ID NO: 9418569 - DNA, 22 bp, Homo sapiens
ctcagtgtcacgttttgcctta

SEQ ID NO: 9418570 - DNA, 22 bp, Homo sapiens
ctcagtgtctggggccccaggg

SEQ ID NO: 9418571 - DNA, 22 bp, Homo sapiens
ctcagtgtcacgttttgcctta

SEQ ID NO: 9418572 - DNA, 22 bp, Homo sapiens
ctcagtgctttggatcctggat

SEQ ID NO: 9418573 - DNA, 22 bp, Homo sapiens
ctcagtgctttggatcctggat

SEQ ID NO: 9418574 - DNA, 21 bp, Homo sapiens
agtgacagaggaaggtgcata

SEQ ID NO: 9418575 - DNA, 21 bp, Homo sapiens
agtgacagaggaaggtgcata

SEQ ID NO: 9418576 - DNA, 22 bp, Homo sapiens
agtgacagattaccggcagagc

SEQ ID NO: 9418577 - DNA, 22 bp, Homo sapiens
agtgacagccaaatccatccat

SEQ ID NO: 9418578 - DNA, 22 bp, Homo sapiens
agtgacagctgggaaggtgaaa

SEQ ID NO: 9418579 - DNA, 22 bp, Homo sapiens
agtgacagccaaatccatccat

SEQ ID NO: 9418580 - DNA, 22 bp, Homo sapiens
agtgacagggaaggataggatt

SEQ ID NO: 9418581 - DNA, 22 bp, Homo sapiens
agtgacaggggaggcaggtgtg

SEQ ID NO: 9418582 - DNA, 22 bp, Homo sapiens
agtgacaggggaggcaggtgtg

SEQ ID NO: 9418583 - DNA, 22 bp, Homo sapiens
agtgacagggaaggataggatt

SEQ ID NO: 9418584 - DNA, 22 bp, Homo sapiens
ctccagaaattcaacagcaaat

SEQ ID NO: 9418585 - DNA, 22 bp, Homo sapiens
ctccagaaatttggatgcagca

SEQ ID NO: 9418586 - DNA, 22 bp, Homo sapiens
ctccagaaatttggatgcagca

SEQ ID NO: 9418587 - DNA, 22 bp, Homo sapiens
ctccagagacacttctcatgat

SEQ ID NO: 9418588 - DNA, 22 bp, Homo sapiens
ctccagagagaaaggaggccgc

SEQ ID NO: 9418589 - DNA, 22 bp, Homo sapiens
ctccagagagaaaggaggccgc

SEQ ID NO: 9418590 - DNA, 22 bp, Homo sapiens
ctccagacagatcttctagcag

SEQ ID NO: 9418591 - DNA, 20 bp, Homo sapiens
ctccagactacagaagagcc

SEQ ID NO: 9418592 - DNA, 22 bp, Homo sapiens
ctccagagacacttctcatgat

SEQ ID NO: 9418593 - DNA, 22 bp, Homo sapiens
ctcaggccaataagctccagcc

SEQ ID NO: 9418594 - DNA, 21 bp, Homo sapiens
ctcaggcatttgaggagagtc

SEQ ID NO: 9418595 - DNA, 21 bp, Homo sapiens
ctcaggcatttgaggagagtc

SEQ ID NO: 9418596 - DNA, 22 bp, Homo sapiens
agtctctatgttcctgcaatat

SEQ ID NO: 9418597 - DNA, 22 bp, Homo sapiens
agtctccacttgacatcagcag

SEQ ID NO: 9418598 - DNA, 22 bp, Homo sapiens
agtctccacttgacatcagcag

SEQ ID NO: 9418599 - DNA, 22 bp, Homo sapiens
agtctccacttgacatcagcag

SEQ ID NO: 9418600 - DNA, 22 bp, Homo sapiens
agtctccacactggcagatgcc

SEQ ID NO: 9418601 - DNA, 22 bp, Homo sapiens
agtctccacactggcagatgcc

SEQ ID NO: 9418602 - DNA, 22 bp, Homo sapiens
agtctcatcaggcatgtagtca

SEQ ID NO: 9418603 - DNA, 22 bp, Homo sapiens
agtctcagggccacccggggaa

SEQ ID NO: 9418604 - DNA, 22 bp, Homo sapiens
agtctcaggcagaggaaggcta

SEQ ID NO: 9418605 - DNA, 22 bp, Homo sapiens
ctcagggaggcctctgctggtt

SEQ ID NO: 9418606 - DNA, 22 bp, Homo sapiens
ctcagggaggccctgggaccct

SEQ ID NO: 9418607 - DNA, 22 bp, Homo sapiens
ctcagggaggccctgggaccct

SEQ ID NO: 9418608 - DNA, 22 bp, Homo sapiens
ctcagggaggtcctgtgctgaa

SEQ ID NO: 9418609 - DNA, 22 bp, Homo sapiens
ctcagggaggcctctgctggtt

SEQ ID NO: 9418610 - DNA, 22 bp, Homo sapiens
ctcagggagagccaagagttcc

SEQ ID NO: 9418611 - DNA, 22 bp, Homo sapiens
ctcagggaggccctgggaccct

SEQ ID NO: 9418612 - DNA, 22 bp, Homo sapiens
ctcagggaggagcttctgggcc

SEQ ID NO: 9418613 - DNA, 22 bp, Homo sapiens
ctcagggaggagcttctgggcc

SEQ ID NO: 9418614 - DNA, 22 bp, Homo sapiens
ctcagggacttggatcctggcc

SEQ ID NO: 9418615 - DNA, 22 bp, Homo sapiens
ctcagggacttggatcctggcc

SEQ ID NO: 9418616 - DNA, 22 bp, Homo sapiens
ctcagggacgttagaggacagg

SEQ ID NO: 9418617 - DNA, 22 bp, Homo sapiens
ctcagggacgttagaggacagg

SEQ ID NO: 9418618 - DNA, 22 bp, Homo sapiens
ctcagggacggaggcttgcgga

SEQ ID NO: 9418619 - DNA, 22 bp, Homo sapiens
ctcagggacaaggggagacccc

SEQ ID NO: 9418620 - DNA, 22 bp, Homo sapiens
ctcagggacaaggggagacccc

SEQ ID NO: 9418621 - DNA, 18 bp, Homo sapiens
agtctcagcggaggagta

SEQ ID NO: 9418622 - DNA, 22 bp, Homo sapiens
agtctcagctacttgggaggct

SEQ ID NO: 9418623 - DNA, 22 bp, Homo sapiens
agtctcagagtacctgagggac

SEQ ID NO: 9418624 - DNA, 22 bp, Homo sapiens
agtctcagagtacctgagggac

SEQ ID NO: 9418625 - DNA, 22 bp, Homo sapiens
ctcagctgcagcctggctggca

SEQ ID NO: 9418626 - DNA, 22 bp, Homo sapiens
ctcagctgcagcctggctggca

SEQ ID NO: 9418627 - DNA, 22 bp, Homo sapiens
ctcagctctttatactagctgt

SEQ ID NO: 9418628 - DNA, 22 bp, Homo sapiens
ctcagctctgtcacttactagc

SEQ ID NO: 9418629 - DNA, 22 bp, Homo sapiens
ctcagctccaggtgtgcatctt

SEQ ID NO: 9418630 - DNA, 22 bp, Homo sapiens
ctcagctccaggtgtgcatctt

SEQ ID NO: 9418631 - DNA, 22 bp, Homo sapiens
ctcagctctgacaggaggcatc

SEQ ID NO: 9418632 - DNA, 22 bp, Homo sapiens
ctcagctccagccctcagcagc

SEQ ID NO: 9418633 - DNA, 22 bp, Homo sapiens
ctcagctccaggtgtgcatctt

SEQ ID NO: 9418634 - DNA, 22 bp, Homo sapiens
ctcagctcaaaattcacctttg

SEQ ID NO: 9418635 - DNA, 22 bp, Homo sapiens
ctcagctacgctttcaccagct

SEQ ID NO: 9418636 - DNA, 22 bp, Homo sapiens
ctcagctagtaacgtacatgtc

SEQ ID NO: 9418637 - DNA, 22 bp, Homo sapiens
ctcagcaattacctgtgtctct

SEQ ID NO: 9418638 - DNA, 22 bp, Homo sapiens
ctcagccccaatttgccctctt

SEQ ID NO: 9418639 - DNA, 22 bp, Homo sapiens
cggggtccctgcccacccatac

SEQ ID NO: 9418640 - DNA, 21 bp, Homo sapiens
agtatcataatgaatagttct

SEQ ID NO: 9418641 - DNA, 21 bp, Homo sapiens
agtatcataatgaatagttct

SEQ ID NO: 9418642 - DNA, 22 bp, Homo sapiens
agtatcatctccatttcactga

SEQ ID NO: 9418643 - DNA, 22 bp, Homo sapiens
agtatcatctccatttcactga

SEQ ID NO: 9418644 - DNA, 22 bp, Homo sapiens
agtatcatgttggaattaatca

SEQ ID NO: 9418645 - DNA, 22 bp, Homo sapiens
agtatctgcatgattttgagaa

SEQ ID NO: 9418646 - DNA, 22 bp, Homo sapiens
agtatctcaaagtggtttatgg

SEQ ID NO: 9418647 - DNA, 22 bp, Homo sapiens
agtatcattttggcattagtat

SEQ ID NO: 9418648 - DNA, 22 bp, Homo sapiens
agtatctatttcacatatggtt

SEQ ID NO: 9418649 - DNA, 21 bp, Homo sapiens
cgggtgagttgagcaggacac

SEQ ID NO: 9418650 - DNA, 22 bp, Homo sapiens
cgggttcacgccattctcctgc

SEQ ID NO: 9418651 - DNA, 22 bp, Homo sapiens
cgggttcacgccattctcctgc

SEQ ID NO: 9418652 - DNA, 22 bp, Homo sapiens
cgggttcacgccattctcctgc

SEQ ID NO: 9418653 - DNA, 22 bp, Homo sapiens
cgggttcacgccattctcctgc

SEQ ID NO: 9418654 - DNA, 23 bp, Homo sapiens
cgggttcacgccattctcctgcc

SEQ ID NO: 9418655 - DNA, 22 bp, Homo sapiens
cgggttcacgccattctcctgc

SEQ ID NO: 9418656 - DNA, 22 bp, Homo sapiens
cgggttcacgccattctcctgc

SEQ ID NO: 9418657 - DNA, 22 bp, Homo sapiens
cggggttcatccatgctgtggc

SEQ ID NO: 9418658 - DNA, 22 bp, Homo sapiens
cggggtgggaatagacctgtct

SEQ ID NO: 9418659 - DNA, 22 bp, Homo sapiens
cggggtgggaatagacctgtct

SEQ ID NO: 9418660 - DNA, 22 bp, Homo sapiens
cggggtggcactctaaatagaa

SEQ ID NO: 9418661 - DNA, 22 bp, Homo sapiens
cggggtggcactctaaatagaa

SEQ ID NO: 9418662 - DNA, 22 bp, Homo sapiens
ctcaaatatgtggtcagaaagc

SEQ ID NO: 9418663 - DNA, 22 bp, Homo sapiens
ctcaaatatgtggtcagaaagc

SEQ ID NO: 9418664 - DNA, 21 bp, Homo sapiens
ctcaaatgccagttttattta

SEQ ID NO: 9418665 - DNA, 22 bp, Homo sapiens
ctcaacatgcctactcagtctg

SEQ ID NO: 9418666 - DNA, 22 bp, Homo sapiens
ctcaacatttaacagtgaaaaa

SEQ ID NO: 9418667 - DNA, 22 bp, Homo sapiens
agtcccaacagcttacaaggaa

SEQ ID NO: 9418668 - DNA, 22 bp, Homo sapiens
agtcccagactccagttttctg

SEQ ID NO: 9418669 - DNA, 22 bp, Homo sapiens
agtcccagactccagttttctg

SEQ ID NO: 9418670 - DNA, 22 bp, Homo sapiens
ctcaagaagagggagacctaca

SEQ ID NO: 9418671 - DNA, 22 bp, Homo sapiens
ctcaagaaggatgagctattgc

SEQ ID NO: 9418672 - DNA, 23 bp, Homo sapiens
ctcaaccctagtaagggagtagg

SEQ ID NO: 9418673 - DNA, 22 bp, Homo sapiens
ctcaaatataagctaaatgtgg

SEQ ID NO: 9418674 - DNA, 22 bp, Homo sapiens
ctcaaatatgtggtcagaaagc

SEQ ID NO: 9418675 - DNA, 22 bp, Homo sapiens
ctcaaatagaactgatctataa

SEQ ID NO: 9418676 - DNA, 22 bp, Homo sapiens
ctatttatctatttctgaatga

SEQ ID NO: 9418677 - DNA, 22 bp, Homo sapiens
ctatttatgtccaagtgtttta

SEQ ID NO: 9418678 - DNA, 22 bp, Homo sapiens
ctcagcaagattaagcagcttg

SEQ ID NO: 9418679 - DNA, 22 bp, Homo sapiens
ctcagattctgaataataaaca

SEQ ID NO: 9418680 - DNA, 22 bp, Homo sapiens
ctcagagtccccacatctgggt

SEQ ID NO: 9418681 - DNA, 23 bp, Homo sapiens
ctcagaggtgtttttcacttact

SEQ ID NO: 9418682 - DNA, 22 bp, Homo sapiens
ctcagaggtcaagagcagagct

SEQ ID NO: 9418683 - DNA, 22 bp, Homo sapiens
ctcagaggtcaagagcagagct

SEQ ID NO: 9418684 - DNA, 22 bp, Homo sapiens
ctcagactggggctccctgagt

SEQ ID NO: 9418685 - DNA, 22 bp, Homo sapiens
ctcagacccccagagctgctaa

SEQ ID NO: 9418686 - DNA, 21 bp, Homo sapiens
ctcagaccacagctcacaccc

SEQ ID NO: 9418687 - DNA, 21 bp, Homo sapiens
ctcagacagggaggctctggg

SEQ ID NO: 9418688 - DNA, 18 bp, Homo sapiens
ctcagacatgcttctttt

SEQ ID NO: 9418689 - DNA, 22 bp, Homo sapiens
ctcagagggtacaggtgaaccc

SEQ ID NO: 9418690 - DNA, 22 bp, Homo sapiens
ctcagagggtctcctccagaat

SEQ ID NO: 9418691 - DNA, 22 bp, Homo sapiens
ctcagagggtacaggtgaaccc

SEQ ID NO: 9418692 - DNA, 22 bp, Homo sapiens
ctcagaggggatgcttggagaa

SEQ ID NO: 9418693 - DNA, 22 bp, Homo sapiens
ctcagagaaaaggagcaagggt

SEQ ID NO: 9418694 - DNA, 22 bp, Homo sapiens
ctcagaggggatgcttggagaa

SEQ ID NO: 9418695 - DNA, 22 bp, Homo sapiens
ctcagaggtcaagagcagagct

SEQ ID NO: 9418696 - DNA, 22 bp, Homo sapiens
ctcagaggtcaagagcagagct

SEQ ID NO: 9418697 - DNA, 22 bp, Homo sapiens
ctcagaggtcaagagcagagct

SEQ ID NO: 9418698 - DNA, 22 bp, Homo sapiens
ctcagagggttgaaggtgctct

SEQ ID NO: 9418699 - DNA, 22 bp, Homo sapiens
ctcagagggttgaaggtgctct

SEQ ID NO: 9418700 - DNA, 22 bp, Homo sapiens
ctcagacaaatgattaaggtta

SEQ ID NO: 9418701 - DNA, 22 bp, Homo sapiens
ctcagacacagccccacgaagt

SEQ ID NO: 9418702 - DNA, 22 bp, Homo sapiens
ctcagaatttagggctctgagg

SEQ ID NO: 9418703 - DNA, 22 bp, Homo sapiens
ctcagaagccttcagtcttggc

SEQ ID NO: 9418704 - DNA, 22 bp, Homo sapiens
ctcagaagttcagcctagagta

SEQ ID NO: 9418705 - DNA, 22 bp, Homo sapiens
ctcagaaatcccactctgtgta

SEQ ID NO: 9418706 - DNA, 22 bp, Homo sapiens
ctcaccatggatcttccatttc

SEQ ID NO: 9418707 - DNA, 22 bp, Homo sapiens
agtcccagatctacaggaggga

SEQ ID NO: 9418708 - DNA, 20 bp, Homo sapiens
agtcccagatcaaatttctg

SEQ ID NO: 9418709 - DNA, 22 bp, Homo sapiens
agtcccagagaggtcggggcca

SEQ ID NO: 9418710 - DNA, 22 bp, Homo sapiens
agtcccagatctccattcggtc

SEQ ID NO: 9418711 - DNA, 22 bp, Homo sapiens
agtcccagatctacaggaggga

SEQ ID NO: 9418712 - DNA, 22 bp, Homo sapiens
agtcccagatctacaggaggga

SEQ ID NO: 9418713 - DNA, 22 bp, Homo sapiens
agtcccagcctgtaggattggg

SEQ ID NO: 9418714 - DNA, 22 bp, Homo sapiens
ctcaccagacatggaacctgtc

SEQ ID NO: 9418715 - DNA, 22 bp, Homo sapiens
ctcaccagatgtcgggctgagt

SEQ ID NO: 9418716 - DNA, 20 bp, Homo sapiens
ctcaccaggtgtaggctgag

SEQ ID NO: 9418717 - DNA, 22 bp, Homo sapiens
agtcccagatgacccagctact

SEQ ID NO: 9418718 - DNA, 22 bp, Homo sapiens
agtcccagcccagtcctgtaag

SEQ ID NO: 9418719 - DNA, 22 bp, Homo sapiens
agtcccagcctaggctgtgctg

SEQ ID NO: 9418720 - DNA, 22 bp, Homo sapiens
ctcttgggatttgcaggctcag

SEQ ID NO: 9418721 - DNA, 22 bp, Homo sapiens
ctcttgggatacactgccatag

SEQ ID NO: 9418722 - DNA, 22 bp, Homo sapiens
ctcttgggagtgctctggagaa

SEQ ID NO: 9418723 - DNA, 22 bp, Homo sapiens
ctcttgggagtgctctggagaa

SEQ ID NO: 9418724 - DNA, 22 bp, Homo sapiens
ctcttgggatacactgccatag

SEQ ID NO: 9418725 - DNA, 22 bp, Homo sapiens
ctcttggccagacacagaggca

SEQ ID NO: 9418726 - DNA, 22 bp, Homo sapiens
ctcttgcttgcaagtggggata

SEQ ID NO: 9418727 - DNA, 21 bp, Homo sapiens
ctcttgtctttgctcagtagc

SEQ ID NO: 9418728 - DNA, 22 bp, Homo sapiens
ctcttggtgggtggcctgttga

SEQ ID NO: 9418729 - DNA, 22 bp, Homo sapiens
ctcttggtaagacattagaggt

SEQ ID NO: 9418730 - DNA, 19 bp, Homo sapiens
ctcttgggtggcagaggcc

SEQ ID NO: 9418731 - DNA, 22 bp, Homo sapiens
ctctttggcgttggcagagcca

SEQ ID NO: 9418732 - DNA, 22 bp, Homo sapiens
ctctttggcgttggcagagcca

SEQ ID NO: 9418733 - DNA, 16 bp, Homo sapiens
ctctttggcttccaag

SEQ ID NO: 9418734 - DNA, 22 bp, Homo sapiens
ctctttggctttgactcccatt

SEQ ID NO: 9418735 - DNA, 22 bp, Homo sapiens
ctcttgcatctgttgtattggt

SEQ ID NO: 9418736 - DNA, 22 bp, Homo sapiens
ctcttgcatgagatccaggagt

SEQ ID NO: 9418737 - DNA, 22 bp, Homo sapiens
ctcttgaactttctagtttcat

SEQ ID NO: 9418738 - DNA, 22 bp, Homo sapiens
ctcttgaaaattggaacacaga

SEQ ID NO: 9418739 - DNA, 22 bp, Homo sapiens
ctcttgccagagatgagactct

SEQ ID NO: 9418740 - DNA, 22 bp, Homo sapiens
ctcttgcattctatccctccag

SEQ ID NO: 9418741 - DNA, 22 bp, Homo sapiens
ctcttgctgtcaaagcagggta

SEQ ID NO: 9418742 - DNA, 20 bp, Homo sapiens
ctcttagtactgttcctggt

SEQ ID NO: 9418743 - DNA, 22 bp, Homo sapiens
ctcttagtgcatctcattagtt

SEQ ID NO: 9418744 - DNA, 22 bp, Homo sapiens
ctcttagtaatgccatgaagca

SEQ ID NO: 9418745 - DNA, 22 bp, Homo sapiens
ctcttcttgtctctggttagaa

SEQ ID NO: 9418746 - DNA, 22 bp, Homo sapiens
agtggtctccccagtagaataa

SEQ ID NO: 9418747 - DNA, 22 bp, Homo sapiens
ctctgtgagggtctgtacagaa

SEQ ID NO: 9418748 - DNA, 22 bp, Homo sapiens
agtggtctgggctaaatgaggt

SEQ ID NO: 9418749 - DNA, 22 bp, Homo sapiens
agtggtctgcctgcctcagcct

SEQ ID NO: 9418750 - DNA, 22 bp, Homo sapiens
ctctgtgaacccctcctttctt

SEQ ID NO: 9418751 - DNA, 22 bp, Homo sapiens
ctctgtcccagacccacctctc

SEQ ID NO: 9418752 - DNA, 22 bp, Homo sapiens
ctctgtcctatgcttgatagaa

SEQ ID NO: 9418753 - DNA, 22 bp, Homo sapiens
agtggtggagccaggaaatgtg

SEQ ID NO: 9418754 - DNA, 22 bp, Homo sapiens
agtggtggagccaggaaatgtg

SEQ ID NO: 9418755 - DNA, 21 bp, Homo sapiens
agtggtctttttcacccagtg

SEQ ID NO: 9418756 - DNA, 22 bp, Homo sapiens
agtggtgagacctggtgctttc

SEQ ID NO: 9418757 - DNA, 22 bp, Homo sapiens
agtggtgcaaactggggcagct

SEQ ID NO: 9418758 - DNA, 22 bp, Homo sapiens
agtggtgccattaaaatcattg

SEQ ID NO: 9418759 - DNA, 22 bp, Homo sapiens
agtggtgagacctggtgctttc

SEQ ID NO: 9418760 - DNA, 22 bp, Homo sapiens
agtggtggagagatgaggacac

SEQ ID NO: 9418761 - DNA, 22 bp, Homo sapiens
agtggtgctgcgcgcggagctc

SEQ ID NO: 9418762 - DNA, 22 bp, Homo sapiens
agtggtgcccacctgagcctga

SEQ ID NO: 9418763 - DNA, 22 bp, Homo sapiens
agtggtgctaggtggaatatag

SEQ ID NO: 9418764 - DNA, 22 bp, Homo sapiens
ctctggaccctcctgctgagag

SEQ ID NO: 9418765 - DNA, 22 bp, Homo sapiens
ctctggacagccctccaggaag

SEQ ID NO: 9418766 - DNA, 22 bp, Homo sapiens
ctctggacagcaggtgctgtgg

SEQ ID NO: 9418767 - DNA, 19 bp, Homo sapiens
ctctggagaacaatagtgc

SEQ ID NO: 9418768 - DNA, 22 bp, Homo sapiens
ctctggaccctcctgctgagag

SEQ ID NO: 9418769 - DNA, 22 bp, Homo sapiens
ctctggacctcagctacagact

SEQ ID NO: 9418770 - DNA, 20 bp, Homo sapiens
ctctctccatctcagtggcc

SEQ ID NO: 9418771 - DNA, 19 bp, Homo sapiens
ctctctccagtggctggct

SEQ ID NO: 9418772 - DNA, 19 bp, Homo sapiens
ctctctccagtggctggct

SEQ ID NO: 9418773 - DNA, 19 bp, Homo sapiens
ctctggagaacaatagtgc

SEQ ID NO: 9418774 - DNA, 19 bp, Homo sapiens
ctctggagaacaatagtgc

SEQ ID NO: 9418775 - DNA, 22 bp, Homo sapiens
ctctggagaacgctatggatct

SEQ ID NO: 9418776 - DNA, 22 bp, Homo sapiens
ctctggagaacgctatggatct

SEQ ID NO: 9418777 - DNA, 22 bp, Homo sapiens
ctctggagaacgctatggatct

SEQ ID NO: 9418778 - DNA, 22 bp, Homo sapiens
ctctggagaacgctatggatct

SEQ ID NO: 9418779 - DNA, 22 bp, Homo sapiens
ctctggagaacgctatggatct

SEQ ID NO: 9418780 - DNA, 22 bp, Homo sapiens
ctctggagaactccttgtgtct

SEQ ID NO: 9418781 - DNA, 22 bp, Homo sapiens
ctctggagaggttcccatggga

SEQ ID NO: 9418782 - DNA, 22 bp, Homo sapiens
ctctggagaggttcccatggga

SEQ ID NO: 9418783 - DNA, 22 bp, Homo sapiens
ctctggagaggttcccatggga

SEQ ID NO: 9418784 - DNA, 22 bp, Homo sapiens
ctctggagaggttcccatggga

SEQ ID NO: 9418785 - DNA, 22 bp, Homo sapiens
agtggctgtcttccaaaatctg

SEQ ID NO: 9418786 - DNA, 22 bp, Homo sapiens
agtggctgtgaaatacatggga

SEQ ID NO: 9418787 - DNA, 22 bp, Homo sapiens
ctctggagatggttctcaattg

SEQ ID NO: 9418788 - DNA, 22 bp, Homo sapiens
ctctggagatggttctcaattg

SEQ ID NO: 9418789 - DNA, 22 bp, Homo sapiens
ctctggagcaccgggctatcca

SEQ ID NO: 9418790 - DNA, 22 bp, Homo sapiens
ctctggagcaccgggctatcca

SEQ ID NO: 9418791 - DNA, 22 bp, Homo sapiens
ctctggagatggttctcaattg

SEQ ID NO: 9418792 - DNA, 23 bp, Homo sapiens
ctctggagatcctctgcctgggt

SEQ ID NO: 9418793 - DNA, 23 bp, Homo sapiens
ctctggagatcctctgcctgggt

SEQ ID NO: 9418794 - DNA, 23 bp, Homo sapiens
ctctggagatcctctgcctgggt

SEQ ID NO: 9418795 - DNA, 23 bp, Homo sapiens
ctctggagatcctctgcctgggt

SEQ ID NO: 9418796 - DNA, 22 bp, Homo sapiens
ctctggagaggttcccatggga

SEQ ID NO: 9418797 - DNA, 22 bp, Homo sapiens
ctctgtatgggatttactggtt

SEQ ID NO: 9418798 - DNA, 22 bp, Homo sapiens
ctctgtatagaaaggaaacatt

SEQ ID NO: 9418799 - DNA, 22 bp, Homo sapiens
ctctgtatgaatcatatggagt

SEQ ID NO: 9418800 - DNA, 22 bp, Homo sapiens
ctctggtttttcttccattaag

SEQ ID NO: 9418801 - DNA, 22 bp, Homo sapiens
ctctgtacctggcatagcaacc

SEQ ID NO: 9418802 - DNA, 15 bp, Homo sapiens
ctctggtttttcttc

SEQ ID NO: 9418803 - DNA, 21 bp, Homo sapiens
ctctggtttgcattggattat

SEQ ID NO: 9418804 - DNA, 22 bp, Homo sapiens
ctctggtttctgacctgaattt

SEQ ID NO: 9418805 - DNA, 22 bp, Homo sapiens
ctctggggttagatctgatgct

SEQ ID NO: 9418806 - DNA, 22 bp, Homo sapiens
ctctggggttagatctgatgct

SEQ ID NO: 9418807 - DNA, 22 bp, Homo sapiens
ctctggggttaagcttccatgg

SEQ ID NO: 9418808 - DNA, 22 bp, Homo sapiens
agtgggagaatgaataagggcc

SEQ ID NO: 9418809 - DNA, 22 bp, Homo sapiens
agtggctgtttataggtgggta

SEQ ID NO: 9418810 - DNA, 22 bp, Homo sapiens
agtggcttatctgggacagcta

SEQ ID NO: 9418811 - DNA, 22 bp, Homo sapiens
agtggcttcatttctgccagaa

SEQ ID NO: 9418812 - DNA, 22 bp, Homo sapiens
agtggctgttcattttacacaa

SEQ ID NO: 9418813 - DNA, 22 bp, Homo sapiens
agtggctgtgaaatacatggga

SEQ ID NO: 9418814 - DNA, 22 bp, Homo sapiens
agtggctgttccaggtgaggac

SEQ ID NO: 9418815 - DNA, 22 bp, Homo sapiens
agtggcttttcttgcttctggc

SEQ ID NO: 9418816 - DNA, 22 bp, Homo sapiens
agtggcttggctgcactacagg

SEQ ID NO: 9418817 - DNA, 22 bp, Homo sapiens
agtggcttgctctgcctcagcc

SEQ ID NO: 9418818 - DNA, 18 bp, Homo sapiens
agtggcttcctgctcata

SEQ ID NO: 9418819 - DNA, 22 bp, Homo sapiens
agtggcttccttcataagcttt

SEQ ID NO: 9418820 - DNA, 22 bp, Homo sapiens
agtggcttatgtttagaatcat

SEQ ID NO: 9418821 - DNA, 22 bp, Homo sapiens
agtgggaccggtgctattccag

SEQ ID NO: 9418822 - DNA, 22 bp, Homo sapiens
agtgggaatttcagtgctaaaa

SEQ ID NO: 9418823 - DNA, 22 bp, Homo sapiens
ctcctgagggatgcttaggctt

SEQ ID NO: 9418824 - DNA, 22 bp, Homo sapiens
ctcctgaggacttctattgggt

SEQ ID NO: 9418825 - DNA, 22 bp, Homo sapiens
ctcctgaggacttctattgggt

SEQ ID NO: 9418826 - DNA, 22 bp, Homo sapiens
ctcctgagggatgcttaggctt

SEQ ID NO: 9418827 - DNA, 22 bp, Homo sapiens
ctcctgagggatgcttaggctt

SEQ ID NO: 9418828 - DNA, 22 bp, Homo sapiens
ctcctgagggatgcttaggctt

SEQ ID NO: 9418829 - DNA, 22 bp, Homo sapiens
ctcctgagctgcagccttgtgt

SEQ ID NO: 9418830 - DNA, 22 bp, Homo sapiens
ctcctgaggaaaagcttggtca

SEQ ID NO: 9418831 - DNA, 22 bp, Homo sapiens
ctcctgaggaaaagcttggtca

SEQ ID NO: 9418832 - DNA, 22 bp, Homo sapiens
agtgctggattacaggcgtgag

SEQ ID NO: 9418833 - DNA, 22 bp, Homo sapiens
agtgctggagggaggcaggttc

SEQ ID NO: 9418834 - DNA, 22 bp, Homo sapiens
agtgctggagggaggcaggttc

SEQ ID NO: 9418835 - DNA, 22 bp, Homo sapiens
agtgctggattacaggcgtgag

SEQ ID NO: 9418836 - DNA, 22 bp, Homo sapiens
agtgctggattacaggcgtgag

SEQ ID NO: 9418837 - DNA, 22 bp, Homo sapiens
agtgctggattacaggcgtgag

SEQ ID NO: 9418838 - DNA, 23 bp, Homo sapiens
agtgctggagaagcttctggctt

SEQ ID NO: 9418839 - DNA, 22 bp, Homo sapiens
agtgctggaaagggacggagga

SEQ ID NO: 9418840 - DNA, 22 bp, Homo sapiens
agtgctggagggaggcaggttc

SEQ ID NO: 9418841 - DNA, 23 bp, Homo sapiens
agtgctggagaagcttctggctt

SEQ ID NO: 9418842 - DNA, 22 bp, Homo sapiens
agtgctggaaagggacggagga

SEQ ID NO: 9418843 - DNA, 22 bp, Homo sapiens
agtgctgaggccatactccata

SEQ ID NO: 9418844 - DNA, 22 bp, Homo sapiens
agtgctgactctgggcacagtg

SEQ ID NO: 9418845 - DNA, 22 bp, Homo sapiens
agtgctatcgagttctaatgct

SEQ ID NO: 9418846 - DNA, 22 bp, Homo sapiens
agtgctatcgagttctaatgct

SEQ ID NO: 9418847 - DNA, 22 bp, Homo sapiens
ctcctgcaggtcagcaggcttg

SEQ ID NO: 9418848 - DNA, 22 bp, Homo sapiens
ctcctgcatgctcacatatgcc

SEQ ID NO: 9418849 - DNA, 22 bp, Homo sapiens
ctcctgccaccgcggtgtcctg

SEQ ID NO: 9418850 - DNA, 22 bp, Homo sapiens
ctcctgcatggttgtgctattg

SEQ ID NO: 9418851 - DNA, 22 bp, Homo sapiens
ctcctggttcagagagctgaga

SEQ ID NO: 9418852 - DNA, 22 bp, Homo sapiens
ctcctgaggggacaggactcat

SEQ ID NO: 9418853 - DNA, 22 bp, Homo sapiens
ctcctgaggggacaggactcat

SEQ ID NO: 9418854 - DNA, 22 bp, Homo sapiens
ctcctgaggggacaggactcat

SEQ ID NO: 9418855 - DNA, 22 bp, Homo sapiens
ctcctgaggggacaggactcat

SEQ ID NO: 9418856 - DNA, 22 bp, Homo sapiens
ctcctgaggggacaggactcat

SEQ ID NO: 9418857 - DNA, 22 bp, Homo sapiens
ctcctgagtagtagcattgtca

SEQ ID NO: 9418858 - DNA, 22 bp, Homo sapiens
ctcctgagtctccacgccccgt

SEQ ID NO: 9418859 - DNA, 22 bp, Homo sapiens
ctcctgagtctccacgccccgt

SEQ ID NO: 9418860 - DNA, 22 bp, Homo sapiens
ctcctgcaagcctccccaagca

SEQ ID NO: 9418861 - DNA, 22 bp, Homo sapiens
ctcctgcaagcctccccaagca

SEQ ID NO: 9418862 - DNA, 22 bp, Homo sapiens
ctcgcaggacagtgctaggact

SEQ ID NO: 9418863 - DNA, 22 bp, Homo sapiens
ctcgcctgcctgtgtctctccc

SEQ ID NO: 9418864 - DNA, 22 bp, Homo sapiens
ctcggagatgctggctgagatc

SEQ ID NO: 9418865 - DNA, 22 bp, Homo sapiens
ctcgccccggcacagtgtccgt

SEQ ID NO: 9418866 - DNA, 23 bp, Homo sapiens
ctccttggtatgccatgcccagc

SEQ ID NO: 9418867 - DNA, 18 bp, Homo sapiens
ctcctttccctacacctc

SEQ ID NO: 9418868 - DNA, 22 bp, Homo sapiens
ctctctcagtgtaatacaggat

SEQ ID NO: 9418869 - DNA, 22 bp, Homo sapiens
ctctctcagtgtaatacaggat

SEQ ID NO: 9418870 - DNA, 22 bp, Homo sapiens
ctctctagaggcccaccttgag

SEQ ID NO: 9418871 - DNA, 22 bp, Homo sapiens
ctctctagaggcccaccttgag

SEQ ID NO: 9418872 - DNA, 22 bp, Homo sapiens
ctctcgccagcggggctgcgct

SEQ ID NO: 9418873 - DNA, 22 bp, Homo sapiens
ctctcgccagcggggctgcgct

SEQ ID NO: 9418874 - DNA, 22 bp, Homo sapiens
ctctccttgcagatggctgcct

SEQ ID NO: 9418875 - DNA, 20 bp, Homo sapiens
ctctcccagcacagcttcct

SEQ ID NO: 9418876 - DNA, 20 bp, Homo sapiens
ctctcccagcacagcttcct

SEQ ID NO: 9418877 - DNA, 22 bp, Homo sapiens
ctctcccagtcaggctcaggat

SEQ ID NO: 9418878 - DNA, 22 bp, Homo sapiens
ctctcccagtcaggctcaggat

SEQ ID NO: 9418879 - DNA, 20 bp, Homo sapiens
ctctcccagcacagcttcct

SEQ ID NO: 9418880 - DNA, 22 bp, Homo sapiens
ctctcccagtcaggctcaggat

SEQ ID NO: 9418881 - DNA, 22 bp, Homo sapiens
ctctccccacaccctctgcatg

SEQ ID NO: 9418882 - DNA, 22 bp, Homo sapiens
ctctccccacaccctctgcatg

SEQ ID NO: 9418883 - DNA, 22 bp, Homo sapiens
ctctcccagtcaggctcaggat

SEQ ID NO: 9418884 - DNA, 22 bp, Homo sapiens
ctctcccagtcaggctcaggat

SEQ ID NO: 9418885 - DNA, 22 bp, Homo sapiens
ctctccccacaccctctgcatg

SEQ ID NO: 9418886 - DNA, 22 bp, Homo sapiens
ctctccccacaccctctgcatg

SEQ ID NO: 9418887 - DNA, 22 bp, Homo sapiens
ctctccccacaccctctgcatg

SEQ ID NO: 9418888 - DNA, 17 bp, Homo sapiens
ctctccttcctctgagg

SEQ ID NO: 9418889 - DNA, 22 bp, Homo sapiens
ctctccccacaccctctgcatg

SEQ ID NO: 9418890 - DNA, 22 bp, Homo sapiens
ctcggcaggtggaggttgtagt

SEQ ID NO: 9418891 - DNA, 22 bp, Homo sapiens
ctcgggcaccctggttctggtg

SEQ ID NO: 9418892 - DNA, 22 bp, Homo sapiens
ctcggcaggtggaggttgtagt

SEQ ID NO: 9418893 - DNA, 22 bp, Homo sapiens
agtgctggcccatagctgctgg

SEQ ID NO: 9418894 - DNA, 22 bp, Homo sapiens
ctcgggcaccctggttctggtg

SEQ ID NO: 9418895 - DNA, 22 bp, Homo sapiens
agtgctggcccatagctgctgg

SEQ ID NO: 9418896 - DNA, 22 bp, Homo sapiens
agtgctggcccatagctgctgg

SEQ ID NO: 9418897 - DNA, 22 bp, Homo sapiens
agtgctggcccatagctgctgg

SEQ ID NO: 9418898 - DNA, 22 bp, Homo sapiens
agtgctggcccatagctgctgg

SEQ ID NO: 9418899 - DNA, 22 bp, Homo sapiens
agtgctgggattacaggcataa

SEQ ID NO: 9418900 - DNA, 22 bp, Homo sapiens
agtgctgggattacaggcataa

SEQ ID NO: 9418901 - DNA, 22 bp, Homo sapiens
agtgctgggattacaggcataa

SEQ ID NO: 9418902 - DNA, 22 bp, Homo sapiens
agtgctgggattgcaggcatga

SEQ ID NO: 9418903 - DNA, 22 bp, Homo sapiens
agtgctgggattgcaggcatga

SEQ ID NO: 9418904 - DNA, 22 bp, Homo sapiens
agtgctgggattgcaggcatga

SEQ ID NO: 9418905 - DNA, 22 bp, Homo sapiens
agtgctgggattacaggcataa

SEQ ID NO: 9418906 - DNA, 22 bp, Homo sapiens
agtgctgggattacaggcataa

SEQ ID NO: 9418907 - DNA, 22 bp, Homo sapiens
agtgctgggctatctactgcta

SEQ ID NO: 9418908 - DNA, 22 bp, Homo sapiens
ctctccaagttatcaagatgaa

SEQ ID NO: 9418909 - DNA, 22 bp, Homo sapiens
agtgctgggattgcaggcatga

SEQ ID NO: 9418910 - DNA, 22 bp, Homo sapiens
agtgctgggctatctactgcta

SEQ ID NO: 9418911 - DNA, 22 bp, Homo sapiens
agtgctgggattgcaggcatga

SEQ ID NO: 9418912 - DNA, 22 bp, Homo sapiens
ctctccatctgtgtgacctccc

SEQ ID NO: 9418913 - DNA, 23 bp, Homo sapiens
ctctccaccttcccacccaggga

SEQ ID NO: 9418914 - DNA, 22 bp, Homo sapiens
ctctccagttatagctgatttg

SEQ ID NO: 9418915 - DNA, 23 bp, Homo sapiens
ctctccaccttcccacccaggga

SEQ ID NO: 9418916 - DNA, 22 bp, Homo sapiens
ctctccattccctacagttttc

SEQ ID NO: 9418917 - DNA, 22 bp, Homo sapiens
ctctccattccctacagttttc

SEQ ID NO: 9418918 - DNA, 22 bp, Homo sapiens
ctctccattccctacagttttc

SEQ ID NO: 9418919 - DNA, 22 bp, Homo sapiens
cggcccgctgcgagtgcaccgt

SEQ ID NO: 9418920 - DNA, 22 bp, Homo sapiens
cggccaggcacagtggcccacg

SEQ ID NO: 9418921 - DNA, 22 bp, Homo sapiens
cggccaagccggggccccgaag

SEQ ID NO: 9418922 - DNA, 22 bp, Homo sapiens
cggccaagccggggccccgaag

SEQ ID NO: 9418923 - DNA, 22 bp, Homo sapiens
cggccaagccggggccccgaag

SEQ ID NO: 9418924 - DNA, 22 bp, Homo sapiens
cggccaagccggggccccgaag

SEQ ID NO: 9418925 - DNA, 22 bp, Homo sapiens
cggcatgggcgtccccctcact

SEQ ID NO: 9418926 - DNA, 22 bp, Homo sapiens
cggcatgggcgtccccctcact

SEQ ID NO: 9418927 - DNA, 22 bp, Homo sapiens
cggcatgggcgtccccctcact

SEQ ID NO: 9418928 - DNA, 22 bp, Homo sapiens
cggaggggtttgaacagaggag

SEQ ID NO: 9418929 - DNA, 22 bp, Homo sapiens
cggaggggtttgaacagaggag

SEQ ID NO: 9418930 - DNA, 22 bp, Homo sapiens
cggaggggtttgaacagaggag

SEQ ID NO: 9418931 - DNA, 22 bp, Homo sapiens
cggaggggatacattttctgaa

SEQ ID NO: 9418932 - DNA, 22 bp, Homo sapiens
cggaggggatacattttctgaa

SEQ ID NO: 9418933 - DNA, 22 bp, Homo sapiens
cggaggggatacattttctgaa

SEQ ID NO: 9418934 - DNA, 22 bp, Homo sapiens
cggagctggcgtctgtgtggac

SEQ ID NO: 9418935 - DNA, 22 bp, Homo sapiens
cggagctggcgtctgtgtggac

SEQ ID NO: 9418936 - DNA, 22 bp, Homo sapiens
cggagctgcgccgggacacggg

SEQ ID NO: 9418937 - DNA, 22 bp, Homo sapiens
cggagctgcctgccaagcctgc

SEQ ID NO: 9418938 - DNA, 22 bp, Homo sapiens
cggagctggcgtctgtgtggac

SEQ ID NO: 9418939 - DNA, 21 bp, Homo sapiens
cggagctgggcagggcatccc

SEQ ID NO: 9418940 - DNA, 21 bp, Homo sapiens
cggagctgggcagggcatccc

SEQ ID NO: 9418941 - DNA, 21 bp, Homo sapiens
cggagctgggcagggcatccc

SEQ ID NO: 9418942 - DNA, 22 bp, Homo sapiens
cggagaggtgggggcagcatct

SEQ ID NO: 9418943 - DNA, 22 bp, Homo sapiens
cggagcagaaggcgccgccggc

SEQ ID NO: 9418944 - DNA, 21 bp, Homo sapiens
cgctccaccccacccactggc

SEQ ID NO: 9418945 - DNA, 22 bp, Homo sapiens
cgctccaagcttgatgggacca

SEQ ID NO: 9418946 - DNA, 22 bp, Homo sapiens
cggagcagagccactcgggccg

SEQ ID NO: 9418947 - DNA, 22 bp, Homo sapiens
cggccgcagcagtgtcggccca

SEQ ID NO: 9418948 - DNA, 22 bp, Homo sapiens
cggccctggcggaggcgggaga

SEQ ID NO: 9418949 - DNA, 22 bp, Homo sapiens
cggccctgaccagaccttagtt

SEQ ID NO: 9418950 - DNA, 22 bp, Homo sapiens
cggccctgctgagcttgtctgg

SEQ ID NO: 9418951 - DNA, 22 bp, Homo sapiens
cggccttctccctgggcatcac

SEQ ID NO: 9418952 - DNA, 22 bp, Homo sapiens
cggctcagacttcccaagaaca

SEQ ID NO: 9418953 - DNA, 22 bp, Homo sapiens
cggctcactgcagctccgcctc

SEQ ID NO: 9418954 - DNA, 22 bp, Homo sapiens
cggctcactgcagctccgcctc

SEQ ID NO: 9418955 - DNA, 22 bp, Homo sapiens
cggctcactgcagctccgcctc

SEQ ID NO: 9418956 - DNA, 22 bp, Homo sapiens
cggctcactgcagctccgcctc

SEQ ID NO: 9418957 - DNA, 22 bp, Homo sapiens
cggctcactgcagctccgcctc

SEQ ID NO: 9418958 - DNA, 22 bp, Homo sapiens
agtagtcagcagataatatagg

SEQ ID NO: 9418959 - DNA, 22 bp, Homo sapiens
agtagtcacttctattaatggc

SEQ ID NO: 9418960 - DNA, 22 bp, Homo sapiens
agtagtcacttctattaatggc

SEQ ID NO: 9418961 - DNA, 22 bp, Homo sapiens
agtagtcacttcacccatccca

SEQ ID NO: 9418962 - DNA, 22 bp, Homo sapiens
agtagtattctacagagggtgc

SEQ ID NO: 9418963 - DNA, 21 bp, Homo sapiens
agtagtatcctggagggacaa

SEQ ID NO: 9418964 - DNA, 22 bp, Homo sapiens
agtatatcacatgtagtaatgg

SEQ ID NO: 9418965 - DNA, 22 bp, Homo sapiens
agtatatttgttaagattattc

SEQ ID NO: 9418966 - DNA, 22 bp, Homo sapiens
agtatattgctcttaatcatag

SEQ ID NO: 9418967 - DNA, 20 bp, Homo sapiens
cgaggccaaggggctgggcc

SEQ ID NO: 9418968 - DNA, 22 bp, Homo sapiens
cgaggcagggaagctgcaaaag

SEQ ID NO: 9418969 - DNA, 22 bp, Homo sapiens
cgaggccacacctgcttctggg

SEQ ID NO: 9418970 - DNA, 22 bp, Homo sapiens
cgaggccacacctgcttctggg

SEQ ID NO: 9418971 - DNA, 22 bp, Homo sapiens
cgaggccaatgtgttttatgaa

SEQ ID NO: 9418972 - DNA, 22 bp, Homo sapiens
cgaggccaccgtggtttccgag

SEQ ID NO: 9418973 - DNA, 22 bp, Homo sapiens
cgaggcaatagagcccagaggt

SEQ ID NO: 9418974 - DNA, 22 bp, Homo sapiens
ccttttatgaacttgagcaggt

SEQ ID NO: 9418975 - DNA, 22 bp, Homo sapiens
ccttttatgaacttgagcaggt

SEQ ID NO: 9418976 - DNA, 22 bp, Homo sapiens
ccttttatatggctcatcacag

SEQ ID NO: 9418977 - DNA, 22 bp, Homo sapiens
ccttttatagatcagtgtgtta

SEQ ID NO: 9418978 - DNA, 22 bp, Homo sapiens
ccttttatagatcagtgtgtta

SEQ ID NO: 9418979 - DNA, 22 bp, Homo sapiens
ccttttatatggctcatcacag

SEQ ID NO: 9418980 - DNA, 22 bp, Homo sapiens
ccttttatatggctcatcacag

SEQ ID NO: 9418981 - DNA, 22 bp, Homo sapiens
ccttttatactctgtcctctgg

SEQ ID NO: 9418982 - DNA, 22 bp, Homo sapiens
ccttttatactctgtcctctgg

SEQ ID NO: 9418983 - DNA, 22 bp, Homo sapiens
ccttttatactctgtcctctgg

SEQ ID NO: 9418984 - DNA, 22 bp, Homo sapiens
ccttttatactcagtgatatca

SEQ ID NO: 9418985 - DNA, 22 bp, Homo sapiens
ccttttatactcagtgatatca

SEQ ID NO: 9418986 - DNA, 22 bp, Homo sapiens
ccttttataaagttgtattgaa

SEQ ID NO: 9418987 - DNA, 22 bp, Homo sapiens
ccttttataaagttgtattgaa

SEQ ID NO: 9418988 - DNA, 22 bp, Homo sapiens
ccttttcccatgtttctggagc

SEQ ID NO: 9418989 - DNA, 22 bp, Homo sapiens
cgaggaaatatttacaactgat

SEQ ID NO: 9418990 - DNA, 22 bp, Homo sapiens
cgaggaaaggcgatggctctcg

SEQ ID NO: 9418991 - DNA, 22 bp, Homo sapiens
cgaggaaaggcgatggctctcg

SEQ ID NO: 9418992 - DNA, 22 bp, Homo sapiens
cgaggaaatatttacaactgat

SEQ ID NO: 9418993 - DNA, 22 bp, Homo sapiens
cgaggaggaaacgcggagaact

SEQ ID NO: 9418994 - DNA, 22 bp, Homo sapiens
cctttggtcttgatgaactgtt

SEQ ID NO: 9418995 - DNA, 22 bp, Homo sapiens
ccttttaagggagactagagat

SEQ ID NO: 9418996 - DNA, 22 bp, Homo sapiens
ccttttataaagttgtattgaa

SEQ ID NO: 9418997 - DNA, 22 bp, Homo sapiens
cctttgttcattgccttcagtc

SEQ ID NO: 9418998 - DNA, 22 bp, Homo sapiens
ccttttaagggagactagagat

SEQ ID NO: 9418999 - DNA, 22 bp, Homo sapiens
cctttgtgaatatgcagaaaat

SEQ ID NO: 9419000 - DNA, 22 bp, Homo sapiens
aggtggggtgagctgcagacta

SEQ ID NO: 9419001 - DNA, 22 bp, Homo sapiens
aggtggggtgagctgcagacta

SEQ ID NO: 9419002 - DNA, 22 bp, Homo sapiens
aggtggggtgagctgcagacta

SEQ ID NO: 9419003 - DNA, 22 bp, Homo sapiens
aggtggggtgttggatgtttat

SEQ ID NO: 9419004 - DNA, 22 bp, Homo sapiens
cctttattcaattagtcctaat

SEQ ID NO: 9419005 - DNA, 22 bp, Homo sapiens
aggtggggtgttggatgtttat

SEQ ID NO: 9419006 - DNA, 22 bp, Homo sapiens
aggtggggtgttggatgtttat

SEQ ID NO: 9419007 - DNA, 22 bp, Homo sapiens
aggtggggtgagctgcagacta

SEQ ID NO: 9419008 - DNA, 22 bp, Homo sapiens
aggtgggggctgtgtccttgac

SEQ ID NO: 9419009 - DNA, 22 bp, Homo sapiens
aggtgggggctgtgtccttgac

SEQ ID NO: 9419010 - DNA, 22 bp, Homo sapiens
aggtgggggctgtgtccttgac

SEQ ID NO: 9419011 - DNA, 22 bp, Homo sapiens
aggtgggggctgtgtccttgac

SEQ ID NO: 9419012 - DNA, 22 bp, Homo sapiens
aggtgggggctgtgtccttgac

SEQ ID NO: 9419013 - DNA, 22 bp, Homo sapiens
aggtgggggctgtgtccttgac

SEQ ID NO: 9419014 - DNA, 22 bp, Homo sapiens
aggtgctgccccgagaaggatg

SEQ ID NO: 9419015 - DNA, 17 bp, Homo sapiens
aggtgctggagcatcag

SEQ ID NO: 9419016 - DNA, 22 bp, Homo sapiens
aggtgctgaactggtgaggtct

SEQ ID NO: 9419017 - DNA, 22 bp, Homo sapiens
aggtgctgaactggtgaggtct

SEQ ID NO: 9419018 - DNA, 17 bp, Homo sapiens
aggtgctggagcatcag

SEQ ID NO: 9419019 - DNA, 22 bp, Homo sapiens
aggtgctggagtagaagaaaaa

SEQ ID NO: 9419020 - DNA, 22 bp, Homo sapiens
aggtgctgggcagcagtcattg

SEQ ID NO: 9419021 - DNA, 22 bp, Homo sapiens
aggtgctggcgccccaggagac

SEQ ID NO: 9419022 - DNA, 22 bp, Homo sapiens
aggtgctggagtctgggcagga

SEQ ID NO: 9419023 - DNA, 22 bp, Homo sapiens
aggtgctggagtctgggcagga

SEQ ID NO: 9419024 - DNA, 22 bp, Homo sapiens
aggtgctggagtctgggcagga

SEQ ID NO: 9419025 - DNA, 22 bp, Homo sapiens
aggtgctggagtctgggcagga

SEQ ID NO: 9419026 - DNA, 22 bp, Homo sapiens
aggtgctgttggcagcgggcag

SEQ ID NO: 9419027 - DNA, 22 bp, Homo sapiens
aggtgctgtttgtcagcagttt

SEQ ID NO: 9419028 - DNA, 19 bp, Homo sapiens
aggtgctggtgagggtgtt

SEQ ID NO: 9419029 - DNA, 19 bp, Homo sapiens
aggtgctggtgagggtgtt

SEQ ID NO: 9419030 - DNA, 19 bp, Homo sapiens
aggtgctggtgagggtgtt

SEQ ID NO: 9419031 - DNA, 22 bp, Homo sapiens
aggtgctgggcagcagtcattg

SEQ ID NO: 9419032 - DNA, 19 bp, Homo sapiens
aggtgctggtgagggtgtt

SEQ ID NO: 9419033 - DNA, 22 bp, Homo sapiens
aggtggcagttgtggaaccatc

SEQ ID NO: 9419034 - DNA, 22 bp, Homo sapiens
aggtggctctgacagctctggt

SEQ ID NO: 9419035 - DNA, 22 bp, Homo sapiens
aggtggcatgagactgtaccag

SEQ ID NO: 9419036 - DNA, 22 bp, Homo sapiens
cctgggaatgatgaccttgcct

SEQ ID NO: 9419037 - DNA, 21 bp, Homo sapiens
cctgggacactcaccagctcc

SEQ ID NO: 9419038 - DNA, 22 bp, Homo sapiens
cctgggaaggtcttagcatcta

SEQ ID NO: 9419039 - DNA, 22 bp, Homo sapiens
cctgggacctcgcgggaagcgg

SEQ ID NO: 9419040 - DNA, 22 bp, Homo sapiens
cctgggacctcgcgggaagcgg

SEQ ID NO: 9419041 - DNA, 22 bp, Homo sapiens
cctgggacctcgcgggaagcgg

SEQ ID NO: 9419042 - DNA, 19 bp, Homo sapiens
cctgggacttaggctgggt

SEQ ID NO: 9419043 - DNA, 19 bp, Homo sapiens
cctgggacttaggctgggt

SEQ ID NO: 9419044 - DNA, 22 bp, Homo sapiens
cctgggactcggccaggacaga

SEQ ID NO: 9419045 - DNA, 22 bp, Homo sapiens
cctgggactcggccaggacaga

SEQ ID NO: 9419046 - DNA, 19 bp, Homo sapiens
cctgggacttaggctgggt

SEQ ID NO: 9419047 - DNA, 22 bp, Homo sapiens
cctgggagaactgctgggttgg

SEQ ID NO: 9419048 - DNA, 18 bp, Homo sapiens
aggtgctcaaatgggaaa

SEQ ID NO: 9419049 - DNA, 22 bp, Homo sapiens
aggtgctctaggtatctacttt

SEQ ID NO: 9419050 - DNA, 22 bp, Homo sapiens
aggtgccttccgcggagctcgc

SEQ ID NO: 9419051 - DNA, 22 bp, Homo sapiens
aggtgcctgtcgtctctggtta

SEQ ID NO: 9419052 - DNA, 22 bp, Homo sapiens
aggtgcctgggagctccctgag

SEQ ID NO: 9419053 - DNA, 22 bp, Homo sapiens
aggtgcaggagctgtgcaggga

SEQ ID NO: 9419054 - DNA, 22 bp, Homo sapiens
aggtgcaggagctgtgcaggga

SEQ ID NO: 9419055 - DNA, 22 bp, Homo sapiens
aggtgccagtgctgtggtcccc

SEQ ID NO: 9419056 - DNA, 22 bp, Homo sapiens
aggtgccaggagggaatttagg

SEQ ID NO: 9419057 - DNA, 22 bp, Homo sapiens
ccttggagcggtcagcactggt

SEQ ID NO: 9419058 - DNA, 22 bp, Homo sapiens
ccttggacagcccatgaaccca

SEQ ID NO: 9419059 - DNA, 22 bp, Homo sapiens
ccttggagacctgggtctgtgc

SEQ ID NO: 9419060 - DNA, 22 bp, Homo sapiens
ccttgctcatcccccagtgcct

SEQ ID NO: 9419061 - DNA, 22 bp, Homo sapiens
ccttgctcaagctagtgacggg

SEQ ID NO: 9419062 - DNA, 22 bp, Homo sapiens
ccttgctcaagctagtgacggg

SEQ ID NO: 9419063 - DNA, 22 bp, Homo sapiens
ccttctctgcaggtagttggct

SEQ ID NO: 9419064 - DNA, 22 bp, Homo sapiens
ccttggattttgtgcccacgcc

SEQ ID NO: 9419065 - DNA, 22 bp, Homo sapiens
ccttggcaaaccagggcagctg

SEQ ID NO: 9419066 - DNA, 22 bp, Homo sapiens
ccttggcaagacagtggagggt

SEQ ID NO: 9419067 - DNA, 22 bp, Homo sapiens
ccttggcaagacagtggagggt

SEQ ID NO: 9419068 - DNA, 22 bp, Homo sapiens
ccttggcaggggagaaatatat

SEQ ID NO: 9419069 - DNA, 21 bp, Homo sapiens
aggtggggctgcacctctgct

SEQ ID NO: 9419070 - DNA, 22 bp, Homo sapiens
ccttggctgaggagggagctga

SEQ ID NO: 9419071 - DNA, 22 bp, Homo sapiens
aggtggggctgggaaagattcc

SEQ ID NO: 9419072 - DNA, 22 bp, Homo sapiens
ccttggctaggcagcggctgtc

SEQ ID NO: 9419073 - DNA, 22 bp, Homo sapiens
ccttggctaggcagcggctgtc

SEQ ID NO: 9419074 - DNA, 22 bp, Homo sapiens
ccttggctgaggagggagctga

SEQ ID NO: 9419075 - DNA, 22 bp, Homo sapiens
ccttggctaaactcaatccagc

SEQ ID NO: 9419076 - DNA, 21 bp, Homo sapiens
aggtggctgcatcctcagaag

SEQ ID NO: 9419077 - DNA, 21 bp, Homo sapiens
aggtggctgcatcctcagaag

SEQ ID NO: 9419078 - DNA, 22 bp, Homo sapiens
aggtggctggtccaggctgcag

SEQ ID NO: 9419079 - DNA, 17 bp, Homo sapiens
aggtggctgctgcgcct

SEQ ID NO: 9419080 - DNA, 21 bp, Homo sapiens
aggtgggagaccatgtaggtc

SEQ ID NO: 9419081 - DNA, 21 bp, Homo sapiens
aggtgggagaccatgtaggtc

SEQ ID NO: 9419082 - DNA, 22 bp, Homo sapiens
ccttctctctgaagaccccaaa

SEQ ID NO: 9419083 - DNA, 22 bp, Homo sapiens
aggtgggacccgtggggtgcga

SEQ ID NO: 9419084 - DNA, 21 bp, Homo sapiens
aggtgggagaccatgtaggtc

SEQ ID NO: 9419085 - DNA, 21 bp, Homo sapiens
aggtgggagaccatgtaggtc

SEQ ID NO: 9419086 - DNA, 22 bp, Homo sapiens
aggtgggaacccagcagggccc

SEQ ID NO: 9419087 - DNA, 22 bp, Homo sapiens
aggtgggaacccagcagggccc

SEQ ID NO: 9419088 - DNA, 22 bp, Homo sapiens
aggtggcttctggccaggtgtg

SEQ ID NO: 9419089 - DNA, 22 bp, Homo sapiens
aggtgggacccgtggggtgcga

SEQ ID NO: 9419090 - DNA, 22 bp, Homo sapiens
aggtgggaacccagcagggccc

SEQ ID NO: 9419091 - DNA, 22 bp, Homo sapiens
aggtgggaacccagcagggccc

SEQ ID NO: 9419092 - DNA, 22 bp, Homo sapiens
cctgggaaggtgaggccctgga

SEQ ID NO: 9419093 - DNA, 22 bp, Homo sapiens
cctgggaagtcagccaaggacg

SEQ ID NO: 9419094 - DNA, 22 bp, Homo sapiens
cctgggaaggtgaggccctgga

SEQ ID NO: 9419095 - DNA, 22 bp, Homo sapiens
cctgggaaggggaagagaattc

SEQ ID NO: 9419096 - DNA, 22 bp, Homo sapiens
cctgggaaggggaagagaattc

SEQ ID NO: 9419097 - DNA, 22 bp, Homo sapiens
cctgggaaggggaagagaattc

SEQ ID NO: 9419098 - DNA, 17 bp, Homo sapiens
cctggctgggaatctga

SEQ ID NO: 9419099 - DNA, 23 bp, Homo sapiens
cctggctggattctctgcattca

SEQ ID NO: 9419100 - DNA, 23 bp, Homo sapiens
cctggctggattctctgcattca

SEQ ID NO: 9419101 - DNA, 22 bp, Homo sapiens
cctggctggactggaccgtggc

SEQ ID NO: 9419102 - DNA, 22 bp, Homo sapiens
cctggctgctttcactatggag

SEQ ID NO: 9419103 - DNA, 22 bp, Homo sapiens
cctggctgcttcctctgccatg

SEQ ID NO: 9419104 - DNA, 22 bp, Homo sapiens
cctggctgctttcactatggag

SEQ ID NO: 9419105 - DNA, 22 bp, Homo sapiens
cctggctgctttcactatggag

SEQ ID NO: 9419106 - DNA, 22 bp, Homo sapiens
cctggctgctgtcactgaccat

SEQ ID NO: 9419107 - DNA, 22 bp, Homo sapiens
cctggctcttcagaggttccta

SEQ ID NO: 9419108 - DNA, 22 bp, Homo sapiens
cctggctgctgtcactgaccat

SEQ ID NO: 9419109 - DNA, 22 bp, Homo sapiens
cctggctctgtcctcgcgcaaa

SEQ ID NO: 9419110 - DNA, 22 bp, Homo sapiens
cctggctctgtcctcgcgcaaa

SEQ ID NO: 9419111 - DNA, 22 bp, Homo sapiens
cctggctgcttcctctgccatg

SEQ ID NO: 9419112 - DNA, 22 bp, Homo sapiens
cctggctgcttcctctgccatg

SEQ ID NO: 9419113 - DNA, 22 bp, Homo sapiens
cctggctgcttcctctgccatg

SEQ ID NO: 9419114 - DNA, 19 bp, Homo sapiens
cctggctgctgtgggatgc

SEQ ID NO: 9419115 - DNA, 22 bp, Homo sapiens
cctggcagctcctccccggcgg

SEQ ID NO: 9419116 - DNA, 22 bp, Homo sapiens
cctggcagctcctccccggcgg

SEQ ID NO: 9419117 - DNA, 22 bp, Homo sapiens
cctggcagctcctccccggcgg

SEQ ID NO: 9419118 - DNA, 22 bp, Homo sapiens
cctggcagctccgtggccttcc

SEQ ID NO: 9419119 - DNA, 22 bp, Homo sapiens
cctggcagctccgtggccttcc

SEQ ID NO: 9419120 - DNA, 21 bp, Homo sapiens
cctggccaatctgatagggtt

SEQ ID NO: 9419121 - DNA, 22 bp, Homo sapiens
cctggccaatctagggctgtta

SEQ ID NO: 9419122 - DNA, 22 bp, Homo sapiens
cctggccaatctagggctgtta

SEQ ID NO: 9419123 - DNA, 22 bp, Homo sapiens
cctggccaatctagggctgtta

SEQ ID NO: 9419124 - DNA, 20 bp, Homo sapiens
cctggccaatgagataggaa

SEQ ID NO: 9419125 - DNA, 20 bp, Homo sapiens
cctggccaatgagataggaa

SEQ ID NO: 9419126 - DNA, 21 bp, Homo sapiens
cctggccaatctgatagggtt

SEQ ID NO: 9419127 - DNA, 22 bp, Homo sapiens
cctggccacagggctctgcatt

SEQ ID NO: 9419128 - DNA, 22 bp, Homo sapiens
cctggccacagggctctgcatt

SEQ ID NO: 9419129 - DNA, 22 bp, Homo sapiens
cctggccagaggcgtgcctgtg

SEQ ID NO: 9419130 - DNA, 22 bp, Homo sapiens
cctggccagaggcgtgcctgtg

SEQ ID NO: 9419131 - DNA, 22 bp, Homo sapiens
cctggccagaggcgtgcctgtg

SEQ ID NO: 9419132 - DNA, 19 bp, Homo sapiens
cctggccagacttctgccc

SEQ ID NO: 9419133 - DNA, 22 bp, Homo sapiens
cctggccactcaggtgtggggc

SEQ ID NO: 9419134 - DNA, 22 bp, Homo sapiens
cctggccactcaggtgtggggc

SEQ ID NO: 9419135 - DNA, 22 bp, Homo sapiens
cctgcctggcttccagaagaga

SEQ ID NO: 9419136 - DNA, 22 bp, Homo sapiens
cctgctctagactctgggaagg

SEQ ID NO: 9419137 - DNA, 22 bp, Homo sapiens
cctgctctccatacactttcta

SEQ ID NO: 9419138 - DNA, 22 bp, Homo sapiens
cctgctctggtttagtcagtct

SEQ ID NO: 9419139 - DNA, 22 bp, Homo sapiens
cctgctctgccaagtcctcttt

SEQ ID NO: 9419140 - DNA, 22 bp, Homo sapiens
cctgctctgccaagtcctcttt

SEQ ID NO: 9419141 - DNA, 22 bp, Homo sapiens
cctgctctgccaagtcctcttt

SEQ ID NO: 9419142 - DNA, 22 bp, Homo sapiens
cctgctctgccaagtcctcttt

SEQ ID NO: 9419143 - DNA, 22 bp, Homo sapiens
cctgctctgccaagtcctcttt

SEQ ID NO: 9419144 - DNA, 22 bp, Homo sapiens
cctggaaagcggttcattttgt

SEQ ID NO: 9419145 - DNA, 22 bp, Homo sapiens
cctgctgctatgaaggtgacag

SEQ ID NO: 9419146 - DNA, 19 bp, Homo sapiens
cctgctgcaccacttgtta

SEQ ID NO: 9419147 - DNA, 19 bp, Homo sapiens
cctgctgaagtgatgcagc

SEQ ID NO: 9419148 - DNA, 19 bp, Homo sapiens
cctgctgaagtgatgcagc

SEQ ID NO: 9419149 - DNA, 19 bp, Homo sapiens
cctgctgaagtgatgcagc

SEQ ID NO: 9419150 - DNA, 22 bp, Homo sapiens
cctgctgagaccctgaggtggg

SEQ ID NO: 9419151 - DNA, 22 bp, Homo sapiens
cctgctctggtttagtcagtct

SEQ ID NO: 9419152 - DNA, 22 bp, Homo sapiens
cctgctgagaccctgaggtggg

SEQ ID NO: 9419153 - DNA, 20 bp, Homo sapiens
cctgctgagccagtgtgagg

SEQ ID NO: 9419154 - DNA, 20 bp, Homo sapiens
cctgctgagccagtgtgagg

SEQ ID NO: 9419155 - DNA, 22 bp, Homo sapiens
cctgctgaggtcagccacccaa

SEQ ID NO: 9419156 - DNA, 22 bp, Homo sapiens
cctgctgaggtcagccacccaa

SEQ ID NO: 9419157 - DNA, 22 bp, Homo sapiens
cctggacaatgagatgtcaggg

SEQ ID NO: 9419158 - DNA, 22 bp, Homo sapiens
cctggacacccattccttggct

SEQ ID NO: 9419159 - DNA, 22 bp, Homo sapiens
cctggacaatgagatgtcaggg

SEQ ID NO: 9419160 - DNA, 22 bp, Homo sapiens
cctggaccaaacactggcctgg

SEQ ID NO: 9419161 - DNA, 22 bp, Homo sapiens
cctggacagggccaggccatgc

SEQ ID NO: 9419162 - DNA, 22 bp, Homo sapiens
cctggaaggcaggcatggattg

SEQ ID NO: 9419163 - DNA, 22 bp, Homo sapiens
cctggaagtcattcctcgttcc

SEQ ID NO: 9419164 - DNA, 22 bp, Homo sapiens
cctggaagattcaccactacca

SEQ ID NO: 9419165 - DNA, 22 bp, Homo sapiens
cctggaaggacaatagatagtg

SEQ ID NO: 9419166 - DNA, 22 bp, Homo sapiens
cctggcagcgtgccgagctgcg

SEQ ID NO: 9419167 - DNA, 22 bp, Homo sapiens
cctggcagcgccgaagctggcc

SEQ ID NO: 9419168 - DNA, 22 bp, Homo sapiens
cctggcagcgccgaagctggcc

SEQ ID NO: 9419169 - DNA, 22 bp, Homo sapiens
cctggcagcgccgaagctggcc

SEQ ID NO: 9419170 - DNA, 22 bp, Homo sapiens
cctggcagcgccgaagctggcc

SEQ ID NO: 9419171 - DNA, 22 bp, Homo sapiens
cctggcagcccagagcgccgct

SEQ ID NO: 9419172 - DNA, 22 bp, Homo sapiens
cctggcacataatagtggctca

SEQ ID NO: 9419173 - DNA, 22 bp, Homo sapiens
cctggcacataatagtggctca

SEQ ID NO: 9419174 - DNA, 22 bp, Homo sapiens
cctggcacataatagtggctca

SEQ ID NO: 9419175 - DNA, 22 bp, Homo sapiens
cctggcacataatagtggctca

SEQ ID NO: 9419176 - DNA, 22 bp, Homo sapiens
cctggcacagagcggtggtcac

SEQ ID NO: 9419177 - DNA, 22 bp, Homo sapiens
cctggaccaaacactggcctgg

SEQ ID NO: 9419178 - DNA, 22 bp, Homo sapiens
agggtcaggttaagggagtcat

SEQ ID NO: 9419179 - DNA, 22 bp, Homo sapiens
agggtcagggagtgagtattta

SEQ ID NO: 9419180 - DNA, 22 bp, Homo sapiens
agggtcaggagacactggcaac

SEQ ID NO: 9419181 - DNA, 21 bp, Homo sapiens
agggtcctacagggctcagga

SEQ ID NO: 9419182 - DNA, 21 bp, Homo sapiens
agggtcctacagggctcagga

SEQ ID NO: 9419183 - DNA, 20 bp, Homo sapiens
agggtcagtagcacagagct

SEQ ID NO: 9419184 - DNA, 22 bp, Homo sapiens
agggtcctgagcctggggcgca

SEQ ID NO: 9419185 - DNA, 22 bp, Homo sapiens
agggtccttctgttcctgagca

SEQ ID NO: 9419186 - DNA, 22 bp, Homo sapiens
agggtcctgggtgcagttgctt

SEQ ID NO: 9419187 - DNA, 22 bp, Homo sapiens
agggtctatctctctgcctttg

SEQ ID NO: 9419188 - DNA, 22 bp, Homo sapiens
agggtctatctctctgcctttg

SEQ ID NO: 9419189 - DNA, 22 bp, Homo sapiens
agggtcagagtcaggtgcagta

SEQ ID NO: 9419190 - DNA, 22 bp, Homo sapiens
agggtcagagtcaggtgcagta

SEQ ID NO: 9419191 - DNA, 22 bp, Homo sapiens
agggtcagagtcaggtgcagta

SEQ ID NO: 9419192 - DNA, 22 bp, Homo sapiens
agggtcagctggctgtcagggg

SEQ ID NO: 9419193 - DNA, 22 bp, Homo sapiens
agggtcagctggctgtcagggg

SEQ ID NO: 9419194 - DNA, 21 bp, Homo sapiens
agggtcaggaaccagggtacc

SEQ ID NO: 9419195 - DNA, 19 bp, Homo sapiens
agggtcaggacaaggactt

SEQ ID NO: 9419196 - DNA, 21 bp, Homo sapiens
agggtcaggaaccagggtacc

SEQ ID NO: 9419197 - DNA, 21 bp, Homo sapiens
agggtcaggaaccagggtacc

SEQ ID NO: 9419198 - DNA, 21 bp, Homo sapiens
agggtcaggaaccagggtacc

SEQ ID NO: 9419199 - DNA, 21 bp, Homo sapiens
agggtcaggaaccagggtacc

SEQ ID NO: 9419200 - DNA, 22 bp, Homo sapiens
agggtcagagatcggccatgtg

SEQ ID NO: 9419201 - DNA, 22 bp, Homo sapiens
agggtcagagatcggccatgtg

SEQ ID NO: 9419202 - DNA, 20 bp, Homo sapiens
agggtcagagagcgtgagtg

SEQ ID NO: 9419203 - DNA, 20 bp, Homo sapiens
agggtcagagagcgtgagtg

SEQ ID NO: 9419204 - DNA, 20 bp, Homo sapiens
agggtcagagagcgtgagtg

SEQ ID NO: 9419205 - DNA, 20 bp, Homo sapiens
agggtcagagagcgtgagtg

SEQ ID NO: 9419206 - DNA, 20 bp, Homo sapiens
agggtcagagagcgtgagtg

SEQ ID NO: 9419207 - DNA, 20 bp, Homo sapiens
agggtcagagagcgtgagtg

SEQ ID NO: 9419208 - DNA, 22 bp, Homo sapiens
agggtcacctgcttgccagggc

SEQ ID NO: 9419209 - DNA, 22 bp, Homo sapiens
agggtgaatctcacaactctta

SEQ ID NO: 9419210 - DNA, 22 bp, Homo sapiens
agggtgaatctcacaactctta

SEQ ID NO: 9419211 - DNA, 22 bp, Homo sapiens
agggtgaatctcacaactctta

SEQ ID NO: 9419212 - DNA, 22 bp, Homo sapiens
agggtgaatctcacaactctta

SEQ ID NO: 9419213 - DNA, 22 bp, Homo sapiens
agggtgactttgggcaagttac

SEQ ID NO: 9419214 - DNA, 20 bp, Homo sapiens
agggtgagacatgagcctcc

SEQ ID NO: 9419215 - DNA, 23 bp, Homo sapiens
agggtgagcaagctatggagacc

SEQ ID NO: 9419216 - DNA, 22 bp, Homo sapiens
cctgcctggcttccagaagaga

SEQ ID NO: 9419217 - DNA, 22 bp, Homo sapiens
agggtctgtggatgcatctggg

SEQ ID NO: 9419218 - DNA, 22 bp, Homo sapiens
agggtctgtatttctggcaagc

SEQ ID NO: 9419219 - DNA, 22 bp, Homo sapiens
agggtctttcctgggagccagc

SEQ ID NO: 9419220 - DNA, 22 bp, Homo sapiens
agggtctgttgtttgttctgga

SEQ ID NO: 9419221 - DNA, 22 bp, Homo sapiens
agggtctgactgaatggaaaag

SEQ ID NO: 9419222 - DNA, 22 bp, Homo sapiens
agggtctgactcctctggcaag

SEQ ID NO: 9419223 - DNA, 20 bp, Homo sapiens
agggtctgatgtggtggccc

SEQ ID NO: 9419224 - DNA, 22 bp, Homo sapiens
agggtctgactgaatggaaaag

SEQ ID NO: 9419225 - DNA, 20 bp, Homo sapiens
agggtctgctgggtaggaca

SEQ ID NO: 9419226 - DNA, 22 bp, Homo sapiens
agggtctgaccaccagtaggga

SEQ ID NO: 9419227 - DNA, 22 bp, Homo sapiens
agggtctgaccaccagtaggga

SEQ ID NO: 9419228 - DNA, 22 bp, Homo sapiens
agggtctctggagagctgagga

SEQ ID NO: 9419229 - DNA, 22 bp, Homo sapiens
agggtctctgggagtagggcac

SEQ ID NO: 9419230 - DNA, 22 bp, Homo sapiens
cctgcccccgtcagaggtgatg

SEQ ID NO: 9419231 - DNA, 22 bp, Homo sapiens
cctgcccctcaaggcctggtgc

SEQ ID NO: 9419232 - DNA, 22 bp, Homo sapiens
cctgcccctcaaggcctggtgc

SEQ ID NO: 9419233 - DNA, 22 bp, Homo sapiens
cctgcccagggtcaccacagag

SEQ ID NO: 9419234 - DNA, 22 bp, Homo sapiens
cctgcccatactgacctctaat

SEQ ID NO: 9419235 - DNA, 22 bp, Homo sapiens
cctgcccatcccgtccttggcc

SEQ ID NO: 9419236 - DNA, 22 bp, Homo sapiens
cctgccctatgaccagcttcac

SEQ ID NO: 9419237 - DNA, 22 bp, Homo sapiens
cctgccctaatccagagactag

SEQ ID NO: 9419238 - DNA, 22 bp, Homo sapiens
cctgccctagagatgacacaat

SEQ ID NO: 9419239 - DNA, 22 bp, Homo sapiens
cctgccctagagatgacacaat

SEQ ID NO: 9419240 - DNA, 22 bp, Homo sapiens
cctgcccagcttcccgagtgca

SEQ ID NO: 9419241 - DNA, 22 bp, Homo sapiens
cctgcccagcttcccgagtgca

SEQ ID NO: 9419242 - DNA, 22 bp, Homo sapiens
cctgcccaggagtctctctgtg

SEQ ID NO: 9419243 - DNA, 23 bp, Homo sapiens
cctgcccaggaatccggcggcgt

SEQ ID NO: 9419244 - DNA, 23 bp, Homo sapiens
cctgcccaggaatccggcggcgt

SEQ ID NO: 9419245 - DNA, 22 bp, Homo sapiens
cctgcccaggccctaagttagg

SEQ ID NO: 9419246 - DNA, 22 bp, Homo sapiens
cctgcccagggtcaccacagag

SEQ ID NO: 9419247 - DNA, 22 bp, Homo sapiens
cctgcccagggtcaccacagag

SEQ ID NO: 9419248 - DNA, 22 bp, Homo sapiens
cctgcccaggagtctctctgtg

SEQ ID NO: 9419249 - DNA, 22 bp, Homo sapiens
cctgcccaggagtctctctgtg

SEQ ID NO: 9419250 - DNA, 22 bp, Homo sapiens
cctgcccaggagtctctctgtg

SEQ ID NO: 9419251 - DNA, 22 bp, Homo sapiens
cctgccaggacattgcttgaag

SEQ ID NO: 9419252 - DNA, 21 bp, Homo sapiens
cctgccaggaaactgagtgtc

SEQ ID NO: 9419253 - DNA, 22 bp, Homo sapiens
cctgcccagcttcacctcaggc

SEQ ID NO: 9419254 - DNA, 22 bp, Homo sapiens
cctgcccagcttcacctcaggc

SEQ ID NO: 9419255 - DNA, 19 bp, Homo sapiens
cctctgccagcccgcctct

SEQ ID NO: 9419256 - DNA, 22 bp, Homo sapiens
cctctgccacctcccacgaggc

SEQ ID NO: 9419257 - DNA, 23 bp, Homo sapiens
cctctctccctgtttggcaaata

SEQ ID NO: 9419258 - DNA, 22 bp, Homo sapiens
cctctctccttcctttgccaaa

SEQ ID NO: 9419259 - DNA, 22 bp, Homo sapiens
cctctctccaattttcacctca

SEQ ID NO: 9419260 - DNA, 22 bp, Homo sapiens
cctctctctcctgcacacacac

SEQ ID NO: 9419261 - DNA, 22 bp, Homo sapiens
cctctctctcctgcacacacac

SEQ ID NO: 9419262 - DNA, 22 bp, Homo sapiens
cctctgagtcctccctggttgc

SEQ ID NO: 9419263 - DNA, 22 bp, Homo sapiens
cctctgagtgttttccccgggt

SEQ ID NO: 9419264 - DNA, 22 bp, Homo sapiens
cctctgagttagagatctagat

SEQ ID NO: 9419265 - DNA, 22 bp, Homo sapiens
cctctgagttggcctgtcttgt

SEQ ID NO: 9419266 - DNA, 22 bp, Homo sapiens
cctctgatgggcacagggtggc

SEQ ID NO: 9419267 - DNA, 22 bp, Homo sapiens
cctctgagtgacagcctcctct

SEQ ID NO: 9419268 - DNA, 22 bp, Homo sapiens
cctctgagtgacagcctcctct

SEQ ID NO: 9419269 - DNA, 22 bp, Homo sapiens
cctctgagtgctttgagggaga

SEQ ID NO: 9419270 - DNA, 22 bp, Homo sapiens
cctctgagtctcactgtaacct

SEQ ID NO: 9419271 - DNA, 22 bp, Homo sapiens
cctctgagtcctttgggctctc

SEQ ID NO: 9419272 - DNA, 22 bp, Homo sapiens
cctctgagtcctttgggctctc

SEQ ID NO: 9419273 - DNA, 22 bp, Homo sapiens
cctctgccacctcccacgaggc

SEQ ID NO: 9419274 - DNA, 22 bp, Homo sapiens
cctctgcatctggctgctgcag

SEQ ID NO: 9419275 - DNA, 22 bp, Homo sapiens
cctctgcatctggctgctgcag

SEQ ID NO: 9419276 - DNA, 22 bp, Homo sapiens
cctctgcaccatagccttcagc

SEQ ID NO: 9419277 - DNA, 22 bp, Homo sapiens
cctctgcacttcaccttagctc

SEQ ID NO: 9419278 - DNA, 22 bp, Homo sapiens
cctctgcagcagagagccagag

SEQ ID NO: 9419279 - DNA, 20 bp, Homo sapiens
ctgtcttgtgggcttcccct

SEQ ID NO: 9419280 - DNA, 22 bp, Homo sapiens
ctgtcttctcctttgtttcagg

SEQ ID NO: 9419281 - DNA, 22 bp, Homo sapiens
ctgtctgttttgtatacaggcc

SEQ ID NO: 9419282 - DNA, 22 bp, Homo sapiens
ctgtctgttttaccttctccag

SEQ ID NO: 9419283 - DNA, 22 bp, Homo sapiens
ctgtctgttttgtatacaggcc

SEQ ID NO: 9419284 - DNA, 22 bp, Homo sapiens
ctgtcttctaccttcaacctcc

SEQ ID NO: 9419285 - DNA, 22 bp, Homo sapiens
ctgtcttcccgaggccctggag

SEQ ID NO: 9419286 - DNA, 22 bp, Homo sapiens
ctgtctgttttgtatacaggcc

SEQ ID NO: 9419287 - DNA, 22 bp, Homo sapiens
ctgtctgttttaccttctccag

SEQ ID NO: 9419288 - DNA, 22 bp, Homo sapiens
ctgtctgtttcaaaagtggtta

SEQ ID NO: 9419289 - DNA, 22 bp, Homo sapiens
ctgtctgtttctgattcaacct

SEQ ID NO: 9419290 - DNA, 22 bp, Homo sapiens
atcacattatgtagtgaaaagg

SEQ ID NO: 9419291 - DNA, 19 bp, Homo sapiens
atcacatgtcaagagcagg

SEQ ID NO: 9419292 - DNA, 19 bp, Homo sapiens
atcacatgtcaagagcagg

SEQ ID NO: 9419293 - DNA, 18 bp, Homo sapiens
ctgtcttttttctctcca

SEQ ID NO: 9419294 - DNA, 22 bp, Homo sapiens
ctgtgatgacaggcagggccaa

SEQ ID NO: 9419295 - DNA, 22 bp, Homo sapiens
ctgtgatcattcttgatttaag

SEQ ID NO: 9419296 - DNA, 22 bp, Homo sapiens
ctgtcttttcttctcattgatg

SEQ ID NO: 9419297 - DNA, 22 bp, Homo sapiens
ctgtcttttcttctcattgatg

SEQ ID NO: 9419298 - DNA, 22 bp, Homo sapiens
ctgtcttttcatactttccctc

SEQ ID NO: 9419299 - DNA, 22 bp, Homo sapiens
ctgtcttttactatcatttact

SEQ ID NO: 9419300 - DNA, 22 bp, Homo sapiens
ctgtgatgatggaaactttctt

SEQ ID NO: 9419301 - DNA, 22 bp, Homo sapiens
ctgtgatgttagctctgtgtta

SEQ ID NO: 9419302 - DNA, 22 bp, Homo sapiens
ctgtgcactaaccacacccacg

SEQ ID NO: 9419303 - DNA, 22 bp, Homo sapiens
ctgtgcacacgtgcccaacagt

SEQ ID NO: 9419304 - DNA, 18 bp, Homo sapiens
ctgtgcagcaaactgagc

SEQ ID NO: 9419305 - DNA, 18 bp, Homo sapiens
ctgtgcagcaaactgagc

SEQ ID NO: 9419306 - DNA, 19 bp, Homo sapiens
ctgtgcaggccgggctgag

SEQ ID NO: 9419307 - DNA, 22 bp, Homo sapiens
ctgtgcagcttggcttcaggcc

SEQ ID NO: 9419308 - DNA, 22 bp, Homo sapiens
ctgtgcagctggcttcctggaa

SEQ ID NO: 9419309 - DNA, 22 bp, Homo sapiens
atcatcatcattgctaacatct

SEQ ID NO: 9419310 - DNA, 18 bp, Homo sapiens
atcatgctgaattaaaga

SEQ ID NO: 9419311 - DNA, 22 bp, Homo sapiens
atcatcatgcactctcaggttt

SEQ ID NO: 9419312 - DNA, 22 bp, Homo sapiens
atcatgacagagtctgccatcc

SEQ ID NO: 9419313 - DNA, 22 bp, Homo sapiens
atcatgaatcttgtgttctatg

SEQ ID NO: 9419314 - DNA, 22 bp, Homo sapiens
atcatggaagcctatcttgaga

SEQ ID NO: 9419315 - DNA, 22 bp, Homo sapiens
atcatggaaaggttcagcaagc

SEQ ID NO: 9419316 - DNA, 22 bp, Homo sapiens
atcatgtctatcttagtcacca

SEQ ID NO: 9419317 - DNA, 22 bp, Homo sapiens
atcatgtgaagtggggggttga

SEQ ID NO: 9419318 - DNA, 22 bp, Homo sapiens
atcatgttcatcgtatttaggc

SEQ ID NO: 9419319 - DNA, 22 bp, Homo sapiens
atcacatatttaagaaacatgt

SEQ ID NO: 9419320 - DNA, 22 bp, Homo sapiens
atcacatggaatgattttagac

SEQ ID NO: 9419321 - DNA, 22 bp, Homo sapiens
atcacatatttaagaaacatgt

SEQ ID NO: 9419322 - DNA, 22 bp, Homo sapiens
atcacatatatgcaccaagaca

SEQ ID NO: 9419323 - DNA, 22 bp, Homo sapiens
atcacagtttacaaacctgctg

SEQ ID NO: 9419324 - DNA, 22 bp, Homo sapiens
atcacagttttgtgccttgtgg

SEQ ID NO: 9419325 - DNA, 22 bp, Homo sapiens
atcacaggtggtaggaaaagaa

SEQ ID NO: 9419326 - DNA, 22 bp, Homo sapiens
atcacagggtgaggattagacc

SEQ ID NO: 9419327 - DNA, 22 bp, Homo sapiens
atcacagtgccttcgtaaattt

SEQ ID NO: 9419328 - DNA, 22 bp, Homo sapiens
atcacagtgtagaccttttaaa

SEQ ID NO: 9419329 - DNA, 22 bp, Homo sapiens
atcacagtgtagaccttttaaa

SEQ ID NO: 9419330 - DNA, 22 bp, Homo sapiens
atcacagtggctacctctggat

SEQ ID NO: 9419331 - DNA, 22 bp, Homo sapiens
atcacagttactcaaataatga

SEQ ID NO: 9419332 - DNA, 22 bp, Homo sapiens
ctgtcctccagacgacagtccc

SEQ ID NO: 9419333 - DNA, 22 bp, Homo sapiens
ctgtcctcatctgccccaaggg

SEQ ID NO: 9419334 - DNA, 22 bp, Homo sapiens
ctgtcctcaacccatccttctc

SEQ ID NO: 9419335 - DNA, 22 bp, Homo sapiens
ctgtcctcaacccatccttctc

SEQ ID NO: 9419336 - DNA, 22 bp, Homo sapiens
ctgtcctcaccttggcaggggg

SEQ ID NO: 9419337 - DNA, 22 bp, Homo sapiens
ctgggtagggcaaggaactggc

SEQ ID NO: 9419338 - DNA, 22 bp, Homo sapiens
ctgggtagggcaaggaactggc

SEQ ID NO: 9419339 - DNA, 20 bp, Homo sapiens
ctgggtcacttggctgctct

SEQ ID NO: 9419340 - DNA, 22 bp, Homo sapiens
ctgggtagggcaaggaactggc

SEQ ID NO: 9419341 - DNA, 22 bp, Homo sapiens
ctgggtcccacagcctgctggg

SEQ ID NO: 9419342 - DNA, 22 bp, Homo sapiens
ctgggtcccacagcctgctggg

SEQ ID NO: 9419343 - DNA, 22 bp, Homo sapiens
ctgggtcagtggcaagctgggt

SEQ ID NO: 9419344 - DNA, 22 bp, Homo sapiens
ctgtccagtcagaacgtcatta

SEQ ID NO: 9419345 - DNA, 22 bp, Homo sapiens
ctgtcccttcattattcactac

SEQ ID NO: 9419346 - DNA, 22 bp, Homo sapiens
ctgtccagtgactttgggccat

SEQ ID NO: 9419347 - DNA, 22 bp, Homo sapiens
ctgtcccttcccaagcccagcc

SEQ ID NO: 9419348 - DNA, 22 bp, Homo sapiens
ctgtcccttcccaagcccagcc

SEQ ID NO: 9419349 - DNA, 22 bp, Homo sapiens
ctgggtcccctcagtgacactg

SEQ ID NO: 9419350 - DNA, 22 bp, Homo sapiens
ctgggtcccggcttctatccac

SEQ ID NO: 9419351 - DNA, 22 bp, Homo sapiens
ctgggtctcaggagttctgagg

SEQ ID NO: 9419352 - DNA, 22 bp, Homo sapiens
ctgggtctaaaaattctcagat

SEQ ID NO: 9419353 - DNA, 19 bp, Homo sapiens
ctgtggagcaagaaaagat

SEQ ID NO: 9419354 - DNA, 23 bp, Homo sapiens
ctgtggagccctttgttgggaga

SEQ ID NO: 9419355 - DNA, 23 bp, Homo sapiens
ctgtggagccctttgttgggaga

SEQ ID NO: 9419356 - DNA, 22 bp, Homo sapiens
ctgtggagcagggcagggtcac

SEQ ID NO: 9419357 - DNA, 22 bp, Homo sapiens
atcatgttccagaaacagtgat

SEQ ID NO: 9419358 - DNA, 22 bp, Homo sapiens
atcatgttgctcaaaattaaac

SEQ ID NO: 9419359 - DNA, 22 bp, Homo sapiens
atcatgttgctcaaaattaaac

SEQ ID NO: 9419360 - DNA, 22 bp, Homo sapiens
atcatgttggctctgacaaaaa

SEQ ID NO: 9419361 - DNA, 22 bp, Homo sapiens
atcatgttgtatgtaatctttt

SEQ ID NO: 9419362 - DNA, 22 bp, Homo sapiens
atcatgttttaattagcaaact

SEQ ID NO: 9419363 - DNA, 22 bp, Homo sapiens
atcatgttttaattagcaaact

SEQ ID NO: 9419364 - DNA, 22 bp, Homo sapiens
ctgtggagtcctggggaatgga

SEQ ID NO: 9419365 - DNA, 22 bp, Homo sapiens
ctgtggagtcctggggaatgga

SEQ ID NO: 9419366 - DNA, 22 bp, Homo sapiens
ctgtggagcttgtggcagtggg

SEQ ID NO: 9419367 - DNA, 22 bp, Homo sapiens
ctgtggagcttgtggcagtggg

SEQ ID NO: 9419368 - DNA, 22 bp, Homo sapiens
ctgtggagcttgtggcagtggg

SEQ ID NO: 9419369 - DNA, 22 bp, Homo sapiens
ctgtggagtggggagtactggt

SEQ ID NO: 9419370 - DNA, 22 bp, Homo sapiens
ctgtggagtgcttggctcagtg

SEQ ID NO: 9419371 - DNA, 22 bp, Homo sapiens
ctgtggagtgcttggctcagtg

SEQ ID NO: 9419372 - DNA, 22 bp, Homo sapiens
ctgtggagtgcttggctcagtg

SEQ ID NO: 9419373 - DNA, 22 bp, Homo sapiens
atcattttgtgacaatgcctgt

SEQ ID NO: 9419374 - DNA, 22 bp, Homo sapiens
atcattttgtgacaatgcctgt

SEQ ID NO: 9419375 - DNA, 22 bp, Homo sapiens
atcattttatggctgagaggac

SEQ ID NO: 9419376 - DNA, 22 bp, Homo sapiens
atcattctattgttgagctgcc

SEQ ID NO: 9419377 - DNA, 22 bp, Homo sapiens
atcattttgtgacaatgcctgt

SEQ ID NO: 9419378 - DNA, 22 bp, Homo sapiens
atcattttatggctgagaggac

SEQ ID NO: 9419379 - DNA, 22 bp, Homo sapiens
atcatttttaagagactcttct

SEQ ID NO: 9419380 - DNA, 22 bp, Homo sapiens
atcatttttaagagactcttct

SEQ ID NO: 9419381 - DNA, 22 bp, Homo sapiens
atcatttttaagagactcttct

SEQ ID NO: 9419382 - DNA, 22 bp, Homo sapiens
atcatttttaagagactcttct

SEQ ID NO: 9419383 - DNA, 18 bp, Homo sapiens
atccaaaaagatggaagt

SEQ ID NO: 9419384 - DNA, 22 bp, Homo sapiens
atccaaaaccagtgcattttcc

SEQ ID NO: 9419385 - DNA, 22 bp, Homo sapiens
atccaaaaccagtgcattttcc

SEQ ID NO: 9419386 - DNA, 22 bp, Homo sapiens
atccaaaaccagtgcattttcc

SEQ ID NO: 9419387 - DNA, 22 bp, Homo sapiens
atccaattacgttttttgtcat

SEQ ID NO: 9419388 - DNA, 22 bp, Homo sapiens
atccaattctaatattgtgttt

SEQ ID NO: 9419389 - DNA, 22 bp, Homo sapiens
atccaattctaatattgtgttt

SEQ ID NO: 9419390 - DNA, 22 bp, Homo sapiens
atccaattacgttttttgtcat

SEQ ID NO: 9419391 - DNA, 22 bp, Homo sapiens
atccaaggcgcaagatggcgct

SEQ ID NO: 9419392 - DNA, 22 bp, Homo sapiens
atccaagtcagggatagtttga

SEQ ID NO: 9419393 - DNA, 22 bp, Homo sapiens
atccaacaggacaaagaaagga

SEQ ID NO: 9419394 - DNA, 22 bp, Homo sapiens
atccaagatccaggaacttgga

SEQ ID NO: 9419395 - DNA, 22 bp, Homo sapiens
atccaaatcttcacacataaca

SEQ ID NO: 9419396 - DNA, 22 bp, Homo sapiens
atccaaatcttcacacataaca

SEQ ID NO: 9419397 - DNA, 22 bp, Homo sapiens
atccaaatcatgtcagaagaac

SEQ ID NO: 9419398 - DNA, 22 bp, Homo sapiens
atccaaatatattttattcact

SEQ ID NO: 9419399 - DNA, 22 bp, Homo sapiens
atccaaaggtgacacagaatac

SEQ ID NO: 9419400 - DNA, 22 bp, Homo sapiens
atccaaagtagattaagtcaca

SEQ ID NO: 9419401 - DNA, 22 bp, Homo sapiens
atccaaagatggaaagaacttt

SEQ ID NO: 9419402 - DNA, 22 bp, Homo sapiens
atccaaagaatgcttagacctg

SEQ ID NO: 9419403 - DNA, 22 bp, Homo sapiens
atccaaacctggacatgagtgg

SEQ ID NO: 9419404 - DNA, 22 bp, Homo sapiens
atccaaactatgactagtgttc

SEQ ID NO: 9419405 - DNA, 22 bp, Homo sapiens
atccaaaggtgacacagaatac

SEQ ID NO: 9419406 - DNA, 22 bp, Homo sapiens
atccaaaggtgacacagaatac

SEQ ID NO: 9419407 - DNA, 22 bp, Homo sapiens
atccaaagccctaagttaactg

SEQ ID NO: 9419408 - DNA, 22 bp, Homo sapiens
atccccagggaggcctgacctg

SEQ ID NO: 9419409 - DNA, 22 bp, Homo sapiens
atccccagggagtgagctgtct

SEQ ID NO: 9419410 - DNA, 22 bp, Homo sapiens
atccccaggggcattcaagctt

SEQ ID NO: 9419411 - DNA, 22 bp, Homo sapiens
atccccctgtatctggaagaat

SEQ ID NO: 9419412 - DNA, 22 bp, Homo sapiens
atccccctgtatctggaagaat

SEQ ID NO: 9419413 - DNA, 22 bp, Homo sapiens
atccccctcttggatggcggca

SEQ ID NO: 9419414 - DNA, 22 bp, Homo sapiens
atccccctcttggatggcggca

SEQ ID NO: 9419415 - DNA, 22 bp, Homo sapiens
atccccctcttggatggcggca

SEQ ID NO: 9419416 - DNA, 22 bp, Homo sapiens
atccctcagccacctttgagga

SEQ ID NO: 9419417 - DNA, 22 bp, Homo sapiens
atccctctctgcatgactgtgt

SEQ ID NO: 9419418 - DNA, 22 bp, Homo sapiens
atccctcagcagacagcaaaat

SEQ ID NO: 9419419 - DNA, 22 bp, Homo sapiens
atccctcagcagacagcaaaat

SEQ ID NO: 9419420 - DNA, 21 bp, Homo sapiens
atcccggctttgaggcagatg

SEQ ID NO: 9419421 - DNA, 22 bp, Homo sapiens
atccccttcacaccctctgcat

SEQ ID NO: 9419422 - DNA, 23 bp, Homo sapiens
atccacattacagtatcatacaa

SEQ ID NO: 9419423 - DNA, 22 bp, Homo sapiens
atccacatttaggtctctaaaa

SEQ ID NO: 9419424 - DNA, 23 bp, Homo sapiens
atccacattacagtatcatacaa

SEQ ID NO: 9419425 - DNA, 22 bp, Homo sapiens
atccatttgccgtgctatgtgc

SEQ ID NO: 9419426 - DNA, 22 bp, Homo sapiens
atccatttgccgtgctatgtgc

SEQ ID NO: 9419427 - DNA, 22 bp, Homo sapiens
atccatttgtaaatgttagagt

SEQ ID NO: 9419428 - DNA, 22 bp, Homo sapiens
atccatttgtaaatgttagagt

SEQ ID NO: 9419429 - DNA, 17 bp, Homo sapiens
atccccagcatctagaa

SEQ ID NO: 9419430 - DNA, 17 bp, Homo sapiens
atccccagcatctagaa

SEQ ID NO: 9419431 - DNA, 22 bp, Homo sapiens
atccacagagaggaagaatagt

SEQ ID NO: 9419432 - DNA, 22 bp, Homo sapiens
atccacaggtcatgtaatgtgg

SEQ ID NO: 9419433 - DNA, 22 bp, Homo sapiens
atcctttataagacttgtattc

SEQ ID NO: 9419434 - DNA, 22 bp, Homo sapiens
atcctttagtcctacaactcga

SEQ ID NO: 9419435 - DNA, 22 bp, Homo sapiens
atctacaacccctcaaactgtg

SEQ ID NO: 9419436 - DNA, 22 bp, Homo sapiens
atctacaacccctcaaactgtg

SEQ ID NO: 9419437 - DNA, 22 bp, Homo sapiens
atctacaacccctcaaactgtg

SEQ ID NO: 9419438 - DNA, 22 bp, Homo sapiens
atctaattttcactcatttgct

SEQ ID NO: 9419439 - DNA, 22 bp, Homo sapiens
atctacaacatcacatggcatt

SEQ ID NO: 9419440 - DNA, 22 bp, Homo sapiens
atcctctctgtgacagggaacg

SEQ ID NO: 9419441 - DNA, 22 bp, Homo sapiens
atcctctctcccataccagtct

SEQ ID NO: 9419442 - DNA, 22 bp, Homo sapiens
atcctctctgtgacagggaacg

SEQ ID NO: 9419443 - DNA, 22 bp, Homo sapiens
atcctctctgttttcgtgtatg

SEQ ID NO: 9419444 - DNA, 23 bp, Homo sapiens
atcctctctccatcccactgtgc

SEQ ID NO: 9419445 - DNA, 23 bp, Homo sapiens
atcctctctccatcccactgtgc

SEQ ID NO: 9419446 - DNA, 22 bp, Homo sapiens
atcctctctcccataccagtct

SEQ ID NO: 9419447 - DNA, 22 bp, Homo sapiens
atcctagaatcagcccttgctg

SEQ ID NO: 9419448 - DNA, 22 bp, Homo sapiens
atcctacaaagcagggctatgg

SEQ ID NO: 9419449 - DNA, 21 bp, Homo sapiens
atcctatttctgaaaacctgc

SEQ ID NO: 9419450 - DNA, 22 bp, Homo sapiens
atcctatggctagcagatgctg

SEQ ID NO: 9419451 - DNA, 22 bp, Homo sapiens
atcctaaagcagacagcaggtt

SEQ ID NO: 9419452 - DNA, 19 bp, Homo sapiens
atcctaaatccagtttcta

SEQ ID NO: 9419453 - DNA, 22 bp, Homo sapiens
atccctggccacgaagctgccc

SEQ ID NO: 9419454 - DNA, 22 bp, Homo sapiens
atatataagctgatgagccaca

SEQ ID NO: 9419455 - DNA, 22 bp, Homo sapiens
atatataatacttgctgtgggc

SEQ ID NO: 9419456 - DNA, 22 bp, Homo sapiens
atatatacaactagattaaaag

SEQ ID NO: 9419457 - DNA, 22 bp, Homo sapiens
atatataacctggataaggctt

SEQ ID NO: 9419458 - DNA, 22 bp, Homo sapiens
atatacttggagactatcattg

SEQ ID NO: 9419459 - DNA, 22 bp, Homo sapiens
atataatacaacctgctaagtg

SEQ ID NO: 9419460 - DNA, 22 bp, Homo sapiens
atatacttttcactaatggcta

SEQ ID NO: 9419461 - DNA, 22 bp, Homo sapiens
atataatacaacctgctaagtg

SEQ ID NO: 9419462 - DNA, 22 bp, Homo sapiens
atataatacaacctgctaagtg

SEQ ID NO: 9419463 - DNA, 20 bp, Homo sapiens
atataataaattttggttac

SEQ ID NO: 9419464 - DNA, 22 bp, Homo sapiens
atataactcttgttcttatagt

SEQ ID NO: 9419465 - DNA, 22 bp, Homo sapiens
atataactcttgttcttatagt

SEQ ID NO: 9419466 - DNA, 22 bp, Homo sapiens
atataactcttgttcttatagt

SEQ ID NO: 9419467 - DNA, 22 bp, Homo sapiens
atataacatacatacagaaaag

SEQ ID NO: 9419468 - DNA, 22 bp, Homo sapiens
atataagttagtggtcatgttt

SEQ ID NO: 9419469 - DNA, 22 bp, Homo sapiens
atataagtgtgtggctgttagt

SEQ ID NO: 9419470 - DNA, 22 bp, Homo sapiens
atataactcttgttcttatagt

SEQ ID NO: 9419471 - DNA, 20 bp, Homo sapiens
atataataaattttggttac

SEQ ID NO: 9419472 - DNA, 22 bp, Homo sapiens
ctgggacaagctctgtctagct

SEQ ID NO: 9419473 - DNA, 19 bp, Homo sapiens
ctgggacaatgaaagcatc

SEQ ID NO: 9419474 - DNA, 19 bp, Homo sapiens
ctgggacaatgaaagcatc

SEQ ID NO: 9419475 - DNA, 22 bp, Homo sapiens
ctgggacacagccttacctggg

SEQ ID NO: 9419476 - DNA, 22 bp, Homo sapiens
ctgggacacagccttacctggg

SEQ ID NO: 9419477 - DNA, 22 bp, Homo sapiens
ctgggaagggacgccagtgcct

SEQ ID NO: 9419478 - DNA, 22 bp, Homo sapiens
ctgggaagggacgccagtgcct

SEQ ID NO: 9419479 - DNA, 22 bp, Homo sapiens
ctgggaagggagtcaagatact

SEQ ID NO: 9419480 - DNA, 22 bp, Homo sapiens
ctgggaagcttcgagcaggaaa

SEQ ID NO: 9419481 - DNA, 22 bp, Homo sapiens
ctgggaagcttcgagcaggaaa

SEQ ID NO: 9419482 - DNA, 22 bp, Homo sapiens
ctgggaagtagaatcagatgag

SEQ ID NO: 9419483 - DNA, 22 bp, Homo sapiens
ctgggaaggggaaggtcctctc

SEQ ID NO: 9419484 - DNA, 22 bp, Homo sapiens
ctgggaagtggtgagggcctga

SEQ ID NO: 9419485 - DNA, 22 bp, Homo sapiens
ctgggaagtagaatcagatgag

SEQ ID NO: 9419486 - DNA, 22 bp, Homo sapiens
ctgggaagtagaatcagatgag

SEQ ID NO: 9419487 - DNA, 22 bp, Homo sapiens
ctgggaagatggtgacagaatt

SEQ ID NO: 9419488 - DNA, 22 bp, Homo sapiens
ctgggaagcatggtgatggtat

SEQ ID NO: 9419489 - DNA, 22 bp, Homo sapiens
ctgggaagcatggtgatggtat

SEQ ID NO: 9419490 - DNA, 22 bp, Homo sapiens
ctgggaagccacagggtgtggg

SEQ ID NO: 9419491 - DNA, 22 bp, Homo sapiens
ctggcagctgcccgagatgccc

SEQ ID NO: 9419492 - DNA, 22 bp, Homo sapiens
ctggcagctgcccgagatgccc

SEQ ID NO: 9419493 - DNA, 22 bp, Homo sapiens
ctggcagctggaggctagaggc

SEQ ID NO: 9419494 - DNA, 22 bp, Homo sapiens
ctggcagctggaggctagaggc

SEQ ID NO: 9419495 - DNA, 22 bp, Homo sapiens
ctggcagcttagcactctggtt

SEQ ID NO: 9419496 - DNA, 22 bp, Homo sapiens
ctggcagctggaggctagaggc

SEQ ID NO: 9419497 - DNA, 22 bp, Homo sapiens
ctggcttctgggccagggcaga

SEQ ID NO: 9419498 - DNA, 22 bp, Homo sapiens
atatatactttgacacattctg

SEQ ID NO: 9419499 - DNA, 22 bp, Homo sapiens
atatatacaactagattaaaag

SEQ ID NO: 9419500 - DNA, 22 bp, Homo sapiens
atatatactttgacacattctg

SEQ ID NO: 9419501 - DNA, 22 bp, Homo sapiens
atatatagagctagatgttaaa

SEQ ID NO: 9419502 - DNA, 22 bp, Homo sapiens
atatatagagctagatgttaaa

SEQ ID NO: 9419503 - DNA, 22 bp, Homo sapiens
ctgggacttgtagtctcggcgc

SEQ ID NO: 9419504 - DNA, 22 bp, Homo sapiens
ctgggactttaccctgtggccc

SEQ ID NO: 9419505 - DNA, 22 bp, Homo sapiens
ctgggactttaccctgtggccc

SEQ ID NO: 9419506 - DNA, 22 bp, Homo sapiens
ctgggactttgtaggccagttg

SEQ ID NO: 9419507 - DNA, 22 bp, Homo sapiens
ctgggactttgtaggccagttg

SEQ ID NO: 9419508 - DNA, 22 bp, Homo sapiens
ctgggactttgtaggccagttg

SEQ ID NO: 9419509 - DNA, 22 bp, Homo sapiens
ctgggagaatttgttgaaggat

SEQ ID NO: 9419510 - DNA, 22 bp, Homo sapiens
ctgggagaatttgttgaaggat

SEQ ID NO: 9419511 - DNA, 22 bp, Homo sapiens
ctgggagacaagagagggctga

SEQ ID NO: 9419512 - DNA, 22 bp, Homo sapiens
ctgggagacaagagagggctga

SEQ ID NO: 9419513 - DNA, 22 bp, Homo sapiens
ctgggagacgcagctggggatc

SEQ ID NO: 9419514 - DNA, 22 bp, Homo sapiens
ctgggagacgcagctggggatc

SEQ ID NO: 9419515 - DNA, 22 bp, Homo sapiens
ctgggagacgcagctggggatc

SEQ ID NO: 9419516 - DNA, 22 bp, Homo sapiens
ctgggagagaagcgaagctggg

SEQ ID NO: 9419517 - DNA, 22 bp, Homo sapiens
ctgggagagaagcgaagctggg

SEQ ID NO: 9419518 - DNA, 22 bp, Homo sapiens
ctgggagagaagcgaagctggg

SEQ ID NO: 9419519 - DNA, 22 bp, Homo sapiens
ctgggagagaagcgaagctggg

SEQ ID NO: 9419520 - DNA, 22 bp, Homo sapiens
ctgggagagcctttcctgagtc

SEQ ID NO: 9419521 - DNA, 22 bp, Homo sapiens
ctgggagaggaacctcgagggt

SEQ ID NO: 9419522 - DNA, 22 bp, Homo sapiens
ctgggagagaagcgaagctggg

SEQ ID NO: 9419523 - DNA, 22 bp, Homo sapiens
ctgggagagcctttcctgagtc

SEQ ID NO: 9419524 - DNA, 22 bp, Homo sapiens
ctgggagagcctttcctgagtc

SEQ ID NO: 9419525 - DNA, 20 bp, Homo sapiens
ctgggcacctgtctgcagtt

SEQ ID NO: 9419526 - DNA, 20 bp, Homo sapiens
ctgggcacctgtctgcagtt

SEQ ID NO: 9419527 - DNA, 20 bp, Homo sapiens
ctgggcacctgtctgcagtt

SEQ ID NO: 9419528 - DNA, 22 bp, Homo sapiens
atatatatcgagttcatgtctc

SEQ ID NO: 9419529 - DNA, 22 bp, Homo sapiens
atatatatcgagttcatgtctc

SEQ ID NO: 9419530 - DNA, 22 bp, Homo sapiens
ctgggcacctttgcagcaggct

SEQ ID NO: 9419531 - DNA, 23 bp, Homo sapiens
ctgggcacccagtacctaggccc

SEQ ID NO: 9419532 - DNA, 22 bp, Homo sapiens
ctgggcaccaggcatgacaggg

SEQ ID NO: 9419533 - DNA, 23 bp, Homo sapiens
ctgggcacccagtacctaggccc

SEQ ID NO: 9419534 - DNA, 22 bp, Homo sapiens
ctgggcaccaggcatgacaggg

SEQ ID NO: 9419535 - DNA, 22 bp, Homo sapiens
ctgggcacaggggagcagagtc

SEQ ID NO: 9419536 - DNA, 22 bp, Homo sapiens
ctgggcacaggggagcagagtc

SEQ ID NO: 9419537 - DNA, 22 bp, Homo sapiens
ctgggcacagtggctcacgcct

SEQ ID NO: 9419538 - DNA, 22 bp, Homo sapiens
ctgggcacattttgactagtgt

SEQ ID NO: 9419539 - DNA, 19 bp, Homo sapiens
ctgggaggtgttcagagaa

SEQ ID NO: 9419540 - DNA, 22 bp, Homo sapiens
ctgggcaatatgctgggcctgg

SEQ ID NO: 9419541 - DNA, 19 bp, Homo sapiens
ctgggaggtgttcagagaa

SEQ ID NO: 9419542 - DNA, 22 bp, Homo sapiens
ctgggcacacagtgactctgca

SEQ ID NO: 9419543 - DNA, 22 bp, Homo sapiens
ctgggcacacagtgactctgca

SEQ ID NO: 9419544 - DNA, 22 bp, Homo sapiens
ctgggcacaagtggccctggat

SEQ ID NO: 9419545 - DNA, 22 bp, Homo sapiens
ctgggcacaagtggccctggat

SEQ ID NO: 9419546 - DNA, 22 bp, Homo sapiens
ctgggcacagcgttgggctctt

SEQ ID NO: 9419547 - DNA, 22 bp, Homo sapiens
ctgggcacagcgttgggctctt

SEQ ID NO: 9419548 - DNA, 22 bp, Homo sapiens
ctgggcacagcgttgggctctt

SEQ ID NO: 9419549 - DNA, 22 bp, Homo sapiens
ctgggcacaggggagcagagtc

SEQ ID NO: 9419550 - DNA, 22 bp, Homo sapiens
atatgacagcggattcacatat

SEQ ID NO: 9419551 - DNA, 22 bp, Homo sapiens
atatgacagcggattcacatat

SEQ ID NO: 9419552 - DNA, 22 bp, Homo sapiens
atatgaatttggggaggacaca

SEQ ID NO: 9419553 - DNA, 22 bp, Homo sapiens
atatgaatttggctggaaaggt

SEQ ID NO: 9419554 - DNA, 22 bp, Homo sapiens
atatgaatttggctggaaaggt

SEQ ID NO: 9419555 - DNA, 22 bp, Homo sapiens
atatgaatttggctggaaaggt

SEQ ID NO: 9419556 - DNA, 22 bp, Homo sapiens
atatgaagtcagacaaactggg

SEQ ID NO: 9419557 - DNA, 22 bp, Homo sapiens
atatgaagaattccaatttgga

SEQ ID NO: 9419558 - DNA, 22 bp, Homo sapiens
atatgaagaattccaatttgga

SEQ ID NO: 9419559 - DNA, 22 bp, Homo sapiens
atatgaagttacaggtaagaaa

SEQ ID NO: 9419560 - DNA, 22 bp, Homo sapiens
atatgaatttggctggaaaggt

SEQ ID NO: 9419561 - DNA, 22 bp, Homo sapiens
atatgaagttacaggtaagaaa

SEQ ID NO: 9419562 - DNA, 22 bp, Homo sapiens
atatgagagaggaaagatttta

SEQ ID NO: 9419563 - DNA, 22 bp, Homo sapiens
atatgagagtaaatgccgatct

SEQ ID NO: 9419564 - DNA, 21 bp, Homo sapiens
atatgagtttcagatgttgct

SEQ ID NO: 9419565 - DNA, 22 bp, Homo sapiens
atatgacataaaatcatttttg

SEQ ID NO: 9419566 - DNA, 22 bp, Homo sapiens
atatgacataaaatcatttttg

SEQ ID NO: 9419567 - DNA, 22 bp, Homo sapiens
atatgacagcggattcacatat

SEQ ID NO: 9419568 - DNA, 22 bp, Homo sapiens
atatatggttaggaatctatga

SEQ ID NO: 9419569 - DNA, 22 bp, Homo sapiens
atatcattctgatgtatatctt

SEQ ID NO: 9419570 - DNA, 22 bp, Homo sapiens
atatatgcatgtgtacttatgt

SEQ ID NO: 9419571 - DNA, 22 bp, Homo sapiens
atatatctgcagtactgaagaa

SEQ ID NO: 9419572 - DNA, 18 bp, Homo sapiens
atatccaataatgaacac

SEQ ID NO: 9419573 - DNA, 22 bp, Homo sapiens
atatccaagaaacaattaattc

SEQ ID NO: 9419574 - DNA, 22 bp, Homo sapiens
atatcattctgatgtatatctt

SEQ ID NO: 9419575 - DNA, 22 bp, Homo sapiens
atatcattctgatgtatatctt

SEQ ID NO: 9419576 - DNA, 21 bp, Homo sapiens
atatgaactgtggactttgga

SEQ ID NO: 9419577 - DNA, 21 bp, Homo sapiens
atatgaactgtggactttgga

SEQ ID NO: 9419578 - DNA, 18 bp, Homo sapiens
atatccaataatgaacac

SEQ ID NO: 9419579 - DNA, 22 bp, Homo sapiens
atatgaaagtaagcatgtgtgt

SEQ ID NO: 9419580 - DNA, 22 bp, Homo sapiens
atatatctgcagtactgaagaa

SEQ ID NO: 9419581 - DNA, 22 bp, Homo sapiens
atatatcatgagtaaaacttga

SEQ ID NO: 9419582 - DNA, 22 bp, Homo sapiens
atatatcatgagtaaaacttga

SEQ ID NO: 9419583 - DNA, 22 bp, Homo sapiens
atatgcttacactacaagatga

SEQ ID NO: 9419584 - DNA, 22 bp, Homo sapiens
atatgctggagtacaggaaata

SEQ ID NO: 9419585 - DNA, 22 bp, Homo sapiens
atatgctggagtacaggaaata

SEQ ID NO: 9419586 - DNA, 20 bp, Homo sapiens
atatgcttaatctcactaca

SEQ ID NO: 9419587 - DNA, 22 bp, Homo sapiens
atatgcttacactacaagatga

SEQ ID NO: 9419588 - DNA, 22 bp, Homo sapiens
atatgcttacactacaagatga

SEQ ID NO: 9419589 - DNA, 22 bp, Homo sapiens
atatggcattacattgttaaat

SEQ ID NO: 9419590 - DNA, 22 bp, Homo sapiens
atatggcattttaatgtatgag

SEQ ID NO: 9419591 - DNA, 22 bp, Homo sapiens
atatggcattttaatgtatgag

SEQ ID NO: 9419592 - DNA, 22 bp, Homo sapiens
ctgggcagtggtggcccttccc

SEQ ID NO: 9419593 - DNA, 22 bp, Homo sapiens
ctgggcagtggtggcccttccc

SEQ ID NO: 9419594 - DNA, 22 bp, Homo sapiens
ctgggcagtggtggcccttccc

SEQ ID NO: 9419595 - DNA, 22 bp, Homo sapiens
ctgggcagtggtggcatctttg

SEQ ID NO: 9419596 - DNA, 22 bp, Homo sapiens
ctgggcagtggtggcatctttg

SEQ ID NO: 9419597 - DNA, 22 bp, Homo sapiens
ctgggcaggagggctctatgga

SEQ ID NO: 9419598 - DNA, 22 bp, Homo sapiens
ctgggcaggagggctctatgga

SEQ ID NO: 9419599 - DNA, 22 bp, Homo sapiens
ctgggcaggagggctctatgga

SEQ ID NO: 9419600 - DNA, 22 bp, Homo sapiens
atatgattgtccttagcaaatt

SEQ ID NO: 9419601 - DNA, 22 bp, Homo sapiens
atatgattgtccttagcaaatt

SEQ ID NO: 9419602 - DNA, 22 bp, Homo sapiens
atatgattccactattgtatgg

SEQ ID NO: 9419603 - DNA, 22 bp, Homo sapiens
atatgattgtccttagcaaatt

SEQ ID NO: 9419604 - DNA, 22 bp, Homo sapiens
ctgggcagtatgaatattcaaa

SEQ ID NO: 9419605 - DNA, 22 bp, Homo sapiens
ctgggcagtgcagctatagaac

SEQ ID NO: 9419606 - DNA, 22 bp, Homo sapiens
ctgggcagtgcagctatagaac

SEQ ID NO: 9419607 - DNA, 22 bp, Homo sapiens
ctgggcaggtatacaaaaaatg

SEQ ID NO: 9419608 - DNA, 22 bp, Homo sapiens
ctgggcaggatacttcatggga

SEQ ID NO: 9419609 - DNA, 22 bp, Homo sapiens
ctgggcaggtatacaaaaaatg

SEQ ID NO: 9419610 - DNA, 22 bp, Homo sapiens
ctgggcaggtatacaaaaaatg

SEQ ID NO: 9419611 - DNA, 20 bp, Homo sapiens
ctgggcaggtgtttgatctc

SEQ ID NO: 9419612 - DNA, 22 bp, Homo sapiens
atatttctctcagacatggaag

SEQ ID NO: 9419613 - DNA, 22 bp, Homo sapiens
atatttctctcagacatggaag

SEQ ID NO: 9419614 - DNA, 22 bp, Homo sapiens
atatttctgggggtgtgtttct

SEQ ID NO: 9419615 - DNA, 22 bp, Homo sapiens
atatttctgggggtgtgtttct

SEQ ID NO: 9419616 - DNA, 20 bp, Homo sapiens
atatttcttaagaactttca

SEQ ID NO: 9419617 - DNA, 20 bp, Homo sapiens
atatttcttaagaactttca

SEQ ID NO: 9419618 - DNA, 20 bp, Homo sapiens
atatttcttaagaactttca

SEQ ID NO: 9419619 - DNA, 22 bp, Homo sapiens
atatttgtaaaattctgtgtct

SEQ ID NO: 9419620 - DNA, 22 bp, Homo sapiens
atatttgtagtgggtaagaagt

SEQ ID NO: 9419621 - DNA, 22 bp, Homo sapiens
atatttgtagtgggtaagaagt

SEQ ID NO: 9419622 - DNA, 22 bp, Homo sapiens
atatttgtagtgggtaagaagt

SEQ ID NO: 9419623 - DNA, 22 bp, Homo sapiens
atatttcttgagcacctggtat

SEQ ID NO: 9419624 - DNA, 22 bp, Homo sapiens
atatttcttgagcacctggtat

SEQ ID NO: 9419625 - DNA, 22 bp, Homo sapiens
atatttgcaggaaactagtttt

SEQ ID NO: 9419626 - DNA, 22 bp, Homo sapiens
atatttggaaagaaaatcattg

SEQ ID NO: 9419627 - DNA, 22 bp, Homo sapiens
atatgttactctttcaagcaga

SEQ ID NO: 9419628 - DNA, 22 bp, Homo sapiens
atatgttactctttcaagcaga

SEQ ID NO: 9419629 - DNA, 18 bp, Homo sapiens
atatgttaattaggtagg

SEQ ID NO: 9419630 - DNA, 22 bp, Homo sapiens
atatgtttcagtattcaagtca

SEQ ID NO: 9419631 - DNA, 22 bp, Homo sapiens
atatgtttcagtattcaagtca

SEQ ID NO: 9419632 - DNA, 22 bp, Homo sapiens
atatttagctcatttccagtgc

SEQ ID NO: 9419633 - DNA, 22 bp, Homo sapiens
atatttctctcagacatggaag

SEQ ID NO: 9419634 - DNA, 22 bp, Homo sapiens
atatttctccaaatgttttcaa

SEQ ID NO: 9419635 - DNA, 22 bp, Homo sapiens
atatttactgctgtggtgaagg

SEQ ID NO: 9419636 - DNA, 22 bp, Homo sapiens
atatgtttttcacaggtttaag

SEQ ID NO: 9419637 - DNA, 22 bp, Homo sapiens
atatgtacacttacgttacaaa

SEQ ID NO: 9419638 - DNA, 22 bp, Homo sapiens
atatggtaagagtatatttact

SEQ ID NO: 9419639 - DNA, 22 bp, Homo sapiens
atatgggggggcgtgcagagga

SEQ ID NO: 9419640 - DNA, 22 bp, Homo sapiens
atatgggggggcgtgcagagga

SEQ ID NO: 9419641 - DNA, 22 bp, Homo sapiens
atatgtatagccagtctttagg

SEQ ID NO: 9419642 - DNA, 20 bp, Homo sapiens
atatgtgtacgtgtatacat

SEQ ID NO: 9419643 - DNA, 23 bp, Homo sapiens
atatgtcatgcaccagcacttta

SEQ ID NO: 9419644 - DNA, 22 bp, Homo sapiens
atatgtccacctgtatgctaaa

SEQ ID NO: 9419645 - DNA, 22 bp, Homo sapiens
atatgtcctcggcacataatgt

SEQ ID NO: 9419646 - DNA, 22 bp, Homo sapiens
atatgtcaagattttgagcaga

SEQ ID NO: 9419647 - DNA, 22 bp, Homo sapiens
atatgtgaagtgggttattttg

SEQ ID NO: 9419648 - DNA, 22 bp, Homo sapiens
atatgtcttgtttacagccttg

SEQ ID NO: 9419649 - DNA, 17 bp, Homo sapiens
ctgaggggagtgctgtg

SEQ ID NO: 9419650 - DNA, 22 bp, Homo sapiens
ctgaggggataaaggtttgggt

SEQ ID NO: 9419651 - DNA, 22 bp, Homo sapiens
ctgaggggtatccaaggggtaa

SEQ ID NO: 9419652 - DNA, 22 bp, Homo sapiens
ctgaggggtatccaaggggtaa

SEQ ID NO: 9419653 - DNA, 22 bp, Homo sapiens
ctgaggggtatccaaggggtaa

SEQ ID NO: 9419654 - DNA, 22 bp, Homo sapiens
ctgaggctttgtgtgcatgcct

SEQ ID NO: 9419655 - DNA, 22 bp, Homo sapiens
ctgaggcttgtcctctcagctt

SEQ ID NO: 9419656 - DNA, 22 bp, Homo sapiens
ctgagggtcaacttgattgtat

SEQ ID NO: 9419657 - DNA, 22 bp, Homo sapiens
ctgagggtcaacttgattgtat

SEQ ID NO: 9419658 - DNA, 22 bp, Homo sapiens
ctgagggtcaacttgattgtat

SEQ ID NO: 9419659 - DNA, 20 bp, Homo sapiens
ctgaggggtctgacttggac

SEQ ID NO: 9419660 - DNA, 20 bp, Homo sapiens
ctgaggggtctgacttggac

SEQ ID NO: 9419661 - DNA, 22 bp, Homo sapiens
ctgaggggtcgtgggagcccag

SEQ ID NO: 9419662 - DNA, 22 bp, Homo sapiens
ctgaggggtcgtgggagcccag

SEQ ID NO: 9419663 - DNA, 22 bp, Homo sapiens
ctgaggtcaccccactggctgt

SEQ ID NO: 9419664 - DNA, 22 bp, Homo sapiens
ctgaggtcagagtttagtctgg

SEQ ID NO: 9419665 - DNA, 22 bp, Homo sapiens
agttgtattagagaacacaaac

SEQ ID NO: 9419666 - DNA, 22 bp, Homo sapiens
agttgtcacctctattcaaatc

SEQ ID NO: 9419667 - DNA, 22 bp, Homo sapiens
agttgtacattgtgaacattca

SEQ ID NO: 9419668 - DNA, 22 bp, Homo sapiens
ctgaggctgggcttgccttctt

SEQ ID NO: 9419669 - DNA, 22 bp, Homo sapiens
ctgaggctggggaagggaagtg

SEQ ID NO: 9419670 - DNA, 22 bp, Homo sapiens
ctgaggctgggctgagggtata

SEQ ID NO: 9419671 - DNA, 18 bp, Homo sapiens
ctgaggcttagagaggtt

SEQ ID NO: 9419672 - DNA, 22 bp, Homo sapiens
ctgaggctggggaagggaagtg

SEQ ID NO: 9419673 - DNA, 18 bp, Homo sapiens
ctgaggcttagagaggtt

SEQ ID NO: 9419674 - DNA, 22 bp, Homo sapiens
ctgaggcttggaggggtctggt

SEQ ID NO: 9419675 - DNA, 22 bp, Homo sapiens
ctgaggcttggaggggtctggt

SEQ ID NO: 9419676 - DNA, 22 bp, Homo sapiens
ctgaggcttctctagttcagct

SEQ ID NO: 9419677 - DNA, 22 bp, Homo sapiens
ctgaggcttggaggggtctggt

SEQ ID NO: 9419678 - DNA, 22 bp, Homo sapiens
ctgaggcttgtcctctcagctt

SEQ ID NO: 9419679 - DNA, 22 bp, Homo sapiens
ctgaggcctctcccactccagc

SEQ ID NO: 9419680 - DNA, 22 bp, Homo sapiens
ctgaggcctctcccactccagc

SEQ ID NO: 9419681 - DNA, 22 bp, Homo sapiens
ctgaggcctctccttggcttgt

SEQ ID NO: 9419682 - DNA, 22 bp, Homo sapiens
ctgaggcctcgttggctggaac

SEQ ID NO: 9419683 - DNA, 22 bp, Homo sapiens
ctgaggcctcgttggctggaac

SEQ ID NO: 9419684 - DNA, 22 bp, Homo sapiens
ctgaggcctctcccactccagc

SEQ ID NO: 9419685 - DNA, 22 bp, Homo sapiens
ctgaggcctctctcctgggctt

SEQ ID NO: 9419686 - DNA, 22 bp, Homo sapiens
ctgaggcctctccttggcttgt

SEQ ID NO: 9419687 - DNA, 22 bp, Homo sapiens
ctgaggcctctctcctgggctt

SEQ ID NO: 9419688 - DNA, 22 bp, Homo sapiens
ctgaggcctctctcctgggctt

SEQ ID NO: 9419689 - DNA, 22 bp, Homo sapiens
ctgaggcctctctccttggctt

SEQ ID NO: 9419690 - DNA, 22 bp, Homo sapiens
ctgaggcctctctccttggctt

SEQ ID NO: 9419691 - DNA, 22 bp, Homo sapiens
ctgaggcctctctccttggctt

SEQ ID NO: 9419692 - DNA, 22 bp, Homo sapiens
ctgaggcctctgttcaccagaa

SEQ ID NO: 9419693 - DNA, 22 bp, Homo sapiens
ctgaggcctctgttcaccagaa

SEQ ID NO: 9419694 - DNA, 22 bp, Homo sapiens
ctgaggcctctttccttggctt

SEQ ID NO: 9419695 - DNA, 22 bp, Homo sapiens
ctgaggcctctttccttggctt

SEQ ID NO: 9419696 - DNA, 22 bp, Homo sapiens
ctgaggcctctttccttggctt

SEQ ID NO: 9419697 - DNA, 23 bp, Homo sapiens
ctgaggcctgctgcgttcaggtt

SEQ ID NO: 9419698 - DNA, 23 bp, Homo sapiens
ctgaggcctgctgcgttcaggtt

SEQ ID NO: 9419699 - DNA, 22 bp, Homo sapiens
ctgaggctgggctgagggtata

SEQ ID NO: 9419700 - DNA, 22 bp, Homo sapiens
ctgaggcatgaatgtgggcttt

SEQ ID NO: 9419701 - DNA, 22 bp, Homo sapiens
ctgaggcatcatggagaacagt

SEQ ID NO: 9419702 - DNA, 22 bp, Homo sapiens
ctgaggcatcatggagaacagt

SEQ ID NO: 9419703 - DNA, 22 bp, Homo sapiens
ctgaggcatcatggagaacagt

SEQ ID NO: 9419704 - DNA, 22 bp, Homo sapiens
ctgaggcctcactgtagtccct

SEQ ID NO: 9419705 - DNA, 22 bp, Homo sapiens
ctgaggcctcactgtagtccct

SEQ ID NO: 9419706 - DNA, 22 bp, Homo sapiens
ctgaggcctaagacatgaatga

SEQ ID NO: 9419707 - DNA, 22 bp, Homo sapiens
ctgaggcctcactgtagtccct

SEQ ID NO: 9419708 - DNA, 22 bp, Homo sapiens
ctgaggcctaagacatgaatga

SEQ ID NO: 9419709 - DNA, 21 bp, Homo sapiens
ctgaggcatgcaggcctgggc

SEQ ID NO: 9419710 - DNA, 22 bp, Homo sapiens
ctgaggcatgaatgtgggcttt

SEQ ID NO: 9419711 - DNA, 22 bp, Homo sapiens
ctgaggcatgaatgtgggcttt

SEQ ID NO: 9419712 - DNA, 22 bp, Homo sapiens
ctgaggcaggatggcctggctg

SEQ ID NO: 9419713 - DNA, 22 bp, Homo sapiens
ctgaggcaggatggcctggctg

SEQ ID NO: 9419714 - DNA, 22 bp, Homo sapiens
ctgaggcaggggcagctggaga

SEQ ID NO: 9419715 - DNA, 22 bp, Homo sapiens
ctgaggcaggggcagctggaga

SEQ ID NO: 9419716 - DNA, 21 bp, Homo sapiens
ctgaggcagcacagctagtca

SEQ ID NO: 9419717 - DNA, 22 bp, Homo sapiens
agttgtaagaggcacaaggaag

SEQ ID NO: 9419718 - DNA, 22 bp, Homo sapiens
agttgggtttgtgtcagttgca

SEQ ID NO: 9419719 - DNA, 22 bp, Homo sapiens
agttgtaacagattctaacata

SEQ ID NO: 9419720 - DNA, 22 bp, Homo sapiens
agttggttggacccaagtaagg

SEQ ID NO: 9419721 - DNA, 22 bp, Homo sapiens
agttggttggacccaagtaagg

SEQ ID NO: 9419722 - DNA, 22 bp, Homo sapiens
agttgggattcttggttctggg

SEQ ID NO: 9419723 - DNA, 22 bp, Homo sapiens
agttgggagttatagactctat

SEQ ID NO: 9419724 - DNA, 22 bp, Homo sapiens
agttgggattcttggttctggg

SEQ ID NO: 9419725 - DNA, 22 bp, Homo sapiens
agttgggagttatagactctat

SEQ ID NO: 9419726 - DNA, 19 bp, Homo sapiens
agttggggcagggaagaga

SEQ ID NO: 9419727 - DNA, 23 bp, Homo sapiens
agttggcatattcaagcacagtc

SEQ ID NO: 9419728 - DNA, 22 bp, Homo sapiens
agttggcgggacatgtggaaag

SEQ ID NO: 9419729 - DNA, 22 bp, Homo sapiens
agttgcttctcaggaaaggagc

SEQ ID NO: 9419730 - DNA, 23 bp, Homo sapiens
agttggacctgggtaagaaaatg

SEQ ID NO: 9419731 - DNA, 22 bp, Homo sapiens
agttggagaagaggtcgggaat

SEQ ID NO: 9419732 - DNA, 18 bp, Homo sapiens
agttgcttattctgtgca

SEQ ID NO: 9419733 - DNA, 22 bp, Homo sapiens
agttgctggcacctgtgagtat

SEQ ID NO: 9419734 - DNA, 22 bp, Homo sapiens
agttggcaaaggtaggtattct

SEQ ID NO: 9419735 - DNA, 22 bp, Homo sapiens
agttggagtgaacatgagattg

SEQ ID NO: 9419736 - DNA, 22 bp, Homo sapiens
agttgctgattctgtctgtgat

SEQ ID NO: 9419737 - DNA, 22 bp, Homo sapiens
agttcttcccttttctatggag

SEQ ID NO: 9419738 - DNA, 22 bp, Homo sapiens
agttcttgctataaaaacaaat

SEQ ID NO: 9419739 - DNA, 22 bp, Homo sapiens
agttcttcccttttctatggag

SEQ ID NO: 9419740 - DNA, 21 bp, Homo sapiens
ctctttgggatctttggaaag

SEQ ID NO: 9419741 - DNA, 21 bp, Homo sapiens
ctctttgggatctttggaaag

SEQ ID NO: 9419742 - DNA, 22 bp, Homo sapiens
ctctttgggatgggctctgctg

SEQ ID NO: 9419743 - DNA, 16 bp, Homo sapiens
ctctttgggcttccag

SEQ ID NO: 9419744 - DNA, 22 bp, Homo sapiens
ctctttggtcgcatcatccatt

SEQ ID NO: 9419745 - DNA, 22 bp, Homo sapiens
ctctttggtcgcatcatccatt

SEQ ID NO: 9419746 - DNA, 22 bp, Homo sapiens
ctctttggggtgccccactggt

SEQ ID NO: 9419747 - DNA, 22 bp, Homo sapiens
ctctttggggctggaagcctag

SEQ ID NO: 9419748 - DNA, 22 bp, Homo sapiens
ctgcagctcctgagctcagaga

SEQ ID NO: 9419749 - DNA, 22 bp, Homo sapiens
ctgcagctcccctgagatcaag

SEQ ID NO: 9419750 - DNA, 22 bp, Homo sapiens
ctgcagctcctgagctcagaga

SEQ ID NO: 9419751 - DNA, 22 bp, Homo sapiens
ctgcagctcctctctgtgcccc

SEQ ID NO: 9419752 - DNA, 22 bp, Homo sapiens
ctgcagctccttctggcatgtg

SEQ ID NO: 9419753 - DNA, 22 bp, Homo sapiens
ctgcagctaaggaatgtggttg

SEQ ID NO: 9419754 - DNA, 22 bp, Homo sapiens
ctgcagctcccctgagatcaag

SEQ ID NO: 9419755 - DNA, 22 bp, Homo sapiens
ctgcagcctcctccagctacgt

SEQ ID NO: 9419756 - DNA, 22 bp, Homo sapiens
ctgcagagcaagttctctgttg

SEQ ID NO: 9419757 - DNA, 22 bp, Homo sapiens
ctgcagagcagccagtccccca

SEQ ID NO: 9419758 - DNA, 22 bp, Homo sapiens
agtttacaaagtttcactgttc

SEQ ID NO: 9419759 - DNA, 22 bp, Homo sapiens
agtttacaaagtttcactgttc

SEQ ID NO: 9419760 - DNA, 22 bp, Homo sapiens
agttgtcacttcaagcaagtgt

SEQ ID NO: 9419761 - DNA, 22 bp, Homo sapiens
agttgtcagtcaaagacatttg

SEQ ID NO: 9419762 - DNA, 22 bp, Homo sapiens
agttgtcagtcaaagacatttg

SEQ ID NO: 9419763 - DNA, 22 bp, Homo sapiens
agttgtgctgtgatgcaggata

SEQ ID NO: 9419764 - DNA, 22 bp, Homo sapiens
agttgtgctgtgatgcaggata

SEQ ID NO: 9419765 - DNA, 22 bp, Homo sapiens
agtttaaatcatgttttgtaac

SEQ ID NO: 9419766 - DNA, 22 bp, Homo sapiens
agtttaactttggaaaactata

SEQ ID NO: 9419767 - DNA, 22 bp, Homo sapiens
agtttaaatcatgttttgtaac

SEQ ID NO: 9419768 - DNA, 23 bp, Homo sapiens
agtttgtaaagaaatatttgcac

SEQ ID NO: 9419769 - DNA, 22 bp, Homo sapiens
agtttgtactgaattcaattta

SEQ ID NO: 9419770 - DNA, 22 bp, Homo sapiens
agtttgtaagttcattatgagt

SEQ ID NO: 9419771 - DNA, 22 bp, Homo sapiens
agtttgtaagttcattatgagt

SEQ ID NO: 9419772 - DNA, 22 bp, Homo sapiens
agtttggaagtcaggcttttct

SEQ ID NO: 9419773 - DNA, 22 bp, Homo sapiens
agtttggaagagaaaaatattt

SEQ ID NO: 9419774 - DNA, 22 bp, Homo sapiens
agtttggaggcagggttgatga

SEQ ID NO: 9419775 - DNA, 22 bp, Homo sapiens
agtttggagtgtggtctttgag

SEQ ID NO: 9419776 - DNA, 22 bp, Homo sapiens
agtttggctcacatctttggct

SEQ ID NO: 9419777 - DNA, 22 bp, Homo sapiens
agtttggcagagcttgggtggt

SEQ ID NO: 9419778 - DNA, 22 bp, Homo sapiens
agtttgcagattatattagtgt

SEQ ID NO: 9419779 - DNA, 22 bp, Homo sapiens
agtttggaaaatgagacaagga

SEQ ID NO: 9419780 - DNA, 22 bp, Homo sapiens
agtttggaagaatttggtctgt

SEQ ID NO: 9419781 - DNA, 22 bp, Homo sapiens
agtttggaaaatgagacaagga

SEQ ID NO: 9419782 - DNA, 22 bp, Homo sapiens
agtttgatgattacagagaaaa

SEQ ID NO: 9419783 - DNA, 22 bp, Homo sapiens
agtttgattgtatgggttttaa

SEQ ID NO: 9419784 - DNA, 22 bp, Homo sapiens
agtttgaagaaggatctatgaa

SEQ ID NO: 9419785 - DNA, 22 bp, Homo sapiens
ctgcagctggctcatgggatat

SEQ ID NO: 9419786 - DNA, 17 bp, Homo sapiens
ctgcagctggagggcca

SEQ ID NO: 9419787 - DNA, 22 bp, Homo sapiens
ctgcagctggagcatcttctca

SEQ ID NO: 9419788 - DNA, 23 bp, Homo sapiens
agtttctttgagacttgccctgt

SEQ ID NO: 9419789 - DNA, 22 bp, Homo sapiens
ctgcagctggctcatgggatat

SEQ ID NO: 9419790 - DNA, 22 bp, Homo sapiens
ctgcagctgctcatgttacttg

SEQ ID NO: 9419791 - DNA, 22 bp, Homo sapiens
ctgcagctctagcttttgacct

SEQ ID NO: 9419792 - DNA, 22 bp, Homo sapiens
ctgcagctgccagtgatttcag

SEQ ID NO: 9419793 - DNA, 22 bp, Homo sapiens
ctgcagctgcagttctgagaga

SEQ ID NO: 9419794 - DNA, 22 bp, Homo sapiens
ctgcagctgccagtgatttcag

SEQ ID NO: 9419795 - DNA, 22 bp, Homo sapiens
ctgcagctgcagttctgagaga

SEQ ID NO: 9419796 - DNA, 22 bp, Homo sapiens
ctgcagctgcagttctgagaga

SEQ ID NO: 9419797 - DNA, 22 bp, Homo sapiens
ctgcagctgcagttctgagaga

SEQ ID NO: 9419798 - DNA, 22 bp, Homo sapiens
ctgcagctgccagtgatttcag

SEQ ID NO: 9419799 - DNA, 22 bp, Homo sapiens
ctgcagctgccagtgatttcag

SEQ ID NO: 9419800 - DNA, 22 bp, Homo sapiens
ctgcagctgcgggaccggagcg

SEQ ID NO: 9419801 - DNA, 22 bp, Homo sapiens
ctgcagctgctcatgttacttg

SEQ ID NO: 9419802 - DNA, 22 bp, Homo sapiens
ctgcagctggagcatcttctca

SEQ ID NO: 9419803 - DNA, 22 bp, Homo sapiens
ataaaggataatccattagact

SEQ ID NO: 9419804 - DNA, 17 bp, Homo sapiens
ataaaggcaagtattat

SEQ ID NO: 9419805 - DNA, 22 bp, Homo sapiens
ataaaggcagattttggacctc

SEQ ID NO: 9419806 - DNA, 19 bp, Homo sapiens
ataaataaaaagtgggaga

SEQ ID NO: 9419807 - DNA, 22 bp, Homo sapiens
ataaatagtgaagggagccggt

SEQ ID NO: 9419808 - DNA, 22 bp, Homo sapiens
ataaatagtgctgccatgagta

SEQ ID NO: 9419809 - DNA, 22 bp, Homo sapiens
ataaatagtgctgccatgagta

SEQ ID NO: 9419810 - DNA, 22 bp, Homo sapiens
ataaatagtgctgccatgagta

SEQ ID NO: 9419811 - DNA, 22 bp, Homo sapiens
ataaatatcactgttgtccctc

SEQ ID NO: 9419812 - DNA, 22 bp, Homo sapiens
ataaatatcactgttgtccctc

SEQ ID NO: 9419813 - DNA, 22 bp, Homo sapiens
ataaatatcactgttgtccctc

SEQ ID NO: 9419814 - DNA, 22 bp, Homo sapiens
ataaatagtgtgtcataaagtc

SEQ ID NO: 9419815 - DNA, 22 bp, Homo sapiens
ataaatagtgtgtcataaagtc

SEQ ID NO: 9419816 - DNA, 22 bp, Homo sapiens
ataaatagtgtgtcataaagtc

SEQ ID NO: 9419817 - DNA, 22 bp, Homo sapiens
ataaatagtgtgtcataaagtc

SEQ ID NO: 9419818 - DNA, 22 bp, Homo sapiens
ataaatagtgtgtcataaagtc

SEQ ID NO: 9419819 - DNA, 22 bp, Homo sapiens
ataaatagtgtgtcataaagtc

SEQ ID NO: 9419820 - DNA, 22 bp, Homo sapiens
ataaatagtgtgtcataaagtc

SEQ ID NO: 9419821 - DNA, 22 bp, Homo sapiens
ataaaagtttccaatcatgcct

SEQ ID NO: 9419822 - DNA, 22 bp, Homo sapiens
ataaaagttcaagagagtacag

SEQ ID NO: 9419823 - DNA, 20 bp, Homo sapiens
ataaaataactgccacaaga

SEQ ID NO: 9419824 - DNA, 22 bp, Homo sapiens
ataaaagtttccaatcatgcct

SEQ ID NO: 9419825 - DNA, 22 bp, Homo sapiens
ataaaagtttccaatcatgcct

SEQ ID NO: 9419826 - DNA, 22 bp, Homo sapiens
ataaaagtttccaatcatgcct

SEQ ID NO: 9419827 - DNA, 20 bp, Homo sapiens
ataaaataactgccacaaga

SEQ ID NO: 9419828 - DNA, 20 bp, Homo sapiens
ataaaataactgccacaaga

SEQ ID NO: 9419829 - DNA, 20 bp, Homo sapiens
ataaaataactgccacaaga

SEQ ID NO: 9419830 - DNA, 20 bp, Homo sapiens
ataaaataactgccacaaga

SEQ ID NO: 9419831 - DNA, 20 bp, Homo sapiens
ataaaataactgccacaaga

SEQ ID NO: 9419832 - DNA, 20 bp, Homo sapiens
ataaaataactgccacaaga

SEQ ID NO: 9419833 - DNA, 20 bp, Homo sapiens
ataaaataactgccacaaga

SEQ ID NO: 9419834 - DNA, 20 bp, Homo sapiens
ataaaataactgccacaaga

SEQ ID NO: 9419835 - DNA, 20 bp, Homo sapiens
ataaaataactgccacaaga

SEQ ID NO: 9419836 - DNA, 20 bp, Homo sapiens
ataaaataactgccacaaga

SEQ ID NO: 9419837 - DNA, 22 bp, Homo sapiens
ataaaagtaggaccaacttaca

SEQ ID NO: 9419838 - DNA, 22 bp, Homo sapiens
ataaaagtaggaccaacttaca

SEQ ID NO: 9419839 - DNA, 22 bp, Homo sapiens
ataaaagtaggaccaacttaca

SEQ ID NO: 9419840 - DNA, 22 bp, Homo sapiens
ataaaagtaggaccaacttaca

SEQ ID NO: 9419841 - DNA, 22 bp, Homo sapiens
ataaaagtaggaccaacttaca

SEQ ID NO: 9419842 - DNA, 22 bp, Homo sapiens
ataaaagtaggaccaacttaca

SEQ ID NO: 9419843 - DNA, 22 bp, Homo sapiens
ataaaagtctgcttatttgggc

SEQ ID NO: 9419844 - DNA, 22 bp, Homo sapiens
ctgccaggcctcatcccagcca

SEQ ID NO: 9419845 - DNA, 22 bp, Homo sapiens
ctgccaggcagggagatggctg

SEQ ID NO: 9419846 - DNA, 22 bp, Homo sapiens
ctgccaggcagggagatggctg

SEQ ID NO: 9419847 - DNA, 22 bp, Homo sapiens
ctgccaggactgacgtcttcag

SEQ ID NO: 9419848 - DNA, 22 bp, Homo sapiens
ctgccaaaaggtgcacctgctg

SEQ ID NO: 9419849 - DNA, 22 bp, Homo sapiens
ctgcatttcacatttaaacttt

SEQ ID NO: 9419850 - DNA, 22 bp, Homo sapiens
ctgcatttcacatttaaacttt

SEQ ID NO: 9419851 - DNA, 22 bp, Homo sapiens
agtttgtatcaatttgctttat

SEQ ID NO: 9419852 - DNA, 22 bp, Homo sapiens
ctgccaaaaggtgcacctgctg

SEQ ID NO: 9419853 - DNA, 21 bp, Homo sapiens
ctgccaggatagcatgcaggc

SEQ ID NO: 9419854 - DNA, 22 bp, Homo sapiens
ctgccaggcacgtgcagcatca

SEQ ID NO: 9419855 - DNA, 22 bp, Homo sapiens
ataatcaaagtcctatgacatc

SEQ ID NO: 9419856 - DNA, 22 bp, Homo sapiens
ataatcaaagtcctatgacatc

SEQ ID NO: 9419857 - DNA, 22 bp, Homo sapiens
ataatcaaagtcctatgacatc

SEQ ID NO: 9419858 - DNA, 22 bp, Homo sapiens
ataatcaaagtcctatgacatc

SEQ ID NO: 9419859 - DNA, 22 bp, Homo sapiens
ataatatttggataggacagta

SEQ ID NO: 9419860 - DNA, 22 bp, Homo sapiens
ataatatttggataggacagta

SEQ ID NO: 9419861 - DNA, 22 bp, Homo sapiens
ataatcaaagtcctatgacatc

SEQ ID NO: 9419862 - DNA, 22 bp, Homo sapiens
ataatcaaagtcctatgacatc

SEQ ID NO: 9419863 - DNA, 22 bp, Homo sapiens
ataatattgaagagccttggcc

SEQ ID NO: 9419864 - DNA, 22 bp, Homo sapiens
ataatataatcctacttcccat

SEQ ID NO: 9419865 - DNA, 22 bp, Homo sapiens
ataatagctaacacagagtgct

SEQ ID NO: 9419866 - DNA, 22 bp, Homo sapiens
ataatataatcctacttcccat

SEQ ID NO: 9419867 - DNA, 22 bp, Homo sapiens
ataatatttgcattactgtgat

SEQ ID NO: 9419868 - DNA, 22 bp, Homo sapiens
ataatatttgcattactgtgat

SEQ ID NO: 9419869 - DNA, 22 bp, Homo sapiens
ataatattgagtcaggacctga

SEQ ID NO: 9419870 - DNA, 22 bp, Homo sapiens
ctgcttgggtcctggcatgggt

SEQ ID NO: 9419871 - DNA, 22 bp, Homo sapiens
ctgcttctaagaacctgcagct

SEQ ID NO: 9419872 - DNA, 22 bp, Homo sapiens
ctgcttctagcaccaagtccct

SEQ ID NO: 9419873 - DNA, 18 bp, Homo sapiens
ctgcttctgtctgccagt

SEQ ID NO: 9419874 - DNA, 18 bp, Homo sapiens
ctgcttctgtctgccagt

SEQ ID NO: 9419875 - DNA, 18 bp, Homo sapiens
ctgcttctgtctgccagt

SEQ ID NO: 9419876 - DNA, 22 bp, Homo sapiens
ctgctttaatgtaagatatacc

SEQ ID NO: 9419877 - DNA, 19 bp, Homo sapiens
atacaagactagcatttac

SEQ ID NO: 9419878 - DNA, 22 bp, Homo sapiens
atacaagacagtaggaaactga

SEQ ID NO: 9419879 - DNA, 22 bp, Homo sapiens
ctgctttaaaactgatacatga

SEQ ID NO: 9419880 - DNA, 19 bp, Homo sapiens
atacaagactagcatttac

SEQ ID NO: 9419881 - DNA, 19 bp, Homo sapiens
atacaagactagcatttac

SEQ ID NO: 9419882 - DNA, 18 bp, Homo sapiens
atacaagatcaagtgttc

SEQ ID NO: 9419883 - DNA, 22 bp, Homo sapiens
atacaagatcactccagaaaat

SEQ ID NO: 9419884 - DNA, 22 bp, Homo sapiens
atacaagatcactccagaaaat

SEQ ID NO: 9419885 - DNA, 22 bp, Homo sapiens
atacaagtgatataattgtttc

SEQ ID NO: 9419886 - DNA, 22 bp, Homo sapiens
atacaagtgagaaaactgaaga

SEQ ID NO: 9419887 - DNA, 20 bp, Homo sapiens
atacaagatgagtaatttct

SEQ ID NO: 9419888 - DNA, 22 bp, Homo sapiens
ctgcccagaagccagatgggca

SEQ ID NO: 9419889 - DNA, 22 bp, Homo sapiens
ctgcccagaagccagatgggca

SEQ ID NO: 9419890 - DNA, 22 bp, Homo sapiens
ctgcccagaagcttagagctta

SEQ ID NO: 9419891 - DNA, 22 bp, Homo sapiens
ctgcccagaagcttagagctta

SEQ ID NO: 9419892 - DNA, 22 bp, Homo sapiens
ctgcccagaatcactcactcga

SEQ ID NO: 9419893 - DNA, 22 bp, Homo sapiens
ctgcccagaagccagatgggca

SEQ ID NO: 9419894 - DNA, 22 bp, Homo sapiens
ctgcccacttggccaccttcta

SEQ ID NO: 9419895 - DNA, 22 bp, Homo sapiens
ctgcccagaagccagatgggca

SEQ ID NO: 9419896 - DNA, 22 bp, Homo sapiens
ctgcccacttggccaccttcta

SEQ ID NO: 9419897 - DNA, 22 bp, Homo sapiens
ctgcccactatgttgtcatggg

SEQ ID NO: 9419898 - DNA, 22 bp, Homo sapiens
ctgcccacttggccaccttcta

SEQ ID NO: 9419899 - DNA, 22 bp, Homo sapiens
ctgctcagtcatgttggattgt

SEQ ID NO: 9419900 - DNA, 22 bp, Homo sapiens
ctgctccaagccagccctgcag

SEQ ID NO: 9419901 - DNA, 22 bp, Homo sapiens
ctgctcagtaatagtcctatct

SEQ ID NO: 9419902 - DNA, 22 bp, Homo sapiens
ctgctcagtaatagtcctatct

SEQ ID NO: 9419903 - DNA, 19 bp, Homo sapiens
ctgctcaggtcagtctgtc

SEQ ID NO: 9419904 - DNA, 19 bp, Homo sapiens
ctgctcaggtcagtctgtc

SEQ ID NO: 9419905 - DNA, 22 bp, Homo sapiens
ctgcccagaatcactcactcga

SEQ ID NO: 9419906 - DNA, 22 bp, Homo sapiens
ctgcccagaatcactcactcga

SEQ ID NO: 9419907 - DNA, 18 bp, Homo sapiens
ctgcccagagcacttgtg

SEQ ID NO: 9419908 - DNA, 22 bp, Homo sapiens
ataaatatcactgttgtccctc

SEQ ID NO: 9419909 - DNA, 22 bp, Homo sapiens
ataaatatcactgttgtccctc

SEQ ID NO: 9419910 - DNA, 22 bp, Homo sapiens
ataaatatcactgttgtccctc

SEQ ID NO: 9419911 - DNA, 22 bp, Homo sapiens
ataaatatcactgttgtccctc

SEQ ID NO: 9419912 - DNA, 22 bp, Homo sapiens
ataaatatcactgttgtccctc

SEQ ID NO: 9419913 - DNA, 22 bp, Homo sapiens
ataaatctattggacatgtgtg

SEQ ID NO: 9419914 - DNA, 22 bp, Homo sapiens
ctgcccacagttctctgccatg

SEQ ID NO: 9419915 - DNA, 22 bp, Homo sapiens
ctgcccacagttctctgccatg

SEQ ID NO: 9419916 - DNA, 22 bp, Homo sapiens
ctgcccaccacacctgctcctg

SEQ ID NO: 9419917 - DNA, 22 bp, Homo sapiens
ctgcccaccccgaggcaggaag

SEQ ID NO: 9419918 - DNA, 22 bp, Homo sapiens
ctgcccaccccgaggcaggaag

SEQ ID NO: 9419919 - DNA, 22 bp, Homo sapiens
ctgcccaccgtgtgcacgtgcg

SEQ ID NO: 9419920 - DNA, 22 bp, Homo sapiens
ctgcccaccacacctgctcctg

SEQ ID NO: 9419921 - DNA, 20 bp, Homo sapiens
ctgcccactagaactacctg

SEQ ID NO: 9419922 - DNA, 22 bp, Homo sapiens
ctgcccactatgttgtcatggg

SEQ ID NO: 9419923 - DNA, 22 bp, Homo sapiens
ctgcccaccgtgtgcacgtgcg

SEQ ID NO: 9419924 - DNA, 20 bp, Homo sapiens
ctgcccactagaactacctg

SEQ ID NO: 9419925 - DNA, 22 bp, Homo sapiens
ctgctctggcgtactcggcatc

SEQ ID NO: 9419926 - DNA, 20 bp, Homo sapiens
ctgctctgctttgcaggtgg

SEQ ID NO: 9419927 - DNA, 22 bp, Homo sapiens
ctgctctggcgtactcggcatc

SEQ ID NO: 9419928 - DNA, 20 bp, Homo sapiens
ctgctctgctttgcaggtgg

SEQ ID NO: 9419929 - DNA, 20 bp, Homo sapiens
ctgctctgctttgcaggtgg

SEQ ID NO: 9419930 - DNA, 22 bp, Homo sapiens
ctgctctgctgatcagtgtctc

SEQ ID NO: 9419931 - DNA, 22 bp, Homo sapiens
ctgctctgctgatcagtgtctc

SEQ ID NO: 9419932 - DNA, 22 bp, Homo sapiens
ctgctctgctgatcagtgtctc

SEQ ID NO: 9419933 - DNA, 22 bp, Homo sapiens
ctgctctgctgatcagtgtctc

SEQ ID NO: 9419934 - DNA, 22 bp, Homo sapiens
ctgctctgctgatcagtgtctc

SEQ ID NO: 9419935 - DNA, 22 bp, Homo sapiens
ctgctctgctgatcagtgtctc

SEQ ID NO: 9419936 - DNA, 22 bp, Homo sapiens
ctgctctgcaaggcacagtgat

SEQ ID NO: 9419937 - DNA, 22 bp, Homo sapiens
ctgctctgcagcttggactccc

SEQ ID NO: 9419938 - DNA, 22 bp, Homo sapiens
ctgctctgcagcttggactccc

SEQ ID NO: 9419939 - DNA, 22 bp, Homo sapiens
ctgctctgctgatcagtgtctc

SEQ ID NO: 9419940 - DNA, 22 bp, Homo sapiens
ctgctctgcaaggcacagtgat

SEQ ID NO: 9419941 - DNA, 22 bp, Homo sapiens
ctgctctgagaggctcttccta

SEQ ID NO: 9419942 - DNA, 22 bp, Homo sapiens
ctgctctgagtattaacggagg

SEQ ID NO: 9419943 - DNA, 22 bp, Homo sapiens
ctgctctggctgtgtacttcag

SEQ ID NO: 9419944 - DNA, 22 bp, Homo sapiens
ctgctctggctgtgtacttcag

SEQ ID NO: 9419945 - DNA, 22 bp, Homo sapiens
ctgctctggcgtactcggcatc

SEQ ID NO: 9419946 - DNA, 22 bp, Homo sapiens
ctgctctggcgtactcggcatc

SEQ ID NO: 9419947 - DNA, 22 bp, Homo sapiens
ctgctctggcgtactcggcatc

SEQ ID NO: 9419948 - DNA, 21 bp, Homo sapiens
ctgctctggggaccggctgtg

SEQ ID NO: 9419949 - DNA, 21 bp, Homo sapiens
ctgctctggggaccggctgtg

SEQ ID NO: 9419950 - DNA, 21 bp, Homo sapiens
ctgctctggggaccggctgtg

SEQ ID NO: 9419951 - DNA, 21 bp, Homo sapiens
ctgctctggggaccggctgtg

SEQ ID NO: 9419952 - DNA, 21 bp, Homo sapiens
ctgctctggggaccggctgtg

SEQ ID NO: 9419953 - DNA, 22 bp, Homo sapiens
ataatacatggttgatcttttc

SEQ ID NO: 9419954 - DNA, 22 bp, Homo sapiens
ataatacatggttgatcttttc

SEQ ID NO: 9419955 - DNA, 22 bp, Homo sapiens
ataatacatggttaacctcttt

SEQ ID NO: 9419956 - DNA, 22 bp, Homo sapiens
ctgctctggtctcttcatgttt

SEQ ID NO: 9419957 - DNA, 22 bp, Homo sapiens
ctgctctggtctcttcatgttt

SEQ ID NO: 9419958 - DNA, 22 bp, Homo sapiens
ctgctctgtatatgagcaggaa

SEQ ID NO: 9419959 - DNA, 22 bp, Homo sapiens
ctgctctgtatatgagcaggaa

SEQ ID NO: 9419960 - DNA, 22 bp, Homo sapiens
ctgctctgtatatgagcaggaa

SEQ ID NO: 9419961 - DNA, 22 bp, Homo sapiens
ctgctctgtatatgagcaggaa

SEQ ID NO: 9419962 - DNA, 22 bp, Homo sapiens
atacaagttaatgagaatgaca

SEQ ID NO: 9419963 - DNA, 22 bp, Homo sapiens
atacaagtggccacttgaattc

SEQ ID NO: 9419964 - DNA, 22 bp, Homo sapiens
ctggagagaccgaaagaggctg

SEQ ID NO: 9419965 - DNA, 22 bp, Homo sapiens
ctggagcatccatgcccagggt

SEQ ID NO: 9419966 - DNA, 22 bp, Homo sapiens
ctggagccactttttatccttt

SEQ ID NO: 9419967 - DNA, 22 bp, Homo sapiens
ctggagccactttttatccttt

SEQ ID NO: 9419968 - DNA, 22 bp, Homo sapiens
ctggagccactgggtcttgtat

SEQ ID NO: 9419969 - DNA, 22 bp, Homo sapiens
ctggagccagccagggccctct

SEQ ID NO: 9419970 - DNA, 17 bp, Homo sapiens
ctggagccaagagggcc

SEQ ID NO: 9419971 - DNA, 17 bp, Homo sapiens
ctggagccaagagggcc

SEQ ID NO: 9419972 - DNA, 22 bp, Homo sapiens
atacagaatactaattcctgag

SEQ ID NO: 9419973 - DNA, 22 bp, Homo sapiens
ctggagccccaggctgtgcaga

SEQ ID NO: 9419974 - DNA, 22 bp, Homo sapiens
atacagaagttttccacttatt

SEQ ID NO: 9419975 - DNA, 22 bp, Homo sapiens
ctggagccccagacagggagag

SEQ ID NO: 9419976 - DNA, 22 bp, Homo sapiens
ctggagccccagacagggagag

SEQ ID NO: 9419977 - DNA, 22 bp, Homo sapiens
ctggagcccaggcctggtgtct

SEQ ID NO: 9419978 - DNA, 22 bp, Homo sapiens
ctggagccatgtcttgactgct

SEQ ID NO: 9419979 - DNA, 22 bp, Homo sapiens
ctggagccatgtcttgactgct

SEQ ID NO: 9419980 - DNA, 22 bp, Homo sapiens
ctggagccatgtcttgactgct

SEQ ID NO: 9419981 - DNA, 22 bp, Homo sapiens
ctggagccatgtatagcctatg

SEQ ID NO: 9419982 - DNA, 22 bp, Homo sapiens
ctggagccatgtatagcctatg

SEQ ID NO: 9419983 - DNA, 22 bp, Homo sapiens
ctggagccagccagggccctct

SEQ ID NO: 9419984 - DNA, 22 bp, Homo sapiens
ctggagggaggaggctgctatt

SEQ ID NO: 9419985 - DNA, 22 bp, Homo sapiens
ctggagggaggaggctgctatt

SEQ ID NO: 9419986 - DNA, 22 bp, Homo sapiens
ctggagggaggaggctgctatt

SEQ ID NO: 9419987 - DNA, 22 bp, Homo sapiens
ctggagggaggaggctgctatt

SEQ ID NO: 9419988 - DNA, 22 bp, Homo sapiens
ctggagggatgtagggtgtatt

SEQ ID NO: 9419989 - DNA, 22 bp, Homo sapiens
ctggagggagttaggacccgga

SEQ ID NO: 9419990 - DNA, 22 bp, Homo sapiens
ctggagggagattcaaaggagg

SEQ ID NO: 9419991 - DNA, 22 bp, Homo sapiens
ctggagggagattcaaaggagg

SEQ ID NO: 9419992 - DNA, 22 bp, Homo sapiens
atacagatgggtcagatttcat

SEQ ID NO: 9419993 - DNA, 22 bp, Homo sapiens
atacagatcccacagcatgtga

SEQ ID NO: 9419994 - DNA, 22 bp, Homo sapiens
atacagatgaaatactaagcta

SEQ ID NO: 9419995 - DNA, 22 bp, Homo sapiens
atacagatgagatcaggcataa

SEQ ID NO: 9419996 - DNA, 22 bp, Homo sapiens
atacagatgcttgctcgtgact

SEQ ID NO: 9419997 - DNA, 22 bp, Homo sapiens
atacagatgcttgctcgtgact

SEQ ID NO: 9419998 - DNA, 19 bp, Homo sapiens
atacagagcttcctaattt

SEQ ID NO: 9419999 - DNA, 22 bp, Homo sapiens
atacagataatgattgtatgtg

SEQ ID NO: 9420000 - DNA, 22 bp, Homo sapiens
atacagatcccacagcatgtga

SEQ ID NO: 9420001 - DNA, 22 bp, Homo sapiens
atacagaatttgcccttttcat

SEQ ID NO: 9420002 - DNA, 22 bp, Homo sapiens
atacagaatttgcccttttcat

SEQ ID NO: 9420003 - DNA, 22 bp, Homo sapiens
atacagaattcactacagtttc

SEQ ID NO: 9420004 - DNA, 22 bp, Homo sapiens
atacagaattcactacagtttc

SEQ ID NO: 9420005 - DNA, 18 bp, Homo sapiens
atacagagacctcaagga

SEQ ID NO: 9420006 - DNA, 22 bp, Homo sapiens
atacagagacacttgagactgg

SEQ ID NO: 9420007 - DNA, 22 bp, Homo sapiens
atactttagagctagattgcct

SEQ ID NO: 9420008 - DNA, 22 bp, Homo sapiens
atactttagagctagattgcct

SEQ ID NO: 9420009 - DNA, 22 bp, Homo sapiens
atacttctttgatgttcacagg

SEQ ID NO: 9420010 - DNA, 22 bp, Homo sapiens
atacttgaggttgtataaatat

SEQ ID NO: 9420011 - DNA, 22 bp, Homo sapiens
ctggcagctctgagtcccttct

SEQ ID NO: 9420012 - DNA, 22 bp, Homo sapiens
ctggcagctctactcagagcct

SEQ ID NO: 9420013 - DNA, 22 bp, Homo sapiens
ctggcagctctactcagagcct

SEQ ID NO: 9420014 - DNA, 22 bp, Homo sapiens
ctggcagcgtgagcagcatcca

SEQ ID NO: 9420015 - DNA, 22 bp, Homo sapiens
ctggcagcgtgtttatgaacat

SEQ ID NO: 9420016 - DNA, 22 bp, Homo sapiens
ctggcagcgtgtttatgaacat

SEQ ID NO: 9420017 - DNA, 22 bp, Homo sapiens
ctggcagcgcagcatgaagtcg

SEQ ID NO: 9420018 - DNA, 19 bp, Homo sapiens
ctggcagcctgtctgtgtc

SEQ ID NO: 9420019 - DNA, 19 bp, Homo sapiens
ctggcagcctgtctgtgtc

SEQ ID NO: 9420020 - DNA, 22 bp, Homo sapiens
ctggcagcggtttgcagcctgg

SEQ ID NO: 9420021 - DNA, 22 bp, Homo sapiens
ctggcagcgcagcatgaagtcg

SEQ ID NO: 9420022 - DNA, 22 bp, Homo sapiens
ctggcagcggtttgcagcctgg

SEQ ID NO: 9420023 - DNA, 22 bp, Homo sapiens
ctggagggctgcagcgaggctg

SEQ ID NO: 9420024 - DNA, 22 bp, Homo sapiens
ctggagggctgcagcgaggctg

SEQ ID NO: 9420025 - DNA, 22 bp, Homo sapiens
ctggagggctgcagcgaggctg

SEQ ID NO: 9420026 - DNA, 22 bp, Homo sapiens
ctggagggatgtagggtgtatt

SEQ ID NO: 9420027 - DNA, 22 bp, Homo sapiens
ctggagggatgtagggtgtatt

SEQ ID NO: 9420028 - DNA, 22 bp, Homo sapiens
ctggagtgaagtctggcagctt

SEQ ID NO: 9420029 - DNA, 22 bp, Homo sapiens
ctggagtgaagtctggcagctt

SEQ ID NO: 9420030 - DNA, 22 bp, Homo sapiens
ctggagtgaagtctggcagctt

SEQ ID NO: 9420031 - DNA, 22 bp, Homo sapiens
ctggagtgaagtctggcagctt

SEQ ID NO: 9420032 - DNA, 22 bp, Homo sapiens
ctggagtgaggtctgggagcct

SEQ ID NO: 9420033 - DNA, 21 bp, Homo sapiens
ctggagtctgggggtggcagt

SEQ ID NO: 9420034 - DNA, 22 bp, Homo sapiens
ctggagtcttaggttatggtga

SEQ ID NO: 9420035 - DNA, 22 bp, Homo sapiens
ctggagtcttaggttatggtga

SEQ ID NO: 9420036 - DNA, 22 bp, Homo sapiens
ctggagtgatactcagaatgtg

SEQ ID NO: 9420037 - DNA, 22 bp, Homo sapiens
ctggagtgaggtctgggagcct

SEQ ID NO: 9420038 - DNA, 22 bp, Homo sapiens
ctggagtgaggtctgggagcct

SEQ ID NO: 9420039 - DNA, 22 bp, Homo sapiens
ctggagtgaggtctgggagcct

SEQ ID NO: 9420040 - DNA, 22 bp, Homo sapiens
ctggagtgatactcagaatgtg

SEQ ID NO: 9420041 - DNA, 22 bp, Homo sapiens
ctggagtgatactcagaatgtg

SEQ ID NO: 9420042 - DNA, 22 bp, Homo sapiens
atacttcaacatatcagtcaga

SEQ ID NO: 9420043 - DNA, 22 bp, Homo sapiens
atacttatgataaataattgct

SEQ ID NO: 9420044 - DNA, 22 bp, Homo sapiens
atacttacttttcttcagacta

SEQ ID NO: 9420045 - DNA, 22 bp, Homo sapiens
atactcaatttgttggaaagca

SEQ ID NO: 9420046 - DNA, 22 bp, Homo sapiens
cattatgttcagtagcttaaaa

SEQ ID NO: 9420047 - DNA, 22 bp, Homo sapiens
cattatgttcagtagcttaaaa

SEQ ID NO: 9420048 - DNA, 22 bp, Homo sapiens
cattattaattcagcacatgct

SEQ ID NO: 9420049 - DNA, 22 bp, Homo sapiens
cattattaattcagcacatgct

SEQ ID NO: 9420050 - DNA, 18 bp, Homo sapiens
cattatgtggttatagaa

SEQ ID NO: 9420051 - DNA, 22 bp, Homo sapiens
cattatgtgcgtacatgtatct

SEQ ID NO: 9420052 - DNA, 20 bp, Homo sapiens
cattatggttgggcacagtg

SEQ ID NO: 9420053 - DNA, 22 bp, Homo sapiens
cattatggcagccaggatattg

SEQ ID NO: 9420054 - DNA, 22 bp, Homo sapiens
cattatggaagacagtgtggtg

SEQ ID NO: 9420055 - DNA, 22 bp, Homo sapiens
cattatggaagtgaagagctct

SEQ ID NO: 9420056 - DNA, 22 bp, Homo sapiens
cattatctcttctatatgctag

SEQ ID NO: 9420057 - DNA, 22 bp, Homo sapiens
cattatctcttctatatgctag

SEQ ID NO: 9420058 - DNA, 22 bp, Homo sapiens
cattatctgagagtgtcctaca

SEQ ID NO: 9420059 - DNA, 22 bp, Homo sapiens
catggcggtcaggatgtaggtg

SEQ ID NO: 9420060 - DNA, 22 bp, Homo sapiens
catggctcacaggatgggctag

SEQ ID NO: 9420061 - DNA, 22 bp, Homo sapiens
cattaagatttttttctactgg

SEQ ID NO: 9420062 - DNA, 22 bp, Homo sapiens
catggccccaaatcccatgcat

SEQ ID NO: 9420063 - DNA, 22 bp, Homo sapiens
catggccaggcccagggcccag

SEQ ID NO: 9420064 - DNA, 22 bp, Homo sapiens
catggcctgcctcctcctggtg

SEQ ID NO: 9420065 - DNA, 22 bp, Homo sapiens
catggcctctctcctggaatgg

SEQ ID NO: 9420066 - DNA, 18 bp, Homo sapiens
cattccaagttctacctc

SEQ ID NO: 9420067 - DNA, 22 bp, Homo sapiens
cattccaagtatatacatgata

SEQ ID NO: 9420068 - DNA, 22 bp, Homo sapiens
cattccaagtatatacatgata

SEQ ID NO: 9420069 - DNA, 22 bp, Homo sapiens
cattcatttgcccagtaagtca

SEQ ID NO: 9420070 - DNA, 22 bp, Homo sapiens
cattcaaagcaggaaaggcctt

SEQ ID NO: 9420071 - DNA, 22 bp, Homo sapiens
cattcaaacattaatttattca

SEQ ID NO: 9420072 - DNA, 22 bp, Homo sapiens
cattcaaaatgggctgacctgt

SEQ ID NO: 9420073 - DNA, 22 bp, Homo sapiens
cattcaaaagctccatgtttgt

SEQ ID NO: 9420074 - DNA, 22 bp, Homo sapiens
cattcaaaatgggctgacctgt

SEQ ID NO: 9420075 - DNA, 22 bp, Homo sapiens
cattcaaaagctccatgtttgt

SEQ ID NO: 9420076 - DNA, 22 bp, Homo sapiens
cattcaaaagctccatgtttgt

SEQ ID NO: 9420077 - DNA, 18 bp, Homo sapiens
cattccccatctctgagc

SEQ ID NO: 9420078 - DNA, 21 bp, Homo sapiens
cattcctcggctcatagagga

SEQ ID NO: 9420079 - DNA, 21 bp, Homo sapiens
cattcctcggctcatagagga

SEQ ID NO: 9420080 - DNA, 19 bp, Homo sapiens
aggcagaggcttggctagc

SEQ ID NO: 9420081 - DNA, 22 bp, Homo sapiens
aggcagcagaaaacaaatggtt

SEQ ID NO: 9420082 - DNA, 19 bp, Homo sapiens
aggcagcacccagtccttg

SEQ ID NO: 9420083 - DNA, 19 bp, Homo sapiens
aggcagcacccagtccttg

SEQ ID NO: 9420084 - DNA, 22 bp, Homo sapiens
catttacagtgagagtttttac

SEQ ID NO: 9420085 - DNA, 22 bp, Homo sapiens
catttacagtgagagtttttac

SEQ ID NO: 9420086 - DNA, 22 bp, Homo sapiens
catttacagtgagagtttttac

SEQ ID NO: 9420087 - DNA, 22 bp, Homo sapiens
catttacagcagactgatgaaa

SEQ ID NO: 9420088 - DNA, 22 bp, Homo sapiens
catttacagcagactgatgaaa

SEQ ID NO: 9420089 - DNA, 21 bp, Homo sapiens
aggcagcaggatccagggaca

SEQ ID NO: 9420090 - DNA, 22 bp, Homo sapiens
aggcagcagcttgctggttgcc

SEQ ID NO: 9420091 - DNA, 22 bp, Homo sapiens
catttacagtgagagtttttac

SEQ ID NO: 9420092 - DNA, 22 bp, Homo sapiens
catttacataacagtaacgctg

SEQ ID NO: 9420093 - DNA, 22 bp, Homo sapiens
catttacataacagtaacgctg

SEQ ID NO: 9420094 - DNA, 22 bp, Homo sapiens
catttacataacagtaacgctg

SEQ ID NO: 9420095 - DNA, 21 bp, Homo sapiens
catttacatgacagattggtt

SEQ ID NO: 9420096 - DNA, 21 bp, Homo sapiens
catttacatgacagattggtt

SEQ ID NO: 9420097 - DNA, 21 bp, Homo sapiens
catttacatgacagattggtt

SEQ ID NO: 9420098 - DNA, 22 bp, Homo sapiens
catttacataacagtaacgctg

SEQ ID NO: 9420099 - DNA, 22 bp, Homo sapiens
aggcagcagaaaacaaatggtt

SEQ ID NO: 9420100 - DNA, 22 bp, Homo sapiens
aggcagcagaaaacaaatggtt

SEQ ID NO: 9420101 - DNA, 22 bp, Homo sapiens
aggcagcagaggttgaggaaag

SEQ ID NO: 9420102 - DNA, 22 bp, Homo sapiens
aggcagcagactgttaatcaga

SEQ ID NO: 9420103 - DNA, 22 bp, Homo sapiens
aggcagcagaggttgaggaaag

SEQ ID NO: 9420104 - DNA, 22 bp, Homo sapiens
aggcagcagaggttgaggaaag

SEQ ID NO: 9420105 - DNA, 18 bp, Homo sapiens
aggcagcagcatcttctc

SEQ ID NO: 9420106 - DNA, 18 bp, Homo sapiens
aggcagcagcatcttctc

SEQ ID NO: 9420107 - DNA, 22 bp, Homo sapiens
aggcagcagaggttgaggaaag

SEQ ID NO: 9420108 - DNA, 18 bp, Homo sapiens
aggcagcagcatcttctc

SEQ ID NO: 9420109 - DNA, 18 bp, Homo sapiens
aggcagcagcatcttctc

SEQ ID NO: 9420110 - DNA, 22 bp, Homo sapiens
aggcagcagccacaaggcctga

SEQ ID NO: 9420111 - DNA, 22 bp, Homo sapiens
aggcagcagccacaaggcctga

SEQ ID NO: 9420112 - DNA, 22 bp, Homo sapiens
aggcagcagccacaaggcctga

SEQ ID NO: 9420113 - DNA, 22 bp, Homo sapiens
aggcagcagccacaaggcctga

SEQ ID NO: 9420114 - DNA, 22 bp, Homo sapiens
catttacatttaaggttaatat

SEQ ID NO: 9420115 - DNA, 22 bp, Homo sapiens
catttacatttaaggttaatat

SEQ ID NO: 9420116 - DNA, 21 bp, Homo sapiens
catttacatgacagattggtt

SEQ ID NO: 9420117 - DNA, 22 bp, Homo sapiens
aggcagcagtcatgaggaaaga

SEQ ID NO: 9420118 - DNA, 22 bp, Homo sapiens
aggcagcagtcatgaggaaaga

SEQ ID NO: 9420119 - DNA, 22 bp, Homo sapiens
catttacatttaaggttaatat

SEQ ID NO: 9420120 - DNA, 22 bp, Homo sapiens
catttacatttaaggttaatat

SEQ ID NO: 9420121 - DNA, 22 bp, Homo sapiens
aggcagcatttctgcttatcca

SEQ ID NO: 9420122 - DNA, 19 bp, Homo sapiens
aggcagcattctggggctt

SEQ ID NO: 9420123 - DNA, 19 bp, Homo sapiens
aggcagcattctggggctt

SEQ ID NO: 9420124 - DNA, 19 bp, Homo sapiens
aggcagcattctggggctt

SEQ ID NO: 9420125 - DNA, 19 bp, Homo sapiens
aggcagcattctggggctt

SEQ ID NO: 9420126 - DNA, 22 bp, Homo sapiens
aggcagcagtcatgaggaaaga

SEQ ID NO: 9420127 - DNA, 19 bp, Homo sapiens
aggcagcattctggggctt

SEQ ID NO: 9420128 - DNA, 19 bp, Homo sapiens
aggcagcattctggggctt

SEQ ID NO: 9420129 - DNA, 22 bp, Homo sapiens
aggcagcatttgaatccaggtc

SEQ ID NO: 9420130 - DNA, 22 bp, Homo sapiens
aggcagcatttctgcttatcca

SEQ ID NO: 9420131 - DNA, 22 bp, Homo sapiens
aggcagcatttctgcttatcca

SEQ ID NO: 9420132 - DNA, 22 bp, Homo sapiens
aggcagcatttgaatccaggtc

SEQ ID NO: 9420133 - DNA, 22 bp, Homo sapiens
aggcagcatttgaatccaggtc

SEQ ID NO: 9420134 - DNA, 22 bp, Homo sapiens
aggcagcatttgaatccaggtc

SEQ ID NO: 9420135 - DNA, 22 bp, Homo sapiens
aggcagccaatcagaggctgac

SEQ ID NO: 9420136 - DNA, 22 bp, Homo sapiens
aggcagccaatcagaggctgac

SEQ ID NO: 9420137 - DNA, 22 bp, Homo sapiens
aggcagccagatggcagcctgc

SEQ ID NO: 9420138 - DNA, 21 bp, Homo sapiens
aggcagccagtcatgctccct

SEQ ID NO: 9420139 - DNA, 22 bp, Homo sapiens
aggcagccagatggcagcctgc

SEQ ID NO: 9420140 - DNA, 22 bp, Homo sapiens
aggcagccagttcaggtttctt

SEQ ID NO: 9420141 - DNA, 22 bp, Homo sapiens
aggcagccagttcaggtttctt

SEQ ID NO: 9420142 - DNA, 22 bp, Homo sapiens
aggcagccagatggcagcctgc

SEQ ID NO: 9420143 - DNA, 22 bp, Homo sapiens
aggcagccacatgagctcctga

SEQ ID NO: 9420144 - DNA, 22 bp, Homo sapiens
aggaggtgcgtggtgatcccct

SEQ ID NO: 9420145 - DNA, 22 bp, Homo sapiens
aggaggtgctagagaagatgtt

SEQ ID NO: 9420146 - DNA, 22 bp, Homo sapiens
aggaggtgcgtggtgatcccct

SEQ ID NO: 9420147 - DNA, 22 bp, Homo sapiens
catgaaatgttagaattagaca

SEQ ID NO: 9420148 - DNA, 22 bp, Homo sapiens
catgaaatgttagaattagaca

SEQ ID NO: 9420149 - DNA, 22 bp, Homo sapiens
catgaaatgttagaattagaca

SEQ ID NO: 9420150 - DNA, 22 bp, Homo sapiens
catgaaatgtgttaatctcttg

SEQ ID NO: 9420151 - DNA, 22 bp, Homo sapiens
catgaaatctgagtatgtttcc

SEQ ID NO: 9420152 - DNA, 22 bp, Homo sapiens
catgaaagcaggaatggtttta

SEQ ID NO: 9420153 - DNA, 22 bp, Homo sapiens
catgaaatatgctacctgtctt

SEQ ID NO: 9420154 - DNA, 22 bp, Homo sapiens
catgaaaatgtcaagttctgct

SEQ ID NO: 9420155 - DNA, 22 bp, Homo sapiens
catgaaaatgtcaagttctgct

SEQ ID NO: 9420156 - DNA, 22 bp, Homo sapiens
catgaaaatgtcaagttctgct

SEQ ID NO: 9420157 - DNA, 17 bp, Homo sapiens
catctttaaaatcctga

SEQ ID NO: 9420158 - DNA, 22 bp, Homo sapiens
aggaggcactcactctcagggt

SEQ ID NO: 9420159 - DNA, 22 bp, Homo sapiens
aggaggcactcactctcagggt

SEQ ID NO: 9420160 - DNA, 22 bp, Homo sapiens
aggaggtggcaactgtcgacag

SEQ ID NO: 9420161 - DNA, 22 bp, Homo sapiens
aggaggtgctgtttgtcctgga

SEQ ID NO: 9420162 - DNA, 22 bp, Homo sapiens
aggaggtgctgtttgtcctgga

SEQ ID NO: 9420163 - DNA, 22 bp, Homo sapiens
aggaggtgctagagaagatgtt

SEQ ID NO: 9420164 - DNA, 22 bp, Homo sapiens
aggaggtgctagagaagatgtt

SEQ ID NO: 9420165 - DNA, 22 bp, Homo sapiens
aggaggtgtagatttcctgtca

SEQ ID NO: 9420166 - DNA, 22 bp, Homo sapiens
aggaggtgttgatagaaggttt

SEQ ID NO: 9420167 - DNA, 22 bp, Homo sapiens
aggaggtggctgaacttgaggg

SEQ ID NO: 9420168 - DNA, 22 bp, Homo sapiens
aggaggtggcctgagcgtgccc

SEQ ID NO: 9420169 - DNA, 22 bp, Homo sapiens
aggaggtggctgaacttgaggg

SEQ ID NO: 9420170 - DNA, 22 bp, Homo sapiens
catgcacttacctgaaattcaa

SEQ ID NO: 9420171 - DNA, 22 bp, Homo sapiens
catgcacagagcttggtcattg

SEQ ID NO: 9420172 - DNA, 22 bp, Homo sapiens
catgcacagtgatatctgaaga

SEQ ID NO: 9420173 - DNA, 22 bp, Homo sapiens
catgcacagagcttggtcattg

SEQ ID NO: 9420174 - DNA, 22 bp, Homo sapiens
aggaggtgttgatagaaggttt

SEQ ID NO: 9420175 - DNA, 22 bp, Homo sapiens
catgaggtgataaagctgggat

SEQ ID NO: 9420176 - DNA, 22 bp, Homo sapiens
aggcacagcctcccccaactcc

SEQ ID NO: 9420177 - DNA, 22 bp, Homo sapiens
aggcaattgtttgtgtaatagg

SEQ ID NO: 9420178 - DNA, 22 bp, Homo sapiens
aggcacaaaagcagggtgacca

SEQ ID NO: 9420179 - DNA, 22 bp, Homo sapiens
aggcacagcacacctggccccc

SEQ ID NO: 9420180 - DNA, 23 bp, Homo sapiens
aggcaatgccctgctgagaactc

SEQ ID NO: 9420181 - DNA, 23 bp, Homo sapiens
aggcaatgccctgctgagaactc

SEQ ID NO: 9420182 - DNA, 22 bp, Homo sapiens
aggcaatggggcttcaggcagg

SEQ ID NO: 9420183 - DNA, 22 bp, Homo sapiens
catgcctgtatttctgatctat

SEQ ID NO: 9420184 - DNA, 22 bp, Homo sapiens
aggcacagcctcccttcacatg

SEQ ID NO: 9420185 - DNA, 22 bp, Homo sapiens
aggcacagcctcccttcacatg

SEQ ID NO: 9420186 - DNA, 22 bp, Homo sapiens
aggcacaggaacaggaaaagag

SEQ ID NO: 9420187 - DNA, 22 bp, Homo sapiens
aggcacaggaacaggaaaagag

SEQ ID NO: 9420188 - DNA, 22 bp, Homo sapiens
aggcacaggaacaggaaaagag

SEQ ID NO: 9420189 - DNA, 22 bp, Homo sapiens
catggccagggcagatggcagg

SEQ ID NO: 9420190 - DNA, 22 bp, Homo sapiens
catggccaggcccagggcccag

SEQ ID NO: 9420191 - DNA, 22 bp, Homo sapiens
catggccaggcccagggcccag

SEQ ID NO: 9420192 - DNA, 22 bp, Homo sapiens
catggccaggcacgcgcatagc

SEQ ID NO: 9420193 - DNA, 22 bp, Homo sapiens
catggccaggccaagagagtac

SEQ ID NO: 9420194 - DNA, 22 bp, Homo sapiens
aggcacaggaatgtcatccagt

SEQ ID NO: 9420195 - DNA, 22 bp, Homo sapiens
aggcacaggaatgtcatccagt

SEQ ID NO: 9420196 - DNA, 22 bp, Homo sapiens
aggcacaggaatgtcatccagt

SEQ ID NO: 9420197 - DNA, 22 bp, Homo sapiens
aggcacaggaatgtcatccagt

SEQ ID NO: 9420198 - DNA, 22 bp, Homo sapiens
aggcacaggaggtggtaagaag

SEQ ID NO: 9420199 - DNA, 22 bp, Homo sapiens
aggcacaggaatgtcatccagt

SEQ ID NO: 9420200 - DNA, 22 bp, Homo sapiens
aggcacaggaggtggtaagaag

SEQ ID NO: 9420201 - DNA, 22 bp, Homo sapiens
aggcacaggaggtggtaagaag

SEQ ID NO: 9420202 - DNA, 22 bp, Homo sapiens
catgccagttttgagatgcacc

SEQ ID NO: 9420203 - DNA, 20 bp, Homo sapiens
catgccatgtctactgaggc

SEQ ID NO: 9420204 - DNA, 22 bp, Homo sapiens
catgccagttttgagatgcacc

SEQ ID NO: 9420205 - DNA, 22 bp, Homo sapiens
catgccagggcttgctgcctgg

SEQ ID NO: 9420206 - DNA, 22 bp, Homo sapiens
catgccctccttgccttcactg

SEQ ID NO: 9420207 - DNA, 22 bp, Homo sapiens
catgcctgcctggtgggcgtgg

SEQ ID NO: 9420208 - DNA, 22 bp, Homo sapiens
catgcccagagctccgggcgcc

SEQ ID NO: 9420209 - DNA, 22 bp, Homo sapiens
catgcctgtaatcccagctctt

SEQ ID NO: 9420210 - DNA, 22 bp, Homo sapiens
catgcctgtaatcccagctctt

SEQ ID NO: 9420211 - DNA, 20 bp, Homo sapiens
catgcctgctggtatctggc

SEQ ID NO: 9420212 - DNA, 21 bp, Homo sapiens
catgcagattctggagccaga

SEQ ID NO: 9420213 - DNA, 18 bp, Homo sapiens
catgcagagggatctgtg

SEQ ID NO: 9420214 - DNA, 22 bp, Homo sapiens
catgcagatgtcatgaggcatg

SEQ ID NO: 9420215 - DNA, 22 bp, Homo sapiens
aggacagcagtgctggcacttg

SEQ ID NO: 9420216 - DNA, 21 bp, Homo sapiens
aggacagcaggagcatttatt

SEQ ID NO: 9420217 - DNA, 20 bp, Homo sapiens
aggacagcagctgccacttg

SEQ ID NO: 9420218 - DNA, 22 bp, Homo sapiens
aggacagcagccattggcagtc

SEQ ID NO: 9420219 - DNA, 22 bp, Homo sapiens
aggacagcaaccgttattcaca

SEQ ID NO: 9420220 - DNA, 22 bp, Homo sapiens
cagtcctgggcacagccctggg

SEQ ID NO: 9420221 - DNA, 22 bp, Homo sapiens
cagtcctgggcacagccctggg

SEQ ID NO: 9420222 - DNA, 22 bp, Homo sapiens
cagtcctgctagtgtgaaaagc

SEQ ID NO: 9420223 - DNA, 22 bp, Homo sapiens
cagtcctgctagtgtgaaaagc

SEQ ID NO: 9420224 - DNA, 22 bp, Homo sapiens
cagtcctgggagacttacccag

SEQ ID NO: 9420225 - DNA, 22 bp, Homo sapiens
cagtcctggagcccttcttggc

SEQ ID NO: 9420226 - DNA, 22 bp, Homo sapiens
cagtcctgggagacttacccag

SEQ ID NO: 9420227 - DNA, 22 bp, Homo sapiens
cagtcctgctggccttccctgg

SEQ ID NO: 9420228 - DNA, 22 bp, Homo sapiens
cagtcctgctggccttccctgg

SEQ ID NO: 9420229 - DNA, 22 bp, Homo sapiens
cagtcctctggagtgagggtga

SEQ ID NO: 9420230 - DNA, 22 bp, Homo sapiens
cagtcctgaatactggacggtg

SEQ ID NO: 9420231 - DNA, 22 bp, Homo sapiens
cagtcctgagctcctgggctga

SEQ ID NO: 9420232 - DNA, 22 bp, Homo sapiens
cagtcctctgcaacaccccttc

SEQ ID NO: 9420233 - DNA, 22 bp, Homo sapiens
aggaaggactgcagcatttggt

SEQ ID NO: 9420234 - DNA, 22 bp, Homo sapiens
cagtcctgagctcctgggctga

SEQ ID NO: 9420235 - DNA, 22 bp, Homo sapiens
cagtcctgagctcctgggctga

SEQ ID NO: 9420236 - DNA, 22 bp, Homo sapiens
cagtcctgaggaagagctgctg

SEQ ID NO: 9420237 - DNA, 22 bp, Homo sapiens
cagtcctgaggaagagctgctg

SEQ ID NO: 9420238 - DNA, 22 bp, Homo sapiens
cagtcctgcccaggctgacaga

SEQ ID NO: 9420239 - DNA, 20 bp, Homo sapiens
cagtcctgcaggcgggagaa

SEQ ID NO: 9420240 - DNA, 22 bp, Homo sapiens
aggaagctggttacgaagggat

SEQ ID NO: 9420241 - DNA, 22 bp, Homo sapiens
aggaagctggttacgaagggat

SEQ ID NO: 9420242 - DNA, 22 bp, Homo sapiens
aggaagcttggggcagggctac

SEQ ID NO: 9420243 - DNA, 22 bp, Homo sapiens
aggaagctggtgtgaggatgaa

SEQ ID NO: 9420244 - DNA, 22 bp, Homo sapiens
aggaagctggtgtgaggatgaa

SEQ ID NO: 9420245 - DNA, 21 bp, Homo sapiens
aggaagctgcccagatagtag

SEQ ID NO: 9420246 - DNA, 20 bp, Homo sapiens
aggaagctgagatgtagagg

SEQ ID NO: 9420247 - DNA, 22 bp, Homo sapiens
aggaagctgggaaactgacatt

SEQ ID NO: 9420248 - DNA, 22 bp, Homo sapiens
aggaagctgggaaactgacatt

SEQ ID NO: 9420249 - DNA, 22 bp, Homo sapiens
aggaagctgcctgggatgggaa

SEQ ID NO: 9420250 - DNA, 22 bp, Homo sapiens
aggaagctgcctgggatgggaa

SEQ ID NO: 9420251 - DNA, 22 bp, Homo sapiens
aggaagctgctaagaaacaatg

SEQ ID NO: 9420252 - DNA, 22 bp, Homo sapiens
aggaaggaagagacaccatttg

SEQ ID NO: 9420253 - DNA, 22 bp, Homo sapiens
aggaaggaagagacaccatttg

SEQ ID NO: 9420254 - DNA, 20 bp, Homo sapiens
aggaaggaagtttgcatgga

SEQ ID NO: 9420255 - DNA, 22 bp, Homo sapiens
aggaaggaagagacaccatttg

SEQ ID NO: 9420256 - DNA, 22 bp, Homo sapiens
aggaaggactgcagcatttggt

SEQ ID NO: 9420257 - DNA, 22 bp, Homo sapiens
aggaaggactgcagcatttggt

SEQ ID NO: 9420258 - DNA, 20 bp, Homo sapiens
aggaaggaagtttgcatgga

SEQ ID NO: 9420259 - DNA, 22 bp, Homo sapiens
aggaaggactccatggtccgtc

SEQ ID NO: 9420260 - DNA, 22 bp, Homo sapiens
aggaagcttggggcagggctac

SEQ ID NO: 9420261 - DNA, 22 bp, Homo sapiens
aggaagctttatgaccagctaa

SEQ ID NO: 9420262 - DNA, 19 bp, Homo sapiens
aggaaggaacctgagtctg

SEQ ID NO: 9420263 - DNA, 19 bp, Homo sapiens
aggaaggaacctgagtctg

SEQ ID NO: 9420264 - DNA, 19 bp, Homo sapiens
aggaaggaacctgagtctg

SEQ ID NO: 9420265 - DNA, 21 bp, Homo sapiens
aggacaggaactggctgaata

SEQ ID NO: 9420266 - DNA, 21 bp, Homo sapiens
aggacaggaactggctgaata

SEQ ID NO: 9420267 - DNA, 21 bp, Homo sapiens
aggacaggaactggctgaata

SEQ ID NO: 9420268 - DNA, 21 bp, Homo sapiens
aggacaggaactggctgaata

SEQ ID NO: 9420269 - DNA, 21 bp, Homo sapiens
aggacaggaactggctgaata

SEQ ID NO: 9420270 - DNA, 21 bp, Homo sapiens
aggacaggaactggctgaata

SEQ ID NO: 9420271 - DNA, 22 bp, Homo sapiens
aggacagcccttgagagcacat

SEQ ID NO: 9420272 - DNA, 22 bp, Homo sapiens
aggacagcccttgagagcacat

SEQ ID NO: 9420273 - DNA, 22 bp, Homo sapiens
aggacagcccttgagagcacat

SEQ ID NO: 9420274 - DNA, 22 bp, Homo sapiens
aggacagcccttgagagcacat

SEQ ID NO: 9420275 - DNA, 22 bp, Homo sapiens
aggacagcagttggtgaggttc

SEQ ID NO: 9420276 - DNA, 22 bp, Homo sapiens
aggacagcatatgggaaccagt

SEQ ID NO: 9420277 - DNA, 22 bp, Homo sapiens
aggacagcagtgctggcacttg

SEQ ID NO: 9420278 - DNA, 22 bp, Homo sapiens
aggacagcccccaacagcaaca

SEQ ID NO: 9420279 - DNA, 22 bp, Homo sapiens
aggacagcccccaacagcaaca

SEQ ID NO: 9420280 - DNA, 22 bp, Homo sapiens
aggacagcccccaacagcaaca

SEQ ID NO: 9420281 - DNA, 22 bp, Homo sapiens
aggacagcattttcagcatctc

SEQ ID NO: 9420282 - DNA, 22 bp, Homo sapiens
aggacagcattttcagcatctc

SEQ ID NO: 9420283 - DNA, 22 bp, Homo sapiens
aggacagcattttcagcatctc

SEQ ID NO: 9420284 - DNA, 18 bp, Homo sapiens
aggagaaagggaccaggg

SEQ ID NO: 9420285 - DNA, 18 bp, Homo sapiens
aggagaaagggaccaggg

SEQ ID NO: 9420286 - DNA, 22 bp, Homo sapiens
aggagaaagactggacagccaa

SEQ ID NO: 9420287 - DNA, 20 bp, Homo sapiens
aggagaaattcgggacacct

SEQ ID NO: 9420288 - DNA, 22 bp, Homo sapiens
aggactgacttttgccatgaaa

SEQ ID NO: 9420289 - DNA, 22 bp, Homo sapiens
aggactgacttttgccatgaaa

SEQ ID NO: 9420290 - DNA, 22 bp, Homo sapiens
aggagaattaggaactcaagat

SEQ ID NO: 9420291 - DNA, 22 bp, Homo sapiens
cagtctcttttcagctccatcc

SEQ ID NO: 9420292 - DNA, 22 bp, Homo sapiens
cagtctcttttcagctccatcc

SEQ ID NO: 9420293 - DNA, 22 bp, Homo sapiens
aggagaattaggaactcaagat

SEQ ID NO: 9420294 - DNA, 22 bp, Homo sapiens
cagtctcttgcttcattagttg

SEQ ID NO: 9420295 - DNA, 22 bp, Homo sapiens
cagtctctttatccaccaagcc

SEQ ID NO: 9420296 - DNA, 22 bp, Homo sapiens
cagtctctgtcatctcatggga

SEQ ID NO: 9420297 - DNA, 22 bp, Homo sapiens
cagtctctgtgccagatcctgg

SEQ ID NO: 9420298 - DNA, 22 bp, Homo sapiens
cagtctctggcagctgctggcc

SEQ ID NO: 9420299 - DNA, 22 bp, Homo sapiens
cagtctctggcagctgctggcc

SEQ ID NO: 9420300 - DNA, 22 bp, Homo sapiens
cagtctctggtgagttgacagt

SEQ ID NO: 9420301 - DNA, 22 bp, Homo sapiens
cagtctctcttgtagtgcagct

SEQ ID NO: 9420302 - DNA, 22 bp, Homo sapiens
cagtctctctgaagtattaaga

SEQ ID NO: 9420303 - DNA, 22 bp, Homo sapiens
cagtctctcttgtagtgcagct

SEQ ID NO: 9420304 - DNA, 22 bp, Homo sapiens
aggagaagccaagttgtgagca

SEQ ID NO: 9420305 - DNA, 22 bp, Homo sapiens
aggagaagccaagttgtgagca

SEQ ID NO: 9420306 - DNA, 22 bp, Homo sapiens
cagtctctctccttgcaggcgt

SEQ ID NO: 9420307 - DNA, 22 bp, Homo sapiens
cagtctctctccttgcaggcgt

SEQ ID NO: 9420308 - DNA, 22 bp, Homo sapiens
cagtctctctccttgcaggcgt

SEQ ID NO: 9420309 - DNA, 22 bp, Homo sapiens
aggagaagccaagttgtgagca

SEQ ID NO: 9420310 - DNA, 22 bp, Homo sapiens
aggagaagccaagttgtgagca

SEQ ID NO: 9420311 - DNA, 23 bp, Homo sapiens
aggagaagagatttccacatgca

SEQ ID NO: 9420312 - DNA, 23 bp, Homo sapiens
aggagaagagatttccacatgca

SEQ ID NO: 9420313 - DNA, 23 bp, Homo sapiens
aggagaagagatttccacatgca

SEQ ID NO: 9420314 - DNA, 23 bp, Homo sapiens
aggagaagagatttccacatgca

SEQ ID NO: 9420315 - DNA, 19 bp, Homo sapiens
aggagaagactctctcccc

SEQ ID NO: 9420316 - DNA, 23 bp, Homo sapiens
aggagaagagatttccacatgca

SEQ ID NO: 9420317 - DNA, 23 bp, Homo sapiens
aggagaagagatttccacatgca

SEQ ID NO: 9420318 - DNA, 23 bp, Homo sapiens
aggagaagagatttccacatgca

SEQ ID NO: 9420319 - DNA, 23 bp, Homo sapiens
aggagaagagatttccacatgca

SEQ ID NO: 9420320 - DNA, 22 bp, Homo sapiens
aggagctcagctaagttggaga

SEQ ID NO: 9420321 - DNA, 22 bp, Homo sapiens
aggagctcagcctgcagggagc

SEQ ID NO: 9420322 - DNA, 21 bp, Homo sapiens
aggagctctccaaggacaaag

SEQ ID NO: 9420323 - DNA, 22 bp, Homo sapiens
aggagctcattgaagtggatga

SEQ ID NO: 9420324 - DNA, 18 bp, Homo sapiens
aggagcctttgcactgga

SEQ ID NO: 9420325 - DNA, 18 bp, Homo sapiens
aggagcctttgcactgga

SEQ ID NO: 9420326 - DNA, 18 bp, Homo sapiens
aggagcctttgcactgga

SEQ ID NO: 9420327 - DNA, 18 bp, Homo sapiens
aggagcggctgcggctgc

SEQ ID NO: 9420328 - DNA, 19 bp, Homo sapiens
aggagccttgagcagtgag

SEQ ID NO: 9420329 - DNA, 19 bp, Homo sapiens
aggagccttgagcagtgag

SEQ ID NO: 9420330 - DNA, 22 bp, Homo sapiens
aggagcctgtgcctggcactcc

SEQ ID NO: 9420331 - DNA, 22 bp, Homo sapiens
aggagcctgtgcctggcactcc

SEQ ID NO: 9420332 - DNA, 22 bp, Homo sapiens
aggagagtcttgagtcactggt

SEQ ID NO: 9420333 - DNA, 22 bp, Homo sapiens
aggagagtaccattgggccgca

SEQ ID NO: 9420334 - DNA, 22 bp, Homo sapiens
aggagagttcacactggtcaga

SEQ ID NO: 9420335 - DNA, 22 bp, Homo sapiens
aggagagtcttgagtcactggt

SEQ ID NO: 9420336 - DNA, 22 bp, Homo sapiens
aggagagggtggcattaagttt

SEQ ID NO: 9420337 - DNA, 22 bp, Homo sapiens
aggagccatgagcaggaggcaa

SEQ ID NO: 9420338 - DNA, 22 bp, Homo sapiens
aggagccatgagcaggaggcaa

SEQ ID NO: 9420339 - DNA, 22 bp, Homo sapiens
aggagcctggctggcccacagg

SEQ ID NO: 9420340 - DNA, 22 bp, Homo sapiens
aggagcctggctggcccacagg

SEQ ID NO: 9420341 - DNA, 22 bp, Homo sapiens
aggagatcagcctccctgcaac

SEQ ID NO: 9420342 - DNA, 22 bp, Homo sapiens
aggagaggctctaactctgtgt

SEQ ID NO: 9420343 - DNA, 22 bp, Homo sapiens
aggagaggctctaactctgtgt

SEQ ID NO: 9420344 - DNA, 22 bp, Homo sapiens
aggagaggggtaggattaattt

SEQ ID NO: 9420345 - DNA, 22 bp, Homo sapiens
aggagagcaggccagccgtccc

SEQ ID NO: 9420346 - DNA, 22 bp, Homo sapiens
aggagagcaggccagccgtccc

SEQ ID NO: 9420347 - DNA, 22 bp, Homo sapiens
aggagagctggtgtctggaatc

SEQ ID NO: 9420348 - DNA, 22 bp, Homo sapiens
aggagaggcatcaagaaaatcg

SEQ ID NO: 9420349 - DNA, 22 bp, Homo sapiens
aggagagaattactgggtgtca

SEQ ID NO: 9420350 - DNA, 22 bp, Homo sapiens
aggagagaattactgggtgtca

SEQ ID NO: 9420351 - DNA, 22 bp, Homo sapiens
aggagagaatgttccaggcttg

SEQ ID NO: 9420352 - DNA, 22 bp, Homo sapiens
aggagactcagagacctggccg

SEQ ID NO: 9420353 - DNA, 22 bp, Homo sapiens
aggagagaatgttccaggcttg

SEQ ID NO: 9420354 - DNA, 22 bp, Homo sapiens
aggagagaatgttccaggcttg

SEQ ID NO: 9420355 - DNA, 22 bp, Homo sapiens
aggagagagaacacttgggtcc

SEQ ID NO: 9420356 - DNA, 22 bp, Homo sapiens
aggagagagaacacttgggtcc

SEQ ID NO: 9420357 - DNA, 22 bp, Homo sapiens
aggagagagctgagctttgctg

SEQ ID NO: 9420358 - DNA, 22 bp, Homo sapiens
aggagagaggttttaaatgggg

SEQ ID NO: 9420359 - DNA, 22 bp, Homo sapiens
aggagagagctgagctttgctg

SEQ ID NO: 9420360 - DNA, 20 bp, Homo sapiens
aggagctgaattagagggtt

SEQ ID NO: 9420361 - DNA, 22 bp, Homo sapiens
aggagctgacttgtaaagcatt

SEQ ID NO: 9420362 - DNA, 20 bp, Homo sapiens
aggagctgaattagagggtt

SEQ ID NO: 9420363 - DNA, 20 bp, Homo sapiens
aggagctgaattagagggtt

SEQ ID NO: 9420364 - DNA, 20 bp, Homo sapiens
aggagctgaattagagggtt

SEQ ID NO: 9420365 - DNA, 22 bp, Homo sapiens
aggagctgaagtctctgcactc

SEQ ID NO: 9420366 - DNA, 22 bp, Homo sapiens
aggagctgaaacttctcatatg

SEQ ID NO: 9420367 - DNA, 22 bp, Homo sapiens
aggagctcttgatgcttgaggg

SEQ ID NO: 9420368 - DNA, 22 bp, Homo sapiens
aggagctgaaacttctcatatg

SEQ ID NO: 9420369 - DNA, 22 bp, Homo sapiens
aggagctctgggcagggcctcc

SEQ ID NO: 9420370 - DNA, 22 bp, Homo sapiens
aggagctctcccatgctgcaga

SEQ ID NO: 9420371 - DNA, 22 bp, Homo sapiens
aggagctcttgatgcttgaggg

SEQ ID NO: 9420372 - DNA, 20 bp, Homo sapiens
aggagctctgtgctgggaag

SEQ ID NO: 9420373 - DNA, 20 bp, Homo sapiens
aggagctctgtgctgggaag

SEQ ID NO: 9420374 - DNA, 22 bp, Homo sapiens
aggagctctgggcagggcctcc

SEQ ID NO: 9420375 - DNA, 22 bp, Homo sapiens
aggaggaagggaagacaagtaa

SEQ ID NO: 9420376 - DNA, 22 bp, Homo sapiens
aggagctgtgaatgggaggggt

SEQ ID NO: 9420377 - DNA, 22 bp, Homo sapiens
aggagctgtgaatgggaggggt

SEQ ID NO: 9420378 - DNA, 22 bp, Homo sapiens
aggagctgataaaagggggtca

SEQ ID NO: 9420379 - DNA, 22 bp, Homo sapiens
aggagctgataaaagggggtca

SEQ ID NO: 9420380 - DNA, 22 bp, Homo sapiens
aggagctgatagtctatggaga

SEQ ID NO: 9420381 - DNA, 22 bp, Homo sapiens
aggagctgagtcagcccgacag

SEQ ID NO: 9420382 - DNA, 22 bp, Homo sapiens
aggagctgagggagcgcccttg

SEQ ID NO: 9420383 - DNA, 22 bp, Homo sapiens
aggagctgataaaagggggtca

SEQ ID NO: 9420384 - DNA, 22 bp, Homo sapiens
aggagctgagtcagcccgacag

SEQ ID NO: 9420385 - DNA, 22 bp, Homo sapiens
aggagctgagtcagcccgacag

SEQ ID NO: 9420386 - DNA, 22 bp, Homo sapiens
aggagctgataaaagggggtca

SEQ ID NO: 9420387 - DNA, 22 bp, Homo sapiens
aggaggataagttagttgggta

SEQ ID NO: 9420388 - DNA, 22 bp, Homo sapiens
aggaggaggtgggacacagtga

SEQ ID NO: 9420389 - DNA, 22 bp, Homo sapiens
aggaggaggtgggacacagtga

SEQ ID NO: 9420390 - DNA, 22 bp, Homo sapiens
aggaggaggtgggacacagtga

SEQ ID NO: 9420391 - DNA, 22 bp, Homo sapiens
aggaggaggtaagaaaagcata

SEQ ID NO: 9420392 - DNA, 22 bp, Homo sapiens
aggaggaggtaagaaaagcata

SEQ ID NO: 9420393 - DNA, 22 bp, Homo sapiens
aggaggaggtaagaaaagcata

SEQ ID NO: 9420394 - DNA, 20 bp, Homo sapiens
aggaggcaatgtagataagc

SEQ ID NO: 9420395 - DNA, 22 bp, Homo sapiens
aggaggcaactgagatttagaa

SEQ ID NO: 9420396 - DNA, 17 bp, Homo sapiens
aggaggatcagagagta

SEQ ID NO: 9420397 - DNA, 17 bp, Homo sapiens
aggaggatcagagagta

SEQ ID NO: 9420398 - DNA, 17 bp, Homo sapiens
aggaggatcagagagta

SEQ ID NO: 9420399 - DNA, 17 bp, Homo sapiens
aggaggatcagagagta

SEQ ID NO: 9420400 - DNA, 17 bp, Homo sapiens
aggaggatcagagagta

SEQ ID NO: 9420401 - DNA, 22 bp, Homo sapiens
aggaggaatacaatccagcagc

SEQ ID NO: 9420402 - DNA, 22 bp, Homo sapiens
aggaggaatacaatccagcagc

SEQ ID NO: 9420403 - DNA, 22 bp, Homo sapiens
aggaggaatacaatccagcagc

SEQ ID NO: 9420404 - DNA, 22 bp, Homo sapiens
aggaggactctctgagccagcc

SEQ ID NO: 9420405 - DNA, 22 bp, Homo sapiens
aggaggaattgacacagaagcc

SEQ ID NO: 9420406 - DNA, 22 bp, Homo sapiens
aggaggaattgacacagaagcc

SEQ ID NO: 9420407 - DNA, 22 bp, Homo sapiens
aggaggaggctggagtacaccc

SEQ ID NO: 9420408 - DNA, 22 bp, Homo sapiens
aggaggaggctggagtacaccc

SEQ ID NO: 9420409 - DNA, 21 bp, Homo sapiens
aggaggagagcttggcctacc

SEQ ID NO: 9420410 - DNA, 21 bp, Homo sapiens
aggaggagagcttggcctacc

SEQ ID NO: 9420411 - DNA, 22 bp, Homo sapiens
aggaggagcagctttttgtctc

SEQ ID NO: 9420412 - DNA, 22 bp, Homo sapiens
aggaagctccatgaaggcagag

SEQ ID NO: 9420413 - DNA, 22 bp, Homo sapiens
aggaagctcattttgacatatc

SEQ ID NO: 9420414 - DNA, 22 bp, Homo sapiens
aggaagctcaaagccatgatgt

SEQ ID NO: 9420415 - DNA, 22 bp, Homo sapiens
aggaagctcctggagagccagt

SEQ ID NO: 9420416 - DNA, 22 bp, Homo sapiens
aggaagctcctggagagccagt

SEQ ID NO: 9420417 - DNA, 22 bp, Homo sapiens
aggaactgggctcagcaaacat

SEQ ID NO: 9420418 - DNA, 22 bp, Homo sapiens
aggaactggtgaagtgtagtga

SEQ ID NO: 9420419 - DNA, 22 bp, Homo sapiens
aggaactggggctattcaccct

SEQ ID NO: 9420420 - DNA, 22 bp, Homo sapiens
aggaactggggctattcaccct

SEQ ID NO: 9420421 - DNA, 22 bp, Homo sapiens
aggaactggtgggaggtgattg

SEQ ID NO: 9420422 - DNA, 22 bp, Homo sapiens
aggaactgtcatgtattgctca

SEQ ID NO: 9420423 - DNA, 22 bp, Homo sapiens
aggaagctcaaagccatgatgt

SEQ ID NO: 9420424 - DNA, 18 bp, Homo sapiens
aggaagcaggaggaaggc

SEQ ID NO: 9420425 - DNA, 22 bp, Homo sapiens
aggaagcagcccatggatatag

SEQ ID NO: 9420426 - DNA, 23 bp, Homo sapiens
aggaactgcttcatttttgaaag

SEQ ID NO: 9420427 - DNA, 23 bp, Homo sapiens
aggaactgcttcatttttgaaag

SEQ ID NO: 9420428 - DNA, 22 bp, Homo sapiens
aggaactgatttataactttag

SEQ ID NO: 9420429 - DNA, 22 bp, Homo sapiens
aggaactgaagacttttactgt

SEQ ID NO: 9420430 - DNA, 22 bp, Homo sapiens
aggaactgatgagcagccaggg

SEQ ID NO: 9420431 - DNA, 22 bp, Homo sapiens
aggaacctgagtctgatcattt

SEQ ID NO: 9420432 - DNA, 22 bp, Homo sapiens
aggaaccagaggttgagcaact

SEQ ID NO: 9420433 - DNA, 22 bp, Homo sapiens
aggaacatctatcacataaacg

SEQ ID NO: 9420434 - DNA, 22 bp, Homo sapiens
aggaaccagacagaactgaatg

SEQ ID NO: 9420435 - DNA, 22 bp, Homo sapiens
aggaacagaagagcaatgcagg

SEQ ID NO: 9420436 - DNA, 22 bp, Homo sapiens
aggaacaggcctcgttttctat

SEQ ID NO: 9420437 - DNA, 22 bp, Homo sapiens
aggaacagaagagcaatgcagg

SEQ ID NO: 9420438 - DNA, 22 bp, Homo sapiens
aggaacagaagagcaatgcagg

SEQ ID NO: 9420439 - DNA, 22 bp, Homo sapiens
aggaaaggcctttgcatttggt

SEQ ID NO: 9420440 - DNA, 22 bp, Homo sapiens
cagggccagcgtctcgggctat

SEQ ID NO: 9420441 - DNA, 22 bp, Homo sapiens
cagggccagcgcccaggcccag

SEQ ID NO: 9420442 - DNA, 22 bp, Homo sapiens
aggaaatgctgatgctcctgga

SEQ ID NO: 9420443 - DNA, 22 bp, Homo sapiens
aggaaatgcaggcaaatactct

SEQ ID NO: 9420444 - DNA, 22 bp, Homo sapiens
aggaaatgccgcggctctcttt

SEQ ID NO: 9420445 - DNA, 22 bp, Homo sapiens
aggaaatgcaggcaaatactct

SEQ ID NO: 9420446 - DNA, 22 bp, Homo sapiens
aggaaatgcaggcaaatactct

SEQ ID NO: 9420447 - DNA, 22 bp, Homo sapiens
aggaaataggaccagacaaagc

SEQ ID NO: 9420448 - DNA, 22 bp, Homo sapiens
aggaaataggaccagacaaagc

SEQ ID NO: 9420449 - DNA, 22 bp, Homo sapiens
aggaaataggaccagacaaagc

SEQ ID NO: 9420450 - DNA, 22 bp, Homo sapiens
aggaaataggaccagacaaagc

SEQ ID NO: 9420451 - DNA, 22 bp, Homo sapiens
aggaaatgggaatagatggtat

SEQ ID NO: 9420452 - DNA, 22 bp, Homo sapiens
aggaaatgtacaaatgaagatg

SEQ ID NO: 9420453 - DNA, 22 bp, Homo sapiens
aggaaatgtacaaatgaagatg

SEQ ID NO: 9420454 - DNA, 22 bp, Homo sapiens
aggaaatgtacaaatgaagatg

SEQ ID NO: 9420455 - DNA, 22 bp, Homo sapiens
aggaaatgtagtcctcatctcc

SEQ ID NO: 9420456 - DNA, 22 bp, Homo sapiens
aggaaatgtagtcctcatctcc

SEQ ID NO: 9420457 - DNA, 22 bp, Homo sapiens
aggaaattgagaatcagaataa

SEQ ID NO: 9420458 - DNA, 22 bp, Homo sapiens
aggaaattgagaatcagaataa

SEQ ID NO: 9420459 - DNA, 22 bp, Homo sapiens
aggaaattgagaatcagaataa

SEQ ID NO: 9420460 - DNA, 22 bp, Homo sapiens
aggaaattttgaatcagtgtct

SEQ ID NO: 9420461 - DNA, 22 bp, Homo sapiens
aggaaattgtctttttccttgt

SEQ ID NO: 9420462 - DNA, 22 bp, Homo sapiens
aggaaattgggacacagagaaa

SEQ ID NO: 9420463 - DNA, 22 bp, Homo sapiens
aggaacacaacttcctgagagc

SEQ ID NO: 9420464 - DNA, 22 bp, Homo sapiens
aggaacaattgataaactcaca

SEQ ID NO: 9420465 - DNA, 22 bp, Homo sapiens
aggaacacatggacatttctga

SEQ ID NO: 9420466 - DNA, 22 bp, Homo sapiens
aggaacacaacttcctgagagc

SEQ ID NO: 9420467 - DNA, 22 bp, Homo sapiens
aggaacaagggagccttttctc

SEQ ID NO: 9420468 - DNA, 22 bp, Homo sapiens
aggaacaagggagccttttctc

SEQ ID NO: 9420469 - DNA, 22 bp, Homo sapiens
aggaacaattgataaactcaca

SEQ ID NO: 9420470 - DNA, 22 bp, Homo sapiens
aggaacaattgataaactcaca

SEQ ID NO: 9420471 - DNA, 22 bp, Homo sapiens
aggaacaactgattcagtcaac

SEQ ID NO: 9420472 - DNA, 22 bp, Homo sapiens
aggaaattttgaatcagtgtct

SEQ ID NO: 9420473 - DNA, 22 bp, Homo sapiens
aggaaattgagaatcagaataa

SEQ ID NO: 9420474 - DNA, 22 bp, Homo sapiens
aggaacaactgattcagtcaac

SEQ ID NO: 9420475 - DNA, 22 bp, Homo sapiens
aggaacaactgattcagtcaac

SEQ ID NO: 9420476 - DNA, 22 bp, Homo sapiens
agcttgtgtttttctaagtatc

SEQ ID NO: 9420477 - DNA, 22 bp, Homo sapiens
agcttgttagaaatgtagactc

SEQ ID NO: 9420478 - DNA, 22 bp, Homo sapiens
agcttgtctttcaaaggagttt

SEQ ID NO: 9420479 - DNA, 21 bp, Homo sapiens
agcttgtgtgtatcacagtgt

SEQ ID NO: 9420480 - DNA, 22 bp, Homo sapiens
agctttaaagcatatttctaag

SEQ ID NO: 9420481 - DNA, 22 bp, Homo sapiens
agctttaaatcaatccagtgag

SEQ ID NO: 9420482 - DNA, 22 bp, Homo sapiens
agctttacctgccttggggcac

SEQ ID NO: 9420483 - DNA, 22 bp, Homo sapiens
agctttatataaaagagtacat

SEQ ID NO: 9420484 - DNA, 17 bp, Homo sapiens
aggaaacattttctttc

SEQ ID NO: 9420485 - DNA, 22 bp, Homo sapiens
aggaaactaaagcccagagagg

SEQ ID NO: 9420486 - DNA, 22 bp, Homo sapiens
aggaaactaacttatctttata

SEQ ID NO: 9420487 - DNA, 22 bp, Homo sapiens
aggaaaccggagctcagagagg

SEQ ID NO: 9420488 - DNA, 17 bp, Homo sapiens
aggaaacattttctttc

SEQ ID NO: 9420489 - DNA, 18 bp, Homo sapiens
aggaaagacgaagagggc

SEQ ID NO: 9420490 - DNA, 22 bp, Homo sapiens
aggaaagactggggccccagaa

SEQ ID NO: 9420491 - DNA, 18 bp, Homo sapiens
aggaaagacgaagagggc

SEQ ID NO: 9420492 - DNA, 18 bp, Homo sapiens
aggaaagacgaagagggc

SEQ ID NO: 9420493 - DNA, 18 bp, Homo sapiens
aggaaagacgaagagggc

SEQ ID NO: 9420494 - DNA, 18 bp, Homo sapiens
aggaaagacgaagagggc

SEQ ID NO: 9420495 - DNA, 22 bp, Homo sapiens
aggaaagaagtacattctcatg

SEQ ID NO: 9420496 - DNA, 22 bp, Homo sapiens
aggaaactaacttatctttata

SEQ ID NO: 9420497 - DNA, 22 bp, Homo sapiens
aggaaagaagtacattctcatg

SEQ ID NO: 9420498 - DNA, 22 bp, Homo sapiens
aggaaagactggggccccagaa

SEQ ID NO: 9420499 - DNA, 22 bp, Homo sapiens
aggaaagatggaaggaggataa

SEQ ID NO: 9420500 - DNA, 22 bp, Homo sapiens
aggaaagatggaaggaggataa

SEQ ID NO: 9420501 - DNA, 22 bp, Homo sapiens
cagggccactgtagatgaggag

SEQ ID NO: 9420502 - DNA, 22 bp, Homo sapiens
cagggccactgtagatgaggag

SEQ ID NO: 9420503 - DNA, 22 bp, Homo sapiens
aggaaagcttggcaaactaaat

SEQ ID NO: 9420504 - DNA, 21 bp, Homo sapiens
aggaaaggaagtccccagggt

SEQ ID NO: 9420505 - DNA, 21 bp, Homo sapiens
aggaaaggaagtccccagggt

SEQ ID NO: 9420506 - DNA, 22 bp, Homo sapiens
aggaaagcttggcaaactaaat

SEQ ID NO: 9420507 - DNA, 22 bp, Homo sapiens
cagggccagcgcccaggcccag

SEQ ID NO: 9420508 - DNA, 22 bp, Homo sapiens
cagggccagccgcagcatccac

SEQ ID NO: 9420509 - DNA, 22 bp, Homo sapiens
cagggccagcccgacgtggtgc

SEQ ID NO: 9420510 - DNA, 22 bp, Homo sapiens
cagggccagccatcctgctggg

SEQ ID NO: 9420511 - DNA, 22 bp, Homo sapiens
cagggccagcccactagcgagg

SEQ ID NO: 9420512 - DNA, 22 bp, Homo sapiens
cagggccagagagggctggctg

SEQ ID NO: 9420513 - DNA, 22 bp, Homo sapiens
cagggccagagagggctggctg

SEQ ID NO: 9420514 - DNA, 22 bp, Homo sapiens
cagggccactgtagatgaggag

SEQ ID NO: 9420515 - DNA, 23 bp, Homo sapiens
agcttgcttttcccagtactgca

SEQ ID NO: 9420516 - DNA, 22 bp, Homo sapiens
agcttgctgtattttctggagg

SEQ ID NO: 9420517 - DNA, 22 bp, Homo sapiens
agcttgagttttggatgaagtg

SEQ ID NO: 9420518 - DNA, 22 bp, Homo sapiens
agcttgagttttggatgaagtg

SEQ ID NO: 9420519 - DNA, 22 bp, Homo sapiens
agcttgcacagagaatacagta

SEQ ID NO: 9420520 - DNA, 22 bp, Homo sapiens
agcttgcacagagaatacagta

SEQ ID NO: 9420521 - DNA, 22 bp, Homo sapiens
agcttgcagtttctgctgtttt

SEQ ID NO: 9420522 - DNA, 22 bp, Homo sapiens
agcttgtagaaggccacgagca

SEQ ID NO: 9420523 - DNA, 22 bp, Homo sapiens
agcttgggtgtgcctgcgagct

SEQ ID NO: 9420524 - DNA, 22 bp, Homo sapiens
agcttgggcaacacagcaagac

SEQ ID NO: 9420525 - DNA, 17 bp, Homo sapiens
agcttggagcagcatga

SEQ ID NO: 9420526 - DNA, 22 bp, Homo sapiens
agcttgggcaacacagcaagac

SEQ ID NO: 9420527 - DNA, 22 bp, Homo sapiens
agcttggtggccctcctggctg

SEQ ID NO: 9420528 - DNA, 22 bp, Homo sapiens
agcttgggtgtgcctgcgagct

SEQ ID NO: 9420529 - DNA, 22 bp, Homo sapiens
agcttgggtgtgcctgcgagct

SEQ ID NO: 9420530 - DNA, 22 bp, Homo sapiens
agcttgaagccttggcgagatt

SEQ ID NO: 9420531 - DNA, 22 bp, Homo sapiens
agcttgacagacagatggtagc

SEQ ID NO: 9420532 - DNA, 22 bp, Homo sapiens
agcttgacagacagatggtagc

SEQ ID NO: 9420533 - DNA, 22 bp, Homo sapiens
agcttgacagacagatggtagc

SEQ ID NO: 9420534 - DNA, 22 bp, Homo sapiens
agcttacagttcaatgacaaag

SEQ ID NO: 9420535 - DNA, 22 bp, Homo sapiens
agcttctgttcatcttccaggc

SEQ ID NO: 9420536 - DNA, 22 bp, Homo sapiens
agcttcttttacagctcatgct

SEQ ID NO: 9420537 - DNA, 22 bp, Homo sapiens
agcttaatggaacttgctcaaa

SEQ ID NO: 9420538 - DNA, 22 bp, Homo sapiens
agcttaatggaacttgctcaaa

SEQ ID NO: 9420539 - DNA, 22 bp, Homo sapiens
agcttaaactctttgaagttat

SEQ ID NO: 9420540 - DNA, 23 bp, Homo sapiens
agctgtttcttgtgagttgagtg

SEQ ID NO: 9420541 - DNA, 22 bp, Homo sapiens
agctgtttgtacttagatagta

SEQ ID NO: 9420542 - DNA, 22 bp, Homo sapiens
agctgtttgtacttagatagta

SEQ ID NO: 9420543 - DNA, 22 bp, Homo sapiens
agctgttttactcagaaacata

SEQ ID NO: 9420544 - DNA, 22 bp, Homo sapiens
agctgttttactcagaaacata

SEQ ID NO: 9420545 - DNA, 22 bp, Homo sapiens
agctgttttcctggttagagac

SEQ ID NO: 9420546 - DNA, 22 bp, Homo sapiens
agctgttttcttctaggaagac

SEQ ID NO: 9420547 - DNA, 22 bp, Homo sapiens
agctgtttaaatgacttacttt

SEQ ID NO: 9420548 - DNA, 18 bp, Homo sapiens
agctgttgttgactctgt

SEQ ID NO: 9420549 - DNA, 18 bp, Homo sapiens
agctgttgttgactctgt

SEQ ID NO: 9420550 - DNA, 22 bp, Homo sapiens
agctgtttaaatgacttacttt

SEQ ID NO: 9420551 - DNA, 22 bp, Homo sapiens
agctgtttaataaatgtctgtt

SEQ ID NO: 9420552 - DNA, 22 bp, Homo sapiens
agctgttggctggctgagctct

SEQ ID NO: 9420553 - DNA, 22 bp, Homo sapiens
agctgttggctggctgagctct

SEQ ID NO: 9420554 - DNA, 22 bp, Homo sapiens
agctgttccaggcctcattgct

SEQ ID NO: 9420555 - DNA, 22 bp, Homo sapiens
agctgtgtttccagatggtagc

SEQ ID NO: 9420556 - DNA, 22 bp, Homo sapiens
agctgtgttattagaaacctgc

SEQ ID NO: 9420557 - DNA, 22 bp, Homo sapiens
agctgtgttctggttgattcac

SEQ ID NO: 9420558 - DNA, 22 bp, Homo sapiens
agctgtgtgcccatggtggagg

SEQ ID NO: 9420559 - DNA, 23 bp, Homo sapiens
agctgtgtggccttgggcaagtt

SEQ ID NO: 9420560 - DNA, 21 bp, Homo sapiens
caggccgggtgagcaggcagc

SEQ ID NO: 9420561 - DNA, 21 bp, Homo sapiens
caggccccaggcctggggtgc

SEQ ID NO: 9420562 - DNA, 21 bp, Homo sapiens
caggccccaggcctggggtgc

SEQ ID NO: 9420563 - DNA, 23 bp, Homo sapiens
agctgggaattttctgaagcttt

SEQ ID NO: 9420564 - DNA, 23 bp, Homo sapiens
agctgggaattttctgaagcttt

SEQ ID NO: 9420565 - DNA, 22 bp, Homo sapiens
agctgggaagactggaagacag

SEQ ID NO: 9420566 - DNA, 22 bp, Homo sapiens
agctgggaagactggaagacag

SEQ ID NO: 9420567 - DNA, 22 bp, Homo sapiens
agctgggaagactggaagacag

SEQ ID NO: 9420568 - DNA, 22 bp, Homo sapiens
agctggcttttgtgaaggtttt

SEQ ID NO: 9420569 - DNA, 22 bp, Homo sapiens
agctgggaagagttttctgcag

SEQ ID NO: 9420570 - DNA, 22 bp, Homo sapiens
agctgggaagagttttctgcag

SEQ ID NO: 9420571 - DNA, 22 bp, Homo sapiens
agctgggaagagttttctgcag

SEQ ID NO: 9420572 - DNA, 23 bp, Homo sapiens
agctgggaattttctgaagcttt

SEQ ID NO: 9420573 - DNA, 22 bp, Homo sapiens
caggcctcatggtgtgtccttc

SEQ ID NO: 9420574 - DNA, 22 bp, Homo sapiens
caggcctccactccacgcagac

SEQ ID NO: 9420575 - DNA, 22 bp, Homo sapiens
caggcctcaggggctcaggctg

SEQ ID NO: 9420576 - DNA, 22 bp, Homo sapiens
caggcctcaggggctcaggctg

SEQ ID NO: 9420577 - DNA, 22 bp, Homo sapiens
caggcctcaggggctcaggctg

SEQ ID NO: 9420578 - DNA, 22 bp, Homo sapiens
caggcctcaggggctcaggctg

SEQ ID NO: 9420579 - DNA, 22 bp, Homo sapiens
caggccggtgattctggatgta

SEQ ID NO: 9420580 - DNA, 21 bp, Homo sapiens
caggccgggtgagcaggcagc

SEQ ID NO: 9420581 - DNA, 21 bp, Homo sapiens
caggccgggtgagcaggcagc

SEQ ID NO: 9420582 - DNA, 22 bp, Homo sapiens
caggcctcaccagcggagctgc

SEQ ID NO: 9420583 - DNA, 22 bp, Homo sapiens
caggcctggttgagccctgaga

SEQ ID NO: 9420584 - DNA, 22 bp, Homo sapiens
caggcctggttgagccctgaga

SEQ ID NO: 9420585 - DNA, 22 bp, Homo sapiens
caggcctgggcttcggggctga

SEQ ID NO: 9420586 - DNA, 22 bp, Homo sapiens
caggcctgggcttcggggctga

SEQ ID NO: 9420587 - DNA, 22 bp, Homo sapiens
caggcctggggctggcttccag

SEQ ID NO: 9420588 - DNA, 22 bp, Homo sapiens
caggcctggggctggcttccag

SEQ ID NO: 9420589 - DNA, 22 bp, Homo sapiens
agctgtggccagatgtgagcgg

SEQ ID NO: 9420590 - DNA, 22 bp, Homo sapiens
agctgtggcagcagccgtggca

SEQ ID NO: 9420591 - DNA, 22 bp, Homo sapiens
agctgtggcagcagccgtggca

SEQ ID NO: 9420592 - DNA, 22 bp, Homo sapiens
agctgtgtagggaatcagagaa

SEQ ID NO: 9420593 - DNA, 22 bp, Homo sapiens
agctgtgtgcatttgggtctca

SEQ ID NO: 9420594 - DNA, 22 bp, Homo sapiens
agctgtgtgccaggggagatgt

SEQ ID NO: 9420595 - DNA, 22 bp, Homo sapiens
agctgtgtgacctagggcaagc

SEQ ID NO: 9420596 - DNA, 22 bp, Homo sapiens
agctgtgtgacctagggcaagc

SEQ ID NO: 9420597 - DNA, 22 bp, Homo sapiens
caggcctggctgcagctcgcct

SEQ ID NO: 9420598 - DNA, 22 bp, Homo sapiens
caggcctggcccccggcacacc

SEQ ID NO: 9420599 - DNA, 22 bp, Homo sapiens
caggcctggcccccggcacacc

SEQ ID NO: 9420600 - DNA, 22 bp, Homo sapiens
caggcctggctgcagctcgcct

SEQ ID NO: 9420601 - DNA, 22 bp, Homo sapiens
caggcctggctgcagctcgcct

SEQ ID NO: 9420602 - DNA, 22 bp, Homo sapiens
caggcctgggcttcggggctga

SEQ ID NO: 9420603 - DNA, 22 bp, Homo sapiens
caggcctgggctgggtatcagg

SEQ ID NO: 9420604 - DNA, 22 bp, Homo sapiens
caggcctgggctgggtatcagg

SEQ ID NO: 9420605 - DNA, 22 bp, Homo sapiens
caggcctggctgcagctcgcct

SEQ ID NO: 9420606 - DNA, 22 bp, Homo sapiens
caggcctccactccacgcagac

SEQ ID NO: 9420607 - DNA, 22 bp, Homo sapiens
caggcctcccggtgcacactga

SEQ ID NO: 9420608 - DNA, 22 bp, Homo sapiens
caggcctcccggtgcacactga

SEQ ID NO: 9420609 - DNA, 22 bp, Homo sapiens
caggcctcccggtgcacactga

SEQ ID NO: 9420610 - DNA, 22 bp, Homo sapiens
caggcctcccggtgcacactga

SEQ ID NO: 9420611 - DNA, 22 bp, Homo sapiens
caggcctcccggtgcacactga

SEQ ID NO: 9420612 - DNA, 22 bp, Homo sapiens
caggcctggcccccggcacacc

SEQ ID NO: 9420613 - DNA, 22 bp, Homo sapiens
caggcctggcccccggcacacc

SEQ ID NO: 9420614 - DNA, 22 bp, Homo sapiens
caggcctggagtgcaatggcac

SEQ ID NO: 9420615 - DNA, 22 bp, Homo sapiens
caggcctggagtgcaatggcac

SEQ ID NO: 9420616 - DNA, 22 bp, Homo sapiens
agctgcaggcgccggggccgat

SEQ ID NO: 9420617 - DNA, 22 bp, Homo sapiens
agctgcaggcgccggggccgat

SEQ ID NO: 9420618 - DNA, 22 bp, Homo sapiens
agctgcaggcctctcctgggga

SEQ ID NO: 9420619 - DNA, 22 bp, Homo sapiens
agctgcaggcctctcctgggga

SEQ ID NO: 9420620 - DNA, 21 bp, Homo sapiens
agctgcagtcaagccagaggt

SEQ ID NO: 9420621 - DNA, 21 bp, Homo sapiens
agctgcagtcaagccagaggt

SEQ ID NO: 9420622 - DNA, 22 bp, Homo sapiens
agctgcagtaaagctctccagg

SEQ ID NO: 9420623 - DNA, 22 bp, Homo sapiens
agctgcagtatgaggctggtgg

SEQ ID NO: 9420624 - DNA, 21 bp, Homo sapiens
agctgcagtcaagccagaggt

SEQ ID NO: 9420625 - DNA, 22 bp, Homo sapiens
agctgcagtatgaggctggtgg

SEQ ID NO: 9420626 - DNA, 22 bp, Homo sapiens
cagcttttaggactgtgagaaa

SEQ ID NO: 9420627 - DNA, 22 bp, Homo sapiens
cagcttttgcagacttcttgcc

SEQ ID NO: 9420628 - DNA, 22 bp, Homo sapiens
caggaaaaatgccaggagtcag

SEQ ID NO: 9420629 - DNA, 22 bp, Homo sapiens
cagctttggagtgtgagtgctg

SEQ ID NO: 9420630 - DNA, 21 bp, Homo sapiens
agctgcaggcctcccagggat

SEQ ID NO: 9420631 - DNA, 22 bp, Homo sapiens
agctgcaggcccatgctcagtc

SEQ ID NO: 9420632 - DNA, 22 bp, Homo sapiens
agctgcaggcccatgctcagtc

SEQ ID NO: 9420633 - DNA, 22 bp, Homo sapiens
agctgcaggcccatgctcagtc

SEQ ID NO: 9420634 - DNA, 22 bp, Homo sapiens
agctgcaggcccatgctcagtc

SEQ ID NO: 9420635 - DNA, 21 bp, Homo sapiens
agctgcagcccaaaggcctgt

SEQ ID NO: 9420636 - DNA, 21 bp, Homo sapiens
agctgcagcccaaaggcctgt

SEQ ID NO: 9420637 - DNA, 22 bp, Homo sapiens
agctgaggctctgagagggaag

SEQ ID NO: 9420638 - DNA, 23 bp, Homo sapiens
agctgaggctgtgggtgtcagag

SEQ ID NO: 9420639 - DNA, 21 bp, Homo sapiens
agctgcagccatgtacatggc

SEQ ID NO: 9420640 - DNA, 23 bp, Homo sapiens
cagcttctttgggattctttata

SEQ ID NO: 9420641 - DNA, 23 bp, Homo sapiens
agctgaggcagaggggcattctc

SEQ ID NO: 9420642 - DNA, 22 bp, Homo sapiens
agctgaggcatgatgctatcag

SEQ ID NO: 9420643 - DNA, 23 bp, Homo sapiens
agctgaggcagaggggcattctc

SEQ ID NO: 9420644 - DNA, 22 bp, Homo sapiens
agctgaggccacgagtgaaggg

SEQ ID NO: 9420645 - DNA, 22 bp, Homo sapiens
agctgaggcatggacaggctgc

SEQ ID NO: 9420646 - DNA, 22 bp, Homo sapiens
agctgaggcatggacaggctgc

SEQ ID NO: 9420647 - DNA, 22 bp, Homo sapiens
agctgaggccacgagtgaaggg

SEQ ID NO: 9420648 - DNA, 22 bp, Homo sapiens
cagcttctggcgtggagcctga

SEQ ID NO: 9420649 - DNA, 22 bp, Homo sapiens
cagcttctggcgtggagcctga

SEQ ID NO: 9420650 - DNA, 22 bp, Homo sapiens
cagcttctgctcatggaggggt

SEQ ID NO: 9420651 - DNA, 22 bp, Homo sapiens
cagcttctgtttattgtgtgcc

SEQ ID NO: 9420652 - DNA, 22 bp, Homo sapiens
cagcttctgtttctagcccctg

SEQ ID NO: 9420653 - DNA, 22 bp, Homo sapiens
cagcttctgtcctagaaactgg

SEQ ID NO: 9420654 - DNA, 22 bp, Homo sapiens
cagcttctgtttctagcccctg

SEQ ID NO: 9420655 - DNA, 22 bp, Homo sapiens
cagcttcttagtctttccttgt

SEQ ID NO: 9420656 - DNA, 22 bp, Homo sapiens
cagcttcttacgagctggtact

SEQ ID NO: 9420657 - DNA, 22 bp, Homo sapiens
cagcttctttgggattctttat

SEQ ID NO: 9420658 - DNA, 22 bp, Homo sapiens
cagcttcttcagtcctggagct

SEQ ID NO: 9420659 - DNA, 21 bp, Homo sapiens
cagcttcttctgtgacctggt

SEQ ID NO: 9420660 - DNA, 22 bp, Homo sapiens
cagctctgaagaaaggtgtcta

SEQ ID NO: 9420661 - DNA, 22 bp, Homo sapiens
cagctctgaagaaaggtgtcta

SEQ ID NO: 9420662 - DNA, 22 bp, Homo sapiens
cagctctgaagaaaggtgtcta

SEQ ID NO: 9420663 - DNA, 22 bp, Homo sapiens
cagctctctaaggtcttgcttt

SEQ ID NO: 9420664 - DNA, 22 bp, Homo sapiens
cagctctgaagaaaggtgtcta

SEQ ID NO: 9420665 - DNA, 22 bp, Homo sapiens
cagctgttgtctctcacatatt

SEQ ID NO: 9420666 - DNA, 22 bp, Homo sapiens
cagctgttgtgatccatttacg

SEQ ID NO: 9420667 - DNA, 22 bp, Homo sapiens
cagctgttgtctctcacatatt

SEQ ID NO: 9420668 - DNA, 22 bp, Homo sapiens
cagctgttgtcacctcacatcc

SEQ ID NO: 9420669 - DNA, 22 bp, Homo sapiens
cagctgttgtcacctcacatcc

SEQ ID NO: 9420670 - DNA, 22 bp, Homo sapiens
cagctctgacacagtacaaaat

SEQ ID NO: 9420671 - DNA, 23 bp, Homo sapiens
cagctcgcttttgttccctccct

SEQ ID NO: 9420672 - DNA, 22 bp, Homo sapiens
cagctcctgttggtcttgagga

SEQ ID NO: 9420673 - DNA, 22 bp, Homo sapiens
cagctctcacaccctcctccca

SEQ ID NO: 9420674 - DNA, 22 bp, Homo sapiens
cagctctcacacttagcttcta

SEQ ID NO: 9420675 - DNA, 22 bp, Homo sapiens
agctctcccaccttcttcttac

SEQ ID NO: 9420676 - DNA, 18 bp, Homo sapiens
agctctcccccacatgcc

SEQ ID NO: 9420677 - DNA, 22 bp, Homo sapiens
agctcctgtgtgaagcctccct

SEQ ID NO: 9420678 - DNA, 22 bp, Homo sapiens
agctctcccatagggcaagatc

SEQ ID NO: 9420679 - DNA, 22 bp, Homo sapiens
agctctcccaccttcttcttac

SEQ ID NO: 9420680 - DNA, 23 bp, Homo sapiens
agctctgaaatagggaaagagga

SEQ ID NO: 9420681 - DNA, 22 bp, Homo sapiens
agctctgatctttacaacaaag

SEQ ID NO: 9420682 - DNA, 22 bp, Homo sapiens
agctctgatgactttacaactt

SEQ ID NO: 9420683 - DNA, 22 bp, Homo sapiens
agctctgatccataatttatac

SEQ ID NO: 9420684 - DNA, 22 bp, Homo sapiens
agctctgagttggggaggagca

SEQ ID NO: 9420685 - DNA, 16 bp, Homo sapiens
agctctgagtagagtt

SEQ ID NO: 9420686 - DNA, 22 bp, Homo sapiens
agctctgacaaggattttctgc

SEQ ID NO: 9420687 - DNA, 22 bp, Homo sapiens
agctctgactgaagagatgcaa

SEQ ID NO: 9420688 - DNA, 22 bp, Homo sapiens
agctctgactgaagagatgcaa

SEQ ID NO: 9420689 - DNA, 16 bp, Homo sapiens
agctctgagtagagtt

SEQ ID NO: 9420690 - DNA, 22 bp, Homo sapiens
agctctgagaaagttagaaagt

SEQ ID NO: 9420691 - DNA, 22 bp, Homo sapiens
cagctcctgcctgggcagctgt

SEQ ID NO: 9420692 - DNA, 22 bp, Homo sapiens
cagctcctgggccatctcctag

SEQ ID NO: 9420693 - DNA, 22 bp, Homo sapiens
cagctcctgggccatctcctag

SEQ ID NO: 9420694 - DNA, 22 bp, Homo sapiens
cagctcctgcagctggctccca

SEQ ID NO: 9420695 - DNA, 22 bp, Homo sapiens
cagctcctgcagctggctccca

SEQ ID NO: 9420696 - DNA, 22 bp, Homo sapiens
agctctggaactcccggctgct

SEQ ID NO: 9420697 - DNA, 22 bp, Homo sapiens
agctctggaagccctggtagtt

SEQ ID NO: 9420698 - DNA, 22 bp, Homo sapiens
agctctgccgcctttcaggctg

SEQ ID NO: 9420699 - DNA, 22 bp, Homo sapiens
agctctggaactcccggctgct

SEQ ID NO: 9420700 - DNA, 22 bp, Homo sapiens
agctggctggccccttcctgcc

SEQ ID NO: 9420701 - DNA, 22 bp, Homo sapiens
agctggctggccccttcctgcc

SEQ ID NO: 9420702 - DNA, 22 bp, Homo sapiens
agctggctggccccttcctgcc

SEQ ID NO: 9420703 - DNA, 22 bp, Homo sapiens
agctggctgccttctccttagg

SEQ ID NO: 9420704 - DNA, 22 bp, Homo sapiens
agctggctgccttctccttagg

SEQ ID NO: 9420705 - DNA, 22 bp, Homo sapiens
caggagtccctctggccagcat

SEQ ID NO: 9420706 - DNA, 21 bp, Homo sapiens
agctggcctggtttgagctcc

SEQ ID NO: 9420707 - DNA, 22 bp, Homo sapiens
agctggcctccgggtgcctggg

SEQ ID NO: 9420708 - DNA, 22 bp, Homo sapiens
caggagtctgttcctcatttgt

SEQ ID NO: 9420709 - DNA, 22 bp, Homo sapiens
agctggctttgagctgggaggt

SEQ ID NO: 9420710 - DNA, 22 bp, Homo sapiens
agctggctttatggttggctaa

SEQ ID NO: 9420711 - DNA, 22 bp, Homo sapiens
agctggctttgagctgggaggt

SEQ ID NO: 9420712 - DNA, 22 bp, Homo sapiens
agctggctttgagctgggaggt

SEQ ID NO: 9420713 - DNA, 22 bp, Homo sapiens
agctggctttgagctgggaggt

SEQ ID NO: 9420714 - DNA, 22 bp, Homo sapiens
agctggcttgcatgctaaggag

SEQ ID NO: 9420715 - DNA, 22 bp, Homo sapiens
agctggctttatggttggctaa

SEQ ID NO: 9420716 - DNA, 22 bp, Homo sapiens
agctggcttcacaggcagtgtg

SEQ ID NO: 9420717 - DNA, 22 bp, Homo sapiens
agctggctgggtgccagtctcc

SEQ ID NO: 9420718 - DNA, 22 bp, Homo sapiens
agctggcttctctgcagacatt

SEQ ID NO: 9420719 - DNA, 22 bp, Homo sapiens
agctggcttctctgcagacatt

SEQ ID NO: 9420720 - DNA, 22 bp, Homo sapiens
agctggcttctctgcagacatt

SEQ ID NO: 9420721 - DNA, 22 bp, Homo sapiens
caggaggtgccctctagtggca

SEQ ID NO: 9420722 - DNA, 22 bp, Homo sapiens
caggaggttgagggtgcagtga

SEQ ID NO: 9420723 - DNA, 22 bp, Homo sapiens
caggaggtgaaggagaaccagt

SEQ ID NO: 9420724 - DNA, 22 bp, Homo sapiens
agctggccagcacctccaggtc

SEQ ID NO: 9420725 - DNA, 22 bp, Homo sapiens
caggaggtgacttccaggggtt

SEQ ID NO: 9420726 - DNA, 22 bp, Homo sapiens
caggagtccagagtgtcatttt

SEQ ID NO: 9420727 - DNA, 22 bp, Homo sapiens
caggaggttgtaagagcaggcc

SEQ ID NO: 9420728 - DNA, 22 bp, Homo sapiens
caggaggttgtaagagcaggcc

SEQ ID NO: 9420729 - DNA, 22 bp, Homo sapiens
caggaggttgtaagagcaggcc

SEQ ID NO: 9420730 - DNA, 22 bp, Homo sapiens
agctggcattacaggagcatgc

SEQ ID NO: 9420731 - DNA, 22 bp, Homo sapiens
agctggcatcgagcatttgaac

SEQ ID NO: 9420732 - DNA, 22 bp, Homo sapiens
agctggcatctgaagtcagggc

SEQ ID NO: 9420733 - DNA, 22 bp, Homo sapiens
agctggcatctgaagtcagggc

SEQ ID NO: 9420734 - DNA, 22 bp, Homo sapiens
agctggcattgcagggagctgc

SEQ ID NO: 9420735 - DNA, 22 bp, Homo sapiens
agctggccagatgtcccaaaga

SEQ ID NO: 9420736 - DNA, 22 bp, Homo sapiens
agctggccagcacctccaggtc

SEQ ID NO: 9420737 - DNA, 22 bp, Homo sapiens
agctggccagcacctccaggtc

SEQ ID NO: 9420738 - DNA, 22 bp, Homo sapiens
agctgcctggagtcatttcctg

SEQ ID NO: 9420739 - DNA, 22 bp, Homo sapiens
caggaaaaggagactttagcac

SEQ ID NO: 9420740 - DNA, 21 bp, Homo sapiens
caggaaaagcggaagtctagc

SEQ ID NO: 9420741 - DNA, 22 bp, Homo sapiens
caggaaaaggagactttagcac

SEQ ID NO: 9420742 - DNA, 22 bp, Homo sapiens
caggaaaaatgccaggagtcag

SEQ ID NO: 9420743 - DNA, 22 bp, Homo sapiens
caggaaaaatgccaggagtcag

SEQ ID NO: 9420744 - DNA, 22 bp, Homo sapiens
caggaaaaatgccaggagtcag

SEQ ID NO: 9420745 - DNA, 22 bp, Homo sapiens
caggaaaaatgccaggagtcag

SEQ ID NO: 9420746 - DNA, 21 bp, Homo sapiens
caggaaaagcggaagtctagc

SEQ ID NO: 9420747 - DNA, 21 bp, Homo sapiens
caggaaaagcggaagtctagc

SEQ ID NO: 9420748 - DNA, 22 bp, Homo sapiens
agctgctccaatttttaccatt

SEQ ID NO: 9420749 - DNA, 22 bp, Homo sapiens
agctgcctggccggagccactg

SEQ ID NO: 9420750 - DNA, 22 bp, Homo sapiens
agctgcctggccggagccactg

SEQ ID NO: 9420751 - DNA, 22 bp, Homo sapiens
agctgcctggccggagccactg

SEQ ID NO: 9420752 - DNA, 22 bp, Homo sapiens
agctgctcttgggtgacttcaa

SEQ ID NO: 9420753 - DNA, 22 bp, Homo sapiens
agctgctcttcatttcccccca

SEQ ID NO: 9420754 - DNA, 22 bp, Homo sapiens
agctgctcctttcctgcaggcg

SEQ ID NO: 9420755 - DNA, 22 bp, Homo sapiens
agctgctccttggctgtggttc

SEQ ID NO: 9420756 - DNA, 22 bp, Homo sapiens
agctgctctacatgatggggaa

SEQ ID NO: 9420757 - DNA, 22 bp, Homo sapiens
agctgctcgaagccggtggccc

SEQ ID NO: 9420758 - DNA, 22 bp, Homo sapiens
agctgctgagagtctgccgggc

SEQ ID NO: 9420759 - DNA, 22 bp, Homo sapiens
agctgctgaatgacactgcaag

SEQ ID NO: 9420760 - DNA, 22 bp, Homo sapiens
agctgctgagagtctgccgggc

SEQ ID NO: 9420761 - DNA, 22 bp, Homo sapiens
agctgctgagccaggctgatgt

SEQ ID NO: 9420762 - DNA, 22 bp, Homo sapiens
agctgctgaagtgagagaattg

SEQ ID NO: 9420763 - DNA, 22 bp, Homo sapiens
agctgctgaagtgagagaattg

SEQ ID NO: 9420764 - DNA, 22 bp, Homo sapiens
agctgctctttgaaggacactt

SEQ ID NO: 9420765 - DNA, 22 bp, Homo sapiens
agctggcagtcggccttgatgc

SEQ ID NO: 9420766 - DNA, 22 bp, Homo sapiens
agctggcagtcggccttgatgc

SEQ ID NO: 9420767 - DNA, 22 bp, Homo sapiens
caggacagagcccagactgtgt

SEQ ID NO: 9420768 - DNA, 22 bp, Homo sapiens
caggacagagcccagactgtgt

SEQ ID NO: 9420769 - DNA, 22 bp, Homo sapiens
agctggaggataactcacttct

SEQ ID NO: 9420770 - DNA, 22 bp, Homo sapiens
caggacagagcccagactgtgt

SEQ ID NO: 9420771 - DNA, 22 bp, Homo sapiens
agctggcaggtgaagatgattt

SEQ ID NO: 9420772 - DNA, 22 bp, Homo sapiens
caggacagaccaagatcgtgct

SEQ ID NO: 9420773 - DNA, 22 bp, Homo sapiens
caggacagacagaatgcctaac

SEQ ID NO: 9420774 - DNA, 19 bp, Homo sapiens
caggacagacttcaaagcc

SEQ ID NO: 9420775 - DNA, 19 bp, Homo sapiens
caggacagacttcaaagcc

SEQ ID NO: 9420776 - DNA, 19 bp, Homo sapiens
caggacagacttcaaagcc

SEQ ID NO: 9420777 - DNA, 22 bp, Homo sapiens
caggacagaccaagatcgtgct

SEQ ID NO: 9420778 - DNA, 22 bp, Homo sapiens
caggacacttgttcttctctgc

SEQ ID NO: 9420779 - DNA, 22 bp, Homo sapiens
agctgctgagccaggctgatgt

SEQ ID NO: 9420780 - DNA, 22 bp, Homo sapiens
caggacagaaataaggaatata

SEQ ID NO: 9420781 - DNA, 22 bp, Homo sapiens
caggacagaaataaggaatata

SEQ ID NO: 9420782 - DNA, 22 bp, Homo sapiens
caggacagaaataaggaatata

SEQ ID NO: 9420783 - DNA, 22 bp, Homo sapiens
caggacagacagaatgcctaac

SEQ ID NO: 9420784 - DNA, 22 bp, Homo sapiens
caggacagacagaatgcctaac

SEQ ID NO: 9420785 - DNA, 22 bp, Homo sapiens
caggacagacagaatgcctaac

SEQ ID NO: 9420786 - DNA, 22 bp, Homo sapiens
caggacagacagaatgcctaac

SEQ ID NO: 9420787 - DNA, 22 bp, Homo sapiens
caggacagaaataaggaatata

SEQ ID NO: 9420788 - DNA, 22 bp, Homo sapiens
cccagcagtttgcttagagtga

SEQ ID NO: 9420789 - DNA, 22 bp, Homo sapiens
cccagcagtttgcttagagtga

SEQ ID NO: 9420790 - DNA, 22 bp, Homo sapiens
cccagcagttgttggtgcacat

SEQ ID NO: 9420791 - DNA, 22 bp, Homo sapiens
cccagcagttgttggtgcacat

SEQ ID NO: 9420792 - DNA, 22 bp, Homo sapiens
cccagcagttgttggtgcacat

SEQ ID NO: 9420793 - DNA, 22 bp, Homo sapiens
cccagcatcctcagggagcggg

SEQ ID NO: 9420794 - DNA, 22 bp, Homo sapiens
cccagcctactctgccatagca

SEQ ID NO: 9420795 - DNA, 22 bp, Homo sapiens
cccagcagtttgcttagagtga

SEQ ID NO: 9420796 - DNA, 22 bp, Homo sapiens
cccagcatcccagtgggcagca

SEQ ID NO: 9420797 - DNA, 22 bp, Homo sapiens
cccagcatcccagtgggcagca

SEQ ID NO: 9420798 - DNA, 22 bp, Homo sapiens
cccagcatcccagtgggcagca

SEQ ID NO: 9420799 - DNA, 22 bp, Homo sapiens
cccagcacaggcaattccatac

SEQ ID NO: 9420800 - DNA, 22 bp, Homo sapiens
cccagcacaggcaattccatac

SEQ ID NO: 9420801 - DNA, 22 bp, Homo sapiens
cccagcactcagcaggctcata

SEQ ID NO: 9420802 - DNA, 22 bp, Homo sapiens
cccagcagtacccaagcccttg

SEQ ID NO: 9420803 - DNA, 22 bp, Homo sapiens
cccagcagtacccaagcccttg

SEQ ID NO: 9420804 - DNA, 22 bp, Homo sapiens
cccagcagtaaccagtggaaat

SEQ ID NO: 9420805 - DNA, 22 bp, Homo sapiens
cccagcactcagcaggctcata

SEQ ID NO: 9420806 - DNA, 22 bp, Homo sapiens
cccagcagtagagctcatatgg

SEQ ID NO: 9420807 - DNA, 22 bp, Homo sapiens
cccagcagtacccaagcccttg

SEQ ID NO: 9420808 - DNA, 22 bp, Homo sapiens
cccagcagtagagctcatatgg

SEQ ID NO: 9420809 - DNA, 22 bp, Homo sapiens
cccagcagtacccaagcccttg

SEQ ID NO: 9420810 - DNA, 22 bp, Homo sapiens
cccagcagtgacccagtgatac

SEQ ID NO: 9420811 - DNA, 22 bp, Homo sapiens
cccagcagtgacccagtgatac

SEQ ID NO: 9420812 - DNA, 22 bp, Homo sapiens
cccagcagtggttctcaaactt

SEQ ID NO: 9420813 - DNA, 22 bp, Homo sapiens
cccagcagtagagctcatatgg

SEQ ID NO: 9420814 - DNA, 22 bp, Homo sapiens
ccataatcgtgtgttaaataat

SEQ ID NO: 9420815 - DNA, 22 bp, Homo sapiens
ccataatctggctttgagagag

SEQ ID NO: 9420816 - DNA, 21 bp, Homo sapiens
ccataaacagatggtaactgt

SEQ ID NO: 9420817 - DNA, 20 bp, Homo sapiens
ccagtttctttcccagcctc

SEQ ID NO: 9420818 - DNA, 22 bp, Homo sapiens
ccataattgggtagccatctga

SEQ ID NO: 9420819 - DNA, 21 bp, Homo sapiens
ccataattttgtttcagaagt

SEQ ID NO: 9420820 - DNA, 21 bp, Homo sapiens
ccataatcttaggatcaaaat

SEQ ID NO: 9420821 - DNA, 22 bp, Homo sapiens
ccatcctgtctgtggcctcagg

SEQ ID NO: 9420822 - DNA, 22 bp, Homo sapiens
ccatcctgtctgtggcctcagg

SEQ ID NO: 9420823 - DNA, 22 bp, Homo sapiens
ccatcgcttcaaatctcagact

SEQ ID NO: 9420824 - DNA, 22 bp, Homo sapiens
ccatcctgtctgtggcctcagg

SEQ ID NO: 9420825 - DNA, 22 bp, Homo sapiens
ccatctccaaataccatcacat

SEQ ID NO: 9420826 - DNA, 22 bp, Homo sapiens
ccatctactgacttagcctcat

SEQ ID NO: 9420827 - DNA, 22 bp, Homo sapiens
ccatctccactgtccctgtcaa

SEQ ID NO: 9420828 - DNA, 22 bp, Homo sapiens
ccatctccactgtccctgtcaa

SEQ ID NO: 9420829 - DNA, 22 bp, Homo sapiens
ccatgagccaggctgaggaagc

SEQ ID NO: 9420830 - DNA, 22 bp, Homo sapiens
ccatgagaagttagactagcca

SEQ ID NO: 9420831 - DNA, 22 bp, Homo sapiens
ccatgatggctatccttgcttg

SEQ ID NO: 9420832 - DNA, 22 bp, Homo sapiens
ccatgattggaatgtcttttca

SEQ ID NO: 9420833 - DNA, 22 bp, Homo sapiens
ccatgatttcccctgctgcaca

SEQ ID NO: 9420834 - DNA, 22 bp, Homo sapiens
ccatgatttgagctacttactg

SEQ ID NO: 9420835 - DNA, 22 bp, Homo sapiens
ccatctgtctcctcctcgaatt

SEQ ID NO: 9420836 - DNA, 22 bp, Homo sapiens
ccatctggatctgtccactgac

SEQ ID NO: 9420837 - DNA, 22 bp, Homo sapiens
ccatctggatctgtccactgac

SEQ ID NO: 9420838 - DNA, 22 bp, Homo sapiens
ccatgaattcactccatgctag

SEQ ID NO: 9420839 - DNA, 22 bp, Homo sapiens
ccatcttgggtcactgcccccc

SEQ ID NO: 9420840 - DNA, 22 bp, Homo sapiens
ccatctggagcatttgacctgg

SEQ ID NO: 9420841 - DNA, 22 bp, Homo sapiens
ccatctggatctgtccactgac

SEQ ID NO: 9420842 - DNA, 22 bp, Homo sapiens
ccatctgtatctgacaaattct

SEQ ID NO: 9420843 - DNA, 22 bp, Homo sapiens
aggctgtgtttcccctggagct

SEQ ID NO: 9420844 - DNA, 21 bp, Homo sapiens
aggcttaaagccattatttcc

SEQ ID NO: 9420845 - DNA, 23 bp, Homo sapiens
aggcttaaatccttggttttgcc

SEQ ID NO: 9420846 - DNA, 22 bp, Homo sapiens
aggcttaaagatagtaagaaac

SEQ ID NO: 9420847 - DNA, 22 bp, Homo sapiens
aggctgttttgtataaactgga

SEQ ID NO: 9420848 - DNA, 22 bp, Homo sapiens
aggcttaaatgctcatatcagt

SEQ ID NO: 9420849 - DNA, 22 bp, Homo sapiens
aggcttaaatgctcatatcagt

SEQ ID NO: 9420850 - DNA, 22 bp, Homo sapiens
aggcttaacctgatcacatgag

SEQ ID NO: 9420851 - DNA, 22 bp, Homo sapiens
aggcttaatgagttaaatcact

SEQ ID NO: 9420852 - DNA, 22 bp, Homo sapiens
aggcttaactttactgttatgc

SEQ ID NO: 9420853 - DNA, 22 bp, Homo sapiens
aggcttaactacaatttttgcc

SEQ ID NO: 9420854 - DNA, 22 bp, Homo sapiens
aggctgtggtgggctttgagcc

SEQ ID NO: 9420855 - DNA, 22 bp, Homo sapiens
aggctgtgtggtcatggtggct

SEQ ID NO: 9420856 - DNA, 22 bp, Homo sapiens
aggctgtgtggatgagtcttac

SEQ ID NO: 9420857 - DNA, 22 bp, Homo sapiens
aggctgtgtttaagtggtaatg

SEQ ID NO: 9420858 - DNA, 22 bp, Homo sapiens
aggctgtgtttaagtggtaatg

SEQ ID NO: 9420859 - DNA, 22 bp, Homo sapiens
aggctgtgttctggttcttagc

SEQ ID NO: 9420860 - DNA, 22 bp, Homo sapiens
cccagctctctcagttctgctt

SEQ ID NO: 9420861 - DNA, 22 bp, Homo sapiens
cccagctctctcagttctgctt

SEQ ID NO: 9420862 - DNA, 22 bp, Homo sapiens
cccagctctctgctcttagcct

SEQ ID NO: 9420863 - DNA, 22 bp, Homo sapiens
cccagctctctgctcttagcct

SEQ ID NO: 9420864 - DNA, 22 bp, Homo sapiens
cccagctctctgctcttagcct

SEQ ID NO: 9420865 - DNA, 22 bp, Homo sapiens
cccagctctcgcacttactagc

SEQ ID NO: 9420866 - DNA, 22 bp, Homo sapiens
cccagctctaggagtggtggca

SEQ ID NO: 9420867 - DNA, 22 bp, Homo sapiens
cccagctctctcagttctgctt

SEQ ID NO: 9420868 - DNA, 19 bp, Homo sapiens
cccagctctcgtggtgtgc

SEQ ID NO: 9420869 - DNA, 22 bp, Homo sapiens
cccagctctgcagacctgccct

SEQ ID NO: 9420870 - DNA, 22 bp, Homo sapiens
cccagctctgcagacctgccct

SEQ ID NO: 9420871 - DNA, 22 bp, Homo sapiens
cccagctctgccatctacccac

SEQ ID NO: 9420872 - DNA, 22 bp, Homo sapiens
cccagctctgccatctacccac

SEQ ID NO: 9420873 - DNA, 22 bp, Homo sapiens
cccagctctgcagacctgccct

SEQ ID NO: 9420874 - DNA, 22 bp, Homo sapiens
cccagctctgccatctacccac

SEQ ID NO: 9420875 - DNA, 22 bp, Homo sapiens
cccagctctggaaggtggggga

SEQ ID NO: 9420876 - DNA, 22 bp, Homo sapiens
cccagctctaggagtggtggca

SEQ ID NO: 9420877 - DNA, 22 bp, Homo sapiens
cccagctcgccgccgatgtgcg

SEQ ID NO: 9420878 - DNA, 22 bp, Homo sapiens
cccagctccttgtttgcatctc

SEQ ID NO: 9420879 - DNA, 22 bp, Homo sapiens
cccagctccttgtttgcatctc

SEQ ID NO: 9420880 - DNA, 22 bp, Homo sapiens
cccagctcgccgccgatgtgcg

SEQ ID NO: 9420881 - DNA, 22 bp, Homo sapiens
cccagctccttggatgggcagg

SEQ ID NO: 9420882 - DNA, 22 bp, Homo sapiens
cccagctccttggatgggcagg

SEQ ID NO: 9420883 - DNA, 22 bp, Homo sapiens
cccagctccttacagggccgaa

SEQ ID NO: 9420884 - DNA, 22 bp, Homo sapiens
cccagcctggtgcactgtgggg

SEQ ID NO: 9420885 - DNA, 22 bp, Homo sapiens
cccagcctggtgcactgtgggg

SEQ ID NO: 9420886 - DNA, 22 bp, Homo sapiens
cccagcctgatctcggccagct

SEQ ID NO: 9420887 - DNA, 22 bp, Homo sapiens
cccagcctctgtttgctcctct

SEQ ID NO: 9420888 - DNA, 22 bp, Homo sapiens
cccagcctgatctcggccagct

SEQ ID NO: 9420889 - DNA, 22 bp, Homo sapiens
cccagcctgatctcggccagct

SEQ ID NO: 9420890 - DNA, 22 bp, Homo sapiens
cccagcctgatctcggccagct

SEQ ID NO: 9420891 - DNA, 22 bp, Homo sapiens
cccagcctgatctcggccagct

SEQ ID NO: 9420892 - DNA, 22 bp, Homo sapiens
cccagcctctgtttgctcctct

SEQ ID NO: 9420893 - DNA, 22 bp, Homo sapiens
cccagcctctgtttgctcctct

SEQ ID NO: 9420894 - DNA, 22 bp, Homo sapiens
cccagcctctgggttctgccgg

SEQ ID NO: 9420895 - DNA, 22 bp, Homo sapiens
cccagcctctgggctcacccaa

SEQ ID NO: 9420896 - DNA, 22 bp, Homo sapiens
cccagcctctgggctcacccaa

SEQ ID NO: 9420897 - DNA, 22 bp, Homo sapiens
cccagcctctgggctcacccaa

SEQ ID NO: 9420898 - DNA, 22 bp, Homo sapiens
cccagcctctggattctgccct

SEQ ID NO: 9420899 - DNA, 18 bp, Homo sapiens
cccagcctctcctttcta

SEQ ID NO: 9420900 - DNA, 18 bp, Homo sapiens
cccagcctctcctttcta

SEQ ID NO: 9420901 - DNA, 18 bp, Homo sapiens
cccagcctctcctttcta

SEQ ID NO: 9420902 - DNA, 18 bp, Homo sapiens
cccagcctctcctttcta

SEQ ID NO: 9420903 - DNA, 22 bp, Homo sapiens
agggagagtttgatgtttcctc

SEQ ID NO: 9420904 - DNA, 22 bp, Homo sapiens
agggagagtagatatcaggtgt

SEQ ID NO: 9420905 - DNA, 22 bp, Homo sapiens
agggagagtttgatgtttcctc

SEQ ID NO: 9420906 - DNA, 22 bp, Homo sapiens
agggagcaaaggtttcagggtt

SEQ ID NO: 9420907 - DNA, 22 bp, Homo sapiens
agggagcaaaggtttcagggtt

SEQ ID NO: 9420908 - DNA, 22 bp, Homo sapiens
agggagcatgggtgaagcaggc

SEQ ID NO: 9420909 - DNA, 18 bp, Homo sapiens
agggagcatctggttgcc

SEQ ID NO: 9420910 - DNA, 18 bp, Homo sapiens
agggagcatctggttgcc

SEQ ID NO: 9420911 - DNA, 22 bp, Homo sapiens
agggagcagggctcctttgggt

SEQ ID NO: 9420912 - DNA, 22 bp, Homo sapiens
agggagcagcagccacaggatg

SEQ ID NO: 9420913 - DNA, 22 bp, Homo sapiens
agggagcagcagccacaggatg

SEQ ID NO: 9420914 - DNA, 22 bp, Homo sapiens
agggagcagcagccacaggatg

SEQ ID NO: 9420915 - DNA, 22 bp, Homo sapiens
agggagcagcagccacaggatg

SEQ ID NO: 9420916 - DNA, 22 bp, Homo sapiens
agggagccaggggccagctatt

SEQ ID NO: 9420917 - DNA, 22 bp, Homo sapiens
agggagccaggaacgcaggtcg

SEQ ID NO: 9420918 - DNA, 22 bp, Homo sapiens
agggagccaggggccagctatt

SEQ ID NO: 9420919 - DNA, 22 bp, Homo sapiens
agggagccaggaacgcaggtcg

SEQ ID NO: 9420920 - DNA, 22 bp, Homo sapiens
agggagccagagttgggagctc

SEQ ID NO: 9420921 - DNA, 22 bp, Homo sapiens
agggagccagagttgggagctc

SEQ ID NO: 9420922 - DNA, 22 bp, Homo sapiens
agggagcattgtgacatatcac

SEQ ID NO: 9420923 - DNA, 21 bp, Homo sapiens
agggagcatgttagctttcga

SEQ ID NO: 9420924 - DNA, 22 bp, Homo sapiens
agggagcatgggtgaagcaggc

SEQ ID NO: 9420925 - DNA, 22 bp, Homo sapiens
agggagcatgggtgaagcaggc

SEQ ID NO: 9420926 - DNA, 22 bp, Homo sapiens
agggagcatgggtgaagcaggc

SEQ ID NO: 9420927 - DNA, 22 bp, Homo sapiens
ccccatggcaactgctgggggt

SEQ ID NO: 9420928 - DNA, 22 bp, Homo sapiens
ccccattctggccagcccagct

SEQ ID NO: 9420929 - DNA, 22 bp, Homo sapiens
agggagctttttcatgtgtcta

SEQ ID NO: 9420930 - DNA, 22 bp, Homo sapiens
agggagctttttcatgtgtcta

SEQ ID NO: 9420931 - DNA, 22 bp, Homo sapiens
agggagctttttcatgtgtcta

SEQ ID NO: 9420932 - DNA, 22 bp, Homo sapiens
agggaggaaggaactccttcta

SEQ ID NO: 9420933 - DNA, 22 bp, Homo sapiens
agggaggaaggaactccttcta

SEQ ID NO: 9420934 - DNA, 22 bp, Homo sapiens
agggaggaaggaactccttcta

SEQ ID NO: 9420935 - DNA, 22 bp, Homo sapiens
ccccatcctattcatgtttctg

SEQ ID NO: 9420936 - DNA, 22 bp, Homo sapiens
ccccatcccacctgagtgtcac

SEQ ID NO: 9420937 - DNA, 22 bp, Homo sapiens
ccccagtggaggtgagggtcct

SEQ ID NO: 9420938 - DNA, 22 bp, Homo sapiens
ccccatgctgggatctgacacc

SEQ ID NO: 9420939 - DNA, 21 bp, Homo sapiens
ccccatggagtacagttgggc

SEQ ID NO: 9420940 - DNA, 22 bp, Homo sapiens
ccccatgaagtagggtctctga

SEQ ID NO: 9420941 - DNA, 19 bp, Homo sapiens
ccccagggtaggctagggg

SEQ ID NO: 9420942 - DNA, 19 bp, Homo sapiens
ccccagggtaggctagggg

SEQ ID NO: 9420943 - DNA, 22 bp, Homo sapiens
ccccagggtcagtgtgtggagg

SEQ ID NO: 9420944 - DNA, 19 bp, Homo sapiens
ccccagggtaggctagggg

SEQ ID NO: 9420945 - DNA, 22 bp, Homo sapiens
ccccagggtcagtgtgtggagg

SEQ ID NO: 9420946 - DNA, 22 bp, Homo sapiens
ccccagggtcagtgtgtggagg

SEQ ID NO: 9420947 - DNA, 22 bp, Homo sapiens
ccccagggactggtttcatgga

SEQ ID NO: 9420948 - DNA, 19 bp, Homo sapiens
ccccagggtaggctagggg

SEQ ID NO: 9420949 - DNA, 22 bp, Homo sapiens
ccccagggaagctttgcttact

SEQ ID NO: 9420950 - DNA, 22 bp, Homo sapiens
ccccagggaagctttgcttact

SEQ ID NO: 9420951 - DNA, 22 bp, Homo sapiens
ccccagcagactcagggcaggt

SEQ ID NO: 9420952 - DNA, 22 bp, Homo sapiens
ccccagcacttggagtggggag

SEQ ID NO: 9420953 - DNA, 22 bp, Homo sapiens
ccccagcacttggagtggggag

SEQ ID NO: 9420954 - DNA, 22 bp, Homo sapiens
aggcttcaaggacctgagggaa

SEQ ID NO: 9420955 - DNA, 22 bp, Homo sapiens
aggcttaatgagttaaatcact

SEQ ID NO: 9420956 - DNA, 22 bp, Homo sapiens
aggcttaatgagttaaatcact

SEQ ID NO: 9420957 - DNA, 22 bp, Homo sapiens
agggaaggaaaagctgtcgctt

SEQ ID NO: 9420958 - DNA, 22 bp, Homo sapiens
agggaaggaggccatgtgtccc

SEQ ID NO: 9420959 - DNA, 22 bp, Homo sapiens
agggaaggaaaagctgtcgctt

SEQ ID NO: 9420960 - DNA, 22 bp, Homo sapiens
agggaaggaaaagctgtcgctt

SEQ ID NO: 9420961 - DNA, 22 bp, Homo sapiens
agggaagaatcactgggatgtt

SEQ ID NO: 9420962 - DNA, 22 bp, Homo sapiens
agggaagcttgttactgagaag

SEQ ID NO: 9420963 - DNA, 22 bp, Homo sapiens
agggaaggaaaagctgtcgctt

SEQ ID NO: 9420964 - DNA, 22 bp, Homo sapiens
agggaaggaaaagctgtcgctt

SEQ ID NO: 9420965 - DNA, 22 bp, Homo sapiens
agggaaggcttttgacatttcc

SEQ ID NO: 9420966 - DNA, 22 bp, Homo sapiens
agggaagggaaaaacactcgtc

SEQ ID NO: 9420967 - DNA, 22 bp, Homo sapiens
agggaagggaaaaacactcgtc

SEQ ID NO: 9420968 - DNA, 22 bp, Homo sapiens
agggaaggcttttgacatttcc

SEQ ID NO: 9420969 - DNA, 22 bp, Homo sapiens
agggaaggcttttgacatttcc

SEQ ID NO: 9420970 - DNA, 22 bp, Homo sapiens
agggaaggcttttgacatttcc

SEQ ID NO: 9420971 - DNA, 19 bp, Homo sapiens
agggaaggattctgtcatt

SEQ ID NO: 9420972 - DNA, 19 bp, Homo sapiens
agggaaggattctgtcatt

SEQ ID NO: 9420973 - DNA, 22 bp, Homo sapiens
agggaaggaggccatgtgtccc

SEQ ID NO: 9420974 - DNA, 22 bp, Homo sapiens
agggaaggaggttagaacccac

SEQ ID NO: 9420975 - DNA, 22 bp, Homo sapiens
agggaaggaggccatgtgtccc

SEQ ID NO: 9420976 - DNA, 22 bp, Homo sapiens
agggaaggaggccatgtgtccc

SEQ ID NO: 9420977 - DNA, 22 bp, Homo sapiens
agggaaggaggccatgtgtccc

SEQ ID NO: 9420978 - DNA, 22 bp, Homo sapiens
agggaaggaggccatgtgtccc

SEQ ID NO: 9420979 - DNA, 22 bp, Homo sapiens
agggaaggaggttagaacccac

SEQ ID NO: 9420980 - DNA, 22 bp, Homo sapiens
agggaaggaggttagaacccac

SEQ ID NO: 9420981 - DNA, 22 bp, Homo sapiens
agggaaggaggttagaacccac

SEQ ID NO: 9420982 - DNA, 19 bp, Homo sapiens
agggaaggattctgtcatt

SEQ ID NO: 9420983 - DNA, 19 bp, Homo sapiens
agggaaggattctgtcatt

SEQ ID NO: 9420984 - DNA, 22 bp, Homo sapiens
agggaaggtagaggtcaccggc

SEQ ID NO: 9420985 - DNA, 22 bp, Homo sapiens
agggaaggtagaggtcaccggc

SEQ ID NO: 9420986 - DNA, 22 bp, Homo sapiens
agggaaggtagaggtcaccggc

SEQ ID NO: 9420987 - DNA, 22 bp, Homo sapiens
agggaaggtagaggtcaccggc

SEQ ID NO: 9420988 - DNA, 22 bp, Homo sapiens
agggaagtgaatgacagatatc

SEQ ID NO: 9420989 - DNA, 23 bp, Homo sapiens
agggaagggggcttattccacag

SEQ ID NO: 9420990 - DNA, 23 bp, Homo sapiens
agggaagggggcttattccacag

SEQ ID NO: 9420991 - DNA, 22 bp, Homo sapiens
agggaagggcagggtctatgca

SEQ ID NO: 9420992 - DNA, 22 bp, Homo sapiens
agggaagggcagggtctatgca

SEQ ID NO: 9420993 - DNA, 22 bp, Homo sapiens
agggaagggcagggtctatgca

SEQ ID NO: 9420994 - DNA, 22 bp, Homo sapiens
agggaagggcagggtctatgca

SEQ ID NO: 9420995 - DNA, 22 bp, Homo sapiens
agggaagggcagggtctatgca

SEQ ID NO: 9420996 - DNA, 22 bp, Homo sapiens
agggaagggaaaaacactcgtc

SEQ ID NO: 9420997 - DNA, 22 bp, Homo sapiens
agggaagggcagggtctatgca

SEQ ID NO: 9420998 - DNA, 22 bp, Homo sapiens
agggagaatgaccaaggtatat

SEQ ID NO: 9420999 - DNA, 22 bp, Homo sapiens
agggagaatgaccaaggtatat

SEQ ID NO: 9421000 - DNA, 22 bp, Homo sapiens
agggagaggctgaactatccta

SEQ ID NO: 9421001 - DNA, 19 bp, Homo sapiens
agggagaattccaagagga

SEQ ID NO: 9421002 - DNA, 22 bp, Homo sapiens
agggagaggctgaactatccta

SEQ ID NO: 9421003 - DNA, 22 bp, Homo sapiens
agggaatgctccgtataaatct

SEQ ID NO: 9421004 - DNA, 22 bp, Homo sapiens
agggagaggttgaaacctcagt

SEQ ID NO: 9421005 - DNA, 22 bp, Homo sapiens
agggagaggttgaaacctcagt

SEQ ID NO: 9421006 - DNA, 22 bp, Homo sapiens
agggagaggttgaaacctcagt

SEQ ID NO: 9421007 - DNA, 22 bp, Homo sapiens
agggagagtagatatcaggtgt

SEQ ID NO: 9421008 - DNA, 22 bp, Homo sapiens
agggagagtagatatcaggtgt

SEQ ID NO: 9421009 - DNA, 23 bp, Homo sapiens
cctcaaatgtagcctttttccca

SEQ ID NO: 9421010 - DNA, 22 bp, Homo sapiens
cctcaaattggcattaattaag

SEQ ID NO: 9421011 - DNA, 22 bp, Homo sapiens
cctcaaattgtcaaataagaat

SEQ ID NO: 9421012 - DNA, 22 bp, Homo sapiens
cctcagaatagtcctcagatca

SEQ ID NO: 9421013 - DNA, 18 bp, Homo sapiens
cctcacagacttccatgt

SEQ ID NO: 9421014 - DNA, 22 bp, Homo sapiens
cctcagaatagtcctcagatca

SEQ ID NO: 9421015 - DNA, 22 bp, Homo sapiens
cctcacacagttatctcttcat

SEQ ID NO: 9421016 - DNA, 18 bp, Homo sapiens
cctcacagacttccatgt

SEQ ID NO: 9421017 - DNA, 22 bp, Homo sapiens
cctcaagttggaaataaaatgt

SEQ ID NO: 9421018 - DNA, 22 bp, Homo sapiens
cctcaagtcaattctgtctcgc

SEQ ID NO: 9421019 - DNA, 21 bp, Homo sapiens
cctcaagtgcctcctgctgct

SEQ ID NO: 9421020 - DNA, 22 bp, Homo sapiens
cctcagagacagtaactggaat

SEQ ID NO: 9421021 - DNA, 23 bp, Homo sapiens
cctcagagaggcagagccacatg

SEQ ID NO: 9421022 - DNA, 22 bp, Homo sapiens
cctcagagcagcacccagatga

SEQ ID NO: 9421023 - DNA, 22 bp, Homo sapiens
cctcagagcagcacccagatga

SEQ ID NO: 9421024 - DNA, 22 bp, Homo sapiens
cctcagagcctccagaaggaat

SEQ ID NO: 9421025 - DNA, 22 bp, Homo sapiens
cctcagagcctccagaaggaat

SEQ ID NO: 9421026 - DNA, 22 bp, Homo sapiens
cctcagagacagtaactggaat

SEQ ID NO: 9421027 - DNA, 22 bp, Homo sapiens
cctcagagaaaggtatggctga

SEQ ID NO: 9421028 - DNA, 22 bp, Homo sapiens
cctcagagaaaggtatggctga

SEQ ID NO: 9421029 - DNA, 22 bp, Homo sapiens
cctcaaagtagagggagatgag

SEQ ID NO: 9421030 - DNA, 22 bp, Homo sapiens
cccttcagctgagtgggacagc

SEQ ID NO: 9421031 - DNA, 22 bp, Homo sapiens
cccttcagctgagtgggacagc

SEQ ID NO: 9421032 - DNA, 22 bp, Homo sapiens
cccttcagggttaagtagaggg

SEQ ID NO: 9421033 - DNA, 23 bp, Homo sapiens
cccttcagcgagggcattaaggt

SEQ ID NO: 9421034 - DNA, 22 bp, Homo sapiens
cccttcaagctctctgggtttt

SEQ ID NO: 9421035 - DNA, 22 bp, Homo sapiens
ccctgtggttgctagggcacag

SEQ ID NO: 9421036 - DNA, 17 bp, Homo sapiens
ccctgggtgagttctca

SEQ ID NO: 9421037 - DNA, 17 bp, Homo sapiens
ccctgggtgagttctca

SEQ ID NO: 9421038 - DNA, 22 bp, Homo sapiens
ccctgtggtgacaggcctgtct

SEQ ID NO: 9421039 - DNA, 19 bp, Homo sapiens
ccctgggggtttctggtac

SEQ ID NO: 9421040 - DNA, 19 bp, Homo sapiens
ccctgggggtttctggtac

SEQ ID NO: 9421041 - DNA, 19 bp, Homo sapiens
ccctgggggtttctggtac

SEQ ID NO: 9421042 - DNA, 22 bp, Homo sapiens
ccctggggctgagggatggccg

SEQ ID NO: 9421043 - DNA, 22 bp, Homo sapiens
ccctggggctgagggatggccg

SEQ ID NO: 9421044 - DNA, 22 bp, Homo sapiens
cccttagatgtcttcctccgga

SEQ ID NO: 9421045 - DNA, 22 bp, Homo sapiens
cccttagataatttccttttct

SEQ ID NO: 9421046 - DNA, 17 bp, Homo sapiens
cccttagagcaaaagat

SEQ ID NO: 9421047 - DNA, 22 bp, Homo sapiens
cccttagagggctctccttact

SEQ ID NO: 9421048 - DNA, 22 bp, Homo sapiens
cccttagagattctgtcagagt

SEQ ID NO: 9421049 - DNA, 22 bp, Homo sapiens
cccttagaggctggaggcagca

SEQ ID NO: 9421050 - DNA, 22 bp, Homo sapiens
cccttagaattttgtagttatt

SEQ ID NO: 9421051 - DNA, 22 bp, Homo sapiens
cccttagaacaacattagcata

SEQ ID NO: 9421052 - DNA, 22 bp, Homo sapiens
ccctgttttaagttgatattga

SEQ ID NO: 9421053 - DNA, 21 bp, Homo sapiens
ccctgtgttccacagcagaca

SEQ ID NO: 9421054 - DNA, 22 bp, Homo sapiens
ccctgtgtcttcttgcctttgt

SEQ ID NO: 9421055 - DNA, 23 bp, Homo sapiens
cctcccaggctgcgagtcccgag

SEQ ID NO: 9421056 - DNA, 23 bp, Homo sapiens
cctcccaggctgcgagtcccgag

SEQ ID NO: 9421057 - DNA, 23 bp, Homo sapiens
cctcccaggctgcgagtcccgag

SEQ ID NO: 9421058 - DNA, 22 bp, Homo sapiens
cctcccaggcattgccattttc

SEQ ID NO: 9421059 - DNA, 22 bp, Homo sapiens
cctccaggctgaatatctagaa

SEQ ID NO: 9421060 - DNA, 22 bp, Homo sapiens
cctccaggccttgcaggttaac

SEQ ID NO: 9421061 - DNA, 22 bp, Homo sapiens
cctccaggataagtcagggcct

SEQ ID NO: 9421062 - DNA, 22 bp, Homo sapiens
cctccaggataagtcagggcct

SEQ ID NO: 9421063 - DNA, 22 bp, Homo sapiens
cctccaggataagtcagggcct

SEQ ID NO: 9421064 - DNA, 22 bp, Homo sapiens
cctccaggataagtcagggcct

SEQ ID NO: 9421065 - DNA, 20 bp, Homo sapiens
cctccaggcacacccatgtg

SEQ ID NO: 9421066 - DNA, 20 bp, Homo sapiens
cctccaggcacacccatgtg

SEQ ID NO: 9421067 - DNA, 20 bp, Homo sapiens
cctccaggcacacccatgtg

SEQ ID NO: 9421068 - DNA, 20 bp, Homo sapiens
cctccaggcacacccatgtg

SEQ ID NO: 9421069 - DNA, 22 bp, Homo sapiens
cctccaggaacttgagagacac

SEQ ID NO: 9421070 - DNA, 22 bp, Homo sapiens
cctcagtgagatgctcagcgaa

SEQ ID NO: 9421071 - DNA, 22 bp, Homo sapiens
cctcagtgagatgctcagcgaa

SEQ ID NO: 9421072 - DNA, 22 bp, Homo sapiens
cctccagctgcctcagtctctt

SEQ ID NO: 9421073 - DNA, 22 bp, Homo sapiens
cctcagtcttgaattagccaga

SEQ ID NO: 9421074 - DNA, 22 bp, Homo sapiens
cctcagtgacctattgcattca

SEQ ID NO: 9421075 - DNA, 22 bp, Homo sapiens
cctcagtctccgtgctcacctt

SEQ ID NO: 9421076 - DNA, 22 bp, Homo sapiens
cctccaggaggaaatggaacac

SEQ ID NO: 9421077 - DNA, 21 bp, Homo sapiens
cctccaggagcagagccctga

SEQ ID NO: 9421078 - DNA, 21 bp, Homo sapiens
cctccaggagcagagccctga

SEQ ID NO: 9421079 - DNA, 22 bp, Homo sapiens
cctccaggaacttgagagacac

SEQ ID NO: 9421080 - DNA, 21 bp, Homo sapiens
cctccaggagcagagccctga

SEQ ID NO: 9421081 - DNA, 21 bp, Homo sapiens
cctccaggagcagagccctga

SEQ ID NO: 9421082 - DNA, 22 bp, Homo sapiens
cctcccatccctgcaagagagc

SEQ ID NO: 9421083 - DNA, 22 bp, Homo sapiens
cctcccagtgcctccagagcag

SEQ ID NO: 9421084 - DNA, 22 bp, Homo sapiens
cctcccagtgcctccagagcag

SEQ ID NO: 9421085 - DNA, 22 bp, Homo sapiens
cctcccagtgcctccagagcag

SEQ ID NO: 9421086 - DNA, 22 bp, Homo sapiens
cctcccagtgcctccagagcag

SEQ ID NO: 9421087 - DNA, 22 bp, Homo sapiens
cctcccagtgcctccagagcag

SEQ ID NO: 9421088 - DNA, 22 bp, Homo sapiens
cctcccagtgcctccagagcag

SEQ ID NO: 9421089 - DNA, 22 bp, Homo sapiens
cctcccagtgcctccagagcag

SEQ ID NO: 9421090 - DNA, 22 bp, Homo sapiens
cctcccagtgccggggccggct

SEQ ID NO: 9421091 - DNA, 22 bp, Homo sapiens
cctcccagtgccggggccggct

SEQ ID NO: 9421092 - DNA, 22 bp, Homo sapiens
cctcccagtgccggggccggct

SEQ ID NO: 9421093 - DNA, 22 bp, Homo sapiens
cctcccagtgccggggccggct

SEQ ID NO: 9421094 - DNA, 22 bp, Homo sapiens
cctcccagtgccggggccggct

SEQ ID NO: 9421095 - DNA, 23 bp, Homo sapiens
cctccccaccagactctaacata

SEQ ID NO: 9421096 - DNA, 22 bp, Homo sapiens
cctccccacagcccaggagact

SEQ ID NO: 9421097 - DNA, 22 bp, Homo sapiens
cctccccacagcccaggagact

SEQ ID NO: 9421098 - DNA, 22 bp, Homo sapiens
cctccccacagcccaggagact

SEQ ID NO: 9421099 - DNA, 22 bp, Homo sapiens
cctccccacagcccaggagact

SEQ ID NO: 9421100 - DNA, 22 bp, Homo sapiens
cctctctccaagggaaatccta

SEQ ID NO: 9421101 - DNA, 22 bp, Homo sapiens
cctctctccaattttcacctca

SEQ ID NO: 9421102 - DNA, 22 bp, Homo sapiens
cctctctccaattttcacctca

SEQ ID NO: 9421103 - DNA, 22 bp, Homo sapiens
cctctctcagcttgctgcaact

SEQ ID NO: 9421104 - DNA, 22 bp, Homo sapiens
cctctctcagcttgctgcaact

SEQ ID NO: 9421105 - DNA, 22 bp, Homo sapiens
cctctcggcagcccatcttgtc

SEQ ID NO: 9421106 - DNA, 22 bp, Homo sapiens
cctctccttgcacccgtcccgc

SEQ ID NO: 9421107 - DNA, 22 bp, Homo sapiens
cctcgctgtgtgaccttgggtg

SEQ ID NO: 9421108 - DNA, 22 bp, Homo sapiens
cctctccttgcacccgtcccgc

SEQ ID NO: 9421109 - DNA, 22 bp, Homo sapiens
cctctccttgcacccgtcccgc

SEQ ID NO: 9421110 - DNA, 22 bp, Homo sapiens
cctccccacccacggctggtgg

SEQ ID NO: 9421111 - DNA, 22 bp, Homo sapiens
cctccccacccacggctggtgg

SEQ ID NO: 9421112 - DNA, 22 bp, Homo sapiens
agggcagccattgagggattct

SEQ ID NO: 9421113 - DNA, 22 bp, Homo sapiens
agggcagccattgagggattct

SEQ ID NO: 9421114 - DNA, 22 bp, Homo sapiens
agggcagcccttctgggagggc

SEQ ID NO: 9421115 - DNA, 22 bp, Homo sapiens
agggcagccatgagccttcagg

SEQ ID NO: 9421116 - DNA, 22 bp, Homo sapiens
agggcagcagctgtccctgaga

SEQ ID NO: 9421117 - DNA, 22 bp, Homo sapiens
agggcagcattgcctttctcca

SEQ ID NO: 9421118 - DNA, 22 bp, Homo sapiens
agggcagcattgcctttctcca

SEQ ID NO: 9421119 - DNA, 22 bp, Homo sapiens
agggcagcagctcctcctagct

SEQ ID NO: 9421120 - DNA, 22 bp, Homo sapiens
agggcagcagctcctcctagct

SEQ ID NO: 9421121 - DNA, 22 bp, Homo sapiens
agggcagatggaacttccccga

SEQ ID NO: 9421122 - DNA, 22 bp, Homo sapiens
agggcagcagctcctcctagct

SEQ ID NO: 9421123 - DNA, 22 bp, Homo sapiens
agggaggagaatggactccttc

SEQ ID NO: 9421124 - DNA, 22 bp, Homo sapiens
agggaggagtcctcaaagtcat

SEQ ID NO: 9421125 - DNA, 22 bp, Homo sapiens
agggaggagaatggactccttc

SEQ ID NO: 9421126 - DNA, 22 bp, Homo sapiens
agggaggagaatggactccttc

SEQ ID NO: 9421127 - DNA, 22 bp, Homo sapiens
agggaggagaatggactccttc

SEQ ID NO: 9421128 - DNA, 22 bp, Homo sapiens
agggaggagtcctcaaagtcat

SEQ ID NO: 9421129 - DNA, 22 bp, Homo sapiens
agggaggagtcctcaaagtcat

SEQ ID NO: 9421130 - DNA, 22 bp, Homo sapiens
agggcagagggtgcctcacctg

SEQ ID NO: 9421131 - DNA, 22 bp, Homo sapiens
agggcagagggtgcctcacctg

SEQ ID NO: 9421132 - DNA, 22 bp, Homo sapiens
agggcagagggtgcctcacctg

SEQ ID NO: 9421133 - DNA, 22 bp, Homo sapiens
agggaggaaggatgttccaaag

SEQ ID NO: 9421134 - DNA, 22 bp, Homo sapiens
agggaggaccaatgtgtggtta

SEQ ID NO: 9421135 - DNA, 22 bp, Homo sapiens
agggaggaaggatgttccaaag

SEQ ID NO: 9421136 - DNA, 22 bp, Homo sapiens
agggaggaaggatgttccaaag

SEQ ID NO: 9421137 - DNA, 22 bp, Homo sapiens
agggaggagaatggactccttc

SEQ ID NO: 9421138 - DNA, 22 bp, Homo sapiens
agggaggaccaatgtgtggtta

SEQ ID NO: 9421139 - DNA, 22 bp, Homo sapiens
agggaggaccaatgtgtggtta

SEQ ID NO: 9421140 - DNA, 22 bp, Homo sapiens
agggccagccgacttccagcct

SEQ ID NO: 9421141 - DNA, 22 bp, Homo sapiens
agggccagccccaccctctctg

SEQ ID NO: 9421142 - DNA, 22 bp, Homo sapiens
agggccagccccaccctctctg

SEQ ID NO: 9421143 - DNA, 21 bp, Homo sapiens
agggccagatcaccaaggagc

SEQ ID NO: 9421144 - DNA, 22 bp, Homo sapiens
agggccagagtggcaaaagcct

SEQ ID NO: 9421145 - DNA, 22 bp, Homo sapiens
agggcagctgtgagccactgtg

SEQ ID NO: 9421146 - DNA, 22 bp, Homo sapiens
agggcagctgtgagccactgtg

SEQ ID NO: 9421147 - DNA, 22 bp, Homo sapiens
agggcagctggaaggtggcttc

SEQ ID NO: 9421148 - DNA, 22 bp, Homo sapiens
agggcagctggaaggtggcttc

SEQ ID NO: 9421149 - DNA, 22 bp, Homo sapiens
agggcagctggaaggtggcttc

SEQ ID NO: 9421150 - DNA, 22 bp, Homo sapiens
agggcagctggaaggtggcttc

SEQ ID NO: 9421151 - DNA, 22 bp, Homo sapiens
agggcagctctcacctctggcc

SEQ ID NO: 9421152 - DNA, 22 bp, Homo sapiens
agggcagctggaaggtggcttc

SEQ ID NO: 9421153 - DNA, 22 bp, Homo sapiens
agggcagctctcacctctggcc

SEQ ID NO: 9421154 - DNA, 22 bp, Homo sapiens
agggcagctagctgtagaaaga

SEQ ID NO: 9421155 - DNA, 22 bp, Homo sapiens
agggcagctaaggtgctgactg

SEQ ID NO: 9421156 - DNA, 22 bp, Homo sapiens
agggcagctaaggtgctgactg

SEQ ID NO: 9421157 - DNA, 22 bp, Homo sapiens
agggcagctctcacctctggcc

SEQ ID NO: 9421158 - DNA, 22 bp, Homo sapiens
agggcagctagctgtagaaaga

SEQ ID NO: 9421159 - DNA, 22 bp, Homo sapiens
agggcagcggtgcttgtgttat

SEQ ID NO: 9421160 - DNA, 22 bp, Homo sapiens
agggcagcctgagtgctggccc

SEQ ID NO: 9421161 - DNA, 22 bp, Homo sapiens
agggcagcctgagtgctggccc

SEQ ID NO: 9421162 - DNA, 22 bp, Homo sapiens
agggcagcggtgcttgtgttat

SEQ ID NO: 9421163 - DNA, 22 bp, Homo sapiens
agggcagcctctcagcctaggt

SEQ ID NO: 9421164 - DNA, 22 bp, Homo sapiens
agggcagcctctcagcctaggt

SEQ ID NO: 9421165 - DNA, 22 bp, Homo sapiens
agggcagcctgagtgctggccc

SEQ ID NO: 9421166 - DNA, 22 bp, Homo sapiens
agggcagcctctcagcctaggt

SEQ ID NO: 9421167 - DNA, 22 bp, Homo sapiens
agggcagcccttctgggagggc

SEQ ID NO: 9421168 - DNA, 22 bp, Homo sapiens
agggcagcctctcagcctaggt

SEQ ID NO: 9421169 - DNA, 22 bp, Homo sapiens
ccctgggcaccaggcctggtaa

SEQ ID NO: 9421170 - DNA, 22 bp, Homo sapiens
ccctgggcaccaggcctggtaa

SEQ ID NO: 9421171 - DNA, 22 bp, Homo sapiens
ccctgggcagtctgcacttcag

SEQ ID NO: 9421172 - DNA, 22 bp, Homo sapiens
ccctgggcagtctgcacttcag

SEQ ID NO: 9421173 - DNA, 22 bp, Homo sapiens
ccctgggattgccttggccttg

SEQ ID NO: 9421174 - DNA, 22 bp, Homo sapiens
ccctgggcaccaggcctggtaa

SEQ ID NO: 9421175 - DNA, 22 bp, Homo sapiens
ccctgggcaagccctattttcc

SEQ ID NO: 9421176 - DNA, 22 bp, Homo sapiens
ccctgggctcagagcaggtagc

SEQ ID NO: 9421177 - DNA, 22 bp, Homo sapiens
ccctgggctcagagcaggtagc

SEQ ID NO: 9421178 - DNA, 22 bp, Homo sapiens
ccctgggctcagagcaggtagc

SEQ ID NO: 9421179 - DNA, 22 bp, Homo sapiens
ccctgggctcagagcaggtagc

SEQ ID NO: 9421180 - DNA, 22 bp, Homo sapiens
ccctgggctcagagcaggtagc

SEQ ID NO: 9421181 - DNA, 22 bp, Homo sapiens
ccctggggagcaggcgaaggag

SEQ ID NO: 9421182 - DNA, 22 bp, Homo sapiens
ccctggggagcaggcgaaggag

SEQ ID NO: 9421183 - DNA, 22 bp, Homo sapiens
ccctggggctgagggatggccg

SEQ ID NO: 9421184 - DNA, 22 bp, Homo sapiens
ccctgggatggattggcaggaa

SEQ ID NO: 9421185 - DNA, 22 bp, Homo sapiens
ccctgggatggattggcaggaa

SEQ ID NO: 9421186 - DNA, 22 bp, Homo sapiens
ccctggcccctcactccgaggc

SEQ ID NO: 9421187 - DNA, 22 bp, Homo sapiens
ccctggcccctcactccgaggc

SEQ ID NO: 9421188 - DNA, 22 bp, Homo sapiens
agggccagggaagctgtatttt

SEQ ID NO: 9421189 - DNA, 22 bp, Homo sapiens
agggccagggaagctgtatttt

SEQ ID NO: 9421190 - DNA, 22 bp, Homo sapiens
agggccaggctcccatgtcagg

SEQ ID NO: 9421191 - DNA, 22 bp, Homo sapiens
agggccaggctcccatgtcagg

SEQ ID NO: 9421192 - DNA, 22 bp, Homo sapiens
agggccaggctcccatgtcagg

SEQ ID NO: 9421193 - DNA, 22 bp, Homo sapiens
agggccaggctcccatgtcagg

SEQ ID NO: 9421194 - DNA, 22 bp, Homo sapiens
agggccaggctcccatgtcagg

SEQ ID NO: 9421195 - DNA, 22 bp, Homo sapiens
agggccaggctcccatgtcagg

SEQ ID NO: 9421196 - DNA, 22 bp, Homo sapiens
agggccagggaaacgatcagca

SEQ ID NO: 9421197 - DNA, 22 bp, Homo sapiens
agggccagggaaacgatcagca

SEQ ID NO: 9421198 - DNA, 22 bp, Homo sapiens
agggccagggaaacgatcagca

SEQ ID NO: 9421199 - DNA, 22 bp, Homo sapiens
agggccagctgatgagaatgag

SEQ ID NO: 9421200 - DNA, 22 bp, Homo sapiens
agggccagctgatgagaatgag

SEQ ID NO: 9421201 - DNA, 22 bp, Homo sapiens
agggccagctgatgagaatgag

SEQ ID NO: 9421202 - DNA, 22 bp, Homo sapiens
agggccagctgatgagaatgag

SEQ ID NO: 9421203 - DNA, 22 bp, Homo sapiens
agggccagctgatgagaatgag

SEQ ID NO: 9421204 - DNA, 22 bp, Homo sapiens
agggccagctgcagaattagca

SEQ ID NO: 9421205 - DNA, 22 bp, Homo sapiens
agggccagctagagccctcgcc

SEQ ID NO: 9421206 - DNA, 22 bp, Homo sapiens
agggccagctagagccctcgcc

SEQ ID NO: 9421207 - DNA, 22 bp, Homo sapiens
agggccagctagagccctcgcc

SEQ ID NO: 9421208 - DNA, 22 bp, Homo sapiens
agggccagctagagccctcgcc

SEQ ID NO: 9421209 - DNA, 22 bp, Homo sapiens
agggccagccgacttccagcct

SEQ ID NO: 9421210 - DNA, 22 bp, Homo sapiens
agggccagccgacttccagcct

SEQ ID NO: 9421211 - DNA, 22 bp, Homo sapiens
agggccagccgacttccagcct

SEQ ID NO: 9421212 - DNA, 22 bp, Homo sapiens
agggccagccccaccctctctg

SEQ ID NO: 9421213 - DNA, 18 bp, Homo sapiens
agggccagctgtgagtag

SEQ ID NO: 9421214 - DNA, 22 bp, Homo sapiens
agggccaggaacacctgaaggg

SEQ ID NO: 9421215 - DNA, 18 bp, Homo sapiens
agggccagctgtgagtag

SEQ ID NO: 9421216 - DNA, 18 bp, Homo sapiens
agggccagctgtgagtag

SEQ ID NO: 9421217 - DNA, 22 bp, Homo sapiens
agggccaggaacacctgaaggg

SEQ ID NO: 9421218 - DNA, 22 bp, Homo sapiens
agggccaggaacacctgaaggg

SEQ ID NO: 9421219 - DNA, 22 bp, Homo sapiens
agggccaggaacacctgaaggg

SEQ ID NO: 9421220 - DNA, 22 bp, Homo sapiens
agggccaggatcacagccaaga

SEQ ID NO: 9421221 - DNA, 22 bp, Homo sapiens
agggccaggatcacagccaaga

SEQ ID NO: 9421222 - DNA, 22 bp, Homo sapiens
agggccaggatcacagccaaga

SEQ ID NO: 9421223 - DNA, 22 bp, Homo sapiens
agggccaggatcacagccaaga

SEQ ID NO: 9421224 - DNA, 22 bp, Homo sapiens
agggccaggatcacagccaaga

SEQ ID NO: 9421225 - DNA, 19 bp, Homo sapiens
agggccaggattctggaac

SEQ ID NO: 9421226 - DNA, 22 bp, Homo sapiens
agggccaggatcacagccaaga

SEQ ID NO: 9421227 - DNA, 19 bp, Homo sapiens
agggccaggattctggaac

SEQ ID NO: 9421228 - DNA, 22 bp, Homo sapiens
ccactggagactggtctctgtg

SEQ ID NO: 9421229 - DNA, 22 bp, Homo sapiens
ccactggagactggtctctgtg

SEQ ID NO: 9421230 - DNA, 22 bp, Homo sapiens
ccactggagatgtcagacaggt

SEQ ID NO: 9421231 - DNA, 22 bp, Homo sapiens
ccactggcaaccccgcctcata

SEQ ID NO: 9421232 - DNA, 22 bp, Homo sapiens
ccactggcatccagctgccatc

SEQ ID NO: 9421233 - DNA, 22 bp, Homo sapiens
ccactggcagttggctagcctt

SEQ ID NO: 9421234 - DNA, 22 bp, Homo sapiens
ccactggcagttggctagcctt

SEQ ID NO: 9421235 - DNA, 22 bp, Homo sapiens
ccactggcatccagctgccatc

SEQ ID NO: 9421236 - DNA, 22 bp, Homo sapiens
ccactggctgtcagcaggactc

SEQ ID NO: 9421237 - DNA, 22 bp, Homo sapiens
ccactggcatccagctgccatc

SEQ ID NO: 9421238 - DNA, 23 bp, Homo sapiens
ccactgctttcattttgtcatgg

SEQ ID NO: 9421239 - DNA, 23 bp, Homo sapiens
ccactgctttcattttgtcatgg

SEQ ID NO: 9421240 - DNA, 22 bp, Homo sapiens
ccactgctgttacttacgcaaa

SEQ ID NO: 9421241 - DNA, 23 bp, Homo sapiens
ccactggagaaagtggcaggtgg

SEQ ID NO: 9421242 - DNA, 22 bp, Homo sapiens
ccactggaagatgctgaggtca

SEQ ID NO: 9421243 - DNA, 21 bp, Homo sapiens
ccactgctcttccctagggcc

SEQ ID NO: 9421244 - DNA, 21 bp, Homo sapiens
ccactgctcttccctagggcc

SEQ ID NO: 9421245 - DNA, 21 bp, Homo sapiens
ccactgctcttccctagggcc

SEQ ID NO: 9421246 - DNA, 22 bp, Homo sapiens
ccactgctctgccaggagctgg

SEQ ID NO: 9421247 - DNA, 22 bp, Homo sapiens
ccactgctgttacttacgcaaa

SEQ ID NO: 9421248 - DNA, 22 bp, Homo sapiens
ccactgctctgccaggagctgg

SEQ ID NO: 9421249 - DNA, 22 bp, Homo sapiens
ccactgctagagatgcatcccc

SEQ ID NO: 9421250 - DNA, 22 bp, Homo sapiens
ccactgctcctgaccaaggtca

SEQ ID NO: 9421251 - DNA, 22 bp, Homo sapiens
aggcattagttgtaaagtattg

SEQ ID NO: 9421252 - DNA, 22 bp, Homo sapiens
aggcattacatctaaatattta

SEQ ID NO: 9421253 - DNA, 22 bp, Homo sapiens
aggcattctagaagtagaagta

SEQ ID NO: 9421254 - DNA, 22 bp, Homo sapiens
aggcattattagatgatgttat

SEQ ID NO: 9421255 - DNA, 22 bp, Homo sapiens
aggcattaatgtaatacagtga

SEQ ID NO: 9421256 - DNA, 22 bp, Homo sapiens
aggcattaagttgataatcata

SEQ ID NO: 9421257 - DNA, 22 bp, Homo sapiens
aggcatttcctatgggcagaga

SEQ ID NO: 9421258 - DNA, 22 bp, Homo sapiens
aggcatttgagtccatgggtga

SEQ ID NO: 9421259 - DNA, 22 bp, Homo sapiens
aggcatttgatgaagattggct

SEQ ID NO: 9421260 - DNA, 22 bp, Homo sapiens
aggcattgtcatgggagcctag

SEQ ID NO: 9421261 - DNA, 22 bp, Homo sapiens
aggcatggcatggggcagatgt

SEQ ID NO: 9421262 - DNA, 22 bp, Homo sapiens
aggcatggcatggggcagatgt

SEQ ID NO: 9421263 - DNA, 22 bp, Homo sapiens
aggcatggcatggggcagatgt

SEQ ID NO: 9421264 - DNA, 22 bp, Homo sapiens
ccactggcttttcctaggtctc

SEQ ID NO: 9421265 - DNA, 22 bp, Homo sapiens
ccactgggcgtttctgtccaat

SEQ ID NO: 9421266 - DNA, 22 bp, Homo sapiens
ccactgggcgtttctgtccaat

SEQ ID NO: 9421267 - DNA, 19 bp, Homo sapiens
ccactggggctccacatta

SEQ ID NO: 9421268 - DNA, 22 bp, Homo sapiens
aggcatctgagtttgcaagctt

SEQ ID NO: 9421269 - DNA, 22 bp, Homo sapiens
aggcatgatgtgcagtggcaaa

SEQ ID NO: 9421270 - DNA, 22 bp, Homo sapiens
aggcatgatgtgcagtggcaaa

SEQ ID NO: 9421271 - DNA, 22 bp, Homo sapiens
aggcatgactttggctgaagaa

SEQ ID NO: 9421272 - DNA, 22 bp, Homo sapiens
aggcatgactttggctgaagaa

SEQ ID NO: 9421273 - DNA, 21 bp, Homo sapiens
aggcatgagccctgcatggac

SEQ ID NO: 9421274 - DNA, 21 bp, Homo sapiens
aggcatgagccctgcatggac

SEQ ID NO: 9421275 - DNA, 22 bp, Homo sapiens
aggcatcaggagtatagccaga

SEQ ID NO: 9421276 - DNA, 22 bp, Homo sapiens
aggcataaccttttatctggat

SEQ ID NO: 9421277 - DNA, 22 bp, Homo sapiens
aggcagtttatccccagagcct

SEQ ID NO: 9421278 - DNA, 22 bp, Homo sapiens
aggcagtttctgggacagcata

SEQ ID NO: 9421279 - DNA, 22 bp, Homo sapiens
aggcagttgttgctgagcagct

SEQ ID NO: 9421280 - DNA, 23 bp, Homo sapiens
aggcagtggtggtaacatgtcaa

SEQ ID NO: 9421281 - DNA, 22 bp, Homo sapiens
aggcagttctcgtgtgtgtccc

SEQ ID NO: 9421282 - DNA, 22 bp, Homo sapiens
aggcagtggctgagaccagggg

SEQ ID NO: 9421283 - DNA, 23 bp, Homo sapiens
aggcagtgggggccactttgctt

SEQ ID NO: 9421284 - DNA, 22 bp, Homo sapiens
aggcagtggcttttgttgtgtt

SEQ ID NO: 9421285 - DNA, 22 bp, Homo sapiens
aggcagtgctcaagacagcagc

SEQ ID NO: 9421286 - DNA, 22 bp, Homo sapiens
aggcagtgcagagtcctcttct

SEQ ID NO: 9421287 - DNA, 22 bp, Homo sapiens
aggcagtgatgagtcatgaata

SEQ ID NO: 9421288 - DNA, 22 bp, Homo sapiens
aggcagtgatgagtcatgaata

SEQ ID NO: 9421289 - DNA, 22 bp, Homo sapiens
aggcagtgatgagtcatgaata

SEQ ID NO: 9421290 - DNA, 22 bp, Homo sapiens
aggcagtgatgagtcatgaata

SEQ ID NO: 9421291 - DNA, 22 bp, Homo sapiens
aggcagtggatgtcaggaatgg

SEQ ID NO: 9421292 - DNA, 22 bp, Homo sapiens
aggcagtggatgtcaggaatgg

SEQ ID NO: 9421293 - DNA, 22 bp, Homo sapiens
aggcagtggctgagaccagggg

SEQ ID NO: 9421294 - DNA, 22 bp, Homo sapiens
aggcagtggctgagaccagggg

SEQ ID NO: 9421295 - DNA, 22 bp, Homo sapiens
aggcagtggatgtcaggaatgg

SEQ ID NO: 9421296 - DNA, 22 bp, Homo sapiens
aggcagtggagctggaataggc

SEQ ID NO: 9421297 - DNA, 22 bp, Homo sapiens
aggcagtggaaggagaaagcaa

SEQ ID NO: 9421298 - DNA, 22 bp, Homo sapiens
aggcagtggaaggagaaagcaa

SEQ ID NO: 9421299 - DNA, 22 bp, Homo sapiens
aggcagtggaaggagaaagcaa

SEQ ID NO: 9421300 - DNA, 22 bp, Homo sapiens
aggcagtggaaggagaaagcaa

SEQ ID NO: 9421301 - DNA, 22 bp, Homo sapiens
aggcagtggagctggaataggc

SEQ ID NO: 9421302 - DNA, 22 bp, Homo sapiens
aggcagtggagctggaataggc

SEQ ID NO: 9421303 - DNA, 23 bp, Homo sapiens
aggcaggtttgggctcttcttgt

SEQ ID NO: 9421304 - DNA, 23 bp, Homo sapiens
aggcaggtttgggctcttcttgt

SEQ ID NO: 9421305 - DNA, 22 bp, Homo sapiens
aggcagcctttagacagtctgc

SEQ ID NO: 9421306 - DNA, 22 bp, Homo sapiens
aggcagcctttagacagtctgc

SEQ ID NO: 9421307 - DNA, 22 bp, Homo sapiens
aggcagcctttagacagtctgc

SEQ ID NO: 9421308 - DNA, 22 bp, Homo sapiens
aggcagcctttttggaaacata

SEQ ID NO: 9421309 - DNA, 22 bp, Homo sapiens
aggcaggttggtgagaagactg

SEQ ID NO: 9421310 - DNA, 22 bp, Homo sapiens
aggcaggttggtgagaagactg

SEQ ID NO: 9421311 - DNA, 22 bp, Homo sapiens
aggcagccctgtgctggatgct

SEQ ID NO: 9421312 - DNA, 22 bp, Homo sapiens
aggcagcccacaggacacagga

SEQ ID NO: 9421313 - DNA, 22 bp, Homo sapiens
aggcagcccacaggacacagga

SEQ ID NO: 9421314 - DNA, 22 bp, Homo sapiens
aggcagcccacaggacacagga

SEQ ID NO: 9421315 - DNA, 22 bp, Homo sapiens
aggcagcctatggggagctcag

SEQ ID NO: 9421316 - DNA, 22 bp, Homo sapiens
aggcagccctgtgctggatgct

SEQ ID NO: 9421317 - DNA, 22 bp, Homo sapiens
aggcagcctggtttgaatggaa

SEQ ID NO: 9421318 - DNA, 22 bp, Homo sapiens
aggcagcctatggggagctcag

SEQ ID NO: 9421319 - DNA, 22 bp, Homo sapiens
aggcagcctatggggagctcag

SEQ ID NO: 9421320 - DNA, 22 bp, Homo sapiens
aggcagccatccaggaggctca

SEQ ID NO: 9421321 - DNA, 22 bp, Homo sapiens
aggcagccatccaggaggctca

SEQ ID NO: 9421322 - DNA, 22 bp, Homo sapiens
aggcagccatctgcaggaagga

SEQ ID NO: 9421323 - DNA, 22 bp, Homo sapiens
aggcagccatctgcaggaagga

SEQ ID NO: 9421324 - DNA, 22 bp, Homo sapiens
aggcagccatctgcaggaagga

SEQ ID NO: 9421325 - DNA, 22 bp, Homo sapiens
aggcagccatctgcaggaagga

SEQ ID NO: 9421326 - DNA, 22 bp, Homo sapiens
aggcagccattaccaagggcat

SEQ ID NO: 9421327 - DNA, 22 bp, Homo sapiens
aggcagcccacaggacacagga

SEQ ID NO: 9421328 - DNA, 22 bp, Homo sapiens
aggccagcaagaaagagagtct

SEQ ID NO: 9421329 - DNA, 22 bp, Homo sapiens
aggccagcaagaaagagagtct

SEQ ID NO: 9421330 - DNA, 22 bp, Homo sapiens
aggccagcctcaggcagggacc

SEQ ID NO: 9421331 - DNA, 22 bp, Homo sapiens
aggccagcctcaggcagggacc

SEQ ID NO: 9421332 - DNA, 22 bp, Homo sapiens
aggccagcctgcccaaagctgc

SEQ ID NO: 9421333 - DNA, 22 bp, Homo sapiens
aggccacaagaaaatgcttcat

SEQ ID NO: 9421334 - DNA, 22 bp, Homo sapiens
aggccacaaccaccctgtgccc

SEQ ID NO: 9421335 - DNA, 22 bp, Homo sapiens
aggccacaagaaaatgcttcat

SEQ ID NO: 9421336 - DNA, 22 bp, Homo sapiens
aggccagatgtcgggctagaag

SEQ ID NO: 9421337 - DNA, 23 bp, Homo sapiens
aggccagcgcagacaccgagcac

SEQ ID NO: 9421338 - DNA, 23 bp, Homo sapiens
aggccagcgcagacaccgagcac

SEQ ID NO: 9421339 - DNA, 23 bp, Homo sapiens
aggccagcgcagacaccgagcac

SEQ ID NO: 9421340 - DNA, 22 bp, Homo sapiens
aggccagcctgcccaaagctgc

SEQ ID NO: 9421341 - DNA, 22 bp, Homo sapiens
aggccagccttgtaaatgcctc

SEQ ID NO: 9421342 - DNA, 22 bp, Homo sapiens
aggccagccttgtaaatgcctc

SEQ ID NO: 9421343 - DNA, 22 bp, Homo sapiens
aggccagcgctgctagctcccg

SEQ ID NO: 9421344 - DNA, 22 bp, Homo sapiens
aggccagcgctgctagctcccg

SEQ ID NO: 9421345 - DNA, 22 bp, Homo sapiens
aggccagcgctgctagctcccg

SEQ ID NO: 9421346 - DNA, 22 bp, Homo sapiens
aggccagcgctgctagctcccg

SEQ ID NO: 9421347 - DNA, 22 bp, Homo sapiens
aggccagctatgactctgctcc

SEQ ID NO: 9421348 - DNA, 22 bp, Homo sapiens
aggccagctatgactctgctcc

SEQ ID NO: 9421349 - DNA, 22 bp, Homo sapiens
aggccagctatgactctgctcc

SEQ ID NO: 9421350 - DNA, 22 bp, Homo sapiens
aggccagctctacccttggact

SEQ ID NO: 9421351 - DNA, 22 bp, Homo sapiens
aggccagctctacccttggact

SEQ ID NO: 9421352 - DNA, 22 bp, Homo sapiens
aggccagctctacccttggact

SEQ ID NO: 9421353 - DNA, 22 bp, Homo sapiens
aggccagctcaccctggctcct

SEQ ID NO: 9421354 - DNA, 22 bp, Homo sapiens
aggccagctcaccctggctcct

SEQ ID NO: 9421355 - DNA, 22 bp, Homo sapiens
aggccagctcaccctggctcct

SEQ ID NO: 9421356 - DNA, 22 bp, Homo sapiens
aggccagctcaccctggctcct

SEQ ID NO: 9421357 - DNA, 22 bp, Homo sapiens
aggccagctgttactagagcca

SEQ ID NO: 9421358 - DNA, 22 bp, Homo sapiens
aggccagctgccacccggtccg

SEQ ID NO: 9421359 - DNA, 22 bp, Homo sapiens
aggccagctgccacccggtccg

SEQ ID NO: 9421360 - DNA, 22 bp, Homo sapiens
aggccagctgccacccggtccg

SEQ ID NO: 9421361 - DNA, 22 bp, Homo sapiens
aggccagctgttactagagcca

SEQ ID NO: 9421362 - DNA, 22 bp, Homo sapiens
aggccagctgttactagagcca

SEQ ID NO: 9421363 - DNA, 22 bp, Homo sapiens
aggccagctgttactagagcca

SEQ ID NO: 9421364 - DNA, 22 bp, Homo sapiens
aggccagctgttactagagcca

SEQ ID NO: 9421365 - DNA, 22 bp, Homo sapiens
aggcattttcactgatgtcatc

SEQ ID NO: 9421366 - DNA, 22 bp, Homo sapiens
aggcattttcactgatgtcatc

SEQ ID NO: 9421367 - DNA, 22 bp, Homo sapiens
aggcatttggctgtcatttgta

SEQ ID NO: 9421368 - DNA, 22 bp, Homo sapiens
aggcattttaagatgctctgca

SEQ ID NO: 9421369 - DNA, 22 bp, Homo sapiens
aggcattttgttcaagatgaca

SEQ ID NO: 9421370 - DNA, 20 bp, Homo sapiens
aggccaaacccagcgcgccc

SEQ ID NO: 9421371 - DNA, 22 bp, Homo sapiens
aggcatttttgttaatctttgg

SEQ ID NO: 9421372 - DNA, 22 bp, Homo sapiens
aggccaaaccggatggaaaagg

SEQ ID NO: 9421373 - DNA, 22 bp, Homo sapiens
aggccaaagcacagagctggaa

SEQ ID NO: 9421374 - DNA, 22 bp, Homo sapiens
aggccaagattttggatcagct

SEQ ID NO: 9421375 - DNA, 22 bp, Homo sapiens
aggccaagattttggatcagct

SEQ ID NO: 9421376 - DNA, 22 bp, Homo sapiens
aggccaagattttggatcagct

SEQ ID NO: 9421377 - DNA, 22 bp, Homo sapiens
aggccaagctcccagagaagct

SEQ ID NO: 9421378 - DNA, 22 bp, Homo sapiens
aggccaagctcccagagaagct

SEQ ID NO: 9421379 - DNA, 22 bp, Homo sapiens
aggccaagctcccagagaagct

SEQ ID NO: 9421380 - DNA, 22 bp, Homo sapiens
aggccacaaccaccctgtgccc

SEQ ID NO: 9421381 - DNA, 22 bp, Homo sapiens
aggccacaaccaccctgtgccc

SEQ ID NO: 9421382 - DNA, 21 bp, Homo sapiens
aggccaagttggatttcttca

SEQ ID NO: 9421383 - DNA, 22 bp, Homo sapiens
aggccaagttacttgggaaagc

SEQ ID NO: 9421384 - DNA, 22 bp, Homo sapiens
aggccaagtgctgggacaggtg

SEQ ID NO: 9421385 - DNA, 22 bp, Homo sapiens
aggccaagttacttgggaaagc

SEQ ID NO: 9421386 - DNA, 22 bp, Homo sapiens
aggccaagtgaacaatgctagt

SEQ ID NO: 9421387 - DNA, 22 bp, Homo sapiens
aggccaagtgctgggacaggtg

SEQ ID NO: 9421388 - DNA, 22 bp, Homo sapiens
aggccaagtgctgggacaggtg

SEQ ID NO: 9421389 - DNA, 22 bp, Homo sapiens
aggccaagtgctgggacaggtg

SEQ ID NO: 9421390 - DNA, 22 bp, Homo sapiens
aggccaagtgctgggacaggtg

SEQ ID NO: 9421391 - DNA, 22 bp, Homo sapiens
aggccaagggcaaagcggagag

SEQ ID NO: 9421392 - DNA, 22 bp, Homo sapiens
aggccaagggcaaagcggagag

SEQ ID NO: 9421393 - DNA, 22 bp, Homo sapiens
aggccaagggcaaagcggagag

SEQ ID NO: 9421394 - DNA, 22 bp, Homo sapiens
aggccaagctcccagagaagct

SEQ ID NO: 9421395 - DNA, 22 bp, Homo sapiens
aggccaagtagctagcattgaa

SEQ ID NO: 9421396 - DNA, 22 bp, Homo sapiens
aggccaagtagctagcattgaa

SEQ ID NO: 9421397 - DNA, 22 bp, Homo sapiens
aggccaagtagccgctgtccta

SEQ ID NO: 9421398 - DNA, 22 bp, Homo sapiens
aggccctaatccaacatgactg

SEQ ID NO: 9421399 - DNA, 22 bp, Homo sapiens
aggccctaatccaacatgactg

SEQ ID NO: 9421400 - DNA, 22 bp, Homo sapiens
aggccctaatccaacatgactg

SEQ ID NO: 9421401 - DNA, 22 bp, Homo sapiens
aggccctattcaatggggccca

SEQ ID NO: 9421402 - DNA, 22 bp, Homo sapiens
aggccctattcaatggggccca

SEQ ID NO: 9421403 - DNA, 22 bp, Homo sapiens
aggccctcacagtctattgtga

SEQ ID NO: 9421404 - DNA, 22 bp, Homo sapiens
aggccctctcattccagaggca

SEQ ID NO: 9421405 - DNA, 22 bp, Homo sapiens
aggccctctcattccagaggca

SEQ ID NO: 9421406 - DNA, 22 bp, Homo sapiens
aggccctgaagtcggcccctca

SEQ ID NO: 9421407 - DNA, 22 bp, Homo sapiens
aggccctggtcaggtctggctg

SEQ ID NO: 9421408 - DNA, 22 bp, Homo sapiens
aggccctggtcaggtctggctg

SEQ ID NO: 9421409 - DNA, 22 bp, Homo sapiens
aggccgaagtggatgggcatct

SEQ ID NO: 9421410 - DNA, 22 bp, Homo sapiens
aggcccgaggttcgtgtgcacc

SEQ ID NO: 9421411 - DNA, 20 bp, Homo sapiens
aggccccaggaaactctcag

SEQ ID NO: 9421412 - DNA, 22 bp, Homo sapiens
aggccccaaagcagtgcaagta

SEQ ID NO: 9421413 - DNA, 22 bp, Homo sapiens
aggcccagtgtggcttcctgga

SEQ ID NO: 9421414 - DNA, 22 bp, Homo sapiens
aggcccagttatcctacttgtt

SEQ ID NO: 9421415 - DNA, 22 bp, Homo sapiens
aggcccagtgtggcttcctgga

SEQ ID NO: 9421416 - DNA, 22 bp, Homo sapiens
aggcccagttatcctacttgtt

SEQ ID NO: 9421417 - DNA, 22 bp, Homo sapiens
aggcccagttatcctacttgtt

SEQ ID NO: 9421418 - DNA, 22 bp, Homo sapiens
aggcccagtcctctgccgtctg

SEQ ID NO: 9421419 - DNA, 22 bp, Homo sapiens
aggcccagtagtgctgccttta

SEQ ID NO: 9421420 - DNA, 22 bp, Homo sapiens
aggcccagtgccattagttttg

SEQ ID NO: 9421421 - DNA, 20 bp, Homo sapiens
aggcccagtgaatatattgc

SEQ ID NO: 9421422 - DNA, 22 bp, Homo sapiens
aggcccagctgggccaggaaca

SEQ ID NO: 9421423 - DNA, 22 bp, Homo sapiens
aggcccagctgggccaggaaca

SEQ ID NO: 9421424 - DNA, 22 bp, Homo sapiens
aggcccagtagtcgacggcgct

SEQ ID NO: 9421425 - DNA, 22 bp, Homo sapiens
aggcccagctgggccaggaaca

SEQ ID NO: 9421426 - DNA, 22 bp, Homo sapiens
aggcccagtagtgctgccttta

SEQ ID NO: 9421427 - DNA, 22 bp, Homo sapiens
aggcccagtagtgctgccttta

SEQ ID NO: 9421428 - DNA, 22 bp, Homo sapiens
aggccaggatagcatggatcag

SEQ ID NO: 9421429 - DNA, 22 bp, Homo sapiens
aggccaggatagcatggatcag

SEQ ID NO: 9421430 - DNA, 22 bp, Homo sapiens
aggccaggatagcatggatcag

SEQ ID NO: 9421431 - DNA, 22 bp, Homo sapiens
aggccagcttccagaggggcag

SEQ ID NO: 9421432 - DNA, 22 bp, Homo sapiens
aggccagcttctaccctctgtt

SEQ ID NO: 9421433 - DNA, 22 bp, Homo sapiens
aggccagcttctaccctctgtt

SEQ ID NO: 9421434 - DNA, 22 bp, Homo sapiens
aggccagcttctaccctctgtt

SEQ ID NO: 9421435 - DNA, 20 bp, Homo sapiens
aggccaggaaatgtagttct

SEQ ID NO: 9421436 - DNA, 20 bp, Homo sapiens
aggccaggaaatgtagttct

SEQ ID NO: 9421437 - DNA, 22 bp, Homo sapiens
aggccaggacacttaagtaaga

SEQ ID NO: 9421438 - DNA, 22 bp, Homo sapiens
aggccaggaatccttgtcccag

SEQ ID NO: 9421439 - DNA, 22 bp, Homo sapiens
aggccaggaccattagcccaga

SEQ ID NO: 9421440 - DNA, 22 bp, Homo sapiens
aggccaggaccattagcccaga

SEQ ID NO: 9421441 - DNA, 22 bp, Homo sapiens
aggccaggaccattagcccaga

SEQ ID NO: 9421442 - DNA, 22 bp, Homo sapiens
aggccaggacacttaagtaaga

SEQ ID NO: 9421443 - DNA, 22 bp, Homo sapiens
aggccaggacacttaagtaaga

SEQ ID NO: 9421444 - DNA, 22 bp, Homo sapiens
aggccaggacacttaagtaaga

SEQ ID NO: 9421445 - DNA, 22 bp, Homo sapiens
aggccaggaatccttgtcccag

SEQ ID NO: 9421446 - DNA, 20 bp, Homo sapiens
aggccaggaaatgtagttct

SEQ ID NO: 9421447 - DNA, 17 bp, Homo sapiens
aggcctccctccaggcc

SEQ ID NO: 9421448 - DNA, 17 bp, Homo sapiens
aggcctccctccaggcc

SEQ ID NO: 9421449 - DNA, 21 bp, Homo sapiens
aggcctccctgttgacagggc

SEQ ID NO: 9421450 - DNA, 22 bp, Homo sapiens
aggcctcctgcagggatgagtg

SEQ ID NO: 9421451 - DNA, 22 bp, Homo sapiens
aggcctccagccacatgccagt

SEQ ID NO: 9421452 - DNA, 22 bp, Homo sapiens
aggcctccagccacatgccagt

SEQ ID NO: 9421453 - DNA, 22 bp, Homo sapiens
aggcctccagccacatgccagt

SEQ ID NO: 9421454 - DNA, 22 bp, Homo sapiens
aggcctccagccacatgccagt

SEQ ID NO: 9421455 - DNA, 22 bp, Homo sapiens
aggcctcatgtcaaagcagcaa

SEQ ID NO: 9421456 - DNA, 22 bp, Homo sapiens
aggcctcattgcccacctgtgg

SEQ ID NO: 9421457 - DNA, 22 bp, Homo sapiens
aggcctcattgcccacctgtgg

SEQ ID NO: 9421458 - DNA, 22 bp, Homo sapiens
aggcctccagccacatgccagt

SEQ ID NO: 9421459 - DNA, 22 bp, Homo sapiens
aggcctcagtttgtcatctgta

SEQ ID NO: 9421460 - DNA, 22 bp, Homo sapiens
aggcctcatagtagacctgccc

SEQ ID NO: 9421461 - DNA, 22 bp, Homo sapiens
aggcctcacacaacagatgcat

SEQ ID NO: 9421462 - DNA, 22 bp, Homo sapiens
aggccgtgtgagcatgtgtgag

SEQ ID NO: 9421463 - DNA, 22 bp, Homo sapiens
aggcctagaggaatggccaggg

SEQ ID NO: 9421464 - DNA, 22 bp, Homo sapiens
aggcctcacattgggcttcaag

SEQ ID NO: 9421465 - DNA, 17 bp, Homo sapiens
aggcctcaggtgaaacc

SEQ ID NO: 9421466 - DNA, 22 bp, Homo sapiens
aggcctcagctcagtgtgacag

SEQ ID NO: 9421467 - DNA, 22 bp, Homo sapiens
aggcctcagctcagtgtgacag

SEQ ID NO: 9421468 - DNA, 22 bp, Homo sapiens
aggcctcagttcttgccaggtg

SEQ ID NO: 9421469 - DNA, 22 bp, Homo sapiens
aggcctcagttcttgccaggtg

SEQ ID NO: 9421470 - DNA, 22 bp, Homo sapiens
aggcctcagttcttgccaggtg

SEQ ID NO: 9421471 - DNA, 22 bp, Homo sapiens
aggcctcagtttccccagttgt

SEQ ID NO: 9421472 - DNA, 22 bp, Homo sapiens
ccaggcagggagctgtttggcc

SEQ ID NO: 9421473 - DNA, 22 bp, Homo sapiens
ccaggcagggctcaaggaacct

SEQ ID NO: 9421474 - DNA, 23 bp, Homo sapiens
ccaggcagtagctattgaagtga

SEQ ID NO: 9421475 - DNA, 22 bp, Homo sapiens
aggcctcctggctccaggcctt

SEQ ID NO: 9421476 - DNA, 22 bp, Homo sapiens
aggcctcctggctccaggcctt

SEQ ID NO: 9421477 - DNA, 22 bp, Homo sapiens
aggcctcctgcagggatgagtg

SEQ ID NO: 9421478 - DNA, 22 bp, Homo sapiens
aggcctcctgcagggatgagtg

SEQ ID NO: 9421479 - DNA, 22 bp, Homo sapiens
aggcctctgagcagcactcatg

SEQ ID NO: 9421480 - DNA, 22 bp, Homo sapiens
aggcctctgagcagcactcatg

SEQ ID NO: 9421481 - DNA, 22 bp, Homo sapiens
ccaggcacttcatcattagggt

SEQ ID NO: 9421482 - DNA, 22 bp, Homo sapiens
ccaggcacttcatcattagggt

SEQ ID NO: 9421483 - DNA, 22 bp, Homo sapiens
ccaggccaaattcagtcagcag

SEQ ID NO: 9421484 - DNA, 22 bp, Homo sapiens
ccaggccaaattcagtcagcag

SEQ ID NO: 9421485 - DNA, 22 bp, Homo sapiens
ccaggccaaattcagtcagcag

SEQ ID NO: 9421486 - DNA, 22 bp, Homo sapiens
ccaggccaaattcagtcagcag

SEQ ID NO: 9421487 - DNA, 22 bp, Homo sapiens
ccaggccaaattcagtcagcag

SEQ ID NO: 9421488 - DNA, 22 bp, Homo sapiens
ccaggcattgtgagtgggcagg

SEQ ID NO: 9421489 - DNA, 22 bp, Homo sapiens
ccaggcatggggagagccagat

SEQ ID NO: 9421490 - DNA, 22 bp, Homo sapiens
ccaggcatggggagagccagat

SEQ ID NO: 9421491 - DNA, 22 bp, Homo sapiens
ccaggcagtggaagctaaaatt

SEQ ID NO: 9421492 - DNA, 21 bp, Homo sapiens
ccaggcatgactgcagagagc

SEQ ID NO: 9421493 - DNA, 22 bp, Homo sapiens
ccaggctctgcaaaatcaggct

SEQ ID NO: 9421494 - DNA, 22 bp, Homo sapiens
ccaggctctgccaggcccttga

SEQ ID NO: 9421495 - DNA, 22 bp, Homo sapiens
ccaggctctgccaggcccttga

SEQ ID NO: 9421496 - DNA, 22 bp, Homo sapiens
ccaggctctgcgctggacatgg

SEQ ID NO: 9421497 - DNA, 22 bp, Homo sapiens
ccaggctctgcgctggacatgg

SEQ ID NO: 9421498 - DNA, 22 bp, Homo sapiens
aggctccttgctcacaggctca

SEQ ID NO: 9421499 - DNA, 22 bp, Homo sapiens
ccaggctctgacatagatggga

SEQ ID NO: 9421500 - DNA, 22 bp, Homo sapiens
ccaggctctgagaggaatgtga

SEQ ID NO: 9421501 - DNA, 22 bp, Homo sapiens
ccaggctctgacatagatggga

SEQ ID NO: 9421502 - DNA, 22 bp, Homo sapiens
ccaggctctgagcctcactctt

SEQ ID NO: 9421503 - DNA, 22 bp, Homo sapiens
ccaggctctgagaggaatgtga

SEQ ID NO: 9421504 - DNA, 22 bp, Homo sapiens
ccaggctctgagaggaatgtga

SEQ ID NO: 9421505 - DNA, 22 bp, Homo sapiens
ccaggctctgcaaaatcaggct

SEQ ID NO: 9421506 - DNA, 22 bp, Homo sapiens
ccaggctctgagcctcactctt

SEQ ID NO: 9421507 - DNA, 22 bp, Homo sapiens
ccaggctctgagcctcactctt

SEQ ID NO: 9421508 - DNA, 22 bp, Homo sapiens
aggctccattttcctgcagctg

SEQ ID NO: 9421509 - DNA, 22 bp, Homo sapiens
aggctccattttcctgcagctg

SEQ ID NO: 9421510 - DNA, 22 bp, Homo sapiens
aggctcccaagcactgacccca

SEQ ID NO: 9421511 - DNA, 22 bp, Homo sapiens
aggctcccaagcactgacccca

SEQ ID NO: 9421512 - DNA, 22 bp, Homo sapiens
aggctccattccaggagctaga

SEQ ID NO: 9421513 - DNA, 22 bp, Homo sapiens
aggctccattcatgtgaaggca

SEQ ID NO: 9421514 - DNA, 22 bp, Homo sapiens
aggctccattccaggagctaga

SEQ ID NO: 9421515 - DNA, 21 bp, Homo sapiens
ccaggctcctgaggctggtca

SEQ ID NO: 9421516 - DNA, 21 bp, Homo sapiens
ccaggctcctgaggctggtca

SEQ ID NO: 9421517 - DNA, 22 bp, Homo sapiens
aggctcccatggtgtggcagga

SEQ ID NO: 9421518 - DNA, 22 bp, Homo sapiens
aggctcccatggtgtggcagga

SEQ ID NO: 9421519 - DNA, 22 bp, Homo sapiens
aggctcccatggtgtggcagga

SEQ ID NO: 9421520 - DNA, 21 bp, Homo sapiens
aggctcccagaaatgggcatc

SEQ ID NO: 9421521 - DNA, 21 bp, Homo sapiens
aggctcccagaaatgggcatc

SEQ ID NO: 9421522 - DNA, 21 bp, Homo sapiens
aggctcccagaaatgggcatc

SEQ ID NO: 9421523 - DNA, 21 bp, Homo sapiens
ccaggctcctgaggctggtca

SEQ ID NO: 9421524 - DNA, 22 bp, Homo sapiens
ccaggctctatccctccttctt

SEQ ID NO: 9421525 - DNA, 22 bp, Homo sapiens
ccaggcctagcccctgagggta

SEQ ID NO: 9421526 - DNA, 22 bp, Homo sapiens
ccaggcctagcccctgagggta

SEQ ID NO: 9421527 - DNA, 22 bp, Homo sapiens
ccaggcccttgcaagtcccacc

SEQ ID NO: 9421528 - DNA, 22 bp, Homo sapiens
ccaggcccttgcaagtcccacc

SEQ ID NO: 9421529 - DNA, 22 bp, Homo sapiens
ccaggcccttgcaagtcccacc

SEQ ID NO: 9421530 - DNA, 22 bp, Homo sapiens
ccaggccctgctcctcacacca

SEQ ID NO: 9421531 - DNA, 22 bp, Homo sapiens
ccaggccctgctcctcacacca

SEQ ID NO: 9421532 - DNA, 22 bp, Homo sapiens
ccaggcccgttcccttctccag

SEQ ID NO: 9421533 - DNA, 22 bp, Homo sapiens
ccaggcccgttcccttctccag

SEQ ID NO: 9421534 - DNA, 22 bp, Homo sapiens
ccaggcccgttcccttctccag

SEQ ID NO: 9421535 - DNA, 22 bp, Homo sapiens
ccaggccctgcctgtggttcct

SEQ ID NO: 9421536 - DNA, 22 bp, Homo sapiens
ccaggccctgcctgtggttcct

SEQ ID NO: 9421537 - DNA, 22 bp, Homo sapiens
ccaggccctgctcctcacacca

SEQ ID NO: 9421538 - DNA, 22 bp, Homo sapiens
ccaggccctgctcctcacacca

SEQ ID NO: 9421539 - DNA, 22 bp, Homo sapiens
ccaggcctcacctgcccaccta

SEQ ID NO: 9421540 - DNA, 22 bp, Homo sapiens
ccaggcctagcccctgagggta

SEQ ID NO: 9421541 - DNA, 22 bp, Homo sapiens
aggctccacggcaggatgctgt

SEQ ID NO: 9421542 - DNA, 22 bp, Homo sapiens
aggctccacggcaggatgctgt

SEQ ID NO: 9421543 - DNA, 22 bp, Homo sapiens
aggctccataccatctccggag

SEQ ID NO: 9421544 - DNA, 22 bp, Homo sapiens
aggctccataccatctccggag

SEQ ID NO: 9421545 - DNA, 22 bp, Homo sapiens
aggctccatgcaaaggctgttt

SEQ ID NO: 9421546 - DNA, 22 bp, Homo sapiens
aggctccatgcaaaggctgttt

SEQ ID NO: 9421547 - DNA, 22 bp, Homo sapiens
aggctccattcatgtgaaggca

SEQ ID NO: 9421548 - DNA, 20 bp, Homo sapiens
aggctctgccattgtccctg

SEQ ID NO: 9421549 - DNA, 20 bp, Homo sapiens
aggctctgcatttctgagtg

SEQ ID NO: 9421550 - DNA, 20 bp, Homo sapiens
aggctctgcatttctgagtg

SEQ ID NO: 9421551 - DNA, 20 bp, Homo sapiens
aggctctgcatttctgagtg

SEQ ID NO: 9421552 - DNA, 22 bp, Homo sapiens
aggctctgccaattccttcctc

SEQ ID NO: 9421553 - DNA, 22 bp, Homo sapiens
aggctctgccaattccttcctc

SEQ ID NO: 9421554 - DNA, 22 bp, Homo sapiens
aggctctgttattctagagggc

SEQ ID NO: 9421555 - DNA, 22 bp, Homo sapiens
aggctctgttattctagagggc

SEQ ID NO: 9421556 - DNA, 22 bp, Homo sapiens
aggctctgttattctagagggc

SEQ ID NO: 9421557 - DNA, 22 bp, Homo sapiens
aggctgagagcaacgtgtcaga

SEQ ID NO: 9421558 - DNA, 22 bp, Homo sapiens
aggctgagactgtgcattagtg

SEQ ID NO: 9421559 - DNA, 22 bp, Homo sapiens
aggctgagataggtggatcatt

SEQ ID NO: 9421560 - DNA, 22 bp, Homo sapiens
aggctgagcaaagggccttacc

SEQ ID NO: 9421561 - DNA, 22 bp, Homo sapiens
aggctgagataggtggatcatt

SEQ ID NO: 9421562 - DNA, 22 bp, Homo sapiens
aggctgagataggtggatcatt

SEQ ID NO: 9421563 - DNA, 22 bp, Homo sapiens
aggctgagataggtggatcatt

SEQ ID NO: 9421564 - DNA, 22 bp, Homo sapiens
aggctgagataggtggatcatt

SEQ ID NO: 9421565 - DNA, 22 bp, Homo sapiens
aggctgagagcaacgtgtcaga

SEQ ID NO: 9421566 - DNA, 22 bp, Homo sapiens
aggctgagcctgggcgtggtgg

SEQ ID NO: 9421567 - DNA, 22 bp, Homo sapiens
aggctgagccacggggctggct

SEQ ID NO: 9421568 - DNA, 22 bp, Homo sapiens
aggctgagccacggggctggct

SEQ ID NO: 9421569 - DNA, 22 bp, Homo sapiens
aggctgagccacggggctggct

SEQ ID NO: 9421570 - DNA, 22 bp, Homo sapiens
aggctgagccacggggctggct

SEQ ID NO: 9421571 - DNA, 22 bp, Homo sapiens
aggctgagcaaagggccttacc

SEQ ID NO: 9421572 - DNA, 22 bp, Homo sapiens
aggctgagcaaagggccttacc

SEQ ID NO: 9421573 - DNA, 22 bp, Homo sapiens
aggctgagcaaagggccttacc

SEQ ID NO: 9421574 - DNA, 22 bp, Homo sapiens
aggctgagcaaagggccttacc

SEQ ID NO: 9421575 - DNA, 22 bp, Homo sapiens
aggctgagccacggggctggct

SEQ ID NO: 9421576 - DNA, 22 bp, Homo sapiens
aggctctgcagaccccagctgt

SEQ ID NO: 9421577 - DNA, 20 bp, Homo sapiens
aggctctgcatttctgagtg

SEQ ID NO: 9421578 - DNA, 22 bp, Homo sapiens
aggctctgcagtgctggaggac

SEQ ID NO: 9421579 - DNA, 22 bp, Homo sapiens
aggctctgcagtgctggaggac

SEQ ID NO: 9421580 - DNA, 22 bp, Homo sapiens
aggctctgcagtgctggaggac

SEQ ID NO: 9421581 - DNA, 22 bp, Homo sapiens
aggctctgcatccaggctttat

SEQ ID NO: 9421582 - DNA, 22 bp, Homo sapiens
aggctctgagtagagctgccag

SEQ ID NO: 9421583 - DNA, 22 bp, Homo sapiens
aggctctgagtagagctgccag

SEQ ID NO: 9421584 - DNA, 22 bp, Homo sapiens
aggctctgaggcagattttcgt

SEQ ID NO: 9421585 - DNA, 22 bp, Homo sapiens
aggctctgaggcagattttcgt

SEQ ID NO: 9421586 - DNA, 19 bp, Homo sapiens
aggctctgagctcctggag

SEQ ID NO: 9421587 - DNA, 22 bp, Homo sapiens
aggctccttgctcacaggctca

SEQ ID NO: 9421588 - DNA, 19 bp, Homo sapiens
aggctctgagctcctggag

SEQ ID NO: 9421589 - DNA, 19 bp, Homo sapiens
aggctctgagctcctggag

SEQ ID NO: 9421590 - DNA, 22 bp, Homo sapiens
aggctctgagtctggtgtctgc

SEQ ID NO: 9421591 - DNA, 22 bp, Homo sapiens
aggctctgatcaggtggctgtg

SEQ ID NO: 9421592 - DNA, 22 bp, Homo sapiens
aggctctgatcaggtggctgtg

SEQ ID NO: 9421593 - DNA, 22 bp, Homo sapiens
aggctgagcggggtcccagagc

SEQ ID NO: 9421594 - DNA, 23 bp, Homo sapiens
aggctgagctctcccagcttcag

SEQ ID NO: 9421595 - DNA, 23 bp, Homo sapiens
aggctgagctctcccagcttcag

SEQ ID NO: 9421596 - DNA, 22 bp, Homo sapiens
ccagtcactctgtgagagctac

SEQ ID NO: 9421597 - DNA, 22 bp, Homo sapiens
ccagtcactctgtgagagctac

SEQ ID NO: 9421598 - DNA, 22 bp, Homo sapiens
aggctgagctgacctggtttgg

SEQ ID NO: 9421599 - DNA, 23 bp, Homo sapiens
aggctgagctctcccagcttcag

SEQ ID NO: 9421600 - DNA, 23 bp, Homo sapiens
ccagtgattgcctggaaggaggt

SEQ ID NO: 9421601 - DNA, 22 bp, Homo sapiens
ccagtgcacagccaggcaggtg

SEQ ID NO: 9421602 - DNA, 22 bp, Homo sapiens
ccagtgcacaatggaacaactc

SEQ ID NO: 9421603 - DNA, 19 bp, Homo sapiens
ccagtgcaaggtaagatag

SEQ ID NO: 9421604 - DNA, 22 bp, Homo sapiens
ccagtgcacagccaggcaggtg

SEQ ID NO: 9421605 - DNA, 22 bp, Homo sapiens
ccagtgcacagccaggcaggtg

SEQ ID NO: 9421606 - DNA, 22 bp, Homo sapiens
ccagtgatggtgatcagatgtt

SEQ ID NO: 9421607 - DNA, 22 bp, Homo sapiens
ccagtgatgataggaagaccct

SEQ ID NO: 9421608 - DNA, 22 bp, Homo sapiens
ccagtgagatatctgggcatta

SEQ ID NO: 9421609 - DNA, 22 bp, Homo sapiens
ccagtgagaatgaagataaggc

SEQ ID NO: 9421610 - DNA, 22 bp, Homo sapiens
ccagtctgtgtgccagcctgcg

SEQ ID NO: 9421611 - DNA, 22 bp, Homo sapiens
ccagtctgtgtgccagcctgcg

SEQ ID NO: 9421612 - DNA, 22 bp, Homo sapiens
ccagtctgttctcacctctgag

SEQ ID NO: 9421613 - DNA, 22 bp, Homo sapiens
ccagtctgttctcacctctgag

SEQ ID NO: 9421614 - DNA, 22 bp, Homo sapiens
aggctgaggcaggtggatcatt

SEQ ID NO: 9421615 - DNA, 22 bp, Homo sapiens
aggctgaggcaggtggatcatt

SEQ ID NO: 9421616 - DNA, 22 bp, Homo sapiens
aggctgaggcaggtggatcact

SEQ ID NO: 9421617 - DNA, 22 bp, Homo sapiens
aggctgaggcaggtggatcatt

SEQ ID NO: 9421618 - DNA, 22 bp, Homo sapiens
aggctgaggcgggaggatcact

SEQ ID NO: 9421619 - DNA, 22 bp, Homo sapiens
aggctgaggcaggtggatcatt

SEQ ID NO: 9421620 - DNA, 22 bp, Homo sapiens
aggctgaggcgggaggatcact

SEQ ID NO: 9421621 - DNA, 22 bp, Homo sapiens
aggctgaggcgggaggatcact

SEQ ID NO: 9421622 - DNA, 22 bp, Homo sapiens
aggctgaggcaggtggatcatt

SEQ ID NO: 9421623 - DNA, 22 bp, Homo sapiens
aggctgaggcaggtggatcact

SEQ ID NO: 9421624 - DNA, 22 bp, Homo sapiens
aggctgaggcaggtggatcact

SEQ ID NO: 9421625 - DNA, 22 bp, Homo sapiens
ccagtgcaccaagaggcctaga

SEQ ID NO: 9421626 - DNA, 22 bp, Homo sapiens
aggctgaggcaggtggatcact

SEQ ID NO: 9421627 - DNA, 22 bp, Homo sapiens
aggctgaggcaggtggatcact

SEQ ID NO: 9421628 - DNA, 22 bp, Homo sapiens
ccagtgcaccatttccctctgt

SEQ ID NO: 9421629 - DNA, 22 bp, Homo sapiens
ccagtgcaccaagaggcctaga

SEQ ID NO: 9421630 - DNA, 22 bp, Homo sapiens
ccagtgcaccaagaggcctaga

SEQ ID NO: 9421631 - DNA, 22 bp, Homo sapiens
ccagttctttctgtgtgcaaca

SEQ ID NO: 9421632 - DNA, 22 bp, Homo sapiens
ccagttctaaacataaagctaa

SEQ ID NO: 9421633 - DNA, 23 bp, Homo sapiens
ccagttctcctttgaacagtgac

SEQ ID NO: 9421634 - DNA, 22 bp, Homo sapiens
ccagttctgagatgaatatcca

SEQ ID NO: 9421635 - DNA, 22 bp, Homo sapiens
ccagtttaggacacatgcccac

SEQ ID NO: 9421636 - DNA, 22 bp, Homo sapiens
ccagtttaggtactaggctcta

SEQ ID NO: 9421637 - DNA, 20 bp, Homo sapiens
ccagtttctttcccagcctc

SEQ ID NO: 9421638 - DNA, 22 bp, Homo sapiens
ccagtttcttaagtaggaagaa

SEQ ID NO: 9421639 - DNA, 22 bp, Homo sapiens
ccagtttcttaagtaggaagaa

SEQ ID NO: 9421640 - DNA, 23 bp, Homo sapiens
ccagtttatctttagtgtagatc

SEQ ID NO: 9421641 - DNA, 22 bp, Homo sapiens
aggctgaggcgggaggatcact

SEQ ID NO: 9421642 - DNA, 22 bp, Homo sapiens
aggctgaggcgggaggatcact

SEQ ID NO: 9421643 - DNA, 22 bp, Homo sapiens
aggctgaggcgggaggatcact

SEQ ID NO: 9421644 - DNA, 22 bp, Homo sapiens
ccagtgtgcaatctctggctta

SEQ ID NO: 9421645 - DNA, 22 bp, Homo sapiens
aggctgaggcgggaggatcact

SEQ ID NO: 9421646 - DNA, 22 bp, Homo sapiens
ccagtgtgcattatcatgtgtc

SEQ ID NO: 9421647 - DNA, 22 bp, Homo sapiens
ccagttatccagcatgctgtct

SEQ ID NO: 9421648 - DNA, 22 bp, Homo sapiens
ccagttccagtgctcacatcca

SEQ ID NO: 9421649 - DNA, 22 bp, Homo sapiens
ccagtgtgcattatcatgtgtc

SEQ ID NO: 9421650 - DNA, 22 bp, Homo sapiens
ccagttacaagtgattcttggt

SEQ ID NO: 9421651 - DNA, 22 bp, Homo sapiens
tcagaaatgatcgttattcatt

SEQ ID NO: 9421652 - DNA, 22 bp, Homo sapiens
tcagaaatgatcgttattcatt

SEQ ID NO: 9421653 - DNA, 22 bp, Homo sapiens
tcagaaatgtaagctgatgact

SEQ ID NO: 9421654 - DNA, 22 bp, Homo sapiens
tcagaaatgatcgttattcatt

SEQ ID NO: 9421655 - DNA, 22 bp, Homo sapiens
tcagaaatagtctttaaaatga

SEQ ID NO: 9421656 - DNA, 22 bp, Homo sapiens
tcagaaatagtctttaaaatga

SEQ ID NO: 9421657 - DNA, 22 bp, Homo sapiens
tcagaaatcttgtcaaggcatc

SEQ ID NO: 9421658 - DNA, 22 bp, Homo sapiens
tcagaaatagtctttaaaatga

SEQ ID NO: 9421659 - DNA, 22 bp, Homo sapiens
tcagaaataatgaatgatgggg

SEQ ID NO: 9421660 - DNA, 22 bp, Homo sapiens
tcagaaatacaaaacacttact

SEQ ID NO: 9421661 - DNA, 22 bp, Homo sapiens
tcagaaagtgaactgttgacat

SEQ ID NO: 9421662 - DNA, 22 bp, Homo sapiens
tcagaaagtgaactgttgacat

SEQ ID NO: 9421663 - DNA, 22 bp, Homo sapiens
tcagaaagtgaactgttgacat

SEQ ID NO: 9421664 - DNA, 22 bp, Homo sapiens
tcagaaatagctctaagctcct

SEQ ID NO: 9421665 - DNA, 22 bp, Homo sapiens
tcagaaatagctctaagctcct

SEQ ID NO: 9421666 - DNA, 22 bp, Homo sapiens
tcagaaatagctctaagctcct

SEQ ID NO: 9421667 - DNA, 22 bp, Homo sapiens
tcagaaatagtctttaaaatga

SEQ ID NO: 9421668 - DNA, 22 bp, Homo sapiens
tcagaaatactatcagcttttg

SEQ ID NO: 9421669 - DNA, 22 bp, Homo sapiens
tcagaaatactatcagcttttg

SEQ ID NO: 9421670 - DNA, 22 bp, Homo sapiens
tcagaaatactatcagcttttg

SEQ ID NO: 9421671 - DNA, 22 bp, Homo sapiens
tcagaacaattcctttataaca

SEQ ID NO: 9421672 - DNA, 22 bp, Homo sapiens
tcagaagctaaatttgatattt

SEQ ID NO: 9421673 - DNA, 22 bp, Homo sapiens
tcagaagctaaatttgatattt

SEQ ID NO: 9421674 - DNA, 21 bp, Homo sapiens
tcagaacaattccatgcctcc

SEQ ID NO: 9421675 - DNA, 21 bp, Homo sapiens
tcagaacaattccatgcctcc

SEQ ID NO: 9421676 - DNA, 22 bp, Homo sapiens
tcagaaatttaggctggacttg

SEQ ID NO: 9421677 - DNA, 23 bp, Homo sapiens
tcagaacaatgccttaggggcat

SEQ ID NO: 9421678 - DNA, 22 bp, Homo sapiens
tcagaaattttctcagtagttc

SEQ ID NO: 9421679 - DNA, 22 bp, Homo sapiens
tcagaaattttctcagtagttc

SEQ ID NO: 9421680 - DNA, 22 bp, Homo sapiens
tcagaaggatgtgcaggtggca

SEQ ID NO: 9421681 - DNA, 22 bp, Homo sapiens
tcagaaggatgtgcaggtggca

SEQ ID NO: 9421682 - DNA, 19 bp, Homo sapiens
tcagaaggcaggagaggcc

SEQ ID NO: 9421683 - DNA, 22 bp, Homo sapiens
tcagaaggaagaagtcatggga

SEQ ID NO: 9421684 - DNA, 22 bp, Homo sapiens
tcagaaggaaacgatgccagct

SEQ ID NO: 9421685 - DNA, 22 bp, Homo sapiens
tcactccatagcttaactcttt

SEQ ID NO: 9421686 - DNA, 22 bp, Homo sapiens
tcactccatagcttaactcttt

SEQ ID NO: 9421687 - DNA, 22 bp, Homo sapiens
tcactccaaaccccaggcttgt

SEQ ID NO: 9421688 - DNA, 22 bp, Homo sapiens
tcactcatattatctctccaca

SEQ ID NO: 9421689 - DNA, 22 bp, Homo sapiens
tcactcaggttcatgtctttgt

SEQ ID NO: 9421690 - DNA, 22 bp, Homo sapiens
tcactcagtttttggcctctgc

SEQ ID NO: 9421691 - DNA, 22 bp, Homo sapiens
tcactcagctagcttcaggagc

SEQ ID NO: 9421692 - DNA, 22 bp, Homo sapiens
tcactcaggctggagtgcagtg

SEQ ID NO: 9421693 - DNA, 22 bp, Homo sapiens
tcactcaggctggagtgcagtg

SEQ ID NO: 9421694 - DNA, 22 bp, Homo sapiens
tcactcctcaggctagcatcat

SEQ ID NO: 9421695 - DNA, 22 bp, Homo sapiens
tcactcctcaggctagcatcat

SEQ ID NO: 9421696 - DNA, 22 bp, Homo sapiens
tcactccatctttgctactggt

SEQ ID NO: 9421697 - DNA, 22 bp, Homo sapiens
tcactccatctttgctactggt

SEQ ID NO: 9421698 - DNA, 22 bp, Homo sapiens
tcactccatctttgctactggt

SEQ ID NO: 9421699 - DNA, 22 bp, Homo sapiens
tcacttcccagacggggtggca

SEQ ID NO: 9421700 - DNA, 22 bp, Homo sapiens
tcacttcgtaaacccctcccat

SEQ ID NO: 9421701 - DNA, 22 bp, Homo sapiens
tcagaaaggttgagtcatgtgc

SEQ ID NO: 9421702 - DNA, 22 bp, Homo sapiens
tcagaaaggttgagtcatgtgc

SEQ ID NO: 9421703 - DNA, 22 bp, Homo sapiens
tcacccagacttgtgaatgtgt

SEQ ID NO: 9421704 - DNA, 22 bp, Homo sapiens
tcacccagacttgtgaatgtgt

SEQ ID NO: 9421705 - DNA, 22 bp, Homo sapiens
tcacccagatagtgagcatagt

SEQ ID NO: 9421706 - DNA, 22 bp, Homo sapiens
tcacccagatagtgagcatagt

SEQ ID NO: 9421707 - DNA, 22 bp, Homo sapiens
tcacccagattacatcctgtca

SEQ ID NO: 9421708 - DNA, 22 bp, Homo sapiens
tcacccagattacatcctgtca

SEQ ID NO: 9421709 - DNA, 22 bp, Homo sapiens
tcacccagattacatcctgtca

SEQ ID NO: 9421710 - DNA, 22 bp, Homo sapiens
tcacccagacagcttgcactga

SEQ ID NO: 9421711 - DNA, 22 bp, Homo sapiens
tcacccagacagcttgcactga

SEQ ID NO: 9421712 - DNA, 22 bp, Homo sapiens
tcacccagaaaagacagcagat

SEQ ID NO: 9421713 - DNA, 22 bp, Homo sapiens
tcacccagactgtctgactctt

SEQ ID NO: 9421714 - DNA, 22 bp, Homo sapiens
tcacccagactgtctgactctt

SEQ ID NO: 9421715 - DNA, 22 bp, Homo sapiens
tcacccagactgtctgactctt

SEQ ID NO: 9421716 - DNA, 22 bp, Homo sapiens
tcacccagacagcttgcactga

SEQ ID NO: 9421717 - DNA, 22 bp, Homo sapiens
tcactataatatgtcaaaatac

SEQ ID NO: 9421718 - DNA, 22 bp, Homo sapiens
tcacccagcagctgcttctgct

SEQ ID NO: 9421719 - DNA, 22 bp, Homo sapiens
tcacccagcagctgcttctgct

SEQ ID NO: 9421720 - DNA, 22 bp, Homo sapiens
tcactcagagatagcctcattt

SEQ ID NO: 9421721 - DNA, 22 bp, Homo sapiens
cagtgctggtgtaggctgacca

SEQ ID NO: 9421722 - DNA, 22 bp, Homo sapiens
cagtgctgggcagaggagagcg

SEQ ID NO: 9421723 - DNA, 22 bp, Homo sapiens
cagtgctggctgttaggacagt

SEQ ID NO: 9421724 - DNA, 22 bp, Homo sapiens
cagtgctgggcagaggagagcg

SEQ ID NO: 9421725 - DNA, 22 bp, Homo sapiens
cagtgctgggcagaggagagcg

SEQ ID NO: 9421726 - DNA, 22 bp, Homo sapiens
cagtgctggctgttaggacagt

SEQ ID NO: 9421727 - DNA, 22 bp, Homo sapiens
cagtgctggctgttaggacagt

SEQ ID NO: 9421728 - DNA, 22 bp, Homo sapiens
cagtgctggaggggtgcttgca

SEQ ID NO: 9421729 - DNA, 22 bp, Homo sapiens
cagtgctgctctctgtaagaga

SEQ ID NO: 9421730 - DNA, 22 bp, Homo sapiens
cagtgctgctctctgtaagaga

SEQ ID NO: 9421731 - DNA, 22 bp, Homo sapiens
cagtgctgctctctgtaagaga

SEQ ID NO: 9421732 - DNA, 22 bp, Homo sapiens
cagtgctgctctctgtaagaga

SEQ ID NO: 9421733 - DNA, 22 bp, Homo sapiens
cagtgctgccaaagggaccttg

SEQ ID NO: 9421734 - DNA, 22 bp, Homo sapiens
cagtgctgccaaagggaccttg

SEQ ID NO: 9421735 - DNA, 22 bp, Homo sapiens
cagtgctgccaaagggaccttg

SEQ ID NO: 9421736 - DNA, 22 bp, Homo sapiens
cagtgctgagagcctggccagg

SEQ ID NO: 9421737 - DNA, 22 bp, Homo sapiens
cagtgctcctgatgtacccttg

SEQ ID NO: 9421738 - DNA, 22 bp, Homo sapiens
cagtgctgacagggaggaacct

SEQ ID NO: 9421739 - DNA, 22 bp, Homo sapiens
cagtgctgacagggaggaacct

SEQ ID NO: 9421740 - DNA, 22 bp, Homo sapiens
cagtgcccaagatgtgccatgc

SEQ ID NO: 9421741 - DNA, 22 bp, Homo sapiens
cagtgcagaggccagggaggat

SEQ ID NO: 9421742 - DNA, 22 bp, Homo sapiens
cagtgcagaggccagggaggat

SEQ ID NO: 9421743 - DNA, 22 bp, Homo sapiens
cagtgctgtgctggaagctgtt

SEQ ID NO: 9421744 - DNA, 22 bp, Homo sapiens
cagtgctgtgtttgctgcctgg

SEQ ID NO: 9421745 - DNA, 22 bp, Homo sapiens
cagtgctgtgctggaagctgtt

SEQ ID NO: 9421746 - DNA, 23 bp, Homo sapiens
cagtgctggttctgcctgtgggg

SEQ ID NO: 9421747 - DNA, 19 bp, Homo sapiens
cagtgctgttcattcagtg

SEQ ID NO: 9421748 - DNA, 22 bp, Homo sapiens
cagtgctgttgtaagctcattg

SEQ ID NO: 9421749 - DNA, 18 bp, Homo sapiens
cagtgctgttaacagtga

SEQ ID NO: 9421750 - DNA, 22 bp, Homo sapiens
cagtgctgttaataaacacaaa

SEQ ID NO: 9421751 - DNA, 19 bp, Homo sapiens
cagtgctgttcattcagtg

SEQ ID NO: 9421752 - DNA, 22 bp, Homo sapiens
cagtgctgttaataaacacaaa

SEQ ID NO: 9421753 - DNA, 22 bp, Homo sapiens
tcaccaggctggagtgcagtgg

SEQ ID NO: 9421754 - DNA, 22 bp, Homo sapiens
tcaccaggctcctgttaagatg

SEQ ID NO: 9421755 - DNA, 22 bp, Homo sapiens
tcaccaggctggaatgcagtgg

SEQ ID NO: 9421756 - DNA, 22 bp, Homo sapiens
cagtgctgttgtaagctcattg

SEQ ID NO: 9421757 - DNA, 22 bp, Homo sapiens
tcacattctttatttgccatcc

SEQ ID NO: 9421758 - DNA, 22 bp, Homo sapiens
tcacccagaaaagacagcagat

SEQ ID NO: 9421759 - DNA, 22 bp, Homo sapiens
tcaccagggagcttgtcctctg

SEQ ID NO: 9421760 - DNA, 22 bp, Homo sapiens
tcaccagggctccagccagcct

SEQ ID NO: 9421761 - DNA, 22 bp, Homo sapiens
tcaccagggagcttgtcctctg

SEQ ID NO: 9421762 - DNA, 22 bp, Homo sapiens
tattggaccacagactttaagg

SEQ ID NO: 9421763 - DNA, 22 bp, Homo sapiens
tattggaagtgaacaccaggct

SEQ ID NO: 9421764 - DNA, 22 bp, Homo sapiens
tattggattgagacattttaga

SEQ ID NO: 9421765 - DNA, 20 bp, Homo sapiens
tattggatctaagaaatggg

SEQ ID NO: 9421766 - DNA, 20 bp, Homo sapiens
tatttacaacttagagcctc

SEQ ID NO: 9421767 - DNA, 20 bp, Homo sapiens
tatttacaacttagagcctc

SEQ ID NO: 9421768 - DNA, 22 bp, Homo sapiens
tattgggcagacatcaggctta

SEQ ID NO: 9421769 - DNA, 22 bp, Homo sapiens
tattggctgcagcttcctctgt

SEQ ID NO: 9421770 - DNA, 22 bp, Homo sapiens
tatttacttttaaattgagaac

SEQ ID NO: 9421771 - DNA, 22 bp, Homo sapiens
tatttacttttaaattgagaac

SEQ ID NO: 9421772 - DNA, 22 bp, Homo sapiens
tatttagaacagacaatagaaa

SEQ ID NO: 9421773 - DNA, 20 bp, Homo sapiens
tatttacaacttagagcctc

SEQ ID NO: 9421774 - DNA, 22 bp, Homo sapiens
tatttactgtatttgaagttga

SEQ ID NO: 9421775 - DNA, 22 bp, Homo sapiens
tatttactgtatttgaagttga

SEQ ID NO: 9421776 - DNA, 19 bp, Homo sapiens
tatttacttcttgattgca

SEQ ID NO: 9421777 - DNA, 22 bp, Homo sapiens
tatttactgtatttgaagttga

SEQ ID NO: 9421778 - DNA, 22 bp, Homo sapiens
tatttactgtatttgaagttga

SEQ ID NO: 9421779 - DNA, 22 bp, Homo sapiens
tatttacttttaaattgagaac

SEQ ID NO: 9421780 - DNA, 22 bp, Homo sapiens
tatttagatgcatttggattgc

SEQ ID NO: 9421781 - DNA, 20 bp, Homo sapiens
tatttagattcaagtatgga

SEQ ID NO: 9421782 - DNA, 22 bp, Homo sapiens
tatttagttatctttcataaaa

SEQ ID NO: 9421783 - DNA, 22 bp, Homo sapiens
tatttagttatctttcataaaa

SEQ ID NO: 9421784 - DNA, 22 bp, Homo sapiens
tatttagtgatagaagcaagga

SEQ ID NO: 9421785 - DNA, 22 bp, Homo sapiens
cagtcctgtgtcccttggtggg

SEQ ID NO: 9421786 - DNA, 22 bp, Homo sapiens
cagtcctgtgtcccttggtggg

SEQ ID NO: 9421787 - DNA, 18 bp, Homo sapiens
cagtcctgtttctacagg

SEQ ID NO: 9421788 - DNA, 22 bp, Homo sapiens
cagtcctgttcctggagtagtt

SEQ ID NO: 9421789 - DNA, 22 bp, Homo sapiens
cagtccttgatccaatagtggg

SEQ ID NO: 9421790 - DNA, 22 bp, Homo sapiens
cagtcctgggcaggtcaggcca

SEQ ID NO: 9421791 - DNA, 22 bp, Homo sapiens
cagtcctgggcaggtcaggcca

SEQ ID NO: 9421792 - DNA, 22 bp, Homo sapiens
cagtcctgggcacagccctggg

SEQ ID NO: 9421793 - DNA, 22 bp, Homo sapiens
cagtcctgggcacagccctggg

SEQ ID NO: 9421794 - DNA, 22 bp, Homo sapiens
cagtcctgggcaggtcaggcca

SEQ ID NO: 9421795 - DNA, 22 bp, Homo sapiens
cagtcctctcactcaggccttt

SEQ ID NO: 9421796 - DNA, 22 bp, Homo sapiens
cagtcctctctgtgtctgcacc

SEQ ID NO: 9421797 - DNA, 22 bp, Homo sapiens
cagtcctgggcacagccctggg

SEQ ID NO: 9421798 - DNA, 22 bp, Homo sapiens
cagtcctgggcacagccctggg

SEQ ID NO: 9421799 - DNA, 22 bp, Homo sapiens
cagtcctctctgtgtctgcacc

SEQ ID NO: 9421800 - DNA, 22 bp, Homo sapiens
cagtcctctctgtgtctgcacc

SEQ ID NO: 9421801 - DNA, 22 bp, Homo sapiens
cagtcctgggtgcagcaggaaa

SEQ ID NO: 9421802 - DNA, 22 bp, Homo sapiens
cagtcctgggtgcagcaggaaa

SEQ ID NO: 9421803 - DNA, 20 bp, Homo sapiens
cagtcctgtccctgctgccc

SEQ ID NO: 9421804 - DNA, 20 bp, Homo sapiens
cagtcctgtccctgctgccc

SEQ ID NO: 9421805 - DNA, 22 bp, Homo sapiens
cagtcctggggaccaggctgag

SEQ ID NO: 9421806 - DNA, 22 bp, Homo sapiens
cagtcctggggaccaggctgag

SEQ ID NO: 9421807 - DNA, 22 bp, Homo sapiens
cagtcctggggaccaggctgag

SEQ ID NO: 9421808 - DNA, 22 bp, Homo sapiens
cagtcctggggaccaggctgag

SEQ ID NO: 9421809 - DNA, 22 bp, Homo sapiens
cagtgatgtttctgcatcagag

SEQ ID NO: 9421810 - DNA, 22 bp, Homo sapiens
cagtgatgatcattgtaacatc

SEQ ID NO: 9421811 - DNA, 22 bp, Homo sapiens
cagtgatggatatggagaagtc

SEQ ID NO: 9421812 - DNA, 22 bp, Homo sapiens
cagtgattcagactcatcattt

SEQ ID NO: 9421813 - DNA, 22 bp, Homo sapiens
cagtgattcagactcatcattt

SEQ ID NO: 9421814 - DNA, 22 bp, Homo sapiens
cagtgatttttacagtaaggaa

SEQ ID NO: 9421815 - DNA, 17 bp, Homo sapiens
cagtgcagagccctttc

SEQ ID NO: 9421816 - DNA, 22 bp, Homo sapiens
cagtgcagacgtggagggggca

SEQ ID NO: 9421817 - DNA, 22 bp, Homo sapiens
cagtgaggtggatggatggcct

SEQ ID NO: 9421818 - DNA, 22 bp, Homo sapiens
cagtgaggtggatggatggcct

SEQ ID NO: 9421819 - DNA, 22 bp, Homo sapiens
cagtgagtaagtagacagctta

SEQ ID NO: 9421820 - DNA, 17 bp, Homo sapiens
cagtgatcattacatta

SEQ ID NO: 9421821 - DNA, 22 bp, Homo sapiens
cagtgatatttatcctactcac

SEQ ID NO: 9421822 - DNA, 22 bp, Homo sapiens
cagtgagtccaagatggctgaa

SEQ ID NO: 9421823 - DNA, 22 bp, Homo sapiens
cagtgagtccaagatggctgaa

SEQ ID NO: 9421824 - DNA, 22 bp, Homo sapiens
cagtgaggtgcccagcctgccc

SEQ ID NO: 9421825 - DNA, 22 bp, Homo sapiens
cagtgaggtgcccagcctgccc

SEQ ID NO: 9421826 - DNA, 21 bp, Homo sapiens
cagtgaggtccccagcctagg

SEQ ID NO: 9421827 - DNA, 22 bp, Homo sapiens
cagtgagggcccccttccaggt

SEQ ID NO: 9421828 - DNA, 22 bp, Homo sapiens
cagtgagggcccccttccaggt

SEQ ID NO: 9421829 - DNA, 22 bp, Homo sapiens
cagtgagggcccccttccaggt

SEQ ID NO: 9421830 - DNA, 20 bp, Homo sapiens
cagtgaggaggtgctggggg

SEQ ID NO: 9421831 - DNA, 22 bp, Homo sapiens
cagtgaggtagacagctttttc

SEQ ID NO: 9421832 - DNA, 22 bp, Homo sapiens
cagtgaggtagacagctttttc

SEQ ID NO: 9421833 - DNA, 22 bp, Homo sapiens
cagtctcagaggtgggagtggg

SEQ ID NO: 9421834 - DNA, 20 bp, Homo sapiens
cagtgaggaggtgctggggg

SEQ ID NO: 9421835 - DNA, 22 bp, Homo sapiens
cagtgaggaagctgtctggacc

SEQ ID NO: 9421836 - DNA, 22 bp, Homo sapiens
cagtctccgccagctcctcaca

SEQ ID NO: 9421837 - DNA, 22 bp, Homo sapiens
cagtctcaccctggaggcccca

SEQ ID NO: 9421838 - DNA, 22 bp, Homo sapiens
cagtctacctttcagacattga

SEQ ID NO: 9421839 - DNA, 17 bp, Homo sapiens
cagtcgaggaggacctg

SEQ ID NO: 9421840 - DNA, 22 bp, Homo sapiens
tatacagattaacagatttaaa

SEQ ID NO: 9421841 - DNA, 22 bp, Homo sapiens
tatacagattaacagatttaaa

SEQ ID NO: 9421842 - DNA, 22 bp, Homo sapiens
tatacagattaacagatttaaa

SEQ ID NO: 9421843 - DNA, 22 bp, Homo sapiens
tatacagattaacagatttaaa

SEQ ID NO: 9421844 - DNA, 22 bp, Homo sapiens
tatacagctatggcaagacaaa

SEQ ID NO: 9421845 - DNA, 21 bp, Homo sapiens
tatacagcaaagtctggagca

SEQ ID NO: 9421846 - DNA, 22 bp, Homo sapiens
tatacagtcttttgctatattc

SEQ ID NO: 9421847 - DNA, 22 bp, Homo sapiens
tatacagtcttttgctatattc

SEQ ID NO: 9421848 - DNA, 22 bp, Homo sapiens
tatacagtgcctcttccattag

SEQ ID NO: 9421849 - DNA, 22 bp, Homo sapiens
tatacagttaagtttcttcagt

SEQ ID NO: 9421850 - DNA, 22 bp, Homo sapiens
tatacagatggaaagatacaca

SEQ ID NO: 9421851 - DNA, 22 bp, Homo sapiens
cagggtggcactcagcgcatct

SEQ ID NO: 9421852 - DNA, 22 bp, Homo sapiens
tatacagatatctaagatgtaa

SEQ ID NO: 9421853 - DNA, 22 bp, Homo sapiens
cagggtggcacatcacagcatt

SEQ ID NO: 9421854 - DNA, 22 bp, Homo sapiens
cagggtggaatggaatgctggc

SEQ ID NO: 9421855 - DNA, 22 bp, Homo sapiens
cagggtggaatggaatgctggc

SEQ ID NO: 9421856 - DNA, 22 bp, Homo sapiens
cagggtggaagctgtagagtgg

SEQ ID NO: 9421857 - DNA, 22 bp, Homo sapiens
cagggtggaagctgtagagtgg

SEQ ID NO: 9421858 - DNA, 22 bp, Homo sapiens
cagggtggcacatcacagcatt

SEQ ID NO: 9421859 - DNA, 22 bp, Homo sapiens
cagggtggcacatcacagcatt

SEQ ID NO: 9421860 - DNA, 22 bp, Homo sapiens
cagggtggcacatcacagcatt

SEQ ID NO: 9421861 - DNA, 22 bp, Homo sapiens
tatctattatgttctatgtgtc

SEQ ID NO: 9421862 - DNA, 22 bp, Homo sapiens
tatctataatgttttacttcct

SEQ ID NO: 9421863 - DNA, 22 bp, Homo sapiens
caggtctgggttgatggcctgg

SEQ ID NO: 9421864 - DNA, 22 bp, Homo sapiens
caggtctggcatcagctgtgtg

SEQ ID NO: 9421865 - DNA, 22 bp, Homo sapiens
caggtctggcatcagctgtgtg

SEQ ID NO: 9421866 - DNA, 22 bp, Homo sapiens
caggtctgcagacagggccatg

SEQ ID NO: 9421867 - DNA, 22 bp, Homo sapiens
caggtctgcagacagggccatg

SEQ ID NO: 9421868 - DNA, 22 bp, Homo sapiens
caggtctgcaggctggagtcca

SEQ ID NO: 9421869 - DNA, 22 bp, Homo sapiens
caggtctgcagacagggccatg

SEQ ID NO: 9421870 - DNA, 17 bp, Homo sapiens
caggtctgaggccaggc

SEQ ID NO: 9421871 - DNA, 17 bp, Homo sapiens
caggtctgaggccaggc

SEQ ID NO: 9421872 - DNA, 17 bp, Homo sapiens
caggtctgaggccaggc

SEQ ID NO: 9421873 - DNA, 22 bp, Homo sapiens
caggtctgagtcacatgttcat

SEQ ID NO: 9421874 - DNA, 17 bp, Homo sapiens
caggtctgaggccaggc

SEQ ID NO: 9421875 - DNA, 17 bp, Homo sapiens
caggtctgaggccaggc

SEQ ID NO: 9421876 - DNA, 22 bp, Homo sapiens
caggtctgaagagtcacatgcc

SEQ ID NO: 9421877 - DNA, 22 bp, Homo sapiens
caggtctgaagagtcacatgcc

SEQ ID NO: 9421878 - DNA, 22 bp, Homo sapiens
caggtctgaagagtcacatgcc

SEQ ID NO: 9421879 - DNA, 22 bp, Homo sapiens
caggtctcttttgtcacaccac

SEQ ID NO: 9421880 - DNA, 22 bp, Homo sapiens
caggtctcgggttcagcagtga

SEQ ID NO: 9421881 - DNA, 22 bp, Homo sapiens
caggtccagaaaccaaaggatt

SEQ ID NO: 9421882 - DNA, 22 bp, Homo sapiens
caggtccacggcgcccaggggt

SEQ ID NO: 9421883 - DNA, 22 bp, Homo sapiens
caggtccacggcgcccaggggt

SEQ ID NO: 9421884 - DNA, 22 bp, Homo sapiens
caggtccaccatgcctcaagcc

SEQ ID NO: 9421885 - DNA, 22 bp, Homo sapiens
caggtctcccatcccctctgtt

SEQ ID NO: 9421886 - DNA, 22 bp, Homo sapiens
caggtctcgggttcagcagtga

SEQ ID NO: 9421887 - DNA, 22 bp, Homo sapiens
caggtctccagctcagggtcca

SEQ ID NO: 9421888 - DNA, 22 bp, Homo sapiens
tataagtagttgttgaagactt

SEQ ID NO: 9421889 - DNA, 22 bp, Homo sapiens
tataagtgacagattatccaaa

SEQ ID NO: 9421890 - DNA, 22 bp, Homo sapiens
tataagtagttgttgaagactt

SEQ ID NO: 9421891 - DNA, 22 bp, Homo sapiens
tataatatgaggcaggagtgat

SEQ ID NO: 9421892 - DNA, 22 bp, Homo sapiens
tataagtgtagtttcaaatgtt

SEQ ID NO: 9421893 - DNA, 22 bp, Homo sapiens
tataatattccttgttgtaggt

SEQ ID NO: 9421894 - DNA, 22 bp, Homo sapiens
tataatctggttttattaagag

SEQ ID NO: 9421895 - DNA, 22 bp, Homo sapiens
tataattagtaaatggcagatt

SEQ ID NO: 9421896 - DNA, 22 bp, Homo sapiens
caggggcaagaatgctgtcagc

SEQ ID NO: 9421897 - DNA, 22 bp, Homo sapiens
caggggcaagaatgctgtcagc

SEQ ID NO: 9421898 - DNA, 22 bp, Homo sapiens
tataattagtaaatggcagatt

SEQ ID NO: 9421899 - DNA, 22 bp, Homo sapiens
tataatccattcattgatttct

SEQ ID NO: 9421900 - DNA, 22 bp, Homo sapiens
tataatcctgcttcacattgaa

SEQ ID NO: 9421901 - DNA, 22 bp, Homo sapiens
tataagaaattgccaacctgtt

SEQ ID NO: 9421902 - DNA, 22 bp, Homo sapiens
tataagaaacaaggcaaatttt

SEQ ID NO: 9421903 - DNA, 22 bp, Homo sapiens
tagttttagtcccattttacag

SEQ ID NO: 9421904 - DNA, 22 bp, Homo sapiens
tataagaagtgaagaagagtta

SEQ ID NO: 9421905 - DNA, 22 bp, Homo sapiens
tataagatacttggcatagtgc

SEQ ID NO: 9421906 - DNA, 22 bp, Homo sapiens
tataagaagtgaagaagagtta

SEQ ID NO: 9421907 - DNA, 17 bp, Homo sapiens
tacatgtgtatctgatt

SEQ ID NO: 9421908 - DNA, 22 bp, Homo sapiens
tacatgtggtagggagggcagt

SEQ ID NO: 9421909 - DNA, 22 bp, Homo sapiens
tagttttagtcccattttacag

SEQ ID NO: 9421910 - DNA, 22 bp, Homo sapiens
cagggtggaacaggcaatactt

SEQ ID NO: 9421911 - DNA, 22 bp, Homo sapiens
cagggtggaacaggcaatactt

SEQ ID NO: 9421912 - DNA, 22 bp, Homo sapiens
cagggtggaagctgtagagtgg

SEQ ID NO: 9421913 - DNA, 22 bp, Homo sapiens
cagggtggaagctgtagagtgg

SEQ ID NO: 9421914 - DNA, 22 bp, Homo sapiens
cagggtggaagctgtagagtgg

SEQ ID NO: 9421915 - DNA, 22 bp, Homo sapiens
caggggcctggctgtctaggaa

SEQ ID NO: 9421916 - DNA, 22 bp, Homo sapiens
caggggcctggctgtctaggaa

SEQ ID NO: 9421917 - DNA, 22 bp, Homo sapiens
cagggtctgatggtcctcactt

SEQ ID NO: 9421918 - DNA, 22 bp, Homo sapiens
cagggtcttataaggccaattt

SEQ ID NO: 9421919 - DNA, 22 bp, Homo sapiens
cagggtgcttccgtggagctgt

SEQ ID NO: 9421920 - DNA, 22 bp, Homo sapiens
caggggcagtctgtgtgcgtgg

SEQ ID NO: 9421921 - DNA, 22 bp, Homo sapiens
caggggccaagggtccagacct

SEQ ID NO: 9421922 - DNA, 22 bp, Homo sapiens
caggggccaagggtccagacct

SEQ ID NO: 9421923 - DNA, 22 bp, Homo sapiens
caggggccggctgtccgtgccc

SEQ ID NO: 9421924 - DNA, 22 bp, Homo sapiens
caggggccggctgtccgtgccc

SEQ ID NO: 9421925 - DNA, 22 bp, Homo sapiens
caggggccggctgtccgtgccc

SEQ ID NO: 9421926 - DNA, 22 bp, Homo sapiens
caggggccaggctgtctgctgt

SEQ ID NO: 9421927 - DNA, 22 bp, Homo sapiens
caggggccaggctgtctgctgt

SEQ ID NO: 9421928 - DNA, 22 bp, Homo sapiens
caggggcagtctgtgtgcgtgg

SEQ ID NO: 9421929 - DNA, 22 bp, Homo sapiens
caggggcagtctgtgtgcgtgg

SEQ ID NO: 9421930 - DNA, 22 bp, Homo sapiens
caggggcagtctgtgtgcgtgg

SEQ ID NO: 9421931 - DNA, 22 bp, Homo sapiens
caggggcaggtgtgagatcatc

SEQ ID NO: 9421932 - DNA, 22 bp, Homo sapiens
caggggcaggtgtgagatcatc

SEQ ID NO: 9421933 - DNA, 22 bp, Homo sapiens
caggggcaggtgtgagatcatc

SEQ ID NO: 9421934 - DNA, 22 bp, Homo sapiens
caggggcaagaatgctgtcagc

SEQ ID NO: 9421935 - DNA, 21 bp, Homo sapiens
caggtctggtgaacactctca

SEQ ID NO: 9421936 - DNA, 22 bp, Homo sapiens
tatggcttctgctttcttgact

SEQ ID NO: 9421937 - DNA, 22 bp, Homo sapiens
caggtctggtgagagaacagtt

SEQ ID NO: 9421938 - DNA, 22 bp, Homo sapiens
caggtctggtgagagaacagtt

SEQ ID NO: 9421939 - DNA, 22 bp, Homo sapiens
caggtctggtgagagaacagtt

SEQ ID NO: 9421940 - DNA, 22 bp, Homo sapiens
tatggcttctcagtcatgaaaa

SEQ ID NO: 9421941 - DNA, 23 bp, Homo sapiens
tatggcttacagtgctttaggta

SEQ ID NO: 9421942 - DNA, 22 bp, Homo sapiens
tatggcttatgctgaacacctg

SEQ ID NO: 9421943 - DNA, 22 bp, Homo sapiens
tatggcttaaaatttcagcatg

SEQ ID NO: 9421944 - DNA, 22 bp, Homo sapiens
tatgtactaactttcattctag

SEQ ID NO: 9421945 - DNA, 22 bp, Homo sapiens
tatgtacatgttaaagggcaaa

SEQ ID NO: 9421946 - DNA, 22 bp, Homo sapiens
caggtgaacccagtctaatcat

SEQ ID NO: 9421947 - DNA, 22 bp, Homo sapiens
caggtgaactcagttttgtatt

SEQ ID NO: 9421948 - DNA, 20 bp, Homo sapiens
caggtcttcatgtggctgtc

SEQ ID NO: 9421949 - DNA, 22 bp, Homo sapiens
caggtgaaaaagcaaccatatt

SEQ ID NO: 9421950 - DNA, 22 bp, Homo sapiens
caggtcttttctactggtggag

SEQ ID NO: 9421951 - DNA, 22 bp, Homo sapiens
caggtctttgttgcagcatgga

SEQ ID NO: 9421952 - DNA, 22 bp, Homo sapiens
caggtctgtattaacagagggt

SEQ ID NO: 9421953 - DNA, 18 bp, Homo sapiens
caggtctgtctgcctccc

SEQ ID NO: 9421954 - DNA, 22 bp, Homo sapiens
caggtctgtgtgccatttccaa

SEQ ID NO: 9421955 - DNA, 22 bp, Homo sapiens
caggtctgtttccatcagtgct

SEQ ID NO: 9421956 - DNA, 22 bp, Homo sapiens
caggtctgttttcaaggtcagt

SEQ ID NO: 9421957 - DNA, 22 bp, Homo sapiens
tatgcacacattagcacagggt

SEQ ID NO: 9421958 - DNA, 22 bp, Homo sapiens
tatggatataatcagactggaa

SEQ ID NO: 9421959 - DNA, 22 bp, Homo sapiens
tatggatgtttatctacaggct

SEQ ID NO: 9421960 - DNA, 22 bp, Homo sapiens
tatggatggaaagggccaagct

SEQ ID NO: 9421961 - DNA, 22 bp, Homo sapiens
tatggatgagttcctgaggagt

SEQ ID NO: 9421962 - DNA, 22 bp, Homo sapiens
tatggagattcaaaagcatctt

SEQ ID NO: 9421963 - DNA, 22 bp, Homo sapiens
tatggagattcaaaagcatctt

SEQ ID NO: 9421964 - DNA, 22 bp, Homo sapiens
tatggcaagagaatcaactgaa

SEQ ID NO: 9421965 - DNA, 22 bp, Homo sapiens
tatggcaagatgacatgttctc

SEQ ID NO: 9421966 - DNA, 22 bp, Homo sapiens
tatggcagaggagaggcactag

SEQ ID NO: 9421967 - DNA, 17 bp, Homo sapiens
tatctctgcttcatggt

SEQ ID NO: 9421968 - DNA, 17 bp, Homo sapiens
tatctcttcaagtttca

SEQ ID NO: 9421969 - DNA, 22 bp, Homo sapiens
tatctcttgcatgctttttaga

SEQ ID NO: 9421970 - DNA, 22 bp, Homo sapiens
tatctccatctggagagcaaaa

SEQ ID NO: 9421971 - DNA, 22 bp, Homo sapiens
tatctccagtttctgagcctca

SEQ ID NO: 9421972 - DNA, 22 bp, Homo sapiens
tatctccatctggagagcaaaa

SEQ ID NO: 9421973 - DNA, 22 bp, Homo sapiens
tatctgagaaagaagcaccaga

SEQ ID NO: 9421974 - DNA, 22 bp, Homo sapiens
tatctgaacaacctttattact

SEQ ID NO: 9421975 - DNA, 22 bp, Homo sapiens
tatctgagaaagaagcaccaga

SEQ ID NO: 9421976 - DNA, 22 bp, Homo sapiens
tatctctttattgacaataaaa

SEQ ID NO: 9421977 - DNA, 22 bp, Homo sapiens
tatctcttgtctgttttgcaaa

SEQ ID NO: 9421978 - DNA, 22 bp, Homo sapiens
tatctcttgtctgttttgcaaa

SEQ ID NO: 9421979 - DNA, 22 bp, Homo sapiens
tatctctttcattttagagtca

SEQ ID NO: 9421980 - DNA, 22 bp, Homo sapiens
tatctctttcattttagagtca

SEQ ID NO: 9421981 - DNA, 22 bp, Homo sapiens
tatctctttattgacaataaaa

SEQ ID NO: 9421982 - DNA, 22 bp, Homo sapiens
tatctctttattgacaataaaa

SEQ ID NO: 9421983 - DNA, 22 bp, Homo sapiens
tattaaagggaagttatgcatg

SEQ ID NO: 9421984 - DNA, 22 bp, Homo sapiens
tattaaagagagaatcatcatc

SEQ ID NO: 9421985 - DNA, 22 bp, Homo sapiens
tattaaagagagaatcatcatc

SEQ ID NO: 9421986 - DNA, 22 bp, Homo sapiens
tatgtttttcaagtgcacacta

SEQ ID NO: 9421987 - DNA, 22 bp, Homo sapiens
tatgtttttcagacgtcctaca

SEQ ID NO: 9421988 - DNA, 22 bp, Homo sapiens
tattaaatatatctgttagttg

SEQ ID NO: 9421989 - DNA, 22 bp, Homo sapiens
tattaaatatatctgttagttg

SEQ ID NO: 9421990 - DNA, 22 bp, Homo sapiens
tattaaatatatctgttagttg

SEQ ID NO: 9421991 - DNA, 22 bp, Homo sapiens
tattaaatatatctgttagttg

SEQ ID NO: 9421992 - DNA, 22 bp, Homo sapiens
tattcctgggttccagcccaga

SEQ ID NO: 9421993 - DNA, 22 bp, Homo sapiens
tattcctggtccctaccacaga

SEQ ID NO: 9421994 - DNA, 22 bp, Homo sapiens
tattgctttctcagacgtttag

SEQ ID NO: 9421995 - DNA, 22 bp, Homo sapiens
tattgctttgtgtcataagcaa

SEQ ID NO: 9421996 - DNA, 22 bp, Homo sapiens
tattgctggtgctgttctgaat

SEQ ID NO: 9421997 - DNA, 22 bp, Homo sapiens
tattgcctgagtgtttcataat

SEQ ID NO: 9421998 - DNA, 22 bp, Homo sapiens
tattgccaaatgtctgctggaa

SEQ ID NO: 9421999 - DNA, 20 bp, Homo sapiens
tattgcctaaataccagaat

SEQ ID NO: 9422000 - DNA, 22 bp, Homo sapiens
tattgctgccaggaccctatcc

SEQ ID NO: 9422001 - DNA, 22 bp, Homo sapiens
tattgctgacttgttcagtgtt

SEQ ID NO: 9422002 - DNA, 22 bp, Homo sapiens
tattgctgacttgttcagtgtt

SEQ ID NO: 9422003 - DNA, 22 bp, Homo sapiens
tattgctgactgtcttctgagt

SEQ ID NO: 9422004 - DNA, 22 bp, Homo sapiens
tatgtgtaaccttgtgatttat

SEQ ID NO: 9422005 - DNA, 22 bp, Homo sapiens
tatgtgtatacctatacatgtg

SEQ ID NO: 9422006 - DNA, 22 bp, Homo sapiens
tatgtgtatacctatacatgtg

SEQ ID NO: 9422007 - DNA, 22 bp, Homo sapiens
tatgtgtactcgttaaatattt

SEQ ID NO: 9422008 - DNA, 22 bp, Homo sapiens
tatgtgtactcgttaaatattt

SEQ ID NO: 9422009 - DNA, 22 bp, Homo sapiens
tatgtgtacagtatactggttt

SEQ ID NO: 9422010 - DNA, 22 bp, Homo sapiens
tatgtgcattattaccagtgga

SEQ ID NO: 9422011 - DNA, 23 bp, Homo sapiens
tatgtgcatatgtgtaagaatac

SEQ ID NO: 9422012 - DNA, 22 bp, Homo sapiens
tatgtactaactttcattctag

SEQ ID NO: 9422013 - DNA, 22 bp, Homo sapiens
tatgtgcattattaccagtgga

SEQ ID NO: 9422014 - DNA, 22 bp, Homo sapiens
tatgtgctttgcactgtgctat

SEQ ID NO: 9422015 - DNA, 22 bp, Homo sapiens
tatgtggccattctgtttgtgt

SEQ ID NO: 9422016 - DNA, 22 bp, Homo sapiens
tatgtgtatgtacatacataca

SEQ ID NO: 9422017 - DNA, 22 bp, Homo sapiens
tatgtgtatgttcattcatgca

SEQ ID NO: 9422018 - DNA, 19 bp, Homo sapiens
tatgtgtatatgtatctgt

SEQ ID NO: 9422019 - DNA, 22 bp, Homo sapiens
tatgtgtatgtacatacataca

SEQ ID NO: 9422020 - DNA, 22 bp, Homo sapiens
tatgtgtatgttcattcatgca

SEQ ID NO: 9422021 - DNA, 22 bp, Homo sapiens
tatgtgtatttagttctataca

SEQ ID NO: 9422022 - DNA, 22 bp, Homo sapiens
tatgtgtccctgctactcaaca

SEQ ID NO: 9422023 - DNA, 22 bp, Homo sapiens
tatgtgtcaaaccattcatctg

SEQ ID NO: 9422024 - DNA, 22 bp, Homo sapiens
tatgtttgttatcacaactagg

SEQ ID NO: 9422025 - DNA, 22 bp, Homo sapiens
tatgttttaggaattaattgtt

SEQ ID NO: 9422026 - DNA, 22 bp, Homo sapiens
tatgtttttaagagaatgcatt

SEQ ID NO: 9422027 - DNA, 22 bp, Homo sapiens
tatgtttttaagagaatgcatt

SEQ ID NO: 9422028 - DNA, 22 bp, Homo sapiens
tatgttttaggaattaattgtt

SEQ ID NO: 9422029 - DNA, 22 bp, Homo sapiens
tcattttcaagtttgaacagga

SEQ ID NO: 9422030 - DNA, 22 bp, Homo sapiens
tcattttcacacataaatagca

SEQ ID NO: 9422031 - DNA, 22 bp, Homo sapiens
tcattttcccactgaagctgtc

SEQ ID NO: 9422032 - DNA, 16 bp, Homo sapiens
tcattttgagtgacag

SEQ ID NO: 9422033 - DNA, 22 bp, Homo sapiens
tcattttgcagagctgaggaac

SEQ ID NO: 9422034 - DNA, 22 bp, Homo sapiens
tcattttcacacataaatagca

SEQ ID NO: 9422035 - DNA, 22 bp, Homo sapiens
tcattttggccatgatacagac

SEQ ID NO: 9422036 - DNA, 22 bp, Homo sapiens
tcattttgcctgccatttgagt

SEQ ID NO: 9422037 - DNA, 18 bp, Homo sapiens
tcattttgtctgcctttg

SEQ ID NO: 9422038 - DNA, 22 bp, Homo sapiens
tcattttgtgccttatgaccgc

SEQ ID NO: 9422039 - DNA, 22 bp, Homo sapiens
tcattttggggtttgtcatctt

SEQ ID NO: 9422040 - DNA, 22 bp, Homo sapiens
tcattttggggtttgtcatctt

SEQ ID NO: 9422041 - DNA, 22 bp, Homo sapiens
catgcaaaggtcaagatcagga

SEQ ID NO: 9422042 - DNA, 23 bp, Homo sapiens
catgcaaacactattgcatttgg

SEQ ID NO: 9422043 - DNA, 23 bp, Homo sapiens
catgcaaacactattgcatttgg

SEQ ID NO: 9422044 - DNA, 22 bp, Homo sapiens
catgcaaagcgttttgaccagc

SEQ ID NO: 9422045 - DNA, 22 bp, Homo sapiens
catgcaaagcgttttgaccagc

SEQ ID NO: 9422046 - DNA, 22 bp, Homo sapiens
catgcaaatgtgctaatctgaa

SEQ ID NO: 9422047 - DNA, 22 bp, Homo sapiens
catgcaaatggtggctaaatgg

SEQ ID NO: 9422048 - DNA, 22 bp, Homo sapiens
catgcaaatggtggctaaatgg

SEQ ID NO: 9422049 - DNA, 22 bp, Homo sapiens
catgcaaatgtgctaatctgaa

SEQ ID NO: 9422050 - DNA, 22 bp, Homo sapiens
catgattttgtcttgtgttaat

SEQ ID NO: 9422051 - DNA, 22 bp, Homo sapiens
catgattttgtcttgtgttaat

SEQ ID NO: 9422052 - DNA, 22 bp, Homo sapiens
catgatttactaaaatttgttt

SEQ ID NO: 9422053 - DNA, 22 bp, Homo sapiens
catgattttgtcttgtgttaat

SEQ ID NO: 9422054 - DNA, 22 bp, Homo sapiens
catgatttactaaaatttgttt

SEQ ID NO: 9422055 - DNA, 23 bp, Homo sapiens
catgcaaacactattgcatttgg

SEQ ID NO: 9422056 - DNA, 23 bp, Homo sapiens
catgcaaacactattgcatttgg

SEQ ID NO: 9422057 - DNA, 22 bp, Homo sapiens
catgcaaaatgtattttattag

SEQ ID NO: 9422058 - DNA, 22 bp, Homo sapiens
catgcaaacacgtaaacattca

SEQ ID NO: 9422059 - DNA, 22 bp, Homo sapiens
catgcaaacacgtaaacattca

SEQ ID NO: 9422060 - DNA, 22 bp, Homo sapiens
catgcaaacacgtaaacattca

SEQ ID NO: 9422061 - DNA, 22 bp, Homo sapiens
catgcacaaaggtaagatgcgt

SEQ ID NO: 9422062 - DNA, 22 bp, Homo sapiens
catgcacaaaggtaagatgcgt

SEQ ID NO: 9422063 - DNA, 22 bp, Homo sapiens
catggccagcccccagttcctc

SEQ ID NO: 9422064 - DNA, 22 bp, Homo sapiens
catggctgaggcagaggactga

SEQ ID NO: 9422065 - DNA, 22 bp, Homo sapiens
catggctgaggcagaggactga

SEQ ID NO: 9422066 - DNA, 22 bp, Homo sapiens
catggctgaacactcagtgact

SEQ ID NO: 9422067 - DNA, 22 bp, Homo sapiens
catggctgcattggaatgggtt

SEQ ID NO: 9422068 - DNA, 22 bp, Homo sapiens
catggctgctggctcggtccct

SEQ ID NO: 9422069 - DNA, 22 bp, Homo sapiens
catggctgcgagaagagtgggt

SEQ ID NO: 9422070 - DNA, 22 bp, Homo sapiens
catggctgcgagaagagtgggt

SEQ ID NO: 9422071 - DNA, 22 bp, Homo sapiens
catggctggtgcacctctggga

SEQ ID NO: 9422072 - DNA, 22 bp, Homo sapiens
catggctgggagacggctgagg

SEQ ID NO: 9422073 - DNA, 22 bp, Homo sapiens
catggctggcacacagcaacca

SEQ ID NO: 9422074 - DNA, 22 bp, Homo sapiens
catggctggccagtgggagtgg

SEQ ID NO: 9422075 - DNA, 22 bp, Homo sapiens
catggcttaccccaggagcagc

SEQ ID NO: 9422076 - DNA, 22 bp, Homo sapiens
catggcttagaagttccagccc

SEQ ID NO: 9422077 - DNA, 22 bp, Homo sapiens
catggcttcgcgcgtccccgct

SEQ ID NO: 9422078 - DNA, 22 bp, Homo sapiens
catggcttgtcttgtcttctga

SEQ ID NO: 9422079 - DNA, 22 bp, Homo sapiens
catggcttgcaagcataggaga

SEQ ID NO: 9422080 - DNA, 22 bp, Homo sapiens
catggcttgctagtggcccaag

SEQ ID NO: 9422081 - DNA, 18 bp, Homo sapiens
tccagcccacattttctg

SEQ ID NO: 9422082 - DNA, 20 bp, Homo sapiens
tccagcccagcagcctgaca

SEQ ID NO: 9422083 - DNA, 18 bp, Homo sapiens
tccagcccacattttctg

SEQ ID NO: 9422084 - DNA, 20 bp, Homo sapiens
tccagcccagcagcctgaca

SEQ ID NO: 9422085 - DNA, 20 bp, Homo sapiens
tccagcccagcagcctgaca

SEQ ID NO: 9422086 - DNA, 20 bp, Homo sapiens
tccagcccagcagcctgaca

SEQ ID NO: 9422087 - DNA, 20 bp, Homo sapiens
tccagcccagcagcctgaca

SEQ ID NO: 9422088 - DNA, 22 bp, Homo sapiens
catgtacatgcctactatcaat

SEQ ID NO: 9422089 - DNA, 22 bp, Homo sapiens
tccagcccagctcctctcagaa

SEQ ID NO: 9422090 - DNA, 22 bp, Homo sapiens
catgtacatgcctactatcaat

SEQ ID NO: 9422091 - DNA, 22 bp, Homo sapiens
catgtacatgcctactatcaat

SEQ ID NO: 9422092 - DNA, 22 bp, Homo sapiens
catgtctgagtagagtgtgatt

SEQ ID NO: 9422093 - DNA, 22 bp, Homo sapiens
catgtacatgcctactatcaat

SEQ ID NO: 9422094 - DNA, 18 bp, Homo sapiens
catgtctgcgccacaagg

SEQ ID NO: 9422095 - DNA, 22 bp, Homo sapiens
catgtctgccaatttggaagga

SEQ ID NO: 9422096 - DNA, 22 bp, Homo sapiens
catgtctgggtatatgcatatg

SEQ ID NO: 9422097 - DNA, 20 bp, Homo sapiens
tccagccacttccgctggtc

SEQ ID NO: 9422098 - DNA, 22 bp, Homo sapiens
tccagccaggatggcccaggga

SEQ ID NO: 9422099 - DNA, 22 bp, Homo sapiens
tccagccacttgcacagttaaa

SEQ ID NO: 9422100 - DNA, 22 bp, Homo sapiens
tccagccacttgcacagttaaa

SEQ ID NO: 9422101 - DNA, 22 bp, Homo sapiens
tccagccaggatggcccaggga

SEQ ID NO: 9422102 - DNA, 22 bp, Homo sapiens
tccagccaggatggcccaggga

SEQ ID NO: 9422103 - DNA, 21 bp, Homo sapiens
tccagccagtaaatgctcagc

SEQ ID NO: 9422104 - DNA, 22 bp, Homo sapiens
tccagccaggatggcccaggga

SEQ ID NO: 9422105 - DNA, 22 bp, Homo sapiens
tccagccatatcttgtagccct

SEQ ID NO: 9422106 - DNA, 22 bp, Homo sapiens
tccagccatatcttgtagccct

SEQ ID NO: 9422107 - DNA, 21 bp, Homo sapiens
tccagccagtaaatgctcagc

SEQ ID NO: 9422108 - DNA, 21 bp, Homo sapiens
tccagccagtaaatgctcagc

SEQ ID NO: 9422109 - DNA, 22 bp, Homo sapiens
tccagccatgactcggacagtg

SEQ ID NO: 9422110 - DNA, 22 bp, Homo sapiens
tccagccattcattatgacacc

SEQ ID NO: 9422111 - DNA, 22 bp, Homo sapiens
tccagccattcattatgacacc

SEQ ID NO: 9422112 - DNA, 22 bp, Homo sapiens
tccagccattcattatgacacc

SEQ ID NO: 9422113 - DNA, 22 bp, Homo sapiens
tccagcccacacctgaagctgg

SEQ ID NO: 9422114 - DNA, 18 bp, Homo sapiens
tccagcccacattttctg

SEQ ID NO: 9422115 - DNA, 22 bp, Homo sapiens
tccagcccacacctgaagctgg

SEQ ID NO: 9422116 - DNA, 22 bp, Homo sapiens
tccaggcaaagtgctgggctgc

SEQ ID NO: 9422117 - DNA, 22 bp, Homo sapiens
tccaggcaaagtgctgggctgc

SEQ ID NO: 9422118 - DNA, 22 bp, Homo sapiens
tccaggcaaagtgctgggctgc

SEQ ID NO: 9422119 - DNA, 19 bp, Homo sapiens
catgtgcatgagcacagga

SEQ ID NO: 9422120 - DNA, 19 bp, Homo sapiens
catgtgcatgagcacagga

SEQ ID NO: 9422121 - DNA, 22 bp, Homo sapiens
tccaggcaaaaaccaactacag

SEQ ID NO: 9422122 - DNA, 22 bp, Homo sapiens
tccaggcaaagccttgtagacg

SEQ ID NO: 9422123 - DNA, 22 bp, Homo sapiens
tccaggcaaagggactagcagg

SEQ ID NO: 9422124 - DNA, 22 bp, Homo sapiens
catgtgcagtgtaagacatgct

SEQ ID NO: 9422125 - DNA, 22 bp, Homo sapiens
catgtgcatccttaatctccct

SEQ ID NO: 9422126 - DNA, 22 bp, Homo sapiens
catgtgcagggccaggcattgc

SEQ ID NO: 9422127 - DNA, 22 bp, Homo sapiens
catgtgaccgctgggtgagcga

SEQ ID NO: 9422128 - DNA, 22 bp, Homo sapiens
catgtctttgttatgctcacca

SEQ ID NO: 9422129 - DNA, 22 bp, Homo sapiens
catgtgaattccaaagctaggt

SEQ ID NO: 9422130 - DNA, 22 bp, Homo sapiens
tcagttcttgggctgctaggac

SEQ ID NO: 9422131 - DNA, 22 bp, Homo sapiens
tcagttcttattttcatgaata

SEQ ID NO: 9422132 - DNA, 22 bp, Homo sapiens
tcagttctttatttcacagtga

SEQ ID NO: 9422133 - DNA, 21 bp, Homo sapiens
tcagttctctgcctgtgcttg

SEQ ID NO: 9422134 - DNA, 22 bp, Homo sapiens
tcagttctaagtgctttacatg

SEQ ID NO: 9422135 - DNA, 21 bp, Homo sapiens
tcagttctctgcctgtgcttg

SEQ ID NO: 9422136 - DNA, 21 bp, Homo sapiens
tcagttctctgcctgtgcttg

SEQ ID NO: 9422137 - DNA, 22 bp, Homo sapiens
tcagttctgaagttctgcctcc

SEQ ID NO: 9422138 - DNA, 22 bp, Homo sapiens
tcagttctgaagttctgcctcc

SEQ ID NO: 9422139 - DNA, 22 bp, Homo sapiens
tcagttctggctgctgctgtca

SEQ ID NO: 9422140 - DNA, 22 bp, Homo sapiens
tcagttctggctgctgctgtca

SEQ ID NO: 9422141 - DNA, 22 bp, Homo sapiens
tcagttctgctagaaaaacagt

SEQ ID NO: 9422142 - DNA, 22 bp, Homo sapiens
catctttagttattgaatatag

SEQ ID NO: 9422143 - DNA, 22 bp, Homo sapiens
catctttatttatatagacagg

SEQ ID NO: 9422144 - DNA, 22 bp, Homo sapiens
catctttatttatatagacagg

SEQ ID NO: 9422145 - DNA, 22 bp, Homo sapiens
catctttatttatatagacagg

SEQ ID NO: 9422146 - DNA, 22 bp, Homo sapiens
catctttatttatatagacagg

SEQ ID NO: 9422147 - DNA, 22 bp, Homo sapiens
catctttcttagaactttcagt

SEQ ID NO: 9422148 - DNA, 22 bp, Homo sapiens
catctttcagtttataagtctg

SEQ ID NO: 9422149 - DNA, 22 bp, Homo sapiens
catctttcagtttataagtctg

SEQ ID NO: 9422150 - DNA, 22 bp, Homo sapiens
catctttatttatatagacagg

SEQ ID NO: 9422151 - DNA, 22 bp, Homo sapiens
catctttagttattgaatatag

SEQ ID NO: 9422152 - DNA, 22 bp, Homo sapiens
catctttaacagaatggatttg

SEQ ID NO: 9422153 - DNA, 22 bp, Homo sapiens
catctttaacagaatggatttg

SEQ ID NO: 9422154 - DNA, 22 bp, Homo sapiens
tcaggtggcttggagggggacg

SEQ ID NO: 9422155 - DNA, 22 bp, Homo sapiens
catccctgctggtggaaggggt

SEQ ID NO: 9422156 - DNA, 22 bp, Homo sapiens
catccctgctggtggaaggggt

SEQ ID NO: 9422157 - DNA, 22 bp, Homo sapiens
catccattaactcatttgtttc

SEQ ID NO: 9422158 - DNA, 22 bp, Homo sapiens
catccattaactcatttgtttc

SEQ ID NO: 9422159 - DNA, 22 bp, Homo sapiens
catccattcagtgcaaatcaca

SEQ ID NO: 9422160 - DNA, 22 bp, Homo sapiens
catccattcattaattctaaag

SEQ ID NO: 9422161 - DNA, 22 bp, Homo sapiens
catccaggctgaagtgcagtgg

SEQ ID NO: 9422162 - DNA, 22 bp, Homo sapiens
catccccaattagcgcccagct

SEQ ID NO: 9422163 - DNA, 22 bp, Homo sapiens
catccctgacttctaggtgaca

SEQ ID NO: 9422164 - DNA, 22 bp, Homo sapiens
tcaggtgggacctgctaggaca

SEQ ID NO: 9422165 - DNA, 22 bp, Homo sapiens
catctttaaaatgggaacaaca

SEQ ID NO: 9422166 - DNA, 22 bp, Homo sapiens
catctttaaaatgggaacaaca

SEQ ID NO: 9422167 - DNA, 22 bp, Homo sapiens
catcttaataaatctcctccct

SEQ ID NO: 9422168 - DNA, 22 bp, Homo sapiens
catcttaacaggtctctgaggg

SEQ ID NO: 9422169 - DNA, 22 bp, Homo sapiens
catctttaacaatttacaatgt

SEQ ID NO: 9422170 - DNA, 22 bp, Homo sapiens
catctttaacaatttacaatgt

SEQ ID NO: 9422171 - DNA, 22 bp, Homo sapiens
tcatggggtagaagcatgttta

SEQ ID NO: 9422172 - DNA, 22 bp, Homo sapiens
tcatggggctcttcaagtggag

SEQ ID NO: 9422173 - DNA, 22 bp, Homo sapiens
tcatggggccacagctgccagc

SEQ ID NO: 9422174 - DNA, 22 bp, Homo sapiens
tcatggggccacagctgccagc

SEQ ID NO: 9422175 - DNA, 22 bp, Homo sapiens
tcatggctttttcactgttcgc

SEQ ID NO: 9422176 - DNA, 22 bp, Homo sapiens
tcatggggaaagcccgccctca

SEQ ID NO: 9422177 - DNA, 22 bp, Homo sapiens
tcatgggcagctactggttccc

SEQ ID NO: 9422178 - DNA, 22 bp, Homo sapiens
catgattatgtgttagagtttg

SEQ ID NO: 9422179 - DNA, 22 bp, Homo sapiens
tcatgtacatgtaagtcagaaa

SEQ ID NO: 9422180 - DNA, 22 bp, Homo sapiens
tcatgtattgaaaagcatttta

SEQ ID NO: 9422181 - DNA, 22 bp, Homo sapiens
tcatgtacatgtaagtcagaaa

SEQ ID NO: 9422182 - DNA, 22 bp, Homo sapiens
tcatggttcatgagtgtccttt

SEQ ID NO: 9422183 - DNA, 22 bp, Homo sapiens
tcatggggtttggctggatgtc

SEQ ID NO: 9422184 - DNA, 22 bp, Homo sapiens
tcatttcaagttctgacagcta

SEQ ID NO: 9422185 - DNA, 22 bp, Homo sapiens
tcatgtctctatgtgcctatta

SEQ ID NO: 9422186 - DNA, 22 bp, Homo sapiens
tcatgtctctatgtgcctatta

SEQ ID NO: 9422187 - DNA, 22 bp, Homo sapiens
tcatgtcagtttcttctataaa

SEQ ID NO: 9422188 - DNA, 22 bp, Homo sapiens
tcatgtattgaaaagcatttta

SEQ ID NO: 9422189 - DNA, 22 bp, Homo sapiens
tcatttcaagttctgacagcta

SEQ ID NO: 9422190 - DNA, 22 bp, Homo sapiens
tcagtttaagatgactaacaat

SEQ ID NO: 9422191 - DNA, 22 bp, Homo sapiens
tcagtttagatgcatttgtcgt

SEQ ID NO: 9422192 - DNA, 22 bp, Homo sapiens
tcagtttagagttatttaatct

SEQ ID NO: 9422193 - DNA, 22 bp, Homo sapiens
tcagtttatggtctagttcatg

SEQ ID NO: 9422194 - DNA, 22 bp, Homo sapiens
tcagtttatagatattgctgat

SEQ ID NO: 9422195 - DNA, 22 bp, Homo sapiens
tcagtttatttcttgttccaca

SEQ ID NO: 9422196 - DNA, 22 bp, Homo sapiens
tcagtttatggtctagttcatg

SEQ ID NO: 9422197 - DNA, 22 bp, Homo sapiens
tcagtttatagatattgctgat

SEQ ID NO: 9422198 - DNA, 22 bp, Homo sapiens
tcagtttataaattgtatttag

SEQ ID NO: 9422199 - DNA, 22 bp, Homo sapiens
tcagtttataaattgtatttag

SEQ ID NO: 9422200 - DNA, 22 bp, Homo sapiens
catgagaaggttttggcatata

SEQ ID NO: 9422201 - DNA, 22 bp, Homo sapiens
catgagaagtggccttcaaaaa

SEQ ID NO: 9422202 - DNA, 22 bp, Homo sapiens
catgagttcaaaatgcctgcct

SEQ ID NO: 9422203 - DNA, 22 bp, Homo sapiens
catgataacacttctgtttaat

SEQ ID NO: 9422204 - DNA, 22 bp, Homo sapiens
catgagttcatctgcttctctt

SEQ ID NO: 9422205 - DNA, 22 bp, Homo sapiens
catgagttttttagttcatgca

SEQ ID NO: 9422206 - DNA, 22 bp, Homo sapiens
catgataacttcattacacaat

SEQ ID NO: 9422207 - DNA, 21 bp, Homo sapiens
catgataatgaaggtgttatt

SEQ ID NO: 9422208 - DNA, 22 bp, Homo sapiens
catgataggtatttaattaaat

SEQ ID NO: 9422209 - DNA, 22 bp, Homo sapiens
catgataggtatttaattaaat

SEQ ID NO: 9422210 - DNA, 22 bp, Homo sapiens
catgatcaccacttgacagccc

SEQ ID NO: 9422211 - DNA, 22 bp, Homo sapiens
catgattatattaatggcttca

SEQ ID NO: 9422212 - DNA, 22 bp, Homo sapiens
catgatggttcttacaaaggtg

SEQ ID NO: 9422213 - DNA, 22 bp, Homo sapiens
catgatctggtcctactgtggg

SEQ ID NO: 9422214 - DNA, 22 bp, Homo sapiens
catgatggatgtgcacttcgct

SEQ ID NO: 9422215 - DNA, 19 bp, Homo sapiens
catgatgagcatcctgcag

SEQ ID NO: 9422216 - DNA, 22 bp, Homo sapiens
catgatcagaaagagaagctag

SEQ ID NO: 9422217 - DNA, 22 bp, Homo sapiens
tcagaagtccccagtcaaggag

SEQ ID NO: 9422218 - DNA, 22 bp, Homo sapiens
tcagaagtcccttgcatcttag

SEQ ID NO: 9422219 - DNA, 22 bp, Homo sapiens
tcagaagtccccagtcaaggag

SEQ ID NO: 9422220 - DNA, 22 bp, Homo sapiens
tcagaagtcccagaattcacat

SEQ ID NO: 9422221 - DNA, 22 bp, Homo sapiens
tcagaagtccaattttcgcacc

SEQ ID NO: 9422222 - DNA, 22 bp, Homo sapiens
tcagaagtcatgctcagtctgt

SEQ ID NO: 9422223 - DNA, 22 bp, Homo sapiens
tcagaagtccaataccatggga

SEQ ID NO: 9422224 - DNA, 22 bp, Homo sapiens
tcagaagtattatgctaaagga

SEQ ID NO: 9422225 - DNA, 22 bp, Homo sapiens
tcagaagtactgtgctacaata

SEQ ID NO: 9422226 - DNA, 22 bp, Homo sapiens
tcagaagtcacttaggaaaggg

SEQ ID NO: 9422227 - DNA, 22 bp, Homo sapiens
tcagaagtcatgctcagtctgt

SEQ ID NO: 9422228 - DNA, 20 bp, Homo sapiens
tcagaaggctccagagcaga

SEQ ID NO: 9422229 - DNA, 22 bp, Homo sapiens
tcagaaggtactgaagacatgg

SEQ ID NO: 9422230 - DNA, 22 bp, Homo sapiens
tcagaaggtacagaagggaggt

SEQ ID NO: 9422231 - DNA, 22 bp, Homo sapiens
tcagaaggtggaggttgcagtg

SEQ ID NO: 9422232 - DNA, 22 bp, Homo sapiens
tcagaaggtttttagcaaagga

SEQ ID NO: 9422233 - DNA, 22 bp, Homo sapiens
tcagaaggtggaggttgcagtg

SEQ ID NO: 9422234 - DNA, 23 bp, Homo sapiens
tcagaaggtgccactgacgcttt

SEQ ID NO: 9422235 - DNA, 22 bp, Homo sapiens
tcagaagtaaggttctcccaag

SEQ ID NO: 9422236 - DNA, 22 bp, Homo sapiens
tcagaagtagctccccttcatt

SEQ ID NO: 9422237 - DNA, 22 bp, Homo sapiens
cagtttctgggaggaaaggaag

SEQ ID NO: 9422238 - DNA, 22 bp, Homo sapiens
cagtttctgccaggatgtgtta

SEQ ID NO: 9422239 - DNA, 22 bp, Homo sapiens
cagtttctgtggtctcttttca

SEQ ID NO: 9422240 - DNA, 22 bp, Homo sapiens
cagtttctgtctgttcttatcc

SEQ ID NO: 9422241 - DNA, 22 bp, Homo sapiens
cagtttctgggcgttcacaggt

SEQ ID NO: 9422242 - DNA, 22 bp, Homo sapiens
cagtttctgggcgttcacaggt

SEQ ID NO: 9422243 - DNA, 22 bp, Homo sapiens
cagtttatatgagggtatcaag

SEQ ID NO: 9422244 - DNA, 22 bp, Homo sapiens
cagtttatatgtcagagctgta

SEQ ID NO: 9422245 - DNA, 22 bp, Homo sapiens
cagtttatatgtcagagctgta

SEQ ID NO: 9422246 - DNA, 22 bp, Homo sapiens
cagtttctctcatacatatttg

SEQ ID NO: 9422247 - DNA, 22 bp, Homo sapiens
cagtttctgaggttccaggttt

SEQ ID NO: 9422248 - DNA, 22 bp, Homo sapiens
cagtttctgagccctgtcattt

SEQ ID NO: 9422249 - DNA, 22 bp, Homo sapiens
cagtttctctcatacatatttg

SEQ ID NO: 9422250 - DNA, 22 bp, Homo sapiens
cagtttcttcatctgcagaatc

SEQ ID NO: 9422251 - DNA, 22 bp, Homo sapiens
cagtttcttcatctgcagaatc

SEQ ID NO: 9422252 - DNA, 22 bp, Homo sapiens
cagtttcttcatcagttaagca

SEQ ID NO: 9422253 - DNA, 22 bp, Homo sapiens
cagtttcttcaattcagacact

SEQ ID NO: 9422254 - DNA, 22 bp, Homo sapiens
cagtttcttcaattcagacact

SEQ ID NO: 9422255 - DNA, 22 bp, Homo sapiens
cagtttcttatcttcaaaattg

SEQ ID NO: 9422256 - DNA, 22 bp, Homo sapiens
cagtttcttatcttcaaaattg

SEQ ID NO: 9422257 - DNA, 22 bp, Homo sapiens
cagtttctgttttaaatagcag

SEQ ID NO: 9422258 - DNA, 22 bp, Homo sapiens
cagtttctgttttaaatagcag

SEQ ID NO: 9422259 - DNA, 22 bp, Homo sapiens
cagtttcttaagactgagatct

SEQ ID NO: 9422260 - DNA, 22 bp, Homo sapiens
cagtttcttaagactgagatct

SEQ ID NO: 9422261 - DNA, 22 bp, Homo sapiens
tcagcagtggctctcatgcagt

SEQ ID NO: 9422262 - DNA, 22 bp, Homo sapiens
tcagcagtgggtcctgagggtg

SEQ ID NO: 9422263 - DNA, 22 bp, Homo sapiens
tcagcagtggctctcatgcagt

SEQ ID NO: 9422264 - DNA, 22 bp, Homo sapiens
tcagcagtggctctcatgcagt

SEQ ID NO: 9422265 - DNA, 22 bp, Homo sapiens
tcagcagtggctctcatgcagt

SEQ ID NO: 9422266 - DNA, 19 bp, Homo sapiens
cagtttgtccagaggggac

SEQ ID NO: 9422267 - DNA, 22 bp, Homo sapiens
tcagcagtgcagggtgaggcag

SEQ ID NO: 9422268 - DNA, 19 bp, Homo sapiens
tcagcccaggctgggaagc

SEQ ID NO: 9422269 - DNA, 22 bp, Homo sapiens
tcagcccagggacagaggcccc

SEQ ID NO: 9422270 - DNA, 20 bp, Homo sapiens
tcagcccagggtgagcatct

SEQ ID NO: 9422271 - DNA, 22 bp, Homo sapiens
tcagcccaggtcacgtaatcaa

SEQ ID NO: 9422272 - DNA, 22 bp, Homo sapiens
cagtttggcagcaacatggcga

SEQ ID NO: 9422273 - DNA, 17 bp, Homo sapiens
cagtttggtggatataa

SEQ ID NO: 9422274 - DNA, 22 bp, Homo sapiens
cagtttgtatttattactcata

SEQ ID NO: 9422275 - DNA, 22 bp, Homo sapiens
cagtttctttccattgttacct

SEQ ID NO: 9422276 - DNA, 22 bp, Homo sapiens
cagtttgcataacaagagattc

SEQ ID NO: 9422277 - DNA, 22 bp, Homo sapiens
cagtttcttctattttgaacta

SEQ ID NO: 9422278 - DNA, 22 bp, Homo sapiens
cagtttcttggatgccaatttc

SEQ ID NO: 9422279 - DNA, 22 bp, Homo sapiens
catactattactaggagcagga

SEQ ID NO: 9422280 - DNA, 22 bp, Homo sapiens
catactcactgttgtatcttcg

SEQ ID NO: 9422281 - DNA, 21 bp, Homo sapiens
catactcagtgtataacttct

SEQ ID NO: 9422282 - DNA, 22 bp, Homo sapiens
catacattttgcatatttacca

SEQ ID NO: 9422283 - DNA, 22 bp, Homo sapiens
catacattttgcatatttacca

SEQ ID NO: 9422284 - DNA, 22 bp, Homo sapiens
catacattttgcatatttacca

SEQ ID NO: 9422285 - DNA, 22 bp, Homo sapiens
catacattttgcatatttacca

SEQ ID NO: 9422286 - DNA, 22 bp, Homo sapiens
catacctttctcaagcacatgt

SEQ ID NO: 9422287 - DNA, 17 bp, Homo sapiens
catacctgagagttata

SEQ ID NO: 9422288 - DNA, 22 bp, Homo sapiens
tcaggaagtataatcagattca

SEQ ID NO: 9422289 - DNA, 22 bp, Homo sapiens
catagaaaagagtaggtaatgt

SEQ ID NO: 9422290 - DNA, 22 bp, Homo sapiens
catacttttgccctgacattct

SEQ ID NO: 9422291 - DNA, 22 bp, Homo sapiens
tcagctgcagtttcacaagcac

SEQ ID NO: 9422292 - DNA, 22 bp, Homo sapiens
tcagctgcagcaggcaccattt

SEQ ID NO: 9422293 - DNA, 22 bp, Homo sapiens
tcagctgcataagtcaccttgc

SEQ ID NO: 9422294 - DNA, 22 bp, Homo sapiens
catacattacctaacttaatgc

SEQ ID NO: 9422295 - DNA, 22 bp, Homo sapiens
catacatttatacacatctatg

SEQ ID NO: 9422296 - DNA, 22 bp, Homo sapiens
catacatttatacacatctatg

SEQ ID NO: 9422297 - DNA, 22 bp, Homo sapiens
catacatttatacacatctatg

SEQ ID NO: 9422298 - DNA, 22 bp, Homo sapiens
catacattgctcattcagtatc

SEQ ID NO: 9422299 - DNA, 22 bp, Homo sapiens
catacattgctcattcagtatc

SEQ ID NO: 9422300 - DNA, 22 bp, Homo sapiens
tcagccctgggcttcctcatgg

SEQ ID NO: 9422301 - DNA, 22 bp, Homo sapiens
tcagccctgggcttcctcatgg

SEQ ID NO: 9422302 - DNA, 19 bp, Homo sapiens
tcagctctggggtcagtgg

SEQ ID NO: 9422303 - DNA, 20 bp, Homo sapiens
tcagctctgtgcctgggatg

SEQ ID NO: 9422304 - DNA, 20 bp, Homo sapiens
tcagctctgtgcctgggatg

SEQ ID NO: 9422305 - DNA, 22 bp, Homo sapiens
tcagctctgttttgagtggaac

SEQ ID NO: 9422306 - DNA, 22 bp, Homo sapiens
tcagctcttccccccagccagg

SEQ ID NO: 9422307 - DNA, 20 bp, Homo sapiens
tcagctcttagaggtcgctt

SEQ ID NO: 9422308 - DNA, 22 bp, Homo sapiens
tcagctcttaaccctctggcct

SEQ ID NO: 9422309 - DNA, 22 bp, Homo sapiens
tcagctcttaaccctctggcct

SEQ ID NO: 9422310 - DNA, 22 bp, Homo sapiens
tcagctgcactgttctgaccca

SEQ ID NO: 9422311 - DNA, 22 bp, Homo sapiens
tcagctgagttctagagcactc

SEQ ID NO: 9422312 - DNA, 22 bp, Homo sapiens
tcagccctagaaagtctaagca

SEQ ID NO: 9422313 - DNA, 22 bp, Homo sapiens
tcagccctagaaagtctaagca

SEQ ID NO: 9422314 - DNA, 22 bp, Homo sapiens
tcagccctagaaagtctaagca

SEQ ID NO: 9422315 - DNA, 22 bp, Homo sapiens
tcagccctggcactgtctccca

SEQ ID NO: 9422316 - DNA, 22 bp, Homo sapiens
tcagccctggcactgtctccca

SEQ ID NO: 9422317 - DNA, 20 bp, Homo sapiens
tcagccctgagtccaggctg

SEQ ID NO: 9422318 - DNA, 22 bp, Homo sapiens
tcagccctgggacccagggatg

SEQ ID NO: 9422319 - DNA, 19 bp, Homo sapiens
tcagcccatcagactcaca

SEQ ID NO: 9422320 - DNA, 22 bp, Homo sapiens
tcagcccatcactcacgtatta

SEQ ID NO: 9422321 - DNA, 22 bp, Homo sapiens
tcagccctacattaggtaagcc

SEQ ID NO: 9422322 - DNA, 22 bp, Homo sapiens
tcagcccagttttatcatctgt

SEQ ID NO: 9422323 - DNA, 22 bp, Homo sapiens
tcagcccagttaagaacctgtt

SEQ ID NO: 9422324 - DNA, 22 bp, Homo sapiens
tcagcccagttttatcatctgt

SEQ ID NO: 9422325 - DNA, 21 bp, Homo sapiens
tcagcccaggtgtctttgccc

SEQ ID NO: 9422326 - DNA, 22 bp, Homo sapiens
tcagcccagttaagaacctgtt

SEQ ID NO: 9422327 - DNA, 22 bp, Homo sapiens
catatactgcatacatatgtgt

SEQ ID NO: 9422328 - DNA, 22 bp, Homo sapiens
catatacacttccacctctgtg

SEQ ID NO: 9422329 - DNA, 20 bp, Homo sapiens
catatatacctagaagtgga

SEQ ID NO: 9422330 - DNA, 20 bp, Homo sapiens
catatatacctagaagtgga

SEQ ID NO: 9422331 - DNA, 20 bp, Homo sapiens
catatatacctagaagtgga

SEQ ID NO: 9422332 - DNA, 22 bp, Homo sapiens
catatattctggttttcactgg

SEQ ID NO: 9422333 - DNA, 22 bp, Homo sapiens
catatcatttgcttataaatct

SEQ ID NO: 9422334 - DNA, 15 bp, Homo sapiens
catatcactgggaat

SEQ ID NO: 9422335 - DNA, 22 bp, Homo sapiens
catatcataggtcttggataat

SEQ ID NO: 9422336 - DNA, 22 bp, Homo sapiens
catatcttatggttttctaagt

SEQ ID NO: 9422337 - DNA, 22 bp, Homo sapiens
catatcttctgacatgatcagg

SEQ ID NO: 9422338 - DNA, 22 bp, Homo sapiens
catatgaaatatgagttgaaca

SEQ ID NO: 9422339 - DNA, 23 bp, Homo sapiens
catatgaattttagaggcagttt

SEQ ID NO: 9422340 - DNA, 20 bp, Homo sapiens
catatggaaagatattgttc

SEQ ID NO: 9422341 - DNA, 22 bp, Homo sapiens
tcaggaagtggtaaaggatgtt

SEQ ID NO: 9422342 - DNA, 22 bp, Homo sapiens
tcaggaagtggtaaaggatgtt

SEQ ID NO: 9422343 - DNA, 22 bp, Homo sapiens
tcaggaagtggtaaaggatgtt

SEQ ID NO: 9422344 - DNA, 22 bp, Homo sapiens
tcaggaagtggtaaaggatgtt

SEQ ID NO: 9422345 - DNA, 22 bp, Homo sapiens
tcaggaagtggtaaaggatgtt

SEQ ID NO: 9422346 - DNA, 22 bp, Homo sapiens
tcaggaagtggtaaaggatgtt

SEQ ID NO: 9422347 - DNA, 22 bp, Homo sapiens
tcaggaagttgaggcgtagaga

SEQ ID NO: 9422348 - DNA, 22 bp, Homo sapiens
tcaggaagtctcaattagctac

SEQ ID NO: 9422349 - DNA, 22 bp, Homo sapiens
tcaggaagtgcctaggctggcc

SEQ ID NO: 9422350 - DNA, 22 bp, Homo sapiens
tcaggaagtgcctaggctggcc

SEQ ID NO: 9422351 - DNA, 22 bp, Homo sapiens
tcaggaagtgcctaggctggcc

SEQ ID NO: 9422352 - DNA, 22 bp, Homo sapiens
tcaggaagtgctgaggctgctt

SEQ ID NO: 9422353 - DNA, 22 bp, Homo sapiens
tcaggaagtgctgaggctgctt

SEQ ID NO: 9422354 - DNA, 22 bp, Homo sapiens
tcaggaagtgctgaggctgctt

SEQ ID NO: 9422355 - DNA, 22 bp, Homo sapiens
tcaggaagtgcctaggctggcc

SEQ ID NO: 9422356 - DNA, 22 bp, Homo sapiens
tcaggaagtgcctaggctggcc

SEQ ID NO: 9422357 - DNA, 22 bp, Homo sapiens
catatacacttccacctctgtg

SEQ ID NO: 9422358 - DNA, 22 bp, Homo sapiens
catataatgtttgaagatgtgg

SEQ ID NO: 9422359 - DNA, 19 bp, Homo sapiens
tcaggaagttgatgaggtg

SEQ ID NO: 9422360 - DNA, 22 bp, Homo sapiens
tcaggaagttgaggcgtagaga

SEQ ID NO: 9422361 - DNA, 19 bp, Homo sapiens
tcaggaagttgatgaggtg

SEQ ID NO: 9422362 - DNA, 19 bp, Homo sapiens
tcaggaagttgatgaggtg

SEQ ID NO: 9422363 - DNA, 22 bp, Homo sapiens
catataaatacaacatgtgtta

SEQ ID NO: 9422364 - DNA, 22 bp, Homo sapiens
catataaatacaacatgtgtta

SEQ ID NO: 9422365 - DNA, 21 bp, Homo sapiens
catcacattactcaaagtcct

SEQ ID NO: 9422366 - DNA, 22 bp, Homo sapiens
catcacatgtaggcagcatcac

SEQ ID NO: 9422367 - DNA, 22 bp, Homo sapiens
catcacatgtaggcagcatcac

SEQ ID NO: 9422368 - DNA, 19 bp, Homo sapiens
catcacatggtctgatgaa

SEQ ID NO: 9422369 - DNA, 22 bp, Homo sapiens
catcacatcagtgtgaacagtt

SEQ ID NO: 9422370 - DNA, 22 bp, Homo sapiens
catcacatgcctatcatgagct

SEQ ID NO: 9422371 - DNA, 22 bp, Homo sapiens
catcacatgcctatcatgagct

SEQ ID NO: 9422372 - DNA, 22 bp, Homo sapiens
catcacagggggctagaagtct

SEQ ID NO: 9422373 - DNA, 22 bp, Homo sapiens
catcacaggtcctgatgacatt

SEQ ID NO: 9422374 - DNA, 22 bp, Homo sapiens
catcacagtttgtcagaaatca

SEQ ID NO: 9422375 - DNA, 22 bp, Homo sapiens
catcacagtttgtcagaaatca

SEQ ID NO: 9422376 - DNA, 22 bp, Homo sapiens
catccaatgtcctattaagact

SEQ ID NO: 9422377 - DNA, 22 bp, Homo sapiens
catccactagaatgacagagtt

SEQ ID NO: 9422378 - DNA, 22 bp, Homo sapiens
catccagaccgtgccatgctgc

SEQ ID NO: 9422379 - DNA, 22 bp, Homo sapiens
catccagaccgtgccatgctgc

SEQ ID NO: 9422380 - DNA, 22 bp, Homo sapiens
catccagctcctgggggccacc

SEQ ID NO: 9422381 - DNA, 23 bp, Homo sapiens
catccaggagctgagtctgactg

SEQ ID NO: 9422382 - DNA, 22 bp, Homo sapiens
catccagctcctgggggccacc

SEQ ID NO: 9422383 - DNA, 22 bp, Homo sapiens
catccaggcaccacaaccagct

SEQ ID NO: 9422384 - DNA, 22 bp, Homo sapiens
tcagggcattcaagaggcctgg

SEQ ID NO: 9422385 - DNA, 22 bp, Homo sapiens
tcagggcattcaagaggcctgg

SEQ ID NO: 9422386 - DNA, 20 bp, Homo sapiens
tcagggcatgggacagcccc

SEQ ID NO: 9422387 - DNA, 20 bp, Homo sapiens
tcagggcatgggacagcccc

SEQ ID NO: 9422388 - DNA, 22 bp, Homo sapiens
tcagggattgcaaaattcatcc

SEQ ID NO: 9422389 - DNA, 22 bp, Homo sapiens
tcagggattgcaaaattcatcc

SEQ ID NO: 9422390 - DNA, 22 bp, Homo sapiens
tcagggcatggctgcacttggc

SEQ ID NO: 9422391 - DNA, 20 bp, Homo sapiens
tcagggcatgggacagcccc

SEQ ID NO: 9422392 - DNA, 22 bp, Homo sapiens
tcagggcatggctgcacttggc

SEQ ID NO: 9422393 - DNA, 22 bp, Homo sapiens
catatggacaagaacatttatg

SEQ ID NO: 9422394 - DNA, 22 bp, Homo sapiens
tcagggattgcaaaattcatcc

SEQ ID NO: 9422395 - DNA, 22 bp, Homo sapiens
catcacagaaataaacatacct

SEQ ID NO: 9422396 - DNA, 19 bp, Homo sapiens
ccagcccatagtccatcac

SEQ ID NO: 9422397 - DNA, 19 bp, Homo sapiens
ccagcccatagtccatcac

SEQ ID NO: 9422398 - DNA, 22 bp, Homo sapiens
ccagcccatgcccttatagcat

SEQ ID NO: 9422399 - DNA, 19 bp, Homo sapiens
ccagcccatagtccatcac

SEQ ID NO: 9422400 - DNA, 19 bp, Homo sapiens
ccagcccatagtccatcac

SEQ ID NO: 9422401 - DNA, 19 bp, Homo sapiens
ccagcccatagtccatcac

SEQ ID NO: 9422402 - DNA, 22 bp, Homo sapiens
ccagcccatgcccttatagcat

SEQ ID NO: 9422403 - DNA, 19 bp, Homo sapiens
ccagcccatagtccatcac

SEQ ID NO: 9422404 - DNA, 22 bp, Homo sapiens
ccagccccgggaacctggccgt

SEQ ID NO: 9422405 - DNA, 22 bp, Homo sapiens
ccagcccctatcctcgctccac

SEQ ID NO: 9422406 - DNA, 22 bp, Homo sapiens
ccagcccctatcctcgctccac

SEQ ID NO: 9422407 - DNA, 22 bp, Homo sapiens
ccagccccgggaacctggccgt

SEQ ID NO: 9422408 - DNA, 22 bp, Homo sapiens
ccagccccgggaacctggccgt

SEQ ID NO: 9422409 - DNA, 22 bp, Homo sapiens
ccagccccgggaacctggccgt

SEQ ID NO: 9422410 - DNA, 22 bp, Homo sapiens
ccagcccctatcctcgctccac

SEQ ID NO: 9422411 - DNA, 21 bp, Homo sapiens
ccagcccagcctccttctctt

SEQ ID NO: 9422412 - DNA, 21 bp, Homo sapiens
ccagcccagcctccttctctt

SEQ ID NO: 9422413 - DNA, 19 bp, Homo sapiens
ccagcccacagtgactttc

SEQ ID NO: 9422414 - DNA, 19 bp, Homo sapiens
ccagcccacagtgactttc

SEQ ID NO: 9422415 - DNA, 19 bp, Homo sapiens
ccagcccacagtgactttc

SEQ ID NO: 9422416 - DNA, 21 bp, Homo sapiens
ccagcccagctgtgtcccagc

SEQ ID NO: 9422417 - DNA, 21 bp, Homo sapiens
ccagcccagcctccttctctt

SEQ ID NO: 9422418 - DNA, 21 bp, Homo sapiens
ccagcccagctgtgtcccagc

SEQ ID NO: 9422419 - DNA, 22 bp, Homo sapiens
ccagccatgggccacctagctg

SEQ ID NO: 9422420 - DNA, 22 bp, Homo sapiens
ccagccatgggccacctagctg

SEQ ID NO: 9422421 - DNA, 22 bp, Homo sapiens
ccagcccaaacaagccgccttc

SEQ ID NO: 9422422 - DNA, 22 bp, Homo sapiens
ccagcccaaacaagccgccttc

SEQ ID NO: 9422423 - DNA, 22 bp, Homo sapiens
ccagccatgggccacctagctg

SEQ ID NO: 9422424 - DNA, 22 bp, Homo sapiens
ccagccataatacgaacccagc

SEQ ID NO: 9422425 - DNA, 22 bp, Homo sapiens
ccagccataatacgaacccagc

SEQ ID NO: 9422426 - DNA, 22 bp, Homo sapiens
ccagccataatacgaacccagc

SEQ ID NO: 9422427 - DNA, 22 bp, Homo sapiens
ccagcccaaacaagccgccttc

SEQ ID NO: 9422428 - DNA, 22 bp, Homo sapiens
ccagcccaaacaagccgccttc

SEQ ID NO: 9422429 - DNA, 22 bp, Homo sapiens
ccagcccaaagtcaccccggga

SEQ ID NO: 9422430 - DNA, 22 bp, Homo sapiens
ccagcccaaagtcaccccggga

SEQ ID NO: 9422431 - DNA, 22 bp, Homo sapiens
tctgaggcaaacagaggagtgt

SEQ ID NO: 9422432 - DNA, 22 bp, Homo sapiens
tctgaggcaaacagaggagtgt

SEQ ID NO: 9422433 - DNA, 22 bp, Homo sapiens
tctgaggcaaacagaggagtgt

SEQ ID NO: 9422434 - DNA, 22 bp, Homo sapiens
tctgaggcagcttgccactcta

SEQ ID NO: 9422435 - DNA, 22 bp, Homo sapiens
tctgaggcagcttgccactcta

SEQ ID NO: 9422436 - DNA, 22 bp, Homo sapiens
tctgaggcagcttgccactcta

SEQ ID NO: 9422437 - DNA, 22 bp, Homo sapiens
tctgaggacctactgaagagtt

SEQ ID NO: 9422438 - DNA, 22 bp, Homo sapiens
tctgaggactattgcaatactt

SEQ ID NO: 9422439 - DNA, 22 bp, Homo sapiens
tctgaggagtgaccctcttgca

SEQ ID NO: 9422440 - DNA, 21 bp, Homo sapiens
tctgaggagaaactcttggtg

SEQ ID NO: 9422441 - DNA, 22 bp, Homo sapiens
tctgaggagttgggccagtgct

SEQ ID NO: 9422442 - DNA, 22 bp, Homo sapiens
tctgaggagttgggccagtgct

SEQ ID NO: 9422443 - DNA, 22 bp, Homo sapiens
tctgaggagttgggccagtgct

SEQ ID NO: 9422444 - DNA, 22 bp, Homo sapiens
tctgaggatagaggcaatagga

SEQ ID NO: 9422445 - DNA, 22 bp, Homo sapiens
tctgaggacagtgctgtgcctg

SEQ ID NO: 9422446 - DNA, 22 bp, Homo sapiens
tctgaggacagtgctgtgcctg

SEQ ID NO: 9422447 - DNA, 22 bp, Homo sapiens
tctgaggaccatcggggagctg

SEQ ID NO: 9422448 - DNA, 22 bp, Homo sapiens
tctgaggacaaactgcatgctg

SEQ ID NO: 9422449 - DNA, 22 bp, Homo sapiens
tctgagagtctttcttcaagtg

SEQ ID NO: 9422450 - DNA, 22 bp, Homo sapiens
tctgagagtctttcttcaagtg

SEQ ID NO: 9422451 - DNA, 22 bp, Homo sapiens
ccagccctacagtatcacctgt

SEQ ID NO: 9422452 - DNA, 20 bp, Homo sapiens
tctgagagtctgagtgatga

SEQ ID NO: 9422453 - DNA, 22 bp, Homo sapiens
tctgaggccccagccctgcaca

SEQ ID NO: 9422454 - DNA, 22 bp, Homo sapiens
tctgaggccccagccctgcaca

SEQ ID NO: 9422455 - DNA, 22 bp, Homo sapiens
tctgaggccccagccctgcaca

SEQ ID NO: 9422456 - DNA, 22 bp, Homo sapiens
tctgaggcccctgggcaggatg

SEQ ID NO: 9422457 - DNA, 22 bp, Homo sapiens
tctgaggcccctgggcaggatg

SEQ ID NO: 9422458 - DNA, 22 bp, Homo sapiens
tctgaggcccctgggcaggatg

SEQ ID NO: 9422459 - DNA, 22 bp, Homo sapiens
tctgagtcttggggtccctatt

SEQ ID NO: 9422460 - DNA, 22 bp, Homo sapiens
tctgaggccctaccctgagcct

SEQ ID NO: 9422461 - DNA, 22 bp, Homo sapiens
tctgaggcccagttcaactctt

SEQ ID NO: 9422462 - DNA, 22 bp, Homo sapiens
tctgaggcccagttcaactctt

SEQ ID NO: 9422463 - DNA, 22 bp, Homo sapiens
tctgaggcccagttcaactctt

SEQ ID NO: 9422464 - DNA, 22 bp, Homo sapiens
tctgaggcatacccaggccccc

SEQ ID NO: 9422465 - DNA, 22 bp, Homo sapiens
tctgaggcatttaattatgacc

SEQ ID NO: 9422466 - DNA, 22 bp, Homo sapiens
tctgaggcatttaattatgacc

SEQ ID NO: 9422467 - DNA, 22 bp, Homo sapiens
tctgaggcataacctgttctgc

SEQ ID NO: 9422468 - DNA, 22 bp, Homo sapiens
tctgaggcataacctgttctgc

SEQ ID NO: 9422469 - DNA, 22 bp, Homo sapiens
tctgaggcatacccaggccccc

SEQ ID NO: 9422470 - DNA, 22 bp, Homo sapiens
tctgaggcatacccaggccccc

SEQ ID NO: 9422471 - DNA, 22 bp, Homo sapiens
tctgaggcatacccaggccccc

SEQ ID NO: 9422472 - DNA, 22 bp, Homo sapiens
tctgaggcatacccaggccccc

SEQ ID NO: 9422473 - DNA, 22 bp, Homo sapiens
ccagccataaacccagatgact

SEQ ID NO: 9422474 - DNA, 22 bp, Homo sapiens
ccagccataaacccagatgact

SEQ ID NO: 9422475 - DNA, 22 bp, Homo sapiens
ccagccataaacccagatgact

SEQ ID NO: 9422476 - DNA, 22 bp, Homo sapiens
ccagccagtcccgcatgaccgc

SEQ ID NO: 9422477 - DNA, 22 bp, Homo sapiens
ccagccagtcccgcatgaccgc

SEQ ID NO: 9422478 - DNA, 22 bp, Homo sapiens
ccagccagtccagcattggtgt

SEQ ID NO: 9422479 - DNA, 22 bp, Homo sapiens
ccagccagtcccgcatgaccgc

SEQ ID NO: 9422480 - DNA, 22 bp, Homo sapiens
ccagccagtatattccaaagcc

SEQ ID NO: 9422481 - DNA, 22 bp, Homo sapiens
ccagccactgggccactgccag

SEQ ID NO: 9422482 - DNA, 22 bp, Homo sapiens
ccagccactgggccactgccag

SEQ ID NO: 9422483 - DNA, 22 bp, Homo sapiens
ccagccactgggccactgccag

SEQ ID NO: 9422484 - DNA, 22 bp, Homo sapiens
ccagccacgaagctcccttcat

SEQ ID NO: 9422485 - DNA, 22 bp, Homo sapiens
ccagccacgaagctcccttcat

SEQ ID NO: 9422486 - DNA, 22 bp, Homo sapiens
ccagccacgaagctcccttcat

SEQ ID NO: 9422487 - DNA, 22 bp, Homo sapiens
tctgaaatctgtaagcactagc

SEQ ID NO: 9422488 - DNA, 22 bp, Homo sapiens
tctgaaatcctttatcttggct

SEQ ID NO: 9422489 - DNA, 22 bp, Homo sapiens
tctcttggtgacttaaaatgtt

SEQ ID NO: 9422490 - DNA, 22 bp, Homo sapiens
tctctcttcatgcttttagaat

SEQ ID NO: 9422491 - DNA, 22 bp, Homo sapiens
tctctcttgaagtattagctag

SEQ ID NO: 9422492 - DNA, 22 bp, Homo sapiens
tctctcttgaagtattagctag

SEQ ID NO: 9422493 - DNA, 22 bp, Homo sapiens
tctctcttgaagtattagctag

SEQ ID NO: 9422494 - DNA, 23 bp, Homo sapiens
tctctcttagctatgcttatggc

SEQ ID NO: 9422495 - DNA, 23 bp, Homo sapiens
tctctcttagctatgcttatggc

SEQ ID NO: 9422496 - DNA, 16 bp, Homo sapiens
tctctctgtatttgct

SEQ ID NO: 9422497 - DNA, 22 bp, Homo sapiens
tctctcttcaacccttaactag

SEQ ID NO: 9422498 - DNA, 22 bp, Homo sapiens
tctcttggacatgtggctctgc

SEQ ID NO: 9422499 - DNA, 22 bp, Homo sapiens
tctcttggaaagcttgcccact

SEQ ID NO: 9422500 - DNA, 22 bp, Homo sapiens
tctcttggaggttcttcctgtt

SEQ ID NO: 9422501 - DNA, 22 bp, Homo sapiens
tctcttgggaggaaagagagaa

SEQ ID NO: 9422502 - DNA, 22 bp, Homo sapiens
tctcttgggaggaaagagagaa

SEQ ID NO: 9422503 - DNA, 22 bp, Homo sapiens
tctcttctttggggtgggctca

SEQ ID NO: 9422504 - DNA, 22 bp, Homo sapiens
tctcttaataagtaaatactga

SEQ ID NO: 9422505 - DNA, 22 bp, Homo sapiens
tctcttgaagattgaagacaaa

SEQ ID NO: 9422506 - DNA, 22 bp, Homo sapiens
tctcttaataagtaaatactga

SEQ ID NO: 9422507 - DNA, 22 bp, Homo sapiens
tctcttaataagtaaatactga

SEQ ID NO: 9422508 - DNA, 22 bp, Homo sapiens
tctcttaactggttcagcaatt

SEQ ID NO: 9422509 - DNA, 22 bp, Homo sapiens
tctcttaactggttcagcaatt

SEQ ID NO: 9422510 - DNA, 22 bp, Homo sapiens
tctcttgatatattacatagag

SEQ ID NO: 9422511 - DNA, 22 bp, Homo sapiens
tctcttgagctcagttctgatg

SEQ ID NO: 9422512 - DNA, 22 bp, Homo sapiens
tctcttgactgctaaaattaga

SEQ ID NO: 9422513 - DNA, 22 bp, Homo sapiens
tctcttgaagattgaagacaaa

SEQ ID NO: 9422514 - DNA, 22 bp, Homo sapiens
ccagcctggttcagaattggct

SEQ ID NO: 9422515 - DNA, 22 bp, Homo sapiens
ccagccttactgcccttcagtg

SEQ ID NO: 9422516 - DNA, 22 bp, Homo sapiens
ccagcctggggaggcagcttct

SEQ ID NO: 9422517 - DNA, 22 bp, Homo sapiens
ccagccttgggggatccaggac

SEQ ID NO: 9422518 - DNA, 19 bp, Homo sapiens
ccagcctttccagtgattg

SEQ ID NO: 9422519 - DNA, 22 bp, Homo sapiens
ccagccttggctttcctagccc

SEQ ID NO: 9422520 - DNA, 22 bp, Homo sapiens
ccagccttgcaccgagccagcc

SEQ ID NO: 9422521 - DNA, 22 bp, Homo sapiens
ccagccttgactgccccagcac

SEQ ID NO: 9422522 - DNA, 22 bp, Homo sapiens
ccagccttctgggactctcatc

SEQ ID NO: 9422523 - DNA, 22 bp, Homo sapiens
ccagctccagcatagccaccat

SEQ ID NO: 9422524 - DNA, 22 bp, Homo sapiens
ccagctccagcatagccaccat

SEQ ID NO: 9422525 - DNA, 22 bp, Homo sapiens
ccagctccagcatagccaccat

SEQ ID NO: 9422526 - DNA, 22 bp, Homo sapiens
ccagctccactgtcagatgaga

SEQ ID NO: 9422527 - DNA, 22 bp, Homo sapiens
ccagctccaagtttgggcatca

SEQ ID NO: 9422528 - DNA, 22 bp, Homo sapiens
ccagcctggactgggtcttgtg

SEQ ID NO: 9422529 - DNA, 21 bp, Homo sapiens
ccagcctcagatcagggagct

SEQ ID NO: 9422530 - DNA, 22 bp, Homo sapiens
ccagcctcatcatattcctgct

SEQ ID NO: 9422531 - DNA, 22 bp, Homo sapiens
ccagcctcatcatattcctgct

SEQ ID NO: 9422532 - DNA, 22 bp, Homo sapiens
tctgataggtggtagaaggagg

SEQ ID NO: 9422533 - DNA, 22 bp, Homo sapiens
tctgataatggacttctcatct

SEQ ID NO: 9422534 - DNA, 22 bp, Homo sapiens
tctgataatgtgcttcgtgacc

SEQ ID NO: 9422535 - DNA, 22 bp, Homo sapiens
ccagcctggagggcagtggtgg

SEQ ID NO: 9422536 - DNA, 22 bp, Homo sapiens
ccagcctggggaggcagcttct

SEQ ID NO: 9422537 - DNA, 22 bp, Homo sapiens
ccagcctggggaggcagcttct

SEQ ID NO: 9422538 - DNA, 22 bp, Homo sapiens
ccagcctggagggcagtggtgg

SEQ ID NO: 9422539 - DNA, 22 bp, Homo sapiens
ccagcctggagggcagtggtgg

SEQ ID NO: 9422540 - DNA, 22 bp, Homo sapiens
ccagcctggagggcagtggtgg

SEQ ID NO: 9422541 - DNA, 22 bp, Homo sapiens
tctgataaatgccatctttttg

SEQ ID NO: 9422542 - DNA, 22 bp, Homo sapiens
tctgagtttaggaccaggctga

SEQ ID NO: 9422543 - DNA, 22 bp, Homo sapiens
tctgataacaaccatgtctggc

SEQ ID NO: 9422544 - DNA, 22 bp, Homo sapiens
tctgataagacagctgatttga

SEQ ID NO: 9422545 - DNA, 22 bp, Homo sapiens
tctgataagtggtgtatactgt

SEQ ID NO: 9422546 - DNA, 22 bp, Homo sapiens
tctgagtgatgttgagtcagaa

SEQ ID NO: 9422547 - DNA, 19 bp, Homo sapiens
tctgagtgagggttatcct

SEQ ID NO: 9422548 - DNA, 22 bp, Homo sapiens
tctgagtgacgtcctgacagga

SEQ ID NO: 9422549 - DNA, 22 bp, Homo sapiens
tctgagtgagtgtaggcctgac

SEQ ID NO: 9422550 - DNA, 22 bp, Homo sapiens
tctgagtcttggggtccctatt

SEQ ID NO: 9422551 - DNA, 22 bp, Homo sapiens
tctgagtgacgtcctgacagga

SEQ ID NO: 9422552 - DNA, 22 bp, Homo sapiens
tctgagtgtgactggttaatga

SEQ ID NO: 9422553 - DNA, 23 bp, Homo sapiens
tctgagtgattagcctctggggt

SEQ ID NO: 9422554 - DNA, 22 bp, Homo sapiens
tctgagtggactgtcctgcagg

SEQ ID NO: 9422555 - DNA, 22 bp, Homo sapiens
tctgagtgggaactctcatgac

SEQ ID NO: 9422556 - DNA, 22 bp, Homo sapiens
tctgagtgggaactctcatgac

SEQ ID NO: 9422557 - DNA, 22 bp, Homo sapiens
tctgcctcgctaacagcagcca

SEQ ID NO: 9422558 - DNA, 19 bp, Homo sapiens
tctgcctctggtcaggctc

SEQ ID NO: 9422559 - DNA, 22 bp, Homo sapiens
tctgcctcctgcttgtcccgac

SEQ ID NO: 9422560 - DNA, 22 bp, Homo sapiens
tctgcctcctgcttgtcccgac

SEQ ID NO: 9422561 - DNA, 22 bp, Homo sapiens
tctgcctcctgcttgtcccgac

SEQ ID NO: 9422562 - DNA, 22 bp, Homo sapiens
tctgcctcgctaacagcagcca

SEQ ID NO: 9422563 - DNA, 22 bp, Homo sapiens
tctgcctcgctaacagcagcca

SEQ ID NO: 9422564 - DNA, 22 bp, Homo sapiens
tctgcctcgctaacagcagcca

SEQ ID NO: 9422565 - DNA, 21 bp, Homo sapiens
tctgccagctgaagaggtgga

SEQ ID NO: 9422566 - DNA, 22 bp, Homo sapiens
tctgcctcctgcttgtcccgac

SEQ ID NO: 9422567 - DNA, 22 bp, Homo sapiens
tctgcctagtgggacagcagcc

SEQ ID NO: 9422568 - DNA, 22 bp, Homo sapiens
tctgccaggagccatgagcaag

SEQ ID NO: 9422569 - DNA, 20 bp, Homo sapiens
tctgccactgcactctgccc

SEQ ID NO: 9422570 - DNA, 22 bp, Homo sapiens
tctgccactgtgatgcatgata

SEQ ID NO: 9422571 - DNA, 22 bp, Homo sapiens
tctgccactgtggccatgggag

SEQ ID NO: 9422572 - DNA, 22 bp, Homo sapiens
tctgccacttacctccatgtac

SEQ ID NO: 9422573 - DNA, 20 bp, Homo sapiens
tctgccactgcactctgccc

SEQ ID NO: 9422574 - DNA, 22 bp, Homo sapiens
tctgccactgtgatgcatgata

SEQ ID NO: 9422575 - DNA, 20 bp, Homo sapiens
tctgccactgcactctgccc

SEQ ID NO: 9422576 - DNA, 22 bp, Homo sapiens
tctgccagaagccagggtctgg

SEQ ID NO: 9422577 - DNA, 20 bp, Homo sapiens
tctgccactttttctgtcac

SEQ ID NO: 9422578 - DNA, 22 bp, Homo sapiens
tctgccacttttgcttactggg

SEQ ID NO: 9422579 - DNA, 22 bp, Homo sapiens
tctgccagaagccagggtctgg

SEQ ID NO: 9422580 - DNA, 22 bp, Homo sapiens
tctgccagaagttctgagagta

SEQ ID NO: 9422581 - DNA, 22 bp, Homo sapiens
tctgccagaagttctgagagta

SEQ ID NO: 9422582 - DNA, 22 bp, Homo sapiens
tctgccagcaccatgatccttc

SEQ ID NO: 9422583 - DNA, 22 bp, Homo sapiens
tctgccagccctgtgagtcttg

SEQ ID NO: 9422584 - DNA, 22 bp, Homo sapiens
ccagctctagccccatgtggct

SEQ ID NO: 9422585 - DNA, 22 bp, Homo sapiens
ccagctctagccccatgtggct

SEQ ID NO: 9422586 - DNA, 22 bp, Homo sapiens
tctgccaccacctacactagta

SEQ ID NO: 9422587 - DNA, 22 bp, Homo sapiens
tctgccaccttcatcctccact

SEQ ID NO: 9422588 - DNA, 22 bp, Homo sapiens
ccagctccttctgtctgtggag

SEQ ID NO: 9422589 - DNA, 22 bp, Homo sapiens
ccagctctaaacggctctgtgg

SEQ ID NO: 9422590 - DNA, 22 bp, Homo sapiens
ccagctcctcttgtctctagca

SEQ ID NO: 9422591 - DNA, 22 bp, Homo sapiens
ccagctcctcttcccagtgtca

SEQ ID NO: 9422592 - DNA, 22 bp, Homo sapiens
ccagctcctcttcccagtgtca

SEQ ID NO: 9422593 - DNA, 22 bp, Homo sapiens
ccagctcctcttcccagtgtca

SEQ ID NO: 9422594 - DNA, 22 bp, Homo sapiens
ccagctcctcttcccagtgtca

SEQ ID NO: 9422595 - DNA, 22 bp, Homo sapiens
ccagctcctgagcatggtttcc

SEQ ID NO: 9422596 - DNA, 22 bp, Homo sapiens
ccagctccaggactgggagctg

SEQ ID NO: 9422597 - DNA, 22 bp, Homo sapiens
ccagctccaggactgggagctg

SEQ ID NO: 9422598 - DNA, 21 bp, Homo sapiens
ccagctccaggaccttggatc

SEQ ID NO: 9422599 - DNA, 21 bp, Homo sapiens
ccagctccaggaccttggatc

SEQ ID NO: 9422600 - DNA, 22 bp, Homo sapiens
ccagctcctcttcccagtgtca

SEQ ID NO: 9422601 - DNA, 22 bp, Homo sapiens
ccagctcctcttcccagtgtca

SEQ ID NO: 9422602 - DNA, 23 bp, Homo sapiens
ccagctccgtgagcctcgggctc

SEQ ID NO: 9422603 - DNA, 22 bp, Homo sapiens
ccagctccaggactgggagctg

SEQ ID NO: 9422604 - DNA, 23 bp, Homo sapiens
tctgtcactttctgctgtggagt

SEQ ID NO: 9422605 - DNA, 23 bp, Homo sapiens
tctgtcactttctgctgtggagt

SEQ ID NO: 9422606 - DNA, 19 bp, Homo sapiens
tctgtcactgggggtattc

SEQ ID NO: 9422607 - DNA, 22 bp, Homo sapiens
tctgtcactgagctcaggattc

SEQ ID NO: 9422608 - DNA, 22 bp, Homo sapiens
tctgtcacttattaagatggat

SEQ ID NO: 9422609 - DNA, 22 bp, Homo sapiens
tctgtcacttaagaattgccta

SEQ ID NO: 9422610 - DNA, 22 bp, Homo sapiens
tctgtcaggagattggcagctg

SEQ ID NO: 9422611 - DNA, 22 bp, Homo sapiens
tctgtcacttttatttactgaa

SEQ ID NO: 9422612 - DNA, 23 bp, Homo sapiens
tctgtcacctatggctgctcttc

SEQ ID NO: 9422613 - DNA, 22 bp, Homo sapiens
tctgtcaccgagggcatccaaa

SEQ ID NO: 9422614 - DNA, 22 bp, Homo sapiens
tctgtcacccgagcaggcgaga

SEQ ID NO: 9422615 - DNA, 22 bp, Homo sapiens
tctgtcactattggccagaaca

SEQ ID NO: 9422616 - DNA, 22 bp, Homo sapiens
tctgtcactccctgatgatgaa

SEQ ID NO: 9422617 - DNA, 22 bp, Homo sapiens
tctgtcactctagagatggcag

SEQ ID NO: 9422618 - DNA, 22 bp, Homo sapiens
tctgtcacccaggctggagtgc

SEQ ID NO: 9422619 - DNA, 22 bp, Homo sapiens
tctgtcacccctgtttctggct

SEQ ID NO: 9422620 - DNA, 22 bp, Homo sapiens
ccaggaggcggaggttgcagcg

SEQ ID NO: 9422621 - DNA, 22 bp, Homo sapiens
ccaggaggcggaaggtacagtg

SEQ ID NO: 9422622 - DNA, 22 bp, Homo sapiens
ccaggaggcggaaggtacagtg

SEQ ID NO: 9422623 - DNA, 22 bp, Homo sapiens
ccaggaggcggaaggtacagtg

SEQ ID NO: 9422624 - DNA, 22 bp, Homo sapiens
ccaggaggcagaagttgcagtg

SEQ ID NO: 9422625 - DNA, 22 bp, Homo sapiens
ccaggaggcagaggttacagtg

SEQ ID NO: 9422626 - DNA, 22 bp, Homo sapiens
tctgtctgtccagggcccccgc

SEQ ID NO: 9422627 - DNA, 22 bp, Homo sapiens
tctgtctgtccagggcccccgc

SEQ ID NO: 9422628 - DNA, 22 bp, Homo sapiens
tctgtctgtagttttacatgat

SEQ ID NO: 9422629 - DNA, 21 bp, Homo sapiens
tctgtctggttttagagtggc

SEQ ID NO: 9422630 - DNA, 21 bp, Homo sapiens
tctgtctggttttagagtggc

SEQ ID NO: 9422631 - DNA, 21 bp, Homo sapiens
tctgtctggttttagagtggc

SEQ ID NO: 9422632 - DNA, 18 bp, Homo sapiens
tctgtctgtacaagtatc

SEQ ID NO: 9422633 - DNA, 22 bp, Homo sapiens
tctgtcatcaaatatgctttct

SEQ ID NO: 9422634 - DNA, 22 bp, Homo sapiens
tctgtcataagtgctgaagtat

SEQ ID NO: 9422635 - DNA, 22 bp, Homo sapiens
tctgtctggtccaggaagatgt

SEQ ID NO: 9422636 - DNA, 22 bp, Homo sapiens
tctgtctggtccaggaagatgt

SEQ ID NO: 9422637 - DNA, 22 bp, Homo sapiens
tctgtctgggtgcctcgagtac

SEQ ID NO: 9422638 - DNA, 22 bp, Homo sapiens
tctgtcatccaggctggaatat

SEQ ID NO: 9422639 - DNA, 18 bp, Homo sapiens
tctgtctgtgttgtcttt

SEQ ID NO: 9422640 - DNA, 18 bp, Homo sapiens
tctgtctgtgttgtcttt

SEQ ID NO: 9422641 - DNA, 23 bp, Homo sapiens
tctgtctgtgtatgtgcagaaag

SEQ ID NO: 9422642 - DNA, 23 bp, Homo sapiens
tctgtctgtgtatgtgcagaaag

SEQ ID NO: 9422643 - DNA, 17 bp, Homo sapiens
tctgtctgtggtccact

SEQ ID NO: 9422644 - DNA, 17 bp, Homo sapiens
tctgtctgtggtccact

SEQ ID NO: 9422645 - DNA, 22 bp, Homo sapiens
tctgtcttcatcagcatgtgat

SEQ ID NO: 9422646 - DNA, 22 bp, Homo sapiens
tctgtcttagccatctcaggct

SEQ ID NO: 9422647 - DNA, 20 bp, Homo sapiens
tctgtggcaggtggcgcttg

SEQ ID NO: 9422648 - DNA, 21 bp, Homo sapiens
tctgtggcagcatgatgaggt

SEQ ID NO: 9422649 - DNA, 19 bp, Homo sapiens
tctgtggcacctgggaggg

SEQ ID NO: 9422650 - DNA, 22 bp, Homo sapiens
tctgtcttctgtagctaataat

SEQ ID NO: 9422651 - DNA, 22 bp, Homo sapiens
tctgtcttcttcattgcctata

SEQ ID NO: 9422652 - DNA, 22 bp, Homo sapiens
tctgtcttctgtagctaataat

SEQ ID NO: 9422653 - DNA, 21 bp, Homo sapiens
tctgtcttcctcagcctaagg

SEQ ID NO: 9422654 - DNA, 22 bp, Homo sapiens
tctgtcttggccagccatctgg

SEQ ID NO: 9422655 - DNA, 17 bp, Homo sapiens
tctgtcttgactgtcac

SEQ ID NO: 9422656 - DNA, 17 bp, Homo sapiens
tctgtcttgactgtcac

SEQ ID NO: 9422657 - DNA, 22 bp, Homo sapiens
ccaggaaggaagcaggggtttc

SEQ ID NO: 9422658 - DNA, 22 bp, Homo sapiens
ccaggaaggaagcaggggtttc

SEQ ID NO: 9422659 - DNA, 22 bp, Homo sapiens
ccaggaagcggtgagggctgcc

SEQ ID NO: 9422660 - DNA, 22 bp, Homo sapiens
ccaggaagcggtgagggctgcc

SEQ ID NO: 9422661 - DNA, 22 bp, Homo sapiens
ccaggaagcggtgagggctgcc

SEQ ID NO: 9422662 - DNA, 22 bp, Homo sapiens
ccaggaagctctgctccacggg

SEQ ID NO: 9422663 - DNA, 22 bp, Homo sapiens
ccaggagcctgggccaggctgg

SEQ ID NO: 9422664 - DNA, 22 bp, Homo sapiens
ccaggaggcagaagttgcagtg

SEQ ID NO: 9422665 - DNA, 22 bp, Homo sapiens
ccaggaagatttattttggctt

SEQ ID NO: 9422666 - DNA, 23 bp, Homo sapiens
ccaggaagaggccatccacagtc

SEQ ID NO: 9422667 - DNA, 22 bp, Homo sapiens
ccaggaagcataatgtagtggg

SEQ ID NO: 9422668 - DNA, 22 bp, Homo sapiens
ccaggaagcctcagatgctgag

SEQ ID NO: 9422669 - DNA, 22 bp, Homo sapiens
ccaggaagcctgtgtctctgga

SEQ ID NO: 9422670 - DNA, 22 bp, Homo sapiens
ccaggaagcctgtgtctctgga

SEQ ID NO: 9422671 - DNA, 22 bp, Homo sapiens
ccaggaagcctcagatgctgag

SEQ ID NO: 9422672 - DNA, 22 bp, Homo sapiens
ccaggaagcctcagatgctgag

SEQ ID NO: 9422673 - DNA, 22 bp, Homo sapiens
ccaggaagcctcagatgctgag

SEQ ID NO: 9422674 - DNA, 22 bp, Homo sapiens
ccaggaaatggcttgcttcttt

SEQ ID NO: 9422675 - DNA, 22 bp, Homo sapiens
ccaggaaatagtgctgtgatct

SEQ ID NO: 9422676 - DNA, 22 bp, Homo sapiens
ccaggaacaaagccccatccac

SEQ ID NO: 9422677 - DNA, 22 bp, Homo sapiens
ccaggaaatggcttgcttcttt

SEQ ID NO: 9422678 - DNA, 16 bp, Homo sapiens
ccaggaacacacagct

SEQ ID NO: 9422679 - DNA, 22 bp, Homo sapiens
ccaggaacaaagccccatccac

SEQ ID NO: 9422680 - DNA, 16 bp, Homo sapiens
ccaggaacacacagct

SEQ ID NO: 9422681 - DNA, 19 bp, Homo sapiens
ccaggaacccctagctacc

SEQ ID NO: 9422682 - DNA, 22 bp, Homo sapiens
ccaggaaccgatgatcagaggg

SEQ ID NO: 9422683 - DNA, 22 bp, Homo sapiens
ccaggaactcagctctgcactt

SEQ ID NO: 9422684 - DNA, 22 bp, Homo sapiens
ccaggaactaagaatcctttag

SEQ ID NO: 9422685 - DNA, 22 bp, Homo sapiens
ccaggaagacacatgctcatcc

SEQ ID NO: 9422686 - DNA, 22 bp, Homo sapiens
ccaggaaaaacacattgaagag

SEQ ID NO: 9422687 - DNA, 22 bp, Homo sapiens
ccaggaaaaagagaaacatggt

SEQ ID NO: 9422688 - DNA, 22 bp, Homo sapiens
ccagcttcggcaagcagacttt

SEQ ID NO: 9422689 - DNA, 22 bp, Homo sapiens
ccagcttcatgggcatgcacca

SEQ ID NO: 9422690 - DNA, 22 bp, Homo sapiens
ccagcttcatgggcatgcacca

SEQ ID NO: 9422691 - DNA, 23 bp, Homo sapiens
ccaggaaagatccaggaagaggc

SEQ ID NO: 9422692 - DNA, 22 bp, Homo sapiens
ccaggaaatagtgctgtgatct

SEQ ID NO: 9422693 - DNA, 22 bp, Homo sapiens
ccaggaaagaggaagaacgcat

SEQ ID NO: 9422694 - DNA, 22 bp, Homo sapiens
ccaggaaagaggaagaacgcat

SEQ ID NO: 9422695 - DNA, 22 bp, Homo sapiens
ccaggaaaataccaagctttaa

SEQ ID NO: 9422696 - DNA, 22 bp, Homo sapiens
ccaggaaaataccaagctttaa

SEQ ID NO: 9422697 - DNA, 22 bp, Homo sapiens
tctggagctggagggcaaggca

SEQ ID NO: 9422698 - DNA, 22 bp, Homo sapiens
tctggagctggcagggccctgg

SEQ ID NO: 9422699 - DNA, 22 bp, Homo sapiens
tctggagcttcctcatttacag

SEQ ID NO: 9422700 - DNA, 22 bp, Homo sapiens
tctggagcttcctcatttacag

SEQ ID NO: 9422701 - DNA, 22 bp, Homo sapiens
tctggagctgggggcttagtat

SEQ ID NO: 9422702 - DNA, 19 bp, Homo sapiens
tctggagctgatgcaggtg

SEQ ID NO: 9422703 - DNA, 19 bp, Homo sapiens
tctggagctgatgcaggtg

SEQ ID NO: 9422704 - DNA, 21 bp, Homo sapiens
tctggagctgcaggctgggca

SEQ ID NO: 9422705 - DNA, 22 bp, Homo sapiens
tctggagcgaggtccctgtctg

SEQ ID NO: 9422706 - DNA, 22 bp, Homo sapiens
tctggagctggagggcaaggca

SEQ ID NO: 9422707 - DNA, 21 bp, Homo sapiens
tctggagctgcaggctgggca

SEQ ID NO: 9422708 - DNA, 22 bp, Homo sapiens
tctggagcttgtttcagatggt

SEQ ID NO: 9422709 - DNA, 22 bp, Homo sapiens
tctggaggcaactaacctagtt

SEQ ID NO: 9422710 - DNA, 22 bp, Homo sapiens
tctggagcttgtttcagatggt

SEQ ID NO: 9422711 - DNA, 22 bp, Homo sapiens
tctggagcttgaagctttggtt

SEQ ID NO: 9422712 - DNA, 22 bp, Homo sapiens
tctggagcttgaagctttggtt

SEQ ID NO: 9422713 - DNA, 22 bp, Homo sapiens
tctggagcttgaagctttggtt

SEQ ID NO: 9422714 - DNA, 22 bp, Homo sapiens
tctggctcatacaagcctgcaa

SEQ ID NO: 9422715 - DNA, 22 bp, Homo sapiens
tctggaggcaggctgccaggat

SEQ ID NO: 9422716 - DNA, 22 bp, Homo sapiens
tctggaggcaggctgccaggat

SEQ ID NO: 9422717 - DNA, 22 bp, Homo sapiens
tctggaggcaggctgccaggat

SEQ ID NO: 9422718 - DNA, 22 bp, Homo sapiens
tctggaggcaactaacctagtt

SEQ ID NO: 9422719 - DNA, 22 bp, Homo sapiens
tctggaggcaactaacctagtt

SEQ ID NO: 9422720 - DNA, 22 bp, Homo sapiens
tctggcttcccactctgccggg

SEQ ID NO: 9422721 - DNA, 22 bp, Homo sapiens
tctggcttccctacttactatg

SEQ ID NO: 9422722 - DNA, 23 bp, Homo sapiens
tctggcttccagtgggttcaacc

SEQ ID NO: 9422723 - DNA, 22 bp, Homo sapiens
tctggcttcagtagggttcact

SEQ ID NO: 9422724 - DNA, 22 bp, Homo sapiens
tctggcttctgcaggattacta

SEQ ID NO: 9422725 - DNA, 22 bp, Homo sapiens
tctggcttctcctagagcaatg

SEQ ID NO: 9422726 - DNA, 22 bp, Homo sapiens
tctggcttcgcagctcccagcc

SEQ ID NO: 9422727 - DNA, 22 bp, Homo sapiens
tctggctgttaggcctgacctt

SEQ ID NO: 9422728 - DNA, 22 bp, Homo sapiens
tctggctgttgttaggttcctg

SEQ ID NO: 9422729 - DNA, 23 bp, Homo sapiens
tctggctttcacgggtattctta

SEQ ID NO: 9422730 - DNA, 22 bp, Homo sapiens
ccagctgtaggcagggggttta

SEQ ID NO: 9422731 - DNA, 22 bp, Homo sapiens
ccagctggtttatattccccac

SEQ ID NO: 9422732 - DNA, 22 bp, Homo sapiens
ccagctgtcactcagaaaggcc

SEQ ID NO: 9422733 - DNA, 22 bp, Homo sapiens
ccagctgtcactcagaaaggcc

SEQ ID NO: 9422734 - DNA, 22 bp, Homo sapiens
ccagctgtcagtgtgaaaataa

SEQ ID NO: 9422735 - DNA, 22 bp, Homo sapiens
ccagctgtcactcagaaaggcc

SEQ ID NO: 9422736 - DNA, 22 bp, Homo sapiens
ccagctgtcactcagaaaggcc

SEQ ID NO: 9422737 - DNA, 22 bp, Homo sapiens
ccagctgtctggttccagagcc

SEQ ID NO: 9422738 - DNA, 22 bp, Homo sapiens
ccagctgtcagtgtgaaaataa

SEQ ID NO: 9422739 - DNA, 22 bp, Homo sapiens
tctggcttgtgtccttccttgc

SEQ ID NO: 9422740 - DNA, 22 bp, Homo sapiens
tctggctttattccttcactga

SEQ ID NO: 9422741 - DNA, 22 bp, Homo sapiens
ccagctggtttatattccccac

SEQ ID NO: 9422742 - DNA, 22 bp, Homo sapiens
tctggctttattttcatcatct

SEQ ID NO: 9422743 - DNA, 22 bp, Homo sapiens
tctggcttgagcttcgaccagt

SEQ ID NO: 9422744 - DNA, 22 bp, Homo sapiens
tctggcttgctggcttggtccc

SEQ ID NO: 9422745 - DNA, 22 bp, Homo sapiens
tctggcttggcgctgccctctg

SEQ ID NO: 9422746 - DNA, 22 bp, Homo sapiens
tctggcttggctggcatctctg

SEQ ID NO: 9422747 - DNA, 22 bp, Homo sapiens
tctggcttgtctcagggtctga

SEQ ID NO: 9422748 - DNA, 22 bp, Homo sapiens
ccagctgtttctgatgctaggc

SEQ ID NO: 9422749 - DNA, 22 bp, Homo sapiens
ccagctgtttctgatgctaggc

SEQ ID NO: 9422750 - DNA, 22 bp, Homo sapiens
ccagctgttggagtttcactgc

SEQ ID NO: 9422751 - DNA, 22 bp, Homo sapiens
ccagctgtttctgatgctaggc

SEQ ID NO: 9422752 - DNA, 22 bp, Homo sapiens
ccagctgtgcctaggagcaggg

SEQ ID NO: 9422753 - DNA, 23 bp, Homo sapiens
ccagctgtgcctggcccaggagc

SEQ ID NO: 9422754 - DNA, 22 bp, Homo sapiens
ccagctgtgctgttggcttgtc

SEQ ID NO: 9422755 - DNA, 21 bp, Homo sapiens
ccagctgttcctcgtccgatg

SEQ ID NO: 9422756 - DNA, 21 bp, Homo sapiens
ccagctgttcctcgtccgatg

SEQ ID NO: 9422757 - DNA, 22 bp, Homo sapiens
ccagctgttggagtttcactgc

SEQ ID NO: 9422758 - DNA, 22 bp, Homo sapiens
ccagctgtctggttccagagcc

SEQ ID NO: 9422759 - DNA, 22 bp, Homo sapiens
ccagctgtctggttccagagcc

SEQ ID NO: 9422760 - DNA, 22 bp, Homo sapiens
ccagctgtctggttccagagcc

SEQ ID NO: 9422761 - DNA, 21 bp, Homo sapiens
ccagctgtctgtccttaggca

SEQ ID NO: 9422762 - DNA, 22 bp, Homo sapiens
ccagctgtcttgagaggaggca

SEQ ID NO: 9422763 - DNA, 22 bp, Homo sapiens
ccagctgtcttgagaggaggca

SEQ ID NO: 9422764 - DNA, 18 bp, Homo sapiens
ccagctgtgcagcatctg

SEQ ID NO: 9422765 - DNA, 18 bp, Homo sapiens
ccagctgtgcagcatctg

SEQ ID NO: 9422766 - DNA, 22 bp, Homo sapiens
ccagctgtgccggggacctggg

SEQ ID NO: 9422767 - DNA, 22 bp, Homo sapiens
ccagctgtgccggggacctggg

SEQ ID NO: 9422768 - DNA, 22 bp, Homo sapiens
ccagctgtgcctaggagcaggg

SEQ ID NO: 9422769 - DNA, 22 bp, Homo sapiens
ccagctgtgcctaggagcaggg

SEQ ID NO: 9422770 - DNA, 22 bp, Homo sapiens
ccagctgtgccgtgtggatagc

SEQ ID NO: 9422771 - DNA, 22 bp, Homo sapiens
ccagctgtgccgtgtggatagc

SEQ ID NO: 9422772 - DNA, 22 bp, Homo sapiens
tctgcctgaatctcttagaaca

SEQ ID NO: 9422773 - DNA, 22 bp, Homo sapiens
tctgcctgaaccactcttggag

SEQ ID NO: 9422774 - DNA, 22 bp, Homo sapiens
tctgcctgagaagtggggtgcc

SEQ ID NO: 9422775 - DNA, 22 bp, Homo sapiens
tctgcctgaaccactcttggag

SEQ ID NO: 9422776 - DNA, 22 bp, Homo sapiens
tctgccttgccgaattccaggc

SEQ ID NO: 9422777 - DNA, 19 bp, Homo sapiens
tctgcctctggtcaggctc

SEQ ID NO: 9422778 - DNA, 22 bp, Homo sapiens
tctgcctctttcaggcctggca

SEQ ID NO: 9422779 - DNA, 19 bp, Homo sapiens
tctgcctctggtcaggctc

SEQ ID NO: 9422780 - DNA, 22 bp, Homo sapiens
tctgcctgaaattcacatgtaa

SEQ ID NO: 9422781 - DNA, 22 bp, Homo sapiens
tctgcctgaaattcacatgtaa

SEQ ID NO: 9422782 - DNA, 22 bp, Homo sapiens
tctgcctttgtggtcgggagaa

SEQ ID NO: 9422783 - DNA, 22 bp, Homo sapiens
tctgcctttctcaagggcaaaa

SEQ ID NO: 9422784 - DNA, 22 bp, Homo sapiens
tctgcctttcccaggctactgt

SEQ ID NO: 9422785 - DNA, 22 bp, Homo sapiens
tctgcctttcacacagacggcc

SEQ ID NO: 9422786 - DNA, 22 bp, Homo sapiens
tctgccttgttgcaggcgctat

SEQ ID NO: 9422787 - DNA, 22 bp, Homo sapiens
tctgccttgtttgagctttgac

SEQ ID NO: 9422788 - DNA, 22 bp, Homo sapiens
tctgcggtccccttctcgccct

SEQ ID NO: 9422789 - DNA, 22 bp, Homo sapiens
tctgcggtccccttctcgccct

SEQ ID NO: 9422790 - DNA, 22 bp, Homo sapiens
tctgcgcgctgctggtaccgaa

SEQ ID NO: 9422791 - DNA, 22 bp, Homo sapiens
tctgcgctgccttgatccttgg

SEQ ID NO: 9422792 - DNA, 22 bp, Homo sapiens
tctgcgtggctgctgtgagcgt

SEQ ID NO: 9422793 - DNA, 22 bp, Homo sapiens
tctgcgtgaatttgcattgtgg

SEQ ID NO: 9422794 - DNA, 22 bp, Homo sapiens
tctgcgtgatgagggtgcagca

SEQ ID NO: 9422795 - DNA, 22 bp, Homo sapiens
tctgcgtggcgtggttctgtgc

SEQ ID NO: 9422796 - DNA, 21 bp, Homo sapiens
tctggagccctaagctgagaa

SEQ ID NO: 9422797 - DNA, 22 bp, Homo sapiens
ccagctggttaaaatagagaaa

SEQ ID NO: 9422798 - DNA, 22 bp, Homo sapiens
ccagctggttaaaatagagaaa

SEQ ID NO: 9422799 - DNA, 21 bp, Homo sapiens
tctggagccctaagctgagaa

SEQ ID NO: 9422800 - DNA, 22 bp, Homo sapiens
tctggagccttggatgggaaag

SEQ ID NO: 9422801 - DNA, 22 bp, Homo sapiens
tctggagcgaggtccctgtctg

SEQ ID NO: 9422802 - DNA, 19 bp, Homo sapiens
tctggagctgatgcaggtg

SEQ ID NO: 9422803 - DNA, 22 bp, Homo sapiens
ccagctggtgttccttaggacc

SEQ ID NO: 9422804 - DNA, 22 bp, Homo sapiens
ccagctggtgacatccccaacc

SEQ ID NO: 9422805 - DNA, 22 bp, Homo sapiens
ccagctggtgggtctttctctg

SEQ ID NO: 9422806 - DNA, 22 bp, Homo sapiens
ccagctggtaagtgatggagcc

SEQ ID NO: 9422807 - DNA, 22 bp, Homo sapiens
ccagctggtctgtgctcatgtt

SEQ ID NO: 9422808 - DNA, 22 bp, Homo sapiens
ccagctggtctgtgctcatgtt

SEQ ID NO: 9422809 - DNA, 22 bp, Homo sapiens
ccagctggtaagtgatggagcc

SEQ ID NO: 9422810 - DNA, 22 bp, Homo sapiens
ccagctgggattaagggaaaat

SEQ ID NO: 9422811 - DNA, 22 bp, Homo sapiens
ccagctgctttttgtcacatgg

SEQ ID NO: 9422812 - DNA, 22 bp, Homo sapiens
tctgctaacaatattgcagact

SEQ ID NO: 9422813 - DNA, 22 bp, Homo sapiens
ccacagtgagtgtcatacttgg

SEQ ID NO: 9422814 - DNA, 22 bp, Homo sapiens
ccacagtgagttagattgacca

SEQ ID NO: 9422815 - DNA, 22 bp, Homo sapiens
ccacagtgacacgggctggccc

SEQ ID NO: 9422816 - DNA, 22 bp, Homo sapiens
ccacagtgacacgggctggccc

SEQ ID NO: 9422817 - DNA, 16 bp, Homo sapiens
ccacctgcagctctca

SEQ ID NO: 9422818 - DNA, 16 bp, Homo sapiens
ccacctgcagctctca

SEQ ID NO: 9422819 - DNA, 16 bp, Homo sapiens
ccacctgcagctctca

SEQ ID NO: 9422820 - DNA, 22 bp, Homo sapiens
ccacagtctatgcaacaaggtc

SEQ ID NO: 9422821 - DNA, 22 bp, Homo sapiens
ccacagtccgggctggcaggac

SEQ ID NO: 9422822 - DNA, 22 bp, Homo sapiens
ccactcttgaatcaagagctca

SEQ ID NO: 9422823 - DNA, 22 bp, Homo sapiens
ccactctgctgtgctccatgat

SEQ ID NO: 9422824 - DNA, 22 bp, Homo sapiens
ccactgagaaggggttggggtc

SEQ ID NO: 9422825 - DNA, 22 bp, Homo sapiens
ccactgagaagcacagcttgtc

SEQ ID NO: 9422826 - DNA, 22 bp, Homo sapiens
ccactgagaagcacagcttgtc

SEQ ID NO: 9422827 - DNA, 22 bp, Homo sapiens
ccactgagaagcacagcttgtc

SEQ ID NO: 9422828 - DNA, 22 bp, Homo sapiens
ccactctgatttcaagggagat

SEQ ID NO: 9422829 - DNA, 21 bp, Homo sapiens
ccactctgagtgttgaacaga

SEQ ID NO: 9422830 - DNA, 23 bp, Homo sapiens
ccactctcccaccatatctgtat

SEQ ID NO: 9422831 - DNA, 22 bp, Homo sapiens
ccactctgattttggctccact

SEQ ID NO: 9422832 - DNA, 22 bp, Homo sapiens
ccactctgctgtgctccatgat

SEQ ID NO: 9422833 - DNA, 22 bp, Homo sapiens
ccactctgctgtgctccatgat

SEQ ID NO: 9422834 - DNA, 23 bp, Homo sapiens
tcctggtgacatgcctgagcatc

SEQ ID NO: 9422835 - DNA, 23 bp, Homo sapiens
tcctggtgacatgcctgagcatc

SEQ ID NO: 9422836 - DNA, 22 bp, Homo sapiens
tcctggtctacactgcattggg

SEQ ID NO: 9422837 - DNA, 22 bp, Homo sapiens
tcctggtcttcaggttgcaaaa

SEQ ID NO: 9422838 - DNA, 20 bp, Homo sapiens
tcctggtcatgtggctgggc

SEQ ID NO: 9422839 - DNA, 20 bp, Homo sapiens
tcctggtcatgtggctgggc

SEQ ID NO: 9422840 - DNA, 22 bp, Homo sapiens
tcctggtcagtgccaaactggt

SEQ ID NO: 9422841 - DNA, 22 bp, Homo sapiens
tcctggggagggttctggctcc

SEQ ID NO: 9422842 - DNA, 22 bp, Homo sapiens
tcctggggagggttctggctcc

SEQ ID NO: 9422843 - DNA, 22 bp, Homo sapiens
tcctggtcagctttgaggttgt

SEQ ID NO: 9422844 - DNA, 22 bp, Homo sapiens
tcctggtgaggctagaagtgtc

SEQ ID NO: 9422845 - DNA, 22 bp, Homo sapiens
tcctggtgaggctagaagtgtc

SEQ ID NO: 9422846 - DNA, 23 bp, Homo sapiens
tcctggtgacatgcctgagcatc

SEQ ID NO: 9422847 - DNA, 22 bp, Homo sapiens
tcctggtgaggactccaagata

SEQ ID NO: 9422848 - DNA, 19 bp, Homo sapiens
tcctggtgaccctgaaatt

SEQ ID NO: 9422849 - DNA, 19 bp, Homo sapiens
tcctggtgcttgacactga

SEQ ID NO: 9422850 - DNA, 22 bp, Homo sapiens
tcctggtgcctggagctctcca

SEQ ID NO: 9422851 - DNA, 22 bp, Homo sapiens
ccacagggtgtcatcagcttga

SEQ ID NO: 9422852 - DNA, 22 bp, Homo sapiens
ccacagggtgtcatcagcttga

SEQ ID NO: 9422853 - DNA, 22 bp, Homo sapiens
ccacagggtgtcatcagcttga

SEQ ID NO: 9422854 - DNA, 22 bp, Homo sapiens
ccacagggtcagccactctgca

SEQ ID NO: 9422855 - DNA, 22 bp, Homo sapiens
ccacagtaagagatagtttatg

SEQ ID NO: 9422856 - DNA, 18 bp, Homo sapiens
tcctggtggagaagtggt

SEQ ID NO: 9422857 - DNA, 18 bp, Homo sapiens
tcctggtggagaagtggt

SEQ ID NO: 9422858 - DNA, 22 bp, Homo sapiens
tcctggtgcttgtatttgaagt

SEQ ID NO: 9422859 - DNA, 19 bp, Homo sapiens
tcctggtgcttgacactga

SEQ ID NO: 9422860 - DNA, 22 bp, Homo sapiens
tcctggtggatagaagccaagg

SEQ ID NO: 9422861 - DNA, 22 bp, Homo sapiens
ccacaggggtctctgtagctga

SEQ ID NO: 9422862 - DNA, 22 bp, Homo sapiens
ccacaggggtctctgtagctga

SEQ ID NO: 9422863 - DNA, 20 bp, Homo sapiens
tcctggtggatactgcttaa

SEQ ID NO: 9422864 - DNA, 22 bp, Homo sapiens
tcctggtggatagaagccaagg

SEQ ID NO: 9422865 - DNA, 22 bp, Homo sapiens
ccagaagcaaaacagacagttt

SEQ ID NO: 9422866 - DNA, 22 bp, Homo sapiens
ccagaagatggctcaaaccatg

SEQ ID NO: 9422867 - DNA, 22 bp, Homo sapiens
ccagaagaggacacagtgtgga

SEQ ID NO: 9422868 - DNA, 22 bp, Homo sapiens
ccagaagaggacacagtgtgga

SEQ ID NO: 9422869 - DNA, 22 bp, Homo sapiens
ccagaagagatcacagttcttg

SEQ ID NO: 9422870 - DNA, 21 bp, Homo sapiens
ccagaagctgcttgcaggcta

SEQ ID NO: 9422871 - DNA, 22 bp, Homo sapiens
ccagaagcttcaaggagattct

SEQ ID NO: 9422872 - DNA, 22 bp, Homo sapiens
ccagaagcttctacacaggaga

SEQ ID NO: 9422873 - DNA, 22 bp, Homo sapiens
ccagaatccaaaacgttttgag

SEQ ID NO: 9422874 - DNA, 22 bp, Homo sapiens
ccagaatcatcatctgaagcct

SEQ ID NO: 9422875 - DNA, 22 bp, Homo sapiens
ccagaatcccattgtcacttca

SEQ ID NO: 9422876 - DNA, 22 bp, Homo sapiens
ccagaagtgtctatcaagatgt

SEQ ID NO: 9422877 - DNA, 22 bp, Homo sapiens
ccagaagtgtctatcaagatgt

SEQ ID NO: 9422878 - DNA, 22 bp, Homo sapiens
ccagaagtcaagtaagatgaag

SEQ ID NO: 9422879 - DNA, 20 bp, Homo sapiens
ccagaaggtaggatggaaca

SEQ ID NO: 9422880 - DNA, 22 bp, Homo sapiens
ccagaagggctattgcagtgac

SEQ ID NO: 9422881 - DNA, 22 bp, Homo sapiens
ccagaagggctattgcagtgac

SEQ ID NO: 9422882 - DNA, 22 bp, Homo sapiens
ccagaagggctattgcagtgac

SEQ ID NO: 9422883 - DNA, 22 bp, Homo sapiens
ccactgcccaccccgacgtcta

SEQ ID NO: 9422884 - DNA, 22 bp, Homo sapiens
ccactgccccctgaagaccagg

SEQ ID NO: 9422885 - DNA, 22 bp, Homo sapiens
ccactgccatgggctaggcatg

SEQ ID NO: 9422886 - DNA, 22 bp, Homo sapiens
ccactgccagctttgtcctccc

SEQ ID NO: 9422887 - DNA, 22 bp, Homo sapiens
ccactgccagctttgtcctccc

SEQ ID NO: 9422888 - DNA, 22 bp, Homo sapiens
ccagaaaagcatctggttcttt

SEQ ID NO: 9422889 - DNA, 22 bp, Homo sapiens
ccagaaaaggagctgcaggatg

SEQ ID NO: 9422890 - DNA, 22 bp, Homo sapiens
ccagaaaagcatctggttcttt

SEQ ID NO: 9422891 - DNA, 22 bp, Homo sapiens
ccactgcctatttgcagggccc

SEQ ID NO: 9422892 - DNA, 22 bp, Homo sapiens
ccactgcctctccagggccatc

SEQ ID NO: 9422893 - DNA, 22 bp, Homo sapiens
ccactgcctctccagggccatc

SEQ ID NO: 9422894 - DNA, 22 bp, Homo sapiens
ccactgagtacccgatggctgc

SEQ ID NO: 9422895 - DNA, 22 bp, Homo sapiens
ccactgagtgagcagagcaggg

SEQ ID NO: 9422896 - DNA, 22 bp, Homo sapiens
ccactgcacttcagcctgggtg

SEQ ID NO: 9422897 - DNA, 22 bp, Homo sapiens
ccactgaggcaggcagtatcta

SEQ ID NO: 9422898 - DNA, 22 bp, Homo sapiens
ccactgaggcctgggcccaggg

SEQ ID NO: 9422899 - DNA, 22 bp, Homo sapiens
ccactgaggggtcatggtggga

SEQ ID NO: 9422900 - DNA, 22 bp, Homo sapiens
ccactgaggttttgtggttatg

SEQ ID NO: 9422901 - DNA, 22 bp, Homo sapiens
ccactgaggggtcatggtggga

SEQ ID NO: 9422902 - DNA, 21 bp, Homo sapiens
ccactgagcattgttatgaag

SEQ ID NO: 9422903 - DNA, 22 bp, Homo sapiens
ccactgagcagtagctgcgtcg

SEQ ID NO: 9422904 - DNA, 22 bp, Homo sapiens
ccactgagcagtagctgcgtcg

SEQ ID NO: 9422905 - DNA, 22 bp, Homo sapiens
ccactgaggaggtgaggacaga

SEQ ID NO: 9422906 - DNA, 22 bp, Homo sapiens
ccagagctgcatccagcaggtt

SEQ ID NO: 9422907 - DNA, 22 bp, Homo sapiens
ccagagctgcaggtaaaatgct

SEQ ID NO: 9422908 - DNA, 22 bp, Homo sapiens
ccagagctgattcctgggactt

SEQ ID NO: 9422909 - DNA, 22 bp, Homo sapiens
ccagagctgattcctgggactt

SEQ ID NO: 9422910 - DNA, 18 bp, Homo sapiens
ccagagctggctcctcgc

SEQ ID NO: 9422911 - DNA, 18 bp, Homo sapiens
ccagagctggctcctcgc

SEQ ID NO: 9422912 - DNA, 22 bp, Homo sapiens
ccagagcttcggggcggctgta

SEQ ID NO: 9422913 - DNA, 22 bp, Homo sapiens
ccagagcttgacgtgcaacgga

SEQ ID NO: 9422914 - DNA, 22 bp, Homo sapiens
ccagaggaaaaatatctcccta

SEQ ID NO: 9422915 - DNA, 22 bp, Homo sapiens
ccagagcttgacgtgcaacgga

SEQ ID NO: 9422916 - DNA, 20 bp, Homo sapiens
ccagacagcacctgcctggt

SEQ ID NO: 9422917 - DNA, 20 bp, Homo sapiens
ccagacagcacctgcctggt

SEQ ID NO: 9422918 - DNA, 22 bp, Homo sapiens
ccagaatttgaactcaggcaat

SEQ ID NO: 9422919 - DNA, 22 bp, Homo sapiens
ccagaatttggatcatgatttt

SEQ ID NO: 9422920 - DNA, 22 bp, Homo sapiens
ccagaattcagaaagggcataa

SEQ ID NO: 9422921 - DNA, 22 bp, Homo sapiens
ccagacagcagttaaaggacat

SEQ ID NO: 9422922 - DNA, 22 bp, Homo sapiens
ccagacagcagttaaaggacat

SEQ ID NO: 9422923 - DNA, 20 bp, Homo sapiens
ccagacagcacctgcctggt

SEQ ID NO: 9422924 - DNA, 22 bp, Homo sapiens
tctctaaatgattgtgtactcc

SEQ ID NO: 9422925 - DNA, 22 bp, Homo sapiens
tctctaaatctggttcacttgc

SEQ ID NO: 9422926 - DNA, 22 bp, Homo sapiens
tctctaaagcctggaagaggag

SEQ ID NO: 9422927 - DNA, 22 bp, Homo sapiens
tctctaaatacagatgtcatgg

SEQ ID NO: 9422928 - DNA, 22 bp, Homo sapiens
tctcccaagggcacattcaagg

SEQ ID NO: 9422929 - DNA, 22 bp, Homo sapiens
tctcccaagggcacattcaagg

SEQ ID NO: 9422930 - DNA, 22 bp, Homo sapiens
tctcccaagtgaccaggaaaga

SEQ ID NO: 9422931 - DNA, 22 bp, Homo sapiens
tctcccaagtgaccaggaaaga

SEQ ID NO: 9422932 - DNA, 22 bp, Homo sapiens
tctcctgggaggacaaggaagg

SEQ ID NO: 9422933 - DNA, 22 bp, Homo sapiens
tctcccaaggcacagaaagagt

SEQ ID NO: 9422934 - DNA, 21 bp, Homo sapiens
tctcccaaggaggtcctgagg

SEQ ID NO: 9422935 - DNA, 22 bp, Homo sapiens
tctcccaacatgtggaggtcag

SEQ ID NO: 9422936 - DNA, 22 bp, Homo sapiens
tctcccaagcctggcaggggca

SEQ ID NO: 9422937 - DNA, 22 bp, Homo sapiens
tctcccaacatgtggaggtcag

SEQ ID NO: 9422938 - DNA, 22 bp, Homo sapiens
tctcccaacctctggtgggtgc

SEQ ID NO: 9422939 - DNA, 19 bp, Homo sapiens
tctccagtttattcttcca

SEQ ID NO: 9422940 - DNA, 21 bp, Homo sapiens
tctccagttgacagtgtctcc

SEQ ID NO: 9422941 - DNA, 22 bp, Homo sapiens
tctccataggcagttcataaca

SEQ ID NO: 9422942 - DNA, 22 bp, Homo sapiens
tctccatacttgcctttggcct

SEQ ID NO: 9422943 - DNA, 22 bp, Homo sapiens
tctccataggcagttcataaca

SEQ ID NO: 9422944 - DNA, 22 bp, Homo sapiens
tctccataggcagttcataaca

SEQ ID NO: 9422945 - DNA, 22 bp, Homo sapiens
tctccagtgaatctcctcctgg

SEQ ID NO: 9422946 - DNA, 22 bp, Homo sapiens
tctccagtctcaagacattgag

SEQ ID NO: 9422947 - DNA, 22 bp, Homo sapiens
tctccagtcccttctctgttag

SEQ ID NO: 9422948 - DNA, 22 bp, Homo sapiens
tctccagtgaatctcctcctgg

SEQ ID NO: 9422949 - DNA, 21 bp, Homo sapiens
tctccagtgcttctgcctctt

SEQ ID NO: 9422950 - DNA, 22 bp, Homo sapiens
tctctacataacctcaatactc

SEQ ID NO: 9422951 - DNA, 19 bp, Homo sapiens
ccagaggactgttaatgaa

SEQ ID NO: 9422952 - DNA, 22 bp, Homo sapiens
tctctagtataatatagcaaaa

SEQ ID NO: 9422953 - DNA, 22 bp, Homo sapiens
tctctaattgacattacttgac

SEQ ID NO: 9422954 - DNA, 22 bp, Homo sapiens
tctctaattcaaccagacactt

SEQ ID NO: 9422955 - DNA, 22 bp, Homo sapiens
tctctacaaaaattagcatgca

SEQ ID NO: 9422956 - DNA, 22 bp, Homo sapiens
tctctaagataggaatacagtt

SEQ ID NO: 9422957 - DNA, 22 bp, Homo sapiens
tctctaacctaatgtggaggga

SEQ ID NO: 9422958 - DNA, 22 bp, Homo sapiens
tctctacacaggattcacatga

SEQ ID NO: 9422959 - DNA, 22 bp, Homo sapiens
tctctacagatcctatatagaa

SEQ ID NO: 9422960 - DNA, 22 bp, Homo sapiens
tctctacataacctcaatactc

SEQ ID NO: 9422961 - DNA, 22 bp, Homo sapiens
tctctacagatcctatatagaa

SEQ ID NO: 9422962 - DNA, 22 bp, Homo sapiens
tctctacagacactgttgactt

SEQ ID NO: 9422963 - DNA, 21 bp, Homo sapiens
tctctacactttcactaggct

SEQ ID NO: 9422964 - DNA, 19 bp, Homo sapiens
tctctacactacatttcta

SEQ ID NO: 9422965 - DNA, 22 bp, Homo sapiens
ccagaggagggctctgatgagg

SEQ ID NO: 9422966 - DNA, 22 bp, Homo sapiens
ccagaggagttgaggctttggg

SEQ ID NO: 9422967 - DNA, 22 bp, Homo sapiens
ccagaggagggctctgatgagg

SEQ ID NO: 9422968 - DNA, 22 bp, Homo sapiens
ccagaggagcaggctggctcca

SEQ ID NO: 9422969 - DNA, 22 bp, Homo sapiens
ccagaggagcaggctggctcca

SEQ ID NO: 9422970 - DNA, 22 bp, Homo sapiens
ccagaggagatgcctcctctgt

SEQ ID NO: 9422971 - DNA, 22 bp, Homo sapiens
ccagaggacttgggggctgaat

SEQ ID NO: 9422972 - DNA, 22 bp, Homo sapiens
ccagaggacttgggggctgaat

SEQ ID NO: 9422973 - DNA, 18 bp, Homo sapiens
ccagatggccagtctgct

SEQ ID NO: 9422974 - DNA, 22 bp, Homo sapiens
ccagatgaggtcatgctgggtt

SEQ ID NO: 9422975 - DNA, 19 bp, Homo sapiens
ccagatgagcagctgagat

SEQ ID NO: 9422976 - DNA, 17 bp, Homo sapiens
ccagatgccctgtctcc

SEQ ID NO: 9422977 - DNA, 22 bp, Homo sapiens
ccagatgggaagaagcatgact

SEQ ID NO: 9422978 - DNA, 22 bp, Homo sapiens
ccagatgggctttagcaaatga

SEQ ID NO: 9422979 - DNA, 22 bp, Homo sapiens
ccagatggtatagtagggagag

SEQ ID NO: 9422980 - DNA, 20 bp, Homo sapiens
ccagatggtccctgtgaaaa

SEQ ID NO: 9422981 - DNA, 22 bp, Homo sapiens
ccagatggtgcctgtcagaagg

SEQ ID NO: 9422982 - DNA, 22 bp, Homo sapiens
ccagatggtccagagtctagcc

SEQ ID NO: 9422983 - DNA, 20 bp, Homo sapiens
tctctctggttggaggagct

SEQ ID NO: 9422984 - DNA, 22 bp, Homo sapiens
ccagatggtttgcatgggaggg

SEQ ID NO: 9422985 - DNA, 22 bp, Homo sapiens
ccagatctaagtccaaagtact

SEQ ID NO: 9422986 - DNA, 21 bp, Homo sapiens
ccagatcctgcttcctcaccc

SEQ ID NO: 9422987 - DNA, 16 bp, Homo sapiens
ccagatgaatgggagt

SEQ ID NO: 9422988 - DNA, 22 bp, Homo sapiens
ccagatattcacttttacatgc

SEQ ID NO: 9422989 - DNA, 22 bp, Homo sapiens
ccagatatcactgccgtgttgt

SEQ ID NO: 9422990 - DNA, 17 bp, Homo sapiens
ccagatcccagtcctta

SEQ ID NO: 9422991 - DNA, 22 bp, Homo sapiens
ccagatccctgtttgcctctgg

SEQ ID NO: 9422992 - DNA, 22 bp, Homo sapiens
ccagataaggctttttaaaagc

SEQ ID NO: 9422993 - DNA, 22 bp, Homo sapiens
ccagataaggctttttaaaagc

SEQ ID NO: 9422994 - DNA, 22 bp, Homo sapiens
ccagatagaaaagaaggcagga

SEQ ID NO: 9422995 - DNA, 22 bp, Homo sapiens
ccagatagcaggtcagaagtgc

SEQ ID NO: 9422996 - DNA, 22 bp, Homo sapiens
ccagatatcactgccgtgttgt

SEQ ID NO: 9422997 - DNA, 22 bp, Homo sapiens
ccagatatcactgccgtgttgt

SEQ ID NO: 9422998 - DNA, 22 bp, Homo sapiens
ccagatagggatgagagtgcta

SEQ ID NO: 9422999 - DNA, 17 bp, Homo sapiens
catttgctggttggctc

SEQ ID NO: 9423000 - DNA, 20 bp, Homo sapiens
tccctgccttttactgctgg

SEQ ID NO: 9423001 - DNA, 22 bp, Homo sapiens
tccctgcctgacagcacccacc

SEQ ID NO: 9423002 - DNA, 22 bp, Homo sapiens
catttgcaaaccaacaagatga

SEQ ID NO: 9423003 - DNA, 22 bp, Homo sapiens
catttgattactaaagataatt

SEQ ID NO: 9423004 - DNA, 22 bp, Homo sapiens
catttgaagaagaaacgtacta

SEQ ID NO: 9423005 - DNA, 22 bp, Homo sapiens
catttgaactaataactgtgct

SEQ ID NO: 9423006 - DNA, 22 bp, Homo sapiens
catttgaatgagattgctgtaa

SEQ ID NO: 9423007 - DNA, 22 bp, Homo sapiens
catttgaacctggatgttctta

SEQ ID NO: 9423008 - DNA, 22 bp, Homo sapiens
catttgaactaataactgtgct

SEQ ID NO: 9423009 - DNA, 22 bp, Homo sapiens
catttgaacctggatgttctta

SEQ ID NO: 9423010 - DNA, 22 bp, Homo sapiens
catttgattactaaagataatt

SEQ ID NO: 9423011 - DNA, 22 bp, Homo sapiens
catttgattactaaagataatt

SEQ ID NO: 9423012 - DNA, 22 bp, Homo sapiens
catttgatgactcaactcataa

SEQ ID NO: 9423013 - DNA, 22 bp, Homo sapiens
catttgatgactcaactcataa

SEQ ID NO: 9423014 - DNA, 22 bp, Homo sapiens
catttgatgactcaactcataa

SEQ ID NO: 9423015 - DNA, 23 bp, Homo sapiens
catttgatcctcacaataaatgg

SEQ ID NO: 9423016 - DNA, 23 bp, Homo sapiens
catttgatcctcacaataaatgg

SEQ ID NO: 9423017 - DNA, 22 bp, Homo sapiens
catttgatcctcacaacaatct

SEQ ID NO: 9423018 - DNA, 23 bp, Homo sapiens
catttgatcctcacaataaatgg

SEQ ID NO: 9423019 - DNA, 22 bp, Homo sapiens
catttgatctcctgaataaaca

SEQ ID NO: 9423020 - DNA, 23 bp, Homo sapiens
catttgatcctcacaataaatgg

SEQ ID NO: 9423021 - DNA, 22 bp, Homo sapiens
catttgatctcctgaataaaca

SEQ ID NO: 9423022 - DNA, 22 bp, Homo sapiens
catttgaatggcatttcacttt

SEQ ID NO: 9423023 - DNA, 22 bp, Homo sapiens
catttgacagtgagtcacagca

SEQ ID NO: 9423024 - DNA, 22 bp, Homo sapiens
catttgaatggcatttcacttt

SEQ ID NO: 9423025 - DNA, 22 bp, Homo sapiens
catttgatcctcacaacaatct

SEQ ID NO: 9423026 - DNA, 22 bp, Homo sapiens
catttgatcctcacaacaatct

SEQ ID NO: 9423027 - DNA, 22 bp, Homo sapiens
ccaaaaattagatacacatata

SEQ ID NO: 9423028 - DNA, 22 bp, Homo sapiens
ccaaaaattagatacacatata

SEQ ID NO: 9423029 - DNA, 22 bp, Homo sapiens
ccaaaaattagatacacatata

SEQ ID NO: 9423030 - DNA, 22 bp, Homo sapiens
ccaaagtccacagtttacatta

SEQ ID NO: 9423031 - DNA, 22 bp, Homo sapiens
ccaaagtccatagtttacataa

SEQ ID NO: 9423032 - DNA, 22 bp, Homo sapiens
ccaaagtccatagtttacatta

SEQ ID NO: 9423033 - DNA, 22 bp, Homo sapiens
ccaaagtccatagtttacttta

SEQ ID NO: 9423034 - DNA, 22 bp, Homo sapiens
tccctgcttgctctcagccctt

SEQ ID NO: 9423035 - DNA, 22 bp, Homo sapiens
tccctgctgggagatgacctta

SEQ ID NO: 9423036 - DNA, 22 bp, Homo sapiens
tccctgctgcactcacacctac

SEQ ID NO: 9423037 - DNA, 22 bp, Homo sapiens
catttacttaaatctttacaag

SEQ ID NO: 9423038 - DNA, 22 bp, Homo sapiens
catttacttaaatctttacaag

SEQ ID NO: 9423039 - DNA, 22 bp, Homo sapiens
catttacagcagactgatgaaa

SEQ ID NO: 9423040 - DNA, 22 bp, Homo sapiens
catttacacttctaaccacaag

SEQ ID NO: 9423041 - DNA, 22 bp, Homo sapiens
tccaggcacagagttggtcagt

SEQ ID NO: 9423042 - DNA, 22 bp, Homo sapiens
tccaggcacgaggccctgtgca

SEQ ID NO: 9423043 - DNA, 22 bp, Homo sapiens
catttagtacaacttttacagt

SEQ ID NO: 9423044 - DNA, 22 bp, Homo sapiens
catttagtacaacttttacagt

SEQ ID NO: 9423045 - DNA, 22 bp, Homo sapiens
catttagtccttgacttctctc

SEQ ID NO: 9423046 - DNA, 22 bp, Homo sapiens
catttagagagtaaaaattagc

SEQ ID NO: 9423047 - DNA, 22 bp, Homo sapiens
catttagagagtaaaaattagc

SEQ ID NO: 9423048 - DNA, 22 bp, Homo sapiens
catttagagtcttgcaatttta

SEQ ID NO: 9423049 - DNA, 22 bp, Homo sapiens
catttagagtcttgcaatttta

SEQ ID NO: 9423050 - DNA, 22 bp, Homo sapiens
catttagttatactaaaacatt

SEQ ID NO: 9423051 - DNA, 22 bp, Homo sapiens
catttagttatactaaaacatt

SEQ ID NO: 9423052 - DNA, 22 bp, Homo sapiens
catttagttttgcagtagcagg

SEQ ID NO: 9423053 - DNA, 22 bp, Homo sapiens
catttagttttgcagtagcagg

SEQ ID NO: 9423054 - DNA, 19 bp, Homo sapiens
catttagaagtacatatta

SEQ ID NO: 9423055 - DNA, 19 bp, Homo sapiens
catttagaagtacatatta

SEQ ID NO: 9423056 - DNA, 19 bp, Homo sapiens
catttagaagtacatatta

SEQ ID NO: 9423057 - DNA, 19 bp, Homo sapiens
catttagaagtacatatta

SEQ ID NO: 9423058 - DNA, 22 bp, Homo sapiens
catttagagaagattacaagga

SEQ ID NO: 9423059 - DNA, 22 bp, Homo sapiens
catttagagagtaaaaattagc

SEQ ID NO: 9423060 - DNA, 22 bp, Homo sapiens
catttagagaagattacaagga

SEQ ID NO: 9423061 - DNA, 22 bp, Homo sapiens
catttagaagtcttagaactat

SEQ ID NO: 9423062 - DNA, 22 bp, Homo sapiens
catttagagaagattacaagga

SEQ ID NO: 9423063 - DNA, 22 bp, Homo sapiens
catttattagttagttcgatgt

SEQ ID NO: 9423064 - DNA, 22 bp, Homo sapiens
tcccagggattaggacatggat

SEQ ID NO: 9423065 - DNA, 22 bp, Homo sapiens
tcccagggattaggacatggat

SEQ ID NO: 9423066 - DNA, 22 bp, Homo sapiens
catttatgaagcactttagagt

SEQ ID NO: 9423067 - DNA, 22 bp, Homo sapiens
catttatataaaatgtccagaa

SEQ ID NO: 9423068 - DNA, 21 bp, Homo sapiens
tcccagggccaggtgccatca

SEQ ID NO: 9423069 - DNA, 22 bp, Homo sapiens
tcccagggcagctgtccagaag

SEQ ID NO: 9423070 - DNA, 22 bp, Homo sapiens
tcccagggcagctgtccagaag

SEQ ID NO: 9423071 - DNA, 22 bp, Homo sapiens
tcccagggctctagagtgctgg

SEQ ID NO: 9423072 - DNA, 22 bp, Homo sapiens
tcccagggctctagagtgctgg

SEQ ID NO: 9423073 - DNA, 22 bp, Homo sapiens
tcccagggctctagagtgctgg

SEQ ID NO: 9423074 - DNA, 22 bp, Homo sapiens
tcccagggcttttctcatgctt

SEQ ID NO: 9423075 - DNA, 22 bp, Homo sapiens
tcccagggcttttctcatgctt

SEQ ID NO: 9423076 - DNA, 22 bp, Homo sapiens
catttctcactccagcaacttt

SEQ ID NO: 9423077 - DNA, 22 bp, Homo sapiens
catttctcactccagcaacttt

SEQ ID NO: 9423078 - DNA, 22 bp, Homo sapiens
tcccagggtcagtggtgaggcc

SEQ ID NO: 9423079 - DNA, 21 bp, Homo sapiens
catttctattgatgagaaaag

SEQ ID NO: 9423080 - DNA, 21 bp, Homo sapiens
catttctattgatgagaaaag

SEQ ID NO: 9423081 - DNA, 22 bp, Homo sapiens
tcccagggtcagtggtgaggcc

SEQ ID NO: 9423082 - DNA, 22 bp, Homo sapiens
tcccagggtcagtggtgaggcc

SEQ ID NO: 9423083 - DNA, 22 bp, Homo sapiens
tcccagggtcagtggtgaggcc

SEQ ID NO: 9423084 - DNA, 22 bp, Homo sapiens
tcccagggtatcctgtagtaaa

SEQ ID NO: 9423085 - DNA, 22 bp, Homo sapiens
tcccagggtatcctgtagtaaa

SEQ ID NO: 9423086 - DNA, 19 bp, Homo sapiens
tcctgcccaccagccaggg

SEQ ID NO: 9423087 - DNA, 22 bp, Homo sapiens
ccacagaagatggggagagtgg

SEQ ID NO: 9423088 - DNA, 22 bp, Homo sapiens
ccacagaatcgctagtggagca

SEQ ID NO: 9423089 - DNA, 22 bp, Homo sapiens
ccacagaatcgctagtggagca

SEQ ID NO: 9423090 - DNA, 22 bp, Homo sapiens
ccacagaatcgctagtggagca

SEQ ID NO: 9423091 - DNA, 22 bp, Homo sapiens
ccacagaatgatgacacttcag

SEQ ID NO: 9423092 - DNA, 22 bp, Homo sapiens
ccacagaggacaactgcctggc

SEQ ID NO: 9423093 - DNA, 22 bp, Homo sapiens
ccacagaggacaactgcctggc

SEQ ID NO: 9423094 - DNA, 22 bp, Homo sapiens
ccacagaggacaactgcctggc

SEQ ID NO: 9423095 - DNA, 20 bp, Homo sapiens
ccacagaggacagggctgtg

SEQ ID NO: 9423096 - DNA, 20 bp, Homo sapiens
ccacagaggacagggctgtg

SEQ ID NO: 9423097 - DNA, 20 bp, Homo sapiens
ccacagaggacagggctgtg

SEQ ID NO: 9423098 - DNA, 22 bp, Homo sapiens
ccacagagtccgcatttgaggc

SEQ ID NO: 9423099 - DNA, 22 bp, Homo sapiens
ccacagagtcttccttctcttc

SEQ ID NO: 9423100 - DNA, 22 bp, Homo sapiens
ccacagagtcttccttctcttc

SEQ ID NO: 9423101 - DNA, 22 bp, Homo sapiens
ccacagagtcttccttctcttc

SEQ ID NO: 9423102 - DNA, 22 bp, Homo sapiens
ccacagagtccgcatttgaggc

SEQ ID NO: 9423103 - DNA, 17 bp, Homo sapiens
tcctgccacctgtcagg

SEQ ID NO: 9423104 - DNA, 17 bp, Homo sapiens
tcctgccacctgtcagg

SEQ ID NO: 9423105 - DNA, 22 bp, Homo sapiens
tcctgccacctgcacagctccc

SEQ ID NO: 9423106 - DNA, 17 bp, Homo sapiens
tcctgccacctgtcagg

SEQ ID NO: 9423107 - DNA, 20 bp, Homo sapiens
tcctgcagttcctaggaggg

SEQ ID NO: 9423108 - DNA, 20 bp, Homo sapiens
tcctgcagttcctaggaggg

SEQ ID NO: 9423109 - DNA, 20 bp, Homo sapiens
tcctgcagttcctaggaggg

SEQ ID NO: 9423110 - DNA, 20 bp, Homo sapiens
tcctgcagttcctaggaggg

SEQ ID NO: 9423111 - DNA, 22 bp, Homo sapiens
tcctgcccacagctgctggaca

SEQ ID NO: 9423112 - DNA, 22 bp, Homo sapiens
tcctgcccacagctgctggaca

SEQ ID NO: 9423113 - DNA, 22 bp, Homo sapiens
tcctgccatcccacccggctca

SEQ ID NO: 9423114 - DNA, 22 bp, Homo sapiens
tcctgccaggagtgctggccct

SEQ ID NO: 9423115 - DNA, 22 bp, Homo sapiens
tcctgccactgcacatatactt

SEQ ID NO: 9423116 - DNA, 22 bp, Homo sapiens
ccacagagttgatgcaataaga

SEQ ID NO: 9423117 - DNA, 22 bp, Homo sapiens
ccacagcaccgctgccagtccc

SEQ ID NO: 9423118 - DNA, 22 bp, Homo sapiens
ccacagcatgcaggcctgacac

SEQ ID NO: 9423119 - DNA, 22 bp, Homo sapiens
ccacagcacctgcagccagttg

SEQ ID NO: 9423120 - DNA, 18 bp, Homo sapiens
ccacagcagagttcttac

SEQ ID NO: 9423121 - DNA, 18 bp, Homo sapiens
ccacagcagagttcttac

SEQ ID NO: 9423122 - DNA, 22 bp, Homo sapiens
ccacagcaggactggagccgcc

SEQ ID NO: 9423123 - DNA, 22 bp, Homo sapiens
ccacagccattccagggaggct

SEQ ID NO: 9423124 - DNA, 17 bp, Homo sapiens
ccacagcctggcacttg

SEQ ID NO: 9423125 - DNA, 19 bp, Homo sapiens
ccacagcctgctgtcttcc

SEQ ID NO: 9423126 - DNA, 19 bp, Homo sapiens
ccacagcctgctgtcttcc

SEQ ID NO: 9423127 - DNA, 22 bp, Homo sapiens
ccacagccattccagggaggct

SEQ ID NO: 9423128 - DNA, 22 bp, Homo sapiens
ccacagctagggcaatctgatt

SEQ ID NO: 9423129 - DNA, 17 bp, Homo sapiens
ccacagcctggcacttg

SEQ ID NO: 9423130 - DNA, 23 bp, Homo sapiens
ccacagctatagggtagtgcagt

SEQ ID NO: 9423131 - DNA, 22 bp, Homo sapiens
ccacagctcctcagcctctttc

SEQ ID NO: 9423132 - DNA, 22 bp, Homo sapiens
ccacagctgaaagcagaggctc

SEQ ID NO: 9423133 - DNA, 22 bp, Homo sapiens
ccacagctgacaatggatagac

SEQ ID NO: 9423134 - DNA, 22 bp, Homo sapiens
tcctggggagggttctggctcc

SEQ ID NO: 9423135 - DNA, 20 bp, Homo sapiens
ccaatgtttacagattactt

SEQ ID NO: 9423136 - DNA, 22 bp, Homo sapiens
ccaatgttttatacagaagtac

SEQ ID NO: 9423137 - DNA, 22 bp, Homo sapiens
ccaatgttttatacagaagtac

SEQ ID NO: 9423138 - DNA, 22 bp, Homo sapiens
ccaatgtttattttcctgctgc

SEQ ID NO: 9423139 - DNA, 22 bp, Homo sapiens
ccaattcatcctctggggcttc

SEQ ID NO: 9423140 - DNA, 23 bp, Homo sapiens
ccaattcatggcagatttgaaga

SEQ ID NO: 9423141 - DNA, 22 bp, Homo sapiens
ccaattttattcttctgcaagt

SEQ ID NO: 9423142 - DNA, 22 bp, Homo sapiens
ccacaagactctgtcagcataa

SEQ ID NO: 9423143 - DNA, 22 bp, Homo sapiens
ccacaagactctgtcagcataa

SEQ ID NO: 9423144 - DNA, 22 bp, Homo sapiens
ccacaaagaatgggggaagcat

SEQ ID NO: 9423145 - DNA, 22 bp, Homo sapiens
ccacaaagttgctgagtttctg

SEQ ID NO: 9423146 - DNA, 22 bp, Homo sapiens
ccacaaagttgctgagtttctg

SEQ ID NO: 9423147 - DNA, 19 bp, Homo sapiens
ccacaaaattattttagtt

SEQ ID NO: 9423148 - DNA, 19 bp, Homo sapiens
ccacaaaattattttagtt

SEQ ID NO: 9423149 - DNA, 22 bp, Homo sapiens
ccacaaaactgtgtgtcaaaga

SEQ ID NO: 9423150 - DNA, 22 bp, Homo sapiens
ccacaaaactgtgtgtcaaaga

SEQ ID NO: 9423151 - DNA, 22 bp, Homo sapiens
tcctgcagttacatcccagcca

SEQ ID NO: 9423152 - DNA, 22 bp, Homo sapiens
tcctgcagtgtgtctcctgcac

SEQ ID NO: 9423153 - DNA, 22 bp, Homo sapiens
tcctgcagtgtgtctcctgcac

SEQ ID NO: 9423154 - DNA, 22 bp, Homo sapiens
tcctgcagtctgcactctgcct

SEQ ID NO: 9423155 - DNA, 22 bp, Homo sapiens
tcctgcagtgtgtctcctgcac

SEQ ID NO: 9423156 - DNA, 22 bp, Homo sapiens
ccacacagataagtgttttcta

SEQ ID NO: 9423157 - DNA, 21 bp, Homo sapiens
ccacaattctagttacatatg

SEQ ID NO: 9423158 - DNA, 22 bp, Homo sapiens
ccacaaggaggacagcagttgg

SEQ ID NO: 9423159 - DNA, 22 bp, Homo sapiens
ccacaaggaggacagcagttgg

SEQ ID NO: 9423160 - DNA, 22 bp, Homo sapiens
ccacaagtgaagtacacctgcc

SEQ ID NO: 9423161 - DNA, 20 bp, Homo sapiens
ccacaagggaatattgttga

SEQ ID NO: 9423162 - DNA, 22 bp, Homo sapiens
ccacaaggcctgtggggctgct

SEQ ID NO: 9423163 - DNA, 22 bp, Homo sapiens
ccacaaggggactcgttaaatg

SEQ ID NO: 9423164 - DNA, 22 bp, Homo sapiens
tcctcccacataggacaatggg

SEQ ID NO: 9423165 - DNA, 22 bp, Homo sapiens
tcctcccacataggacaatggg

SEQ ID NO: 9423166 - DNA, 22 bp, Homo sapiens
tcctcccacataggacaatggg

SEQ ID NO: 9423167 - DNA, 22 bp, Homo sapiens
tcctccccaaagcccagcctgg

SEQ ID NO: 9423168 - DNA, 22 bp, Homo sapiens
tcctcccaacttttccatctca

SEQ ID NO: 9423169 - DNA, 22 bp, Homo sapiens
tcctcccacataggacaatggg

SEQ ID NO: 9423170 - DNA, 22 bp, Homo sapiens
tcctcccaacttttccatctca

SEQ ID NO: 9423171 - DNA, 20 bp, Homo sapiens
tcctcccccacctttgcagc

SEQ ID NO: 9423172 - DNA, 20 bp, Homo sapiens
tcctcccccacctttgcagc

SEQ ID NO: 9423173 - DNA, 17 bp, Homo sapiens
tcctccccgcagttgca

SEQ ID NO: 9423174 - DNA, 22 bp, Homo sapiens
ccaagggaaggatgtatatgat

SEQ ID NO: 9423175 - DNA, 22 bp, Homo sapiens
tcctccccaaagcccagcctgg

SEQ ID NO: 9423176 - DNA, 22 bp, Homo sapiens
tcctccccaaagcccagcctgg

SEQ ID NO: 9423177 - DNA, 22 bp, Homo sapiens
tcctccccaaagcccagcctgg

SEQ ID NO: 9423178 - DNA, 22 bp, Homo sapiens
tcctccccaaagcccagcctgg

SEQ ID NO: 9423179 - DNA, 23 bp, Homo sapiens
tcctcccaaatttcagcctcatt

SEQ ID NO: 9423180 - DNA, 23 bp, Homo sapiens
tcctcccaaatttcagcctcatt

SEQ ID NO: 9423181 - DNA, 23 bp, Homo sapiens
tcctcccaaatttcagcctcatt

SEQ ID NO: 9423182 - DNA, 23 bp, Homo sapiens
tcctcccaaatttcagcctcatt

SEQ ID NO: 9423183 - DNA, 23 bp, Homo sapiens
tcctcccaaatttcagcctcatt

SEQ ID NO: 9423184 - DNA, 22 bp, Homo sapiens
ccaaatcaccagcacgatcatt

SEQ ID NO: 9423185 - DNA, 22 bp, Homo sapiens
ccaaatcaccagcacgatcatt

SEQ ID NO: 9423186 - DNA, 22 bp, Homo sapiens
ccaaatcaggggccacaagcat

SEQ ID NO: 9423187 - DNA, 22 bp, Homo sapiens
ccaaatcaggggccacaagcat

SEQ ID NO: 9423188 - DNA, 22 bp, Homo sapiens
ccaaagtgtgggagaagaggta

SEQ ID NO: 9423189 - DNA, 22 bp, Homo sapiens
ccaaataatatttcagaaccat

SEQ ID NO: 9423190 - DNA, 22 bp, Homo sapiens
ccaaagtgtgggagaagaggta

SEQ ID NO: 9423191 - DNA, 22 bp, Homo sapiens
ccaaatattaacaaagtaattt

SEQ ID NO: 9423192 - DNA, 22 bp, Homo sapiens
ccaaatagtctttcattgaatt

SEQ ID NO: 9423193 - DNA, 22 bp, Homo sapiens
ccaaatagtctttcattgaatt

SEQ ID NO: 9423194 - DNA, 22 bp, Homo sapiens
ccaaatattaacaaagtaattt

SEQ ID NO: 9423195 - DNA, 22 bp, Homo sapiens
ccaaatattaacaaagtaattt

SEQ ID NO: 9423196 - DNA, 22 bp, Homo sapiens
ccaaatcaccagcacgatcatt

SEQ ID NO: 9423197 - DNA, 22 bp, Homo sapiens
ccaaatcaccagcacgatcatt

SEQ ID NO: 9423198 - DNA, 22 bp, Homo sapiens
caggccctgctgctgagacctt

SEQ ID NO: 9423199 - DNA, 19 bp, Homo sapiens
caggccctggacccatctg

SEQ ID NO: 9423200 - DNA, 19 bp, Homo sapiens
caggccctggacccatctg

SEQ ID NO: 9423201 - DNA, 22 bp, Homo sapiens
tacagtaacatgttgtacaagc

SEQ ID NO: 9423202 - DNA, 22 bp, Homo sapiens
tacagtaacatgttgtacaagc

SEQ ID NO: 9423203 - DNA, 22 bp, Homo sapiens
tacaggttacacttttaaaagt

SEQ ID NO: 9423204 - DNA, 22 bp, Homo sapiens
tacaggtggtaaaaatattgtt

SEQ ID NO: 9423205 - DNA, 22 bp, Homo sapiens
tacaggtggtaaaaatattgtt

SEQ ID NO: 9423206 - DNA, 22 bp, Homo sapiens
caggccggccggccccagctct

SEQ ID NO: 9423207 - DNA, 22 bp, Homo sapiens
caggccggccggccccagctct

SEQ ID NO: 9423208 - DNA, 22 bp, Homo sapiens
caggccctttcctgggcatagg

SEQ ID NO: 9423209 - DNA, 22 bp, Homo sapiens
caggccctgtgctgggtgatgt

SEQ ID NO: 9423210 - DNA, 22 bp, Homo sapiens
caggccggccggccccagctct

SEQ ID NO: 9423211 - DNA, 18 bp, Homo sapiens
caggccctgtctggcctc

SEQ ID NO: 9423212 - DNA, 22 bp, Homo sapiens
caggccctgggcaggcacagag

SEQ ID NO: 9423213 - DNA, 18 bp, Homo sapiens
caggccctgtctggcctc

SEQ ID NO: 9423214 - DNA, 18 bp, Homo sapiens
caggccctgtctggcctc

SEQ ID NO: 9423215 - DNA, 22 bp, Homo sapiens
caggccctgggcaggatcagcc

SEQ ID NO: 9423216 - DNA, 22 bp, Homo sapiens
caggccctgggcaggcacagag

SEQ ID NO: 9423217 - DNA, 22 bp, Homo sapiens
caggccctgggcaggcacagag

SEQ ID NO: 9423218 - DNA, 22 bp, Homo sapiens
caggccctgggcaggatcagcc

SEQ ID NO: 9423219 - DNA, 22 bp, Homo sapiens
caggccctggcagggctgagtc

SEQ ID NO: 9423220 - DNA, 22 bp, Homo sapiens
caggccctggcagggctgagtc

SEQ ID NO: 9423221 - DNA, 22 bp, Homo sapiens
caggccctggcagggctgagtc

SEQ ID NO: 9423222 - DNA, 22 bp, Homo sapiens
caggccctggcagggctgagtc

SEQ ID NO: 9423223 - DNA, 22 bp, Homo sapiens
caggccctggcagggctgagtc

SEQ ID NO: 9423224 - DNA, 22 bp, Homo sapiens
tacatatttgtctttgtactgt

SEQ ID NO: 9423225 - DNA, 22 bp, Homo sapiens
tacatcaaatcaatgttccagt

SEQ ID NO: 9423226 - DNA, 22 bp, Homo sapiens
tacatcaagataaaaactgtca

SEQ ID NO: 9423227 - DNA, 22 bp, Homo sapiens
tacatcatgaaagcatacatca

SEQ ID NO: 9423228 - DNA, 22 bp, Homo sapiens
tacatcataataatacttagaa

SEQ ID NO: 9423229 - DNA, 22 bp, Homo sapiens
tacatcatgaaagcatacatca

SEQ ID NO: 9423230 - DNA, 22 bp, Homo sapiens
tacatcatggcttcatgctgca

SEQ ID NO: 9423231 - DNA, 22 bp, Homo sapiens
tacatgtggagataactgaagc

SEQ ID NO: 9423232 - DNA, 22 bp, Homo sapiens
tacatatgtaaacatgtataaa

SEQ ID NO: 9423233 - DNA, 22 bp, Homo sapiens
tacatatgtaaacatgtataaa

SEQ ID NO: 9423234 - DNA, 22 bp, Homo sapiens
tacatatagacagttactctag

SEQ ID NO: 9423235 - DNA, 22 bp, Homo sapiens
tacatatccaggctgagaagat

SEQ ID NO: 9423236 - DNA, 22 bp, Homo sapiens
tacatatagacagttactctag

SEQ ID NO: 9423237 - DNA, 22 bp, Homo sapiens
tacatatgaactttataacttg

SEQ ID NO: 9423238 - DNA, 22 bp, Homo sapiens
tacatatttgtctttgtactgt

SEQ ID NO: 9423239 - DNA, 22 bp, Homo sapiens
tacatatttgtctttgtactgt

SEQ ID NO: 9423240 - DNA, 22 bp, Homo sapiens
tacatattcaacgttcagtatt

SEQ ID NO: 9423241 - DNA, 20 bp, Homo sapiens
tacatattatatcagctgca

SEQ ID NO: 9423242 - DNA, 22 bp, Homo sapiens
tacatattcaacgttcagtatt

SEQ ID NO: 9423243 - DNA, 22 bp, Homo sapiens
tacaaatgaaccaactttgatg

SEQ ID NO: 9423244 - DNA, 22 bp, Homo sapiens
tacaaatgaaccaactttgatg

SEQ ID NO: 9423245 - DNA, 22 bp, Homo sapiens
tacaaactaacatgtctcatcc

SEQ ID NO: 9423246 - DNA, 22 bp, Homo sapiens
caggcagggagccactgtataa

SEQ ID NO: 9423247 - DNA, 22 bp, Homo sapiens
caggcagggagctggaaaggat

SEQ ID NO: 9423248 - DNA, 22 bp, Homo sapiens
caggcagggagctggaaaggat

SEQ ID NO: 9423249 - DNA, 22 bp, Homo sapiens
tacaaatgagttgtatgaacca

SEQ ID NO: 9423250 - DNA, 22 bp, Homo sapiens
tacaaatgagttgtatgaacca

SEQ ID NO: 9423251 - DNA, 22 bp, Homo sapiens
tacaaatgagttgtatgaacca

SEQ ID NO: 9423252 - DNA, 22 bp, Homo sapiens
tacaaatgagttgtatgaacca

SEQ ID NO: 9423253 - DNA, 22 bp, Homo sapiens
tacaaatgaaccaactttgatg

SEQ ID NO: 9423254 - DNA, 22 bp, Homo sapiens
tacaaatgaaccaactttgatg

SEQ ID NO: 9423255 - DNA, 22 bp, Homo sapiens
tacaaggaggctaatgatgaca

SEQ ID NO: 9423256 - DNA, 22 bp, Homo sapiens
tacaaggaggctaatgatgaca

SEQ ID NO: 9423257 - DNA, 19 bp, Homo sapiens
tacaagcttttttggcagg

SEQ ID NO: 9423258 - DNA, 20 bp, Homo sapiens
tacaaattttccatgtttcc

SEQ ID NO: 9423259 - DNA, 20 bp, Homo sapiens
tacaaattttccatgtttcc

SEQ ID NO: 9423260 - DNA, 22 bp, Homo sapiens
tacaaatgtattttattttggt

SEQ ID NO: 9423261 - DNA, 22 bp, Homo sapiens
tacaaattaatgggcatgttta

SEQ ID NO: 9423262 - DNA, 22 bp, Homo sapiens
tacaaattaatgggcatgttta

SEQ ID NO: 9423263 - DNA, 22 bp, Homo sapiens
tacaaatgtattttattttggt

SEQ ID NO: 9423264 - DNA, 22 bp, Homo sapiens
tacaaatggttgaatggatgaa

SEQ ID NO: 9423265 - DNA, 22 bp, Homo sapiens
tacaaatgtattttattttggt

SEQ ID NO: 9423266 - DNA, 22 bp, Homo sapiens
tacaaatgggttaaaatatagt

SEQ ID NO: 9423267 - DNA, 22 bp, Homo sapiens
tacaaatgggttaaaatatagt

SEQ ID NO: 9423268 - DNA, 22 bp, Homo sapiens
tacaaatgggttaaaatatagt

SEQ ID NO: 9423269 - DNA, 22 bp, Homo sapiens
tacaaatgggttaaaatatagt

SEQ ID NO: 9423270 - DNA, 22 bp, Homo sapiens
tacaaatgcctgacacacagat

SEQ ID NO: 9423271 - DNA, 22 bp, Homo sapiens
tacaagtgtggctcctctgtct

SEQ ID NO: 9423272 - DNA, 22 bp, Homo sapiens
tacaagtgtaagcttgtgagac

SEQ ID NO: 9423273 - DNA, 22 bp, Homo sapiens
tacaagtgtgcaccaccatgtc

SEQ ID NO: 9423274 - DNA, 22 bp, Homo sapiens
tacaagtgctagcagatattgt

SEQ ID NO: 9423275 - DNA, 22 bp, Homo sapiens
tacaagtcacttcctttctaaa

SEQ ID NO: 9423276 - DNA, 22 bp, Homo sapiens
tacaagtcacttcctttctaaa

SEQ ID NO: 9423277 - DNA, 22 bp, Homo sapiens
tacaagtcattggatgaggaat

SEQ ID NO: 9423278 - DNA, 22 bp, Homo sapiens
tacaagtaaattgtagatacca

SEQ ID NO: 9423279 - DNA, 22 bp, Homo sapiens
tacaaggcttcagctcagctat

SEQ ID NO: 9423280 - DNA, 22 bp, Homo sapiens
tacaaggcaaatccatgatgtc

SEQ ID NO: 9423281 - DNA, 22 bp, Homo sapiens
tacaaggcaaatccatgatgtc

SEQ ID NO: 9423282 - DNA, 22 bp, Homo sapiens
tacaagtactgtggctttgaat

SEQ ID NO: 9423283 - DNA, 22 bp, Homo sapiens
tacaagtatgttttaaaatgtt

SEQ ID NO: 9423284 - DNA, 22 bp, Homo sapiens
tacaagtatgttttaaaatgtt

SEQ ID NO: 9423285 - DNA, 20 bp, Homo sapiens
tacaatacacatgcatatga

SEQ ID NO: 9423286 - DNA, 22 bp, Homo sapiens
tacagggattgttttaatcacc

SEQ ID NO: 9423287 - DNA, 22 bp, Homo sapiens
tacagggattgttttaatcacc

SEQ ID NO: 9423288 - DNA, 22 bp, Homo sapiens
tacagggattcctgccgctcgc

SEQ ID NO: 9423289 - DNA, 22 bp, Homo sapiens
tacagcttaaaaaagccaactt

SEQ ID NO: 9423290 - DNA, 22 bp, Homo sapiens
tacagggattcctgccgctcgc

SEQ ID NO: 9423291 - DNA, 22 bp, Homo sapiens
tacagctgttggtgtttcctct

SEQ ID NO: 9423292 - DNA, 22 bp, Homo sapiens
tacagctgttggtgtttcctct

SEQ ID NO: 9423293 - DNA, 22 bp, Homo sapiens
tacaggtaaaattatcagaaac

SEQ ID NO: 9423294 - DNA, 22 bp, Homo sapiens
tacaggtagagtctctagttta

SEQ ID NO: 9423295 - DNA, 22 bp, Homo sapiens
tacagggtataggtacagatga

SEQ ID NO: 9423296 - DNA, 22 bp, Homo sapiens
tacagggtattcaagggtagtt

SEQ ID NO: 9423297 - DNA, 22 bp, Homo sapiens
taatgttagtatgtaatcttat

SEQ ID NO: 9423298 - DNA, 22 bp, Homo sapiens
taatgttagtatgtaatcttat

SEQ ID NO: 9423299 - DNA, 22 bp, Homo sapiens
taatgttataaattcttggttt

SEQ ID NO: 9423300 - DNA, 22 bp, Homo sapiens
caggcagagcaactggtccaga

SEQ ID NO: 9423301 - DNA, 22 bp, Homo sapiens
caggcagagcaactggtccaga

SEQ ID NO: 9423302 - DNA, 22 bp, Homo sapiens
taattgtatggagaaggctgca

SEQ ID NO: 9423303 - DNA, 22 bp, Homo sapiens
taattgtagctttgtaatcagc

SEQ ID NO: 9423304 - DNA, 22 bp, Homo sapiens
taattgtactccctgtgggaaa

SEQ ID NO: 9423305 - DNA, 22 bp, Homo sapiens
taattgtagctttgtaatcagc

SEQ ID NO: 9423306 - DNA, 22 bp, Homo sapiens
taattgtacgatgttaaatcag

SEQ ID NO: 9423307 - DNA, 22 bp, Homo sapiens
taattgtaaagtagtagtacag

SEQ ID NO: 9423308 - DNA, 22 bp, Homo sapiens
taatttaattccatggattcta

SEQ ID NO: 9423309 - DNA, 22 bp, Homo sapiens
taatttaatccaagtgttacat

SEQ ID NO: 9423310 - DNA, 22 bp, Homo sapiens
taatttactcagatgttcaatc

SEQ ID NO: 9423311 - DNA, 22 bp, Homo sapiens
taatttacttgcaaataacaat

SEQ ID NO: 9423312 - DNA, 22 bp, Homo sapiens
taatttacttgcaaataacaat

SEQ ID NO: 9423313 - DNA, 22 bp, Homo sapiens
taatttacagttcgccatgtct

SEQ ID NO: 9423314 - DNA, 22 bp, Homo sapiens
taatttacagttcgccatgtct

SEQ ID NO: 9423315 - DNA, 22 bp, Homo sapiens
taatttactcagatgttcaatc

SEQ ID NO: 9423316 - DNA, 22 bp, Homo sapiens
taatttactcagatgttcaatc

SEQ ID NO: 9423317 - DNA, 22 bp, Homo sapiens
taatttacagagatacagtcag

SEQ ID NO: 9423318 - DNA, 22 bp, Homo sapiens
taatttacagagatacagtcag

SEQ ID NO: 9423319 - DNA, 22 bp, Homo sapiens
taatttaatttcatgccagcct

SEQ ID NO: 9423320 - DNA, 22 bp, Homo sapiens
caggcagacatttttgacatag

SEQ ID NO: 9423321 - DNA, 22 bp, Homo sapiens
caggcagactttgagaatgatg

SEQ ID NO: 9423322 - DNA, 22 bp, Homo sapiens
caggcagagaactcatccgtga

SEQ ID NO: 9423323 - DNA, 22 bp, Homo sapiens
caggcagagaactcatccgtga

SEQ ID NO: 9423324 - DNA, 22 bp, Homo sapiens
caggcagagaggagcatttaat

SEQ ID NO: 9423325 - DNA, 22 bp, Homo sapiens
caggcagagacgtcagtgtagg

SEQ ID NO: 9423326 - DNA, 22 bp, Homo sapiens
caggcagagacgtcagtgtagg

SEQ ID NO: 9423327 - DNA, 22 bp, Homo sapiens
caggcagagacgtcagtgtagg

SEQ ID NO: 9423328 - DNA, 22 bp, Homo sapiens
caggcagagaccctctcctaaa

SEQ ID NO: 9423329 - DNA, 22 bp, Homo sapiens
caggcagagacgtcagtgtagg

SEQ ID NO: 9423330 - DNA, 22 bp, Homo sapiens
caggcagaaggaagtaccaggc

SEQ ID NO: 9423331 - DNA, 22 bp, Homo sapiens
caggcagaaggaagtaccaggc

SEQ ID NO: 9423332 - DNA, 22 bp, Homo sapiens
caggcagaatgaccgacctcgc

SEQ ID NO: 9423333 - DNA, 22 bp, Homo sapiens
caggcagaatgaccgacctcgc

SEQ ID NO: 9423334 - DNA, 22 bp, Homo sapiens
caggcagaatgagattacttca

SEQ ID NO: 9423335 - DNA, 22 bp, Homo sapiens
caggcagaatgagattacttca

SEQ ID NO: 9423336 - DNA, 17 bp, Homo sapiens
caggcagacatgtaagc

SEQ ID NO: 9423337 - DNA, 22 bp, Homo sapiens
caggcagaagaagtggaaggac

SEQ ID NO: 9423338 - DNA, 22 bp, Homo sapiens
caggcagaaggaagtaccaggc

SEQ ID NO: 9423339 - DNA, 22 bp, Homo sapiens
caggcagaaggaagtaccaggc

SEQ ID NO: 9423340 - DNA, 22 bp, Homo sapiens
caggcagaagaagtggaaggac

SEQ ID NO: 9423341 - DNA, 22 bp, Homo sapiens
caggcagaagaagtggaaggac

SEQ ID NO: 9423342 - DNA, 22 bp, Homo sapiens
caggcagctgctgggttcagcc

SEQ ID NO: 9423343 - DNA, 22 bp, Homo sapiens
caggcaggagacatttggttgg

SEQ ID NO: 9423344 - DNA, 22 bp, Homo sapiens
caggcaggagacatttggttgg

SEQ ID NO: 9423345 - DNA, 22 bp, Homo sapiens
caggcagctgggtcaccgtccc

SEQ ID NO: 9423346 - DNA, 22 bp, Homo sapiens
caggcagctgactgtcagatat

SEQ ID NO: 9423347 - DNA, 22 bp, Homo sapiens
caggcagctgcgacaagagagc

SEQ ID NO: 9423348 - DNA, 22 bp, Homo sapiens
caggcagctgcgacaagagagc

SEQ ID NO: 9423349 - DNA, 22 bp, Homo sapiens
caggcagctgctgggttcagcc

SEQ ID NO: 9423350 - DNA, 22 bp, Homo sapiens
caggcagggagccactgtataa

SEQ ID NO: 9423351 - DNA, 22 bp, Homo sapiens
caggcaggctgctttttgttca

SEQ ID NO: 9423352 - DNA, 22 bp, Homo sapiens
caggcaggctgctttttgttca

SEQ ID NO: 9423353 - DNA, 23 bp, Homo sapiens
caggcaggatgaggactacactc

SEQ ID NO: 9423354 - DNA, 23 bp, Homo sapiens
caggcaggatgaggactacactc

SEQ ID NO: 9423355 - DNA, 23 bp, Homo sapiens
caggcaggatgaggactacactc

SEQ ID NO: 9423356 - DNA, 23 bp, Homo sapiens
caggcaggatgaggactacactc

SEQ ID NO: 9423357 - DNA, 22 bp, Homo sapiens
caggcaggagccagggattcca

SEQ ID NO: 9423358 - DNA, 22 bp, Homo sapiens
caggcaggagaggaggatttct

SEQ ID NO: 9423359 - DNA, 22 bp, Homo sapiens
caggcaggagacatttggttgg

SEQ ID NO: 9423360 - DNA, 22 bp, Homo sapiens
caggcaggagaggaggatttct

SEQ ID NO: 9423361 - DNA, 22 bp, Homo sapiens
caggcaggagaggaggatttct

SEQ ID NO: 9423362 - DNA, 22 bp, Homo sapiens
caggcagcagccactctggtat

SEQ ID NO: 9423363 - DNA, 22 bp, Homo sapiens
caggcagcagccactctggtat

SEQ ID NO: 9423364 - DNA, 22 bp, Homo sapiens
caggcagcagccactctggtat

SEQ ID NO: 9423365 - DNA, 22 bp, Homo sapiens
caggcagcagccactctggtat

SEQ ID NO: 9423366 - DNA, 22 bp, Homo sapiens
caggcagcaggagccctgctcg

SEQ ID NO: 9423367 - DNA, 22 bp, Homo sapiens
caggcagctctaatggaaagtg

SEQ ID NO: 9423368 - DNA, 22 bp, Homo sapiens
caggcagctctaatggaaagtg

SEQ ID NO: 9423369 - DNA, 22 bp, Homo sapiens
caggcagctctaatggaaagtg

SEQ ID NO: 9423370 - DNA, 22 bp, Homo sapiens
caggcagctgactgtcagatat

SEQ ID NO: 9423371 - DNA, 22 bp, Homo sapiens
caggcagcctgagggatctggg

SEQ ID NO: 9423372 - DNA, 22 bp, Homo sapiens
caggattgcagatttgattaga

SEQ ID NO: 9423373 - DNA, 22 bp, Homo sapiens
caggcaacgtccttagagatgc

SEQ ID NO: 9423374 - DNA, 22 bp, Homo sapiens
caggatttcatacatctttact

SEQ ID NO: 9423375 - DNA, 19 bp, Homo sapiens
caggattgtttaaagcttt

SEQ ID NO: 9423376 - DNA, 22 bp, Homo sapiens
caggcaagatccagaggctgct

SEQ ID NO: 9423377 - DNA, 22 bp, Homo sapiens
caggcaagattagagatgagca

SEQ ID NO: 9423378 - DNA, 22 bp, Homo sapiens
caggcaagatccagaggctgct

SEQ ID NO: 9423379 - DNA, 22 bp, Homo sapiens
caggcaagatccagaggctgct

SEQ ID NO: 9423380 - DNA, 22 bp, Homo sapiens
caggcaagatccagaggctgct

SEQ ID NO: 9423381 - DNA, 22 bp, Homo sapiens
caggatggtgtgagtgtgagga

SEQ ID NO: 9423382 - DNA, 22 bp, Homo sapiens
caggatggtggcatgatcagaa

SEQ ID NO: 9423383 - DNA, 22 bp, Homo sapiens
caggatggtgtgagtgtgagga

SEQ ID NO: 9423384 - DNA, 22 bp, Homo sapiens
caggattgaatgcttctccctg

SEQ ID NO: 9423385 - DNA, 22 bp, Homo sapiens
caggattataaactgtgcactg

SEQ ID NO: 9423386 - DNA, 22 bp, Homo sapiens
caggcaagttcatttccaggca

SEQ ID NO: 9423387 - DNA, 22 bp, Homo sapiens
caggcaagttcatttccaggca

SEQ ID NO: 9423388 - DNA, 22 bp, Homo sapiens
caggcaaggaggcactgaggga

SEQ ID NO: 9423389 - DNA, 22 bp, Homo sapiens
caggcaaggaggcactgaggga

SEQ ID NO: 9423390 - DNA, 22 bp, Homo sapiens
caggcaaggaggcactgaggga

SEQ ID NO: 9423391 - DNA, 22 bp, Homo sapiens
caggcaaggaggcactgaggga

SEQ ID NO: 9423392 - DNA, 22 bp, Homo sapiens
caggcaagcacggtgaacctgg

SEQ ID NO: 9423393 - DNA, 22 bp, Homo sapiens
caggcaaggagctggctcaagt

SEQ ID NO: 9423394 - DNA, 22 bp, Homo sapiens
caggcaaggagctggctcaagt

SEQ ID NO: 9423395 - DNA, 22 bp, Homo sapiens
caggcaagattagagatgagca

SEQ ID NO: 9423396 - DNA, 22 bp, Homo sapiens
caggcacagtggggtcctctct

SEQ ID NO: 9423397 - DNA, 22 bp, Homo sapiens
caggcacagctaagactggcca

SEQ ID NO: 9423398 - DNA, 22 bp, Homo sapiens
caggcacagacgcaaacttctt

SEQ ID NO: 9423399 - DNA, 22 bp, Homo sapiens
caggcacagacgcaaacttctt

SEQ ID NO: 9423400 - DNA, 22 bp, Homo sapiens
caggcacagagagaataccttt

SEQ ID NO: 9423401 - DNA, 22 bp, Homo sapiens
caggcacaagaagcaaatgtta

SEQ ID NO: 9423402 - DNA, 22 bp, Homo sapiens
caggcacaagaagcaaatgtta

SEQ ID NO: 9423403 - DNA, 22 bp, Homo sapiens
caggcacaagatcggctagata

SEQ ID NO: 9423404 - DNA, 22 bp, Homo sapiens
caggcacatgggagctcatcat

SEQ ID NO: 9423405 - DNA, 22 bp, Homo sapiens
caggcaccaacttcctggggag

SEQ ID NO: 9423406 - DNA, 22 bp, Homo sapiens
caggcacatgggagctcatcat

SEQ ID NO: 9423407 - DNA, 22 bp, Homo sapiens
taagacacagtccgcactctct

SEQ ID NO: 9423408 - DNA, 22 bp, Homo sapiens
taagacaattcttcagtcacaa

SEQ ID NO: 9423409 - DNA, 17 bp, Homo sapiens
caggcacatgaagccag

SEQ ID NO: 9423410 - DNA, 22 bp, Homo sapiens
caggcacatgggagctcatcat

SEQ ID NO: 9423411 - DNA, 22 bp, Homo sapiens
caggcacagtggggtcctctct

SEQ ID NO: 9423412 - DNA, 22 bp, Homo sapiens
taagacacatgcgtacaagata

SEQ ID NO: 9423413 - DNA, 22 bp, Homo sapiens
taagacacattcatatctgtct

SEQ ID NO: 9423414 - DNA, 22 bp, Homo sapiens
taagacacattgagaaacacaa

SEQ ID NO: 9423415 - DNA, 22 bp, Homo sapiens
taagacacattggagtagatga

SEQ ID NO: 9423416 - DNA, 22 bp, Homo sapiens
taagacacattggagtagatga

SEQ ID NO: 9423417 - DNA, 22 bp, Homo sapiens
taagacacgggctgatctaaag

SEQ ID NO: 9423418 - DNA, 22 bp, Homo sapiens
taagacacctctctgcccttca

SEQ ID NO: 9423419 - DNA, 23 bp, Homo sapiens
taagacacccgactccagagatg

SEQ ID NO: 9423420 - DNA, 22 bp, Homo sapiens
taagatgtaagatcagagcttg

SEQ ID NO: 9423421 - DNA, 22 bp, Homo sapiens
taagatgtaagatcagagcttg

SEQ ID NO: 9423422 - DNA, 22 bp, Homo sapiens
taagatgtacaaccacttctct

SEQ ID NO: 9423423 - DNA, 22 bp, Homo sapiens
taagatgtcaaagggtcacagt

SEQ ID NO: 9423424 - DNA, 22 bp, Homo sapiens
taagcaaagtttataaggctct

SEQ ID NO: 9423425 - DNA, 22 bp, Homo sapiens
taagcaaataatgcatcaaggg

SEQ ID NO: 9423426 - DNA, 22 bp, Homo sapiens
taagcaaataatgcatcaaggg

SEQ ID NO: 9423427 - DNA, 22 bp, Homo sapiens
taagcaaataatgcatcaaggg

SEQ ID NO: 9423428 - DNA, 22 bp, Homo sapiens
taagcaaataatgcatcaaggg

SEQ ID NO: 9423429 - DNA, 22 bp, Homo sapiens
taagcaaaggattttgatcttt

SEQ ID NO: 9423430 - DNA, 22 bp, Homo sapiens
taagcaaaggattttgatcttt

SEQ ID NO: 9423431 - DNA, 22 bp, Homo sapiens
taagcaaagtttataaggctct

SEQ ID NO: 9423432 - DNA, 22 bp, Homo sapiens
taagcaaaggattttgatcttt

SEQ ID NO: 9423433 - DNA, 22 bp, Homo sapiens
taagatttttaaaatgtcctca

SEQ ID NO: 9423434 - DNA, 22 bp, Homo sapiens
taagcaaaagtcgagtgtgagc

SEQ ID NO: 9423435 - DNA, 22 bp, Homo sapiens
taagattacagtgagaaataaa

SEQ ID NO: 9423436 - DNA, 22 bp, Homo sapiens
taagatttttaaaatgtcctca

SEQ ID NO: 9423437 - DNA, 22 bp, Homo sapiens
taagattatacttaaagagaaa

SEQ ID NO: 9423438 - DNA, 22 bp, Homo sapiens
taagatgtttacagtatggaga

SEQ ID NO: 9423439 - DNA, 22 bp, Homo sapiens
taagatgttttggtttgataag

SEQ ID NO: 9423440 - DNA, 22 bp, Homo sapiens
taagattacagtgagaaataaa

SEQ ID NO: 9423441 - DNA, 22 bp, Homo sapiens
taagatgtctaagaggagatgc

SEQ ID NO: 9423442 - DNA, 22 bp, Homo sapiens
taagatgtggaatcacagcttc

SEQ ID NO: 9423443 - DNA, 22 bp, Homo sapiens
taagatgtcaaagggtcacagt

SEQ ID NO: 9423444 - DNA, 22 bp, Homo sapiens
taagatgtcatccacatagagt

SEQ ID NO: 9423445 - DNA, 22 bp, Homo sapiens
taagatgtcatccacatagagt

SEQ ID NO: 9423446 - DNA, 22 bp, Homo sapiens
taagcaaatagctagatcagag

SEQ ID NO: 9423447 - DNA, 22 bp, Homo sapiens
taagcaaatagctagatcagag

SEQ ID NO: 9423448 - DNA, 22 bp, Homo sapiens
taagcaaatagctagatcagag

SEQ ID NO: 9423449 - DNA, 22 bp, Homo sapiens
taagcaaatagctagatcagag

SEQ ID NO: 9423450 - DNA, 22 bp, Homo sapiens
taagcaaataatgcatcaaggg

SEQ ID NO: 9423451 - DNA, 22 bp, Homo sapiens
taagcaaatagctagatcagag

SEQ ID NO: 9423452 - DNA, 22 bp, Homo sapiens
taaggcacacagttgctgcatg

SEQ ID NO: 9423453 - DNA, 22 bp, Homo sapiens
taaggcacacagttgctgcatg

SEQ ID NO: 9423454 - DNA, 22 bp, Homo sapiens
taaggcacccatgttcatacag

SEQ ID NO: 9423455 - DNA, 22 bp, Homo sapiens
taaggcaccataatatatttaa

SEQ ID NO: 9423456 - DNA, 22 bp, Homo sapiens
taaggcacgcataagagggggc

SEQ ID NO: 9423457 - DNA, 22 bp, Homo sapiens
taaggcacctgtccaggctggg

SEQ ID NO: 9423458 - DNA, 22 bp, Homo sapiens
taaggcacccgtgagctgccag

SEQ ID NO: 9423459 - DNA, 22 bp, Homo sapiens
taaggcacccttctgagtagag

SEQ ID NO: 9423460 - DNA, 22 bp, Homo sapiens
taaggcagaaatatgagcaggg

SEQ ID NO: 9423461 - DNA, 22 bp, Homo sapiens
taaggcagaaatatgagcaggg

SEQ ID NO: 9423462 - DNA, 22 bp, Homo sapiens
taaggcacttcaatgtttagaa

SEQ ID NO: 9423463 - DNA, 22 bp, Homo sapiens
taaggcacgcggtgaatgccaa

SEQ ID NO: 9423464 - DNA, 22 bp, Homo sapiens
caggcactagcagaatgaggct

SEQ ID NO: 9423465 - DNA, 22 bp, Homo sapiens
caggcacgggggcatggcctct

SEQ ID NO: 9423466 - DNA, 22 bp, Homo sapiens
taaggcagccgctcagagaggt

SEQ ID NO: 9423467 - DNA, 22 bp, Homo sapiens
caggcagaaattttgtttcatt

SEQ ID NO: 9423468 - DNA, 22 bp, Homo sapiens
caggcagaaagtattctgtgta

SEQ ID NO: 9423469 - DNA, 22 bp, Homo sapiens
caggcagaaagtattctgtgta

SEQ ID NO: 9423470 - DNA, 22 bp, Homo sapiens
caggcagaaagtattctgtgta

SEQ ID NO: 9423471 - DNA, 22 bp, Homo sapiens
taaggcagatgtggaatcaatt

SEQ ID NO: 9423472 - DNA, 22 bp, Homo sapiens
taaggcagatgtggaatcaatt

SEQ ID NO: 9423473 - DNA, 22 bp, Homo sapiens
taaggcagaaatatgagcaggg

SEQ ID NO: 9423474 - DNA, 22 bp, Homo sapiens
taaggcagaggtaccactaggc

SEQ ID NO: 9423475 - DNA, 19 bp, Homo sapiens
taaggcagcagtgacaggc

SEQ ID NO: 9423476 - DNA, 19 bp, Homo sapiens
taaggcagcagtgacaggc

SEQ ID NO: 9423477 - DNA, 22 bp, Homo sapiens
taaggcagccgctcagagaggt

SEQ ID NO: 9423478 - DNA, 22 bp, Homo sapiens
taaggcagccgctcagagaggt

SEQ ID NO: 9423479 - DNA, 22 bp, Homo sapiens
taaggcagcataattaggccac

SEQ ID NO: 9423480 - DNA, 22 bp, Homo sapiens
taactttgatcacttgataagg

SEQ ID NO: 9423481 - DNA, 22 bp, Homo sapiens
taactttggggacacttctctt

SEQ ID NO: 9423482 - DNA, 22 bp, Homo sapiens
taactttggggacacttctctt

SEQ ID NO: 9423483 - DNA, 22 bp, Homo sapiens
taacttttacatttggctcact

SEQ ID NO: 9423484 - DNA, 22 bp, Homo sapiens
taactttcttcatatgtgaacc

SEQ ID NO: 9423485 - DNA, 22 bp, Homo sapiens
taactttgaagggaattttact

SEQ ID NO: 9423486 - DNA, 22 bp, Homo sapiens
taactttgaagggaattttact

SEQ ID NO: 9423487 - DNA, 20 bp, Homo sapiens
taactttctatgctttcagc

SEQ ID NO: 9423488 - DNA, 22 bp, Homo sapiens
taactttaggaataggtaatct

SEQ ID NO: 9423489 - DNA, 22 bp, Homo sapiens
taactttagtgtatgaggtaag

SEQ ID NO: 9423490 - DNA, 15 bp, Homo sapiens
taacttttttgggct

SEQ ID NO: 9423491 - DNA, 21 bp, Homo sapiens
taacttttgtgcctatcttgt

SEQ ID NO: 9423492 - DNA, 22 bp, Homo sapiens
taacttttctaggtgtgataat

SEQ ID NO: 9423493 - DNA, 22 bp, Homo sapiens
taacttttacttaccatctgag

SEQ ID NO: 9423494 - DNA, 22 bp, Homo sapiens
taacttttgtgatctgtcgatt

SEQ ID NO: 9423495 - DNA, 22 bp, Homo sapiens
taacttttctaggtgtgataat

SEQ ID NO: 9423496 - DNA, 22 bp, Homo sapiens
taagaaacatgatacttttcct

SEQ ID NO: 9423497 - DNA, 22 bp, Homo sapiens
taagaaacatgatacttttcct

SEQ ID NO: 9423498 - DNA, 22 bp, Homo sapiens
taagaaacatgatacttttcct

SEQ ID NO: 9423499 - DNA, 22 bp, Homo sapiens
taagaaacatgattaatggcag

SEQ ID NO: 9423500 - DNA, 22 bp, Homo sapiens
taagaaacatgattaatggcag

SEQ ID NO: 9423501 - DNA, 22 bp, Homo sapiens
taagaaacatttttatgacagt

SEQ ID NO: 9423502 - DNA, 22 bp, Homo sapiens
taacttctttggtttaaagaga

SEQ ID NO: 9423503 - DNA, 22 bp, Homo sapiens
taacttctttggtttaaagaga

SEQ ID NO: 9423504 - DNA, 22 bp, Homo sapiens
taacttgtgttacattactctt

SEQ ID NO: 9423505 - DNA, 22 bp, Homo sapiens
taacttgtgttacattactctt

SEQ ID NO: 9423506 - DNA, 22 bp, Homo sapiens
taacttgataagtattctctgc

SEQ ID NO: 9423507 - DNA, 22 bp, Homo sapiens
taacttgataagtattctctgc

SEQ ID NO: 9423508 - DNA, 19 bp, Homo sapiens
taacttgtagatatgaagt

SEQ ID NO: 9423509 - DNA, 22 bp, Homo sapiens
taacatttgctgtctcctatgt

SEQ ID NO: 9423510 - DNA, 22 bp, Homo sapiens
taacatttgctgtctcctatgt

SEQ ID NO: 9423511 - DNA, 22 bp, Homo sapiens
taacatttagaaagtgtccatt

SEQ ID NO: 9423512 - DNA, 22 bp, Homo sapiens
taacatttaaatttttcacata

SEQ ID NO: 9423513 - DNA, 22 bp, Homo sapiens
caggatggtcttcatttggctc

SEQ ID NO: 9423514 - DNA, 22 bp, Homo sapiens
caggatggtggcatgatcagaa

SEQ ID NO: 9423515 - DNA, 22 bp, Homo sapiens
caggatgccatctgctgctgct

SEQ ID NO: 9423516 - DNA, 22 bp, Homo sapiens
caggatgcactaggaaccaggg

SEQ ID NO: 9423517 - DNA, 22 bp, Homo sapiens
caggatgagaggcccagggaag

SEQ ID NO: 9423518 - DNA, 19 bp, Homo sapiens
caggatgatcccatgacac

SEQ ID NO: 9423519 - DNA, 19 bp, Homo sapiens
caggatgatcccatgacac

SEQ ID NO: 9423520 - DNA, 18 bp, Homo sapiens
caggatgagtgatgggga

SEQ ID NO: 9423521 - DNA, 22 bp, Homo sapiens
caggatgaggtagaggcagata

SEQ ID NO: 9423522 - DNA, 22 bp, Homo sapiens
caggatctgccaatattcaacc

SEQ ID NO: 9423523 - DNA, 22 bp, Homo sapiens
taagaaacccaggaatttctta

SEQ ID NO: 9423524 - DNA, 22 bp, Homo sapiens
taagaaacatttttatgacagt

SEQ ID NO: 9423525 - DNA, 22 bp, Homo sapiens
taagaaacatttttatgacagt

SEQ ID NO: 9423526 - DNA, 22 bp, Homo sapiens
taacagaagatgaaacttcttt

SEQ ID NO: 9423527 - DNA, 22 bp, Homo sapiens
taacagaagagcaggcagccct

SEQ ID NO: 9423528 - DNA, 22 bp, Homo sapiens
taacagaaatagtaggtgaggg

SEQ ID NO: 9423529 - DNA, 22 bp, Homo sapiens
taacagaaattttagttagggg

SEQ ID NO: 9423530 - DNA, 22 bp, Homo sapiens
taacagaaatagaaatgagagt

SEQ ID NO: 9423531 - DNA, 22 bp, Homo sapiens
taacagaaatagaaatgagagt

SEQ ID NO: 9423532 - DNA, 22 bp, Homo sapiens
taacagaaatagtaggtgaggg

SEQ ID NO: 9423533 - DNA, 22 bp, Homo sapiens
taacagaaatagaaatgagagt

SEQ ID NO: 9423534 - DNA, 22 bp, Homo sapiens
taacagaaatagaaatgagagt

SEQ ID NO: 9423535 - DNA, 22 bp, Homo sapiens
taacagaaaggggacagaaata

SEQ ID NO: 9423536 - DNA, 22 bp, Homo sapiens
taacagaaaggggacagaaata

SEQ ID NO: 9423537 - DNA, 22 bp, Homo sapiens
taacagaaaggggacagaaata

SEQ ID NO: 9423538 - DNA, 20 bp, Homo sapiens
taacagaagtagaagtgggt

SEQ ID NO: 9423539 - DNA, 22 bp, Homo sapiens
taacattacggacatctgtcag

SEQ ID NO: 9423540 - DNA, 22 bp, Homo sapiens
taacattaggtagacataagcc

SEQ ID NO: 9423541 - DNA, 22 bp, Homo sapiens
taacattaggtagacataagcc

SEQ ID NO: 9423542 - DNA, 22 bp, Homo sapiens
taacattgagtccactaaacag

SEQ ID NO: 9423543 - DNA, 22 bp, Homo sapiens
taacattgagtccactaaacag

SEQ ID NO: 9423544 - DNA, 22 bp, Homo sapiens
taacattgttatgaatcaggtc

SEQ ID NO: 9423545 - DNA, 22 bp, Homo sapiens
taacattgtcagttcaactgct

SEQ ID NO: 9423546 - DNA, 22 bp, Homo sapiens
taacattgttatgaatcaggtc

SEQ ID NO: 9423547 - DNA, 22 bp, Homo sapiens
taacattccatggatctgcaga

SEQ ID NO: 9423548 - DNA, 22 bp, Homo sapiens
taacattcttaacttagaaaca

SEQ ID NO: 9423549 - DNA, 22 bp, Homo sapiens
taacaaggtggtcttggtattt

SEQ ID NO: 9423550 - DNA, 22 bp, Homo sapiens
taacaaggtaagcctggccatg

SEQ ID NO: 9423551 - DNA, 22 bp, Homo sapiens
taacaacttgcttttatcttag

SEQ ID NO: 9423552 - DNA, 22 bp, Homo sapiens
taacaacttgcttttatcttag

SEQ ID NO: 9423553 - DNA, 22 bp, Homo sapiens
taacaacttgcttttatcttag

SEQ ID NO: 9423554 - DNA, 22 bp, Homo sapiens
taacaagatatatgacttggat

SEQ ID NO: 9423555 - DNA, 19 bp, Homo sapiens
taacaaagtctgaagtcag

SEQ ID NO: 9423556 - DNA, 22 bp, Homo sapiens
taacaacatgcaatttaacctt

SEQ ID NO: 9423557 - DNA, 22 bp, Homo sapiens
taacaactggacaatgttgctc

SEQ ID NO: 9423558 - DNA, 22 bp, Homo sapiens
taacaactgctgaggtatttga

SEQ ID NO: 9423559 - DNA, 19 bp, Homo sapiens
taacaaagtctgaagtcag

SEQ ID NO: 9423560 - DNA, 22 bp, Homo sapiens
taacacttgggggcatccttag

SEQ ID NO: 9423561 - DNA, 22 bp, Homo sapiens
taacagaaaggctcaggtgctc

SEQ ID NO: 9423562 - DNA, 22 bp, Homo sapiens
taacagaaaggggacagaaata

SEQ ID NO: 9423563 - DNA, 22 bp, Homo sapiens
taacagaaacagataagtgtaa

SEQ ID NO: 9423564 - DNA, 22 bp, Homo sapiens
taacaatacccattctaattac

SEQ ID NO: 9423565 - DNA, 22 bp, Homo sapiens
taacaatacccattctaattac

SEQ ID NO: 9423566 - DNA, 22 bp, Homo sapiens
taacaatacccattctaattac

SEQ ID NO: 9423567 - DNA, 22 bp, Homo sapiens
taacaatacccattctaattac

SEQ ID NO: 9423568 - DNA, 22 bp, Homo sapiens
taacactgtgtctgccatatcc

SEQ ID NO: 9423569 - DNA, 22 bp, Homo sapiens
taacactgtgtctgccatatcc

SEQ ID NO: 9423570 - DNA, 22 bp, Homo sapiens
taacacttcagatgattttgtt

SEQ ID NO: 9423571 - DNA, 22 bp, Homo sapiens
caggagacaagttagcagctga

SEQ ID NO: 9423572 - DNA, 22 bp, Homo sapiens
caggagacaatggctgtggggc

SEQ ID NO: 9423573 - DNA, 22 bp, Homo sapiens
caggagaaggtttggagtgcag

SEQ ID NO: 9423574 - DNA, 22 bp, Homo sapiens
caggagaagtctctagggggtg

SEQ ID NO: 9423575 - DNA, 22 bp, Homo sapiens
caggagaaggtttggagtgcag

SEQ ID NO: 9423576 - DNA, 22 bp, Homo sapiens
caggagaagtctctagggggtg

SEQ ID NO: 9423577 - DNA, 22 bp, Homo sapiens
caggagaagtctctagggggtg

SEQ ID NO: 9423578 - DNA, 22 bp, Homo sapiens
caggagaagtctctagggggtg

SEQ ID NO: 9423579 - DNA, 22 bp, Homo sapiens
caggacccatcagccaggcact

SEQ ID NO: 9423580 - DNA, 22 bp, Homo sapiens
caggaccccatattcactgaac

SEQ ID NO: 9423581 - DNA, 22 bp, Homo sapiens
caggagaaggtttggagtgcag

SEQ ID NO: 9423582 - DNA, 19 bp, Homo sapiens
caggacagtttgccaagaa

SEQ ID NO: 9423583 - DNA, 22 bp, Homo sapiens
caggacagttggcatctgctgc

SEQ ID NO: 9423584 - DNA, 19 bp, Homo sapiens
caggacagtttgccaagaa

SEQ ID NO: 9423585 - DNA, 19 bp, Homo sapiens
caggacagtttgccaagaa

SEQ ID NO: 9423586 - DNA, 19 bp, Homo sapiens
caggacagtttgccaagaa

SEQ ID NO: 9423587 - DNA, 22 bp, Homo sapiens
caggacagtttgctttgccctg

SEQ ID NO: 9423588 - DNA, 19 bp, Homo sapiens
caggacagtttgccaagaa

SEQ ID NO: 9423589 - DNA, 22 bp, Homo sapiens
caggacagtttgctttgccctg

SEQ ID NO: 9423590 - DNA, 22 bp, Homo sapiens
caggacagtttgctttgccctg

SEQ ID NO: 9423591 - DNA, 22 bp, Homo sapiens
caggaccaggcgttctgggctg

SEQ ID NO: 9423592 - DNA, 22 bp, Homo sapiens
caggaccaggcgttctgggctg

SEQ ID NO: 9423593 - DNA, 22 bp, Homo sapiens
caggacccaacctccctgctct

SEQ ID NO: 9423594 - DNA, 22 bp, Homo sapiens
caggacccaacctccctgctct

SEQ ID NO: 9423595 - DNA, 22 bp, Homo sapiens
caggacagtgcaggtccatcct

SEQ ID NO: 9423596 - DNA, 22 bp, Homo sapiens
caggacagtgcaggtccatcct

SEQ ID NO: 9423597 - DNA, 22 bp, Homo sapiens
taaactgaagctcaactcaaat

SEQ ID NO: 9423598 - DNA, 22 bp, Homo sapiens
caggacagttggcatctgctgc

SEQ ID NO: 9423599 - DNA, 22 bp, Homo sapiens
caggacagtgcaggtccatcct

SEQ ID NO: 9423600 - DNA, 22 bp, Homo sapiens
caggacagtgcaggtccatcct

SEQ ID NO: 9423601 - DNA, 22 bp, Homo sapiens
caggacagtgcaggtccatcct

SEQ ID NO: 9423602 - DNA, 22 bp, Homo sapiens
taaactatctgtgtttgaagtt

SEQ ID NO: 9423603 - DNA, 22 bp, Homo sapiens
taaactatctgtgtttgaagtt

SEQ ID NO: 9423604 - DNA, 22 bp, Homo sapiens
taaactatctgtgtttgaagtt

SEQ ID NO: 9423605 - DNA, 22 bp, Homo sapiens
taaactatctgtgtttgaagtt

SEQ ID NO: 9423606 - DNA, 22 bp, Homo sapiens
taaactactaggatgaattttt

SEQ ID NO: 9423607 - DNA, 22 bp, Homo sapiens
taaaccattcagactgaaccac

SEQ ID NO: 9423608 - DNA, 22 bp, Homo sapiens
taaaccatgcagacagctccat

SEQ ID NO: 9423609 - DNA, 22 bp, Homo sapiens
taaaccattcacatcccagaaa

SEQ ID NO: 9423610 - DNA, 22 bp, Homo sapiens
taaaccatccatcccacctgtg

SEQ ID NO: 9423611 - DNA, 22 bp, Homo sapiens
taaaccaggtaaagaagctctc

SEQ ID NO: 9423612 - DNA, 21 bp, Homo sapiens
taaaccaggtaatttccattc

SEQ ID NO: 9423613 - DNA, 18 bp, Homo sapiens
taaaccagatgacagttg

SEQ ID NO: 9423614 - DNA, 22 bp, Homo sapiens
taaacatgttgacatcttacct

SEQ ID NO: 9423615 - DNA, 22 bp, Homo sapiens
taaacatttgttattcttgttt

SEQ ID NO: 9423616 - DNA, 22 bp, Homo sapiens
taaacatttgttattcttgttt

SEQ ID NO: 9423617 - DNA, 22 bp, Homo sapiens
taaaatgacttcctccaacatc

SEQ ID NO: 9423618 - DNA, 22 bp, Homo sapiens
taaaatgacttcctccaacatc

SEQ ID NO: 9423619 - DNA, 22 bp, Homo sapiens
taaaatcattctggtgtcagta

SEQ ID NO: 9423620 - DNA, 22 bp, Homo sapiens
taaaatcattctggtgtcagta

SEQ ID NO: 9423621 - DNA, 22 bp, Homo sapiens
taaaatgacttcctccaacatc

SEQ ID NO: 9423622 - DNA, 22 bp, Homo sapiens
taaaatcattctggtgtcagta

SEQ ID NO: 9423623 - DNA, 22 bp, Homo sapiens
taaaatcattctggtgtcagta

SEQ ID NO: 9423624 - DNA, 22 bp, Homo sapiens
taaaatcattctggtgtcagta

SEQ ID NO: 9423625 - DNA, 22 bp, Homo sapiens
taaaatcagccgaccatggtgg

SEQ ID NO: 9423626 - DNA, 22 bp, Homo sapiens
taaaatcagccgaccatggtgg

SEQ ID NO: 9423627 - DNA, 22 bp, Homo sapiens
taaaatcagccgaccatggtgg

SEQ ID NO: 9423628 - DNA, 22 bp, Homo sapiens
taaaatcatgacagattgacat

SEQ ID NO: 9423629 - DNA, 22 bp, Homo sapiens
taaaatcaccaaaagcaggtgg

SEQ ID NO: 9423630 - DNA, 22 bp, Homo sapiens
taaaatcaccaaaagcaggtgg

SEQ ID NO: 9423631 - DNA, 22 bp, Homo sapiens
taaaatcaccaaaagcaggtgg

SEQ ID NO: 9423632 - DNA, 22 bp, Homo sapiens
taaaatcagccgaccatggtgg

SEQ ID NO: 9423633 - DNA, 22 bp, Homo sapiens
taaaatcaccaaaagcaggtgg

SEQ ID NO: 9423634 - DNA, 22 bp, Homo sapiens
taaaaagtagtgagaatggcgc

SEQ ID NO: 9423635 - DNA, 22 bp, Homo sapiens
taaaaagtagtgagaatggcgc

SEQ ID NO: 9423636 - DNA, 22 bp, Homo sapiens
taaaaagttgaaaggacttatc

SEQ ID NO: 9423637 - DNA, 22 bp, Homo sapiens
taaaaagttgaaaggacttatc

SEQ ID NO: 9423638 - DNA, 22 bp, Homo sapiens
taaaaagttgaaaggacttatc

SEQ ID NO: 9423639 - DNA, 22 bp, Homo sapiens
taaaaatcttatgaatggcaag

SEQ ID NO: 9423640 - DNA, 22 bp, Homo sapiens
taaaaatcttatgaatggcaag

SEQ ID NO: 9423641 - DNA, 22 bp, Homo sapiens
taaaaatcttatgaatggcaag

SEQ ID NO: 9423642 - DNA, 22 bp, Homo sapiens
taaaatagcttatgtcttttga

SEQ ID NO: 9423643 - DNA, 22 bp, Homo sapiens
taaaatagcttatgtcttttga

SEQ ID NO: 9423644 - DNA, 22 bp, Homo sapiens
taaaatagcatgtgcagtgaaa

SEQ ID NO: 9423645 - DNA, 22 bp, Homo sapiens
taaaatagccagtgcccctctg

SEQ ID NO: 9423646 - DNA, 22 bp, Homo sapiens
taaaatagccagtgcccctctg

SEQ ID NO: 9423647 - DNA, 22 bp, Homo sapiens
taaaatagcatgtgcagtgaaa

SEQ ID NO: 9423648 - DNA, 22 bp, Homo sapiens
taaaatagcatgtgcagtgaaa

SEQ ID NO: 9423649 - DNA, 22 bp, Homo sapiens
taaaatagcatgtgcagtgaaa

SEQ ID NO: 9423650 - DNA, 22 bp, Homo sapiens
taaaaatcttatgaatggcaag

SEQ ID NO: 9423651 - DNA, 22 bp, Homo sapiens
gttttcctgttgagtagtattc

SEQ ID NO: 9423652 - DNA, 22 bp, Homo sapiens
gttttccttctcagccattgcc

SEQ ID NO: 9423653 - DNA, 22 bp, Homo sapiens
gttttccttctcagccattgcc

SEQ ID NO: 9423654 - DNA, 22 bp, Homo sapiens
gttttctaccagggaagagagt

SEQ ID NO: 9423655 - DNA, 22 bp, Homo sapiens
gttttcctgttgagtagtattc

SEQ ID NO: 9423656 - DNA, 22 bp, Homo sapiens
gttttcctgagcccagagatgc

SEQ ID NO: 9423657 - DNA, 22 bp, Homo sapiens
gttttcctgagcccagagatgc

SEQ ID NO: 9423658 - DNA, 22 bp, Homo sapiens
gttttcctgaaactgatggtgt

SEQ ID NO: 9423659 - DNA, 22 bp, Homo sapiens
gttttcctgaaactgatggtgt

SEQ ID NO: 9423660 - DNA, 22 bp, Homo sapiens
gttttcctgaaactgatggtgt

SEQ ID NO: 9423661 - DNA, 22 bp, Homo sapiens
gttttctaccagggaagagagt

SEQ ID NO: 9423662 - DNA, 22 bp, Homo sapiens
gttttctaccagggaagagagt

SEQ ID NO: 9423663 - DNA, 22 bp, Homo sapiens
taaaaagtagtgagaatggcgc

SEQ ID NO: 9423664 - DNA, 22 bp, Homo sapiens
taaaaagcagctgagattttct

SEQ ID NO: 9423665 - DNA, 19 bp, Homo sapiens
taaaaactgaaggaagcag

SEQ ID NO: 9423666 - DNA, 19 bp, Homo sapiens
taaaaactgaaggaagcag

SEQ ID NO: 9423667 - DNA, 22 bp, Homo sapiens
gttttcttcctgcaattggcat

SEQ ID NO: 9423668 - DNA, 22 bp, Homo sapiens
gttttctggcagttattcctta

SEQ ID NO: 9423669 - DNA, 22 bp, Homo sapiens
taaaaaacattactctgtcctg

SEQ ID NO: 9423670 - DNA, 22 bp, Homo sapiens
taaaaaacattactctgtcctg

SEQ ID NO: 9423671 - DNA, 22 bp, Homo sapiens
taaaaaacattactctgtcctg

SEQ ID NO: 9423672 - DNA, 22 bp, Homo sapiens
taaaaaacattactctgtcctg

SEQ ID NO: 9423673 - DNA, 22 bp, Homo sapiens
taaaaaacattactctgtcctg

SEQ ID NO: 9423674 - DNA, 22 bp, Homo sapiens
taaaaaacattactctgtcctg

SEQ ID NO: 9423675 - DNA, 22 bp, Homo sapiens
gttttcctactgtatcatcaaa

SEQ ID NO: 9423676 - DNA, 22 bp, Homo sapiens
gttttcctactgtatcatcaaa

SEQ ID NO: 9423677 - DNA, 22 bp, Homo sapiens
gttttccatggaggtctgacct

SEQ ID NO: 9423678 - DNA, 22 bp, Homo sapiens
caggacagtataggctttagga

SEQ ID NO: 9423679 - DNA, 22 bp, Homo sapiens
caggacaggccctgtggggtct

SEQ ID NO: 9423680 - DNA, 22 bp, Homo sapiens
caggacaggtgttctagatcag

SEQ ID NO: 9423681 - DNA, 22 bp, Homo sapiens
caggacaggtgttctagatcag

SEQ ID NO: 9423682 - DNA, 22 bp, Homo sapiens
caggacaggtgttctagatcag

SEQ ID NO: 9423683 - DNA, 22 bp, Homo sapiens
caggacagtataggctttagga

SEQ ID NO: 9423684 - DNA, 22 bp, Homo sapiens
caggacagtataggctttagga

SEQ ID NO: 9423685 - DNA, 22 bp, Homo sapiens
caggacaggtgttctagatcag

SEQ ID NO: 9423686 - DNA, 22 bp, Homo sapiens
caggacagtataggctttagga

SEQ ID NO: 9423687 - DNA, 22 bp, Homo sapiens
caggacagctgggccaccacca

SEQ ID NO: 9423688 - DNA, 22 bp, Homo sapiens
caggacaggagtggggtcaaag

SEQ ID NO: 9423689 - DNA, 22 bp, Homo sapiens
caggacaggagtggggtcaaag

SEQ ID NO: 9423690 - DNA, 22 bp, Homo sapiens
caggacaggccctgtggggtct

SEQ ID NO: 9423691 - DNA, 22 bp, Homo sapiens
caggacaggagtggggtcaaag

SEQ ID NO: 9423692 - DNA, 22 bp, Homo sapiens
caggacacttgttcttctctgc

SEQ ID NO: 9423693 - DNA, 22 bp, Homo sapiens
caggacagctcaacacctcctc

SEQ ID NO: 9423694 - DNA, 22 bp, Homo sapiens
caggacagctcaacacctcctc

SEQ ID NO: 9423695 - DNA, 22 bp, Homo sapiens
caggacagctgggccaccacca

SEQ ID NO: 9423696 - DNA, 22 bp, Homo sapiens
caggacagctgggccaccacca

SEQ ID NO: 9423697 - DNA, 22 bp, Homo sapiens
caggacagctcaacacctcctc

SEQ ID NO: 9423698 - DNA, 22 bp, Homo sapiens
caggacagctcaacacctcctc

SEQ ID NO: 9423699 - DNA, 22 bp, Homo sapiens
caggacagctgggccaccacca

SEQ ID NO: 9423700 - DNA, 22 bp, Homo sapiens
caggacacagggtgtggctgat

SEQ ID NO: 9423701 - DNA, 22 bp, Homo sapiens
caggacacagggtgtggctgat

SEQ ID NO: 9423702 - DNA, 22 bp, Homo sapiens
caggacactaaaaagccaagct

SEQ ID NO: 9423703 - DNA, 22 bp, Homo sapiens
caggacactaaaaagccaagct

SEQ ID NO: 9423704 - DNA, 22 bp, Homo sapiens
caggacaattttgagccacctg

SEQ ID NO: 9423705 - DNA, 22 bp, Homo sapiens
caggacacagaataaggcagtt

SEQ ID NO: 9423706 - DNA, 22 bp, Homo sapiens
caggacacagaataaggcagtt

SEQ ID NO: 9423707 - DNA, 22 bp, Homo sapiens
caggacaacctcaggttgctgc

SEQ ID NO: 9423708 - DNA, 22 bp, Homo sapiens
caggacaagagggaatcgataa

SEQ ID NO: 9423709 - DNA, 22 bp, Homo sapiens
caggaattcatagcattgttct

SEQ ID NO: 9423710 - DNA, 22 bp, Homo sapiens
caggaatgtttgtgctccttta

SEQ ID NO: 9423711 - DNA, 19 bp, Homo sapiens
caggaatgaggtaatggct

SEQ ID NO: 9423712 - DNA, 22 bp, Homo sapiens
caggaatgaggtcgtaagtgtc

SEQ ID NO: 9423713 - DNA, 22 bp, Homo sapiens
caggaatgtagcagcgatggaa

SEQ ID NO: 9423714 - DNA, 22 bp, Homo sapiens
caggaagtgtgagggtggtgta

SEQ ID NO: 9423715 - DNA, 22 bp, Homo sapiens
caggaagtgggtagaaggaata

SEQ ID NO: 9423716 - DNA, 22 bp, Homo sapiens
caggaagtgcctggtgagagga

SEQ ID NO: 9423717 - DNA, 22 bp, Homo sapiens
caggaagtctttgcccaggcca

SEQ ID NO: 9423718 - DNA, 22 bp, Homo sapiens
caggaagtctttgcccaggcca

SEQ ID NO: 9423719 - DNA, 22 bp, Homo sapiens
caggaagggggatccttggaag

SEQ ID NO: 9423720 - DNA, 22 bp, Homo sapiens
caggaagggggatccttggaag

SEQ ID NO: 9423721 - DNA, 22 bp, Homo sapiens
caggaagggggatccttggaag

SEQ ID NO: 9423722 - DNA, 22 bp, Homo sapiens
caggaatccagagtgagcctcc

SEQ ID NO: 9423723 - DNA, 22 bp, Homo sapiens
caggaatcctatggcttttgct

SEQ ID NO: 9423724 - DNA, 22 bp, Homo sapiens
caggaatagtggagcaacaaga

SEQ ID NO: 9423725 - DNA, 22 bp, Homo sapiens
caggaagttgtgtgttcgaggc

SEQ ID NO: 9423726 - DNA, 22 bp, Homo sapiens
caggaatagtggagcaacaaga

SEQ ID NO: 9423727 - DNA, 22 bp, Homo sapiens
caggaatgaaaggtcagggttg

SEQ ID NO: 9423728 - DNA, 22 bp, Homo sapiens
caggaagctgtgaaggagacgg

SEQ ID NO: 9423729 - DNA, 22 bp, Homo sapiens
caggaaggaaagggtgtggaga

SEQ ID NO: 9423730 - DNA, 22 bp, Homo sapiens
caggaaggaaagggtgtggaga

SEQ ID NO: 9423731 - DNA, 22 bp, Homo sapiens
caggaagctgccggtgagcgag

SEQ ID NO: 9423732 - DNA, 22 bp, Homo sapiens
caggaagctggtcagatcctgt

SEQ ID NO: 9423733 - DNA, 22 bp, Homo sapiens
caggaagctgtgaaggagacgg

SEQ ID NO: 9423734 - DNA, 22 bp, Homo sapiens
caggaagctgagctgcactgca

SEQ ID NO: 9423735 - DNA, 22 bp, Homo sapiens
gtttggaatagcagtaaacatt

SEQ ID NO: 9423736 - DNA, 22 bp, Homo sapiens
gtttggatgtgtagtgagggga

SEQ ID NO: 9423737 - DNA, 22 bp, Homo sapiens
gtttggatagtgagagatactt

SEQ ID NO: 9423738 - DNA, 22 bp, Homo sapiens
gtttggatgtgtagtgagggga

SEQ ID NO: 9423739 - DNA, 22 bp, Homo sapiens
gtttggcaagaagaggagtaag

SEQ ID NO: 9423740 - DNA, 22 bp, Homo sapiens
gtttgggtacaggcttcaggtg

SEQ ID NO: 9423741 - DNA, 22 bp, Homo sapiens
gtttgggtaatatcagtagagt

SEQ ID NO: 9423742 - DNA, 22 bp, Homo sapiens
gtttgggtccctctgtcccact

SEQ ID NO: 9423743 - DNA, 22 bp, Homo sapiens
gtttgggtaatatcagtagagt

SEQ ID NO: 9423744 - DNA, 22 bp, Homo sapiens
gtttggcagttttagagtgcaa

SEQ ID NO: 9423745 - DNA, 19 bp, Homo sapiens
gtttggcagcaaatcagac

SEQ ID NO: 9423746 - DNA, 22 bp, Homo sapiens
gtttgtatgaatgttttatgct

SEQ ID NO: 9423747 - DNA, 22 bp, Homo sapiens
gtttgtaattacctcttttgac

SEQ ID NO: 9423748 - DNA, 22 bp, Homo sapiens
gtttgtaattactgcagcatgg

SEQ ID NO: 9423749 - DNA, 22 bp, Homo sapiens
gtttgtaattacctcttttgac

SEQ ID NO: 9423750 - DNA, 22 bp, Homo sapiens
gtttgtaattacctcttttgac

SEQ ID NO: 9423751 - DNA, 22 bp, Homo sapiens
gtttgtaagcagtctgcttgtg

SEQ ID NO: 9423752 - DNA, 21 bp, Homo sapiens
gtttgtaaggcactgtgttct

SEQ ID NO: 9423753 - DNA, 21 bp, Homo sapiens
gtttgtaaggcactgtgttct

SEQ ID NO: 9423754 - DNA, 22 bp, Homo sapiens
gtttgtaaccagaacagagagt

SEQ ID NO: 9423755 - DNA, 22 bp, Homo sapiens
gtttggtgagcagcttgggtat

SEQ ID NO: 9423756 - DNA, 22 bp, Homo sapiens
caggaagctgagctgcactgca

SEQ ID NO: 9423757 - DNA, 22 bp, Homo sapiens
caggaagccacaggacaggtag

SEQ ID NO: 9423758 - DNA, 22 bp, Homo sapiens
caggaagcatctggctagctaa

SEQ ID NO: 9423759 - DNA, 22 bp, Homo sapiens
taaagtcagatatctgggttga

SEQ ID NO: 9423760 - DNA, 22 bp, Homo sapiens
taaagtcagatatctgggttga

SEQ ID NO: 9423761 - DNA, 22 bp, Homo sapiens
taaagtcagggagattgaggct

SEQ ID NO: 9423762 - DNA, 22 bp, Homo sapiens
taaagtcagggagattgaggct

SEQ ID NO: 9423763 - DNA, 22 bp, Homo sapiens
taaagtcataagagtggatccg

SEQ ID NO: 9423764 - DNA, 23 bp, Homo sapiens
taaagtcacatattagagtgagc

SEQ ID NO: 9423765 - DNA, 22 bp, Homo sapiens
taaagtcagagatccttggctt

SEQ ID NO: 9423766 - DNA, 22 bp, Homo sapiens
taaagtcacagagcaggtgcaa

SEQ ID NO: 9423767 - DNA, 23 bp, Homo sapiens
taaagtcacatattagagtgagc

SEQ ID NO: 9423768 - DNA, 22 bp, Homo sapiens
taaagtcatctttaaacatgcc

SEQ ID NO: 9423769 - DNA, 22 bp, Homo sapiens
taaagtcatctttacatctttg

SEQ ID NO: 9423770 - DNA, 22 bp, Homo sapiens
taaagtcatctttacatctttg

SEQ ID NO: 9423771 - DNA, 22 bp, Homo sapiens
taaagtcatctttacatctttg

SEQ ID NO: 9423772 - DNA, 22 bp, Homo sapiens
taaagtgaaggtcataatgatt

SEQ ID NO: 9423773 - DNA, 22 bp, Homo sapiens
taaagtgaagttcagaatggct

SEQ ID NO: 9423774 - DNA, 22 bp, Homo sapiens
taaagtgaaggtcataatgatt

SEQ ID NO: 9423775 - DNA, 22 bp, Homo sapiens
taaagtgaaggtcataatgatt

SEQ ID NO: 9423776 - DNA, 22 bp, Homo sapiens
taaagccacgctggaaatcagg

SEQ ID NO: 9423777 - DNA, 22 bp, Homo sapiens
taaagcatgtgttagaagtgca

SEQ ID NO: 9423778 - DNA, 22 bp, Homo sapiens
taaagcatgtactgtgtgctag

SEQ ID NO: 9423779 - DNA, 22 bp, Homo sapiens
taaagcatgtactgtgtgctag

SEQ ID NO: 9423780 - DNA, 22 bp, Homo sapiens
taaagcatgtttcagtaaggtt

SEQ ID NO: 9423781 - DNA, 22 bp, Homo sapiens
taaagcatgtgttagaagtgca

SEQ ID NO: 9423782 - DNA, 22 bp, Homo sapiens
taaagcatgtttcagtaaggtt

SEQ ID NO: 9423783 - DNA, 17 bp, Homo sapiens
taaagccagtcaagtca

SEQ ID NO: 9423784 - DNA, 22 bp, Homo sapiens
taaagccacttcattctagtct

SEQ ID NO: 9423785 - DNA, 22 bp, Homo sapiens
taaagccacgctggaaatcagg

SEQ ID NO: 9423786 - DNA, 22 bp, Homo sapiens
taaagccacgctggaaatcagg

SEQ ID NO: 9423787 - DNA, 22 bp, Homo sapiens
taaagccacgctggaaatcagg

SEQ ID NO: 9423788 - DNA, 17 bp, Homo sapiens
taaagccagtcaagtca

SEQ ID NO: 9423789 - DNA, 22 bp, Homo sapiens
taaagccatactgaaagccact

SEQ ID NO: 9423790 - DNA, 22 bp, Homo sapiens
taaagctacacattattaatcc

SEQ ID NO: 9423791 - DNA, 22 bp, Homo sapiens
taaagctaaccttagtgaacac

SEQ ID NO: 9423792 - DNA, 18 bp, Homo sapiens
taaatatatttccccctt

SEQ ID NO: 9423793 - DNA, 18 bp, Homo sapiens
taaatatatttccccctt

SEQ ID NO: 9423794 - DNA, 18 bp, Homo sapiens
taaatatatttccccctt

SEQ ID NO: 9423795 - DNA, 18 bp, Homo sapiens
taaatatatttccccctt

SEQ ID NO: 9423796 - DNA, 22 bp, Homo sapiens
taaatagagaatcagcttggag

SEQ ID NO: 9423797 - DNA, 22 bp, Homo sapiens
taaatagaatctaaactgctca

SEQ ID NO: 9423798 - DNA, 22 bp, Homo sapiens
taaatagagaatcagcttggag

SEQ ID NO: 9423799 - DNA, 22 bp, Homo sapiens
taaagtgagtacaaaatgaggg

SEQ ID NO: 9423800 - DNA, 22 bp, Homo sapiens
taaagtgcagactcccggaaac

SEQ ID NO: 9423801 - DNA, 22 bp, Homo sapiens
taaagtgagtacaaaatgaggg

SEQ ID NO: 9423802 - DNA, 22 bp, Homo sapiens
taaagtgagtacaaaatgaggg

SEQ ID NO: 9423803 - DNA, 22 bp, Homo sapiens
taaagtgcaggctactcagaag

SEQ ID NO: 9423804 - DNA, 22 bp, Homo sapiens
taaagtgcagattgtgattcag

SEQ ID NO: 9423805 - DNA, 22 bp, Homo sapiens
taaagtgcagattgtgattcag

SEQ ID NO: 9423806 - DNA, 22 bp, Homo sapiens
taaagtgcagactcccggaaac

SEQ ID NO: 9423807 - DNA, 22 bp, Homo sapiens
taaatagaatctaaactgctca

SEQ ID NO: 9423808 - DNA, 22 bp, Homo sapiens
taaatagaatctaaactgctca

SEQ ID NO: 9423809 - DNA, 22 bp, Homo sapiens
taaagtgcccagggaaagcggg

SEQ ID NO: 9423810 - DNA, 22 bp, Homo sapiens
taaagtgcatgcggggccagat

SEQ ID NO: 9423811 - DNA, 22 bp, Homo sapiens
taaagtgcatgcggggccagat

SEQ ID NO: 9423812 - DNA, 22 bp, Homo sapiens
taaagtgcatgcggggccagat

SEQ ID NO: 9423813 - DNA, 22 bp, Homo sapiens
taaagtgcaggctactcagaag

SEQ ID NO: 9423814 - DNA, 22 bp, Homo sapiens
taaatatgcatgtatccttatc

SEQ ID NO: 9423815 - DNA, 22 bp, Homo sapiens
taaatatgcatgtatccttatc

SEQ ID NO: 9423816 - DNA, 22 bp, Homo sapiens
taaatatcagtccagctcttcc

SEQ ID NO: 9423817 - DNA, 22 bp, Homo sapiens
taaatatcagtccagctcttcc

SEQ ID NO: 9423818 - DNA, 22 bp, Homo sapiens
taaatatcagtccagctcttcc

SEQ ID NO: 9423819 - DNA, 22 bp, Homo sapiens
taaatatcacctggaattgtta

SEQ ID NO: 9423820 - DNA, 22 bp, Homo sapiens
taaatgctttctatgaaagagg

SEQ ID NO: 9423821 - DNA, 22 bp, Homo sapiens
taaatgcttagattcatagaaa

SEQ ID NO: 9423822 - DNA, 22 bp, Homo sapiens
taaatgcttagattcatagaaa

SEQ ID NO: 9423823 - DNA, 22 bp, Homo sapiens
taaatgcttagattcatagaaa

SEQ ID NO: 9423824 - DNA, 22 bp, Homo sapiens
taaatgctccatacatacacca

SEQ ID NO: 9423825 - DNA, 22 bp, Homo sapiens
taaatcaagaatatcagcttgt

SEQ ID NO: 9423826 - DNA, 22 bp, Homo sapiens
taaatcaagaatatcagcttgt

SEQ ID NO: 9423827 - DNA, 22 bp, Homo sapiens
taaatcaagaatatcagcttgt

SEQ ID NO: 9423828 - DNA, 22 bp, Homo sapiens
caggagctcttaaggatgtgat

SEQ ID NO: 9423829 - DNA, 22 bp, Homo sapiens
caggagctggataggaccacaa

SEQ ID NO: 9423830 - DNA, 22 bp, Homo sapiens
taaagcataatgaatatctaga

SEQ ID NO: 9423831 - DNA, 22 bp, Homo sapiens
taaagcagtgcaaaagcgtttt

SEQ ID NO: 9423832 - DNA, 22 bp, Homo sapiens
taaagcagtgtggttgtgtccc

SEQ ID NO: 9423833 - DNA, 22 bp, Homo sapiens
caggagctactcaggttgggtt

SEQ ID NO: 9423834 - DNA, 22 bp, Homo sapiens
caggagctactcaggttgggtt

SEQ ID NO: 9423835 - DNA, 22 bp, Homo sapiens
caggagctactcaggttgggtt

SEQ ID NO: 9423836 - DNA, 22 bp, Homo sapiens
caggagctcaagaccaccctgg

SEQ ID NO: 9423837 - DNA, 22 bp, Homo sapiens
caggagcccgttgctccggcgg

SEQ ID NO: 9423838 - DNA, 22 bp, Homo sapiens
caggagccccaggctgacaata

SEQ ID NO: 9423839 - DNA, 22 bp, Homo sapiens
caggagccctggtgggtggaca

SEQ ID NO: 9423840 - DNA, 22 bp, Homo sapiens
caggagccctggtgggtggaca

SEQ ID NO: 9423841 - DNA, 22 bp, Homo sapiens
caggagatgtacctgtttttga

SEQ ID NO: 9423842 - DNA, 22 bp, Homo sapiens
caggagatgtaagacttctgtt

SEQ ID NO: 9423843 - DNA, 23 bp, Homo sapiens
caggagatggctgctgtgtcagc

SEQ ID NO: 9423844 - DNA, 23 bp, Homo sapiens
caggagatggctgctgtgtcagc

SEQ ID NO: 9423845 - DNA, 22 bp, Homo sapiens
caggagatgacagggaagaacc

SEQ ID NO: 9423846 - DNA, 22 bp, Homo sapiens
caggagatgacagggaagaacc

SEQ ID NO: 9423847 - DNA, 22 bp, Homo sapiens
caggagatgacagggaagaacc

SEQ ID NO: 9423848 - DNA, 22 bp, Homo sapiens
caggagataaaagagatgcttt

SEQ ID NO: 9423849 - DNA, 22 bp, Homo sapiens
caggagataaaagagatgcttt

SEQ ID NO: 9423850 - DNA, 22 bp, Homo sapiens
caggagaggctgtacgtttctc

SEQ ID NO: 9423851 - DNA, 22 bp, Homo sapiens
caggagaggctgtacgtttctc

SEQ ID NO: 9423852 - DNA, 22 bp, Homo sapiens
caggagatcttaggaattctta

SEQ ID NO: 9423853 - DNA, 22 bp, Homo sapiens
caggagataaaagagatgcttt

SEQ ID NO: 9423854 - DNA, 19 bp, Homo sapiens
caggagagcatgcactttg

SEQ ID NO: 9423855 - DNA, 22 bp, Homo sapiens
caggagagatatgagtccccac

SEQ ID NO: 9423856 - DNA, 22 bp, Homo sapiens
caggagagatatgagtccccac

SEQ ID NO: 9423857 - DNA, 22 bp, Homo sapiens
caggagagatatgagtccccac

SEQ ID NO: 9423858 - DNA, 22 bp, Homo sapiens
caggagactcagcatccaggat

SEQ ID NO: 9423859 - DNA, 22 bp, Homo sapiens
caggagagatatgagtccccac

SEQ ID NO: 9423860 - DNA, 22 bp, Homo sapiens
caggagagatatgagtccccac

SEQ ID NO: 9423861 - DNA, 22 bp, Homo sapiens
caggagagatatgagtccccac

SEQ ID NO: 9423862 - DNA, 22 bp, Homo sapiens
caggagagcccgggtccgggct

SEQ ID NO: 9423863 - DNA, 22 bp, Homo sapiens
caggagaggaggctacttctta

SEQ ID NO: 9423864 - DNA, 19 bp, Homo sapiens
caggagagcatgcactttg

SEQ ID NO: 9423865 - DNA, 22 bp, Homo sapiens
caggagagcccgggtccgggct

SEQ ID NO: 9423866 - DNA, 19 bp, Homo sapiens
caggagagcatgcactttg

SEQ ID NO: 9423867 - DNA, 22 bp, Homo sapiens
caggaggcccaaagggcgcaga

SEQ ID NO: 9423868 - DNA, 22 bp, Homo sapiens
caggaggcccaaagggcgcaga

SEQ ID NO: 9423869 - DNA, 22 bp, Homo sapiens
caggaggcccaaagggcgcaga

SEQ ID NO: 9423870 - DNA, 22 bp, Homo sapiens
caggaggcccggccacagccca

SEQ ID NO: 9423871 - DNA, 22 bp, Homo sapiens
caggaggcccacaggcccctgc

SEQ ID NO: 9423872 - DNA, 22 bp, Homo sapiens
caggaggcccacaggcccctgc

SEQ ID NO: 9423873 - DNA, 22 bp, Homo sapiens
caggaggcccacaggcccctgc

SEQ ID NO: 9423874 - DNA, 22 bp, Homo sapiens
caggaggcatcatggagcggac

SEQ ID NO: 9423875 - DNA, 22 bp, Homo sapiens
caggaggcatcatggagcggac

SEQ ID NO: 9423876 - DNA, 22 bp, Homo sapiens
caggaggcagtttcagaagtca

SEQ ID NO: 9423877 - DNA, 22 bp, Homo sapiens
caggaggccaactgtgggactt

SEQ ID NO: 9423878 - DNA, 22 bp, Homo sapiens
caggaggccaactgtgggactt

SEQ ID NO: 9423879 - DNA, 22 bp, Homo sapiens
caggaggccaactgtgggactt

SEQ ID NO: 9423880 - DNA, 22 bp, Homo sapiens
caggagggcccgagactcttcc

SEQ ID NO: 9423881 - DNA, 22 bp, Homo sapiens
caggagggggtggagtttcgcc

SEQ ID NO: 9423882 - DNA, 23 bp, Homo sapiens
caggagggaatgaagttagacaa

SEQ ID NO: 9423883 - DNA, 20 bp, Homo sapiens
caggagggacatttcagcat

SEQ ID NO: 9423884 - DNA, 22 bp, Homo sapiens
caggaggctcctagggctctgt

SEQ ID NO: 9423885 - DNA, 22 bp, Homo sapiens
caggaggcgtcttcagtttgtt

SEQ ID NO: 9423886 - DNA, 22 bp, Homo sapiens
caggaggcgtcttcagtttgtt

SEQ ID NO: 9423887 - DNA, 22 bp, Homo sapiens
caggagtgagttggggtctaca

SEQ ID NO: 9423888 - DNA, 22 bp, Homo sapiens
caggagtgaaatgaggcccagg

SEQ ID NO: 9423889 - DNA, 22 bp, Homo sapiens
caggagtgcaggtggtgaggca

SEQ ID NO: 9423890 - DNA, 22 bp, Homo sapiens
caggagtgcaggtggtgaggca

SEQ ID NO: 9423891 - DNA, 22 bp, Homo sapiens
caggagtgtctccacacagcaa

SEQ ID NO: 9423892 - DNA, 22 bp, Homo sapiens
caggagtgtcgggtcactaggt

SEQ ID NO: 9423893 - DNA, 22 bp, Homo sapiens
caggagtggtgtgagggactcc

SEQ ID NO: 9423894 - DNA, 22 bp, Homo sapiens
caggagtgtctccacacagcaa

SEQ ID NO: 9423895 - DNA, 22 bp, Homo sapiens
caggagtgttgattgctcagga

SEQ ID NO: 9423896 - DNA, 22 bp, Homo sapiens
caggagttcaaggttgcagtga

SEQ ID NO: 9423897 - DNA, 22 bp, Homo sapiens
caggagttggtaatattgtgga

SEQ ID NO: 9423898 - DNA, 22 bp, Homo sapiens
caggagtttctattgttccaaa

SEQ ID NO: 9423899 - DNA, 22 bp, Homo sapiens
caggagtttctattgttccaaa

SEQ ID NO: 9423900 - DNA, 22 bp, Homo sapiens
caggatagaaaggccatggagt

SEQ ID NO: 9423901 - DNA, 22 bp, Homo sapiens
caggataacagaaaatagctga

SEQ ID NO: 9423902 - DNA, 22 bp, Homo sapiens
caggagttttaaatctagcatg

SEQ ID NO: 9423903 - DNA, 22 bp, Homo sapiens
taacaaagtattgtttgtgtat

SEQ ID NO: 9423904 - DNA, 22 bp, Homo sapiens
taacaaagtaccatagattggg

SEQ ID NO: 9423905 - DNA, 22 bp, Homo sapiens
taacaaagtaccatagactgga

SEQ ID NO: 9423906 - DNA, 22 bp, Homo sapiens
taacaaaggttgccaaactaag

SEQ ID NO: 9423907 - DNA, 22 bp, Homo sapiens
taacaaaggttgccaaactaag

SEQ ID NO: 9423908 - DNA, 22 bp, Homo sapiens
taacaaaggttgccaaactaag

SEQ ID NO: 9423909 - DNA, 22 bp, Homo sapiens
taacaaaggttgccaaactaag

SEQ ID NO: 9423910 - DNA, 22 bp, Homo sapiens
taaatgtagtcaaaggagcctc

SEQ ID NO: 9423911 - DNA, 22 bp, Homo sapiens
taaatgtataggcactaaacct

SEQ ID NO: 9423912 - DNA, 22 bp, Homo sapiens
taaatgtataggcactaaacct

SEQ ID NO: 9423913 - DNA, 22 bp, Homo sapiens
taaatgtactgaggcaacagga

SEQ ID NO: 9423914 - DNA, 22 bp, Homo sapiens
taaatgtagtcaaaggagcctc

SEQ ID NO: 9423915 - DNA, 22 bp, Homo sapiens
taaatgtataggcactaaacct

SEQ ID NO: 9423916 - DNA, 22 bp, Homo sapiens
taaatgtataggcactaaacct

SEQ ID NO: 9423917 - DNA, 22 bp, Homo sapiens
taaatgtataggcactaaacct

SEQ ID NO: 9423918 - DNA, 22 bp, Homo sapiens
taaatgtataggcactaaacct

SEQ ID NO: 9423919 - DNA, 22 bp, Homo sapiens
taaatgtataggcactaaacct

SEQ ID NO: 9423920 - DNA, 22 bp, Homo sapiens
taaatgtcaatgtgatttataa

SEQ ID NO: 9423921 - DNA, 22 bp, Homo sapiens
taaatgtataggcactaaacct

SEQ ID NO: 9423922 - DNA, 22 bp, Homo sapiens
taaatgtaaatggcgtcttgcg

SEQ ID NO: 9423923 - DNA, 22 bp, Homo sapiens
taaatgtaaatggcgtcttgcg

SEQ ID NO: 9423924 - DNA, 20 bp, Homo sapiens
taaatggtgcatttcttata

SEQ ID NO: 9423925 - DNA, 22 bp, Homo sapiens
taaatggtatccttgctgtgct

SEQ ID NO: 9423926 - DNA, 22 bp, Homo sapiens
taaatgtactgaggcaacagga

SEQ ID NO: 9423927 - DNA, 22 bp, Homo sapiens
taaatgtactgaggcaacagga

SEQ ID NO: 9423928 - DNA, 22 bp, Homo sapiens
taaatgtactgaggcaacagga

SEQ ID NO: 9423929 - DNA, 22 bp, Homo sapiens
taaatgtaccttctgccttact

SEQ ID NO: 9423930 - DNA, 22 bp, Homo sapiens
taaatgtaccttctgccttact

SEQ ID NO: 9423931 - DNA, 22 bp, Homo sapiens
taaatgtaccttctgccttact

SEQ ID NO: 9423932 - DNA, 22 bp, Homo sapiens
taaatgtctgttaacatgaatg

SEQ ID NO: 9423933 - DNA, 22 bp, Homo sapiens
taaatgtctttgtcacgttggg

SEQ ID NO: 9423934 - DNA, 22 bp, Homo sapiens
caggagcttctgcccatggcca

SEQ ID NO: 9423935 - DNA, 22 bp, Homo sapiens
caggagctttcttcccaaactt

SEQ ID NO: 9423936 - DNA, 22 bp, Homo sapiens
caggagctgggtctggaagcag

SEQ ID NO: 9423937 - DNA, 22 bp, Homo sapiens
caggaggcagaggttgcagcga

SEQ ID NO: 9423938 - DNA, 22 bp, Homo sapiens
caggaggcagaggatgcccagt

SEQ ID NO: 9423939 - DNA, 22 bp, Homo sapiens
caggaggcagaggttgcagtga

SEQ ID NO: 9423940 - DNA, 22 bp, Homo sapiens
caggaggcagaggttgcagcga

SEQ ID NO: 9423941 - DNA, 22 bp, Homo sapiens
caggaggcagaggttgcagtga

SEQ ID NO: 9423942 - DNA, 22 bp, Homo sapiens
caggaggcagaggttgcagtga

SEQ ID NO: 9423943 - DNA, 22 bp, Homo sapiens
caggaggcagcgctctcaggac

SEQ ID NO: 9423944 - DNA, 22 bp, Homo sapiens
caggaggcagcgctctcaggac

SEQ ID NO: 9423945 - DNA, 22 bp, Homo sapiens
caggaggcagtttcagaagtca

SEQ ID NO: 9423946 - DNA, 22 bp, Homo sapiens
caggaggaacaagaggttctgg

SEQ ID NO: 9423947 - DNA, 22 bp, Homo sapiens
caggaggaacaagaggttctgg

SEQ ID NO: 9423948 - DNA, 22 bp, Homo sapiens
caggaggaaagttccactcaac

SEQ ID NO: 9423949 - DNA, 22 bp, Homo sapiens
caggaggaaatgtgaccctgct

SEQ ID NO: 9423950 - DNA, 20 bp, Homo sapiens
caggaggcaaggtcaaggtc

SEQ ID NO: 9423951 - DNA, 20 bp, Homo sapiens
caggaggcaaggtcaaggtc

SEQ ID NO: 9423952 - DNA, 20 bp, Homo sapiens
caggaggcaaggtcaaggtc

SEQ ID NO: 9423953 - DNA, 20 bp, Homo sapiens
caggaggcaaggtcaaggtc

SEQ ID NO: 9423954 - DNA, 22 bp, Homo sapiens
caggaggattgcttgaggccag

SEQ ID NO: 9423955 - DNA, 22 bp, Homo sapiens
caggaggaagaactctgcaaca

SEQ ID NO: 9423956 - DNA, 22 bp, Homo sapiens
caggaggaacaagaggttctgg

SEQ ID NO: 9423957 - DNA, 22 bp, Homo sapiens
caggaggaacaagaggttctgg

SEQ ID NO: 9423958 - DNA, 22 bp, Homo sapiens
caggaggaagaactctgcaaca

SEQ ID NO: 9423959 - DNA, 22 bp, Homo sapiens
gtggcagtagacagtgcatcta

SEQ ID NO: 9423960 - DNA, 22 bp, Homo sapiens
gtggcagtcatcaaggacagat

SEQ ID NO: 9423961 - DNA, 22 bp, Homo sapiens
gtggcagtcatcaaggacagat

SEQ ID NO: 9423962 - DNA, 22 bp, Homo sapiens
gtggcagtcggaagtcaggaga

SEQ ID NO: 9423963 - DNA, 19 bp, Homo sapiens
gtggccagggcaggggctg

SEQ ID NO: 9423964 - DNA, 19 bp, Homo sapiens
gtggccagggcaggggctg

SEQ ID NO: 9423965 - DNA, 22 bp, Homo sapiens
gtggccaggcgtccgcgcggct

SEQ ID NO: 9423966 - DNA, 22 bp, Homo sapiens
gtggccaggccgactgccaggc

SEQ ID NO: 9423967 - DNA, 22 bp, Homo sapiens
gtggccaggccgactgccaggc

SEQ ID NO: 9423968 - DNA, 22 bp, Homo sapiens
gtggcagtgaggcaggagcagt

SEQ ID NO: 9423969 - DNA, 22 bp, Homo sapiens
gtggcagtgaggcaggagcagt

SEQ ID NO: 9423970 - DNA, 22 bp, Homo sapiens
gtggccagtggtgggcgccctg

SEQ ID NO: 9423971 - DNA, 21 bp, Homo sapiens
gtggccagtgactacttattg

SEQ ID NO: 9423972 - DNA, 22 bp, Homo sapiens
gtggccagtgggaatgggctca

SEQ ID NO: 9423973 - DNA, 22 bp, Homo sapiens
gtggccagtgggaatgggctca

SEQ ID NO: 9423974 - DNA, 19 bp, Homo sapiens
gtggccagggcaggggctg

SEQ ID NO: 9423975 - DNA, 22 bp, Homo sapiens
gtggccagggcccacaggatga

SEQ ID NO: 9423976 - DNA, 22 bp, Homo sapiens
gtggccagggcccacaggatga

SEQ ID NO: 9423977 - DNA, 22 bp, Homo sapiens
gtggccagggcccacaggatga

SEQ ID NO: 9423978 - DNA, 22 bp, Homo sapiens
gtggccagggcccacaggatga

SEQ ID NO: 9423979 - DNA, 22 bp, Homo sapiens
gtggccaggtcagggacttgtg

SEQ ID NO: 9423980 - DNA, 22 bp, Homo sapiens
gtggccaggtcagggacttgtg

SEQ ID NO: 9423981 - DNA, 22 bp, Homo sapiens
gtggccagtcccgatgcttgtt

SEQ ID NO: 9423982 - DNA, 22 bp, Homo sapiens
gtggccagtcccgatgcttgtt

SEQ ID NO: 9423983 - DNA, 22 bp, Homo sapiens
gtggccagtcccgatgcttgtt

SEQ ID NO: 9423984 - DNA, 22 bp, Homo sapiens
cagctctgctgggaggatgcag

SEQ ID NO: 9423985 - DNA, 22 bp, Homo sapiens
cagctctgctggtggtgccagg

SEQ ID NO: 9423986 - DNA, 22 bp, Homo sapiens
cagctctgctggtggtgccagg

SEQ ID NO: 9423987 - DNA, 22 bp, Homo sapiens
cagctctgctggtggtgccagg

SEQ ID NO: 9423988 - DNA, 22 bp, Homo sapiens
cagctctgctggtggtgccagg

SEQ ID NO: 9423989 - DNA, 22 bp, Homo sapiens
cagctctgcttccttgtacagg

SEQ ID NO: 9423990 - DNA, 22 bp, Homo sapiens
cagctctgcttccttgtacagg

SEQ ID NO: 9423991 - DNA, 22 bp, Homo sapiens
cagctctgcttccttgtacagg

SEQ ID NO: 9423992 - DNA, 22 bp, Homo sapiens
cagctctggcagagcccaaccc

SEQ ID NO: 9423993 - DNA, 22 bp, Homo sapiens
cagctctggccagatctatcct

SEQ ID NO: 9423994 - DNA, 22 bp, Homo sapiens
cagctctggcgtcagggagcga

SEQ ID NO: 9423995 - DNA, 22 bp, Homo sapiens
cagctctggcgtcagggagcga

SEQ ID NO: 9423996 - DNA, 22 bp, Homo sapiens
cagctctggctttggggagctt

SEQ ID NO: 9423997 - DNA, 20 bp, Homo sapiens
cagctctgggaaagaggcca

SEQ ID NO: 9423998 - DNA, 20 bp, Homo sapiens
cagctctgggaaagaggcca

SEQ ID NO: 9423999 - DNA, 22 bp, Homo sapiens
cagctctgggagtcccacccct

SEQ ID NO: 9424000 - DNA, 22 bp, Homo sapiens
cagctctgtgcaggcctgggga

SEQ ID NO: 9424001 - DNA, 22 bp, Homo sapiens
cagctctgtgcaggcctgggga

SEQ ID NO: 9424002 - DNA, 22 bp, Homo sapiens
cagctctgtgcaggcctgggga

SEQ ID NO: 9424003 - DNA, 21 bp, Homo sapiens
cagcccagcttcttccccagt

SEQ ID NO: 9424004 - DNA, 22 bp, Homo sapiens
cagcccagctgggatcacactc

SEQ ID NO: 9424005 - DNA, 21 bp, Homo sapiens
cagcccagcttcttccccagt

SEQ ID NO: 9424006 - DNA, 22 bp, Homo sapiens
cagcccaggactgcaggtgttt

SEQ ID NO: 9424007 - DNA, 21 bp, Homo sapiens
cagcccagcttcttccccagt

SEQ ID NO: 9424008 - DNA, 22 bp, Homo sapiens
cagcccagctctgactaaccct

SEQ ID NO: 9424009 - DNA, 22 bp, Homo sapiens
cagcccagctctgactaaccct

SEQ ID NO: 9424010 - DNA, 22 bp, Homo sapiens
cagcccagctctgactaaccct

SEQ ID NO: 9424011 - DNA, 22 bp, Homo sapiens
cagcccagctgggatcacactc

SEQ ID NO: 9424012 - DNA, 22 bp, Homo sapiens
cagcccagcgcaaacaactggc

SEQ ID NO: 9424013 - DNA, 22 bp, Homo sapiens
cagcccagcgcaaacaactggc

SEQ ID NO: 9424014 - DNA, 22 bp, Homo sapiens
cagcccagcgcaaacaactggc

SEQ ID NO: 9424015 - DNA, 22 bp, Homo sapiens
cagcccagccgagggcctggct

SEQ ID NO: 9424016 - DNA, 22 bp, Homo sapiens
cagcccagccgagggcctggct

SEQ ID NO: 9424017 - DNA, 22 bp, Homo sapiens
cagcccagccgagggcctggct

SEQ ID NO: 9424018 - DNA, 22 bp, Homo sapiens
cagcccagccgagggcctggct

SEQ ID NO: 9424019 - DNA, 22 bp, Homo sapiens
cagcccaggccgacagttcctc

SEQ ID NO: 9424020 - DNA, 22 bp, Homo sapiens
cagcccaggactgcaggtgttt

SEQ ID NO: 9424021 - DNA, 22 bp, Homo sapiens
cagcccaggccgacagttcctc

SEQ ID NO: 9424022 - DNA, 22 bp, Homo sapiens
cagcccaggccgacagttcctc

SEQ ID NO: 9424023 - DNA, 22 bp, Homo sapiens
cagcccaggccgacagttcctc

SEQ ID NO: 9424024 - DNA, 22 bp, Homo sapiens
cagcccaggccgacagttcctc

SEQ ID NO: 9424025 - DNA, 22 bp, Homo sapiens
cagcccaggccgacagttcctc

SEQ ID NO: 9424026 - DNA, 22 bp, Homo sapiens
cagcccaggccgacagttcctc

SEQ ID NO: 9424027 - DNA, 22 bp, Homo sapiens
gtggagccaggggctgtaggta

SEQ ID NO: 9424028 - DNA, 22 bp, Homo sapiens
gtggcactcacctgtagtttca

SEQ ID NO: 9424029 - DNA, 22 bp, Homo sapiens
gtggcactgggtgagtgagtga

SEQ ID NO: 9424030 - DNA, 22 bp, Homo sapiens
gtggcagaaactggcagaggag

SEQ ID NO: 9424031 - DNA, 22 bp, Homo sapiens
gtggcagggtgctcatcatgca

SEQ ID NO: 9424032 - DNA, 22 bp, Homo sapiens
gtggcagggtgctcatcatgca

SEQ ID NO: 9424033 - DNA, 22 bp, Homo sapiens
gtggcagggtgctcatcatgca

SEQ ID NO: 9424034 - DNA, 22 bp, Homo sapiens
gtggcagagccaaggctggagc

SEQ ID NO: 9424035 - DNA, 22 bp, Homo sapiens
gtggcagggtgctcatcatgca

SEQ ID NO: 9424036 - DNA, 22 bp, Homo sapiens
gtggcaggtcccattggagcag

SEQ ID NO: 9424037 - DNA, 22 bp, Homo sapiens
gtggcaggtcccattggagcag

SEQ ID NO: 9424038 - DNA, 22 bp, Homo sapiens
gtggcaggtggagcctcctgca

SEQ ID NO: 9424039 - DNA, 22 bp, Homo sapiens
gtggcaggtggagcctcctgca

SEQ ID NO: 9424040 - DNA, 22 bp, Homo sapiens
gtggcaggttataagcatctca

SEQ ID NO: 9424041 - DNA, 22 bp, Homo sapiens
gtggcaggttataagcatctca

SEQ ID NO: 9424042 - DNA, 22 bp, Homo sapiens
gtggcagagcaggagacaggac

SEQ ID NO: 9424043 - DNA, 22 bp, Homo sapiens
gtggcagagagcaagtgtctga

SEQ ID NO: 9424044 - DNA, 22 bp, Homo sapiens
gtggcagagagcaagtgtctga

SEQ ID NO: 9424045 - DNA, 22 bp, Homo sapiens
gtggcagagcaggagacaggac

SEQ ID NO: 9424046 - DNA, 22 bp, Homo sapiens
gtggcagagaacaaggagaggt

SEQ ID NO: 9424047 - DNA, 22 bp, Homo sapiens
gtggcagagaacaaggagaggt

SEQ ID NO: 9424048 - DNA, 22 bp, Homo sapiens
gtggcagaccttcccttctcct

SEQ ID NO: 9424049 - DNA, 22 bp, Homo sapiens
gtggcagagaacaaggagaggt

SEQ ID NO: 9424050 - DNA, 22 bp, Homo sapiens
gtggcagaaatgggactttgag

SEQ ID NO: 9424051 - DNA, 22 bp, Homo sapiens
gtggcagaaatattcttgctct

SEQ ID NO: 9424052 - DNA, 22 bp, Homo sapiens
gtggcagaaactggcagaggag

SEQ ID NO: 9424053 - DNA, 22 bp, Homo sapiens
gtggcagaagagtaggatgggc

SEQ ID NO: 9424054 - DNA, 22 bp, Homo sapiens
gtggcagaccttcccttctcct

SEQ ID NO: 9424055 - DNA, 22 bp, Homo sapiens
gtggcagaagagtaggatgggc

SEQ ID NO: 9424056 - DNA, 22 bp, Homo sapiens
gtggcagaactatgtgattgct

SEQ ID NO: 9424057 - DNA, 22 bp, Homo sapiens
gtggcagaactatgtgattgct

SEQ ID NO: 9424058 - DNA, 22 bp, Homo sapiens
cagctgaagaaagagtggttag

SEQ ID NO: 9424059 - DNA, 22 bp, Homo sapiens
cagctgaaagaaggaagtgtca

SEQ ID NO: 9424060 - DNA, 22 bp, Homo sapiens
cagctctttttcacacaacatg

SEQ ID NO: 9424061 - DNA, 22 bp, Homo sapiens
cagctctttgagtattccattt

SEQ ID NO: 9424062 - DNA, 18 bp, Homo sapiens
cagctcttctccagtaac

SEQ ID NO: 9424063 - DNA, 22 bp, Homo sapiens
cagctcttggagaaaccagagc

SEQ ID NO: 9424064 - DNA, 22 bp, Homo sapiens
cagctctttattgccaatattc

SEQ ID NO: 9424065 - DNA, 22 bp, Homo sapiens
cagctcttcctagccatgccac

SEQ ID NO: 9424066 - DNA, 22 bp, Homo sapiens
cagctcttcctcccaccggaca

SEQ ID NO: 9424067 - DNA, 17 bp, Homo sapiens
cagctcttcctccctct

SEQ ID NO: 9424068 - DNA, 22 bp, Homo sapiens
cagctcttcctaccctagttgg

SEQ ID NO: 9424069 - DNA, 22 bp, Homo sapiens
cagctcttcagtgcctgagata

SEQ ID NO: 9424070 - DNA, 22 bp, Homo sapiens
cagctcttcagtgcctgagata

SEQ ID NO: 9424071 - DNA, 22 bp, Homo sapiens
cagctcttccatttccttcagc

SEQ ID NO: 9424072 - DNA, 22 bp, Homo sapiens
cagctcttattttctctcctaa

SEQ ID NO: 9424073 - DNA, 22 bp, Homo sapiens
cagctcttaacacagcttgtat

SEQ ID NO: 9424074 - DNA, 22 bp, Homo sapiens
cagctctgttgccaaagtgggc

SEQ ID NO: 9424075 - DNA, 22 bp, Homo sapiens
cagctctgttcaaactatccag

SEQ ID NO: 9424076 - DNA, 22 bp, Homo sapiens
cagctctgttcatagatggtgc

SEQ ID NO: 9424077 - DNA, 22 bp, Homo sapiens
cagctctgttcatagatggtgc

SEQ ID NO: 9424078 - DNA, 22 bp, Homo sapiens
cagctctgttcatagatggtgc

SEQ ID NO: 9424079 - DNA, 22 bp, Homo sapiens
cagctgaggtcaaagaagcagg

SEQ ID NO: 9424080 - DNA, 22 bp, Homo sapiens
cagctgaggtcaaagaagcagg

SEQ ID NO: 9424081 - DNA, 18 bp, Homo sapiens
cagctgaggaccaaactg

SEQ ID NO: 9424082 - DNA, 22 bp, Homo sapiens
cagctgagtatgcattcaagca

SEQ ID NO: 9424083 - DNA, 22 bp, Homo sapiens
cagctgagtatgcattcaagca

SEQ ID NO: 9424084 - DNA, 22 bp, Homo sapiens
cagctgagctgccagactactg

SEQ ID NO: 9424085 - DNA, 22 bp, Homo sapiens
cagctgaggaatactagatgta

SEQ ID NO: 9424086 - DNA, 22 bp, Homo sapiens
cagctgaggaatactagatgta

SEQ ID NO: 9424087 - DNA, 22 bp, Homo sapiens
cagctgaggaatactagatgta

SEQ ID NO: 9424088 - DNA, 22 bp, Homo sapiens
cagctgaagagaggtgctgagt

SEQ ID NO: 9424089 - DNA, 22 bp, Homo sapiens
cagctgaacctttccctggagc

SEQ ID NO: 9424090 - DNA, 23 bp, Homo sapiens
cagctgaagcagcctgggctgga

SEQ ID NO: 9424091 - DNA, 22 bp, Homo sapiens
cagctgagcatcactagtctgg

SEQ ID NO: 9424092 - DNA, 22 bp, Homo sapiens
cagctgaagagaggtgctgagt

SEQ ID NO: 9424093 - DNA, 22 bp, Homo sapiens
cagctgagctcccaggccatca

SEQ ID NO: 9424094 - DNA, 22 bp, Homo sapiens
cagctgagtttccaagtctgcc

SEQ ID NO: 9424095 - DNA, 22 bp, Homo sapiens
cagctgagtggaccctagaggc

SEQ ID NO: 9424096 - DNA, 22 bp, Homo sapiens
cagctgagtggaccctagaggc

SEQ ID NO: 9424097 - DNA, 22 bp, Homo sapiens
cagctgagtgttggcatgttca

SEQ ID NO: 9424098 - DNA, 22 bp, Homo sapiens
cagctgagtctgaggttctttg

SEQ ID NO: 9424099 - DNA, 22 bp, Homo sapiens
cagctgagtggaccctagaggc

SEQ ID NO: 9424100 - DNA, 22 bp, Homo sapiens
cagctgagtggaccctagaggc

SEQ ID NO: 9424101 - DNA, 22 bp, Homo sapiens
cagctgagtttccaagtctgcc

SEQ ID NO: 9424102 - DNA, 22 bp, Homo sapiens
cagctgagttactctgaggtct

SEQ ID NO: 9424103 - DNA, 22 bp, Homo sapiens
cagctgagttactctgaggtct

SEQ ID NO: 9424104 - DNA, 22 bp, Homo sapiens
gtgggcaggaggccctgccctg

SEQ ID NO: 9424105 - DNA, 22 bp, Homo sapiens
gtgggactcttctttggcagtg

SEQ ID NO: 9424106 - DNA, 22 bp, Homo sapiens
gtgggacagtcagaagtgagca

SEQ ID NO: 9424107 - DNA, 22 bp, Homo sapiens
gtgggacagctggagggtccct

SEQ ID NO: 9424108 - DNA, 22 bp, Homo sapiens
gtgggacaggtcaaatcttaaa

SEQ ID NO: 9424109 - DNA, 22 bp, Homo sapiens
gtgggacagctggagggtccct

SEQ ID NO: 9424110 - DNA, 22 bp, Homo sapiens
gtgggacagctttccgttgagg

SEQ ID NO: 9424111 - DNA, 22 bp, Homo sapiens
gtgggacagcggggtgggacag

SEQ ID NO: 9424112 - DNA, 22 bp, Homo sapiens
gtgggacagcggggtgggacag

SEQ ID NO: 9424113 - DNA, 22 bp, Homo sapiens
gtgggcaggccctaggcgattt

SEQ ID NO: 9424114 - DNA, 22 bp, Homo sapiens
gtgggcaggccctaggcgattt

SEQ ID NO: 9424115 - DNA, 22 bp, Homo sapiens
gtgggcaggccctaggcgattt

SEQ ID NO: 9424116 - DNA, 22 bp, Homo sapiens
gtgggcaggccctaggcgattt

SEQ ID NO: 9424117 - DNA, 22 bp, Homo sapiens
gtgggcaggagtgagcaacagg

SEQ ID NO: 9424118 - DNA, 22 bp, Homo sapiens
gtgggcaggccccaaagcaggg

SEQ ID NO: 9424119 - DNA, 22 bp, Homo sapiens
gtgggcaggccccaaagcaggg

SEQ ID NO: 9424120 - DNA, 22 bp, Homo sapiens
gtggggagggagatgctgaagt

SEQ ID NO: 9424121 - DNA, 22 bp, Homo sapiens
gtggggagggagatgctgaagt

SEQ ID NO: 9424122 - DNA, 22 bp, Homo sapiens
gtggggaggcctaagcaagttg

SEQ ID NO: 9424123 - DNA, 22 bp, Homo sapiens
gtgggcagtggggtcttctgcc

SEQ ID NO: 9424124 - DNA, 22 bp, Homo sapiens
gtgggcagtggggtcttctgcc

SEQ ID NO: 9424125 - DNA, 22 bp, Homo sapiens
gtgggcagtgcctgacggatga

SEQ ID NO: 9424126 - DNA, 22 bp, Homo sapiens
gtgggcagtgcctgacggatga

SEQ ID NO: 9424127 - DNA, 22 bp, Homo sapiens
gtgggcagtgcctgacggatga

SEQ ID NO: 9424128 - DNA, 22 bp, Homo sapiens
gtgggcaggtaggcaccagcta

SEQ ID NO: 9424129 - DNA, 22 bp, Homo sapiens
gtgggcaggtaggcaccagcta

SEQ ID NO: 9424130 - DNA, 22 bp, Homo sapiens
gtggccttgctcacatgtccag

SEQ ID NO: 9424131 - DNA, 22 bp, Homo sapiens
gtggcgcagagggtggcagaga

SEQ ID NO: 9424132 - DNA, 22 bp, Homo sapiens
gtggcggactcgacctggcctg

SEQ ID NO: 9424133 - DNA, 22 bp, Homo sapiens
gtggcggactcgacctggcctg

SEQ ID NO: 9424134 - DNA, 22 bp, Homo sapiens
gtggcttctgcggtgtgcgcag

SEQ ID NO: 9424135 - DNA, 22 bp, Homo sapiens
gtggcttctgcggtgtgcgcag

SEQ ID NO: 9424136 - DNA, 22 bp, Homo sapiens
gtggctcacgtctgtcatctca

SEQ ID NO: 9424137 - DNA, 22 bp, Homo sapiens
gtggctcacgcctgtaatccca

SEQ ID NO: 9424138 - DNA, 22 bp, Homo sapiens
gtggctcacgtctgtcatctca

SEQ ID NO: 9424139 - DNA, 22 bp, Homo sapiens
gtggctcacacctgtaatccca

SEQ ID NO: 9424140 - DNA, 22 bp, Homo sapiens
gtggctcacagcaatgtttcct

SEQ ID NO: 9424141 - DNA, 22 bp, Homo sapiens
gtggctcacgcctgtaatccca

SEQ ID NO: 9424142 - DNA, 22 bp, Homo sapiens
gtggctcacacctgtaatccca

SEQ ID NO: 9424143 - DNA, 22 bp, Homo sapiens
gtggctcacagcaatgtttcct

SEQ ID NO: 9424144 - DNA, 22 bp, Homo sapiens
gtggcttcttcttgggagctgc

SEQ ID NO: 9424145 - DNA, 22 bp, Homo sapiens
gtggcttcttcttgggagctgc

SEQ ID NO: 9424146 - DNA, 22 bp, Homo sapiens
gtggcttctggctgggcctcag

SEQ ID NO: 9424147 - DNA, 22 bp, Homo sapiens
gtggcttctggctgggcctcag

SEQ ID NO: 9424148 - DNA, 22 bp, Homo sapiens
gtgggaagtctctcggaggaag

SEQ ID NO: 9424149 - DNA, 22 bp, Homo sapiens
gtgggaagtctctcggaggaag

SEQ ID NO: 9424150 - DNA, 19 bp, Homo sapiens
gtgggacagacattacata

SEQ ID NO: 9424151 - DNA, 22 bp, Homo sapiens
gtgggacaaggatgaagatatt

SEQ ID NO: 9424152 - DNA, 22 bp, Homo sapiens
gtgggacacatagaaaaataag

SEQ ID NO: 9424153 - DNA, 22 bp, Homo sapiens
gtgggacaaggatgaagatatt

SEQ ID NO: 9424154 - DNA, 22 bp, Homo sapiens
gtggctttgtttccaaatgaaa

SEQ ID NO: 9424155 - DNA, 22 bp, Homo sapiens
cagctggccaatcagggcgccc

SEQ ID NO: 9424156 - DNA, 22 bp, Homo sapiens
cagctggccccacagtagaggc

SEQ ID NO: 9424157 - DNA, 22 bp, Homo sapiens
cagctggccctttggtagcctt

SEQ ID NO: 9424158 - DNA, 22 bp, Homo sapiens
cagctggccccacagtagaggc

SEQ ID NO: 9424159 - DNA, 22 bp, Homo sapiens
cagctggcctgagcggtggcgg

SEQ ID NO: 9424160 - DNA, 22 bp, Homo sapiens
cagctggcctgatccctgtggc

SEQ ID NO: 9424161 - DNA, 22 bp, Homo sapiens
cagctggcctgatccctgtggc

SEQ ID NO: 9424162 - DNA, 22 bp, Homo sapiens
cagctggcgggcagagccgcca

SEQ ID NO: 9424163 - DNA, 22 bp, Homo sapiens
cagctggcgtggagtgattgca

SEQ ID NO: 9424164 - DNA, 22 bp, Homo sapiens
cagctggctccacctctgggct

SEQ ID NO: 9424165 - DNA, 22 bp, Homo sapiens
cagctggcgcctggggaccaga

SEQ ID NO: 9424166 - DNA, 22 bp, Homo sapiens
cagctggcgactctcctcgatg

SEQ ID NO: 9424167 - DNA, 22 bp, Homo sapiens
cagctggcgcctggggaccaga

SEQ ID NO: 9424168 - DNA, 22 bp, Homo sapiens
gtgggtggatcatgaggtcagg

SEQ ID NO: 9424169 - DNA, 22 bp, Homo sapiens
gtgggtggatcacctgaggtca

SEQ ID NO: 9424170 - DNA, 22 bp, Homo sapiens
gtgggtggatcacctgaggtca

SEQ ID NO: 9424171 - DNA, 22 bp, Homo sapiens
gtgggtggatcatgaggtcagg

SEQ ID NO: 9424172 - DNA, 22 bp, Homo sapiens
gtgggtggatcatgaggtcagg

SEQ ID NO: 9424173 - DNA, 22 bp, Homo sapiens
gtgggtggatcatgaggtcagg

SEQ ID NO: 9424174 - DNA, 22 bp, Homo sapiens
gtgggtggatggctcacctcca

SEQ ID NO: 9424175 - DNA, 22 bp, Homo sapiens
cagctggctgcatgatgccaaa

SEQ ID NO: 9424176 - DNA, 22 bp, Homo sapiens
gtgggtggatcacctgaggtca

SEQ ID NO: 9424177 - DNA, 22 bp, Homo sapiens
gtgggtggaggcgtcgagggca

SEQ ID NO: 9424178 - DNA, 22 bp, Homo sapiens
gtgggtggaggcgtcgagggca

SEQ ID NO: 9424179 - DNA, 22 bp, Homo sapiens
gtgggtggaggcgtcgagggca

SEQ ID NO: 9424180 - DNA, 22 bp, Homo sapiens
cagctgctgttcagttttgttt

SEQ ID NO: 9424181 - DNA, 22 bp, Homo sapiens
cagctgcttactagctgtgtga

SEQ ID NO: 9424182 - DNA, 22 bp, Homo sapiens
cagctgctgttcagttttgttt

SEQ ID NO: 9424183 - DNA, 22 bp, Homo sapiens
cagctgctgttcagttttgttt

SEQ ID NO: 9424184 - DNA, 22 bp, Homo sapiens
cagctgctgttactgcttatta

SEQ ID NO: 9424185 - DNA, 22 bp, Homo sapiens
cagctgctgttcagttttgttt

SEQ ID NO: 9424186 - DNA, 22 bp, Homo sapiens
cagctgctgttcagttttgttt

SEQ ID NO: 9424187 - DNA, 22 bp, Homo sapiens
cagctgctgttactgcttatta

SEQ ID NO: 9424188 - DNA, 22 bp, Homo sapiens
cagctgctgcctcatccacttt

SEQ ID NO: 9424189 - DNA, 22 bp, Homo sapiens
cagctgctgcctcatccacttt

SEQ ID NO: 9424190 - DNA, 22 bp, Homo sapiens
cagctgctgtaacagaatactt

SEQ ID NO: 9424191 - DNA, 22 bp, Homo sapiens
cagctgcctgtattgtcctcat

SEQ ID NO: 9424192 - DNA, 21 bp, Homo sapiens
cagctgcgtgtcctcccaccc

SEQ ID NO: 9424193 - DNA, 22 bp, Homo sapiens
cagctgctgatggcctgacaga

SEQ ID NO: 9424194 - DNA, 22 bp, Homo sapiens
cagctgctgatggcctgacaga

SEQ ID NO: 9424195 - DNA, 22 bp, Homo sapiens
cagctgctctggtggtctctcc

SEQ ID NO: 9424196 - DNA, 22 bp, Homo sapiens
cagctgctgaggaaggggttgg

SEQ ID NO: 9424197 - DNA, 22 bp, Homo sapiens
cagctgcaggagaaacagaggc

SEQ ID NO: 9424198 - DNA, 22 bp, Homo sapiens
cagctgcaggagaaacagaggc

SEQ ID NO: 9424199 - DNA, 22 bp, Homo sapiens
cagctgcaggagctgagcactt

SEQ ID NO: 9424200 - DNA, 22 bp, Homo sapiens
cagctgcaggaacaaaaatgtg

SEQ ID NO: 9424201 - DNA, 22 bp, Homo sapiens
cagctgcactgaagcaggtttg

SEQ ID NO: 9424202 - DNA, 22 bp, Homo sapiens
cagctgcagaaagcaagcaggt

SEQ ID NO: 9424203 - DNA, 22 bp, Homo sapiens
cagctgcagaaagcaagcaggt

SEQ ID NO: 9424204 - DNA, 22 bp, Homo sapiens
cagctgcagatcatgtttacag

SEQ ID NO: 9424205 - DNA, 22 bp, Homo sapiens
cagctgcagaaagcaagcaggt

SEQ ID NO: 9424206 - DNA, 22 bp, Homo sapiens
gtggggctgcttaggctgcgca

SEQ ID NO: 9424207 - DNA, 22 bp, Homo sapiens
gtggggctgagtggagccagaa

SEQ ID NO: 9424208 - DNA, 19 bp, Homo sapiens
cagctgcaccgtgaccatc

SEQ ID NO: 9424209 - DNA, 19 bp, Homo sapiens
cagctgcaccgtgaccatc

SEQ ID NO: 9424210 - DNA, 22 bp, Homo sapiens
cagctgatttgagaaagaatga

SEQ ID NO: 9424211 - DNA, 22 bp, Homo sapiens
cagctgcaatcagaagctaagg

SEQ ID NO: 9424212 - DNA, 22 bp, Homo sapiens
gtggggcagtggcctgggagca

SEQ ID NO: 9424213 - DNA, 22 bp, Homo sapiens
gtggggagtgttctgtgattgg

SEQ ID NO: 9424214 - DNA, 22 bp, Homo sapiens
gtggggcagtggcctgggagca

SEQ ID NO: 9424215 - DNA, 22 bp, Homo sapiens
gtggggagtgttctgtgattgg

SEQ ID NO: 9424216 - DNA, 22 bp, Homo sapiens
gtggggagggagatgctgaagt

SEQ ID NO: 9424217 - DNA, 22 bp, Homo sapiens
gtggggagggagatgctgaagt

SEQ ID NO: 9424218 - DNA, 22 bp, Homo sapiens
gtggggcatgcacgctgctcct

SEQ ID NO: 9424219 - DNA, 22 bp, Homo sapiens
gtggggcatgcacgctgctcct

SEQ ID NO: 9424220 - DNA, 22 bp, Homo sapiens
gtggggcatgcacgctgctcct

SEQ ID NO: 9424221 - DNA, 22 bp, Homo sapiens
gtggggcatgcacgctgctcct

SEQ ID NO: 9424222 - DNA, 22 bp, Homo sapiens
gtggggctaaaaactgtgcagt

SEQ ID NO: 9424223 - DNA, 22 bp, Homo sapiens
gtggggcggcagatgctccctg

SEQ ID NO: 9424224 - DNA, 22 bp, Homo sapiens
gtggggctcccatctcctggct

SEQ ID NO: 9424225 - DNA, 22 bp, Homo sapiens
cagctgcctgcaacacaagctt

SEQ ID NO: 9424226 - DNA, 22 bp, Homo sapiens
cagctgcctgcaacacaagctt

SEQ ID NO: 9424227 - DNA, 22 bp, Homo sapiens
cagctgcctgtattgtcctcat

SEQ ID NO: 9424228 - DNA, 22 bp, Homo sapiens
cagctgcctatgacctagcctc

SEQ ID NO: 9424229 - DNA, 22 bp, Homo sapiens
cagctgcctatgacctagcctc

SEQ ID NO: 9424230 - DNA, 22 bp, Homo sapiens
cagctgcctatgacctagcctc

SEQ ID NO: 9424231 - DNA, 22 bp, Homo sapiens
cagctgccctgccttgccctta

SEQ ID NO: 9424232 - DNA, 18 bp, Homo sapiens
cagctgcaggctcaggac

SEQ ID NO: 9424233 - DNA, 18 bp, Homo sapiens
cagctgcaggctcaggac

SEQ ID NO: 9424234 - DNA, 22 bp, Homo sapiens
cagctgcaggagctgagcactt

SEQ ID NO: 9424235 - DNA, 18 bp, Homo sapiens
cagctgcaggctcaggac

SEQ ID NO: 9424236 - DNA, 22 bp, Homo sapiens
cagctgcagttcaatgcttgct

SEQ ID NO: 9424237 - DNA, 22 bp, Homo sapiens
cagctgcagttcaatgcttgct

SEQ ID NO: 9424238 - DNA, 22 bp, Homo sapiens
cagctgcagtgggggaccacaa

SEQ ID NO: 9424239 - DNA, 22 bp, Homo sapiens
cagctgcagttcaatgcttgct

SEQ ID NO: 9424240 - DNA, 22 bp, Homo sapiens
cagctgcagtgggggaccacaa

SEQ ID NO: 9424241 - DNA, 22 bp, Homo sapiens
cagctgcaggctgtgcaggaag

SEQ ID NO: 9424242 - DNA, 22 bp, Homo sapiens
cagctgcagtcatcttctagaa

SEQ ID NO: 9424243 - DNA, 22 bp, Homo sapiens
cagctgcagtcatcttctagaa

SEQ ID NO: 9424244 - DNA, 22 bp, Homo sapiens
cagctgcattaattttagtgaa

SEQ ID NO: 9424245 - DNA, 22 bp, Homo sapiens
cagctgcatgtctgtggtggtc

SEQ ID NO: 9424246 - DNA, 22 bp, Homo sapiens
cagctgccacacctctttctct

SEQ ID NO: 9424247 - DNA, 22 bp, Homo sapiens
gtgtagtataaggttaaaacct

SEQ ID NO: 9424248 - DNA, 22 bp, Homo sapiens
gtgtagagtgacaaggtgggaa

SEQ ID NO: 9424249 - DNA, 22 bp, Homo sapiens
gtgtagcatatagcaagagcat

SEQ ID NO: 9424250 - DNA, 22 bp, Homo sapiens
gtgtagcatatagcaagagcat

SEQ ID NO: 9424251 - DNA, 22 bp, Homo sapiens
gtgtacatattgagtctgctga

SEQ ID NO: 9424252 - DNA, 22 bp, Homo sapiens
gtgtacatagaattgtgctttg

SEQ ID NO: 9424253 - DNA, 18 bp, Homo sapiens
gtgtactcatgtcctcag

SEQ ID NO: 9424254 - DNA, 22 bp, Homo sapiens
gtgtatctcatgttcttctctg

SEQ ID NO: 9424255 - DNA, 22 bp, Homo sapiens
gtgtatccttattcacacacat

SEQ ID NO: 9424256 - DNA, 17 bp, Homo sapiens
gtgtatcaccatggcaa

SEQ ID NO: 9424257 - DNA, 19 bp, Homo sapiens
gtgtatgtaagttgtgagg

SEQ ID NO: 9424258 - DNA, 22 bp, Homo sapiens
gtgtatcaaagcacagacttca

SEQ ID NO: 9424259 - DNA, 22 bp, Homo sapiens
gtgggtgtggaactgtgagacc

SEQ ID NO: 9424260 - DNA, 22 bp, Homo sapiens
gtgggtgtggaactgtgagacc

SEQ ID NO: 9424261 - DNA, 22 bp, Homo sapiens
gtgggtgtcctgtgaaggctca

SEQ ID NO: 9424262 - DNA, 22 bp, Homo sapiens
gtgggtggggagctctctggag

SEQ ID NO: 9424263 - DNA, 22 bp, Homo sapiens
gtgggtgtgataagaccaaggg

SEQ ID NO: 9424264 - DNA, 22 bp, Homo sapiens
gtgggtgtgagtgacggcgtcc

SEQ ID NO: 9424265 - DNA, 22 bp, Homo sapiens
gtgggtgtgagtgacggcgtcc

SEQ ID NO: 9424266 - DNA, 22 bp, Homo sapiens
gtgggtgtctcaagaatggggg

SEQ ID NO: 9424267 - DNA, 22 bp, Homo sapiens
gtgggtgtcctgtgaaggctca

SEQ ID NO: 9424268 - DNA, 22 bp, Homo sapiens
gtgggtgtgagtgacggcgtcc

SEQ ID NO: 9424269 - DNA, 22 bp, Homo sapiens
gtgggtggggagctctctggag

SEQ ID NO: 9424270 - DNA, 22 bp, Homo sapiens
gtgggtggggagctctctggag

SEQ ID NO: 9424271 - DNA, 22 bp, Homo sapiens
gtgggtggattccagcaacgct

SEQ ID NO: 9424272 - DNA, 22 bp, Homo sapiens
gtgtgagcagaaaccatgagta

SEQ ID NO: 9424273 - DNA, 22 bp, Homo sapiens
gtgtgagcatcaaagcctgtca

SEQ ID NO: 9424274 - DNA, 22 bp, Homo sapiens
gtgtgagcagaaaccatgagta

SEQ ID NO: 9424275 - DNA, 22 bp, Homo sapiens
gtgtgacccaaggacactctct

SEQ ID NO: 9424276 - DNA, 20 bp, Homo sapiens
gtgtgaagccctcaggagga

SEQ ID NO: 9424277 - DNA, 20 bp, Homo sapiens
gtgtgacctcctgtggatgc

SEQ ID NO: 9424278 - DNA, 22 bp, Homo sapiens
gtgtgactttatttggaaatag

SEQ ID NO: 9424279 - DNA, 22 bp, Homo sapiens
gtgtgaaagttcctaagactat

SEQ ID NO: 9424280 - DNA, 22 bp, Homo sapiens
gtgtgaaagttcctaagactat

SEQ ID NO: 9424281 - DNA, 22 bp, Homo sapiens
gtgtgaaatggttctctttgtt

SEQ ID NO: 9424282 - DNA, 22 bp, Homo sapiens
gtgtcttagggttgcacagagt

SEQ ID NO: 9424283 - DNA, 18 bp, Homo sapiens
gtgtcttattacagtggg

SEQ ID NO: 9424284 - DNA, 22 bp, Homo sapiens
gtgtctgtgtcattactaatag

SEQ ID NO: 9424285 - DNA, 22 bp, Homo sapiens
gtgtctgttatacagaggagac

SEQ ID NO: 9424286 - DNA, 22 bp, Homo sapiens
gtgtcttagaaagactgaatgc

SEQ ID NO: 9424287 - DNA, 22 bp, Homo sapiens
gtgtctgttatacagaggagac

SEQ ID NO: 9424288 - DNA, 19 bp, Homo sapiens
gtgtctgcctttgtgccac

SEQ ID NO: 9424289 - DNA, 22 bp, Homo sapiens
gtgtctgcttgctgagcattta

SEQ ID NO: 9424290 - DNA, 22 bp, Homo sapiens
gtgtcaaatccactcctctttt

SEQ ID NO: 9424291 - DNA, 22 bp, Homo sapiens
gtgtctgcacataggatctcaa

SEQ ID NO: 9424292 - DNA, 19 bp, Homo sapiens
gtgtctgcctttgtgccac

SEQ ID NO: 9424293 - DNA, 19 bp, Homo sapiens
gtgtatgtaagttgtgagg

SEQ ID NO: 9424294 - DNA, 22 bp, Homo sapiens
gtgtatgttctacttaatatta

SEQ ID NO: 9424295 - DNA, 22 bp, Homo sapiens
gtgtatgtgtttatagggaggt

SEQ ID NO: 9424296 - DNA, 22 bp, Homo sapiens
cagctggctggtcagtgcacaa

SEQ ID NO: 9424297 - DNA, 22 bp, Homo sapiens
cagctggctggtcagtgcacaa

SEQ ID NO: 9424298 - DNA, 22 bp, Homo sapiens
cagctggctgcggtgaggggac

SEQ ID NO: 9424299 - DNA, 22 bp, Homo sapiens
gtgtggccgccacttggggcag

SEQ ID NO: 9424300 - DNA, 22 bp, Homo sapiens
gtgtggccgtgtatccatggct

SEQ ID NO: 9424301 - DNA, 22 bp, Homo sapiens
cagctggctgcggtgaggggac

SEQ ID NO: 9424302 - DNA, 22 bp, Homo sapiens
gtgtggccgtgtatccatggct

SEQ ID NO: 9424303 - DNA, 22 bp, Homo sapiens
gtgtggcacctcctttccagct

SEQ ID NO: 9424304 - DNA, 19 bp, Homo sapiens
gtgtggcagagagtgacca

SEQ ID NO: 9424305 - DNA, 19 bp, Homo sapiens
gtgtggcagagagtgacca

SEQ ID NO: 9424306 - DNA, 22 bp, Homo sapiens
gtgtggccctgcgtcctgagtc

SEQ ID NO: 9424307 - DNA, 22 bp, Homo sapiens
gtgtggccctgcgtcctgagtc

SEQ ID NO: 9424308 - DNA, 20 bp, Homo sapiens
gtgtggccaggagctgcgct

SEQ ID NO: 9424309 - DNA, 20 bp, Homo sapiens
gtgtggccaggagctgcgct

SEQ ID NO: 9424310 - DNA, 22 bp, Homo sapiens
gtgtggcagggcgtttgcagac

SEQ ID NO: 9424311 - DNA, 22 bp, Homo sapiens
gtgtgctgggaccacgctgggt

SEQ ID NO: 9424312 - DNA, 22 bp, Homo sapiens
gtgtgctgagtgactgtcatca

SEQ ID NO: 9424313 - DNA, 22 bp, Homo sapiens
gtgtggaaccaaataacctaaa

SEQ ID NO: 9424314 - DNA, 22 bp, Homo sapiens
gtgtggaatggagtttttgccc

SEQ ID NO: 9424315 - DNA, 22 bp, Homo sapiens
gtgtgctgttgttcaggtagaa

SEQ ID NO: 9424316 - DNA, 22 bp, Homo sapiens
gtgtgctgagtgactgtcatca

SEQ ID NO: 9424317 - DNA, 22 bp, Homo sapiens
gtgtgctgagtgactgtcatca

SEQ ID NO: 9424318 - DNA, 18 bp, Homo sapiens
gtgtgctcagagagtgag

SEQ ID NO: 9424319 - DNA, 22 bp, Homo sapiens
gtgtgctgagtgactgtcatca

SEQ ID NO: 9424320 - DNA, 22 bp, Homo sapiens
gtgtgcgttcctagtaaacgtg

SEQ ID NO: 9424321 - DNA, 22 bp, Homo sapiens
gtgtgcgcgctcataggtgtgt

SEQ ID NO: 9424322 - DNA, 22 bp, Homo sapiens
cagctgtgacagccagttgatg

SEQ ID NO: 9424323 - DNA, 22 bp, Homo sapiens
cagctgtgacagccagttgatg

SEQ ID NO: 9424324 - DNA, 17 bp, Homo sapiens
cagctgtgagagcctta

SEQ ID NO: 9424325 - DNA, 22 bp, Homo sapiens
cagctgtgacagccagttgatg

SEQ ID NO: 9424326 - DNA, 22 bp, Homo sapiens
cagctgtgaattgtcttatcta

SEQ ID NO: 9424327 - DNA, 22 bp, Homo sapiens
cagctgtgaattgtcttatcta

SEQ ID NO: 9424328 - DNA, 22 bp, Homo sapiens
cagctgtgagcagccagttgcc

SEQ ID NO: 9424329 - DNA, 22 bp, Homo sapiens
cagctgtgagagtgcattgaag

SEQ ID NO: 9424330 - DNA, 22 bp, Homo sapiens
cagctgtgagagtgcattgaag

SEQ ID NO: 9424331 - DNA, 17 bp, Homo sapiens
cagctgtgagagcctta

SEQ ID NO: 9424332 - DNA, 22 bp, Homo sapiens
cagctgtgagagtgcattgaag

SEQ ID NO: 9424333 - DNA, 17 bp, Homo sapiens
cagctgtgagagcctta

SEQ ID NO: 9424334 - DNA, 17 bp, Homo sapiens
cagctgtgagagcctta

SEQ ID NO: 9424335 - DNA, 22 bp, Homo sapiens
cagctgggtgatcttgggcagg

SEQ ID NO: 9424336 - DNA, 22 bp, Homo sapiens
cagctgtcttttctaaatatta

SEQ ID NO: 9424337 - DNA, 22 bp, Homo sapiens
cagctgtctggggagtgctcgc

SEQ ID NO: 9424338 - DNA, 22 bp, Homo sapiens
cagctgtctgaagcaggagtcc

SEQ ID NO: 9424339 - DNA, 22 bp, Homo sapiens
cagctggggcagccacgtgcgg

SEQ ID NO: 9424340 - DNA, 22 bp, Homo sapiens
cagctggggagagacatggcag

SEQ ID NO: 9424341 - DNA, 22 bp, Homo sapiens
cagctggggagagacatggcag

SEQ ID NO: 9424342 - DNA, 22 bp, Homo sapiens
cagctggggcagccacgtgcgg

SEQ ID NO: 9424343 - DNA, 22 bp, Homo sapiens
cagctggggcagccacgtgcgg

SEQ ID NO: 9424344 - DNA, 22 bp, Homo sapiens
cagctgggtgatcttgggcagg

SEQ ID NO: 9424345 - DNA, 22 bp, Homo sapiens
cagctgggagctccattagata

SEQ ID NO: 9424346 - DNA, 22 bp, Homo sapiens
cagctgggcctcctgagccctg

SEQ ID NO: 9424347 - DNA, 22 bp, Homo sapiens
cagctgggcctcctgagccctg

SEQ ID NO: 9424348 - DNA, 22 bp, Homo sapiens
cagctgggctaagagtagaggc

SEQ ID NO: 9424349 - DNA, 22 bp, Homo sapiens
cagcttctcagaaagctgaggt

SEQ ID NO: 9424350 - DNA, 22 bp, Homo sapiens
cagcttctcagaaagctgaggt

SEQ ID NO: 9424351 - DNA, 22 bp, Homo sapiens
cagcttctccagatgaccctca

SEQ ID NO: 9424352 - DNA, 22 bp, Homo sapiens
cagcttctccagatgaccctca

SEQ ID NO: 9424353 - DNA, 22 bp, Homo sapiens
cagcttctatttatctttgtgt

SEQ ID NO: 9424354 - DNA, 22 bp, Homo sapiens
cagcttctatttatctttgtgt

SEQ ID NO: 9424355 - DNA, 22 bp, Homo sapiens
cagcttctagcatcggctttga

SEQ ID NO: 9424356 - DNA, 22 bp, Homo sapiens
cagcttctagcatcggctttga

SEQ ID NO: 9424357 - DNA, 22 bp, Homo sapiens
cagcttctaccatcaggaaatt

SEQ ID NO: 9424358 - DNA, 22 bp, Homo sapiens
cagcttctccggcctggtgcgg

SEQ ID NO: 9424359 - DNA, 22 bp, Homo sapiens
cagcttctcgggagcgcatgtg

SEQ ID NO: 9424360 - DNA, 22 bp, Homo sapiens
cagcttctccattcttctggct

SEQ ID NO: 9424361 - DNA, 22 bp, Homo sapiens
cagcttctccattcttctggct

SEQ ID NO: 9424362 - DNA, 22 bp, Homo sapiens
cagcttctgagcaagccagggg

SEQ ID NO: 9424363 - DNA, 21 bp, Homo sapiens
cagcttctgaaggtgtaggaa

SEQ ID NO: 9424364 - DNA, 20 bp, Homo sapiens
cagcttggatgagaggctga

SEQ ID NO: 9424365 - DNA, 20 bp, Homo sapiens
cagcttggatgagaggctga

SEQ ID NO: 9424366 - DNA, 20 bp, Homo sapiens
cagcttggatgagaggctga

SEQ ID NO: 9424367 - DNA, 22 bp, Homo sapiens
cagcttggaggaggatctaaga

SEQ ID NO: 9424368 - DNA, 22 bp, Homo sapiens
cagcttgctaattttgacttca

SEQ ID NO: 9424369 - DNA, 22 bp, Homo sapiens
cagcttctgctatcgaacatct

SEQ ID NO: 9424370 - DNA, 22 bp, Homo sapiens
cagcttctgctatcgaacatct

SEQ ID NO: 9424371 - DNA, 22 bp, Homo sapiens
cagcttggattttggcacgtgt

SEQ ID NO: 9424372 - DNA, 22 bp, Homo sapiens
cagcttggcttcacattctgta

SEQ ID NO: 9424373 - DNA, 22 bp, Homo sapiens
cagcttggcgaatgtaggtatg

SEQ ID NO: 9424374 - DNA, 22 bp, Homo sapiens
cagcttggcttccgctttactg

SEQ ID NO: 9424375 - DNA, 22 bp, Homo sapiens
cagcttgggggcgctggcctca

SEQ ID NO: 9424376 - DNA, 22 bp, Homo sapiens
cagcttgggggcgctggcctca

SEQ ID NO: 9424377 - DNA, 22 bp, Homo sapiens
cagcttgggagtttggttttat

SEQ ID NO: 9424378 - DNA, 22 bp, Homo sapiens
cagcttgggtcaggtgcctgct

SEQ ID NO: 9424379 - DNA, 22 bp, Homo sapiens
gttattgaggtggagtctcact

SEQ ID NO: 9424380 - DNA, 22 bp, Homo sapiens
cagcttctaccatcaggaaatt

SEQ ID NO: 9424381 - DNA, 22 bp, Homo sapiens
gttattcttttatagcaataca

SEQ ID NO: 9424382 - DNA, 22 bp, Homo sapiens
gttattcttttatagcaataca

SEQ ID NO: 9424383 - DNA, 22 bp, Homo sapiens
gttattcttttatagcaataca

SEQ ID NO: 9424384 - DNA, 18 bp, Homo sapiens
gttattctctctgcagta

SEQ ID NO: 9424385 - DNA, 22 bp, Homo sapiens
gttattctcttggcctaattat

SEQ ID NO: 9424386 - DNA, 22 bp, Homo sapiens
gttattctgcacacctttaaaa

SEQ ID NO: 9424387 - DNA, 22 bp, Homo sapiens
gttattctgccaaacttccaca

SEQ ID NO: 9424388 - DNA, 22 bp, Homo sapiens
gttattctgcgatgcaatcctg

SEQ ID NO: 9424389 - DNA, 22 bp, Homo sapiens
gttattcttggtggccctgctg

SEQ ID NO: 9424390 - DNA, 22 bp, Homo sapiens
gttattctttgtatggtacatc

SEQ ID NO: 9424391 - DNA, 22 bp, Homo sapiens
gttattctttgtatggtacatc

SEQ ID NO: 9424392 - DNA, 22 bp, Homo sapiens
gttattctagtgctcagccatt

SEQ ID NO: 9424393 - DNA, 22 bp, Homo sapiens
gttattctattaatgtgattgt

SEQ ID NO: 9424394 - DNA, 22 bp, Homo sapiens
gttattctaccactatgtacag

SEQ ID NO: 9424395 - DNA, 22 bp, Homo sapiens
gttattctaccactatgtacag

SEQ ID NO: 9424396 - DNA, 22 bp, Homo sapiens
gttattctacagtcattgaagt

SEQ ID NO: 9424397 - DNA, 22 bp, Homo sapiens
gttattctacagtcattgaagt

SEQ ID NO: 9424398 - DNA, 22 bp, Homo sapiens
gttacatggagcaatgatgcat

SEQ ID NO: 9424399 - DNA, 22 bp, Homo sapiens
gttacataggtgtgttcagttt

SEQ ID NO: 9424400 - DNA, 22 bp, Homo sapiens
gttacattacttgtgcagttgt

SEQ ID NO: 9424401 - DNA, 22 bp, Homo sapiens
gttacattaaaaacattcactg

SEQ ID NO: 9424402 - DNA, 23 bp, Homo sapiens
gttaccttacttctgtgatcttc

SEQ ID NO: 9424403 - DNA, 22 bp, Homo sapiens
gttatgtatgagggaatgatta

SEQ ID NO: 9424404 - DNA, 22 bp, Homo sapiens
gttatgtatgggggccttatga

SEQ ID NO: 9424405 - DNA, 22 bp, Homo sapiens
gttacatttggtgatttggtgc

SEQ ID NO: 9424406 - DNA, 22 bp, Homo sapiens
gttacatttattagaggtctct

SEQ ID NO: 9424407 - DNA, 22 bp, Homo sapiens
gttacattaggataatttgctg

SEQ ID NO: 9424408 - DNA, 22 bp, Homo sapiens
gttattctacagtcattgaagt

SEQ ID NO: 9424409 - DNA, 22 bp, Homo sapiens
gttattctacagtcattgaagt

SEQ ID NO: 9424410 - DNA, 22 bp, Homo sapiens
gttattaaagtatttgatgtta

SEQ ID NO: 9424411 - DNA, 22 bp, Homo sapiens
gttattaaagtatttgatgtta

SEQ ID NO: 9424412 - DNA, 22 bp, Homo sapiens
gttattaaagtatttgatgtta

SEQ ID NO: 9424413 - DNA, 22 bp, Homo sapiens
gttatgtattgggaaatccaag

SEQ ID NO: 9424414 - DNA, 22 bp, Homo sapiens
gttatgtattgggaaatccaag

SEQ ID NO: 9424415 - DNA, 23 bp, Homo sapiens
cagctttcagggctttagggaag

SEQ ID NO: 9424416 - DNA, 22 bp, Homo sapiens
cagctttatttcacgtgtttgt

SEQ ID NO: 9424417 - DNA, 22 bp, Homo sapiens
caggaaaatggaatcacctgta

SEQ ID NO: 9424418 - DNA, 22 bp, Homo sapiens
caggaaaatggaatcacctgta

SEQ ID NO: 9424419 - DNA, 22 bp, Homo sapiens
caggaaaatctgcccacacaag

SEQ ID NO: 9424420 - DNA, 22 bp, Homo sapiens
caggaaaatctgcccacacaag

SEQ ID NO: 9424421 - DNA, 22 bp, Homo sapiens
cagctttgagagttgcatttta

SEQ ID NO: 9424422 - DNA, 22 bp, Homo sapiens
cagcttgggtcaggtgcctgct

SEQ ID NO: 9424423 - DNA, 22 bp, Homo sapiens
cagcttgtgcaaaggtcctggg

SEQ ID NO: 9424424 - DNA, 22 bp, Homo sapiens
cagctttagagaaaacatattt

SEQ ID NO: 9424425 - DNA, 16 bp, Homo sapiens
cagctttatgtcagtg

SEQ ID NO: 9424426 - DNA, 22 bp, Homo sapiens
cagctttattaatgattgtctt

SEQ ID NO: 9424427 - DNA, 17 bp, Homo sapiens
cagctttatgctactgt

SEQ ID NO: 9424428 - DNA, 20 bp, Homo sapiens
cagctttagatctttgatta

SEQ ID NO: 9424429 - DNA, 22 bp, Homo sapiens
cagctttagagaaaacatattt

SEQ ID NO: 9424430 - DNA, 22 bp, Homo sapiens
cagctttagagaaaacatattt

SEQ ID NO: 9424431 - DNA, 22 bp, Homo sapiens
cagctttaggactcataataaa

SEQ ID NO: 9424432 - DNA, 22 bp, Homo sapiens
cagctttaggactcataataaa

SEQ ID NO: 9424433 - DNA, 22 bp, Homo sapiens
caggaaagagctgccaggcagg

SEQ ID NO: 9424434 - DNA, 22 bp, Homo sapiens
caggaaagagctgccaggcagg

SEQ ID NO: 9424435 - DNA, 22 bp, Homo sapiens
caggaaagagctgccaggcagg

SEQ ID NO: 9424436 - DNA, 22 bp, Homo sapiens
caggaaagagctgccaggcagg

SEQ ID NO: 9424437 - DNA, 22 bp, Homo sapiens
caggaaagagctgccaggcagg

SEQ ID NO: 9424438 - DNA, 22 bp, Homo sapiens
caggaaagccgagtgccatagg

SEQ ID NO: 9424439 - DNA, 22 bp, Homo sapiens
gttcacacttttgatatgtgaa

SEQ ID NO: 9424440 - DNA, 22 bp, Homo sapiens
gttcacagaaggccagatggta

SEQ ID NO: 9424441 - DNA, 22 bp, Homo sapiens
caggaaagaaatgagaacacca

SEQ ID NO: 9424442 - DNA, 22 bp, Homo sapiens
caggaaagaaatgagaacacca

SEQ ID NO: 9424443 - DNA, 22 bp, Homo sapiens
caggaaactgtgggcttaaatc

SEQ ID NO: 9424444 - DNA, 16 bp, Homo sapiens
caggaaacttaaagac

SEQ ID NO: 9424445 - DNA, 21 bp, Homo sapiens
caggaaagaaaacgtacatat

SEQ ID NO: 9424446 - DNA, 21 bp, Homo sapiens
caggaaagaaaacgtacatat

SEQ ID NO: 9424447 - DNA, 22 bp, Homo sapiens
caggaaagaaatgagaacacca

SEQ ID NO: 9424448 - DNA, 22 bp, Homo sapiens
caggaaagaaatgagaacacca

SEQ ID NO: 9424449 - DNA, 22 bp, Homo sapiens
caggaaacatatgtgcttgagg

SEQ ID NO: 9424450 - DNA, 19 bp, Homo sapiens
caggaaacacctactgcta

SEQ ID NO: 9424451 - DNA, 22 bp, Homo sapiens
caggaaacaaagccttgctcat

SEQ ID NO: 9424452 - DNA, 22 bp, Homo sapiens
caggaaaatgtcaatggaaagc

SEQ ID NO: 9424453 - DNA, 21 bp, Homo sapiens
caggaaactgaggccatgggg

SEQ ID NO: 9424454 - DNA, 22 bp, Homo sapiens
caggaaacggctattcttttgt

SEQ ID NO: 9424455 - DNA, 22 bp, Homo sapiens
caggaaacggctattcttttgt

SEQ ID NO: 9424456 - DNA, 22 bp, Homo sapiens
caggaaaccgcatcccagtggg

SEQ ID NO: 9424457 - DNA, 22 bp, Homo sapiens
caggaaaccgcatcccagtggg

SEQ ID NO: 9424458 - DNA, 22 bp, Homo sapiens
caggaaacattcccataacaca

SEQ ID NO: 9424459 - DNA, 22 bp, Homo sapiens
caggaaacattcccataacaca

SEQ ID NO: 9424460 - DNA, 22 bp, Homo sapiens
caggaaacattcttggtaagga

SEQ ID NO: 9424461 - DNA, 22 bp, Homo sapiens
cagctgttgtgtatcaggcaga

SEQ ID NO: 9424462 - DNA, 22 bp, Homo sapiens
cagctgttgtgatccatttacg

SEQ ID NO: 9424463 - DNA, 22 bp, Homo sapiens
cagctgtttcagtagcgttact

SEQ ID NO: 9424464 - DNA, 22 bp, Homo sapiens
cagcttcatgacaaacagtttt

SEQ ID NO: 9424465 - DNA, 22 bp, Homo sapiens
gtgtgtctgaagttgagtagac

SEQ ID NO: 9424466 - DNA, 21 bp, Homo sapiens
gtgtgtctaatgtagtggaaa

SEQ ID NO: 9424467 - DNA, 22 bp, Homo sapiens
gtgtgtctttataagaagaggg

SEQ ID NO: 9424468 - DNA, 22 bp, Homo sapiens
gtgtgtctgaagttgagtagac

SEQ ID NO: 9424469 - DNA, 22 bp, Homo sapiens
gtgtgtcttgaccaggatcgga

SEQ ID NO: 9424470 - DNA, 22 bp, Homo sapiens
gtgtgtctcccaagaaggccca

SEQ ID NO: 9424471 - DNA, 22 bp, Homo sapiens
cagcttcccttggctgagcaga

SEQ ID NO: 9424472 - DNA, 22 bp, Homo sapiens
cagctgtggagggaggaaatgc

SEQ ID NO: 9424473 - DNA, 22 bp, Homo sapiens
cagctgtggctgccactgctcc

SEQ ID NO: 9424474 - DNA, 22 bp, Homo sapiens
cagctgtggctgccactgctcc

SEQ ID NO: 9424475 - DNA, 22 bp, Homo sapiens
cagctgtggctgccactgctcc

SEQ ID NO: 9424476 - DNA, 22 bp, Homo sapiens
cagctgtggggagcttgggcca

SEQ ID NO: 9424477 - DNA, 22 bp, Homo sapiens
cagctgtggggagcttgggcca

SEQ ID NO: 9424478 - DNA, 22 bp, Homo sapiens
cagctgtgggcctgacgtggca

SEQ ID NO: 9424479 - DNA, 22 bp, Homo sapiens
cagctgtgggcctgacgtggca

SEQ ID NO: 9424480 - DNA, 22 bp, Homo sapiens
cagctgtgggcctgacgtggca

SEQ ID NO: 9424481 - DNA, 22 bp, Homo sapiens
cagctgtgtagatgcagggtca

SEQ ID NO: 9424482 - DNA, 22 bp, Homo sapiens
cagctgtgtatgagagcatgct

SEQ ID NO: 9424483 - DNA, 22 bp, Homo sapiens
cagctgtgtatgagagcatgct

SEQ ID NO: 9424484 - DNA, 22 bp, Homo sapiens
cagctgtgtagatgcagggtca

SEQ ID NO: 9424485 - DNA, 22 bp, Homo sapiens
cagctgtgtagatgcagggtca

SEQ ID NO: 9424486 - DNA, 22 bp, Homo sapiens
cagctgtgtagatgcagggtca

SEQ ID NO: 9424487 - DNA, 22 bp, Homo sapiens
cagctgtgtagatgcagggtca

SEQ ID NO: 9424488 - DNA, 22 bp, Homo sapiens
cagctgtggggagcttgggcca

SEQ ID NO: 9424489 - DNA, 22 bp, Homo sapiens
cagctgtgtaaacacatgtgta

SEQ ID NO: 9424490 - DNA, 22 bp, Homo sapiens
cagctgtgtaaacacatgtgta

SEQ ID NO: 9424491 - DNA, 22 bp, Homo sapiens
cagctgtgtaaacacatgtgta

SEQ ID NO: 9424492 - DNA, 22 bp, Homo sapiens
cagctgtgatatgcctgcctga

SEQ ID NO: 9424493 - DNA, 22 bp, Homo sapiens
cagctgtgatatgcctgcctga

SEQ ID NO: 9424494 - DNA, 22 bp, Homo sapiens
cagctgtgatatgcctgcctga

SEQ ID NO: 9424495 - DNA, 22 bp, Homo sapiens
cagctgtgattcctgctgtcca

SEQ ID NO: 9424496 - DNA, 22 bp, Homo sapiens
cagctgtgattcctgctgtcca

SEQ ID NO: 9424497 - DNA, 22 bp, Homo sapiens
cagctgtgctagaagccacgaa

SEQ ID NO: 9424498 - DNA, 22 bp, Homo sapiens
cagctgtgctagaagccacgaa

SEQ ID NO: 9424499 - DNA, 22 bp, Homo sapiens
cagctgtgctagaagccacgaa

SEQ ID NO: 9424500 - DNA, 18 bp, Homo sapiens
cagctgtgccctgtttgg

SEQ ID NO: 9424501 - DNA, 22 bp, Homo sapiens
cagctgtgattcctgctgtcca

SEQ ID NO: 9424502 - DNA, 22 bp, Homo sapiens
cagctgtgattcctgctgtcca

SEQ ID NO: 9424503 - DNA, 22 bp, Homo sapiens
cagctgtggagggaggaaatgc

SEQ ID NO: 9424504 - DNA, 22 bp, Homo sapiens
cagctgtggagggaggaaatgc

SEQ ID NO: 9424505 - DNA, 22 bp, Homo sapiens
cagctgtggagggaggaaatgc

SEQ ID NO: 9424506 - DNA, 22 bp, Homo sapiens
cagctgtggagatggggtgcat

SEQ ID NO: 9424507 - DNA, 22 bp, Homo sapiens
cagctgtggagatggggtgcat

SEQ ID NO: 9424508 - DNA, 22 bp, Homo sapiens
cagctgtgctgattgctcagta

SEQ ID NO: 9424509 - DNA, 22 bp, Homo sapiens
cagctgtgctgattgctcagta

SEQ ID NO: 9424510 - DNA, 22 bp, Homo sapiens
cagctgtgctgattgctcagta

SEQ ID NO: 9424511 - DNA, 22 bp, Homo sapiens
cagctgtgctgtattaagctct

SEQ ID NO: 9424512 - DNA, 22 bp, Homo sapiens
cagctgtgctgattgctcagta

SEQ ID NO: 9424513 - DNA, 22 bp, Homo sapiens
cagctgtgctgattgctcagta

SEQ ID NO: 9424514 - DNA, 22 bp, Homo sapiens
cagctgtgctgattgctcagta

SEQ ID NO: 9424515 - DNA, 22 bp, Homo sapiens
gttaaacattgctccacgggtt

SEQ ID NO: 9424516 - DNA, 22 bp, Homo sapiens
gttaaacagttacatgtgctgg

SEQ ID NO: 9424517 - DNA, 22 bp, Homo sapiens
gttacaaatgccaaagctgaga

SEQ ID NO: 9424518 - DNA, 22 bp, Homo sapiens
gttaaagtgagctactttaggt

SEQ ID NO: 9424519 - DNA, 22 bp, Homo sapiens
gttaaagtgagctactttaggt

SEQ ID NO: 9424520 - DNA, 22 bp, Homo sapiens
gttaaagtgatcttgtcaggtt

SEQ ID NO: 9424521 - DNA, 22 bp, Homo sapiens
gttaaacaataactggcacaca

SEQ ID NO: 9424522 - DNA, 22 bp, Homo sapiens
gttaaacaagctggacactgaa

SEQ ID NO: 9424523 - DNA, 22 bp, Homo sapiens
gttacaagtgttcgagagtgac

SEQ ID NO: 9424524 - DNA, 22 bp, Homo sapiens
gttacaagtgagatttaggaga

SEQ ID NO: 9424525 - DNA, 22 bp, Homo sapiens
gttacaaatgtaaattctgggg

SEQ ID NO: 9424526 - DNA, 22 bp, Homo sapiens
gttacaaatgtaaattctgggg

SEQ ID NO: 9424527 - DNA, 22 bp, Homo sapiens
gttacaaatgtaaattctgggg

SEQ ID NO: 9424528 - DNA, 22 bp, Homo sapiens
gttacaaatgtaaattctgggg

SEQ ID NO: 9424529 - DNA, 22 bp, Homo sapiens
gttacaaatgtaaattctgggg

SEQ ID NO: 9424530 - DNA, 22 bp, Homo sapiens
gttacaaatgtaaattctgggg

SEQ ID NO: 9424531 - DNA, 22 bp, Homo sapiens
gttacaaatgtaaattctgggg

SEQ ID NO: 9424532 - DNA, 22 bp, Homo sapiens
gttacaaatgccaaagctgaga

SEQ ID NO: 9424533 - DNA, 22 bp, Homo sapiens
gttacaaatgccaaagctgaga

SEQ ID NO: 9424534 - DNA, 22 bp, Homo sapiens
gttacaaatgccaaagctgaga

SEQ ID NO: 9424535 - DNA, 22 bp, Homo sapiens
gttacaaatgccaaagctgaga

SEQ ID NO: 9424536 - DNA, 22 bp, Homo sapiens
gttacaaatgccaaagctgaga

SEQ ID NO: 9424537 - DNA, 22 bp, Homo sapiens
gttacacaggaaaacattagca

SEQ ID NO: 9424538 - DNA, 22 bp, Homo sapiens
gttacaatgtccttacatgaaa

SEQ ID NO: 9424539 - DNA, 22 bp, Homo sapiens
gtgtttgtttagtgcagagaga

SEQ ID NO: 9424540 - DNA, 22 bp, Homo sapiens
gtgtttggtcagacgtccgggg

SEQ ID NO: 9424541 - DNA, 22 bp, Homo sapiens
gtgtgtgtactctgtatataaa

SEQ ID NO: 9424542 - DNA, 22 bp, Homo sapiens
gtgtgtgtatatatacacacac

SEQ ID NO: 9424543 - DNA, 22 bp, Homo sapiens
gtgtgtgtatatatacacacac

SEQ ID NO: 9424544 - DNA, 22 bp, Homo sapiens
gtgtgtgtatatatacacacac

SEQ ID NO: 9424545 - DNA, 22 bp, Homo sapiens
gtgtgtgtatatatacacacac

SEQ ID NO: 9424546 - DNA, 22 bp, Homo sapiens
gtgtgtgccaactttatgtgca

SEQ ID NO: 9424547 - DNA, 22 bp, Homo sapiens
gtgtgtgccatcaagagctttc

SEQ ID NO: 9424548 - DNA, 20 bp, Homo sapiens
gtgtgtgctccatgcatgct

SEQ ID NO: 9424549 - DNA, 22 bp, Homo sapiens
gtgtgtgctccccaggagagct

SEQ ID NO: 9424550 - DNA, 22 bp, Homo sapiens
gtgtgtctttataagaagaggg

SEQ ID NO: 9424551 - DNA, 22 bp, Homo sapiens
gtgtgtctttcatttcatgagg

SEQ ID NO: 9424552 - DNA, 22 bp, Homo sapiens
gtgtgtgcaagaggtttattga

SEQ ID NO: 9424553 - DNA, 22 bp, Homo sapiens
gtgtgtgccaactttatgtgca

SEQ ID NO: 9424554 - DNA, 22 bp, Homo sapiens
gtgtgtgtactctgtatataaa

SEQ ID NO: 9424555 - DNA, 22 bp, Homo sapiens
gtgtgtgtactctgtatataaa

SEQ ID NO: 9424556 - DNA, 22 bp, Homo sapiens
gtgtgtgtactctgtatataaa

SEQ ID NO: 9424557 - DNA, 22 bp, Homo sapiens
gtgtgtgctccccaggagagct

SEQ ID NO: 9424558 - DNA, 23 bp, Homo sapiens
gtgtgtggaaagtgcatgggcct

SEQ ID NO: 9424559 - DNA, 22 bp, Homo sapiens
gttggccattaattggaggaca

SEQ ID NO: 9424560 - DNA, 22 bp, Homo sapiens
gttgggaagcagatggatgagc

SEQ ID NO: 9424561 - DNA, 22 bp, Homo sapiens
gttggctttgctctctgtccta

SEQ ID NO: 9424562 - DNA, 22 bp, Homo sapiens
gttggctcattttatagacagc

SEQ ID NO: 9424563 - DNA, 22 bp, Homo sapiens
gttggcagaaagctttcgatcg

SEQ ID NO: 9424564 - DNA, 22 bp, Homo sapiens
gttggagtgcagcttgtgcgat

SEQ ID NO: 9424565 - DNA, 22 bp, Homo sapiens
gttggagtgcagcttgtgcgat

SEQ ID NO: 9424566 - DNA, 22 bp, Homo sapiens
caggaaagggatgggctgccac

SEQ ID NO: 9424567 - DNA, 22 bp, Homo sapiens
caggaaagggatgggctgccac

SEQ ID NO: 9424568 - DNA, 22 bp, Homo sapiens
caggaaaggtagtcacaatgta

SEQ ID NO: 9424569 - DNA, 22 bp, Homo sapiens
caggaaaggtagtcacaatgta

SEQ ID NO: 9424570 - DNA, 22 bp, Homo sapiens
caggaaagggatgggctgccac

SEQ ID NO: 9424571 - DNA, 22 bp, Homo sapiens
caggaaagggatgggctgccac

SEQ ID NO: 9424572 - DNA, 22 bp, Homo sapiens
caggaaagccgagtgccatagg

SEQ ID NO: 9424573 - DNA, 22 bp, Homo sapiens
caggaaagccgagtgccatagg

SEQ ID NO: 9424574 - DNA, 22 bp, Homo sapiens
caggaaagggatgggctgccac

SEQ ID NO: 9424575 - DNA, 22 bp, Homo sapiens
caggaaagccgagtgccatagg

SEQ ID NO: 9424576 - DNA, 22 bp, Homo sapiens
caggaaaggtagtcacaatgta

SEQ ID NO: 9424577 - DNA, 22 bp, Homo sapiens
caggaaaggtagtcacaatgta

SEQ ID NO: 9424578 - DNA, 22 bp, Homo sapiens
caggaaaggtgtgtcatgatgg

SEQ ID NO: 9424579 - DNA, 22 bp, Homo sapiens
caggaaaggtgtgtcatgatgg

SEQ ID NO: 9424580 - DNA, 22 bp, Homo sapiens
caggaaaggtgtgtcatgatgg

SEQ ID NO: 9424581 - DNA, 22 bp, Homo sapiens
caggaaagtctgtaaaggaacc

SEQ ID NO: 9424582 - DNA, 22 bp, Homo sapiens
caggaaagtctgtaaaggaacc

SEQ ID NO: 9424583 - DNA, 22 bp, Homo sapiens
caggaaaggtgtgtcatgatgg

SEQ ID NO: 9424584 - DNA, 22 bp, Homo sapiens
caggaaatggggtttagttatt

SEQ ID NO: 9424585 - DNA, 22 bp, Homo sapiens
caggaaatgggtcgttttataa

SEQ ID NO: 9424586 - DNA, 22 bp, Homo sapiens
caggaaatgggtcgttttataa

SEQ ID NO: 9424587 - DNA, 22 bp, Homo sapiens
caggaaatgggtcgttttataa

SEQ ID NO: 9424588 - DNA, 22 bp, Homo sapiens
caggaaatgtataattttataa

SEQ ID NO: 9424589 - DNA, 22 bp, Homo sapiens
caggaaatgtataattttataa

SEQ ID NO: 9424590 - DNA, 22 bp, Homo sapiens
caggaaattcccagaaggactg

SEQ ID NO: 9424591 - DNA, 22 bp, Homo sapiens
caggaaattcttttgtttgtgc

SEQ ID NO: 9424592 - DNA, 22 bp, Homo sapiens
caggaaattcaagagaggctgc

SEQ ID NO: 9424593 - DNA, 23 bp, Homo sapiens
caggaaatgttcttgaagcctga

SEQ ID NO: 9424594 - DNA, 23 bp, Homo sapiens
caggaaatgttcttgaagcctga

SEQ ID NO: 9424595 - DNA, 22 bp, Homo sapiens
caggaaattagtctctctgttg

SEQ ID NO: 9424596 - DNA, 22 bp, Homo sapiens
caggaaataaaaagtatcttct

SEQ ID NO: 9424597 - DNA, 22 bp, Homo sapiens
caggaaataaaaagtatcttct

SEQ ID NO: 9424598 - DNA, 22 bp, Homo sapiens
caggaaataaatggtaatgcat

SEQ ID NO: 9424599 - DNA, 22 bp, Homo sapiens
caggaaatagacactgtatgat

SEQ ID NO: 9424600 - DNA, 22 bp, Homo sapiens
caggaaataggcgtttgtcctc

SEQ ID NO: 9424601 - DNA, 22 bp, Homo sapiens
caggaaataggcgtttgtcctc

SEQ ID NO: 9424602 - DNA, 22 bp, Homo sapiens
caggaaatagttcagtcaaact

SEQ ID NO: 9424603 - DNA, 22 bp, Homo sapiens
caggaaataggcgtttgtcctc

SEQ ID NO: 9424604 - DNA, 22 bp, Homo sapiens
caggaaatagttcagtcaaact

SEQ ID NO: 9424605 - DNA, 22 bp, Homo sapiens
caggaaatggggtttagttatt

SEQ ID NO: 9424606 - DNA, 22 bp, Homo sapiens
caggaaatggctgaataaattc

SEQ ID NO: 9424607 - DNA, 22 bp, Homo sapiens
caggaaatggctgaataaattc

SEQ ID NO: 9424608 - DNA, 22 bp, Homo sapiens
caggaacaatatctgtcctggt

SEQ ID NO: 9424609 - DNA, 22 bp, Homo sapiens
caggaacaaggcctatgggact

SEQ ID NO: 9424610 - DNA, 22 bp, Homo sapiens
caggaacaatacctcttgccag

SEQ ID NO: 9424611 - DNA, 22 bp, Homo sapiens
caggaacaatgtaagtctcatt

SEQ ID NO: 9424612 - DNA, 22 bp, Homo sapiens
caggaacaatcttactactatt

SEQ ID NO: 9424613 - DNA, 22 bp, Homo sapiens
caggaacaatcttactactatt

SEQ ID NO: 9424614 - DNA, 22 bp, Homo sapiens
caggaacaaggcctatgggact

SEQ ID NO: 9424615 - DNA, 22 bp, Homo sapiens
caggaacaactcccagcatctc

SEQ ID NO: 9424616 - DNA, 22 bp, Homo sapiens
caggaacaactcccagcatctc

SEQ ID NO: 9424617 - DNA, 22 bp, Homo sapiens
caggaaattttgtgatctgttc

SEQ ID NO: 9424618 - DNA, 22 bp, Homo sapiens
caggaaattttgtgatctgttc

SEQ ID NO: 9424619 - DNA, 22 bp, Homo sapiens
caggaaatttatgttctactta

SEQ ID NO: 9424620 - DNA, 22 bp, Homo sapiens
caggaaattttgtgatctgttc

SEQ ID NO: 9424621 - DNA, 22 bp, Homo sapiens
caggaaattgcaacagtctgag

SEQ ID NO: 9424622 - DNA, 22 bp, Homo sapiens
caggaaattgcaacagtctgag

SEQ ID NO: 9424623 - DNA, 22 bp, Homo sapiens
caggaaattgcaacagtctgag

SEQ ID NO: 9424624 - DNA, 22 bp, Homo sapiens
caggaaattctttttaacagaa

SEQ ID NO: 9424625 - DNA, 22 bp, Homo sapiens
caggaaattcttttgtttgtgc

SEQ ID NO: 9424626 - DNA, 22 bp, Homo sapiens
caggaaattcttttgtttgtgc

SEQ ID NO: 9424627 - DNA, 22 bp, Homo sapiens
caggaaattggctatttgggat

SEQ ID NO: 9424628 - DNA, 22 bp, Homo sapiens
caggaaattggctatttgggat

SEQ ID NO: 9424629 - DNA, 22 bp, Homo sapiens
caggaaatttaagagtgtacaa

SEQ ID NO: 9424630 - DNA, 22 bp, Homo sapiens
caggaaatttatgttctactta

SEQ ID NO: 9424631 - DNA, 22 bp, Homo sapiens
caggaaatttatgttctactta

SEQ ID NO: 9424632 - DNA, 22 bp, Homo sapiens
caggaaatttaagagtgtacaa

SEQ ID NO: 9424633 - DNA, 22 bp, Homo sapiens
gttcacagtgttttctttgcat

SEQ ID NO: 9424634 - DNA, 22 bp, Homo sapiens
gttcacagtgttttctttgcat

SEQ ID NO: 9424635 - DNA, 22 bp, Homo sapiens
gttcccaggccctgggctctcc

SEQ ID NO: 9424636 - DNA, 22 bp, Homo sapiens
gttcccaggccctgggctctcc

SEQ ID NO: 9424637 - DNA, 22 bp, Homo sapiens
gttcccatgcctccaagcttca

SEQ ID NO: 9424638 - DNA, 22 bp, Homo sapiens
gttcccatgcctccaagcttca

SEQ ID NO: 9424639 - DNA, 22 bp, Homo sapiens
gttcccattgccctagcttgta

SEQ ID NO: 9424640 - DNA, 22 bp, Homo sapiens
gttcccattgccctagcttgta

SEQ ID NO: 9424641 - DNA, 22 bp, Homo sapiens
gttctgggaaggtggacctgtt

SEQ ID NO: 9424642 - DNA, 22 bp, Homo sapiens
gttcctgcaagtaagtggctga

SEQ ID NO: 9424643 - DNA, 22 bp, Homo sapiens
gttcctgaagggactggtgcag

SEQ ID NO: 9424644 - DNA, 22 bp, Homo sapiens
gttcctgaagggactggtgcag

SEQ ID NO: 9424645 - DNA, 22 bp, Homo sapiens
gttcccttctcatggggtccag

SEQ ID NO: 9424646 - DNA, 21 bp, Homo sapiens
gttcccttattggggcaggca

SEQ ID NO: 9424647 - DNA, 22 bp, Homo sapiens
gttccctttcgtatggactggg

SEQ ID NO: 9424648 - DNA, 22 bp, Homo sapiens
gttcctaaccagcagagaaaca

SEQ ID NO: 9424649 - DNA, 22 bp, Homo sapiens
gttctgtagtcatagagcaatt

SEQ ID NO: 9424650 - DNA, 22 bp, Homo sapiens
gttctgtcctcactgcaggcct

SEQ ID NO: 9424651 - DNA, 22 bp, Homo sapiens
gttctgggaaggtggacctgtt

SEQ ID NO: 9424652 - DNA, 22 bp, Homo sapiens
gttctgtcctcctaccaggcat

SEQ ID NO: 9424653 - DNA, 22 bp, Homo sapiens
gttctgtctgagcaccacagga

SEQ ID NO: 9424654 - DNA, 22 bp, Homo sapiens
gttcttaagaccacaataaaaa

SEQ ID NO: 9424655 - DNA, 22 bp, Homo sapiens
gttcttaaccttctttggttgt

SEQ ID NO: 9424656 - DNA, 22 bp, Homo sapiens
gttcttcagaggggaaagaacc

SEQ ID NO: 9424657 - DNA, 22 bp, Homo sapiens
gttgctgattaacactttgagt

SEQ ID NO: 9424658 - DNA, 22 bp, Homo sapiens
gttgctggaagctatggtccag

SEQ ID NO: 9424659 - DNA, 22 bp, Homo sapiens
gttgctgggagcagggatcctg

SEQ ID NO: 9424660 - DNA, 22 bp, Homo sapiens
gttgcttctcttaagtccagct

SEQ ID NO: 9424661 - DNA, 22 bp, Homo sapiens
gttgcttttctccatcacatgg

SEQ ID NO: 9424662 - DNA, 22 bp, Homo sapiens
gttgcttttctccatcacatgg

SEQ ID NO: 9424663 - DNA, 20 bp, Homo sapiens
gttgctttagtctggtttgg

SEQ ID NO: 9424664 - DNA, 22 bp, Homo sapiens
caggaagaggacaggcttcccc

SEQ ID NO: 9424665 - DNA, 22 bp, Homo sapiens
caggaagaggacaggcttcccc

SEQ ID NO: 9424666 - DNA, 22 bp, Homo sapiens
caggaagaggacaggcttcccc

SEQ ID NO: 9424667 - DNA, 22 bp, Homo sapiens
caggaagaggacaggcttcccc

SEQ ID NO: 9424668 - DNA, 22 bp, Homo sapiens
caggaagagaacatggaggctg

SEQ ID NO: 9424669 - DNA, 22 bp, Homo sapiens
caggaagaggtatcaccgagca

SEQ ID NO: 9424670 - DNA, 22 bp, Homo sapiens
caggaagaggacaggcttcccc

SEQ ID NO: 9424671 - DNA, 22 bp, Homo sapiens
caggaagaggtatcaccgagca

SEQ ID NO: 9424672 - DNA, 22 bp, Homo sapiens
caggaagaggtatcaccgagca

SEQ ID NO: 9424673 - DNA, 22 bp, Homo sapiens
caggaacatttaaccacagggt

SEQ ID NO: 9424674 - DNA, 22 bp, Homo sapiens
caggaacattgtagaattgaaa

SEQ ID NO: 9424675 - DNA, 22 bp, Homo sapiens
caggaacattgtagaattgaaa

SEQ ID NO: 9424676 - DNA, 21 bp, Homo sapiens
caggaacattctttacattta

SEQ ID NO: 9424677 - DNA, 22 bp, Homo sapiens
caggaacatgttggaaagaaat

SEQ ID NO: 9424678 - DNA, 22 bp, Homo sapiens
caggaacattgtagaattgaaa

SEQ ID NO: 9424679 - DNA, 21 bp, Homo sapiens
caggaacattctttacattta

SEQ ID NO: 9424680 - DNA, 19 bp, Homo sapiens
caggaacatggagggaggg

SEQ ID NO: 9424681 - DNA, 22 bp, Homo sapiens
caggaacatgtctccaattaga

SEQ ID NO: 9424682 - DNA, 22 bp, Homo sapiens
caggaacatgtctccaattaga

SEQ ID NO: 9424683 - DNA, 22 bp, Homo sapiens
caggaacatgttggaaagaaat

SEQ ID NO: 9424684 - DNA, 22 bp, Homo sapiens
caggaacatgtctccaattaga

SEQ ID NO: 9424685 - DNA, 22 bp, Homo sapiens
caggaacatgttggaaagaaat

SEQ ID NO: 9424686 - DNA, 22 bp, Homo sapiens
caggaacatgttggaaagaaat

SEQ ID NO: 9424687 - DNA, 22 bp, Homo sapiens
caggaacagctgacctgacaat

SEQ ID NO: 9424688 - DNA, 22 bp, Homo sapiens
caggaacagctgacctgacaat

SEQ ID NO: 9424689 - DNA, 22 bp, Homo sapiens
caggaacagagtggcattgtct

SEQ ID NO: 9424690 - DNA, 22 bp, Homo sapiens
caggaacagcaccaggagctag

SEQ ID NO: 9424691 - DNA, 22 bp, Homo sapiens
caggaacaggctgatgggcagg

SEQ ID NO: 9424692 - DNA, 22 bp, Homo sapiens
caggaacaggggagtgaacctg

SEQ ID NO: 9424693 - DNA, 22 bp, Homo sapiens
caggaacaggctgatgggcagg

SEQ ID NO: 9424694 - DNA, 22 bp, Homo sapiens
caggaacagggtgtcctggcag

SEQ ID NO: 9424695 - DNA, 19 bp, Homo sapiens
caggaacatggagggaggg

SEQ ID NO: 9424696 - DNA, 22 bp, Homo sapiens
caggaacaggggagtgaacctg

SEQ ID NO: 9424697 - DNA, 22 bp, Homo sapiens
caggaacacaatgagtctcaaa

SEQ ID NO: 9424698 - DNA, 22 bp, Homo sapiens
caggaacacaagttcagggatg

SEQ ID NO: 9424699 - DNA, 22 bp, Homo sapiens
caggaacacaagttcagggatg

SEQ ID NO: 9424700 - DNA, 22 bp, Homo sapiens
caggaacacaagttcagggatg

SEQ ID NO: 9424701 - DNA, 22 bp, Homo sapiens
caggaacaatgtaagtctcatt

SEQ ID NO: 9424702 - DNA, 22 bp, Homo sapiens
caggaacagagtggcattgtct

SEQ ID NO: 9424703 - DNA, 22 bp, Homo sapiens
caggaacacctgcagctagtgg

SEQ ID NO: 9424704 - DNA, 22 bp, Homo sapiens
caggaacagagtggcattgtct

SEQ ID NO: 9424705 - DNA, 22 bp, Homo sapiens
caggaacacctgcagctagtgg

SEQ ID NO: 9424706 - DNA, 22 bp, Homo sapiens
caggaacacaatgagtctcaaa

SEQ ID NO: 9424707 - DNA, 22 bp, Homo sapiens
caggaagattgtggaggtggtt

SEQ ID NO: 9424708 - DNA, 22 bp, Homo sapiens
caggaagattgtggaggtggtt

SEQ ID NO: 9424709 - DNA, 22 bp, Homo sapiens
caggaagattgtggaggtggtt

SEQ ID NO: 9424710 - DNA, 22 bp, Homo sapiens
caggaagcaccagcccggcccc

SEQ ID NO: 9424711 - DNA, 22 bp, Homo sapiens
caggaagcacagtgaggagacc

SEQ ID NO: 9424712 - DNA, 22 bp, Homo sapiens
caggaagattgtggaggtggtt

SEQ ID NO: 9424713 - DNA, 22 bp, Homo sapiens
caggaagcaagtgattttcttg

SEQ ID NO: 9424714 - DNA, 22 bp, Homo sapiens
caggaagattagaccaagagct

SEQ ID NO: 9424715 - DNA, 22 bp, Homo sapiens
caggaagattagaccaagagct

SEQ ID NO: 9424716 - DNA, 22 bp, Homo sapiens
caggaagattagaccaagagct

SEQ ID NO: 9424717 - DNA, 22 bp, Homo sapiens
caggaagattgtggaggtggtt

SEQ ID NO: 9424718 - DNA, 22 bp, Homo sapiens
caggaagattagaccaagagct

SEQ ID NO: 9424719 - DNA, 22 bp, Homo sapiens
caggaagattagaccaagagct

SEQ ID NO: 9424720 - DNA, 22 bp, Homo sapiens
caggaagattagaccaagagct

SEQ ID NO: 9424721 - DNA, 22 bp, Homo sapiens
caggaagaggtggggctaaagt

SEQ ID NO: 9424722 - DNA, 22 bp, Homo sapiens
caggaagaggtatcaccgagca

SEQ ID NO: 9424723 - DNA, 22 bp, Homo sapiens
caggaagaggtggggctaaagt

SEQ ID NO: 9424724 - DNA, 21 bp, Homo sapiens
gtttacaaggctttgctcctg

SEQ ID NO: 9424725 - DNA, 22 bp, Homo sapiens
gtttacacataactcctatcaa

SEQ ID NO: 9424726 - DNA, 22 bp, Homo sapiens
gtttacaacatgccaactgggc

SEQ ID NO: 9424727 - DNA, 22 bp, Homo sapiens
gtttacaacatgccaactgggc

SEQ ID NO: 9424728 - DNA, 22 bp, Homo sapiens
gtttacaacatcttgtccttca

SEQ ID NO: 9424729 - DNA, 22 bp, Homo sapiens
gtttacaaatattttaaatggt

SEQ ID NO: 9424730 - DNA, 18 bp, Homo sapiens
gtttacacattctagaaa

SEQ ID NO: 9424731 - DNA, 22 bp, Homo sapiens
gtttacatgcagaaaatcaatg

SEQ ID NO: 9424732 - DNA, 22 bp, Homo sapiens
gtttacatgcagaaaatcaatg

SEQ ID NO: 9424733 - DNA, 22 bp, Homo sapiens
gtttcctctgctggttttcatt

SEQ ID NO: 9424734 - DNA, 22 bp, Homo sapiens
gtttcctgaccctggcccagca

SEQ ID NO: 9424735 - DNA, 22 bp, Homo sapiens
gtttcctgatgtgggagatctt

SEQ ID NO: 9424736 - DNA, 22 bp, Homo sapiens
gtttcctttctattgccttgat

SEQ ID NO: 9424737 - DNA, 22 bp, Homo sapiens
gtttcctttaatagtgatattg

SEQ ID NO: 9424738 - DNA, 22 bp, Homo sapiens
gtttcctttaatagtgatattg

SEQ ID NO: 9424739 - DNA, 22 bp, Homo sapiens
gtttgcttttttgaatcaggag

SEQ ID NO: 9424740 - DNA, 22 bp, Homo sapiens
gtttgccttttagataggaatg

SEQ ID NO: 9424741 - DNA, 22 bp, Homo sapiens
gtttgcctgtgatgtacatttc

SEQ ID NO: 9424742 - DNA, 22 bp, Homo sapiens
gtttgcctgccgacgctctcat

SEQ ID NO: 9424743 - DNA, 19 bp, Homo sapiens
gtttccttgggtgtaggga

SEQ ID NO: 9424744 - DNA, 22 bp, Homo sapiens
gtttattgggtattgtggagcc

SEQ ID NO: 9424745 - DNA, 22 bp, Homo sapiens
gtttattgggtattgtggagcc

SEQ ID NO: 9424746 - DNA, 22 bp, Homo sapiens
gtttattgggtattgtggagcc

SEQ ID NO: 9424747 - DNA, 22 bp, Homo sapiens
gtttcaaaagtcaggctattct

SEQ ID NO: 9424748 - DNA, 22 bp, Homo sapiens
gtttcaaaagtcaggctattct

SEQ ID NO: 9424749 - DNA, 22 bp, Homo sapiens
gtttcaaaatgatgctgtaact

SEQ ID NO: 9424750 - DNA, 22 bp, Homo sapiens
gtttcaaaatgatgctgtaact

SEQ ID NO: 9424751 - DNA, 22 bp, Homo sapiens
gtttattcttcagcaacatctg

SEQ ID NO: 9424752 - DNA, 22 bp, Homo sapiens
gtttattgataaaagctggaca

SEQ ID NO: 9424753 - DNA, 22 bp, Homo sapiens
gtttattgataaaagctggaca

SEQ ID NO: 9424754 - DNA, 22 bp, Homo sapiens
gtttattgataaaagctggaca

SEQ ID NO: 9424755 - DNA, 22 bp, Homo sapiens
gtttattgataaaagctggaca

SEQ ID NO: 9424756 - DNA, 22 bp, Homo sapiens
gtttattatacaacaaaagcta

SEQ ID NO: 9424757 - DNA, 22 bp, Homo sapiens
gtttattattcaacttcatgtt

SEQ ID NO: 9424758 - DNA, 22 bp, Homo sapiens
gtttattccagcaatctgctta

SEQ ID NO: 9424759 - DNA, 22 bp, Homo sapiens
gtttattattcaacttcatgtt

SEQ ID NO: 9424760 - DNA, 22 bp, Homo sapiens
gtttattattcaacttcatgtt

SEQ ID NO: 9424761 - DNA, 22 bp, Homo sapiens
gtttacatgtaatgtgttattg

SEQ ID NO: 9424762 - DNA, 22 bp, Homo sapiens
gtttacatgtaatgtgttattg

SEQ ID NO: 9424763 - DNA, 22 bp, Homo sapiens
gtttacatgtactcattatact

SEQ ID NO: 9424764 - DNA, 20 bp, Homo sapiens
ctgaagagactggaggggca

SEQ ID NO: 9424765 - DNA, 20 bp, Homo sapiens
ctgaagagactggaggggca

SEQ ID NO: 9424766 - DNA, 22 bp, Homo sapiens
ctgaagagatgtcaatattggc

SEQ ID NO: 9424767 - DNA, 22 bp, Homo sapiens
ctgaagagactggagggggcat

SEQ ID NO: 9424768 - DNA, 22 bp, Homo sapiens
ctgaagagaaagggagctcttc

SEQ ID NO: 9424769 - DNA, 20 bp, Homo sapiens
ctgaagagactggaggggca

SEQ ID NO: 9424770 - DNA, 22 bp, Homo sapiens
ctgaagaagtctctaggctatt

SEQ ID NO: 9424771 - DNA, 22 bp, Homo sapiens
ctgaagaatgacagtgctttga

SEQ ID NO: 9424772 - DNA, 22 bp, Homo sapiens
ctgaagactgctgagaagttac

SEQ ID NO: 9424773 - DNA, 22 bp, Homo sapiens
ctgaagaatgacagtgctttga

SEQ ID NO: 9424774 - DNA, 18 bp, Homo sapiens
ctgaagacaaaatgtcca

SEQ ID NO: 9424775 - DNA, 22 bp, Homo sapiens
ctgaacttctctgagcctcagt

SEQ ID NO: 9424776 - DNA, 22 bp, Homo sapiens
ctgaacttattgagtgcttgct

SEQ ID NO: 9424777 - DNA, 22 bp, Homo sapiens
ctgaacttattgagtgcttgct

SEQ ID NO: 9424778 - DNA, 19 bp, Homo sapiens
tttttaatgggctggagca

SEQ ID NO: 9424779 - DNA, 19 bp, Homo sapiens
tttttaatgggctggagca

SEQ ID NO: 9424780 - DNA, 22 bp, Homo sapiens
ctgaaagcaaagtaattcttaa

SEQ ID NO: 9424781 - DNA, 22 bp, Homo sapiens
ctgaaagcattaactccacttc

SEQ ID NO: 9424782 - DNA, 22 bp, Homo sapiens
ctgaaaggagagctgcaaggat

SEQ ID NO: 9424783 - DNA, 22 bp, Homo sapiens
ctgaaattctgcctctgcacaa

SEQ ID NO: 9424784 - DNA, 22 bp, Homo sapiens
ctgaacattcttgaacatctgt

SEQ ID NO: 9424785 - DNA, 22 bp, Homo sapiens
ctgaactatcctgcaactgcag

SEQ ID NO: 9424786 - DNA, 22 bp, Homo sapiens
ctgaacatcccgcagtgcacga

SEQ ID NO: 9424787 - DNA, 22 bp, Homo sapiens
ctgaacagtacttggccagttt

SEQ ID NO: 9424788 - DNA, 22 bp, Homo sapiens
ctgagaaggaagcctccactct

SEQ ID NO: 9424789 - DNA, 22 bp, Homo sapiens
ctgagaaggtgtggagatgggc

SEQ ID NO: 9424790 - DNA, 22 bp, Homo sapiens
ctgagaataaagccagcaggag

SEQ ID NO: 9424791 - DNA, 22 bp, Homo sapiens
ctgagaagcaaagaactgcact

SEQ ID NO: 9424792 - DNA, 22 bp, Homo sapiens
ctgagaagcactgtctgcaaga

SEQ ID NO: 9424793 - DNA, 22 bp, Homo sapiens
ctgagaaattctttctttcact

SEQ ID NO: 9424794 - DNA, 22 bp, Homo sapiens
ctgagaaatttattggttggaa

SEQ ID NO: 9424795 - DNA, 22 bp, Homo sapiens
ctgagaaagtgagggttaaaca

SEQ ID NO: 9424796 - DNA, 22 bp, Homo sapiens
ctgagaaagtttatgtttattt

SEQ ID NO: 9424797 - DNA, 22 bp, Homo sapiens
ctgagaaagtttatgtttattt

SEQ ID NO: 9424798 - DNA, 22 bp, Homo sapiens
ctgagaaatgcatttttccagc

SEQ ID NO: 9424799 - DNA, 22 bp, Homo sapiens
ctgagaaatacccaagtctggt

SEQ ID NO: 9424800 - DNA, 22 bp, Homo sapiens
ctgagaaatacccaagtctggt

SEQ ID NO: 9424801 - DNA, 22 bp, Homo sapiens
ctgagaaatgcatttttccagc

SEQ ID NO: 9424802 - DNA, 22 bp, Homo sapiens
ctgagaaattctttctttcact

SEQ ID NO: 9424803 - DNA, 22 bp, Homo sapiens
ctgagaaattctttctttcact

SEQ ID NO: 9424804 - DNA, 17 bp, Homo sapiens
ctgaagataatggcaac

SEQ ID NO: 9424805 - DNA, 17 bp, Homo sapiens
ctgaagataatggcaac

SEQ ID NO: 9424806 - DNA, 22 bp, Homo sapiens
ctgactgtctcttctcccatga

SEQ ID NO: 9424807 - DNA, 22 bp, Homo sapiens
ctgactgtctcttctcccatga

SEQ ID NO: 9424808 - DNA, 23 bp, Homo sapiens
ctgaagagccaacaaaaagcttg

SEQ ID NO: 9424809 - DNA, 22 bp, Homo sapiens
ctgaagaggacgcagcagcaag

SEQ ID NO: 9424810 - DNA, 22 bp, Homo sapiens
ctgaagaggactgggttggagg

SEQ ID NO: 9424811 - DNA, 22 bp, Homo sapiens
tttttaagagtctggaaatagt

SEQ ID NO: 9424812 - DNA, 22 bp, Homo sapiens
tttttaagagtctggaaatagt

SEQ ID NO: 9424813 - DNA, 22 bp, Homo sapiens
tttttaagctcctttgatgtca

SEQ ID NO: 9424814 - DNA, 22 bp, Homo sapiens
tttttaagctcctttgatgtca

SEQ ID NO: 9424815 - DNA, 22 bp, Homo sapiens
ttttgttttcttagaaacctgg

SEQ ID NO: 9424816 - DNA, 22 bp, Homo sapiens
tttttaacctaccttaagagca

SEQ ID NO: 9424817 - DNA, 22 bp, Homo sapiens
tttttaagagattctccagtct

SEQ ID NO: 9424818 - DNA, 19 bp, Homo sapiens
ctgaaaaacattctcagga

SEQ ID NO: 9424819 - DNA, 19 bp, Homo sapiens
ctgaaaaacattctcagga

SEQ ID NO: 9424820 - DNA, 22 bp, Homo sapiens
ttttgtttgtgtccactgcagt

SEQ ID NO: 9424821 - DNA, 19 bp, Homo sapiens
ctgaaaaacattctcagga

SEQ ID NO: 9424822 - DNA, 22 bp, Homo sapiens
ttttgttttcttagaaacctgg

SEQ ID NO: 9424823 - DNA, 22 bp, Homo sapiens
ttttgttttcttagaaacctgg

SEQ ID NO: 9424824 - DNA, 22 bp, Homo sapiens
ctctttttcagccttaccaaag

SEQ ID NO: 9424825 - DNA, 19 bp, Homo sapiens
ctgaaaaacattctcagga

SEQ ID NO: 9424826 - DNA, 22 bp, Homo sapiens
ctctttttcagccttaccaaag

SEQ ID NO: 9424827 - DNA, 19 bp, Homo sapiens
ctgaaaaacattctcagga

SEQ ID NO: 9424828 - DNA, 22 bp, Homo sapiens
ctctttttcacctctgtcagcg

SEQ ID NO: 9424829 - DNA, 22 bp, Homo sapiens
ctctttttcacctctgtcagcg

SEQ ID NO: 9424830 - DNA, 22 bp, Homo sapiens
ctctttttcagccttaccaaag

SEQ ID NO: 9424831 - DNA, 22 bp, Homo sapiens
ctctttttcagccttaccaaag

SEQ ID NO: 9424832 - DNA, 20 bp, Homo sapiens
ctcttttcactctcagtggt

SEQ ID NO: 9424833 - DNA, 17 bp, Homo sapiens
ctcttttgtcttcttcc

SEQ ID NO: 9424834 - DNA, 17 bp, Homo sapiens
ctcttttgtcttcttcc

SEQ ID NO: 9424835 - DNA, 22 bp, Homo sapiens
ctcttttcaaacctgtttatgg

SEQ ID NO: 9424836 - DNA, 22 bp, Homo sapiens
ctcttttcaaaatttcactgca

SEQ ID NO: 9424837 - DNA, 22 bp, Homo sapiens
ctctgggttcactgaggctctg

SEQ ID NO: 9424838 - DNA, 21 bp, Homo sapiens
ttttattgatgaatggccact

SEQ ID NO: 9424839 - DNA, 21 bp, Homo sapiens
ttttattgatgaatggccact

SEQ ID NO: 9424840 - DNA, 21 bp, Homo sapiens
ttttattgatgaatggccact

SEQ ID NO: 9424841 - DNA, 23 bp, Homo sapiens
ttttattgatatgtagctgttgt

SEQ ID NO: 9424842 - DNA, 23 bp, Homo sapiens
ttttattgatatgtagctgttgt

SEQ ID NO: 9424843 - DNA, 22 bp, Homo sapiens
ctctgggttttgtcagctgagg

SEQ ID NO: 9424844 - DNA, 22 bp, Homo sapiens
ctctggtcaagcaaagaggttt

SEQ ID NO: 9424845 - DNA, 22 bp, Homo sapiens
ctctgggttctggcctgcaccc

SEQ ID NO: 9424846 - DNA, 22 bp, Homo sapiens
ctctgggttcagccccggccct

SEQ ID NO: 9424847 - DNA, 22 bp, Homo sapiens
ctctgggttctggcctgcaccc

SEQ ID NO: 9424848 - DNA, 22 bp, Homo sapiens
ctctggtcatttggaagagcat

SEQ ID NO: 9424849 - DNA, 22 bp, Homo sapiens
ctctggtcatttggaagagcat

SEQ ID NO: 9424850 - DNA, 21 bp, Homo sapiens
ctctggtcctgtctggcaggc

SEQ ID NO: 9424851 - DNA, 21 bp, Homo sapiens
ctctggtcctgtctggcaggc

SEQ ID NO: 9424852 - DNA, 21 bp, Homo sapiens
ctctttgtggcaatgtatttt

SEQ ID NO: 9424853 - DNA, 22 bp, Homo sapiens
ctctttgtcactcatacagtca

SEQ ID NO: 9424854 - DNA, 22 bp, Homo sapiens
ctctttgtagcctttgcatatt

SEQ ID NO: 9424855 - DNA, 22 bp, Homo sapiens
ctctttggccagaaaatgtttt

SEQ ID NO: 9424856 - DNA, 22 bp, Homo sapiens
ctctttggcccccgatgattca

SEQ ID NO: 9424857 - DNA, 22 bp, Homo sapiens
ctctggttcaaagtagtataat

SEQ ID NO: 9424858 - DNA, 22 bp, Homo sapiens
ctctggttcagggctccctggc

SEQ ID NO: 9424859 - DNA, 22 bp, Homo sapiens
ctctggttcgtggtagatttta

SEQ ID NO: 9424860 - DNA, 22 bp, Homo sapiens
ctctggttcagggctccctggc

SEQ ID NO: 9424861 - DNA, 23 bp, Homo sapiens
ctctggttagatatcatatgctg

SEQ ID NO: 9424862 - DNA, 22 bp, Homo sapiens
ctctggtcctttatggtttcca

SEQ ID NO: 9424863 - DNA, 22 bp, Homo sapiens
ctctgggatagagcctcggtct

SEQ ID NO: 9424864 - DNA, 18 bp, Homo sapiens
ctctgggagaggcataca

SEQ ID NO: 9424865 - DNA, 18 bp, Homo sapiens
ctctgggagaggcataca

SEQ ID NO: 9424866 - DNA, 22 bp, Homo sapiens
ctctgggaggtgttactatctg

SEQ ID NO: 9424867 - DNA, 19 bp, Homo sapiens
ctctgggcaagtcacttaa

SEQ ID NO: 9424868 - DNA, 19 bp, Homo sapiens
ctctgggcaagtcacttaa

SEQ ID NO: 9424869 - DNA, 22 bp, Homo sapiens
ctctgggcaagtttcttcatga

SEQ ID NO: 9424870 - DNA, 22 bp, Homo sapiens
ctctgggcaagtttcttcatga

SEQ ID NO: 9424871 - DNA, 22 bp, Homo sapiens
ctctgggcaagtatgatagaaa

SEQ ID NO: 9424872 - DNA, 22 bp, Homo sapiens
ctctgggcaagtatgatagaaa

SEQ ID NO: 9424873 - DNA, 22 bp, Homo sapiens
ctctgggcaaagatgcctcatc

SEQ ID NO: 9424874 - DNA, 22 bp, Homo sapiens
ctctgggcaaagatgcctcatc

SEQ ID NO: 9424875 - DNA, 22 bp, Homo sapiens
ctctgggcaggaccagtggacc

SEQ ID NO: 9424876 - DNA, 22 bp, Homo sapiens
ctctgggcaggaccagtggacc

SEQ ID NO: 9424877 - DNA, 22 bp, Homo sapiens
ctctgggcaggaccagtggacc

SEQ ID NO: 9424878 - DNA, 22 bp, Homo sapiens
ctctgggcaggaccagtggacc

SEQ ID NO: 9424879 - DNA, 22 bp, Homo sapiens
ctctgggccaccgctggtgtat

SEQ ID NO: 9424880 - DNA, 22 bp, Homo sapiens
ctctgggcaggacgccaggcct

SEQ ID NO: 9424881 - DNA, 22 bp, Homo sapiens
ctctgggccaccgctggtgtat

SEQ ID NO: 9424882 - DNA, 22 bp, Homo sapiens
ctctgggcaggacgccaggcct

SEQ ID NO: 9424883 - DNA, 22 bp, Homo sapiens
ctctgggcaggacgccaggcct

SEQ ID NO: 9424884 - DNA, 22 bp, Homo sapiens
ctctgggcaggacgccaggcct

SEQ ID NO: 9424885 - DNA, 22 bp, Homo sapiens
ctctgggcacattttccaggac

SEQ ID NO: 9424886 - DNA, 22 bp, Homo sapiens
ctctgggcaccaaagagcagct

SEQ ID NO: 9424887 - DNA, 22 bp, Homo sapiens
ctctgggcaccaaagagcagct

SEQ ID NO: 9424888 - DNA, 22 bp, Homo sapiens
ctctgggcaccaaagagcagct

SEQ ID NO: 9424889 - DNA, 22 bp, Homo sapiens
ctctgggcaccaaagagcagct

SEQ ID NO: 9424890 - DNA, 17 bp, Homo sapiens
ctctgggcagcctgggg

SEQ ID NO: 9424891 - DNA, 17 bp, Homo sapiens
ctctgggcagcctgggg

SEQ ID NO: 9424892 - DNA, 22 bp, Homo sapiens
ctctgggcactgtatgggttct

SEQ ID NO: 9424893 - DNA, 22 bp, Homo sapiens
ttttattatctttgaatgggac

SEQ ID NO: 9424894 - DNA, 22 bp, Homo sapiens
ttttattatctttgaatgggac

SEQ ID NO: 9424895 - DNA, 22 bp, Homo sapiens
ttttattcaaatagttcacact

SEQ ID NO: 9424896 - DNA, 22 bp, Homo sapiens
ttttattcatagggatggagag

SEQ ID NO: 9424897 - DNA, 22 bp, Homo sapiens
ttttattctaagtatgatggga

SEQ ID NO: 9424898 - DNA, 23 bp, Homo sapiens
ttttattgatatgtagctgttgt

SEQ ID NO: 9424899 - DNA, 23 bp, Homo sapiens
ttttattgatatgtagctgttgt

SEQ ID NO: 9424900 - DNA, 23 bp, Homo sapiens
ttttattgatatgtagctgttgt

SEQ ID NO: 9424901 - DNA, 22 bp, Homo sapiens
ttttattctcagctccagagag

SEQ ID NO: 9424902 - DNA, 22 bp, Homo sapiens
ttttattctcagctccagagag

SEQ ID NO: 9424903 - DNA, 22 bp, Homo sapiens
ttttattctcaagacaatggga

SEQ ID NO: 9424904 - DNA, 22 bp, Homo sapiens
ttttattctcaagacaatggga

SEQ ID NO: 9424905 - DNA, 22 bp, Homo sapiens
ttttagttgtactgtcaacagt

SEQ ID NO: 9424906 - DNA, 22 bp, Homo sapiens
ttttattatctttgaatgggac

SEQ ID NO: 9424907 - DNA, 22 bp, Homo sapiens
ttttagttgtactgtcaacagt

SEQ ID NO: 9424908 - DNA, 22 bp, Homo sapiens
ttttagttactgcagtagcaaa

SEQ ID NO: 9424909 - DNA, 22 bp, Homo sapiens
ctctgggctccttcagcccttt

SEQ ID NO: 9424910 - DNA, 22 bp, Homo sapiens
ctctgggctccttcagcccttt

SEQ ID NO: 9424911 - DNA, 22 bp, Homo sapiens
ctctgggctccttcagcccttt

SEQ ID NO: 9424912 - DNA, 22 bp, Homo sapiens
ttttagttactgcagtagcaaa

SEQ ID NO: 9424913 - DNA, 22 bp, Homo sapiens
ctctgggctgaatggctgaacc

SEQ ID NO: 9424914 - DNA, 22 bp, Homo sapiens
ctctgggctgaatggctgaacc

SEQ ID NO: 9424915 - DNA, 22 bp, Homo sapiens
ctctgggcggcccaggccaacc

SEQ ID NO: 9424916 - DNA, 23 bp, Homo sapiens
ctctgggcgggcaggtcagcctc

SEQ ID NO: 9424917 - DNA, 22 bp, Homo sapiens
ctctgggctccttcagcccttt

SEQ ID NO: 9424918 - DNA, 23 bp, Homo sapiens
ctctgggcgggcaggtcagcctc

SEQ ID NO: 9424919 - DNA, 23 bp, Homo sapiens
ctctgggcgggcaggtcagcctc

SEQ ID NO: 9424920 - DNA, 22 bp, Homo sapiens
ctctgggccatgctactgctct

SEQ ID NO: 9424921 - DNA, 22 bp, Homo sapiens
ctctgggccatgctactgctct

SEQ ID NO: 9424922 - DNA, 22 bp, Homo sapiens
ctctgggccatgctactgctct

SEQ ID NO: 9424923 - DNA, 21 bp, Homo sapiens
ctctgggccattttcttccac

SEQ ID NO: 9424924 - DNA, 21 bp, Homo sapiens
ctctgggccattttcttccac

SEQ ID NO: 9424925 - DNA, 21 bp, Homo sapiens
ctctgggccattttcttccac

SEQ ID NO: 9424926 - DNA, 22 bp, Homo sapiens
ctctgggcggcccaggccaacc

SEQ ID NO: 9424927 - DNA, 22 bp, Homo sapiens
ctctgggcccacttaaatctgg

SEQ ID NO: 9424928 - DNA, 22 bp, Homo sapiens
ctctcctggggagcacacacac

SEQ ID NO: 9424929 - DNA, 22 bp, Homo sapiens
tttgtacatcctaattctgagt

SEQ ID NO: 9424930 - DNA, 22 bp, Homo sapiens
tttgtcttggcctcagttttct

SEQ ID NO: 9424931 - DNA, 22 bp, Homo sapiens
tttgtcttggcctcagttttct

SEQ ID NO: 9424932 - DNA, 22 bp, Homo sapiens
tttgtcttggcctcagttttct

SEQ ID NO: 9424933 - DNA, 22 bp, Homo sapiens
ctctcctctgaagtggtgaccc

SEQ ID NO: 9424934 - DNA, 22 bp, Homo sapiens
ctctcctctgaagtggtgaccc

SEQ ID NO: 9424935 - DNA, 23 bp, Homo sapiens
ctctcctgaaggacaagctgccg

SEQ ID NO: 9424936 - DNA, 23 bp, Homo sapiens
ctctcctgaaggacaagctgccg

SEQ ID NO: 9424937 - DNA, 23 bp, Homo sapiens
ctctcctgaaggacaagctgccg

SEQ ID NO: 9424938 - DNA, 22 bp, Homo sapiens
ctctcctgggctgaccgtccga

SEQ ID NO: 9424939 - DNA, 22 bp, Homo sapiens
tttgtgaacttaggcaattagg

SEQ ID NO: 9424940 - DNA, 22 bp, Homo sapiens
tttgtgaacttaggcaattagg

SEQ ID NO: 9424941 - DNA, 22 bp, Homo sapiens
tttgtgaacaaacatgaagatg

SEQ ID NO: 9424942 - DNA, 22 bp, Homo sapiens
tttgtgaagggaacagaagtgt

SEQ ID NO: 9424943 - DNA, 22 bp, Homo sapiens
tttgtctttcccctcctcattg

SEQ ID NO: 9424944 - DNA, 22 bp, Homo sapiens
tttgtctttcccctcctcattg

SEQ ID NO: 9424945 - DNA, 22 bp, Homo sapiens
tttgtcttgtaagttaaattca

SEQ ID NO: 9424946 - DNA, 22 bp, Homo sapiens
tttgtctttcccctcctcattg

SEQ ID NO: 9424947 - DNA, 22 bp, Homo sapiens
tttgtctttcccctcctcattg

SEQ ID NO: 9424948 - DNA, 22 bp, Homo sapiens
tttgtgaatggaatccacagac

SEQ ID NO: 9424949 - DNA, 20 bp, Homo sapiens
ctctggctccgcgtgaccgc

SEQ ID NO: 9424950 - DNA, 19 bp, Homo sapiens
ctctggctcctgggctgcc

SEQ ID NO: 9424951 - DNA, 22 bp, Homo sapiens
tttgtgaataggttggcttcca

SEQ ID NO: 9424952 - DNA, 22 bp, Homo sapiens
tttgtgaataggttggcttcca

SEQ ID NO: 9424953 - DNA, 22 bp, Homo sapiens
tttgtgaataggttggcttcca

SEQ ID NO: 9424954 - DNA, 22 bp, Homo sapiens
tttgtgaataggttggcttcca

SEQ ID NO: 9424955 - DNA, 22 bp, Homo sapiens
tttgtgaataggttggcttcca

SEQ ID NO: 9424956 - DNA, 22 bp, Homo sapiens
tttgtgaataggttggcttcca

SEQ ID NO: 9424957 - DNA, 22 bp, Homo sapiens
tttgtgaatgccttataagcat

SEQ ID NO: 9424958 - DNA, 22 bp, Homo sapiens
ctctggctgcctctcaggcctg

SEQ ID NO: 9424959 - DNA, 22 bp, Homo sapiens
ctctggctctgacagttgatcc

SEQ ID NO: 9424960 - DNA, 22 bp, Homo sapiens
ctctggctctgttgagatttgt

SEQ ID NO: 9424961 - DNA, 22 bp, Homo sapiens
ctctggctcttgggaaacaggt

SEQ ID NO: 9424962 - DNA, 22 bp, Homo sapiens
ctctggctggcacctgatctga

SEQ ID NO: 9424963 - DNA, 22 bp, Homo sapiens
ctctggctggcacctgatctga

SEQ ID NO: 9424964 - DNA, 22 bp, Homo sapiens
ctctggctgcggggcgcgtgga

SEQ ID NO: 9424965 - DNA, 22 bp, Homo sapiens
ctctggctgcggggcgcgtgga

SEQ ID NO: 9424966 - DNA, 22 bp, Homo sapiens
ctctggctgcctctcaggcctg

SEQ ID NO: 9424967 - DNA, 22 bp, Homo sapiens
ctctggctgcctctcaggcctg

SEQ ID NO: 9424968 - DNA, 22 bp, Homo sapiens
ctctggctggctgggcctcagt

SEQ ID NO: 9424969 - DNA, 22 bp, Homo sapiens
ctctggctggctgggcctcagt

SEQ ID NO: 9424970 - DNA, 22 bp, Homo sapiens
ctctggctgtttgcagctcaag

SEQ ID NO: 9424971 - DNA, 22 bp, Homo sapiens
ctctggctgtcccgatgagcag

SEQ ID NO: 9424972 - DNA, 22 bp, Homo sapiens
ctctggctggctgggcctcagt

SEQ ID NO: 9424973 - DNA, 22 bp, Homo sapiens
ctctggctggcacctgatctga

SEQ ID NO: 9424974 - DNA, 22 bp, Homo sapiens
ctctggctggcattgctggact

SEQ ID NO: 9424975 - DNA, 22 bp, Homo sapiens
ctctggcttctaccttgcagtt

SEQ ID NO: 9424976 - DNA, 19 bp, Homo sapiens
ctctggcttccaaagcatc

SEQ ID NO: 9424977 - DNA, 19 bp, Homo sapiens
ctctggcttccaaagcatc

SEQ ID NO: 9424978 - DNA, 22 bp, Homo sapiens
ctctggcttagtatgctccaaa

SEQ ID NO: 9424979 - DNA, 22 bp, Homo sapiens
ctctggcttagtatgctccaaa

SEQ ID NO: 9424980 - DNA, 22 bp, Homo sapiens
ctctggcttagtatgctccaaa

SEQ ID NO: 9424981 - DNA, 22 bp, Homo sapiens
ctctggcttagtatgctccaaa

SEQ ID NO: 9424982 - DNA, 22 bp, Homo sapiens
ctctggctgtttgcagctcaag

SEQ ID NO: 9424983 - DNA, 22 bp, Homo sapiens
ctgaggcactggtaatgggcat

SEQ ID NO: 9424984 - DNA, 22 bp, Homo sapiens
ctgaggcactggtaatgggcat

SEQ ID NO: 9424985 - DNA, 22 bp, Homo sapiens
ctgaggcactggtaatgggcat

SEQ ID NO: 9424986 - DNA, 22 bp, Homo sapiens
ctgaggcactgtcagctgaggc

SEQ ID NO: 9424987 - DNA, 22 bp, Homo sapiens
ctgaggcactgtcagctgaggc

SEQ ID NO: 9424988 - DNA, 22 bp, Homo sapiens
ctgaggcactgtcagctgaggc

SEQ ID NO: 9424989 - DNA, 22 bp, Homo sapiens
ctgaggcactgtcagctgaggc

SEQ ID NO: 9424990 - DNA, 22 bp, Homo sapiens
ctgaggcagaaaaagcaagggt

SEQ ID NO: 9424991 - DNA, 22 bp, Homo sapiens
ctgaggcagaaaaagcaagggt

SEQ ID NO: 9424992 - DNA, 22 bp, Homo sapiens
ctgaggcagaaaaagcaagggt

SEQ ID NO: 9424993 - DNA, 22 bp, Homo sapiens
ctgaggcacccatcttctcctg

SEQ ID NO: 9424994 - DNA, 22 bp, Homo sapiens
ctgaggcacccatcttctcctg

SEQ ID NO: 9424995 - DNA, 22 bp, Homo sapiens
ctgaggcactaacaaggacaag

SEQ ID NO: 9424996 - DNA, 22 bp, Homo sapiens
ctgaggcactaacaaggacaag

SEQ ID NO: 9424997 - DNA, 22 bp, Homo sapiens
ctgaggatctaattattgggtc

SEQ ID NO: 9424998 - DNA, 22 bp, Homo sapiens
ctgaggagttggtgaataagcc

SEQ ID NO: 9424999 - DNA, 19 bp, Homo sapiens
ctgaggcaagtggtggtca

SEQ ID NO: 9425000 - DNA, 17 bp, Homo sapiens
ctgaggattatggttgt

SEQ ID NO: 9425001 - DNA, 22 bp, Homo sapiens
ctgaggaggggcctgagtgaga

SEQ ID NO: 9425002 - DNA, 22 bp, Homo sapiens
ctgaggaggggcctgagtgaga

SEQ ID NO: 9425003 - DNA, 22 bp, Homo sapiens
ctgaggagtgggtgggcagtga

SEQ ID NO: 9425004 - DNA, 22 bp, Homo sapiens
ctgaggagtgggtgggcagtga

SEQ ID NO: 9425005 - DNA, 22 bp, Homo sapiens
ctgaggagtgggtgggcagtga

SEQ ID NO: 9425006 - DNA, 22 bp, Homo sapiens
ctgaggagtgggtgggcagtga

SEQ ID NO: 9425007 - DNA, 22 bp, Homo sapiens
ctgagaattactctgatgagta

SEQ ID NO: 9425008 - DNA, 22 bp, Homo sapiens
ctgagacacggagaggctgtgt

SEQ ID NO: 9425009 - DNA, 22 bp, Homo sapiens
ctgagacacggagaggctgtgt

SEQ ID NO: 9425010 - DNA, 22 bp, Homo sapiens
ctgagaattactctgatgagta

SEQ ID NO: 9425011 - DNA, 22 bp, Homo sapiens
ctgagacaggagaatggcgtga

SEQ ID NO: 9425012 - DNA, 22 bp, Homo sapiens
ctgagacacggagaggctgtgt

SEQ ID NO: 9425013 - DNA, 22 bp, Homo sapiens
ctgagacacggagaggctgtgt

SEQ ID NO: 9425014 - DNA, 22 bp, Homo sapiens
ctgagacatggtttgactggca

SEQ ID NO: 9425015 - DNA, 22 bp, Homo sapiens
ctgagacatggtttgactggca

SEQ ID NO: 9425016 - DNA, 22 bp, Homo sapiens
ctgagacccagacacctgagga

SEQ ID NO: 9425017 - DNA, 21 bp, Homo sapiens
ctgagacctgcattagagagg

SEQ ID NO: 9425018 - DNA, 22 bp, Homo sapiens
ctgagacccagacacctgagga

SEQ ID NO: 9425019 - DNA, 22 bp, Homo sapiens
ctgagacattatgacaagtgga

SEQ ID NO: 9425020 - DNA, 22 bp, Homo sapiens
ctgagacattatgacaagtgga

SEQ ID NO: 9425021 - DNA, 22 bp, Homo sapiens
ctgagacattatgacaagtgga

SEQ ID NO: 9425022 - DNA, 22 bp, Homo sapiens
ctgagagaaacatgactcagga

SEQ ID NO: 9425023 - DNA, 22 bp, Homo sapiens
ctgagagaaacatgactcagga

SEQ ID NO: 9425024 - DNA, 22 bp, Homo sapiens
ctgaggagaaatgggatggttc

SEQ ID NO: 9425025 - DNA, 22 bp, Homo sapiens
ctgaggagctgaaggccctcca

SEQ ID NO: 9425026 - DNA, 22 bp, Homo sapiens
ctgaggagaacaatgagatcaa

SEQ ID NO: 9425027 - DNA, 22 bp, Homo sapiens
ctgaggaggggcctgagtgaga

SEQ ID NO: 9425028 - DNA, 22 bp, Homo sapiens
ctgaggagggaagtccccaaag

SEQ ID NO: 9425029 - DNA, 22 bp, Homo sapiens
ctgagagagtaaagtagaatta

SEQ ID NO: 9425030 - DNA, 22 bp, Homo sapiens
ctgaggagaaagatggtccaag

SEQ ID NO: 9425031 - DNA, 22 bp, Homo sapiens
ctgaggagaaagatggtccaag

SEQ ID NO: 9425032 - DNA, 22 bp, Homo sapiens
ctgagagaatcatgctgcaggt

SEQ ID NO: 9425033 - DNA, 22 bp, Homo sapiens
ctgagagaatcatgctgcaggt

SEQ ID NO: 9425034 - DNA, 22 bp, Homo sapiens
ctgagagaatcatgctgcaggt

SEQ ID NO: 9425035 - DNA, 22 bp, Homo sapiens
ctgagagaatcatgctgcaggt

SEQ ID NO: 9425036 - DNA, 22 bp, Homo sapiens
ctgagagactgtttgtaatatt

SEQ ID NO: 9425037 - DNA, 22 bp, Homo sapiens
ctgagagactgtttgtaatatt

SEQ ID NO: 9425038 - DNA, 22 bp, Homo sapiens
ctgatccctccatagggcacag

SEQ ID NO: 9425039 - DNA, 22 bp, Homo sapiens
ctgatccctccatagggcacag

SEQ ID NO: 9425040 - DNA, 22 bp, Homo sapiens
ctgatcctcctttaagtagctg

SEQ ID NO: 9425041 - DNA, 22 bp, Homo sapiens
ctgatcctcctttaagtagctg

SEQ ID NO: 9425042 - DNA, 22 bp, Homo sapiens
ctgatcctcctttaagtagctg

SEQ ID NO: 9425043 - DNA, 22 bp, Homo sapiens
ctgatccctccatagggcacag

SEQ ID NO: 9425044 - DNA, 22 bp, Homo sapiens
ctgatctcaagtgatccaccca

SEQ ID NO: 9425045 - DNA, 22 bp, Homo sapiens
ctgatctatttacaggaaccaa

SEQ ID NO: 9425046 - DNA, 22 bp, Homo sapiens
ctgatctgtcctcctcagagcc

SEQ ID NO: 9425047 - DNA, 22 bp, Homo sapiens
ctgatctgtcctcctcagagcc

SEQ ID NO: 9425048 - DNA, 22 bp, Homo sapiens
ctgatcttaagtaacattattt

SEQ ID NO: 9425049 - DNA, 22 bp, Homo sapiens
ctgatgaccttggcaagtcaca

SEQ ID NO: 9425050 - DNA, 22 bp, Homo sapiens
ctgatgaatggctcctgagtgg

SEQ ID NO: 9425051 - DNA, 22 bp, Homo sapiens
ctgatgagtcggctgccaccag

SEQ ID NO: 9425052 - DNA, 22 bp, Homo sapiens
ctgatgagcccaggtgaccatg

SEQ ID NO: 9425053 - DNA, 22 bp, Homo sapiens
ctgatgagcccaggtgaccatg

SEQ ID NO: 9425054 - DNA, 22 bp, Homo sapiens
ctgagtcattgcagatgtggag

SEQ ID NO: 9425055 - DNA, 19 bp, Homo sapiens
ctgagtcaaaggttgtggg

SEQ ID NO: 9425056 - DNA, 22 bp, Homo sapiens
ctgagtccagggacagaggcgt

SEQ ID NO: 9425057 - DNA, 22 bp, Homo sapiens
ctgagtccagggacagaggcgt

SEQ ID NO: 9425058 - DNA, 22 bp, Homo sapiens
ctgagtccagggacagaggcgt

SEQ ID NO: 9425059 - DNA, 22 bp, Homo sapiens
ctgaggcagaaaaagcaagggt

SEQ ID NO: 9425060 - DNA, 22 bp, Homo sapiens
ctgaggcagaaaaagcaagggt

SEQ ID NO: 9425061 - DNA, 22 bp, Homo sapiens
ctgattaggctaagcaagaggg

SEQ ID NO: 9425062 - DNA, 22 bp, Homo sapiens
ctgattattactttccaggcgg

SEQ ID NO: 9425063 - DNA, 22 bp, Homo sapiens
ctgattagagtgttaatgagga

SEQ ID NO: 9425064 - DNA, 22 bp, Homo sapiens
ctgattaattagctataaaact

SEQ ID NO: 9425065 - DNA, 22 bp, Homo sapiens
ctgattaactgaactgaattta

SEQ ID NO: 9425066 - DNA, 22 bp, Homo sapiens
ctgattaactgaactgaattta

SEQ ID NO: 9425067 - DNA, 22 bp, Homo sapiens
ctgattaaaaacaggttctgag

SEQ ID NO: 9425068 - DNA, 19 bp, Homo sapiens
ctgatgttccagagaagct

SEQ ID NO: 9425069 - DNA, 22 bp, Homo sapiens
ctgatggatggacaggggtagt

SEQ ID NO: 9425070 - DNA, 22 bp, Homo sapiens
ctgatggatgctacgtaagagg

SEQ ID NO: 9425071 - DNA, 22 bp, Homo sapiens
ctgatggagtgatggagaaatt

SEQ ID NO: 9425072 - DNA, 22 bp, Homo sapiens
ctgatgtgttttagtttggtaa

SEQ ID NO: 9425073 - DNA, 17 bp, Homo sapiens
ctgatggattttttcca

SEQ ID NO: 9425074 - DNA, 22 bp, Homo sapiens
ctgatggagactccactgtgat

SEQ ID NO: 9425075 - DNA, 22 bp, Homo sapiens
ctgatggagagtgtgatttggg

SEQ ID NO: 9425076 - DNA, 22 bp, Homo sapiens
ctgatggagagtgtgatttggg

SEQ ID NO: 9425077 - DNA, 22 bp, Homo sapiens
ctgatggagactccactgtgat

SEQ ID NO: 9425078 - DNA, 22 bp, Homo sapiens
ctgatgctataagccacagtgg

SEQ ID NO: 9425079 - DNA, 22 bp, Homo sapiens
ctgatgatagtgatttattgag

SEQ ID NO: 9425080 - DNA, 22 bp, Homo sapiens
ctgatgcccctggacctgtgac

SEQ ID NO: 9425081 - DNA, 22 bp, Homo sapiens
ctgatttcacttagctaggttt

SEQ ID NO: 9425082 - DNA, 22 bp, Homo sapiens
ctgatttagatttcacacgtga

SEQ ID NO: 9425083 - DNA, 22 bp, Homo sapiens
ctgcaaaagtaattgcaggttt

SEQ ID NO: 9425084 - DNA, 22 bp, Homo sapiens
ctgattctttgaagatgcaccc

SEQ ID NO: 9425085 - DNA, 22 bp, Homo sapiens
ctgattctctgactcttggctt

SEQ ID NO: 9425086 - DNA, 22 bp, Homo sapiens
ctgattcctgattcatgctctt

SEQ ID NO: 9425087 - DNA, 22 bp, Homo sapiens
ctgattccctggtgcctccgtt

SEQ ID NO: 9425088 - DNA, 22 bp, Homo sapiens
ctgattccagagtctgtgttct

SEQ ID NO: 9425089 - DNA, 22 bp, Homo sapiens
ctgattccaaagccaaagctat

SEQ ID NO: 9425090 - DNA, 22 bp, Homo sapiens
ctgcagagcatgaggaggtctg

SEQ ID NO: 9425091 - DNA, 22 bp, Homo sapiens
ctgcagagcatgaggaggtctg

SEQ ID NO: 9425092 - DNA, 22 bp, Homo sapiens
ctgcaaaagtaattgcaggttt

SEQ ID NO: 9425093 - DNA, 22 bp, Homo sapiens
ctgcaaaagtaattgcaggttt

SEQ ID NO: 9425094 - DNA, 22 bp, Homo sapiens
ctgcaaaagtcattgtggtttt

SEQ ID NO: 9425095 - DNA, 22 bp, Homo sapiens
ctgcaaaagtaattggggcttt

SEQ ID NO: 9425096 - DNA, 22 bp, Homo sapiens
ctgcagacctctgaggtccatg

SEQ ID NO: 9425097 - DNA, 22 bp, Homo sapiens
ctgcagacctctgaggtccatg

SEQ ID NO: 9425098 - DNA, 22 bp, Homo sapiens
ctgcagaatggggccaagtgga

SEQ ID NO: 9425099 - DNA, 22 bp, Homo sapiens
ctgcagagcttgtctggatgtg

SEQ ID NO: 9425100 - DNA, 22 bp, Homo sapiens
ctgcagagctaggctgagtgaa

SEQ ID NO: 9425101 - DNA, 22 bp, Homo sapiens
ctgcagagctaggctgagtgaa

SEQ ID NO: 9425102 - DNA, 22 bp, Homo sapiens
ctgcagagctaggctgagtgaa

SEQ ID NO: 9425103 - DNA, 22 bp, Homo sapiens
ctgcagagctaggctgagtgaa

SEQ ID NO: 9425104 - DNA, 22 bp, Homo sapiens
ctgcagagctaggctgagtgaa

SEQ ID NO: 9425105 - DNA, 22 bp, Homo sapiens
ctgcagagctttctgaatgaag

SEQ ID NO: 9425106 - DNA, 22 bp, Homo sapiens
ctgcagagcttgtctggatgtg

SEQ ID NO: 9425107 - DNA, 22 bp, Homo sapiens
ctgcagagcttgtctggatgtg

SEQ ID NO: 9425108 - DNA, 22 bp, Homo sapiens
ctgcagagcttgtctggatgtg

SEQ ID NO: 9425109 - DNA, 22 bp, Homo sapiens
ctgcagagcttgtctggatgtg

SEQ ID NO: 9425110 - DNA, 22 bp, Homo sapiens
ctgcagagggtttgagcatcct

SEQ ID NO: 9425111 - DNA, 22 bp, Homo sapiens
ctgcagaggcctcgcctcctct

SEQ ID NO: 9425112 - DNA, 22 bp, Homo sapiens
ctgcagagcttgtctggatgtg

SEQ ID NO: 9425113 - DNA, 22 bp, Homo sapiens
ctgcagaggggttgaagggtcc

SEQ ID NO: 9425114 - DNA, 22 bp, Homo sapiens
ctgcagaggggttgaagggtcc

SEQ ID NO: 9425115 - DNA, 22 bp, Homo sapiens
ctgcagatggctcagtggggca

SEQ ID NO: 9425116 - DNA, 22 bp, Homo sapiens
ctgcagaggtcttgctgatggt

SEQ ID NO: 9425117 - DNA, 22 bp, Homo sapiens
ctgcagaggtcttgctgatggt

SEQ ID NO: 9425118 - DNA, 22 bp, Homo sapiens
ctgcagaggttggttctaagat

SEQ ID NO: 9425119 - DNA, 22 bp, Homo sapiens
ctgcagagtatagcgagttggg

SEQ ID NO: 9425120 - DNA, 22 bp, Homo sapiens
ctgcagcagaataatctgctca

SEQ ID NO: 9425121 - DNA, 22 bp, Homo sapiens
ctgcagcagcctccagccttgg

SEQ ID NO: 9425122 - DNA, 22 bp, Homo sapiens
ctgcagcaaatgttaagtgact

SEQ ID NO: 9425123 - DNA, 21 bp, Homo sapiens
ctgcagcaaaactttgctcct

SEQ ID NO: 9425124 - DNA, 21 bp, Homo sapiens
ctgcagcaaaactttgctcct

SEQ ID NO: 9425125 - DNA, 22 bp, Homo sapiens
ctgcagcagcctccagccttgg

SEQ ID NO: 9425126 - DNA, 22 bp, Homo sapiens
ctgcagcagtactcagcagcca

SEQ ID NO: 9425127 - DNA, 22 bp, Homo sapiens
ctgcagcagtactcagcagcca

SEQ ID NO: 9425128 - DNA, 22 bp, Homo sapiens
ctgccagctctctggaggctct

SEQ ID NO: 9425129 - DNA, 22 bp, Homo sapiens
ctgcagcagtactcagcagcca

SEQ ID NO: 9425130 - DNA, 22 bp, Homo sapiens
ctgcagcatcctagggtctgtg

SEQ ID NO: 9425131 - DNA, 22 bp, Homo sapiens
ctgcagcatcgccacctgcctc

SEQ ID NO: 9425132 - DNA, 22 bp, Homo sapiens
ctgccagctggagaccaaggaa

SEQ ID NO: 9425133 - DNA, 22 bp, Homo sapiens
ctgccaggcctccgctgtcccc

SEQ ID NO: 9425134 - DNA, 22 bp, Homo sapiens
ctgccagctggagaccaaggaa

SEQ ID NO: 9425135 - DNA, 22 bp, Homo sapiens
ctgccagctggagaccaaggaa

SEQ ID NO: 9425136 - DNA, 22 bp, Homo sapiens
ctgccaggcctccgctgtcccc

SEQ ID NO: 9425137 - DNA, 22 bp, Homo sapiens
ctgccaggctgtcccaggtccg

SEQ ID NO: 9425138 - DNA, 22 bp, Homo sapiens
ctgccaggctgtcccaggtccg

SEQ ID NO: 9425139 - DNA, 22 bp, Homo sapiens
ctgccaggggcctcacaggcca

SEQ ID NO: 9425140 - DNA, 22 bp, Homo sapiens
ctgccatcgggggccccactgc

SEQ ID NO: 9425141 - DNA, 22 bp, Homo sapiens
ctgccatcctcaccagagcagc

SEQ ID NO: 9425142 - DNA, 22 bp, Homo sapiens
ctgccatccacggcccactcat

SEQ ID NO: 9425143 - DNA, 22 bp, Homo sapiens
ctgccatctgagggtccagcct

SEQ ID NO: 9425144 - DNA, 20 bp, Homo sapiens
ctgccatgattgatagagtg

SEQ ID NO: 9425145 - DNA, 22 bp, Homo sapiens
ctgccatcctcaccagagcagc

SEQ ID NO: 9425146 - DNA, 22 bp, Homo sapiens
ctgccatcctcaccagagcagc

SEQ ID NO: 9425147 - DNA, 22 bp, Homo sapiens
ctgccaggttggcgctcgctct

SEQ ID NO: 9425148 - DNA, 22 bp, Homo sapiens
ctgccaggtgccagggcgcggc

SEQ ID NO: 9425149 - DNA, 22 bp, Homo sapiens
ctgccgttgtgaagctcttaga

SEQ ID NO: 9425150 - DNA, 22 bp, Homo sapiens
ctgccgttgtgaagctcttaga

SEQ ID NO: 9425151 - DNA, 22 bp, Homo sapiens
ctgcctagatttgaatcctggc

SEQ ID NO: 9425152 - DNA, 22 bp, Homo sapiens
ctgcctagaaaaccaggctcct

SEQ ID NO: 9425153 - DNA, 22 bp, Homo sapiens
ctgccgtgtttttcatgttaaa

SEQ ID NO: 9425154 - DNA, 22 bp, Homo sapiens
ctgccgtgtttttcatgttaaa

SEQ ID NO: 9425155 - DNA, 22 bp, Homo sapiens
ctgccgtgagctttcgcgagcc

SEQ ID NO: 9425156 - DNA, 22 bp, Homo sapiens
ctgccgagtgggtcatgaggca

SEQ ID NO: 9425157 - DNA, 22 bp, Homo sapiens
ctgccctgggttttatgggagt

SEQ ID NO: 9425158 - DNA, 22 bp, Homo sapiens
ctgccctgggttttatgggagt

SEQ ID NO: 9425159 - DNA, 22 bp, Homo sapiens
ctgccctggggggcctccttgc

SEQ ID NO: 9425160 - DNA, 22 bp, Homo sapiens
ctgccctggggggcctccttgc

SEQ ID NO: 9425161 - DNA, 22 bp, Homo sapiens
ctgccatgcagttagtccctca

SEQ ID NO: 9425162 - DNA, 22 bp, Homo sapiens
ctgccatgctcaagaagtcttt

SEQ ID NO: 9425163 - DNA, 22 bp, Homo sapiens
ctgccctgggtgctggggatcc

SEQ ID NO: 9425164 - DNA, 22 bp, Homo sapiens
ctgccctgggtgctggggatcc

SEQ ID NO: 9425165 - DNA, 22 bp, Homo sapiens
ctgccctgggtgctggggatcc

SEQ ID NO: 9425166 - DNA, 22 bp, Homo sapiens
ctgccctgggttttatgggagt

SEQ ID NO: 9425167 - DNA, 22 bp, Homo sapiens
ctgccctggggggcctccttgc

SEQ ID NO: 9425168 - DNA, 22 bp, Homo sapiens
ctgccctggggggcctccttgc

SEQ ID NO: 9425169 - DNA, 22 bp, Homo sapiens
ctgcctcctcacgtccacagtg

SEQ ID NO: 9425170 - DNA, 22 bp, Homo sapiens
ctgcctcctcacgtccacagtg

SEQ ID NO: 9425171 - DNA, 22 bp, Homo sapiens
ctgcctcctgccgtgcagcttc

SEQ ID NO: 9425172 - DNA, 22 bp, Homo sapiens
ctgcctcctcacgtccacagtg

SEQ ID NO: 9425173 - DNA, 22 bp, Homo sapiens
ctgcctcctcacgtccacagtg

SEQ ID NO: 9425174 - DNA, 22 bp, Homo sapiens
ctgcctcctcacgtccacagtg

SEQ ID NO: 9425175 - DNA, 22 bp, Homo sapiens
ctgcctccaggctcaccttgac

SEQ ID NO: 9425176 - DNA, 22 bp, Homo sapiens
ctgcctccaggctcaccttgac

SEQ ID NO: 9425177 - DNA, 22 bp, Homo sapiens
ctgcctcctgccgtgcagcttc

SEQ ID NO: 9425178 - DNA, 22 bp, Homo sapiens
ctgcctcctgccgtgcagcttc

SEQ ID NO: 9425179 - DNA, 22 bp, Homo sapiens
ctgcctcctgccgtgcagcttc

SEQ ID NO: 9425180 - DNA, 22 bp, Homo sapiens
ctgcctcctgccgtgcagcttc

SEQ ID NO: 9425181 - DNA, 22 bp, Homo sapiens
ctgcctcctgccgtgcagcttc

SEQ ID NO: 9425182 - DNA, 22 bp, Homo sapiens
ctgcctcctggctgatgggtag

SEQ ID NO: 9425183 - DNA, 22 bp, Homo sapiens
ctgcctcctggctgatgggtag

SEQ ID NO: 9425184 - DNA, 22 bp, Homo sapiens
ctgcctgcgttgcctcgtgcct

SEQ ID NO: 9425185 - DNA, 22 bp, Homo sapiens
ctgcctctataggagtccacca

SEQ ID NO: 9425186 - DNA, 22 bp, Homo sapiens
ctgcctcacattggctgtgtga

SEQ ID NO: 9425187 - DNA, 22 bp, Homo sapiens
ctgcctcagccttctgggtgac

SEQ ID NO: 9425188 - DNA, 22 bp, Homo sapiens
ctgcctcacattggctgtgtga

SEQ ID NO: 9425189 - DNA, 22 bp, Homo sapiens
ctgcctcagccttctgggtgac

SEQ ID NO: 9425190 - DNA, 22 bp, Homo sapiens
ctgcctcagcgttgtggcccta

SEQ ID NO: 9425191 - DNA, 22 bp, Homo sapiens
ctgcctcatgctgcctgcagcc

SEQ ID NO: 9425192 - DNA, 22 bp, Homo sapiens
ctgcctccaggctcaccttgac

SEQ ID NO: 9425193 - DNA, 22 bp, Homo sapiens
ctgcctccaggctcaccttgac

SEQ ID NO: 9425194 - DNA, 22 bp, Homo sapiens
ctgcctcatgctgcctgcagcc

SEQ ID NO: 9425195 - DNA, 22 bp, Homo sapiens
ctggcccagagctctggccttt

SEQ ID NO: 9425196 - DNA, 22 bp, Homo sapiens
ctggcccagagctctggccttt

SEQ ID NO: 9425197 - DNA, 22 bp, Homo sapiens
ctggcccagagctctggccttt

SEQ ID NO: 9425198 - DNA, 22 bp, Homo sapiens
ctggcccagagctctggccttt

SEQ ID NO: 9425199 - DNA, 22 bp, Homo sapiens
ctggcccagagctctggccttt

SEQ ID NO: 9425200 - DNA, 22 bp, Homo sapiens
ctggcccagagctctggccttt

SEQ ID NO: 9425201 - DNA, 20 bp, Homo sapiens
ctggcccaggatgatggcgc

SEQ ID NO: 9425202 - DNA, 22 bp, Homo sapiens
ctggcccaggagagcaggcatt

SEQ ID NO: 9425203 - DNA, 22 bp, Homo sapiens
ctggcccaggagagcaggcatt

SEQ ID NO: 9425204 - DNA, 22 bp, Homo sapiens
ctggcccaggagagcaggcatt

SEQ ID NO: 9425205 - DNA, 22 bp, Homo sapiens
ctggcccaggagagcaggcatt

SEQ ID NO: 9425206 - DNA, 22 bp, Homo sapiens
ctggcccaggaagacgtgtccc

SEQ ID NO: 9425207 - DNA, 22 bp, Homo sapiens
ctggcccaggaagacgtgtccc

SEQ ID NO: 9425208 - DNA, 22 bp, Homo sapiens
ctggcccaggaagacgtgtccc

SEQ ID NO: 9425209 - DNA, 22 bp, Homo sapiens
ctggcccaggctcctggggcac

SEQ ID NO: 9425210 - DNA, 22 bp, Homo sapiens
ctggcccaggctcctggggcac

SEQ ID NO: 9425211 - DNA, 22 bp, Homo sapiens
ctggcccaggctcctggggcac

SEQ ID NO: 9425212 - DNA, 22 bp, Homo sapiens
ctggcccaggctcctggggcac

SEQ ID NO: 9425213 - DNA, 20 bp, Homo sapiens
ctggcccaggatgatggcgc

SEQ ID NO: 9425214 - DNA, 20 bp, Homo sapiens
ctggcccaggatgatggcgc

SEQ ID NO: 9425215 - DNA, 20 bp, Homo sapiens
ctggcccaggatgatggcgc

SEQ ID NO: 9425216 - DNA, 20 bp, Homo sapiens
ctggcccaggatgatggcgc

SEQ ID NO: 9425217 - DNA, 23 bp, Homo sapiens
ctggcccaggtgagaggttggtg

SEQ ID NO: 9425218 - DNA, 23 bp, Homo sapiens
ctggcccaggtgagaggttggtg

SEQ ID NO: 9425219 - DNA, 23 bp, Homo sapiens
ctggcccaggtgagaggttggtg

SEQ ID NO: 9425220 - DNA, 21 bp, Homo sapiens
ctggcccagggatctgcattt

SEQ ID NO: 9425221 - DNA, 22 bp, Homo sapiens
ctggccagttgccttcctgggt

SEQ ID NO: 9425222 - DNA, 22 bp, Homo sapiens
ctggccagttgccttcctgggt

SEQ ID NO: 9425223 - DNA, 22 bp, Homo sapiens
ctggccagttgtcctggcttgg

SEQ ID NO: 9425224 - DNA, 22 bp, Homo sapiens
ctggccagtgtggctctgatct

SEQ ID NO: 9425225 - DNA, 22 bp, Homo sapiens
ctggccagtgtggctctgatct

SEQ ID NO: 9425226 - DNA, 22 bp, Homo sapiens
ctggccagttactgctattggc

SEQ ID NO: 9425227 - DNA, 22 bp, Homo sapiens
ctggccagtgtggctctgatct

SEQ ID NO: 9425228 - DNA, 22 bp, Homo sapiens
ctggccagttactgctattggc

SEQ ID NO: 9425229 - DNA, 22 bp, Homo sapiens
ctggccagtgtggctctgatct

SEQ ID NO: 9425230 - DNA, 22 bp, Homo sapiens
ctggccagtgtggctctgatct

SEQ ID NO: 9425231 - DNA, 17 bp, Homo sapiens
ctggccagtgtacttgg

SEQ ID NO: 9425232 - DNA, 17 bp, Homo sapiens
ctggccagtgtacttgg

SEQ ID NO: 9425233 - DNA, 22 bp, Homo sapiens
ctggcccagagagcagagctta

SEQ ID NO: 9425234 - DNA, 22 bp, Homo sapiens
ctggcccagagagcagagctta

SEQ ID NO: 9425235 - DNA, 22 bp, Homo sapiens
ctggcccagagagcagagctta

SEQ ID NO: 9425236 - DNA, 22 bp, Homo sapiens
ctggcccagagagcagagctta

SEQ ID NO: 9425237 - DNA, 22 bp, Homo sapiens
ctggcccagagagcagagctta

SEQ ID NO: 9425238 - DNA, 22 bp, Homo sapiens
ctggcccagagagcagagctta

SEQ ID NO: 9425239 - DNA, 22 bp, Homo sapiens
ctggccagttgtcctggcttgg

SEQ ID NO: 9425240 - DNA, 22 bp, Homo sapiens
ctggccagttgtcctggcttgg

SEQ ID NO: 9425241 - DNA, 22 bp, Homo sapiens
ctggccataggttctcagtgtg

SEQ ID NO: 9425242 - DNA, 22 bp, Homo sapiens
ctggccatatccaccagatgga

SEQ ID NO: 9425243 - DNA, 22 bp, Homo sapiens
ctggcccttaggaaaacaaagt

SEQ ID NO: 9425244 - DNA, 22 bp, Homo sapiens
ctggccctgtggcctaaggact

SEQ ID NO: 9425245 - DNA, 22 bp, Homo sapiens
ctggccctgtggaggcaggaac

SEQ ID NO: 9425246 - DNA, 22 bp, Homo sapiens
ctggcctctgtgttcaccatag

SEQ ID NO: 9425247 - DNA, 22 bp, Homo sapiens
ctggcctctgtgttcaccatag

SEQ ID NO: 9425248 - DNA, 22 bp, Homo sapiens
ctggcctgagaatgctaccctt

SEQ ID NO: 9425249 - DNA, 22 bp, Homo sapiens
ctggcctgagaatgctaccctt

SEQ ID NO: 9425250 - DNA, 22 bp, Homo sapiens
ctggcctgaggccgccttcaga

SEQ ID NO: 9425251 - DNA, 22 bp, Homo sapiens
ctggcctgaggccgccttcaga

SEQ ID NO: 9425252 - DNA, 22 bp, Homo sapiens
ctggcctgaggtcggctgtagg

SEQ ID NO: 9425253 - DNA, 22 bp, Homo sapiens
ctggcctgaggccgccttcaga

SEQ ID NO: 9425254 - DNA, 22 bp, Homo sapiens
ctggcctgagcacagcggctgc

SEQ ID NO: 9425255 - DNA, 22 bp, Homo sapiens
ctggcctgagcacagcggctgc

SEQ ID NO: 9425256 - DNA, 22 bp, Homo sapiens
ctggcctgagcacagcggctgc

SEQ ID NO: 9425257 - DNA, 22 bp, Homo sapiens
ctggcctggcagggagggcatg

SEQ ID NO: 9425258 - DNA, 22 bp, Homo sapiens
ctggcctggcagggagggcatg

SEQ ID NO: 9425259 - DNA, 22 bp, Homo sapiens
ctggcctggcagggagggcatg

SEQ ID NO: 9425260 - DNA, 22 bp, Homo sapiens
ctggcctggcagggagggcatg

SEQ ID NO: 9425261 - DNA, 22 bp, Homo sapiens
ctggcctggcagggagggcatg

SEQ ID NO: 9425262 - DNA, 22 bp, Homo sapiens
ctggcctggcagggagggcatg

SEQ ID NO: 9425263 - DNA, 22 bp, Homo sapiens
ctggcctggcaggggacctcta

SEQ ID NO: 9425264 - DNA, 22 bp, Homo sapiens
ctggcctggcaggggacctcta

SEQ ID NO: 9425265 - DNA, 22 bp, Homo sapiens
ctggcctggcaggggacctcta

SEQ ID NO: 9425266 - DNA, 22 bp, Homo sapiens
ctggcctgctgggtgaggtcct

SEQ ID NO: 9425267 - DNA, 22 bp, Homo sapiens
ctggcctggagcctctgggtgg

SEQ ID NO: 9425268 - DNA, 22 bp, Homo sapiens
ctggcctgctgggtgaggtcct

SEQ ID NO: 9425269 - DNA, 22 bp, Homo sapiens
ctggcctgctgggtgaggtcct

SEQ ID NO: 9425270 - DNA, 22 bp, Homo sapiens
ctggcctgcagatcccagggtc

SEQ ID NO: 9425271 - DNA, 22 bp, Homo sapiens
ctggcctgcagatcccagggtc

SEQ ID NO: 9425272 - DNA, 22 bp, Homo sapiens
ctggcctgcagatcccagggtc

SEQ ID NO: 9425273 - DNA, 22 bp, Homo sapiens
ctggcctgcagatcccagggtc

SEQ ID NO: 9425274 - DNA, 22 bp, Homo sapiens
ctggcctgcagatcccagggtc

SEQ ID NO: 9425275 - DNA, 22 bp, Homo sapiens
ctggcctgcagatcccagggtc

SEQ ID NO: 9425276 - DNA, 22 bp, Homo sapiens
ctggcctgcagatcccagggtc

SEQ ID NO: 9425277 - DNA, 22 bp, Homo sapiens
ctggcctgatctcatgctgtcc

SEQ ID NO: 9425278 - DNA, 22 bp, Homo sapiens
ctggcctgaggtcggctgtagg

SEQ ID NO: 9425279 - DNA, 22 bp, Homo sapiens
ctggctctaagtgtcagctccc

SEQ ID NO: 9425280 - DNA, 22 bp, Homo sapiens
ctggctctaagtgtcagctccc

SEQ ID NO: 9425281 - DNA, 22 bp, Homo sapiens
ctggctctaagtgtcagctccc

SEQ ID NO: 9425282 - DNA, 22 bp, Homo sapiens
ctggctcctgaggcttggcccc

SEQ ID NO: 9425283 - DNA, 22 bp, Homo sapiens
ctggctcctgaggcttggcccc

SEQ ID NO: 9425284 - DNA, 22 bp, Homo sapiens
ctggctcctgaggcttggcccc

SEQ ID NO: 9425285 - DNA, 22 bp, Homo sapiens
ctggctctctgatttcacattc

SEQ ID NO: 9425286 - DNA, 22 bp, Homo sapiens
ctggctctatctccaaggctgg

SEQ ID NO: 9425287 - DNA, 22 bp, Homo sapiens
ctggctctattccctaaggatg

SEQ ID NO: 9425288 - DNA, 22 bp, Homo sapiens
ctggctctattccctaaggatg

SEQ ID NO: 9425289 - DNA, 22 bp, Homo sapiens
ctggctctcgctgggagtactt

SEQ ID NO: 9425290 - DNA, 22 bp, Homo sapiens
ctggctctcaggctggtcccca

SEQ ID NO: 9425291 - DNA, 22 bp, Homo sapiens
ctggctctcaggctggtcccca

SEQ ID NO: 9425292 - DNA, 22 bp, Homo sapiens
ctggctctgaccgcgctggcct

SEQ ID NO: 9425293 - DNA, 22 bp, Homo sapiens
ctggctctgaccgcgctggcct

SEQ ID NO: 9425294 - DNA, 22 bp, Homo sapiens
ctggctctgactccgcatattt

SEQ ID NO: 9425295 - DNA, 22 bp, Homo sapiens
ctggctctgagcccacctccag

SEQ ID NO: 9425296 - DNA, 22 bp, Homo sapiens
ctggctctgagcccacctccag

SEQ ID NO: 9425297 - DNA, 22 bp, Homo sapiens
ctggctctgagtggctctaatt

SEQ ID NO: 9425298 - DNA, 22 bp, Homo sapiens
ctggctctgggcctcagacact

SEQ ID NO: 9425299 - DNA, 22 bp, Homo sapiens
ctggctctgggcctcagacact

SEQ ID NO: 9425300 - DNA, 22 bp, Homo sapiens
ctggctctgggctaagctccca

SEQ ID NO: 9425301 - DNA, 22 bp, Homo sapiens
ctggctctgcaacccccacaca

SEQ ID NO: 9425302 - DNA, 22 bp, Homo sapiens
ctggctctgagtggtatcttga

SEQ ID NO: 9425303 - DNA, 22 bp, Homo sapiens
ctggctctgagtggtatcttga

SEQ ID NO: 9425304 - DNA, 22 bp, Homo sapiens
ctggctctgagtggctctaatt

SEQ ID NO: 9425305 - DNA, 22 bp, Homo sapiens
ctggctctgggctaagctccca

SEQ ID NO: 9425306 - DNA, 23 bp, Homo sapiens
ctggctctgtaggtggcatcctt

SEQ ID NO: 9425307 - DNA, 22 bp, Homo sapiens
ctggctctgtcaccctttctcc

SEQ ID NO: 9425308 - DNA, 22 bp, Homo sapiens
ctggctctgtggcttccttcat

SEQ ID NO: 9425309 - DNA, 22 bp, Homo sapiens
ctggctctgtggcttccttcat

SEQ ID NO: 9425310 - DNA, 22 bp, Homo sapiens
ctggctctgtcaccctttctcc

SEQ ID NO: 9425311 - DNA, 22 bp, Homo sapiens
ctggctctgtgggacctggcct

SEQ ID NO: 9425312 - DNA, 22 bp, Homo sapiens
ctggctctgtggcttccttcat

SEQ ID NO: 9425313 - DNA, 22 bp, Homo sapiens
ctggctctgtgggacctggcct

SEQ ID NO: 9425314 - DNA, 22 bp, Homo sapiens
ctggctctgtgggacctggcct

SEQ ID NO: 9425315 - DNA, 22 bp, Homo sapiens
ctggcctggggcctcagctgct

SEQ ID NO: 9425316 - DNA, 22 bp, Homo sapiens
ctggcctggtctggcctctcca

SEQ ID NO: 9425317 - DNA, 22 bp, Homo sapiens
ctggctccaccccaggaggatg

SEQ ID NO: 9425318 - DNA, 22 bp, Homo sapiens
ctggcctggtctggcctctcca

SEQ ID NO: 9425319 - DNA, 22 bp, Homo sapiens
ctggcctggtctggcctctcca

SEQ ID NO: 9425320 - DNA, 22 bp, Homo sapiens
ctggctccaccccaggaggatg

SEQ ID NO: 9425321 - DNA, 22 bp, Homo sapiens
ctggcctggggcctcagctgct

SEQ ID NO: 9425322 - DNA, 22 bp, Homo sapiens
ctggcctggggcctcagctgct

SEQ ID NO: 9425323 - DNA, 22 bp, Homo sapiens
ctggcctggggcctcagctgct

SEQ ID NO: 9425324 - DNA, 22 bp, Homo sapiens
ctggcctggcaggggacctcta

SEQ ID NO: 9425325 - DNA, 22 bp, Homo sapiens
ctggcctggcaggggacctcta

SEQ ID NO: 9425326 - DNA, 22 bp, Homo sapiens
ctggcctggcgcagtggctcac

SEQ ID NO: 9425327 - DNA, 22 bp, Homo sapiens
ctggcctggcgcagtggctcac

SEQ ID NO: 9425328 - DNA, 22 bp, Homo sapiens
ctggcctggcgcagtggctcac

SEQ ID NO: 9425329 - DNA, 22 bp, Homo sapiens
ctggcctggcgcagtggctcac

SEQ ID NO: 9425330 - DNA, 22 bp, Homo sapiens
ctggcctgggagctgctagcgt

SEQ ID NO: 9425331 - DNA, 22 bp, Homo sapiens
ctggcctggcgcagtggctcac

SEQ ID NO: 9425332 - DNA, 22 bp, Homo sapiens
ctggcctgggagctgctagcgt

SEQ ID NO: 9425333 - DNA, 23 bp, Homo sapiens
ctggctccgaagactccaggatc

SEQ ID NO: 9425334 - DNA, 23 bp, Homo sapiens
ctggctccgaagactccaggatc

SEQ ID NO: 9425335 - DNA, 22 bp, Homo sapiens
ctggctccctggacatggggcc

SEQ ID NO: 9425336 - DNA, 22 bp, Homo sapiens
ctggctccctggacatggggcc

SEQ ID NO: 9425337 - DNA, 22 bp, Homo sapiens
ctggctcctcagtattccactt

SEQ ID NO: 9425338 - DNA, 22 bp, Homo sapiens
ctggctcctccaaggcctggag

SEQ ID NO: 9425339 - DNA, 22 bp, Homo sapiens
ctggctcctcagtattccactt

SEQ ID NO: 9425340 - DNA, 22 bp, Homo sapiens
ctggctcctcaggactgcggga

SEQ ID NO: 9425341 - DNA, 22 bp, Homo sapiens
ctggctcctcaggactgcggga

SEQ ID NO: 9425342 - DNA, 22 bp, Homo sapiens
ctggctccactccctgcctgac

SEQ ID NO: 9425343 - DNA, 22 bp, Homo sapiens
ctggctccaggtcatgcactca

SEQ ID NO: 9425344 - DNA, 22 bp, Homo sapiens
ctggctccactccctgcctgac

SEQ ID NO: 9425345 - DNA, 22 bp, Homo sapiens
ctggctccactccctgcctgac

SEQ ID NO: 9425346 - DNA, 22 bp, Homo sapiens
ctggctccctcgctgaggtgct

SEQ ID NO: 9425347 - DNA, 22 bp, Homo sapiens
ctggctccctctccctgagtca

SEQ ID NO: 9425348 - DNA, 22 bp, Homo sapiens
ctggctccaggtcatgcactca

SEQ ID NO: 9425349 - DNA, 22 bp, Homo sapiens
ctggctccaggtcatgcactca

SEQ ID NO: 9425350 - DNA, 22 bp, Homo sapiens
ctggctccaggtcatgcactca

SEQ ID NO: 9425351 - DNA, 22 bp, Homo sapiens
ctggatccatcgggtcccgagt

SEQ ID NO: 9425352 - DNA, 22 bp, Homo sapiens
ctggataaatgtttgctttaga

SEQ ID NO: 9425353 - DNA, 22 bp, Homo sapiens
ctggataaatgctttagttgga

SEQ ID NO: 9425354 - DNA, 22 bp, Homo sapiens
ctggataagagttttacttcct

SEQ ID NO: 9425355 - DNA, 22 bp, Homo sapiens
ctggataatcacagaggagcat

SEQ ID NO: 9425356 - DNA, 21 bp, Homo sapiens
ctggatctgtcatcgagtttt

SEQ ID NO: 9425357 - DNA, 22 bp, Homo sapiens
ctggatctgtcccctttttgtt

SEQ ID NO: 9425358 - DNA, 22 bp, Homo sapiens
ctggatctgtttgtgcttgtgg

SEQ ID NO: 9425359 - DNA, 22 bp, Homo sapiens
ctggatctgtcttttggatccc

SEQ ID NO: 9425360 - DNA, 22 bp, Homo sapiens
ctggatctaaaggtggatgtag

SEQ ID NO: 9425361 - DNA, 22 bp, Homo sapiens
ctggatctgaacatcggtatca

SEQ ID NO: 9425362 - DNA, 22 bp, Homo sapiens
ctggatctaaaggtggatgtag

SEQ ID NO: 9425363 - DNA, 22 bp, Homo sapiens
ctggatggtcccatgagcagct

SEQ ID NO: 9425364 - DNA, 22 bp, Homo sapiens
ctggatggtcccatgagcagct

SEQ ID NO: 9425365 - DNA, 22 bp, Homo sapiens
ctggatggaaggaggatagtat

SEQ ID NO: 9425366 - DNA, 22 bp, Homo sapiens
ctggatctgtttgtgcttgtgg

SEQ ID NO: 9425367 - DNA, 22 bp, Homo sapiens
ctggatcttcagagatcaccag

SEQ ID NO: 9425368 - DNA, 22 bp, Homo sapiens
ctggatcttgctgcattgagaa

SEQ ID NO: 9425369 - DNA, 22 bp, Homo sapiens
ctggatcttcagagatcaccag

SEQ ID NO: 9425370 - DNA, 22 bp, Homo sapiens
ctggatctgtttgtgcttgtgg

SEQ ID NO: 9425371 - DNA, 21 bp, Homo sapiens
ctggatctgtcatcgagtttt

SEQ ID NO: 9425372 - DNA, 22 bp, Homo sapiens
ctggatctgaacatcggtatca

SEQ ID NO: 9425373 - DNA, 22 bp, Homo sapiens
ctggatgctgagaggtaccaag

SEQ ID NO: 9425374 - DNA, 22 bp, Homo sapiens
ctggatgctgagaggtaccaag

SEQ ID NO: 9425375 - DNA, 22 bp, Homo sapiens
ctggatgataacagcaatattt

SEQ ID NO: 9425376 - DNA, 22 bp, Homo sapiens
ctggatgataacagcaatattt

SEQ ID NO: 9425377 - DNA, 22 bp, Homo sapiens
ctggatgtcttggggactcctg

SEQ ID NO: 9425378 - DNA, 22 bp, Homo sapiens
ctggattctttcataaaagtca

SEQ ID NO: 9425379 - DNA, 22 bp, Homo sapiens
ctggatgttttgctaaggactc

SEQ ID NO: 9425380 - DNA, 22 bp, Homo sapiens
ctggcaagaaatatatatctta

SEQ ID NO: 9425381 - DNA, 22 bp, Homo sapiens
ctggcaagaaatatatatctta

SEQ ID NO: 9425382 - DNA, 19 bp, Homo sapiens
ctggcaaatgctttggcca

SEQ ID NO: 9425383 - DNA, 22 bp, Homo sapiens
ctggattttaaattttctctgt

SEQ ID NO: 9425384 - DNA, 22 bp, Homo sapiens
ctggcagatagtaagtgatcaa

SEQ ID NO: 9425385 - DNA, 22 bp, Homo sapiens
ctggcagatatttgcagacatg

SEQ ID NO: 9425386 - DNA, 22 bp, Homo sapiens
ctggcagatagccacgcctgtc

SEQ ID NO: 9425387 - DNA, 22 bp, Homo sapiens
ctggcagaggatggggacccag

SEQ ID NO: 9425388 - DNA, 22 bp, Homo sapiens
ctggcagagttgggtctcaaat

SEQ ID NO: 9425389 - DNA, 22 bp, Homo sapiens
ctggcagagtctgctgtctgca

SEQ ID NO: 9425390 - DNA, 22 bp, Homo sapiens
ctggcagagtctgctgtctgca

SEQ ID NO: 9425391 - DNA, 22 bp, Homo sapiens
ctggcagcagctggtaccttat

SEQ ID NO: 9425392 - DNA, 22 bp, Homo sapiens
ctggcagcagagctcaacatag

SEQ ID NO: 9425393 - DNA, 22 bp, Homo sapiens
ctggcagcagcttctggatcga

SEQ ID NO: 9425394 - DNA, 22 bp, Homo sapiens
ctggcagcagcttctggatcga

SEQ ID NO: 9425395 - DNA, 22 bp, Homo sapiens
ctggcagcaggtcacacgcaga

SEQ ID NO: 9425396 - DNA, 22 bp, Homo sapiens
ctggcacatagtcagcactcaa

SEQ ID NO: 9425397 - DNA, 22 bp, Homo sapiens
ctggcacatagtcagcactcaa

SEQ ID NO: 9425398 - DNA, 22 bp, Homo sapiens
ctggcacatagtcagcactcaa

SEQ ID NO: 9425399 - DNA, 22 bp, Homo sapiens
ctggcacatcactcctagttta

SEQ ID NO: 9425400 - DNA, 22 bp, Homo sapiens
ctggcacatcactcctagttta

SEQ ID NO: 9425401 - DNA, 22 bp, Homo sapiens
ctggcacatgctccctgagtgg

SEQ ID NO: 9425402 - DNA, 22 bp, Homo sapiens
ctggcacatgtgagccacatca

SEQ ID NO: 9425403 - DNA, 22 bp, Homo sapiens
ctggcacatgtgagccacatca

SEQ ID NO: 9425404 - DNA, 22 bp, Homo sapiens
ctggcacatgtgagccacatca

SEQ ID NO: 9425405 - DNA, 22 bp, Homo sapiens
ctggcacctccagctcatggcc

SEQ ID NO: 9425406 - DNA, 22 bp, Homo sapiens
ctggcactggatcgtgcatatc

SEQ ID NO: 9425407 - DNA, 22 bp, Homo sapiens
ctggcacttggcacccatgaaa

SEQ ID NO: 9425408 - DNA, 22 bp, Homo sapiens
ctggcaccaggcatgctgggag

SEQ ID NO: 9425409 - DNA, 22 bp, Homo sapiens
ctggcatgaaatggcatctcat

SEQ ID NO: 9425410 - DNA, 22 bp, Homo sapiens
ctggcatgaaatggcatctcat

SEQ ID NO: 9425411 - DNA, 22 bp, Homo sapiens
ctggcatgaaatggcatctcat

SEQ ID NO: 9425412 - DNA, 22 bp, Homo sapiens
ctggcatcatttagcacagtgt

SEQ ID NO: 9425413 - DNA, 22 bp, Homo sapiens
ctggcagggctggtattcaaaa

SEQ ID NO: 9425414 - DNA, 22 bp, Homo sapiens
ctggcagcattaacagagagca

SEQ ID NO: 9425415 - DNA, 22 bp, Homo sapiens
ctggcagcattaacagagagca

SEQ ID NO: 9425416 - DNA, 22 bp, Homo sapiens
ctggcagcatggagcctgtgct

SEQ ID NO: 9425417 - DNA, 22 bp, Homo sapiens
ctggcagcattaacagagagca

SEQ ID NO: 9425418 - DNA, 22 bp, Homo sapiens
ctggcagcatggagcctgtgct

SEQ ID NO: 9425419 - DNA, 22 bp, Homo sapiens
ctggcagcagttatgaaacaat

SEQ ID NO: 9425420 - DNA, 22 bp, Homo sapiens
ctggcagcaggtcacacgcaga

SEQ ID NO: 9425421 - DNA, 22 bp, Homo sapiens
ctggccagtgcctgtgggcccc

SEQ ID NO: 9425422 - DNA, 22 bp, Homo sapiens
ctggccagtgcctgtgggcccc

SEQ ID NO: 9425423 - DNA, 22 bp, Homo sapiens
ctggccaggcggcccctgcatg

SEQ ID NO: 9425424 - DNA, 22 bp, Homo sapiens
ctggccaggcggcccctgcatg

SEQ ID NO: 9425425 - DNA, 22 bp, Homo sapiens
ctggccaggcggcccctgcatg

SEQ ID NO: 9425426 - DNA, 22 bp, Homo sapiens
ctggccaggcggcccctgcatg

SEQ ID NO: 9425427 - DNA, 22 bp, Homo sapiens
ctggccacatgtgtgctgagca

SEQ ID NO: 9425428 - DNA, 22 bp, Homo sapiens
ctggccaccaagagcttgctca

SEQ ID NO: 9425429 - DNA, 22 bp, Homo sapiens
ctggccaccaagagcttgctca

SEQ ID NO: 9425430 - DNA, 23 bp, Homo sapiens
ctggccaccatctttctggcttc

SEQ ID NO: 9425431 - DNA, 19 bp, Homo sapiens
ctggccacacctgctggtt

SEQ ID NO: 9425432 - DNA, 22 bp, Homo sapiens
ctggccacatgtgtgctgagca

SEQ ID NO: 9425433 - DNA, 19 bp, Homo sapiens
ctggccacacctgctggtt

SEQ ID NO: 9425434 - DNA, 22 bp, Homo sapiens
ctggccacatgtgtgctgagca

SEQ ID NO: 9425435 - DNA, 22 bp, Homo sapiens
ctggccacaactagcccaggac

SEQ ID NO: 9425436 - DNA, 22 bp, Homo sapiens
ctggccacaactagcccaggac

SEQ ID NO: 9425437 - DNA, 22 bp, Homo sapiens
ctggccaatatagggaaatctt

SEQ ID NO: 9425438 - DNA, 22 bp, Homo sapiens
ctggcattgagggtcacaaggc

SEQ ID NO: 9425439 - DNA, 22 bp, Homo sapiens
ctggcattgagggtcacaaggc

SEQ ID NO: 9425440 - DNA, 22 bp, Homo sapiens
ctggcatgtgtttggctcctgt

SEQ ID NO: 9425441 - DNA, 22 bp, Homo sapiens
ctggcatgtgtttggctcctgt

SEQ ID NO: 9425442 - DNA, 21 bp, Homo sapiens
ctggcattatgatagcgtcct

SEQ ID NO: 9425443 - DNA, 22 bp, Homo sapiens
ctggcatgccttgggtgcctct

SEQ ID NO: 9425444 - DNA, 22 bp, Homo sapiens
ctggcatgccttgggtgcctct

SEQ ID NO: 9425445 - DNA, 21 bp, Homo sapiens
ctggaggcaggtggtgccagg

SEQ ID NO: 9425446 - DNA, 22 bp, Homo sapiens
ctggaggcacccttagagaggc

SEQ ID NO: 9425447 - DNA, 22 bp, Homo sapiens
ctggaggcacccttagagaggc

SEQ ID NO: 9425448 - DNA, 21 bp, Homo sapiens
ctggaggcaggtggtgccagg

SEQ ID NO: 9425449 - DNA, 21 bp, Homo sapiens
ctggaggcaggtggtgccagg

SEQ ID NO: 9425450 - DNA, 22 bp, Homo sapiens
ctggaggctgagttgggtctcc

SEQ ID NO: 9425451 - DNA, 22 bp, Homo sapiens
ctggaggctggcttcccctggc

SEQ ID NO: 9425452 - DNA, 22 bp, Homo sapiens
ctggaggcagttgccccagtca

SEQ ID NO: 9425453 - DNA, 22 bp, Homo sapiens
ctggaggctgagttgggtctcc

SEQ ID NO: 9425454 - DNA, 22 bp, Homo sapiens
ctggaggctgagttgggtctcc

SEQ ID NO: 9425455 - DNA, 22 bp, Homo sapiens
ctggaggaccacagaagctggt

SEQ ID NO: 9425456 - DNA, 22 bp, Homo sapiens
ctggaggagaacttgaggaagg

SEQ ID NO: 9425457 - DNA, 22 bp, Homo sapiens
ctggaggagagtctgaatgaca

SEQ ID NO: 9425458 - DNA, 22 bp, Homo sapiens
ctggaggagaacttgaggaagg

SEQ ID NO: 9425459 - DNA, 22 bp, Homo sapiens
ctggaggagcatggactggagt

SEQ ID NO: 9425460 - DNA, 22 bp, Homo sapiens
ctggaggcaaagcagaggcatg

SEQ ID NO: 9425461 - DNA, 22 bp, Homo sapiens
ctggaggcaaagcagaggcatg

SEQ ID NO: 9425462 - DNA, 22 bp, Homo sapiens
ctggagctctccagagccccgt

SEQ ID NO: 9425463 - DNA, 22 bp, Homo sapiens
ctggagctctccagagccccgt

SEQ ID NO: 9425464 - DNA, 22 bp, Homo sapiens
ctggagctctgtgtgttcctga

SEQ ID NO: 9425465 - DNA, 22 bp, Homo sapiens
ctggagctcttctgagtgtgct

SEQ ID NO: 9425466 - DNA, 22 bp, Homo sapiens
ctggaggaatcacagaaggctt

SEQ ID NO: 9425467 - DNA, 22 bp, Homo sapiens
ctggaggacagaggccatgtct

SEQ ID NO: 9425468 - DNA, 22 bp, Homo sapiens
ctggaggacagaggccatgtct

SEQ ID NO: 9425469 - DNA, 22 bp, Homo sapiens
ctggaggaccacagaagctggt

SEQ ID NO: 9425470 - DNA, 22 bp, Homo sapiens
ctggaccagcctccgccttcac

SEQ ID NO: 9425471 - DNA, 19 bp, Homo sapiens
ctggacctggaggcccgga

SEQ ID NO: 9425472 - DNA, 19 bp, Homo sapiens
ctggacctggaggcccgga

SEQ ID NO: 9425473 - DNA, 23 bp, Homo sapiens
ctggactcaggggatgtgaagga

SEQ ID NO: 9425474 - DNA, 22 bp, Homo sapiens
ctggactcactatggcttcaga

SEQ ID NO: 9425475 - DNA, 22 bp, Homo sapiens
ctggacagtgggcagaggagac

SEQ ID NO: 9425476 - DNA, 22 bp, Homo sapiens
ctggacagtgggcagaggagac

SEQ ID NO: 9425477 - DNA, 22 bp, Homo sapiens
ctggacagtgggcagaggagac

SEQ ID NO: 9425478 - DNA, 22 bp, Homo sapiens
ctggacatcagtgtgcctggct

SEQ ID NO: 9425479 - DNA, 22 bp, Homo sapiens
ctggaccagaaaggacatggct

SEQ ID NO: 9425480 - DNA, 22 bp, Homo sapiens
ctggactttggcccatctgcca

SEQ ID NO: 9425481 - DNA, 22 bp, Homo sapiens
ctggacttctcttcaaagacag

SEQ ID NO: 9425482 - DNA, 22 bp, Homo sapiens
ctggacttaggcaggcaccccg

SEQ ID NO: 9425483 - DNA, 23 bp, Homo sapiens
ctggactcaggggatgtgaagga

SEQ ID NO: 9425484 - DNA, 22 bp, Homo sapiens
ctggactcatccatagaggtga

SEQ ID NO: 9425485 - DNA, 22 bp, Homo sapiens
ctggactcatccatagaggtga

SEQ ID NO: 9425486 - DNA, 22 bp, Homo sapiens
ctggagggactttctcacggat

SEQ ID NO: 9425487 - DNA, 22 bp, Homo sapiens
ctggagggactttctcacggat

SEQ ID NO: 9425488 - DNA, 22 bp, Homo sapiens
ctggagggactttctcacggat

SEQ ID NO: 9425489 - DNA, 22 bp, Homo sapiens
ctggagggactttctcacggat

SEQ ID NO: 9425490 - DNA, 22 bp, Homo sapiens
ctggagggctggactaaggaaa

SEQ ID NO: 9425491 - DNA, 22 bp, Homo sapiens
ctggagggctggactaaggaaa

SEQ ID NO: 9425492 - DNA, 22 bp, Homo sapiens
ctggagggctggactaaggaaa

SEQ ID NO: 9425493 - DNA, 22 bp, Homo sapiens
ctggagggcttctgcaggttac

SEQ ID NO: 9425494 - DNA, 22 bp, Homo sapiens
ctggagggcttctgcaggttac

SEQ ID NO: 9425495 - DNA, 22 bp, Homo sapiens
ctggagggcttctgcaggttac

SEQ ID NO: 9425496 - DNA, 22 bp, Homo sapiens
ctggaggggccatccacagtct

SEQ ID NO: 9425497 - DNA, 22 bp, Homo sapiens
ctggaggggctggcatggtagc

SEQ ID NO: 9425498 - DNA, 22 bp, Homo sapiens
ctggaggggctggcatggtagc

SEQ ID NO: 9425499 - DNA, 22 bp, Homo sapiens
ctggagggggaaatgttcattg

SEQ ID NO: 9425500 - DNA, 22 bp, Homo sapiens
ctggaggggctggcatggtagc

SEQ ID NO: 9425501 - DNA, 22 bp, Homo sapiens
ctggaggggccatccacagtct

SEQ ID NO: 9425502 - DNA, 22 bp, Homo sapiens
ctggagggggaaatgttcattg

SEQ ID NO: 9425503 - DNA, 22 bp, Homo sapiens
ctggagggggaaatgttcattg

SEQ ID NO: 9425504 - DNA, 21 bp, Homo sapiens
ctggagggtagagttgggctg

SEQ ID NO: 9425505 - DNA, 21 bp, Homo sapiens
ctggagggtagagttgggctg

SEQ ID NO: 9425506 - DNA, 21 bp, Homo sapiens
ctggagggtagagttgggctg

SEQ ID NO: 9425507 - DNA, 22 bp, Homo sapiens
ctggaggtctacagtggtagct

SEQ ID NO: 9425508 - DNA, 19 bp, Homo sapiens
ctggaggtagagggttagt

SEQ ID NO: 9425509 - DNA, 19 bp, Homo sapiens
ctggaggtagagggttagt

SEQ ID NO: 9425510 - DNA, 22 bp, Homo sapiens
ctggaggtcacccttagaacat

SEQ ID NO: 9425511 - DNA, 22 bp, Homo sapiens
ctggagggtgagcctcatctct

SEQ ID NO: 9425512 - DNA, 22 bp, Homo sapiens
ctggagggtgagcctcatctct

SEQ ID NO: 9425513 - DNA, 22 bp, Homo sapiens
ctggagggtggagagaagtctc

SEQ ID NO: 9425514 - DNA, 22 bp, Homo sapiens
ctggaggtctacagtggtagct

SEQ ID NO: 9425515 - DNA, 22 bp, Homo sapiens
ctggaggtgcctagatgagctc

SEQ ID NO: 9425516 - DNA, 22 bp, Homo sapiens
ctggaggtgcctagatgagctc

SEQ ID NO: 9425517 - DNA, 22 bp, Homo sapiens
ctggaggtgggggcaagagtgt

SEQ ID NO: 9425518 - DNA, 22 bp, Homo sapiens
ctggagtagccggacgggtctg

SEQ ID NO: 9425519 - DNA, 22 bp, Homo sapiens
ctggagtcactcatgtagctgc

SEQ ID NO: 9425520 - DNA, 18 bp, Homo sapiens
ctggagtcacagtgggga

SEQ ID NO: 9425521 - DNA, 21 bp, Homo sapiens
ctggagtcattttctgagtag

SEQ ID NO: 9425522 - DNA, 21 bp, Homo sapiens
ctggagtcattttctgagtag

SEQ ID NO: 9425523 - DNA, 22 bp, Homo sapiens
ctggagtctccccaggagcgtg

SEQ ID NO: 9425524 - DNA, 20 bp, Homo sapiens
ctggagtctaggagtactgg

SEQ ID NO: 9425525 - DNA, 22 bp, Homo sapiens
ctggagtcggcgccccaacaga

SEQ ID NO: 9425526 - DNA, 20 bp, Homo sapiens
ctggagtgtagcagtggctg

SEQ ID NO: 9425527 - DNA, 20 bp, Homo sapiens
ctggagtgtagcagtggctg

SEQ ID NO: 9425528 - DNA, 22 bp, Homo sapiens
ctggagtgttatggtcaagtca

SEQ ID NO: 9425529 - DNA, 22 bp, Homo sapiens
ctggagtgtaaagagcatagaa

SEQ ID NO: 9425530 - DNA, 20 bp, Homo sapiens
ctggagtgtagcagtggctg

SEQ ID NO: 9425531 - DNA, 22 bp, Homo sapiens
ctggagtgtaaagagcatagaa

SEQ ID NO: 9425532 - DNA, 22 bp, Homo sapiens
ctggagtgtaaagagcatagaa

SEQ ID NO: 9425533 - DNA, 22 bp, Homo sapiens
ctggagtggccggtgctgtggc

SEQ ID NO: 9425534 - DNA, 22 bp, Homo sapiens
ctggagtctcttctgtagctac

SEQ ID NO: 9425535 - DNA, 22 bp, Homo sapiens
ctggagtctccccaggagcgtg

SEQ ID NO: 9425536 - DNA, 22 bp, Homo sapiens
ctggacagtgctgcttgagatg

SEQ ID NO: 9425537 - DNA, 22 bp, Homo sapiens
ctggacagtgctgcttgagatg

SEQ ID NO: 9425538 - DNA, 22 bp, Homo sapiens
ctggacagtgctgcttgagatg

SEQ ID NO: 9425539 - DNA, 22 bp, Homo sapiens
ctggacagtgctgcttgagatg

SEQ ID NO: 9425540 - DNA, 22 bp, Homo sapiens
ctggacaggctggggactgcaa

SEQ ID NO: 9425541 - DNA, 22 bp, Homo sapiens
ctggacaggctggggactgcaa

SEQ ID NO: 9425542 - DNA, 22 bp, Homo sapiens
ctggacaggaagaattgggagc

SEQ ID NO: 9425543 - DNA, 22 bp, Homo sapiens
ctggacagaagtggctgggcag

SEQ ID NO: 9425544 - DNA, 22 bp, Homo sapiens
ctggacagccctcactgtgtgc

SEQ ID NO: 9425545 - DNA, 22 bp, Homo sapiens
ctggacagccctcactgtgtgc

SEQ ID NO: 9425546 - DNA, 22 bp, Homo sapiens
ctggacagaaaccagtcctggg

SEQ ID NO: 9425547 - DNA, 22 bp, Homo sapiens
ctggacagaaaccagtcctggg

SEQ ID NO: 9425548 - DNA, 22 bp, Homo sapiens
ctggacagaaagggctgctgtg

SEQ ID NO: 9425549 - DNA, 22 bp, Homo sapiens
ctggacagaaagggctgctgtg

SEQ ID NO: 9425550 - DNA, 22 bp, Homo sapiens
ctggacagaagtggctgggcag

SEQ ID NO: 9425551 - DNA, 22 bp, Homo sapiens
ctggacagaagtggctgggcag

SEQ ID NO: 9425552 - DNA, 22 bp, Homo sapiens
ctggacagaagtggctgggcag

SEQ ID NO: 9425553 - DNA, 22 bp, Homo sapiens
ctggacagaaagggctgctgtg

SEQ ID NO: 9425554 - DNA, 22 bp, Homo sapiens
ctggacagaaagggctgctgtg

SEQ ID NO: 9425555 - DNA, 22 bp, Homo sapiens
ctggaatgttctccagcatggc

SEQ ID NO: 9425556 - DNA, 22 bp, Homo sapiens
ctggaatttttgtcgtggagta

SEQ ID NO: 9425557 - DNA, 22 bp, Homo sapiens
ctggaattgcataatatgtcct

SEQ ID NO: 9425558 - DNA, 22 bp, Homo sapiens
ctggaattgcataatatgtcct

SEQ ID NO: 9425559 - DNA, 22 bp, Homo sapiens
ctggacagaaaaggccactgga

SEQ ID NO: 9425560 - DNA, 22 bp, Homo sapiens
ctggacagaaaaggccactgga

SEQ ID NO: 9425561 - DNA, 22 bp, Homo sapiens
ctggaaggttctttgtgtgcct

SEQ ID NO: 9425562 - DNA, 22 bp, Homo sapiens
ctggaaagtacagtgtgtcaca

SEQ ID NO: 9425563 - DNA, 22 bp, Homo sapiens
ctggaaagtacagtgtgtcaca

SEQ ID NO: 9425564 - DNA, 19 bp, Homo sapiens
ctggaatgtggctggtgca

SEQ ID NO: 9425565 - DNA, 22 bp, Homo sapiens
ctggaagtggagagtggccctc

SEQ ID NO: 9425566 - DNA, 22 bp, Homo sapiens
ctggaagtatttaacccagaga

SEQ ID NO: 9425567 - DNA, 22 bp, Homo sapiens
ctggaagtataggggagatgat

SEQ ID NO: 9425568 - DNA, 22 bp, Homo sapiens
ctggaaagacagagggcatggg

SEQ ID NO: 9425569 - DNA, 22 bp, Homo sapiens
ctggaaagacagagggcatggg

SEQ ID NO: 9425570 - DNA, 22 bp, Homo sapiens
ctggaaagatttacacggggaa

SEQ ID NO: 9425571 - DNA, 22 bp, Homo sapiens
ctggaaagagatggcagggttt

SEQ ID NO: 9425572 - DNA, 22 bp, Homo sapiens
ctggaaagggtcctcattctgt

SEQ ID NO: 9425573 - DNA, 22 bp, Homo sapiens
ctggaaagatttctttggagtc

SEQ ID NO: 9425574 - DNA, 22 bp, Homo sapiens
ctgctttgtgtggtccctccag

SEQ ID NO: 9425575 - DNA, 22 bp, Homo sapiens
ctgctttttctaggaggacaat

SEQ ID NO: 9425576 - DNA, 22 bp, Homo sapiens
ctgcttttgagcccagtgctca

SEQ ID NO: 9425577 - DNA, 22 bp, Homo sapiens
ctggaaaatgaagaagcagagg

SEQ ID NO: 9425578 - DNA, 22 bp, Homo sapiens
ctgctttttgtaggtcccagag

SEQ ID NO: 9425579 - DNA, 20 bp, Homo sapiens
ctggaaaccctgctgatggt

SEQ ID NO: 9425580 - DNA, 22 bp, Homo sapiens
ctggaaaccaggcagttaagag

SEQ ID NO: 9425581 - DNA, 22 bp, Homo sapiens
ctgctttggcagaagtcagcta

SEQ ID NO: 9425582 - DNA, 22 bp, Homo sapiens
ctgctttgggcagctttgtggc

SEQ ID NO: 9425583 - DNA, 22 bp, Homo sapiens
ctgctttggctcagtgacatca

SEQ ID NO: 9425584 - DNA, 22 bp, Homo sapiens
ctgctttgcatagctgccagag

SEQ ID NO: 9425585 - DNA, 22 bp, Homo sapiens
ctgctttggacaactattcttg

SEQ ID NO: 9425586 - DNA, 18 bp, Homo sapiens
ctgctttgccttcattcc

SEQ ID NO: 9425587 - DNA, 22 bp, Homo sapiens
ctgctttgtaaaatagacataa

SEQ ID NO: 9425588 - DNA, 22 bp, Homo sapiens
ctgctttgtggaatcacactgg

SEQ ID NO: 9425589 - DNA, 17 bp, Homo sapiens
ctgctttgtgcaacgct

SEQ ID NO: 9425590 - DNA, 22 bp, Homo sapiens
ctgctttgtggaatcacactgg

SEQ ID NO: 9425591 - DNA, 22 bp, Homo sapiens
ctgctttgaggggctctgtata

SEQ ID NO: 9425592 - DNA, 22 bp, Homo sapiens
ctgctttgactgttaagaacca

SEQ ID NO: 9425593 - DNA, 22 bp, Homo sapiens
ctgctttgcatagctgccagag

SEQ ID NO: 9425594 - DNA, 22 bp, Homo sapiens
ctgctttgattagaagagtaca

SEQ ID NO: 9425595 - DNA, 22 bp, Homo sapiens
ctgctttgattagaagagtaca

SEQ ID NO: 9425596 - DNA, 22 bp, Homo sapiens
ctgctttctgcaccccaggtcg

SEQ ID NO: 9425597 - DNA, 23 bp, Homo sapiens
ctgctttcccactccatgctctt

SEQ ID NO: 9425598 - DNA, 22 bp, Homo sapiens
ctgctttgaaaataaacttgtc

SEQ ID NO: 9425599 - DNA, 22 bp, Homo sapiens
ctgctttgactgttaagaacca

SEQ ID NO: 9425600 - DNA, 22 bp, Homo sapiens
ctgcctggctaaactcaagtcg

SEQ ID NO: 9425601 - DNA, 22 bp, Homo sapiens
ctgcctggctaaactcaagtcg

SEQ ID NO: 9425602 - DNA, 22 bp, Homo sapiens
ctgcctggctaaactcaagtcg

SEQ ID NO: 9425603 - DNA, 22 bp, Homo sapiens
ctgcctggcccagggatgggcc

SEQ ID NO: 9425604 - DNA, 22 bp, Homo sapiens
ctgcctggcccagggatgggcc

SEQ ID NO: 9425605 - DNA, 22 bp, Homo sapiens
ctgcctgggccatgcccagtcc

SEQ ID NO: 9425606 - DNA, 22 bp, Homo sapiens
ctgcctgggccggccaccctct

SEQ ID NO: 9425607 - DNA, 19 bp, Homo sapiens
ctgcttccttccctcactg

SEQ ID NO: 9425608 - DNA, 21 bp, Homo sapiens
ctgctttacttcagaggatct

SEQ ID NO: 9425609 - DNA, 22 bp, Homo sapiens
ctgctttaggtggaatgttcta

SEQ ID NO: 9425610 - DNA, 22 bp, Homo sapiens
ctgctttagtgtggtgttagag

SEQ ID NO: 9425611 - DNA, 22 bp, Homo sapiens
ctgctttaggtggaatgttcta

SEQ ID NO: 9425612 - DNA, 22 bp, Homo sapiens
ctgcctggaatgccagcttctc

SEQ ID NO: 9425613 - DNA, 22 bp, Homo sapiens
ctgcctgctctatccaggcctg

SEQ ID NO: 9425614 - DNA, 22 bp, Homo sapiens
ctgcctgctcaccagggctctg

SEQ ID NO: 9425615 - DNA, 22 bp, Homo sapiens
ctgcctgctcaccagggctctg

SEQ ID NO: 9425616 - DNA, 22 bp, Homo sapiens
ctgcctgctacctgaaatgcca

SEQ ID NO: 9425617 - DNA, 22 bp, Homo sapiens
ctgcctggaatgccagcttctc

SEQ ID NO: 9425618 - DNA, 22 bp, Homo sapiens
ctgcctggaatgccagcttctc

SEQ ID NO: 9425619 - DNA, 22 bp, Homo sapiens
ctgcctggagcattctgaaggt

SEQ ID NO: 9425620 - DNA, 22 bp, Homo sapiens
ctgcctggaccggcagccctcc

SEQ ID NO: 9425621 - DNA, 22 bp, Homo sapiens
ctgcctggaccggcagccctcc

SEQ ID NO: 9425622 - DNA, 20 bp, Homo sapiens
ctgcctggaggcctctacct

SEQ ID NO: 9425623 - DNA, 17 bp, Homo sapiens
ctgcctggagtcccatc

SEQ ID NO: 9425624 - DNA, 17 bp, Homo sapiens
ctgcctggagtcccatc

SEQ ID NO: 9425625 - DNA, 22 bp, Homo sapiens
ctgcctggatgaatggcgcctt

SEQ ID NO: 9425626 - DNA, 22 bp, Homo sapiens
ctgcctggatgaatggcgcctt

SEQ ID NO: 9425627 - DNA, 22 bp, Homo sapiens
ctgcctggcatagtctggtcga

SEQ ID NO: 9425628 - DNA, 22 bp, Homo sapiens
ctgcctggcatagtctggtcga

SEQ ID NO: 9425629 - DNA, 22 bp, Homo sapiens
ctgcctggcatggagaagagaa

SEQ ID NO: 9425630 - DNA, 22 bp, Homo sapiens
ctgcctggcatggagaagagaa

SEQ ID NO: 9425631 - DNA, 22 bp, Homo sapiens
ctgcctggccacaacccagggt

SEQ ID NO: 9425632 - DNA, 22 bp, Homo sapiens
ctgcctggccacaacccagggt

SEQ ID NO: 9425633 - DNA, 22 bp, Homo sapiens
ctgcctggccacaacccagggt

SEQ ID NO: 9425634 - DNA, 22 bp, Homo sapiens
ttcctttctctggactgcagcc

SEQ ID NO: 9425635 - DNA, 22 bp, Homo sapiens
ttccttttagaatcatgaagac

SEQ ID NO: 9425636 - DNA, 22 bp, Homo sapiens
ttccttttatttgtccaggctt

SEQ ID NO: 9425637 - DNA, 22 bp, Homo sapiens
ttcctttcacgttttaatgcac

SEQ ID NO: 9425638 - DNA, 22 bp, Homo sapiens
ttcctttccctcacagcctcgg

SEQ ID NO: 9425639 - DNA, 22 bp, Homo sapiens
ttccttctaattttacacctga

SEQ ID NO: 9425640 - DNA, 22 bp, Homo sapiens
ttccttttctcacggggatcca

SEQ ID NO: 9425641 - DNA, 22 bp, Homo sapiens
ttccttttcttaaacatatgtg

SEQ ID NO: 9425642 - DNA, 22 bp, Homo sapiens
ttccttttcttctaccacatgt

SEQ ID NO: 9425643 - DNA, 22 bp, Homo sapiens
ttccttttcttctaccacatgt

SEQ ID NO: 9425644 - DNA, 22 bp, Homo sapiens
ttccttttcttctaccacatgt

SEQ ID NO: 9425645 - DNA, 22 bp, Homo sapiens
ttccttttcttaaacatatgtg

SEQ ID NO: 9425646 - DNA, 22 bp, Homo sapiens
ttccttttcttatgcatcatta

SEQ ID NO: 9425647 - DNA, 22 bp, Homo sapiens
ctagcccaggaatgccgtggcc

SEQ ID NO: 9425648 - DNA, 20 bp, Homo sapiens
ctaggcagcgagtgactgag

SEQ ID NO: 9425649 - DNA, 22 bp, Homo sapiens
ctaggcagactgagctctaggg

SEQ ID NO: 9425650 - DNA, 22 bp, Homo sapiens
ctaggcagactgagctctaggg

SEQ ID NO: 9425651 - DNA, 22 bp, Homo sapiens
ctagggaatataatgtatgcca

SEQ ID NO: 9425652 - DNA, 22 bp, Homo sapiens
ctagggaaagtggacatggctt

SEQ ID NO: 9425653 - DNA, 22 bp, Homo sapiens
ctagggaatgagagactggatc

SEQ ID NO: 9425654 - DNA, 22 bp, Homo sapiens
ctagggagactcgcaggactca

SEQ ID NO: 9425655 - DNA, 22 bp, Homo sapiens
ctagggagactcgcaggactca

SEQ ID NO: 9425656 - DNA, 22 bp, Homo sapiens
ctaggctgttcatgctcagacc

SEQ ID NO: 9425657 - DNA, 22 bp, Homo sapiens
ctaggctggagtgcagtggcat

SEQ ID NO: 9425658 - DNA, 22 bp, Homo sapiens
ctaggctggagtgcagtggcac

SEQ ID NO: 9425659 - DNA, 22 bp, Homo sapiens
ctaggcatccagactgggcttg

SEQ ID NO: 9425660 - DNA, 22 bp, Homo sapiens
ctaggccagagagacctcatga

SEQ ID NO: 9425661 - DNA, 22 bp, Homo sapiens
ctaggcagctttgggtgtgaag

SEQ ID NO: 9425662 - DNA, 22 bp, Homo sapiens
ctaggcagggtgctgtgccatg

SEQ ID NO: 9425663 - DNA, 22 bp, Homo sapiens
ctaggcccatgaggtttgctgg

SEQ ID NO: 9425664 - DNA, 22 bp, Homo sapiens
ctaggccttcataggcatggaa

SEQ ID NO: 9425665 - DNA, 22 bp, Homo sapiens
ctaggccagttaggaagagaag

SEQ ID NO: 9425666 - DNA, 22 bp, Homo sapiens
ctaggccatattttgagaactg

SEQ ID NO: 9425667 - DNA, 22 bp, Homo sapiens
ctaggctcagtctctggtctgt

SEQ ID NO: 9425668 - DNA, 22 bp, Homo sapiens
ctaggctctgccagcactgtcg

SEQ ID NO: 9425669 - DNA, 22 bp, Homo sapiens
ctaggctgagctgggctgagct

SEQ ID NO: 9425670 - DNA, 22 bp, Homo sapiens
ctaggctgagctgggctgagct

SEQ ID NO: 9425671 - DNA, 22 bp, Homo sapiens
ctattcactgtggcagagggag

SEQ ID NO: 9425672 - DNA, 22 bp, Homo sapiens
ctattcactgtggcagagggag

SEQ ID NO: 9425673 - DNA, 22 bp, Homo sapiens
ctatttatgtgctattttgtat

SEQ ID NO: 9425674 - DNA, 22 bp, Homo sapiens
ctatttattgtgggtatccagg

SEQ ID NO: 9425675 - DNA, 22 bp, Homo sapiens
ctagggcactaggactcatgtg

SEQ ID NO: 9425676 - DNA, 22 bp, Homo sapiens
ctagggcactaggactcatgtg

SEQ ID NO: 9425677 - DNA, 22 bp, Homo sapiens
ctagggagggatgttggcatga

SEQ ID NO: 9425678 - DNA, 22 bp, Homo sapiens
ctagggagcactagctgccttg

SEQ ID NO: 9425679 - DNA, 22 bp, Homo sapiens
ctagggagactcgcaggactca

SEQ ID NO: 9425680 - DNA, 23 bp, Homo sapiens
ctagggcagtatttcacagacac

SEQ ID NO: 9425681 - DNA, 22 bp, Homo sapiens
ctagggcagggagtgtttgcgc

SEQ ID NO: 9425682 - DNA, 22 bp, Homo sapiens
ctagggccaaaggctgtgatgc

SEQ ID NO: 9425683 - DNA, 23 bp, Homo sapiens
ctagggcagtatttcacagacac

SEQ ID NO: 9425684 - DNA, 22 bp, Homo sapiens
ctagggctccaaagctgagaag

SEQ ID NO: 9425685 - DNA, 22 bp, Homo sapiens
ctagggccaaaggctgtgatgc

SEQ ID NO: 9425686 - DNA, 22 bp, Homo sapiens
ctatttctgcctaatgacctgt

SEQ ID NO: 9425687 - DNA, 22 bp, Homo sapiens
ctatttggatgttagcctcagt

SEQ ID NO: 9425688 - DNA, 22 bp, Homo sapiens
ctatttgaagttgcagagatga

SEQ ID NO: 9425689 - DNA, 22 bp, Homo sapiens
ctatttggggtagaagatggat

SEQ ID NO: 9425690 - DNA, 22 bp, Homo sapiens
ctatttggccaagctgcccaca

SEQ ID NO: 9425691 - DNA, 22 bp, Homo sapiens
ctatttctaaacctataagtga

SEQ ID NO: 9425692 - DNA, 22 bp, Homo sapiens
ctatttcatgttcctatggccg

SEQ ID NO: 9425693 - DNA, 22 bp, Homo sapiens
ctatttcagctgcctttgactg

SEQ ID NO: 9425694 - DNA, 22 bp, Homo sapiens
ctatttcagctgcctttgactg

SEQ ID NO: 9425695 - DNA, 22 bp, Homo sapiens
ttctgtcaaatgccagtagaga

SEQ ID NO: 9425696 - DNA, 22 bp, Homo sapiens
ttctgtcacagtgctggtatca

SEQ ID NO: 9425697 - DNA, 22 bp, Homo sapiens
ttctgtcacttttttggaatct

SEQ ID NO: 9425698 - DNA, 22 bp, Homo sapiens
ttctgtcacttgcaatcaagag

SEQ ID NO: 9425699 - DNA, 22 bp, Homo sapiens
ttctgtcagcgtcagaaattct

SEQ ID NO: 9425700 - DNA, 22 bp, Homo sapiens
ttcttcccttcattccaccacc

SEQ ID NO: 9425701 - DNA, 22 bp, Homo sapiens
ttctgtccactgctggggcctc

SEQ ID NO: 9425702 - DNA, 22 bp, Homo sapiens
ttcttcctcacactctcaccca

SEQ ID NO: 9425703 - DNA, 22 bp, Homo sapiens
ttcttcctcacactctcaccca

SEQ ID NO: 9425704 - DNA, 22 bp, Homo sapiens
ttcttggaaatacattcaataa

SEQ ID NO: 9425705 - DNA, 22 bp, Homo sapiens
ttcttggatgccctcatgcctt

SEQ ID NO: 9425706 - DNA, 22 bp, Homo sapiens
ttcttggagataaattcttaca

SEQ ID NO: 9425707 - DNA, 22 bp, Homo sapiens
ttcttggagataaattcttaca

SEQ ID NO: 9425708 - DNA, 22 bp, Homo sapiens
ttctgtatattgaggttatagt

SEQ ID NO: 9425709 - DNA, 22 bp, Homo sapiens
ttctgtatattgtaaagactca

SEQ ID NO: 9425710 - DNA, 22 bp, Homo sapiens
ttctgtatctttcttcaagatt

SEQ ID NO: 9425711 - DNA, 22 bp, Homo sapiens
ctattttaacttgattacctct

SEQ ID NO: 9425712 - DNA, 22 bp, Homo sapiens
ttctgtaggcatggaacaggga

SEQ ID NO: 9425713 - DNA, 22 bp, Homo sapiens
ttctgtaggcatggaacaggga

SEQ ID NO: 9425714 - DNA, 22 bp, Homo sapiens
ttctgtaggacttctgccaact

SEQ ID NO: 9425715 - DNA, 22 bp, Homo sapiens
ctattttaacttgattacctct

SEQ ID NO: 9425716 - DNA, 22 bp, Homo sapiens
ttctgtacttcaggggctctgt

SEQ ID NO: 9425717 - DNA, 22 bp, Homo sapiens
ttcttgttggcctcaggtttgc

SEQ ID NO: 9425718 - DNA, 22 bp, Homo sapiens
ttcttgttctggttctgttagc

SEQ ID NO: 9425719 - DNA, 22 bp, Homo sapiens
ttcttgttctcctcatttagag

SEQ ID NO: 9425720 - DNA, 22 bp, Homo sapiens
ttcttgttctcctcatttagag

SEQ ID NO: 9425721 - DNA, 22 bp, Homo sapiens
ttcttggggttccacaatggga

SEQ ID NO: 9425722 - DNA, 22 bp, Homo sapiens
ttcttgggtcctgtcgttgccc

SEQ ID NO: 9425723 - DNA, 22 bp, Homo sapiens
ttcttggcatcatgaaaaatta

SEQ ID NO: 9425724 - DNA, 22 bp, Homo sapiens
ctattttccgcagcaggaagta

SEQ ID NO: 9425725 - DNA, 22 bp, Homo sapiens
ctattttctgtctctatagagt

SEQ ID NO: 9425726 - DNA, 22 bp, Homo sapiens
ctattttctgtctctatagagt

SEQ ID NO: 9425727 - DNA, 22 bp, Homo sapiens
ctattttctgtctctatagagt

SEQ ID NO: 9425728 - DNA, 22 bp, Homo sapiens
ctattttaagaggccattaggt

SEQ ID NO: 9425729 - DNA, 22 bp, Homo sapiens
ctattttaagaggccattaggt

SEQ ID NO: 9425730 - DNA, 22 bp, Homo sapiens
ctattttcattcttacattgtc

SEQ ID NO: 9425731 - DNA, 22 bp, Homo sapiens
ctattttcattcttacattgtc

SEQ ID NO: 9425732 - DNA, 22 bp, Homo sapiens
ctattttcattcttacattgtc

SEQ ID NO: 9425733 - DNA, 22 bp, Homo sapiens
ctattttcccatatggttgaca

SEQ ID NO: 9425734 - DNA, 22 bp, Homo sapiens
ttcttgtttattaagatataaa

SEQ ID NO: 9425735 - DNA, 22 bp, Homo sapiens
ttctttaaaatagtgagaaaga

SEQ ID NO: 9425736 - DNA, 22 bp, Homo sapiens
ctattttaacttgattacctct

SEQ ID NO: 9425737 - DNA, 22 bp, Homo sapiens
ctcagcaggcactgtgccttac

SEQ ID NO: 9425738 - DNA, 22 bp, Homo sapiens
ctcagcaggtaccacatgatct

SEQ ID NO: 9425739 - DNA, 17 bp, Homo sapiens
ctcagcagggctcactt

SEQ ID NO: 9425740 - DNA, 22 bp, Homo sapiens
ctcagcagctgctgctggtggg

SEQ ID NO: 9425741 - DNA, 22 bp, Homo sapiens
ctcagcagctacaggattcggg

SEQ ID NO: 9425742 - DNA, 22 bp, Homo sapiens
ctcagcagctgctgctggtggg

SEQ ID NO: 9425743 - DNA, 22 bp, Homo sapiens
ctcagcagaggcagtattcagt

SEQ ID NO: 9425744 - DNA, 22 bp, Homo sapiens
ctatttttctgtaccctaattt

SEQ ID NO: 9425745 - DNA, 22 bp, Homo sapiens
ctatttttctgtaccctaattt

SEQ ID NO: 9425746 - DNA, 22 bp, Homo sapiens
ctatttttctgtaccctaattt

SEQ ID NO: 9425747 - DNA, 22 bp, Homo sapiens
ctcagagggaggactgggctgg

SEQ ID NO: 9425748 - DNA, 22 bp, Homo sapiens
ctatttttctgtaccctaattt

SEQ ID NO: 9425749 - DNA, 17 bp, Homo sapiens
ctattttggagattaaa

SEQ ID NO: 9425750 - DNA, 22 bp, Homo sapiens
ctcagagggaggactgggctgg

SEQ ID NO: 9425751 - DNA, 22 bp, Homo sapiens
ctcagagggaggactgggctgg

SEQ ID NO: 9425752 - DNA, 22 bp, Homo sapiens
ctcagaggggatgcttggagaa

SEQ ID NO: 9425753 - DNA, 22 bp, Homo sapiens
ctcagcacccgggcctttcctc

SEQ ID NO: 9425754 - DNA, 22 bp, Homo sapiens
ctcagcacccgggcctttcctc

SEQ ID NO: 9425755 - DNA, 22 bp, Homo sapiens
ctcagcaccccgacaggacatt

SEQ ID NO: 9425756 - DNA, 22 bp, Homo sapiens
ctcagcactgacccaggagatg

SEQ ID NO: 9425757 - DNA, 19 bp, Homo sapiens
ctcagcacttttacacagg

SEQ ID NO: 9425758 - DNA, 22 bp, Homo sapiens
ctcagcactttggaaggctgat

SEQ ID NO: 9425759 - DNA, 20 bp, Homo sapiens
ttgagcttttagtacagaca

SEQ ID NO: 9425760 - DNA, 23 bp, Homo sapiens
ttgaggacaatttacatggtgtt

SEQ ID NO: 9425761 - DNA, 22 bp, Homo sapiens
ttgaggaaaggaatttatttta

SEQ ID NO: 9425762 - DNA, 22 bp, Homo sapiens
ttgaggaaaggaatttatttta

SEQ ID NO: 9425763 - DNA, 22 bp, Homo sapiens
ttgaggactgtggtccccaaag

SEQ ID NO: 9425764 - DNA, 22 bp, Homo sapiens
ttgaggacaggctgattgtata

SEQ ID NO: 9425765 - DNA, 23 bp, Homo sapiens
ttgaggacaatttacatggtgtt

SEQ ID NO: 9425766 - DNA, 22 bp, Homo sapiens
ttgaggaggcctttcagggctt

SEQ ID NO: 9425767 - DNA, 22 bp, Homo sapiens
ttgaggaggtagtacagagtat

SEQ ID NO: 9425768 - DNA, 22 bp, Homo sapiens
ttgaggaggacagaaacattta

SEQ ID NO: 9425769 - DNA, 22 bp, Homo sapiens
ttgaggagtacaaagcatgctt

SEQ ID NO: 9425770 - DNA, 22 bp, Homo sapiens
ttgaggagtagaagctttgaat

SEQ ID NO: 9425771 - DNA, 22 bp, Homo sapiens
ttgataaaatgatatcttcttt

SEQ ID NO: 9425772 - DNA, 22 bp, Homo sapiens
ttgataaaatgatatcttcttt

SEQ ID NO: 9425773 - DNA, 22 bp, Homo sapiens
ttgataaaatgatatcttcttt

SEQ ID NO: 9425774 - DNA, 22 bp, Homo sapiens
ttgataaaatgatgaaatcact

SEQ ID NO: 9425775 - DNA, 23 bp, Homo sapiens
ttgatacagaagaatcagtttgt

SEQ ID NO: 9425776 - DNA, 23 bp, Homo sapiens
ttgatacagaagaatcagtttgt

SEQ ID NO: 9425777 - DNA, 22 bp, Homo sapiens
ttgatacacaatggaacaatgt

SEQ ID NO: 9425778 - DNA, 22 bp, Homo sapiens
ttgatacagcagcctgtgatcc

SEQ ID NO: 9425779 - DNA, 22 bp, Homo sapiens
ttgatacaggccttctagatga

SEQ ID NO: 9425780 - DNA, 18 bp, Homo sapiens
ttgataaacaatttcatt

SEQ ID NO: 9425781 - DNA, 18 bp, Homo sapiens
ttgataaacaatttcatt

SEQ ID NO: 9425782 - DNA, 18 bp, Homo sapiens
ttgataaacaatttcatt

SEQ ID NO: 9425783 - DNA, 22 bp, Homo sapiens
ttgataaaatgatgaaatcact

SEQ ID NO: 9425784 - DNA, 22 bp, Homo sapiens
ctcagcagtatactctgaagat

SEQ ID NO: 9425785 - DNA, 22 bp, Homo sapiens
ctcagcagtaaacgtccggaac

SEQ ID NO: 9425786 - DNA, 22 bp, Homo sapiens
ttgaccctggtgtcagagatgg

SEQ ID NO: 9425787 - DNA, 22 bp, Homo sapiens
ttgacctggaaggtgcttcctg

SEQ ID NO: 9425788 - DNA, 20 bp, Homo sapiens
ttgacctgcaagtcatcatt

SEQ ID NO: 9425789 - DNA, 22 bp, Homo sapiens
ttgactgtacaaccttttgtag

SEQ ID NO: 9425790 - DNA, 22 bp, Homo sapiens
ttgactctggaggtcactgaag

SEQ ID NO: 9425791 - DNA, 22 bp, Homo sapiens
ttgactctaaatttacttttcc

SEQ ID NO: 9425792 - DNA, 22 bp, Homo sapiens
ttgactttacagttttcttagg

SEQ ID NO: 9425793 - DNA, 22 bp, Homo sapiens
ttgagaaaatagttcgaatgtt

SEQ ID NO: 9425794 - DNA, 22 bp, Homo sapiens
ttgagaaaatagttcgaatgtt

SEQ ID NO: 9425795 - DNA, 22 bp, Homo sapiens
ttgagaaacatctaatctttgt

SEQ ID NO: 9425796 - DNA, 22 bp, Homo sapiens
ttgagaaacagattggcaccgt

SEQ ID NO: 9425797 - DNA, 22 bp, Homo sapiens
ttgagaaaatagttcgaatgtt

SEQ ID NO: 9425798 - DNA, 22 bp, Homo sapiens
ttgagaaaagctgtgtaaggat

SEQ ID NO: 9425799 - DNA, 22 bp, Homo sapiens
ttgagaaaaccatcgtaagaat

SEQ ID NO: 9425800 - DNA, 22 bp, Homo sapiens
ttgagaaaagctgtgtaaggat

SEQ ID NO: 9425801 - DNA, 22 bp, Homo sapiens
ttgagaaaagctgtgtaaggat

SEQ ID NO: 9425802 - DNA, 22 bp, Homo sapiens
ttgagaaaacacagagtttatt

SEQ ID NO: 9425803 - DNA, 22 bp, Homo sapiens
ttgagaaaacacagagtttatt

SEQ ID NO: 9425804 - DNA, 22 bp, Homo sapiens
ttgagaaaacattgagggccat

SEQ ID NO: 9425805 - DNA, 22 bp, Homo sapiens
ttgagaaaaccatcgtaagaat

SEQ ID NO: 9425806 - DNA, 22 bp, Homo sapiens
ttgagaaaacacagagtttatt

SEQ ID NO: 9425807 - DNA, 22 bp, Homo sapiens
ttgagctttgaagttcaatatt

SEQ ID NO: 9425808 - DNA, 22 bp, Homo sapiens
ttgagcttgaggagttatttga

SEQ ID NO: 9425809 - DNA, 22 bp, Homo sapiens
ttgagctgtaaggtgggatgtg

SEQ ID NO: 9425810 - DNA, 22 bp, Homo sapiens
ttgagctgtatacctatgactg

SEQ ID NO: 9425811 - DNA, 20 bp, Homo sapiens
ttgagcttccaagtctttgt

SEQ ID NO: 9425812 - DNA, 22 bp, Homo sapiens
ttgagcttgaggagttatttga

SEQ ID NO: 9425813 - DNA, 22 bp, Homo sapiens
ttgagctgcctggctgtggctc

SEQ ID NO: 9425814 - DNA, 22 bp, Homo sapiens
ttgagaaacatctaatctttgt

SEQ ID NO: 9425815 - DNA, 22 bp, Homo sapiens
ttgagaaacatctaatctttgt

SEQ ID NO: 9425816 - DNA, 22 bp, Homo sapiens
cggctgaggatctccaggcctg

SEQ ID NO: 9425817 - DNA, 22 bp, Homo sapiens
cggctgagcagtgctgatggaa

SEQ ID NO: 9425818 - DNA, 23 bp, Homo sapiens
cggctgctcggccgagtcctcgg

SEQ ID NO: 9425819 - DNA, 22 bp, Homo sapiens
cggctctgtcctcagcactgct

SEQ ID NO: 9425820 - DNA, 22 bp, Homo sapiens
cggctgagacggccatagacac

SEQ ID NO: 9425821 - DNA, 22 bp, Homo sapiens
cggctgctgcctgagtcgctgt

SEQ ID NO: 9425822 - DNA, 22 bp, Homo sapiens
cggctggggctgtccccatgac

SEQ ID NO: 9425823 - DNA, 22 bp, Homo sapiens
cggctggggctgtccccatgac

SEQ ID NO: 9425824 - DNA, 22 bp, Homo sapiens
cggctggggctgtccccatgac

SEQ ID NO: 9425825 - DNA, 22 bp, Homo sapiens
cggctgggtagaggtgccgggt

SEQ ID NO: 9425826 - DNA, 22 bp, Homo sapiens
ttcagaaaaaacttcaataagt

SEQ ID NO: 9425827 - DNA, 22 bp, Homo sapiens
ttcagaaaaaacttcaataagt

SEQ ID NO: 9425828 - DNA, 22 bp, Homo sapiens
ttcactgtttcatcctacttct

SEQ ID NO: 9425829 - DNA, 22 bp, Homo sapiens
ttcagaaaaagaccattgcaat

SEQ ID NO: 9425830 - DNA, 22 bp, Homo sapiens
ttcattcccttatattagcatt

SEQ ID NO: 9425831 - DNA, 22 bp, Homo sapiens
ttcattccttctgtaccttgcc

SEQ ID NO: 9425832 - DNA, 21 bp, Homo sapiens
ttcatgatacagttttagagt

SEQ ID NO: 9425833 - DNA, 22 bp, Homo sapiens
ttcatgagcagaagggaggggt

SEQ ID NO: 9425834 - DNA, 22 bp, Homo sapiens
ttcagaaaggttaatctggatt

SEQ ID NO: 9425835 - DNA, 21 bp, Homo sapiens
ttcatgagataaccagctgta

SEQ ID NO: 9425836 - DNA, 22 bp, Homo sapiens
ttcagaaaggttaatctggatt

SEQ ID NO: 9425837 - DNA, 22 bp, Homo sapiens
ttcagaaaggtaaatggatttc

SEQ ID NO: 9425838 - DNA, 22 bp, Homo sapiens
ttcattctcttagcatagtcct

SEQ ID NO: 9425839 - DNA, 22 bp, Homo sapiens
ttcattctcttagcatagtcct

SEQ ID NO: 9425840 - DNA, 19 bp, Homo sapiens
ttcattctcttattgttgt

SEQ ID NO: 9425841 - DNA, 22 bp, Homo sapiens
ttcattctgggctctaaggaac

SEQ ID NO: 9425842 - DNA, 22 bp, Homo sapiens
ttcattctgcagttctcagctc

SEQ ID NO: 9425843 - DNA, 22 bp, Homo sapiens
ttcattctgcagttctcagctc

SEQ ID NO: 9425844 - DNA, 19 bp, Homo sapiens
ttcattctcttattgttgt

SEQ ID NO: 9425845 - DNA, 22 bp, Homo sapiens
ttcattcttgggatcagagagt

SEQ ID NO: 9425846 - DNA, 22 bp, Homo sapiens
ttcattcttatttgtgatctgg

SEQ ID NO: 9425847 - DNA, 22 bp, Homo sapiens
ttccaaaatgccttgatatgat

SEQ ID NO: 9425848 - DNA, 22 bp, Homo sapiens
ttccaaaatgccttgatatgat

SEQ ID NO: 9425849 - DNA, 22 bp, Homo sapiens
ttccaaactgccaattcagaag

SEQ ID NO: 9425850 - DNA, 22 bp, Homo sapiens
ttccaaaatgccttgatatgat

SEQ ID NO: 9425851 - DNA, 22 bp, Homo sapiens
ttccaaacctcaaataattaat

SEQ ID NO: 9425852 - DNA, 22 bp, Homo sapiens
cggaaacttgagaaccagccag

SEQ ID NO: 9425853 - DNA, 22 bp, Homo sapiens
cgctttggatttcgctttccaa

SEQ ID NO: 9425854 - DNA, 22 bp, Homo sapiens
cggaaactacgtgacacccgtt

SEQ ID NO: 9425855 - DNA, 21 bp, Homo sapiens
cggaaactcggctctggttcc

SEQ ID NO: 9425856 - DNA, 22 bp, Homo sapiens
cgctttggagtccctgctttac

SEQ ID NO: 9425857 - DNA, 22 bp, Homo sapiens
cgctggtcaccatggcgtcctg

SEQ ID NO: 9425858 - DNA, 22 bp, Homo sapiens
cgctggtcaccatggcgtcctg

SEQ ID NO: 9425859 - DNA, 22 bp, Homo sapiens
cggctcaggccacaggacggca

SEQ ID NO: 9425860 - DNA, 22 bp, Homo sapiens
cggacaggctcctggagctcct

SEQ ID NO: 9425861 - DNA, 22 bp, Homo sapiens
cggacaggctcctggagctcct

SEQ ID NO: 9425862 - DNA, 22 bp, Homo sapiens
cgctgggggaacagcgagggtg

SEQ ID NO: 9425863 - DNA, 22 bp, Homo sapiens
cgctgggggaacagcgagggtg

SEQ ID NO: 9425864 - DNA, 22 bp, Homo sapiens
ttcacattaagcctcctcctac

SEQ ID NO: 9425865 - DNA, 22 bp, Homo sapiens
ttcacatgttggacatagagga

SEQ ID NO: 9425866 - DNA, 22 bp, Homo sapiens
ttcacatgttggacatagagga

SEQ ID NO: 9425867 - DNA, 22 bp, Homo sapiens
ttcacattaagcctcctcctac

SEQ ID NO: 9425868 - DNA, 22 bp, Homo sapiens
cgctgggcgccgacctgctggc

SEQ ID NO: 9425869 - DNA, 22 bp, Homo sapiens
cgctgggcgccgacctgctggc

SEQ ID NO: 9425870 - DNA, 22 bp, Homo sapiens
ttcacatgaaagtaggaaagga

SEQ ID NO: 9425871 - DNA, 22 bp, Homo sapiens
ttcacatggcaatagagaggga

SEQ ID NO: 9425872 - DNA, 22 bp, Homo sapiens
ttcacatctataacttagataa

SEQ ID NO: 9425873 - DNA, 22 bp, Homo sapiens
ttcacataatgatacaaagctt

SEQ ID NO: 9425874 - DNA, 22 bp, Homo sapiens
ttcacataggagcatggttttt

SEQ ID NO: 9425875 - DNA, 22 bp, Homo sapiens
ttcacataaatagatcacatca

SEQ ID NO: 9425876 - DNA, 22 bp, Homo sapiens
ttcacataatctgcagcaagcg

SEQ ID NO: 9425877 - DNA, 22 bp, Homo sapiens
ttcacataatctgcagcaagcg

SEQ ID NO: 9425878 - DNA, 22 bp, Homo sapiens
ttcacataatctgcagcaagcg

SEQ ID NO: 9425879 - DNA, 22 bp, Homo sapiens
ttcacagttcctgggaaaacag

SEQ ID NO: 9425880 - DNA, 22 bp, Homo sapiens
ttcacagttcctgggaaaacag

SEQ ID NO: 9425881 - DNA, 22 bp, Homo sapiens
ttcacagttcctgggaaaacag

SEQ ID NO: 9425882 - DNA, 22 bp, Homo sapiens
ttcacagtttgctgggacagga

SEQ ID NO: 9425883 - DNA, 22 bp, Homo sapiens
ttcacagtttaatggcaaggat

SEQ ID NO: 9425884 - DNA, 22 bp, Homo sapiens
ttcacataaaagctccaaagaa

SEQ ID NO: 9425885 - DNA, 22 bp, Homo sapiens
ttcacataaatagatcacatca

SEQ ID NO: 9425886 - DNA, 22 bp, Homo sapiens
ttcacataaatagatcacatca

SEQ ID NO: 9425887 - DNA, 22 bp, Homo sapiens
ttcacagtgtgatctatgggca

SEQ ID NO: 9425888 - DNA, 22 bp, Homo sapiens
ttcacagtggcttaggctatgg

SEQ ID NO: 9425889 - DNA, 22 bp, Homo sapiens
ttcacagactgcagactttttg

SEQ ID NO: 9425890 - DNA, 22 bp, Homo sapiens
ttcacagaccaggaggctgtga

SEQ ID NO: 9425891 - DNA, 22 bp, Homo sapiens
ttcacagacattgcagactgaa

SEQ ID NO: 9425892 - DNA, 22 bp, Homo sapiens
cctgggtggttccggcaaggag

SEQ ID NO: 9425893 - DNA, 22 bp, Homo sapiens
cctgggtggttccggcaaggag

SEQ ID NO: 9425894 - DNA, 22 bp, Homo sapiens
cctgggtggttccggcaaggag

SEQ ID NO: 9425895 - DNA, 22 bp, Homo sapiens
cctgggtggttccggcaaggag

SEQ ID NO: 9425896 - DNA, 22 bp, Homo sapiens
cctgggtggttccggcaaggag

SEQ ID NO: 9425897 - DNA, 22 bp, Homo sapiens
cctgggtggcagaggttgcagt

SEQ ID NO: 9425898 - DNA, 22 bp, Homo sapiens
cctgggtggcagaggttgcagt

SEQ ID NO: 9425899 - DNA, 22 bp, Homo sapiens
ttcccacacccatattgtgatt

SEQ ID NO: 9425900 - DNA, 22 bp, Homo sapiens
ttcccacagagattacattgaa

SEQ ID NO: 9425901 - DNA, 22 bp, Homo sapiens
ttcccacattctttacattcat

SEQ ID NO: 9425902 - DNA, 22 bp, Homo sapiens
ttccctggtgggtgagaacctg

SEQ ID NO: 9425903 - DNA, 22 bp, Homo sapiens
ttcccagaatgaatggatggag

SEQ ID NO: 9425904 - DNA, 22 bp, Homo sapiens
ttcccttcctcactctacttgt

SEQ ID NO: 9425905 - DNA, 22 bp, Homo sapiens
ttcccttcctcactctacttgt

SEQ ID NO: 9425906 - DNA, 22 bp, Homo sapiens
ttcccttcaaggtggcctaaag

SEQ ID NO: 9425907 - DNA, 22 bp, Homo sapiens
ttcccttaaattatggcatcta

SEQ ID NO: 9425908 - DNA, 22 bp, Homo sapiens
ttccgagggctcggcggccgcc

SEQ ID NO: 9425909 - DNA, 22 bp, Homo sapiens
ttcccttctagttttgagagac

SEQ ID NO: 9425910 - DNA, 22 bp, Homo sapiens
ttcccttctagttttgagagac

SEQ ID NO: 9425911 - DNA, 22 bp, Homo sapiens
ttcccttctagttttgagagac

SEQ ID NO: 9425912 - DNA, 21 bp, Homo sapiens
ttcccttctggttttgagaga

SEQ ID NO: 9425913 - DNA, 21 bp, Homo sapiens
ttcccttctggttttgagaga

SEQ ID NO: 9425914 - DNA, 22 bp, Homo sapiens
ttccggaaggttctctagaatt

SEQ ID NO: 9425915 - DNA, 22 bp, Homo sapiens
ttccgctgtttagttgaagttt

SEQ ID NO: 9425916 - DNA, 22 bp, Homo sapiens
ctaactttttgattcttgggga

SEQ ID NO: 9425917 - DNA, 22 bp, Homo sapiens
ctaagaaagtattgttttgtgg

SEQ ID NO: 9425918 - DNA, 22 bp, Homo sapiens
ctaaggcaccgaggcaggagcg

SEQ ID NO: 9425919 - DNA, 22 bp, Homo sapiens
ttccaaatgagttccatcgaat

SEQ ID NO: 9425920 - DNA, 22 bp, Homo sapiens
ttccaaagttattcaagcagta

SEQ ID NO: 9425921 - DNA, 22 bp, Homo sapiens
ttccaaagttagttattagaaa

SEQ ID NO: 9425922 - DNA, 22 bp, Homo sapiens
ttccaaagttagttattagaaa

SEQ ID NO: 9425923 - DNA, 22 bp, Homo sapiens
ttccaaagttagttattagaaa

SEQ ID NO: 9425924 - DNA, 22 bp, Homo sapiens
ttccaaagttattcaagcagta

SEQ ID NO: 9425925 - DNA, 22 bp, Homo sapiens
ttccaaagtcatgttgctgata

SEQ ID NO: 9425926 - DNA, 22 bp, Homo sapiens
ttccaaagtgctggaattacat

SEQ ID NO: 9425927 - DNA, 22 bp, Homo sapiens
ttccaaagcacttgatgtaaag

SEQ ID NO: 9425928 - DNA, 22 bp, Homo sapiens
ttccaaagcacttgatgtaaag

SEQ ID NO: 9425929 - DNA, 22 bp, Homo sapiens
ttccaaagctgctttatttagt

SEQ ID NO: 9425930 - DNA, 22 bp, Homo sapiens
ttccaaaggaatggggagctat

SEQ ID NO: 9425931 - DNA, 22 bp, Homo sapiens
ttccaaaggaatggggagctat

SEQ ID NO: 9425932 - DNA, 22 bp, Homo sapiens
ttccaaactgccaattcagaag

SEQ ID NO: 9425933 - DNA, 22 bp, Homo sapiens
ttccaaagaaattgaccaagac

SEQ ID NO: 9425934 - DNA, 22 bp, Homo sapiens
ttccaaactgccaattcagaag

SEQ ID NO: 9425935 - DNA, 22 bp, Homo sapiens
ttccaaactgccaattcagaag

SEQ ID NO: 9425936 - DNA, 22 bp, Homo sapiens
ttccatttggcacttcactgag

SEQ ID NO: 9425937 - DNA, 22 bp, Homo sapiens
ttccatttggcacttcactgag

SEQ ID NO: 9425938 - DNA, 22 bp, Homo sapiens
ttccatttttctaactctcaga

SEQ ID NO: 9425939 - DNA, 22 bp, Homo sapiens
ttccatttttctaactctcaga

SEQ ID NO: 9425940 - DNA, 22 bp, Homo sapiens
ttccatttttctaactctcaga

SEQ ID NO: 9425941 - DNA, 22 bp, Homo sapiens
ttcccacaatctgcgtgtgtat

SEQ ID NO: 9425942 - DNA, 22 bp, Homo sapiens
ttcccaaagctttgtctgtgaa

SEQ ID NO: 9425943 - DNA, 22 bp, Homo sapiens
ttccaggatgggctgtcctact

SEQ ID NO: 9425944 - DNA, 22 bp, Homo sapiens
ttccaggcaaaggaagcagctt

SEQ ID NO: 9425945 - DNA, 21 bp, Homo sapiens
ttccaggattgcttattttta

SEQ ID NO: 9425946 - DNA, 22 bp, Homo sapiens
ttccatttggcacttcactgag

SEQ ID NO: 9425947 - DNA, 22 bp, Homo sapiens
ttccatttggcacttcactgag

SEQ ID NO: 9425948 - DNA, 22 bp, Homo sapiens
ttccatttggagctcgcagcct

SEQ ID NO: 9425949 - DNA, 22 bp, Homo sapiens
ttccatttggcacttcactgag

SEQ ID NO: 9425950 - DNA, 22 bp, Homo sapiens
ttccatttattcttgtccagat

SEQ ID NO: 9425951 - DNA, 22 bp, Homo sapiens
ttccatttattcttgtccagat

SEQ ID NO: 9425952 - DNA, 22 bp, Homo sapiens
ttccatttattcttgtccagat

SEQ ID NO: 9425953 - DNA, 22 bp, Homo sapiens
ctaaggctaagaaattgtgtgt

SEQ ID NO: 9425954 - DNA, 22 bp, Homo sapiens
ctaaggcaggtccattccagga

SEQ ID NO: 9425955 - DNA, 22 bp, Homo sapiens
ctaagggttgaaacagcaagaa

SEQ ID NO: 9425956 - DNA, 22 bp, Homo sapiens
ctaataacatgaactactttct

SEQ ID NO: 9425957 - DNA, 22 bp, Homo sapiens
ctaataatagaggtggcatttg

SEQ ID NO: 9425958 - DNA, 22 bp, Homo sapiens
ctaataacatgaactactttct

SEQ ID NO: 9425959 - DNA, 22 bp, Homo sapiens
ctaagggttgaaacagcaagaa

SEQ ID NO: 9425960 - DNA, 22 bp, Homo sapiens
ctaagtcatggaaagtgtgtgt

SEQ ID NO: 9425961 - DNA, 22 bp, Homo sapiens
ctaatcatctttctcttaaagc

SEQ ID NO: 9425962 - DNA, 22 bp, Homo sapiens
ctaatgtaatgatatgttgaat

SEQ ID NO: 9425963 - DNA, 22 bp, Homo sapiens
ctaataatagaggtggcatttg

SEQ ID NO: 9425964 - DNA, 22 bp, Homo sapiens
ctaatagagcttcggaactctg

SEQ ID NO: 9425965 - DNA, 22 bp, Homo sapiens
ctacaaaagtaattgtggtttt

SEQ ID NO: 9425966 - DNA, 22 bp, Homo sapiens
ctacaaaagtaattgtggtttt

SEQ ID NO: 9425967 - DNA, 22 bp, Homo sapiens
ctaatttttgttctgcattgaa

SEQ ID NO: 9425968 - DNA, 22 bp, Homo sapiens
ctaatttaatgaatgagtctta

SEQ ID NO: 9425969 - DNA, 22 bp, Homo sapiens
ctaattctttggagacaatctg

SEQ ID NO: 9425970 - DNA, 22 bp, Homo sapiens
ctaattctgtatttggtcattg

SEQ ID NO: 9425971 - DNA, 22 bp, Homo sapiens
ctaattgtaagctccttgaggg

SEQ ID NO: 9425972 - DNA, 22 bp, Homo sapiens
ctaattctttggagacaatctg

SEQ ID NO: 9425973 - DNA, 22 bp, Homo sapiens
ctaatttaatgaatgagtctta

SEQ ID NO: 9425974 - DNA, 22 bp, Homo sapiens
ctaattgtttgtgttgtcacct

SEQ ID NO: 9425975 - DNA, 22 bp, Homo sapiens
ctaatttaatgaatgagtctta

SEQ ID NO: 9425976 - DNA, 22 bp, Homo sapiens
ctaattgtaccagatttctctt

SEQ ID NO: 9425977 - DNA, 22 bp, Homo sapiens
ctaattatgttgttataatcaa

SEQ ID NO: 9425978 - DNA, 22 bp, Homo sapiens
ctaatgtatcatggctctcagc

SEQ ID NO: 9425979 - DNA, 22 bp, Homo sapiens
ctaatgtaaagcatttgttcag

SEQ ID NO: 9425980 - DNA, 22 bp, Homo sapiens
ctaattctgaaacagtgtcaat

SEQ ID NO: 9425981 - DNA, 22 bp, Homo sapiens
ctaattctcagcatgaactggt

SEQ ID NO: 9425982 - DNA, 22 bp, Homo sapiens
ctacaaaagtaattgtggtttt

SEQ ID NO: 9425983 - DNA, 22 bp, Homo sapiens
ctacaaaagtaattgtggtttt

SEQ ID NO: 9425984 - DNA, 22 bp, Homo sapiens
ctacaaaagtaattgtggtttt

SEQ ID NO: 9425985 - DNA, 22 bp, Homo sapiens
ctacaaagtaccacagactggg

SEQ ID NO: 9425986 - DNA, 22 bp, Homo sapiens
ctacaaatataaaacacagata

SEQ ID NO: 9425987 - DNA, 22 bp, Homo sapiens
ctacaaagctcttctacaggca

SEQ ID NO: 9425988 - DNA, 20 bp, Homo sapiens
ttcctggggaatgatagaag

SEQ ID NO: 9425989 - DNA, 22 bp, Homo sapiens
ttccttccacttcaggattttg

SEQ ID NO: 9425990 - DNA, 22 bp, Homo sapiens
ttcctggggacttaccgtcatt

SEQ ID NO: 9425991 - DNA, 22 bp, Homo sapiens
ctacaaatataaaacacagata

SEQ ID NO: 9425992 - DNA, 22 bp, Homo sapiens
ctacaaatccacaaggcacttt

SEQ ID NO: 9425993 - DNA, 21 bp, Homo sapiens
ttcctggggaaggagctgcct

SEQ ID NO: 9425994 - DNA, 21 bp, Homo sapiens
ttcctggggaaggagctgcct

SEQ ID NO: 9425995 - DNA, 21 bp, Homo sapiens
ttcctggggaaggagctgcct

SEQ ID NO: 9425996 - DNA, 22 bp, Homo sapiens
ttccttccagcttgtgacagtc

SEQ ID NO: 9425997 - DNA, 22 bp, Homo sapiens
ttccttccagcttgtgacagtc

SEQ ID NO: 9425998 - DNA, 22 bp, Homo sapiens
ttccttccatagcaaaacatgc

SEQ ID NO: 9425999 - DNA, 22 bp, Homo sapiens
ttccttccatagcaaaacatgc

SEQ ID NO: 9426000 - DNA, 22 bp, Homo sapiens
ttccttccgggcaccaggcact

SEQ ID NO: 9426001 - DNA, 22 bp, Homo sapiens
ttccttccgggcaccaggcact

SEQ ID NO: 9426002 - DNA, 22 bp, Homo sapiens
ttccttccctcagtggctgaag

SEQ ID NO: 9426003 - DNA, 22 bp, Homo sapiens
ttccttcccctagctgagaaac

SEQ ID NO: 9426004 - DNA, 22 bp, Homo sapiens
ttccttcctgtcttccttactg

SEQ ID NO: 9426005 - DNA, 22 bp, Homo sapiens
ttccttctaatattctgcctgt

SEQ ID NO: 9426006 - DNA, 22 bp, Homo sapiens
ttccttcctctttcacaacagc

SEQ ID NO: 9426007 - DNA, 22 bp, Homo sapiens
ttccttcctctttcacaacagc

SEQ ID NO: 9426008 - DNA, 22 bp, Homo sapiens
ttccttcctcctccagttctgg

SEQ ID NO: 9426009 - DNA, 22 bp, Homo sapiens
ctcagtttcttactctgtataa

SEQ ID NO: 9426010 - DNA, 22 bp, Homo sapiens
ctcagtttgaggggtaggtgtt

SEQ ID NO: 9426011 - DNA, 22 bp, Homo sapiens
ctcagtttcttcatattgtagg

SEQ ID NO: 9426012 - DNA, 22 bp, Homo sapiens
ctcagtttgtgtgatattgtct

SEQ ID NO: 9426013 - DNA, 22 bp, Homo sapiens
ttgctttgccaccagaagtcta

SEQ ID NO: 9426014 - DNA, 22 bp, Homo sapiens
ttgctttccgtcatgtgctaat

SEQ ID NO: 9426015 - DNA, 22 bp, Homo sapiens
ctcagttttgctagctggagtt

SEQ ID NO: 9426016 - DNA, 22 bp, Homo sapiens
ctcagtttttgctgtctggttc

SEQ ID NO: 9426017 - DNA, 22 bp, Homo sapiens
ctcagttttcccttgggagcgt

SEQ ID NO: 9426018 - DNA, 22 bp, Homo sapiens
ctcagttttaagactactcttt

SEQ ID NO: 9426019 - DNA, 22 bp, Homo sapiens
ctcagttttgaaaaggtaagct

SEQ ID NO: 9426020 - DNA, 22 bp, Homo sapiens
ctcagtttcctcttctgttgaa

SEQ ID NO: 9426021 - DNA, 22 bp, Homo sapiens
ctcagtttcctcaactgcaaaa

SEQ ID NO: 9426022 - DNA, 20 bp, Homo sapiens
ctcagtttcctcatggctca

SEQ ID NO: 9426023 - DNA, 22 bp, Homo sapiens
ctcagtttccccggcctgggcg

SEQ ID NO: 9426024 - DNA, 20 bp, Homo sapiens
ctcagtgctttcattgcctc

SEQ ID NO: 9426025 - DNA, 20 bp, Homo sapiens
ctcagtgctttcattgcctc

SEQ ID NO: 9426026 - DNA, 22 bp, Homo sapiens
ttgatattagagtatttgtttg

SEQ ID NO: 9426027 - DNA, 22 bp, Homo sapiens
ttgatattagagtatttgtttg

SEQ ID NO: 9426028 - DNA, 22 bp, Homo sapiens
ttgatacatgctctagagttga

SEQ ID NO: 9426029 - DNA, 22 bp, Homo sapiens
ttgatacatagcacagtttagg

SEQ ID NO: 9426030 - DNA, 22 bp, Homo sapiens
ttgatacccaagtgttatgggt

SEQ ID NO: 9426031 - DNA, 22 bp, Homo sapiens
ttgatacaggctctatttcatc

SEQ ID NO: 9426032 - DNA, 22 bp, Homo sapiens
ttgatacaggctctatttcatc

SEQ ID NO: 9426033 - DNA, 22 bp, Homo sapiens
ttgatacatagcacagtttagg

SEQ ID NO: 9426034 - DNA, 22 bp, Homo sapiens
ttggaaaagcgttctctgtagc

SEQ ID NO: 9426035 - DNA, 22 bp, Homo sapiens
ttggatcttatgaaggtggcat

SEQ ID NO: 9426036 - DNA, 20 bp, Homo sapiens
ttggatctaaaatgtgggga

SEQ ID NO: 9426037 - DNA, 22 bp, Homo sapiens
ttggaaaacttacacagagctg

SEQ ID NO: 9426038 - DNA, 22 bp, Homo sapiens
ttggaaaaattgcctgatgtct

SEQ ID NO: 9426039 - DNA, 22 bp, Homo sapiens
ttggaaaacttacacagagctg

SEQ ID NO: 9426040 - DNA, 22 bp, Homo sapiens
ttgctttttaattaggaggcag

SEQ ID NO: 9426041 - DNA, 22 bp, Homo sapiens
ttggaaaaacacgatagtggtt

SEQ ID NO: 9426042 - DNA, 22 bp, Homo sapiens
ttgcttttgtgtgctctctgga

SEQ ID NO: 9426043 - DNA, 22 bp, Homo sapiens
ttggatgaggttgagaatcatt

SEQ ID NO: 9426044 - DNA, 22 bp, Homo sapiens
ttggccaaagctcaccagtgct

SEQ ID NO: 9426045 - DNA, 22 bp, Homo sapiens
ttggccaaacagagttcaacag

SEQ ID NO: 9426046 - DNA, 22 bp, Homo sapiens
ttgcttttgggaaaacatgcct

SEQ ID NO: 9426047 - DNA, 22 bp, Homo sapiens
ttgcttttccctgtctctgatt

SEQ ID NO: 9426048 - DNA, 17 bp, Homo sapiens
ttgcttttgaaattgtc

SEQ ID NO: 9426049 - DNA, 22 bp, Homo sapiens
ttgcttttgggaaaacatgcct

SEQ ID NO: 9426050 - DNA, 22 bp, Homo sapiens
ttgcttttgtctcgggtttgga

SEQ ID NO: 9426051 - DNA, 22 bp, Homo sapiens
ttgcttttaattaatcattgct

SEQ ID NO: 9426052 - DNA, 18 bp, Homo sapiens
ttgctttgtaagcttgca

SEQ ID NO: 9426053 - DNA, 18 bp, Homo sapiens
ttgctttgtaagcttgca

SEQ ID NO: 9426054 - DNA, 22 bp, Homo sapiens
ttgctttggtagcagctataga

SEQ ID NO: 9426055 - DNA, 22 bp, Homo sapiens
ttgctttgtggtggttcttcca

SEQ ID NO: 9426056 - DNA, 22 bp, Homo sapiens
ttgcttttaatctttgtacatc

SEQ ID NO: 9426057 - DNA, 22 bp, Homo sapiens
ttgcttttaatctttgtacatc

SEQ ID NO: 9426058 - DNA, 22 bp, Homo sapiens
ttgctttgtttaaaagtggtat

SEQ ID NO: 9426059 - DNA, 22 bp, Homo sapiens
ttgggcaccagtgcactgacag

SEQ ID NO: 9426060 - DNA, 22 bp, Homo sapiens
ttgggcagaggccaggaggatg

SEQ ID NO: 9426061 - DNA, 22 bp, Homo sapiens
ttgggcagatgtttcctgtgga

SEQ ID NO: 9426062 - DNA, 22 bp, Homo sapiens
ttgggcagaggctgtgcagagg

SEQ ID NO: 9426063 - DNA, 22 bp, Homo sapiens
ttgggcaggctggcagactgct

SEQ ID NO: 9426064 - DNA, 22 bp, Homo sapiens
ttgggcaggatgacaccacttg

SEQ ID NO: 9426065 - DNA, 23 bp, Homo sapiens
ttgggcaggagagtaatgtgatc

SEQ ID NO: 9426066 - DNA, 22 bp, Homo sapiens
ttgggcaggaacagatgcttga

SEQ ID NO: 9426067 - DNA, 22 bp, Homo sapiens
ttgggcagatgtttcctgtgga

SEQ ID NO: 9426068 - DNA, 22 bp, Homo sapiens
ttgggaggtaatggagccaagt

SEQ ID NO: 9426069 - DNA, 22 bp, Homo sapiens
ttgggaggtcataaatctgttc

SEQ ID NO: 9426070 - DNA, 22 bp, Homo sapiens
ttggctgctgaaatatgttctg

SEQ ID NO: 9426071 - DNA, 22 bp, Homo sapiens
ttgggagtaataaaaaattcca

SEQ ID NO: 9426072 - DNA, 22 bp, Homo sapiens
ctcatccaccgcagcccctcag

SEQ ID NO: 9426073 - DNA, 22 bp, Homo sapiens
ctcatctgctcttattatctta

SEQ ID NO: 9426074 - DNA, 22 bp, Homo sapiens
ctcatctgataaatcactctta

SEQ ID NO: 9426075 - DNA, 22 bp, Homo sapiens
ctcatctgataaatcactctta

SEQ ID NO: 9426076 - DNA, 22 bp, Homo sapiens
ctcatctgactgtaaggtaatg

SEQ ID NO: 9426077 - DNA, 22 bp, Homo sapiens
ttggccagactgaggtgctggg

SEQ ID NO: 9426078 - DNA, 22 bp, Homo sapiens
ttggccagactgaggtgctggg

SEQ ID NO: 9426079 - DNA, 22 bp, Homo sapiens
ttggccagagaccagagcaggg

SEQ ID NO: 9426080 - DNA, 22 bp, Homo sapiens
ttggccagaggtttctctcatg

SEQ ID NO: 9426081 - DNA, 22 bp, Homo sapiens
ttggccagaggtttctctcatg

SEQ ID NO: 9426082 - DNA, 22 bp, Homo sapiens
ttggccagagaccagagcaggg

SEQ ID NO: 9426083 - DNA, 22 bp, Homo sapiens
ttggccagaggtttctctcatg

SEQ ID NO: 9426084 - DNA, 22 bp, Homo sapiens
ttggccagacactacccccctt

SEQ ID NO: 9426085 - DNA, 22 bp, Homo sapiens
ttggccagaatcttcctagtga

SEQ ID NO: 9426086 - DNA, 22 bp, Homo sapiens
ttggccagaatcttcctagtga

SEQ ID NO: 9426087 - DNA, 22 bp, Homo sapiens
ttggccacaatccaagccttgg

SEQ ID NO: 9426088 - DNA, 22 bp, Homo sapiens
ttggccaattccagaggatcat

SEQ ID NO: 9426089 - DNA, 22 bp, Homo sapiens
ttggccaaaggaaagactactg

SEQ ID NO: 9426090 - DNA, 22 bp, Homo sapiens
ctcataatgtgactgtatttga

SEQ ID NO: 9426091 - DNA, 22 bp, Homo sapiens
ctcataaagtgagaatatgacc

SEQ ID NO: 9426092 - DNA, 22 bp, Homo sapiens
ctcataaacattattcattatt

SEQ ID NO: 9426093 - DNA, 22 bp, Homo sapiens
ttggccagacactacccccctt

SEQ ID NO: 9426094 - DNA, 22 bp, Homo sapiens
ttggccagaggtttctctcatg

SEQ ID NO: 9426095 - DNA, 22 bp, Homo sapiens
ttggccagatctgaggatactg

SEQ ID NO: 9426096 - DNA, 22 bp, Homo sapiens
ttggccagaggtttctctcatg

SEQ ID NO: 9426097 - DNA, 22 bp, Homo sapiens
ctcatcataaccctgtgaggat

SEQ ID NO: 9426098 - DNA, 22 bp, Homo sapiens
ctcatccaccctcactaggaaa

SEQ ID NO: 9426099 - DNA, 22 bp, Homo sapiens
ctcatcagaaatacctgacaaa

SEQ ID NO: 9426100 - DNA, 22 bp, Homo sapiens
ctcatattcagtcactgatgca

SEQ ID NO: 9426101 - DNA, 22 bp, Homo sapiens
ctcatagatttagatagatcga

SEQ ID NO: 9426102 - DNA, 22 bp, Homo sapiens
ctcataatgtgactgtatttga

SEQ ID NO: 9426103 - DNA, 22 bp, Homo sapiens
ctcataatgtgactgtatttga

SEQ ID NO: 9426104 - DNA, 22 bp, Homo sapiens
ttgttaaaggcaaaacaagcac

SEQ ID NO: 9426105 - DNA, 22 bp, Homo sapiens
ttgttaaatggatgcagaataa

SEQ ID NO: 9426106 - DNA, 22 bp, Homo sapiens
ttgttaaaggcaaaacaagcac

SEQ ID NO: 9426107 - DNA, 21 bp, Homo sapiens
ttgttacaatgcaagagtatg

SEQ ID NO: 9426108 - DNA, 23 bp, Homo sapiens
ttgttaactttcctgcccctaca

SEQ ID NO: 9426109 - DNA, 22 bp, Homo sapiens
ttgttaagggttatgcagcttt

SEQ ID NO: 9426110 - DNA, 21 bp, Homo sapiens
ttgttacaatgcaagagtatg

SEQ ID NO: 9426111 - DNA, 22 bp, Homo sapiens
ttgttacacataataacatttt

SEQ ID NO: 9426112 - DNA, 22 bp, Homo sapiens
ttgttacacataataacatttt

SEQ ID NO: 9426113 - DNA, 22 bp, Homo sapiens
ttgttacagatcacatttctgc

SEQ ID NO: 9426114 - DNA, 22 bp, Homo sapiens
ctccaggtagctaagtcctggg

SEQ ID NO: 9426115 - DNA, 22 bp, Homo sapiens
ttgttacagcagcaatagaaaa

SEQ ID NO: 9426116 - DNA, 22 bp, Homo sapiens
ttgttacagcagcaatagaaaa

SEQ ID NO: 9426117 - DNA, 22 bp, Homo sapiens
ttgtgtacaggtgtttccaagt

SEQ ID NO: 9426118 - DNA, 22 bp, Homo sapiens
ttgtattttgttatgctactgc

SEQ ID NO: 9426119 - DNA, 22 bp, Homo sapiens
ttgttaaaaatagatttccagg

SEQ ID NO: 9426120 - DNA, 22 bp, Homo sapiens
ttgttaaaatgcatattctggt

SEQ ID NO: 9426121 - DNA, 22 bp, Homo sapiens
ttgttaaaatattggagaaagg

SEQ ID NO: 9426122 - DNA, 22 bp, Homo sapiens
ttgttaaaactccattggtttg

SEQ ID NO: 9426123 - DNA, 22 bp, Homo sapiens
tttaaaaaactagtctgagtct

SEQ ID NO: 9426124 - DNA, 22 bp, Homo sapiens
tttaaaaaactagtctgagtct

SEQ ID NO: 9426125 - DNA, 22 bp, Homo sapiens
tttaaaaaactagtctgagtct

SEQ ID NO: 9426126 - DNA, 22 bp, Homo sapiens
tttaaaaaactagtctgagtct

SEQ ID NO: 9426127 - DNA, 22 bp, Homo sapiens
tttaaaaaactagtctgagtct

SEQ ID NO: 9426128 - DNA, 22 bp, Homo sapiens
tttaaaaaactagtctgagtct

SEQ ID NO: 9426129 - DNA, 22 bp, Homo sapiens
tttaaaaaactagtctgagtct

SEQ ID NO: 9426130 - DNA, 22 bp, Homo sapiens
ctccagtgcgcaggacagcccc

SEQ ID NO: 9426131 - DNA, 22 bp, Homo sapiens
ttgtttcagctgtatgctatgt

SEQ ID NO: 9426132 - DNA, 22 bp, Homo sapiens
ttgtttcagctgtatgctatgt

SEQ ID NO: 9426133 - DNA, 22 bp, Homo sapiens
ctccagtgcacccagaggattt

SEQ ID NO: 9426134 - DNA, 22 bp, Homo sapiens
ttgtttcaggatggtttgttac

SEQ ID NO: 9426135 - DNA, 22 bp, Homo sapiens
ttgtttcatggggatgtttatt

SEQ ID NO: 9426136 - DNA, 22 bp, Homo sapiens
tttaaaaaactagtctgagtct

SEQ ID NO: 9426137 - DNA, 22 bp, Homo sapiens
ctccagtctaggtcctacttat

SEQ ID NO: 9426138 - DNA, 22 bp, Homo sapiens
ctccagtctaggtcctacttat

SEQ ID NO: 9426139 - DNA, 22 bp, Homo sapiens
ctccagtctagtagagcctgct

SEQ ID NO: 9426140 - DNA, 22 bp, Homo sapiens
ctccagtctttcagatgtccct

SEQ ID NO: 9426141 - DNA, 22 bp, Homo sapiens
ctccagtctctttcggagacac

SEQ ID NO: 9426142 - DNA, 22 bp, Homo sapiens
ctccagtctctttcggagacac

SEQ ID NO: 9426143 - DNA, 22 bp, Homo sapiens
ctccagtgagtgagcaggcgac

SEQ ID NO: 9426144 - DNA, 22 bp, Homo sapiens
ctccagtgagtgagcaggcgac

SEQ ID NO: 9426145 - DNA, 22 bp, Homo sapiens
ctccaggttacttagcctagct

SEQ ID NO: 9426146 - DNA, 22 bp, Homo sapiens
ctccaggttttacaaggtctat

SEQ ID NO: 9426147 - DNA, 22 bp, Homo sapiens
ctccaggtgcagaaggactcag

SEQ ID NO: 9426148 - DNA, 22 bp, Homo sapiens
ctccaggtgcagaaggactcag

SEQ ID NO: 9426149 - DNA, 22 bp, Homo sapiens
ctccagtatctgtaggaaaagg

SEQ ID NO: 9426150 - DNA, 22 bp, Homo sapiens
ctccagtcatagcctcttgagt

SEQ ID NO: 9426151 - DNA, 22 bp, Homo sapiens
ctccagtcatagcctcttgagt

SEQ ID NO: 9426152 - DNA, 22 bp, Homo sapiens
ctccagtcatgtttactgtgca

SEQ ID NO: 9426153 - DNA, 22 bp, Homo sapiens
ctccagtcatagtctgtcttgt

SEQ ID NO: 9426154 - DNA, 22 bp, Homo sapiens
ctccagtcctagtctcttgctt

SEQ ID NO: 9426155 - DNA, 22 bp, Homo sapiens
ctccagtcatgtttactgtgca

SEQ ID NO: 9426156 - DNA, 22 bp, Homo sapiens
ttggggtgttggatggagcaag

SEQ ID NO: 9426157 - DNA, 22 bp, Homo sapiens
ttggggtgttggatggagcaag

SEQ ID NO: 9426158 - DNA, 22 bp, Homo sapiens
ttgggtgggtcaggactcggag

SEQ ID NO: 9426159 - DNA, 22 bp, Homo sapiens
ttgggtggtggggagagttcag

SEQ ID NO: 9426160 - DNA, 22 bp, Homo sapiens
ttgggtggtggggagagttcag

SEQ ID NO: 9426161 - DNA, 22 bp, Homo sapiens
ttgggtggtggggagagttcag

SEQ ID NO: 9426162 - DNA, 22 bp, Homo sapiens
ttgggttagaacggtaacatac

SEQ ID NO: 9426163 - DNA, 22 bp, Homo sapiens
ttggtaaatccccttacacaaa

SEQ ID NO: 9426164 - DNA, 22 bp, Homo sapiens
ttggtaaatccccttacacaaa

SEQ ID NO: 9426165 - DNA, 22 bp, Homo sapiens
ttggtaaatactataatcaaat

SEQ ID NO: 9426166 - DNA, 22 bp, Homo sapiens
ttggtaaatactataatcaaat

SEQ ID NO: 9426167 - DNA, 22 bp, Homo sapiens
ttggtacatgttaaggaagagt

SEQ ID NO: 9426168 - DNA, 22 bp, Homo sapiens
ttggtaaattatttcttccaat

SEQ ID NO: 9426169 - DNA, 22 bp, Homo sapiens
ttggtcaaggacattacagttt

SEQ ID NO: 9426170 - DNA, 22 bp, Homo sapiens
ttggtcaagtcttaaagaaaaa

SEQ ID NO: 9426171 - DNA, 22 bp, Homo sapiens
ttggtcaagtcttaaagaaaaa

SEQ ID NO: 9426172 - DNA, 21 bp, Homo sapiens
ttggtatgactctgcaggtga

SEQ ID NO: 9426173 - DNA, 22 bp, Homo sapiens
ttggtataacagatgacttacg

SEQ ID NO: 9426174 - DNA, 22 bp, Homo sapiens
ttggtagaatgaacattcattg

SEQ ID NO: 9426175 - DNA, 22 bp, Homo sapiens
ctccagggagctgtggaggttt

SEQ ID NO: 9426176 - DNA, 22 bp, Homo sapiens
ctccagggagctgtggaggttt

SEQ ID NO: 9426177 - DNA, 22 bp, Homo sapiens
ctccagggagcttggaaagacc

SEQ ID NO: 9426178 - DNA, 22 bp, Homo sapiens
ctccaggcgcttaccaagcgct

SEQ ID NO: 9426179 - DNA, 22 bp, Homo sapiens
ctccagggagctgcgggagcca

SEQ ID NO: 9426180 - DNA, 22 bp, Homo sapiens
ttgtatttgattgtcatatcgt

SEQ ID NO: 9426181 - DNA, 22 bp, Homo sapiens
ttgtatttgggtagtatagaga

SEQ ID NO: 9426182 - DNA, 22 bp, Homo sapiens
ttgtatttgggtagtatagaga

SEQ ID NO: 9426183 - DNA, 22 bp, Homo sapiens
ttgtatttgggtagtatagaga

SEQ ID NO: 9426184 - DNA, 22 bp, Homo sapiens
ttgtatttgggtagtatagaga

SEQ ID NO: 9426185 - DNA, 22 bp, Homo sapiens
ttgtatttgggtagtatagaga

SEQ ID NO: 9426186 - DNA, 22 bp, Homo sapiens
ttgtatttcttccggtctcatt

SEQ ID NO: 9426187 - DNA, 22 bp, Homo sapiens
ttgtatttctccactttctgtt

SEQ ID NO: 9426188 - DNA, 22 bp, Homo sapiens
ttgtatttgattgtcatatcgt

SEQ ID NO: 9426189 - DNA, 22 bp, Homo sapiens
ttgtatttctccactttctgtt

SEQ ID NO: 9426190 - DNA, 22 bp, Homo sapiens
ttgtatttctccactttctgtt

SEQ ID NO: 9426191 - DNA, 22 bp, Homo sapiens
ctccagggggcatccacacagc

SEQ ID NO: 9426192 - DNA, 22 bp, Homo sapiens
ttgtatttctccactttctgtt

SEQ ID NO: 9426193 - DNA, 22 bp, Homo sapiens
ctccagggaggtctgcaggact

SEQ ID NO: 9426194 - DNA, 22 bp, Homo sapiens
ctccagggaggtctgcaggact

SEQ ID NO: 9426195 - DNA, 22 bp, Homo sapiens
ctccagggatgagacagagtag

SEQ ID NO: 9426196 - DNA, 20 bp, Homo sapiens
ctccaggggaagagccttcc

SEQ ID NO: 9426197 - DNA, 22 bp, Homo sapiens
ctccagggcagcatggcagtgg

SEQ ID NO: 9426198 - DNA, 22 bp, Homo sapiens
ctccagggcagcatggcagtgg

SEQ ID NO: 9426199 - DNA, 22 bp, Homo sapiens
ctccagggcagcatggcagtgg

SEQ ID NO: 9426200 - DNA, 20 bp, Homo sapiens
ctccaggggaagagccttcc

SEQ ID NO: 9426201 - DNA, 22 bp, Homo sapiens
ctcctgggaggatgcggacccg

SEQ ID NO: 9426202 - DNA, 22 bp, Homo sapiens
ctcctgggagtcttcctggatg

SEQ ID NO: 9426203 - DNA, 22 bp, Homo sapiens
ctcctgggagtcttcctggatg

SEQ ID NO: 9426204 - DNA, 22 bp, Homo sapiens
ctcctgggagtcttcctggatg

SEQ ID NO: 9426205 - DNA, 22 bp, Homo sapiens
ctcctgggagctgtggcagagc

SEQ ID NO: 9426206 - DNA, 22 bp, Homo sapiens
ctcctgggagctgtggcagagc

SEQ ID NO: 9426207 - DNA, 22 bp, Homo sapiens
ctcctgggagctgtggcagagc

SEQ ID NO: 9426208 - DNA, 22 bp, Homo sapiens
ctcctgggaggatgcggacccg

SEQ ID NO: 9426209 - DNA, 22 bp, Homo sapiens
ctcctgggaggatgcggacccg

SEQ ID NO: 9426210 - DNA, 22 bp, Homo sapiens
ctcctgggaggatgcggacccg

SEQ ID NO: 9426211 - DNA, 22 bp, Homo sapiens
ctcctgggaggatgcggacccg

SEQ ID NO: 9426212 - DNA, 22 bp, Homo sapiens
ctcctgggagctgtggcagagc

SEQ ID NO: 9426213 - DNA, 22 bp, Homo sapiens
ctcctgggagctgtggcagagc

SEQ ID NO: 9426214 - DNA, 22 bp, Homo sapiens
ctcctgggagcagggatggatg

SEQ ID NO: 9426215 - DNA, 22 bp, Homo sapiens
ctcctgggagcagggatggatg

SEQ ID NO: 9426216 - DNA, 22 bp, Homo sapiens
ctcctgggagcagggatggatg

SEQ ID NO: 9426217 - DNA, 18 bp, Homo sapiens
ctcctgggctgcagatgc

SEQ ID NO: 9426218 - DNA, 18 bp, Homo sapiens
ctcctgggctgcagatgc

SEQ ID NO: 9426219 - DNA, 22 bp, Homo sapiens
ctcctgggctcatatcattcag

SEQ ID NO: 9426220 - DNA, 22 bp, Homo sapiens
ctcctgggctcatatcattcag

SEQ ID NO: 9426221 - DNA, 22 bp, Homo sapiens
ctcctgggctcaagtgatcctc

SEQ ID NO: 9426222 - DNA, 22 bp, Homo sapiens
ctcctgggctcaagtgatcctc

SEQ ID NO: 9426223 - DNA, 22 bp, Homo sapiens
ctcctgggatgactctttcttt

SEQ ID NO: 9426224 - DNA, 21 bp, Homo sapiens
ctcctgggctaagatatagtg

SEQ ID NO: 9426225 - DNA, 21 bp, Homo sapiens
ctcctgggctaagatatagtg

SEQ ID NO: 9426226 - DNA, 22 bp, Homo sapiens
ctcctgggctatgtctgcttgg

SEQ ID NO: 9426227 - DNA, 22 bp, Homo sapiens
ctctccagaattattactatta

SEQ ID NO: 9426228 - DNA, 22 bp, Homo sapiens
ctctccactgtcctttgctggt

SEQ ID NO: 9426229 - DNA, 22 bp, Homo sapiens
ctctcagaagtagcacgtgggc

SEQ ID NO: 9426230 - DNA, 22 bp, Homo sapiens
ctctcagaagcttccagtatgg

SEQ ID NO: 9426231 - DNA, 22 bp, Homo sapiens
ctctccactcagcgtcatgtcc

SEQ ID NO: 9426232 - DNA, 22 bp, Homo sapiens
ctctccactcagcgtcatgtcc

SEQ ID NO: 9426233 - DNA, 19 bp, Homo sapiens
ctctcactcgccacatcct

SEQ ID NO: 9426234 - DNA, 22 bp, Homo sapiens
ctcctgggctgggaactcagcc

SEQ ID NO: 9426235 - DNA, 18 bp, Homo sapiens
ctcctgggctgcagatgc

SEQ ID NO: 9426236 - DNA, 18 bp, Homo sapiens
ctcctgggctgcagatgc

SEQ ID NO: 9426237 - DNA, 18 bp, Homo sapiens
ctcctgggctgcagatgc

SEQ ID NO: 9426238 - DNA, 18 bp, Homo sapiens
ctcctgggctgcagatgc

SEQ ID NO: 9426239 - DNA, 22 bp, Homo sapiens
ctcctgggctgggaactcagcc

SEQ ID NO: 9426240 - DNA, 22 bp, Homo sapiens
ctcctgggctgtcggcgctctg

SEQ ID NO: 9426241 - DNA, 22 bp, Homo sapiens
ctcctgggctgggaactcagcc

SEQ ID NO: 9426242 - DNA, 22 bp, Homo sapiens
ctcctgggctgtcggcgctctg

SEQ ID NO: 9426243 - DNA, 22 bp, Homo sapiens
ctcctgggctgtcggcgctctg

SEQ ID NO: 9426244 - DNA, 22 bp, Homo sapiens
ctctccagagcccttccggccc

SEQ ID NO: 9426245 - DNA, 22 bp, Homo sapiens
ctctccagagcccttccggccc

SEQ ID NO: 9426246 - DNA, 22 bp, Homo sapiens
ctctccagatctgctgagccag

SEQ ID NO: 9426247 - DNA, 22 bp, Homo sapiens
ctctccagatctgctgagccag

SEQ ID NO: 9426248 - DNA, 22 bp, Homo sapiens
ctctccagatctgctgagccag

SEQ ID NO: 9426249 - DNA, 22 bp, Homo sapiens
ctctccagcagatgtagtctgt

SEQ ID NO: 9426250 - DNA, 22 bp, Homo sapiens
ctctccagccaggggcttcctg

SEQ ID NO: 9426251 - DNA, 22 bp, Homo sapiens
ctctccagccaggggcttcctg

SEQ ID NO: 9426252 - DNA, 22 bp, Homo sapiens
ctctccagccacagaagctgct

SEQ ID NO: 9426253 - DNA, 22 bp, Homo sapiens
ctctccagccacagaagctgct

SEQ ID NO: 9426254 - DNA, 22 bp, Homo sapiens
ctctccagccaggggcttcctg

SEQ ID NO: 9426255 - DNA, 19 bp, Homo sapiens
ctctccagctccagtagct

SEQ ID NO: 9426256 - DNA, 19 bp, Homo sapiens
ctctccagctccagtagct

SEQ ID NO: 9426257 - DNA, 22 bp, Homo sapiens
ctctccagcctttagcccacgc

SEQ ID NO: 9426258 - DNA, 21 bp, Homo sapiens
ctctccagtggttcctgattc

SEQ ID NO: 9426259 - DNA, 21 bp, Homo sapiens
ctctccagtggttcctgattc

SEQ ID NO: 9426260 - DNA, 22 bp, Homo sapiens
tttcagtttaagtaactgctat

SEQ ID NO: 9426261 - DNA, 21 bp, Homo sapiens
ctctccagtggttcctgattc

SEQ ID NO: 9426262 - DNA, 22 bp, Homo sapiens
tttcagttgtgccggcccctct

SEQ ID NO: 9426263 - DNA, 22 bp, Homo sapiens
tttcagttgttttagctctgtg

SEQ ID NO: 9426264 - DNA, 22 bp, Homo sapiens
tttcagttgtcctgttaatagc

SEQ ID NO: 9426265 - DNA, 22 bp, Homo sapiens
tttcagttcatgtattccgagt

SEQ ID NO: 9426266 - DNA, 22 bp, Homo sapiens
tttcagttcatgtattccgagt

SEQ ID NO: 9426267 - DNA, 22 bp, Homo sapiens
tttcagttgccaagctaattct

SEQ ID NO: 9426268 - DNA, 22 bp, Homo sapiens
tttcagttcagtttattatatc

SEQ ID NO: 9426269 - DNA, 22 bp, Homo sapiens
tttcagttactgctatatcatt

SEQ ID NO: 9426270 - DNA, 20 bp, Homo sapiens
tttcagttatcttgaccttc

SEQ ID NO: 9426271 - DNA, 22 bp, Homo sapiens
tttcagttactgctatatcatt

SEQ ID NO: 9426272 - DNA, 22 bp, Homo sapiens
tttcagttactgctatatcatt

SEQ ID NO: 9426273 - DNA, 22 bp, Homo sapiens
ctctccaggagagcactttgag

SEQ ID NO: 9426274 - DNA, 22 bp, Homo sapiens
ctctccaggactttggcccaat

SEQ ID NO: 9426275 - DNA, 22 bp, Homo sapiens
ctctccaggactttggcccaat

SEQ ID NO: 9426276 - DNA, 22 bp, Homo sapiens
ctctccaggactttggcccaat

SEQ ID NO: 9426277 - DNA, 22 bp, Homo sapiens
ctctccaggactttggcccaat

SEQ ID NO: 9426278 - DNA, 22 bp, Homo sapiens
ctctccccggtacgagcggccg

SEQ ID NO: 9426279 - DNA, 22 bp, Homo sapiens
ctctccccggtacgagcggccg

SEQ ID NO: 9426280 - DNA, 23 bp, Homo sapiens
ctctccccctttgatgttagctc

SEQ ID NO: 9426281 - DNA, 22 bp, Homo sapiens
ctctccccggtacgagcggccg

SEQ ID NO: 9426282 - DNA, 22 bp, Homo sapiens
ctctccccggtacgagcggccg

SEQ ID NO: 9426283 - DNA, 23 bp, Homo sapiens
ctctccccctttgatgttagctc

SEQ ID NO: 9426284 - DNA, 22 bp, Homo sapiens
ctctcccccacagcagccttct

SEQ ID NO: 9426285 - DNA, 22 bp, Homo sapiens
ctctcccccacagcagccttct

SEQ ID NO: 9426286 - DNA, 22 bp, Homo sapiens
ctctcccccacagcagccttct

SEQ ID NO: 9426287 - DNA, 22 bp, Homo sapiens
ctctcccccacagcagccttct

SEQ ID NO: 9426288 - DNA, 22 bp, Homo sapiens
ctctccctaggttagcggtcag

SEQ ID NO: 9426289 - DNA, 22 bp, Homo sapiens
ctctccctaggttagcggtcag

SEQ ID NO: 9426290 - DNA, 22 bp, Homo sapiens
ctctccctaggttagcggtcag

SEQ ID NO: 9426291 - DNA, 22 bp, Homo sapiens
ctctccctatgcctcccaggag

SEQ ID NO: 9426292 - DNA, 22 bp, Homo sapiens
ctctccctcattgggttccatt

SEQ ID NO: 9426293 - DNA, 22 bp, Homo sapiens
ctctccctatgcctcccaggag

SEQ ID NO: 9426294 - DNA, 22 bp, Homo sapiens
ctctccctatgcctcccaggag

SEQ ID NO: 9426295 - DNA, 22 bp, Homo sapiens
ctctcctccaacagccctgccg

SEQ ID NO: 9426296 - DNA, 22 bp, Homo sapiens
ctctcctcccatgtaggagatg

SEQ ID NO: 9426297 - DNA, 22 bp, Homo sapiens
ctctcctccaggaactcacagt

SEQ ID NO: 9426298 - DNA, 22 bp, Homo sapiens
ctctcctccaggaactcacagt

SEQ ID NO: 9426299 - DNA, 22 bp, Homo sapiens
ctctcctccaggaactcacagt

SEQ ID NO: 9426300 - DNA, 22 bp, Homo sapiens
ctctcctccaggaactcacagt

SEQ ID NO: 9426301 - DNA, 22 bp, Homo sapiens
ctctccctggccagctgtgcag

SEQ ID NO: 9426302 - DNA, 22 bp, Homo sapiens
ctctccctcattgggttccatt

SEQ ID NO: 9426303 - DNA, 22 bp, Homo sapiens
ctctccctggccagctgtgcag

SEQ ID NO: 9426304 - DNA, 22 bp, Homo sapiens
ctctccctggccagctgtgcag

SEQ ID NO: 9426305 - DNA, 22 bp, Homo sapiens
ctctccctggccagctgtgcag

SEQ ID NO: 9426306 - DNA, 22 bp, Homo sapiens
ctctccctggccagctgtgcag

SEQ ID NO: 9426307 - DNA, 22 bp, Homo sapiens
ctctcctcagaacaggccctct

SEQ ID NO: 9426308 - DNA, 20 bp, Homo sapiens
ctctcctcacccgtgtcagg

SEQ ID NO: 9426309 - DNA, 22 bp, Homo sapiens
ctctcctattgtgtggtaagga

SEQ ID NO: 9426310 - DNA, 22 bp, Homo sapiens
ctctcccttgggtgggctttgg

SEQ ID NO: 9426311 - DNA, 22 bp, Homo sapiens
ctcctctgtattgattgggact

SEQ ID NO: 9426312 - DNA, 22 bp, Homo sapiens
ctcctctgggtcctggtggcca

SEQ ID NO: 9426313 - DNA, 22 bp, Homo sapiens
ctcctctgggtcctggtggcca

SEQ ID NO: 9426314 - DNA, 22 bp, Homo sapiens
ctcctctgtctaccacgagggt

SEQ ID NO: 9426315 - DNA, 22 bp, Homo sapiens
ctcctctgtctggccctgagcc

SEQ ID NO: 9426316 - DNA, 22 bp, Homo sapiens
ctcctctgtctggccctgagcc

SEQ ID NO: 9426317 - DNA, 22 bp, Homo sapiens
ctcctctgtctggccctgagcc

SEQ ID NO: 9426318 - DNA, 22 bp, Homo sapiens
ctcctggctatgactacatttc

SEQ ID NO: 9426319 - DNA, 22 bp, Homo sapiens
ctcctggccctgagctcccagg

SEQ ID NO: 9426320 - DNA, 22 bp, Homo sapiens
ctcctgagaggatctctgttgt

SEQ ID NO: 9426321 - DNA, 22 bp, Homo sapiens
ctcctgagaggatctctgttgt

SEQ ID NO: 9426322 - DNA, 22 bp, Homo sapiens
ctcctgagaattttcagttgga

SEQ ID NO: 9426323 - DNA, 22 bp, Homo sapiens
ctcctgagaattttcagttgga

SEQ ID NO: 9426324 - DNA, 22 bp, Homo sapiens
ctcctgagaggatctctgttgt

SEQ ID NO: 9426325 - DNA, 22 bp, Homo sapiens
ctcctgagaattttcagttgga

SEQ ID NO: 9426326 - DNA, 22 bp, Homo sapiens
ctcctgagaaataagcaagtaa

SEQ ID NO: 9426327 - DNA, 22 bp, Homo sapiens
tttagacacactttgtatattt

SEQ ID NO: 9426328 - DNA, 22 bp, Homo sapiens
tttagaatgttagcgttaaagg

SEQ ID NO: 9426329 - DNA, 22 bp, Homo sapiens
tttagaatgttagcgttaaagg

SEQ ID NO: 9426330 - DNA, 22 bp, Homo sapiens
tttagaatgtgactgtatttga

SEQ ID NO: 9426331 - DNA, 17 bp, Homo sapiens
tttagaatacaatgttt

SEQ ID NO: 9426332 - DNA, 17 bp, Homo sapiens
tttagaatacaatgttt

SEQ ID NO: 9426333 - DNA, 22 bp, Homo sapiens
tttagacatctataattgctaa

SEQ ID NO: 9426334 - DNA, 22 bp, Homo sapiens
tttagacatagctgaaatcatt

SEQ ID NO: 9426335 - DNA, 22 bp, Homo sapiens
tttagacaggggcaaaataagg

SEQ ID NO: 9426336 - DNA, 22 bp, Homo sapiens
ctcctctggcttcctggaggca

SEQ ID NO: 9426337 - DNA, 22 bp, Homo sapiens
ctcctctggcttcctggaggca

SEQ ID NO: 9426338 - DNA, 22 bp, Homo sapiens
ctcctctggaaattcctctgcc

SEQ ID NO: 9426339 - DNA, 22 bp, Homo sapiens
ctcctctggaaattcctctgcc

SEQ ID NO: 9426340 - DNA, 22 bp, Homo sapiens
ctcctctctggagttatgcaga

SEQ ID NO: 9426341 - DNA, 16 bp, Homo sapiens
ctcctctccttcagga

SEQ ID NO: 9426342 - DNA, 17 bp, Homo sapiens
ctcctctctgggttact

SEQ ID NO: 9426343 - DNA, 22 bp, Homo sapiens
ctcctcccaattgccaagtgct

SEQ ID NO: 9426344 - DNA, 22 bp, Homo sapiens
tttagacatggcttgctcactt

SEQ ID NO: 9426345 - DNA, 22 bp, Homo sapiens
ctcctcccaattgccaagtgct

SEQ ID NO: 9426346 - DNA, 22 bp, Homo sapiens
ctcctctccatcagcgccaccc

SEQ ID NO: 9426347 - DNA, 22 bp, Homo sapiens
tttaaatttagaagaaacactg

SEQ ID NO: 9426348 - DNA, 22 bp, Homo sapiens
tttaaatttagaagaaacactg

SEQ ID NO: 9426349 - DNA, 22 bp, Homo sapiens
tttaaatttagaagaaacactg

SEQ ID NO: 9426350 - DNA, 22 bp, Homo sapiens
tttaaatttagaagaaacactg

SEQ ID NO: 9426351 - DNA, 22 bp, Homo sapiens
tttaaattctgtctgccgctta

SEQ ID NO: 9426352 - DNA, 22 bp, Homo sapiens
tttaaattctgtctgccgctta

SEQ ID NO: 9426353 - DNA, 22 bp, Homo sapiens
tttaaatttagaagaaacactg

SEQ ID NO: 9426354 - DNA, 22 bp, Homo sapiens
tttaaatttgtgtttagagggt

SEQ ID NO: 9426355 - DNA, 22 bp, Homo sapiens
tttaacagatagtttcttctgt

SEQ ID NO: 9426356 - DNA, 22 bp, Homo sapiens
tttaacagatagtttcttctgt

SEQ ID NO: 9426357 - DNA, 22 bp, Homo sapiens
tttaacactcagtttaatagcc

SEQ ID NO: 9426358 - DNA, 22 bp, Homo sapiens
tttaaaaggggtattaagtcca

SEQ ID NO: 9426359 - DNA, 22 bp, Homo sapiens
tttaaaaggggtattaagtcca

SEQ ID NO: 9426360 - DNA, 22 bp, Homo sapiens
tttaaaaaactagtctgagtct

SEQ ID NO: 9426361 - DNA, 22 bp, Homo sapiens
tttaaaaaactagtctgagtct

SEQ ID NO: 9426362 - DNA, 22 bp, Homo sapiens
tttaaaaaactagtctgagtct

SEQ ID NO: 9426363 - DNA, 22 bp, Homo sapiens
tttaaaaaactagtctgagtct

SEQ ID NO: 9426364 - DNA, 22 bp, Homo sapiens
tttaaaaaactagtctgagtct

SEQ ID NO: 9426365 - DNA, 22 bp, Homo sapiens
tttaaaaaactagtctgagtct

SEQ ID NO: 9426366 - DNA, 22 bp, Homo sapiens
tttaaaaaactagtctgagtct

SEQ ID NO: 9426367 - DNA, 22 bp, Homo sapiens
tttaaaaaactagtctgagtct

SEQ ID NO: 9426368 - DNA, 22 bp, Homo sapiens
tttacatttccctctgtcagtt

SEQ ID NO: 9426369 - DNA, 17 bp, Homo sapiens
tttagaatacaatgttt

SEQ ID NO: 9426370 - DNA, 17 bp, Homo sapiens
tttagaatacaatgttt

SEQ ID NO: 9426371 - DNA, 17 bp, Homo sapiens
tttagaatacaatgttt

SEQ ID NO: 9426372 - DNA, 17 bp, Homo sapiens
tttagaatacaatgttt

SEQ ID NO: 9426373 - DNA, 22 bp, Homo sapiens
tttacattgcattaggtattat

SEQ ID NO: 9426374 - DNA, 22 bp, Homo sapiens
tttacattgcattaggtattat

SEQ ID NO: 9426375 - DNA, 22 bp, Homo sapiens
tttacattgcattaggtattat

SEQ ID NO: 9426376 - DNA, 22 bp, Homo sapiens
tttacatttccctctgtcagtt

SEQ ID NO: 9426377 - DNA, 17 bp, Homo sapiens
tttacattgctcgcagt

SEQ ID NO: 9426378 - DNA, 22 bp, Homo sapiens
tttacatggaatattgtcttgt

SEQ ID NO: 9426379 - DNA, 22 bp, Homo sapiens
tttacatgtaatgttatacaaa

SEQ ID NO: 9426380 - DNA, 22 bp, Homo sapiens
tttacatgtaatgttatacaaa

SEQ ID NO: 9426381 - DNA, 22 bp, Homo sapiens
tttacatgtaatgttatacaaa

SEQ ID NO: 9426382 - DNA, 22 bp, Homo sapiens
tttacagtgtcttgttgactgt

SEQ ID NO: 9426383 - DNA, 22 bp, Homo sapiens
tttacagtgtcttgttgactgt

SEQ ID NO: 9426384 - DNA, 22 bp, Homo sapiens
tttacacatacctctttaaagt

SEQ ID NO: 9426385 - DNA, 22 bp, Homo sapiens
tttacagttaagaaatgttacc

SEQ ID NO: 9426386 - DNA, 22 bp, Homo sapiens
tttacagttaagaaatgttacc

SEQ ID NO: 9426387 - DNA, 22 bp, Homo sapiens
tttacagttaagaaatgttacc

SEQ ID NO: 9426388 - DNA, 22 bp, Homo sapiens
tttacacatacctctttaaagt

SEQ ID NO: 9426389 - DNA, 22 bp, Homo sapiens
tttacagttccatgtgataggc

SEQ ID NO: 9426390 - DNA, 22 bp, Homo sapiens
tttacagttaagaaatgttacc

SEQ ID NO: 9426391 - DNA, 22 bp, Homo sapiens
tttacatctcaccagattcata

SEQ ID NO: 9426392 - DNA, 20 bp, Homo sapiens
tttacatccccaccagcaat

SEQ ID NO: 9426393 - DNA, 22 bp, Homo sapiens
cctctgagaacacctggcgtcc

SEQ ID NO: 9426394 - DNA, 22 bp, Homo sapiens
cctctgacttctctttattggc

SEQ ID NO: 9426395 - DNA, 22 bp, Homo sapiens
cctctgagaccagctctgcacc

SEQ ID NO: 9426396 - DNA, 22 bp, Homo sapiens
cctctgagaccagctctgcacc

SEQ ID NO: 9426397 - DNA, 22 bp, Homo sapiens
cctctgagccacatgcgtttgt

SEQ ID NO: 9426398 - DNA, 22 bp, Homo sapiens
cctctcttggccgcagtcttct

SEQ ID NO: 9426399 - DNA, 23 bp, Homo sapiens
cctctgacaatgatgtcacctgc

SEQ ID NO: 9426400 - DNA, 22 bp, Homo sapiens
cctctgacacttgtcccacaca

SEQ ID NO: 9426401 - DNA, 22 bp, Homo sapiens
cctctgaccctggtggtggcca

SEQ ID NO: 9426402 - DNA, 22 bp, Homo sapiens
cctctgactccacacttgaact

SEQ ID NO: 9426403 - DNA, 22 bp, Homo sapiens
cctctgaccctggtggtggcca

SEQ ID NO: 9426404 - DNA, 22 bp, Homo sapiens
cctctgactccagaaactccag

SEQ ID NO: 9426405 - DNA, 22 bp, Homo sapiens
cctctgactcctggacttgggg

SEQ ID NO: 9426406 - DNA, 22 bp, Homo sapiens
cctctgagctggcctgtggggc

SEQ ID NO: 9426407 - DNA, 22 bp, Homo sapiens
cctctgagctggcctgtggggc

SEQ ID NO: 9426408 - DNA, 22 bp, Homo sapiens
cctctgagctggcctgtggggc

SEQ ID NO: 9426409 - DNA, 22 bp, Homo sapiens
cctctgagcctgtgtgcggcac

SEQ ID NO: 9426410 - DNA, 22 bp, Homo sapiens
cctctgagcctgtgtgcggcac

SEQ ID NO: 9426411 - DNA, 22 bp, Homo sapiens
cctctgaggtcatggacttggc

SEQ ID NO: 9426412 - DNA, 22 bp, Homo sapiens
cctctgaggtgagcccagctgg

SEQ ID NO: 9426413 - DNA, 22 bp, Homo sapiens
cctctggctgtaccactggcac

SEQ ID NO: 9426414 - DNA, 22 bp, Homo sapiens
cctctggctgtaccactggcac

SEQ ID NO: 9426415 - DNA, 22 bp, Homo sapiens
cctctgaggtgagcccagctgg

SEQ ID NO: 9426416 - DNA, 22 bp, Homo sapiens
cctctgaggtgagcccagctgg

SEQ ID NO: 9426417 - DNA, 22 bp, Homo sapiens
cctctggctcacagcaccaact

SEQ ID NO: 9426418 - DNA, 22 bp, Homo sapiens
cctctggctcacagcaccaact

SEQ ID NO: 9426419 - DNA, 22 bp, Homo sapiens
cctctggctgtaccactggcac

SEQ ID NO: 9426420 - DNA, 22 bp, Homo sapiens
cctctggggcatcagacaaagg

SEQ ID NO: 9426421 - DNA, 22 bp, Homo sapiens
cctctggggcatcagacaaagg

SEQ ID NO: 9426422 - DNA, 22 bp, Homo sapiens
cctctgggggcttccttaccct

SEQ ID NO: 9426423 - DNA, 22 bp, Homo sapiens
cctctgggctgcctgcacgggt

SEQ ID NO: 9426424 - DNA, 22 bp, Homo sapiens
cctctgggctgcctgcacgggt

SEQ ID NO: 9426425 - DNA, 22 bp, Homo sapiens
cctctgggctgcctgcacgggt

SEQ ID NO: 9426426 - DNA, 22 bp, Homo sapiens
cctctgggctgcctgcacgggt

SEQ ID NO: 9426427 - DNA, 22 bp, Homo sapiens
cctctgggctggaaaattaatg

SEQ ID NO: 9426428 - DNA, 22 bp, Homo sapiens
cctctgggctgcctgcacgggt

SEQ ID NO: 9426429 - DNA, 22 bp, Homo sapiens
cctctgggctgcctgcacgggt

SEQ ID NO: 9426430 - DNA, 22 bp, Homo sapiens
cctctggtcccagctctgctgc

SEQ ID NO: 9426431 - DNA, 22 bp, Homo sapiens
cctctggtcccagctctgctgc

SEQ ID NO: 9426432 - DNA, 22 bp, Homo sapiens
cctctggtcccagctctgctgc

SEQ ID NO: 9426433 - DNA, 22 bp, Homo sapiens
cctctgggttagtttagggagc

SEQ ID NO: 9426434 - DNA, 18 bp, Homo sapiens
cctctgggttttgttccc

SEQ ID NO: 9426435 - DNA, 22 bp, Homo sapiens
cctctgggttagtttagggagc

SEQ ID NO: 9426436 - DNA, 22 bp, Homo sapiens
cctctgtccccagtgcaggcct

SEQ ID NO: 9426437 - DNA, 22 bp, Homo sapiens
cctctgtagtaagagaacatat

SEQ ID NO: 9426438 - DNA, 22 bp, Homo sapiens
cctctgtccccagtgcaggcct

SEQ ID NO: 9426439 - DNA, 22 bp, Homo sapiens
cctctgtgacaaacagtcctgg

SEQ ID NO: 9426440 - DNA, 22 bp, Homo sapiens
cctctgtgatttctgagccaat

SEQ ID NO: 9426441 - DNA, 22 bp, Homo sapiens
cctctgtgatttctgagccaat

SEQ ID NO: 9426442 - DNA, 22 bp, Homo sapiens
cctctgtgatttctgagccaat

SEQ ID NO: 9426443 - DNA, 22 bp, Homo sapiens
cctctgtgcaggaaatacatgt

SEQ ID NO: 9426444 - DNA, 22 bp, Homo sapiens
cctctgggtgacagactcttgg

SEQ ID NO: 9426445 - DNA, 22 bp, Homo sapiens
cctctgggtgacagactcttgg

SEQ ID NO: 9426446 - DNA, 22 bp, Homo sapiens
cctctgggtgggaggccgggcg

SEQ ID NO: 9426447 - DNA, 22 bp, Homo sapiens
cctctgggtgggaggccgggcg

SEQ ID NO: 9426448 - DNA, 22 bp, Homo sapiens
cctctgggtgggaggccgggcg

SEQ ID NO: 9426449 - DNA, 22 bp, Homo sapiens
cctctgggtgggaggccgggcg

SEQ ID NO: 9426450 - DNA, 22 bp, Homo sapiens
cctctgggtatctgtggaagta

SEQ ID NO: 9426451 - DNA, 22 bp, Homo sapiens
cctctggggtgagtgggccact

SEQ ID NO: 9426452 - DNA, 22 bp, Homo sapiens
cctctggggtgagtgggccact

SEQ ID NO: 9426453 - DNA, 22 bp, Homo sapiens
cctctggggtgagtgggccact

SEQ ID NO: 9426454 - DNA, 22 bp, Homo sapiens
cctctggggtctagcaatagca

SEQ ID NO: 9426455 - DNA, 22 bp, Homo sapiens
cctctggggtctagcaatagca

SEQ ID NO: 9426456 - DNA, 22 bp, Homo sapiens
cctctggggtgagtgggccact

SEQ ID NO: 9426457 - DNA, 22 bp, Homo sapiens
cctctggggtctagcaatagca

SEQ ID NO: 9426458 - DNA, 22 bp, Homo sapiens
cctctgggggtcctcagagtct

SEQ ID NO: 9426459 - DNA, 22 bp, Homo sapiens
cctctgggggtcctcagagtct

SEQ ID NO: 9426460 - DNA, 22 bp, Homo sapiens
cctctgggggtcctcagagtct

SEQ ID NO: 9426461 - DNA, 20 bp, Homo sapiens
cctctctgaagaggtcatct

SEQ ID NO: 9426462 - DNA, 20 bp, Homo sapiens
cctctctgaagaggtcatct

SEQ ID NO: 9426463 - DNA, 20 bp, Homo sapiens
cctctctgccctgcaaggcc

SEQ ID NO: 9426464 - DNA, 20 bp, Homo sapiens
cctctctgcatgctccctga

SEQ ID NO: 9426465 - DNA, 20 bp, Homo sapiens
cctctctgcatgctccctga

SEQ ID NO: 9426466 - DNA, 20 bp, Homo sapiens
cctctctgcatgctccctga

SEQ ID NO: 9426467 - DNA, 22 bp, Homo sapiens
tggctgccttccctgctggagg

SEQ ID NO: 9426468 - DNA, 22 bp, Homo sapiens
tggctgcctttcacctcatctc

SEQ ID NO: 9426469 - DNA, 22 bp, Homo sapiens
cctctcccgggtgccgctgggc

SEQ ID NO: 9426470 - DNA, 22 bp, Homo sapiens
cctctctcttgtagtccctgcc

SEQ ID NO: 9426471 - DNA, 19 bp, Homo sapiens
cctctccgcccaccagccc

SEQ ID NO: 9426472 - DNA, 19 bp, Homo sapiens
cctctccgcccaccagccc

SEQ ID NO: 9426473 - DNA, 22 bp, Homo sapiens
cctctctgtgtggcctctccat

SEQ ID NO: 9426474 - DNA, 22 bp, Homo sapiens
cctctctgtcacaccagtggcc

SEQ ID NO: 9426475 - DNA, 22 bp, Homo sapiens
cctctctgtcacaccagtggcc

SEQ ID NO: 9426476 - DNA, 20 bp, Homo sapiens
cctctctgccctgcaaggcc

SEQ ID NO: 9426477 - DNA, 20 bp, Homo sapiens
cctctctgccctgcaaggcc

SEQ ID NO: 9426478 - DNA, 20 bp, Homo sapiens
cctctctgccctgcaaggcc

SEQ ID NO: 9426479 - DNA, 21 bp, Homo sapiens
tggctgcctacatgctgcagg

SEQ ID NO: 9426480 - DNA, 22 bp, Homo sapiens
tggctgcctagtccctcagcct

SEQ ID NO: 9426481 - DNA, 22 bp, Homo sapiens
tggctgcctagtccctcagcct

SEQ ID NO: 9426482 - DNA, 22 bp, Homo sapiens
tggctgccctcatgggcctgat

SEQ ID NO: 9426483 - DNA, 21 bp, Homo sapiens
tggctgcctacatgctgcagg

SEQ ID NO: 9426484 - DNA, 22 bp, Homo sapiens
tggctgccgactggctcttggc

SEQ ID NO: 9426485 - DNA, 22 bp, Homo sapiens
tggctgcctgatcgagcaggtg

SEQ ID NO: 9426486 - DNA, 22 bp, Homo sapiens
tggctgcctgatcgagcaggtg

SEQ ID NO: 9426487 - DNA, 22 bp, Homo sapiens
tggctgcctgatcgagcaggtg

SEQ ID NO: 9426488 - DNA, 21 bp, Homo sapiens
tggctgcctggctctgtggtt

SEQ ID NO: 9426489 - DNA, 22 bp, Homo sapiens
tggctgccttccctgctggagg

SEQ ID NO: 9426490 - DNA, 22 bp, Homo sapiens
tggctgcctgaatgcaagacag

SEQ ID NO: 9426491 - DNA, 22 bp, Homo sapiens
tggctgcctcagtgtccctgca

SEQ ID NO: 9426492 - DNA, 22 bp, Homo sapiens
tggctgcctagtgtctgagcag

SEQ ID NO: 9426493 - DNA, 22 bp, Homo sapiens
tggctgcctagtgtctgagcag

SEQ ID NO: 9426494 - DNA, 22 bp, Homo sapiens
cctctcagccggactgtcaggc

SEQ ID NO: 9426495 - DNA, 22 bp, Homo sapiens
cctctcaaaagcacaacattga

SEQ ID NO: 9426496 - DNA, 22 bp, Homo sapiens
cctctcagccggactgtcaggc

SEQ ID NO: 9426497 - DNA, 22 bp, Homo sapiens
cctctacttaccactcagccag

SEQ ID NO: 9426498 - DNA, 22 bp, Homo sapiens
cctctacttaccactcagccag

SEQ ID NO: 9426499 - DNA, 22 bp, Homo sapiens
cctctacttaccactcagccag

SEQ ID NO: 9426500 - DNA, 22 bp, Homo sapiens
cctctacagggcatagcccaaa

SEQ ID NO: 9426501 - DNA, 22 bp, Homo sapiens
cctctacagggcatagcccaaa

SEQ ID NO: 9426502 - DNA, 23 bp, Homo sapiens
cctctaataaacttgaccttgtg

SEQ ID NO: 9426503 - DNA, 22 bp, Homo sapiens
cctctcagcgattcctcttgga

SEQ ID NO: 9426504 - DNA, 22 bp, Homo sapiens
cctctcagtattgaactttata

SEQ ID NO: 9426505 - DNA, 22 bp, Homo sapiens
cctctcagcgattcctcttgga

SEQ ID NO: 9426506 - DNA, 22 bp, Homo sapiens
cctctcagtattgaactttata

SEQ ID NO: 9426507 - DNA, 20 bp, Homo sapiens
tggctgcccgaggcacacac

SEQ ID NO: 9426508 - DNA, 22 bp, Homo sapiens
cctctccagcggcctcagggcc

SEQ ID NO: 9426509 - DNA, 23 bp, Homo sapiens
cctctccagacactgggccttgt

SEQ ID NO: 9426510 - DNA, 23 bp, Homo sapiens
cctctccagacactgggccttgt

SEQ ID NO: 9426511 - DNA, 22 bp, Homo sapiens
tggctcagtttgggggattgaa

SEQ ID NO: 9426512 - DNA, 22 bp, Homo sapiens
tggctcatctttttagacttat

SEQ ID NO: 9426513 - DNA, 22 bp, Homo sapiens
tggctcatgcatcttttctaca

SEQ ID NO: 9426514 - DNA, 22 bp, Homo sapiens
tggctcatattgagtgatttct

SEQ ID NO: 9426515 - DNA, 22 bp, Homo sapiens
tggctcagtttgggggattgaa

SEQ ID NO: 9426516 - DNA, 22 bp, Homo sapiens
tggctcagtttagcagctcagt

SEQ ID NO: 9426517 - DNA, 22 bp, Homo sapiens
tggctcagtttagcagctcagt

SEQ ID NO: 9426518 - DNA, 22 bp, Homo sapiens
tggctcagtttctgcccagctg

SEQ ID NO: 9426519 - DNA, 22 bp, Homo sapiens
tggctcagtttcagtcctggtt

SEQ ID NO: 9426520 - DNA, 22 bp, Homo sapiens
tggctcagtttcagtcctggtt

SEQ ID NO: 9426521 - DNA, 22 bp, Homo sapiens
tggccctgctgtatcatctgct

SEQ ID NO: 9426522 - DNA, 22 bp, Homo sapiens
tggccctgctgtatcatctgct

SEQ ID NO: 9426523 - DNA, 22 bp, Homo sapiens
tggccctgctggccaaaggcta

SEQ ID NO: 9426524 - DNA, 22 bp, Homo sapiens
tggccctgctgggtcagagctg

SEQ ID NO: 9426525 - DNA, 22 bp, Homo sapiens
tggccctgctgggtcagagctg

SEQ ID NO: 9426526 - DNA, 22 bp, Homo sapiens
tggccctgcttatgtctctctt

SEQ ID NO: 9426527 - DNA, 22 bp, Homo sapiens
tggctcagctgactcggcttct

SEQ ID NO: 9426528 - DNA, 21 bp, Homo sapiens
tggctcagttgctgggcacag

SEQ ID NO: 9426529 - DNA, 21 bp, Homo sapiens
tggctcagttgctgggcacag

SEQ ID NO: 9426530 - DNA, 20 bp, Homo sapiens
tggcccagtggggcagggtg

SEQ ID NO: 9426531 - DNA, 20 bp, Homo sapiens
tggcccagtggggcagggtg

SEQ ID NO: 9426532 - DNA, 20 bp, Homo sapiens
tggcccagtggggcagggtg

SEQ ID NO: 9426533 - DNA, 20 bp, Homo sapiens
tggcccagtggggcagggtg

SEQ ID NO: 9426534 - DNA, 20 bp, Homo sapiens
tggcccagtggggcagggtg

SEQ ID NO: 9426535 - DNA, 20 bp, Homo sapiens
tggcccagtggggcagggtg

SEQ ID NO: 9426536 - DNA, 22 bp, Homo sapiens
tggccccattttacagatgaaa

SEQ ID NO: 9426537 - DNA, 22 bp, Homo sapiens
tggcccagcagttctgccccag

SEQ ID NO: 9426538 - DNA, 21 bp, Homo sapiens
cctatgtcgcactcctaggat

SEQ ID NO: 9426539 - DNA, 22 bp, Homo sapiens
tggcccagtgcttatgctctga

SEQ ID NO: 9426540 - DNA, 22 bp, Homo sapiens
tggcccagtgcttatgctctga

SEQ ID NO: 9426541 - DNA, 22 bp, Homo sapiens
tggcccagtgcttatgctctga

SEQ ID NO: 9426542 - DNA, 22 bp, Homo sapiens
tggcccagtgcttatgctctga

SEQ ID NO: 9426543 - DNA, 22 bp, Homo sapiens
tggcccagtgcttatgctctga

SEQ ID NO: 9426544 - DNA, 22 bp, Homo sapiens
tggcccagtgcttatgctctga

SEQ ID NO: 9426545 - DNA, 22 bp, Homo sapiens
tggccccctgattgtcaccttt

SEQ ID NO: 9426546 - DNA, 18 bp, Homo sapiens
tggccccttatcagtcct

SEQ ID NO: 9426547 - DNA, 22 bp, Homo sapiens
tggcccgaagatccgagggtca

SEQ ID NO: 9426548 - DNA, 22 bp, Homo sapiens
tggcccgacctctgctcatgca

SEQ ID NO: 9426549 - DNA, 22 bp, Homo sapiens
tggccctgctggacacgcctgc

SEQ ID NO: 9426550 - DNA, 22 bp, Homo sapiens
tggccctgctggccaaaggcta

SEQ ID NO: 9426551 - DNA, 22 bp, Homo sapiens
tggccctgctggacacgcctgc

SEQ ID NO: 9426552 - DNA, 22 bp, Homo sapiens
tggccctgctggccaaaggcta

SEQ ID NO: 9426553 - DNA, 22 bp, Homo sapiens
tggcccgcagcacgcgcaccat

SEQ ID NO: 9426554 - DNA, 22 bp, Homo sapiens
tggccctgctatgatcctgcaa

SEQ ID NO: 9426555 - DNA, 22 bp, Homo sapiens
tggccctgctatgatcctgcaa

SEQ ID NO: 9426556 - DNA, 22 bp, Homo sapiens
tggccctgctatgatcctgcaa

SEQ ID NO: 9426557 - DNA, 22 bp, Homo sapiens
tggccctgctatgatcctgcaa

SEQ ID NO: 9426558 - DNA, 22 bp, Homo sapiens
tggctgaggtctggggcttctg

SEQ ID NO: 9426559 - DNA, 22 bp, Homo sapiens
tggctgaggtaactatgaataa

SEQ ID NO: 9426560 - DNA, 23 bp, Homo sapiens
tggctgaggtccaggtagtttca

SEQ ID NO: 9426561 - DNA, 23 bp, Homo sapiens
tggctgaggtccaggtagtttca

SEQ ID NO: 9426562 - DNA, 22 bp, Homo sapiens
tggctgaggtaactatgaataa

SEQ ID NO: 9426563 - DNA, 22 bp, Homo sapiens
tggctgaggtaactatgaataa

SEQ ID NO: 9426564 - DNA, 22 bp, Homo sapiens
tggctgagggggctctgctcag

SEQ ID NO: 9426565 - DNA, 22 bp, Homo sapiens
tggctgagggggctctgctcag

SEQ ID NO: 9426566 - DNA, 22 bp, Homo sapiens
tggctgagagcaattgactctg

SEQ ID NO: 9426567 - DNA, 22 bp, Homo sapiens
tggctgagggggcagttcagga

SEQ ID NO: 9426568 - DNA, 22 bp, Homo sapiens
tggctgagggggcagttcagga

SEQ ID NO: 9426569 - DNA, 22 bp, Homo sapiens
cctccagcgcgatccactccgg

SEQ ID NO: 9426570 - DNA, 22 bp, Homo sapiens
cctccagccttcctgaagagcc

SEQ ID NO: 9426571 - DNA, 22 bp, Homo sapiens
cctccagcgcgatccactccgg

SEQ ID NO: 9426572 - DNA, 22 bp, Homo sapiens
cctccagcgcgatccactccgg

SEQ ID NO: 9426573 - DNA, 22 bp, Homo sapiens
cctccagcattactggcccatg

SEQ ID NO: 9426574 - DNA, 22 bp, Homo sapiens
cctccagcattactggcccatg

SEQ ID NO: 9426575 - DNA, 22 bp, Homo sapiens
cctccagcattactggcccatg

SEQ ID NO: 9426576 - DNA, 22 bp, Homo sapiens
cctccagcattactggcccatg

SEQ ID NO: 9426577 - DNA, 22 bp, Homo sapiens
cctccagcattactggcccatg

SEQ ID NO: 9426578 - DNA, 22 bp, Homo sapiens
cctccagactttggccatcctc

SEQ ID NO: 9426579 - DNA, 22 bp, Homo sapiens
cctccagagggtttcccatgaa

SEQ ID NO: 9426580 - DNA, 22 bp, Homo sapiens
cctccagagggtttcccatgaa

SEQ ID NO: 9426581 - DNA, 22 bp, Homo sapiens
cctccagactttggccatcctc

SEQ ID NO: 9426582 - DNA, 22 bp, Homo sapiens
cctccacaggagctgcagtgct

SEQ ID NO: 9426583 - DNA, 22 bp, Homo sapiens
cctccacaggagctgcagtgct

SEQ ID NO: 9426584 - DNA, 22 bp, Homo sapiens
cctccaagtgagagatggtaca

SEQ ID NO: 9426585 - DNA, 22 bp, Homo sapiens
cctccaagtttgactcaggaca

SEQ ID NO: 9426586 - DNA, 22 bp, Homo sapiens
cctccacaggagctgcagtgct

SEQ ID NO: 9426587 - DNA, 22 bp, Homo sapiens
cctccctgtctacctgttgtgg

SEQ ID NO: 9426588 - DNA, 22 bp, Homo sapiens
cctccctgtctacctgttgtgg

SEQ ID NO: 9426589 - DNA, 22 bp, Homo sapiens
cctccctgtctacctgttgtgg

SEQ ID NO: 9426590 - DNA, 22 bp, Homo sapiens
cctccctggtggctctggtcta

SEQ ID NO: 9426591 - DNA, 22 bp, Homo sapiens
cctccctggtggctctggtcta

SEQ ID NO: 9426592 - DNA, 22 bp, Homo sapiens
cctcctagaggaaccccagggc

SEQ ID NO: 9426593 - DNA, 22 bp, Homo sapiens
cctcctagaggaaccccagggc

SEQ ID NO: 9426594 - DNA, 22 bp, Homo sapiens
cctccctgctcctcaactggca

SEQ ID NO: 9426595 - DNA, 22 bp, Homo sapiens
cctccctgctcctcaactggca

SEQ ID NO: 9426596 - DNA, 22 bp, Homo sapiens
tggctgaggtctggggcttctg

SEQ ID NO: 9426597 - DNA, 22 bp, Homo sapiens
cctccctggccagagcagcagc

SEQ ID NO: 9426598 - DNA, 22 bp, Homo sapiens
cctccctggccagagcagcagc

SEQ ID NO: 9426599 - DNA, 22 bp, Homo sapiens
cctccctggccagagcagcagc

SEQ ID NO: 9426600 - DNA, 22 bp, Homo sapiens
cctccctggccagagcagcagc

SEQ ID NO: 9426601 - DNA, 22 bp, Homo sapiens
cctccctgggtgacgggctcct

SEQ ID NO: 9426602 - DNA, 22 bp, Homo sapiens
cctccctgggtgacgggctcct

SEQ ID NO: 9426603 - DNA, 22 bp, Homo sapiens
cctcctggtccagcatctcttt

SEQ ID NO: 9426604 - DNA, 22 bp, Homo sapiens
cctcctggtccagcatctcttt

SEQ ID NO: 9426605 - DNA, 22 bp, Homo sapiens
cctcggagcgggtcagagaggg

SEQ ID NO: 9426606 - DNA, 22 bp, Homo sapiens
cctcggagcgggtcagagaggg

SEQ ID NO: 9426607 - DNA, 22 bp, Homo sapiens
cctcggctgcccagcccagctg

SEQ ID NO: 9426608 - DNA, 22 bp, Homo sapiens
cctcggggcaccgcggcctgct

SEQ ID NO: 9426609 - DNA, 22 bp, Homo sapiens
cctcggtttccacatctgtaca

SEQ ID NO: 9426610 - DNA, 22 bp, Homo sapiens
cctcgtggtgtcagacctgtgc

SEQ ID NO: 9426611 - DNA, 22 bp, Homo sapiens
cctcgtgtgctaggatccaggt

SEQ ID NO: 9426612 - DNA, 22 bp, Homo sapiens
tggccaggaggctgcttctgac

SEQ ID NO: 9426613 - DNA, 22 bp, Homo sapiens
tggccaggaggctgcttctgac

SEQ ID NO: 9426614 - DNA, 22 bp, Homo sapiens
tggccaggaggctgcttctgac

SEQ ID NO: 9426615 - DNA, 22 bp, Homo sapiens
tggccagctttgactgtaaacc

SEQ ID NO: 9426616 - DNA, 22 bp, Homo sapiens
tggccagctttgactgtaaacc

SEQ ID NO: 9426617 - DNA, 22 bp, Homo sapiens
tggccagctttttgtagtgctc

SEQ ID NO: 9426618 - DNA, 22 bp, Homo sapiens
tggccagctttttgtagtgctc

SEQ ID NO: 9426619 - DNA, 22 bp, Homo sapiens
tggcagcttgaatgcagtcttt

SEQ ID NO: 9426620 - DNA, 22 bp, Homo sapiens
tggcagcttgaatgcagtcttt

SEQ ID NO: 9426621 - DNA, 22 bp, Homo sapiens
tggcagcttgaatgcagtcttt

SEQ ID NO: 9426622 - DNA, 22 bp, Homo sapiens
tggccacacccacctagaggag

SEQ ID NO: 9426623 - DNA, 22 bp, Homo sapiens
tggccagctgtaggttgtgcag

SEQ ID NO: 9426624 - DNA, 21 bp, Homo sapiens
tggccagctggagtctccaca

SEQ ID NO: 9426625 - DNA, 21 bp, Homo sapiens
tggccagctggagtctccaca

SEQ ID NO: 9426626 - DNA, 23 bp, Homo sapiens
tggcagctgtgtaagagaaagca

SEQ ID NO: 9426627 - DNA, 22 bp, Homo sapiens
tggcagctgtgtccaggtagaa

SEQ ID NO: 9426628 - DNA, 22 bp, Homo sapiens
tggcagctgtgtccaggtagaa

SEQ ID NO: 9426629 - DNA, 22 bp, Homo sapiens
tggcagcttgaatgcagtcttt

SEQ ID NO: 9426630 - DNA, 22 bp, Homo sapiens
tggcagcttgaatgcagtcttt

SEQ ID NO: 9426631 - DNA, 22 bp, Homo sapiens
tggcagctggctctgcgcaggc

SEQ ID NO: 9426632 - DNA, 22 bp, Homo sapiens
tggcagctggtacagtgggtct

SEQ ID NO: 9426633 - DNA, 22 bp, Homo sapiens
tggcagctgtctgtggggtctc

SEQ ID NO: 9426634 - DNA, 22 bp, Homo sapiens
cctaggccctcaaagagcataa

SEQ ID NO: 9426635 - DNA, 20 bp, Homo sapiens
cctaggccctccggctgccc

SEQ ID NO: 9426636 - DNA, 23 bp, Homo sapiens
tggccaggcataaaggtgggtgg

SEQ ID NO: 9426637 - DNA, 23 bp, Homo sapiens
tggccaggcataaaggtgggtgg

SEQ ID NO: 9426638 - DNA, 23 bp, Homo sapiens
tggccaggcataaaggtgggtgg

SEQ ID NO: 9426639 - DNA, 23 bp, Homo sapiens
tggccaggcataaaggtgggtgg

SEQ ID NO: 9426640 - DNA, 22 bp, Homo sapiens
tggccaggcaggtagaacggcc

SEQ ID NO: 9426641 - DNA, 22 bp, Homo sapiens
tggccaggcaggtagaacggcc

SEQ ID NO: 9426642 - DNA, 22 bp, Homo sapiens
tggccaggcaggtagaacggcc

SEQ ID NO: 9426643 - DNA, 23 bp, Homo sapiens
tggccaggcataaaggtgggtgg

SEQ ID NO: 9426644 - DNA, 23 bp, Homo sapiens
tggccaggcataaaggtgggtgg

SEQ ID NO: 9426645 - DNA, 21 bp, Homo sapiens
cctagtgttaaaacagtttaa

SEQ ID NO: 9426646 - DNA, 22 bp, Homo sapiens
cctagtcttccgcgtccccacc

SEQ ID NO: 9426647 - DNA, 22 bp, Homo sapiens
cctagtcttccgcgtccccacc

SEQ ID NO: 9426648 - DNA, 22 bp, Homo sapiens
cctatgaaacgtaatggaatgt

SEQ ID NO: 9426649 - DNA, 22 bp, Homo sapiens
cctatgaaacgtaatggaatgt

SEQ ID NO: 9426650 - DNA, 22 bp, Homo sapiens
cctatgaacaggaaatggaacg

SEQ ID NO: 9426651 - DNA, 22 bp, Homo sapiens
cctatgaacaggaaatggaacg

SEQ ID NO: 9426652 - DNA, 22 bp, Homo sapiens
cctatgcctgtcactctgcgct

SEQ ID NO: 9426653 - DNA, 22 bp, Homo sapiens
cctagtttttcacttgtgctgt

SEQ ID NO: 9426654 - DNA, 22 bp, Homo sapiens
cctaggctaattcagtccagta

SEQ ID NO: 9426655 - DNA, 22 bp, Homo sapiens
cctaggctggctgtcttcaggt

SEQ ID NO: 9426656 - DNA, 22 bp, Homo sapiens
cctaggcttgttttcatcagct

SEQ ID NO: 9426657 - DNA, 22 bp, Homo sapiens
cctaggctggctgtcttcaggt

SEQ ID NO: 9426658 - DNA, 22 bp, Homo sapiens
cctaggccgcccggtgcgtggg

SEQ ID NO: 9426659 - DNA, 22 bp, Homo sapiens
cctaggctggctgtcttcaggt

SEQ ID NO: 9426660 - DNA, 22 bp, Homo sapiens
cctagggagcctgagagcagtg

SEQ ID NO: 9426661 - DNA, 20 bp, Homo sapiens
cctagggcaagtgggtgggc

SEQ ID NO: 9426662 - DNA, 22 bp, Homo sapiens
cctagggtcagtgtggcaggag

SEQ ID NO: 9426663 - DNA, 23 bp, Homo sapiens
tggcaaggaatgggatggagact

SEQ ID NO: 9426664 - DNA, 22 bp, Homo sapiens
tggcaaggccacaggtgcagtt

SEQ ID NO: 9426665 - DNA, 22 bp, Homo sapiens
tggcaaggccacaggtgcagtt

SEQ ID NO: 9426666 - DNA, 22 bp, Homo sapiens
tggcaaggccacaggtgcagtt

SEQ ID NO: 9426667 - DNA, 22 bp, Homo sapiens
tggcaaggctgtgggggcagag

SEQ ID NO: 9426668 - DNA, 22 bp, Homo sapiens
tggcaagggattgtggagaact

SEQ ID NO: 9426669 - DNA, 22 bp, Homo sapiens
tggcaagggattgtggagaact

SEQ ID NO: 9426670 - DNA, 22 bp, Homo sapiens
tggcacagcttgtcataaactc

SEQ ID NO: 9426671 - DNA, 22 bp, Homo sapiens
tggcacagcttgtcataaactc

SEQ ID NO: 9426672 - DNA, 22 bp, Homo sapiens
tggcacaggaatttagatgcag

SEQ ID NO: 9426673 - DNA, 22 bp, Homo sapiens
tggcacaggagcactgccctgg

SEQ ID NO: 9426674 - DNA, 22 bp, Homo sapiens
tggcacaggagcactgccctgg

SEQ ID NO: 9426675 - DNA, 22 bp, Homo sapiens
tggcacaggagcactgccctgg

SEQ ID NO: 9426676 - DNA, 22 bp, Homo sapiens
tggcacaggagcactgccctgg

SEQ ID NO: 9426677 - DNA, 22 bp, Homo sapiens
tggcacaggagcactgccctgg

SEQ ID NO: 9426678 - DNA, 22 bp, Homo sapiens
tggcacaggcggtaagggtgtg

SEQ ID NO: 9426679 - DNA, 22 bp, Homo sapiens
tggcacaggatctcagcggcca

SEQ ID NO: 9426680 - DNA, 22 bp, Homo sapiens
tggcacagggcttggtcgctca

SEQ ID NO: 9426681 - DNA, 22 bp, Homo sapiens
tggcacagggcttggtcgctca

SEQ ID NO: 9426682 - DNA, 22 bp, Homo sapiens
tggcacagggcttggtcgctca

SEQ ID NO: 9426683 - DNA, 22 bp, Homo sapiens
tggcacagtatgggattaaaga

SEQ ID NO: 9426684 - DNA, 22 bp, Homo sapiens
tggcacagtcctgggtgcctgc

SEQ ID NO: 9426685 - DNA, 22 bp, Homo sapiens
tggcacagtcctgggtgcctgc

SEQ ID NO: 9426686 - DNA, 22 bp, Homo sapiens
tggcacagtcctgggtgcctgc

SEQ ID NO: 9426687 - DNA, 22 bp, Homo sapiens
tggcagcacattgacccgggct

SEQ ID NO: 9426688 - DNA, 22 bp, Homo sapiens
tggcagcaccagcagtgtcctt

SEQ ID NO: 9426689 - DNA, 22 bp, Homo sapiens
tggcagcaccagcagtgtcctt

SEQ ID NO: 9426690 - DNA, 22 bp, Homo sapiens
tggcagcacaaggtggcccatg

SEQ ID NO: 9426691 - DNA, 22 bp, Homo sapiens
tggcagcaatttgtgatgttga

SEQ ID NO: 9426692 - DNA, 22 bp, Homo sapiens
tggcagcaattagctagagctg

SEQ ID NO: 9426693 - DNA, 22 bp, Homo sapiens
tggcagcaatttgtgatgttga

SEQ ID NO: 9426694 - DNA, 22 bp, Homo sapiens
tggcagctggagggcaatggcc

SEQ ID NO: 9426695 - DNA, 22 bp, Homo sapiens
tggcagcactaggtactgagct

SEQ ID NO: 9426696 - DNA, 22 bp, Homo sapiens
tggcagcacggcatccactctc

SEQ ID NO: 9426697 - DNA, 21 bp, Homo sapiens
tggcagcacccacaccctctg

SEQ ID NO: 9426698 - DNA, 22 bp, Homo sapiens
tggcagcacggcatccactctc

SEQ ID NO: 9426699 - DNA, 22 bp, Homo sapiens
tggcagcacggcatccactctc

SEQ ID NO: 9426700 - DNA, 22 bp, Homo sapiens
tggcagcaattagctagagctg

SEQ ID NO: 9426701 - DNA, 22 bp, Homo sapiens
tggcagcaatagaaatataatc

SEQ ID NO: 9426702 - DNA, 22 bp, Homo sapiens
tggcagcaagttcttgggaggt

SEQ ID NO: 9426703 - DNA, 22 bp, Homo sapiens
tggcagcaagttcttgggaggt

SEQ ID NO: 9426704 - DNA, 22 bp, Homo sapiens
tggcagcaaaaccagaatcaga

SEQ ID NO: 9426705 - DNA, 22 bp, Homo sapiens
tggcagaggtatattgggagga

SEQ ID NO: 9426706 - DNA, 22 bp, Homo sapiens
tggcagatgagccgcgctccaa

SEQ ID NO: 9426707 - DNA, 22 bp, Homo sapiens
tggcagatggcctggaaccaaa

SEQ ID NO: 9426708 - DNA, 22 bp, Homo sapiens
tggcagatgtatatcacagctt

SEQ ID NO: 9426709 - DNA, 22 bp, Homo sapiens
tggcagatgagccgcgctccaa

SEQ ID NO: 9426710 - DNA, 22 bp, Homo sapiens
tggcagatggcctggaaccaaa

SEQ ID NO: 9426711 - DNA, 22 bp, Homo sapiens
tggcagatgtggtttgagacag

SEQ ID NO: 9426712 - DNA, 22 bp, Homo sapiens
tggcagattttctctggaggag

SEQ ID NO: 9426713 - DNA, 22 bp, Homo sapiens
tggcagatttaacattggaact

SEQ ID NO: 9426714 - DNA, 22 bp, Homo sapiens
ccctggcctacaggcccagaga

SEQ ID NO: 9426715 - DNA, 22 bp, Homo sapiens
ccctggcctacaggcccagaga

SEQ ID NO: 9426716 - DNA, 22 bp, Homo sapiens
ccctggcctccaggcagtcctg

SEQ ID NO: 9426717 - DNA, 22 bp, Homo sapiens
ccctggcctccaggcagtcctg

SEQ ID NO: 9426718 - DNA, 22 bp, Homo sapiens
ccctggcctccaggcagtcctg

SEQ ID NO: 9426719 - DNA, 20 bp, Homo sapiens
ccctggcctgtttcatgccc

SEQ ID NO: 9426720 - DNA, 22 bp, Homo sapiens
ccctggatttacatcattctga

SEQ ID NO: 9426721 - DNA, 22 bp, Homo sapiens
ccctggatttacatcattctga

SEQ ID NO: 9426722 - DNA, 18 bp, Homo sapiens
tggagctgagggcaatgc

SEQ ID NO: 9426723 - DNA, 22 bp, Homo sapiens
tggagctgagcacctccagggc

SEQ ID NO: 9426724 - DNA, 22 bp, Homo sapiens
tggagctgagcacctccagggc

SEQ ID NO: 9426725 - DNA, 22 bp, Homo sapiens
ccctggctctgcctcagagccc

SEQ ID NO: 9426726 - DNA, 22 bp, Homo sapiens
ccctggctctgcctcagagccc

SEQ ID NO: 9426727 - DNA, 22 bp, Homo sapiens
ccctggctcttcaccacctgcc

SEQ ID NO: 9426728 - DNA, 22 bp, Homo sapiens
ccctggctcttcaccacctgcc

SEQ ID NO: 9426729 - DNA, 22 bp, Homo sapiens
ccctggctgccagtcaccagac

SEQ ID NO: 9426730 - DNA, 22 bp, Homo sapiens
ccctggctgccagtcaccagac

SEQ ID NO: 9426731 - DNA, 22 bp, Homo sapiens
ccctggctgccagtcaccagac

SEQ ID NO: 9426732 - DNA, 22 bp, Homo sapiens
ccctggctgataccggaaaggc

SEQ ID NO: 9426733 - DNA, 22 bp, Homo sapiens
ccctggctgataccggaaaggc

SEQ ID NO: 9426734 - DNA, 22 bp, Homo sapiens
ccctggctcaggcagctttgtt

SEQ ID NO: 9426735 - DNA, 17 bp, Homo sapiens
ccctggctctaggtgga

SEQ ID NO: 9426736 - DNA, 17 bp, Homo sapiens
ccctggctctaggtgga

SEQ ID NO: 9426737 - DNA, 22 bp, Homo sapiens
ccctggctctgcctcagagccc

SEQ ID NO: 9426738 - DNA, 22 bp, Homo sapiens
ccctggctctgcctcagagccc

SEQ ID NO: 9426739 - DNA, 23 bp, Homo sapiens
ccctggccttggggcacaggctg

SEQ ID NO: 9426740 - DNA, 23 bp, Homo sapiens
ccctggccttggggcacaggctg

SEQ ID NO: 9426741 - DNA, 23 bp, Homo sapiens
ccctggccttggggcacaggctg

SEQ ID NO: 9426742 - DNA, 22 bp, Homo sapiens
ccctggcctccaggcagtcctg

SEQ ID NO: 9426743 - DNA, 23 bp, Homo sapiens
ccctggccttggggcacaggctg

SEQ ID NO: 9426744 - DNA, 22 bp, Homo sapiens
tggcaagctgggttgggtagcc

SEQ ID NO: 9426745 - DNA, 22 bp, Homo sapiens
tggcaaggaagagcctggtgca

SEQ ID NO: 9426746 - DNA, 17 bp, Homo sapiens
tggcaagacagctcagg

SEQ ID NO: 9426747 - DNA, 22 bp, Homo sapiens
tggcaagagggatgcaaggttt

SEQ ID NO: 9426748 - DNA, 22 bp, Homo sapiens
tggatgagggctgagcactggg

SEQ ID NO: 9426749 - DNA, 22 bp, Homo sapiens
tggatgagttcaatgaggcaga

SEQ ID NO: 9426750 - DNA, 22 bp, Homo sapiens
tggatgcctgggcctccttcca

SEQ ID NO: 9426751 - DNA, 22 bp, Homo sapiens
tggcaagaatattggaccagaa

SEQ ID NO: 9426752 - DNA, 17 bp, Homo sapiens
tggcaagaatggaaatg

SEQ ID NO: 9426753 - DNA, 22 bp, Homo sapiens
tggatgagttcaatgaggcaga

SEQ ID NO: 9426754 - DNA, 22 bp, Homo sapiens
tggatgagattaaagtgaggtt

SEQ ID NO: 9426755 - DNA, 22 bp, Homo sapiens
tggatgagggctgagcactggg

SEQ ID NO: 9426756 - DNA, 22 bp, Homo sapiens
tggatgagaaactctggtgact

SEQ ID NO: 9426757 - DNA, 22 bp, Homo sapiens
tggatgaacagttttggagaga

SEQ ID NO: 9426758 - DNA, 22 bp, Homo sapiens
tggatgaaatattgcatttatg

SEQ ID NO: 9426759 - DNA, 18 bp, Homo sapiens
tggatctttatgaggctg

SEQ ID NO: 9426760 - DNA, 22 bp, Homo sapiens
tggatctgactggcttttcttc

SEQ ID NO: 9426761 - DNA, 22 bp, Homo sapiens
tggatctggttccctgagcctt

SEQ ID NO: 9426762 - DNA, 21 bp, Homo sapiens
tggatctgtgatctggggcac

SEQ ID NO: 9426763 - DNA, 22 bp, Homo sapiens
tggatctgtcccaaggctaggc

SEQ ID NO: 9426764 - DNA, 22 bp, Homo sapiens
tggatctcggcaatgcgggact

SEQ ID NO: 9426765 - DNA, 22 bp, Homo sapiens
tggatctcggcaatgcgggact

SEQ ID NO: 9426766 - DNA, 22 bp, Homo sapiens
tggatcctcttaatgtgtaagg

SEQ ID NO: 9426767 - DNA, 23 bp, Homo sapiens
tggagctgacagtcagagggagg

SEQ ID NO: 9426768 - DNA, 22 bp, Homo sapiens
ccctggagctagtctgagcaga

SEQ ID NO: 9426769 - DNA, 23 bp, Homo sapiens
tggagctgacagtcagagggagg

SEQ ID NO: 9426770 - DNA, 22 bp, Homo sapiens
tggagctgagaagtggagctct

SEQ ID NO: 9426771 - DNA, 22 bp, Homo sapiens
tggagctgactcacaccagcta

SEQ ID NO: 9426772 - DNA, 22 bp, Homo sapiens
tggagctgactcacaccagcta

SEQ ID NO: 9426773 - DNA, 22 bp, Homo sapiens
tggagctgagaagtggagctct

SEQ ID NO: 9426774 - DNA, 22 bp, Homo sapiens
tggagctgagagccaggctggc

SEQ ID NO: 9426775 - DNA, 22 bp, Homo sapiens
tggagctgagaagtggagctct

SEQ ID NO: 9426776 - DNA, 22 bp, Homo sapiens
tggagctgagaagtggagctct

SEQ ID NO: 9426777 - DNA, 22 bp, Homo sapiens
tggagctgagagccaggctggc

SEQ ID NO: 9426778 - DNA, 20 bp, Homo sapiens
ccctggagagaagctccacg

SEQ ID NO: 9426779 - DNA, 20 bp, Homo sapiens
ccctggagagaagctccacg

SEQ ID NO: 9426780 - DNA, 19 bp, Homo sapiens
ccctggagaataccctgga

SEQ ID NO: 9426781 - DNA, 20 bp, Homo sapiens
ccctggagagaagctccacg

SEQ ID NO: 9426782 - DNA, 22 bp, Homo sapiens
ccctggagaaggggacgcggag

SEQ ID NO: 9426783 - DNA, 20 bp, Homo sapiens
ccctggagagaagctccacg

SEQ ID NO: 9426784 - DNA, 22 bp, Homo sapiens
ccctggagctagtctgagcaga

SEQ ID NO: 9426785 - DNA, 22 bp, Homo sapiens
ccctggagcatctctgctgtct

SEQ ID NO: 9426786 - DNA, 22 bp, Homo sapiens
ccctggagatcgggagaggaag

SEQ ID NO: 9426787 - DNA, 22 bp, Homo sapiens
ccctggagaggactcacccctg

SEQ ID NO: 9426788 - DNA, 22 bp, Homo sapiens
ccctggagatcgggagaggaag

SEQ ID NO: 9426789 - DNA, 22 bp, Homo sapiens
ccctggagatcgggagaggaag

SEQ ID NO: 9426790 - DNA, 22 bp, Homo sapiens
ccctggagatcgggagaggaag

SEQ ID NO: 9426791 - DNA, 22 bp, Homo sapiens
ccctcaggtgaaaggaaaaatt

SEQ ID NO: 9426792 - DNA, 22 bp, Homo sapiens
ccctccagagcctggacattct

SEQ ID NO: 9426793 - DNA, 22 bp, Homo sapiens
ccctccaccaagcagggcgcca

SEQ ID NO: 9426794 - DNA, 20 bp, Homo sapiens
ccctccagcaaccaggactt

SEQ ID NO: 9426795 - DNA, 20 bp, Homo sapiens
ccctccagcaaccaggactt

SEQ ID NO: 9426796 - DNA, 22 bp, Homo sapiens
ccctccagccatggacccaggt

SEQ ID NO: 9426797 - DNA, 22 bp, Homo sapiens
ccctccagccatggacccaggt

SEQ ID NO: 9426798 - DNA, 22 bp, Homo sapiens
ccctccagagcttgacctgctg

SEQ ID NO: 9426799 - DNA, 22 bp, Homo sapiens
ccctccagagcttgacctgctg

SEQ ID NO: 9426800 - DNA, 22 bp, Homo sapiens
ccctgctgcagagagctttcca

SEQ ID NO: 9426801 - DNA, 22 bp, Homo sapiens
ccctgctgcagagagctttcca

SEQ ID NO: 9426802 - DNA, 22 bp, Homo sapiens
ccctccagggagccatgctggg

SEQ ID NO: 9426803 - DNA, 22 bp, Homo sapiens
ccctccagggagccatgctggg

SEQ ID NO: 9426804 - DNA, 22 bp, Homo sapiens
ccctccagggagccatgctggg

SEQ ID NO: 9426805 - DNA, 22 bp, Homo sapiens
ccctccagggagccatgctggg

SEQ ID NO: 9426806 - DNA, 22 bp, Homo sapiens
ccctgctgatgccttgattttg

SEQ ID NO: 9426807 - DNA, 22 bp, Homo sapiens
ccctgctgacaacttgattttg

SEQ ID NO: 9426808 - DNA, 22 bp, Homo sapiens
ccctccagggagccatgctggg

SEQ ID NO: 9426809 - DNA, 22 bp, Homo sapiens
ccctccagggagccatgctggg

SEQ ID NO: 9426810 - DNA, 22 bp, Homo sapiens
ccctccaggcactgccctcttc

SEQ ID NO: 9426811 - DNA, 22 bp, Homo sapiens
ccctccaggcctgtcatgttcc

SEQ ID NO: 9426812 - DNA, 22 bp, Homo sapiens
ccctccaggcctgtcatgttcc

SEQ ID NO: 9426813 - DNA, 22 bp, Homo sapiens
ccctccagctcaaagcaaccgg

SEQ ID NO: 9426814 - DNA, 22 bp, Homo sapiens
cccctcaggtacccgtgcagca

SEQ ID NO: 9426815 - DNA, 22 bp, Homo sapiens
cccctcaggtacccgtgcagca

SEQ ID NO: 9426816 - DNA, 22 bp, Homo sapiens
ccccctggcaggctggcctctc

SEQ ID NO: 9426817 - DNA, 22 bp, Homo sapiens
ccccctgcgcccggcacgtcat

SEQ ID NO: 9426818 - DNA, 16 bp, Homo sapiens
cccctcaggaagtaca

SEQ ID NO: 9426819 - DNA, 17 bp, Homo sapiens
cccctacctccgtttga

SEQ ID NO: 9426820 - DNA, 22 bp, Homo sapiens
ccccggaggcggaggttgcagt

SEQ ID NO: 9426821 - DNA, 22 bp, Homo sapiens
cccccaggggctccgcctcgtg

SEQ ID NO: 9426822 - DNA, 22 bp, Homo sapiens
cccccaggggctccgcctcgtg

SEQ ID NO: 9426823 - DNA, 22 bp, Homo sapiens
cccccaggctctgacacaggag

SEQ ID NO: 9426824 - DNA, 22 bp, Homo sapiens
cccccagtctgaacagcagctg

SEQ ID NO: 9426825 - DNA, 22 bp, Homo sapiens
cccccatccatgtcaggagagg

SEQ ID NO: 9426826 - DNA, 22 bp, Homo sapiens
cccccagccagcagtgctcagc

SEQ ID NO: 9426827 - DNA, 22 bp, Homo sapiens
cccccagccagcagtgctcagc

SEQ ID NO: 9426828 - DNA, 22 bp, Homo sapiens
cccccagctctgctgggtcccg

SEQ ID NO: 9426829 - DNA, 22 bp, Homo sapiens
cccccagccagcagtgctcagc

SEQ ID NO: 9426830 - DNA, 22 bp, Homo sapiens
cccccagctctgctgggtcccg

SEQ ID NO: 9426831 - DNA, 22 bp, Homo sapiens
cccccagctctgctgggtcccg

SEQ ID NO: 9426832 - DNA, 22 bp, Homo sapiens
cccccagatgcgagccatagcc

SEQ ID NO: 9426833 - DNA, 22 bp, Homo sapiens
cccccagatgcgagccatagcc

SEQ ID NO: 9426834 - DNA, 22 bp, Homo sapiens
cccccagatgcgagccatagcc

SEQ ID NO: 9426835 - DNA, 18 bp, Homo sapiens
cccccagccaaattctct

SEQ ID NO: 9426836 - DNA, 22 bp, Homo sapiens
cccccaaggccaggctgagacc

SEQ ID NO: 9426837 - DNA, 22 bp, Homo sapiens
cccccaaggccaggctgagacc

SEQ ID NO: 9426838 - DNA, 22 bp, Homo sapiens
cccccaccgtgttcctgctcgg

SEQ ID NO: 9426839 - DNA, 22 bp, Homo sapiens
cccccaccgtgttcctgctcgg

SEQ ID NO: 9426840 - DNA, 22 bp, Homo sapiens
cccccacctgaggacagtctta

SEQ ID NO: 9426841 - DNA, 22 bp, Homo sapiens
cccccacctgaggacagtctta

SEQ ID NO: 9426842 - DNA, 19 bp, Homo sapiens
ccctcaggtctgagcagtc

SEQ ID NO: 9426843 - DNA, 19 bp, Homo sapiens
ccctcaggtctgagcagtc

SEQ ID NO: 9426844 - DNA, 22 bp, Homo sapiens
ccctcaggagatgtcagctgga

SEQ ID NO: 9426845 - DNA, 22 bp, Homo sapiens
ccctcaggagatgtcagctgga

SEQ ID NO: 9426846 - DNA, 22 bp, Homo sapiens
ccctcaggatgcagtggaagtg

SEQ ID NO: 9426847 - DNA, 22 bp, Homo sapiens
ccctcaggagatgtcagctgga

SEQ ID NO: 9426848 - DNA, 22 bp, Homo sapiens
ccctcaggatgcagtggaagtg

SEQ ID NO: 9426849 - DNA, 22 bp, Homo sapiens
ccctcagggaccactgacttca

SEQ ID NO: 9426850 - DNA, 22 bp, Homo sapiens
ccctcaggatgcagtggaagtg

SEQ ID NO: 9426851 - DNA, 22 bp, Homo sapiens
ccctcagctccaccctcagcag

SEQ ID NO: 9426852 - DNA, 22 bp, Homo sapiens
ccctaggaattctatggccaag

SEQ ID NO: 9426853 - DNA, 22 bp, Homo sapiens
ccctcagctccaccctcagcag

SEQ ID NO: 9426854 - DNA, 22 bp, Homo sapiens
ccctcagcttctccctgcagct

SEQ ID NO: 9426855 - DNA, 22 bp, Homo sapiens
ccctcagcttctccctgcagct

SEQ ID NO: 9426856 - DNA, 21 bp, Homo sapiens
ccctcaggaaacagaatgcac

SEQ ID NO: 9426857 - DNA, 22 bp, Homo sapiens
ccctcaggagatgtcagctgga

SEQ ID NO: 9426858 - DNA, 22 bp, Homo sapiens
ccctcaggagatgtcagctgga

SEQ ID NO: 9426859 - DNA, 22 bp, Homo sapiens
ccctcaggagatgtcagctgga

SEQ ID NO: 9426860 - DNA, 22 bp, Homo sapiens
ccctcaggagatgtcagctgga

SEQ ID NO: 9426861 - DNA, 22 bp, Homo sapiens
cccctcctggccacactgtcag

SEQ ID NO: 9426862 - DNA, 22 bp, Homo sapiens
cccctctggtcaaccagtcaca

SEQ ID NO: 9426863 - DNA, 20 bp, Homo sapiens
ccctaggaacgcagcaggag

SEQ ID NO: 9426864 - DNA, 22 bp, Homo sapiens
ccctaggaattctatggccaag

SEQ ID NO: 9426865 - DNA, 22 bp, Homo sapiens
cccctccctgacctggttgggc

SEQ ID NO: 9426866 - DNA, 22 bp, Homo sapiens
cccctccctgacctggttgggc

SEQ ID NO: 9426867 - DNA, 22 bp, Homo sapiens
cccctccctgacctggttgggc

SEQ ID NO: 9426868 - DNA, 22 bp, Homo sapiens
cccctcctggccacactgtcag

SEQ ID NO: 9426869 - DNA, 22 bp, Homo sapiens
cccctcctggccacactgtcag

SEQ ID NO: 9426870 - DNA, 22 bp, Homo sapiens
cccctcctggccacactgtcag

SEQ ID NO: 9426871 - DNA, 22 bp, Homo sapiens
cccctcctggccacactgtcag

SEQ ID NO: 9426872 - DNA, 22 bp, Homo sapiens
cccctccctgacctggttgggc

SEQ ID NO: 9426873 - DNA, 22 bp, Homo sapiens
cccctcctgcagcacctttctt

SEQ ID NO: 9426874 - DNA, 22 bp, Homo sapiens
cccctcctggccacactgtcag

SEQ ID NO: 9426875 - DNA, 22 bp, Homo sapiens
tgctgcagatcagctgagtcct

SEQ ID NO: 9426876 - DNA, 22 bp, Homo sapiens
tgctgcagacgaagcccatgcc

SEQ ID NO: 9426877 - DNA, 22 bp, Homo sapiens
tgctgcagacgaagcccatgcc

SEQ ID NO: 9426878 - DNA, 22 bp, Homo sapiens
tgctgcagctaaggtgaggtgc

SEQ ID NO: 9426879 - DNA, 22 bp, Homo sapiens
tgctgcagatcagctgagtcct

SEQ ID NO: 9426880 - DNA, 22 bp, Homo sapiens
tgctgcagatcagctgagtcct

SEQ ID NO: 9426881 - DNA, 22 bp, Homo sapiens
tgctgcagattgcagattaact

SEQ ID NO: 9426882 - DNA, 22 bp, Homo sapiens
ccccaccttgcaattgttccct

SEQ ID NO: 9426883 - DNA, 22 bp, Homo sapiens
ccccactctcggccagataggc

SEQ ID NO: 9426884 - DNA, 22 bp, Homo sapiens
tgctgcaggaattctcaaggga

SEQ ID NO: 9426885 - DNA, 22 bp, Homo sapiens
tgctgcaggaattctcaaggga

SEQ ID NO: 9426886 - DNA, 22 bp, Homo sapiens
tgctgcagctttgtcacatgca

SEQ ID NO: 9426887 - DNA, 22 bp, Homo sapiens
tgctgcagctttgtcacatgca

SEQ ID NO: 9426888 - DNA, 22 bp, Homo sapiens
tgctgcaggaacttaagaagct

SEQ ID NO: 9426889 - DNA, 22 bp, Homo sapiens
tgctgcagctttgtcacatgca

SEQ ID NO: 9426890 - DNA, 22 bp, Homo sapiens
tgctgcagctaaggtgaggtgc

SEQ ID NO: 9426891 - DNA, 22 bp, Homo sapiens
ccccagccagcaggacctctga

SEQ ID NO: 9426892 - DNA, 22 bp, Homo sapiens
ccccagcaggaatacaggggtc

SEQ ID NO: 9426893 - DNA, 22 bp, Homo sapiens
ccccagccagcaggacctctga

SEQ ID NO: 9426894 - DNA, 22 bp, Homo sapiens
ccccagccagcaggacctctga

SEQ ID NO: 9426895 - DNA, 22 bp, Homo sapiens
ccccagccagcaggacctctga

SEQ ID NO: 9426896 - DNA, 22 bp, Homo sapiens
ccccagccagcttgtagtagaa

SEQ ID NO: 9426897 - DNA, 22 bp, Homo sapiens
ccccagccagcttgtagtagaa

SEQ ID NO: 9426898 - DNA, 22 bp, Homo sapiens
ccccagccagcaggacctctga

SEQ ID NO: 9426899 - DNA, 22 bp, Homo sapiens
ccccagcagactcagggcaggt

SEQ ID NO: 9426900 - DNA, 22 bp, Homo sapiens
ccccagcagactcagggcaggt

SEQ ID NO: 9426901 - DNA, 22 bp, Homo sapiens
ccccagcagactcagggcaggt

SEQ ID NO: 9426902 - DNA, 23 bp, Homo sapiens
ccccactaccgtgatgtgcgagg

SEQ ID NO: 9426903 - DNA, 18 bp, Homo sapiens
ccccagcagtgtggtgcc

SEQ ID NO: 9426904 - DNA, 22 bp, Homo sapiens
ccccagcaggaatacaggggtc

SEQ ID NO: 9426905 - DNA, 22 bp, Homo sapiens
ccccagcagcacctggggcagt

SEQ ID NO: 9426906 - DNA, 23 bp, Homo sapiens
tgctggagacaagtgtgagaagg

SEQ ID NO: 9426907 - DNA, 23 bp, Homo sapiens
tgctggagacaagtgtgagaagg

SEQ ID NO: 9426908 - DNA, 22 bp, Homo sapiens
ccccagccttccatgggaattg

SEQ ID NO: 9426909 - DNA, 22 bp, Homo sapiens
ccccagccttccatgggaattg

SEQ ID NO: 9426910 - DNA, 22 bp, Homo sapiens
ccccagcccacaagcatattaa

SEQ ID NO: 9426911 - DNA, 22 bp, Homo sapiens
ccccagccttccatgggaattg

SEQ ID NO: 9426912 - DNA, 22 bp, Homo sapiens
ccccagcccacaagcatattaa

SEQ ID NO: 9426913 - DNA, 22 bp, Homo sapiens
tgctggagacctgcttgcacca

SEQ ID NO: 9426914 - DNA, 22 bp, Homo sapiens
tgctggagacctgcttgcacca

SEQ ID NO: 9426915 - DNA, 22 bp, Homo sapiens
tgctggagactcactcaggtgc

SEQ ID NO: 9426916 - DNA, 22 bp, Homo sapiens
tgctggagacatagcaggcagc

SEQ ID NO: 9426917 - DNA, 22 bp, Homo sapiens
tgctggagcaacattattgtgc

SEQ ID NO: 9426918 - DNA, 22 bp, Homo sapiens
tgctggagcaacattattgtgc

SEQ ID NO: 9426919 - DNA, 22 bp, Homo sapiens
tgctggagcatctgagagcatc

SEQ ID NO: 9426920 - DNA, 22 bp, Homo sapiens
tgctggagcatctgagagcatc

SEQ ID NO: 9426921 - DNA, 22 bp, Homo sapiens
ccccaggcctgttggatggcgc

SEQ ID NO: 9426922 - DNA, 22 bp, Homo sapiens
ccccaggcagggcctaacagag

SEQ ID NO: 9426923 - DNA, 22 bp, Homo sapiens
tgctggagatgaaagggccctg

SEQ ID NO: 9426924 - DNA, 22 bp, Homo sapiens
tgctggagaggaaggtggggtc

SEQ ID NO: 9426925 - DNA, 22 bp, Homo sapiens
tgctggagagctagttctgcag

SEQ ID NO: 9426926 - DNA, 22 bp, Homo sapiens
tgctggagaggaaggtggggtc

SEQ ID NO: 9426927 - DNA, 22 bp, Homo sapiens
tgctggagagccttggccaagg

SEQ ID NO: 9426928 - DNA, 22 bp, Homo sapiens
tgcctgggatctgtgccctttg

SEQ ID NO: 9426929 - DNA, 22 bp, Homo sapiens
tgcctgggcctctgaggaaggc

SEQ ID NO: 9426930 - DNA, 22 bp, Homo sapiens
tgcctgggccttcccacctctg

SEQ ID NO: 9426931 - DNA, 22 bp, Homo sapiens
tgcctgggctcaccgcctcttt

SEQ ID NO: 9426932 - DNA, 22 bp, Homo sapiens
cccaggctcctagaggcccaga

SEQ ID NO: 9426933 - DNA, 22 bp, Homo sapiens
tgcctgctctgtgccacagttg

SEQ ID NO: 9426934 - DNA, 22 bp, Homo sapiens
tgcctgctctgtgccacagttg

SEQ ID NO: 9426935 - DNA, 22 bp, Homo sapiens
tgcctgggagtgaccaagactc

SEQ ID NO: 9426936 - DNA, 22 bp, Homo sapiens
tgcctgggactctgttatcttg

SEQ ID NO: 9426937 - DNA, 22 bp, Homo sapiens
tgcctgggactgtactaaattt

SEQ ID NO: 9426938 - DNA, 22 bp, Homo sapiens
tgcctgggactgtactaaattt

SEQ ID NO: 9426939 - DNA, 20 bp, Homo sapiens
tgctccatctaaagtgatta

SEQ ID NO: 9426940 - DNA, 22 bp, Homo sapiens
tgctccatgcgctcggccggcg

SEQ ID NO: 9426941 - DNA, 22 bp, Homo sapiens
tgctccatgcgctcggccggcg

SEQ ID NO: 9426942 - DNA, 22 bp, Homo sapiens
tgctccatgcgctcggccggcg

SEQ ID NO: 9426943 - DNA, 22 bp, Homo sapiens
tgctccatgcgctcggccggcg

SEQ ID NO: 9426944 - DNA, 22 bp, Homo sapiens
tgctccattctctagccagtgc

SEQ ID NO: 9426945 - DNA, 19 bp, Homo sapiens
tgctccattgaggtgtctc

SEQ ID NO: 9426946 - DNA, 22 bp, Homo sapiens
tgctccattctctagccagtgc

SEQ ID NO: 9426947 - DNA, 23 bp, Homo sapiens
tgctccaggtacagaactccagg

SEQ ID NO: 9426948 - DNA, 22 bp, Homo sapiens
tgctcagtagcagtgtgctgct

SEQ ID NO: 9426949 - DNA, 22 bp, Homo sapiens
tgctccagggctgccagaccct

SEQ ID NO: 9426950 - DNA, 22 bp, Homo sapiens
tgctccagtgagctggccatcc

SEQ ID NO: 9426951 - DNA, 22 bp, Homo sapiens
tgctccaggtgtgcctctcatg

SEQ ID NO: 9426952 - DNA, 22 bp, Homo sapiens
cccaggctcctgactcattcta

SEQ ID NO: 9426953 - DNA, 22 bp, Homo sapiens
cccaggctcctgactcattcta

SEQ ID NO: 9426954 - DNA, 22 bp, Homo sapiens
cccaggctcctgctgtgttgac

SEQ ID NO: 9426955 - DNA, 22 bp, Homo sapiens
cccaggctcctgctgtgttgac

SEQ ID NO: 9426956 - DNA, 22 bp, Homo sapiens
cccaggctcctgctgtgttgac

SEQ ID NO: 9426957 - DNA, 22 bp, Homo sapiens
cccaggctcctgactcattcta

SEQ ID NO: 9426958 - DNA, 21 bp, Homo sapiens
tgctcagtaaatgctgagtga

SEQ ID NO: 9426959 - DNA, 21 bp, Homo sapiens
tgctcagtaaatgctgagtga

SEQ ID NO: 9426960 - DNA, 22 bp, Homo sapiens
tgctcagtagcagtgtgctgct

SEQ ID NO: 9426961 - DNA, 22 bp, Homo sapiens
tgctgacactattctaaaaagc

SEQ ID NO: 9426962 - DNA, 22 bp, Homo sapiens
tgctgaattctcattccctgga

SEQ ID NO: 9426963 - DNA, 22 bp, Homo sapiens
tgctgaattctaccatccattt

SEQ ID NO: 9426964 - DNA, 22 bp, Homo sapiens
tgctgaattggtagtactgttg

SEQ ID NO: 9426965 - DNA, 22 bp, Homo sapiens
tgctgaatttacatttttgtag

SEQ ID NO: 9426966 - DNA, 22 bp, Homo sapiens
tgctgaatggtaaagaagtata

SEQ ID NO: 9426967 - DNA, 22 bp, Homo sapiens
tgctgaatgtgctcccttttaa

SEQ ID NO: 9426968 - DNA, 22 bp, Homo sapiens
tgctgaattccagggccccact

SEQ ID NO: 9426969 - DNA, 22 bp, Homo sapiens
tgctgaattaaactctatgtgg

SEQ ID NO: 9426970 - DNA, 22 bp, Homo sapiens
tgctgaatgctgcatgccgtat

SEQ ID NO: 9426971 - DNA, 22 bp, Homo sapiens
tgctgaatgggatatgttgagc

SEQ ID NO: 9426972 - DNA, 22 bp, Homo sapiens
tgctgaatgggtgattttggag

SEQ ID NO: 9426973 - DNA, 19 bp, Homo sapiens
tgctgaagttgtcagtctg

SEQ ID NO: 9426974 - DNA, 22 bp, Homo sapiens
tgctgaataataagattactca

SEQ ID NO: 9426975 - DNA, 22 bp, Homo sapiens
tgctgaataagacgtggcttgt

SEQ ID NO: 9426976 - DNA, 22 bp, Homo sapiens
tgctgaataaagatatattttc

SEQ ID NO: 9426977 - DNA, 22 bp, Homo sapiens
tgctgaataaataaagtctatt

SEQ ID NO: 9426978 - DNA, 22 bp, Homo sapiens
tgctgaatcatatggtaattct

SEQ ID NO: 9426979 - DNA, 22 bp, Homo sapiens
tgctgaatcaaaacaaaggttt

SEQ ID NO: 9426980 - DNA, 22 bp, Homo sapiens
tgctgaatcccaccctccagtg

SEQ ID NO: 9426981 - DNA, 22 bp, Homo sapiens
tgctgaatgaatggatggttgc

SEQ ID NO: 9426982 - DNA, 21 bp, Homo sapiens
tgctgaatctgccatattttc

SEQ ID NO: 9426983 - DNA, 22 bp, Homo sapiens
tgctgaataataagattactca

SEQ ID NO: 9426984 - DNA, 22 bp, Homo sapiens
tgctgaataataagattactca

SEQ ID NO: 9426985 - DNA, 22 bp, Homo sapiens
tgctgaatatagagcaagaagt

SEQ ID NO: 9426986 - DNA, 22 bp, Homo sapiens
tgctgagatagctgactaggca

SEQ ID NO: 9426987 - DNA, 20 bp, Homo sapiens
tgctgcagacagggccattg

SEQ ID NO: 9426988 - DNA, 22 bp, Homo sapiens
tgctgcagaaattctgtgagga

SEQ ID NO: 9426989 - DNA, 22 bp, Homo sapiens
tgctgcagaaattctgtgagga

SEQ ID NO: 9426990 - DNA, 22 bp, Homo sapiens
tgctgcagaaattctgtgagga

SEQ ID NO: 9426991 - DNA, 22 bp, Homo sapiens
tgctgcagaaattctgtgagga

SEQ ID NO: 9426992 - DNA, 22 bp, Homo sapiens
tgctgcagaaattctgtgagga

SEQ ID NO: 9426993 - DNA, 22 bp, Homo sapiens
tgctgcacttatggctctgagg

SEQ ID NO: 9426994 - DNA, 22 bp, Homo sapiens
tgctgaccttgttctgtgagga

SEQ ID NO: 9426995 - DNA, 19 bp, Homo sapiens
tgctgactgggcctcaccg

SEQ ID NO: 9426996 - DNA, 22 bp, Homo sapiens
tgctgagaggaaggtgcactgg

SEQ ID NO: 9426997 - DNA, 22 bp, Homo sapiens
tgctgagaggaaggtgcactgg

SEQ ID NO: 9426998 - DNA, 22 bp, Homo sapiens
tgctgagagccagggctggcat

SEQ ID NO: 9426999 - DNA, 22 bp, Homo sapiens
tgctgaagtccatctgtttgac

SEQ ID NO: 9427000 - DNA, 22 bp, Homo sapiens
tgctctggagtggcttgtgcac

SEQ ID NO: 9427001 - DNA, 22 bp, Homo sapiens
tgctctggagtggcttgtgcac

SEQ ID NO: 9427002 - DNA, 22 bp, Homo sapiens
tgctctggagtggcttgtgcac

SEQ ID NO: 9427003 - DNA, 22 bp, Homo sapiens
tgctctggagtggcttgtgcac

SEQ ID NO: 9427004 - DNA, 22 bp, Homo sapiens
cccagggaggtagcaggagaaa

SEQ ID NO: 9427005 - DNA, 22 bp, Homo sapiens
cccagggaggtagcaggagaaa

SEQ ID NO: 9427006 - DNA, 22 bp, Homo sapiens
cccagggatgtggcagatgtta

SEQ ID NO: 9427007 - DNA, 22 bp, Homo sapiens
cccagggatgtggcagatgtta

SEQ ID NO: 9427008 - DNA, 22 bp, Homo sapiens
cccagggaggtagcaggagaaa

SEQ ID NO: 9427009 - DNA, 22 bp, Homo sapiens
cccagggatgtggcagatgtta

SEQ ID NO: 9427010 - DNA, 22 bp, Homo sapiens
cccagggagagcgcggaggcgg

SEQ ID NO: 9427011 - DNA, 22 bp, Homo sapiens
cccagggagagcgcggaggcgg

SEQ ID NO: 9427012 - DNA, 22 bp, Homo sapiens
cccagggactcgggattctagg

SEQ ID NO: 9427013 - DNA, 22 bp, Homo sapiens
cccagggaggcccaggctctgc

SEQ ID NO: 9427014 - DNA, 22 bp, Homo sapiens
cccagggagcttggagaacggg

SEQ ID NO: 9427015 - DNA, 22 bp, Homo sapiens
cccagggagcttggagaacggg

SEQ ID NO: 9427016 - DNA, 22 bp, Homo sapiens
tgctcccacactactcggaggc

SEQ ID NO: 9427017 - DNA, 22 bp, Homo sapiens
tgctcccacactactcggaggc

SEQ ID NO: 9427018 - DNA, 22 bp, Homo sapiens
tgctcccaaacgacctactgtg

SEQ ID NO: 9427019 - DNA, 22 bp, Homo sapiens
tgctcccacactactcggaggc

SEQ ID NO: 9427020 - DNA, 22 bp, Homo sapiens
tgctcccagctcctgcagcaac

SEQ ID NO: 9427021 - DNA, 22 bp, Homo sapiens
tgctcccagctcctgcagcaac

SEQ ID NO: 9427022 - DNA, 22 bp, Homo sapiens
tgctcccagctcctgcagcaac

SEQ ID NO: 9427023 - DNA, 20 bp, Homo sapiens
cccagggacctgagctccat

SEQ ID NO: 9427024 - DNA, 22 bp, Homo sapiens
cccaggcagggacgtgctctgg

SEQ ID NO: 9427025 - DNA, 22 bp, Homo sapiens
cccaggcagggacgtgctctgg

SEQ ID NO: 9427026 - DNA, 22 bp, Homo sapiens
cccaggcagtagaaagaagagg

SEQ ID NO: 9427027 - DNA, 22 bp, Homo sapiens
cccaggcagggacgtgctctgg

SEQ ID NO: 9427028 - DNA, 22 bp, Homo sapiens
cccaggcagggacgtgctctgg

SEQ ID NO: 9427029 - DNA, 22 bp, Homo sapiens
cccaggcagtctggctctaaag

SEQ ID NO: 9427030 - DNA, 22 bp, Homo sapiens
cccaggcagtgtgtgcatgcgt

SEQ ID NO: 9427031 - DNA, 22 bp, Homo sapiens
cccaggcagtgtgtgcatgcgt

SEQ ID NO: 9427032 - DNA, 22 bp, Homo sapiens
cccaggcagcccttctgacgca

SEQ ID NO: 9427033 - DNA, 22 bp, Homo sapiens
cccaggcagccccagaagcttg

SEQ ID NO: 9427034 - DNA, 22 bp, Homo sapiens
cccaggcagccccagaagcttg

SEQ ID NO: 9427035 - DNA, 22 bp, Homo sapiens
cccaggcagccccagaagcttg

SEQ ID NO: 9427036 - DNA, 22 bp, Homo sapiens
cccaggcagccccagaagcttg

SEQ ID NO: 9427037 - DNA, 20 bp, Homo sapiens
cccaggcagagctagcggca

SEQ ID NO: 9427038 - DNA, 22 bp, Homo sapiens
cccaggcagcggggtctccttg

SEQ ID NO: 9427039 - DNA, 22 bp, Homo sapiens
cccaggcagcggggtctccttg

SEQ ID NO: 9427040 - DNA, 22 bp, Homo sapiens
cccaggcagcggggtctccttg

SEQ ID NO: 9427041 - DNA, 22 bp, Homo sapiens
cccaggcagcctgcagggaagg

SEQ ID NO: 9427042 - DNA, 22 bp, Homo sapiens
tgccaggcgtggtggtgcgcac

SEQ ID NO: 9427043 - DNA, 22 bp, Homo sapiens
cccaggagttagaggttgtggt

SEQ ID NO: 9427044 - DNA, 22 bp, Homo sapiens
cccaggatgtcgaggctgcagt

SEQ ID NO: 9427045 - DNA, 22 bp, Homo sapiens
cccaggatgtcgaggctgcagt

SEQ ID NO: 9427046 - DNA, 22 bp, Homo sapiens
cccaggatgtcgaggctgcagt

SEQ ID NO: 9427047 - DNA, 21 bp, Homo sapiens
tgccaggcctgagctggggtc

SEQ ID NO: 9427048 - DNA, 22 bp, Homo sapiens
tgccaggcgattgctatcagca

SEQ ID NO: 9427049 - DNA, 22 bp, Homo sapiens
tgccaggcgtggtggtgcgcac

SEQ ID NO: 9427050 - DNA, 22 bp, Homo sapiens
tgccaggcgattgctatcagca

SEQ ID NO: 9427051 - DNA, 22 bp, Homo sapiens
tgccaggcgattgctatcagca

SEQ ID NO: 9427052 - DNA, 22 bp, Homo sapiens
tgccaggcgattgctatcagca

SEQ ID NO: 9427053 - DNA, 21 bp, Homo sapiens
tgccaggcctgagctggggtc

SEQ ID NO: 9427054 - DNA, 21 bp, Homo sapiens
tgccaggcctgagctggggtc

SEQ ID NO: 9427055 - DNA, 22 bp, Homo sapiens
tgccaggcctcaggagtctcca

SEQ ID NO: 9427056 - DNA, 22 bp, Homo sapiens
cccaggcacactgaagtgacat

SEQ ID NO: 9427057 - DNA, 22 bp, Homo sapiens
cccaggcacactgaagtgacat

SEQ ID NO: 9427058 - DNA, 22 bp, Homo sapiens
cccaggcacactgaagtgacat

SEQ ID NO: 9427059 - DNA, 22 bp, Homo sapiens
cccaggcacagattatcccaat

SEQ ID NO: 9427060 - DNA, 22 bp, Homo sapiens
cccaggcacatccactctgtga

SEQ ID NO: 9427061 - DNA, 22 bp, Homo sapiens
cccaggcagagagctggtgagc

SEQ ID NO: 9427062 - DNA, 22 bp, Homo sapiens
cccaggcagagagctggtgagc

SEQ ID NO: 9427063 - DNA, 22 bp, Homo sapiens
cccaggcagagagctggtgagc

SEQ ID NO: 9427064 - DNA, 22 bp, Homo sapiens
cccaggcagaattagtgtttca

SEQ ID NO: 9427065 - DNA, 22 bp, Homo sapiens
cccaggcactcttggtcatttt

SEQ ID NO: 9427066 - DNA, 22 bp, Homo sapiens
cccaggaggttgaggctgcagt

SEQ ID NO: 9427067 - DNA, 22 bp, Homo sapiens
cccaggaggtgtgcccaactcg

SEQ ID NO: 9427068 - DNA, 22 bp, Homo sapiens
tgccaggcctcaggagtctcca

SEQ ID NO: 9427069 - DNA, 22 bp, Homo sapiens
tgccaggcctcaggagtctcca

SEQ ID NO: 9427070 - DNA, 22 bp, Homo sapiens
tgccaggcctcaggagtctcca

SEQ ID NO: 9427071 - DNA, 22 bp, Homo sapiens
cccaggaggtgtgcccaactcg

SEQ ID NO: 9427072 - DNA, 22 bp, Homo sapiens
cccaggaggtggagttcacagt

SEQ ID NO: 9427073 - DNA, 22 bp, Homo sapiens
cccaggaggtggaggttgcagt

SEQ ID NO: 9427074 - DNA, 22 bp, Homo sapiens
cccaggaggtggaggttgcggt

SEQ ID NO: 9427075 - DNA, 22 bp, Homo sapiens
cccaggaggtggaggctgcagt

SEQ ID NO: 9427076 - DNA, 22 bp, Homo sapiens
cccaggaggtggaggctgcagt

SEQ ID NO: 9427077 - DNA, 22 bp, Homo sapiens
tgccacagagcaattctgctga

SEQ ID NO: 9427078 - DNA, 22 bp, Homo sapiens
tgccacagagcaattctgctga

SEQ ID NO: 9427079 - DNA, 21 bp, Homo sapiens
cccaggaggctgagaagagca

SEQ ID NO: 9427080 - DNA, 22 bp, Homo sapiens
cccaggaggtggaggttgcagc

SEQ ID NO: 9427081 - DNA, 22 bp, Homo sapiens
cccaggaggtggaggctgcagt

SEQ ID NO: 9427082 - DNA, 22 bp, Homo sapiens
cccaggaggtggaggctgcagt

SEQ ID NO: 9427083 - DNA, 22 bp, Homo sapiens
cccaggaggtggaggctgcagt

SEQ ID NO: 9427084 - DNA, 22 bp, Homo sapiens
cccaggaggtggaggctgcagt

SEQ ID NO: 9427085 - DNA, 22 bp, Homo sapiens
cccaggaggtggaggttgcagt

SEQ ID NO: 9427086 - DNA, 22 bp, Homo sapiens
cccaggaggtggaggttgcagt

SEQ ID NO: 9427087 - DNA, 22 bp, Homo sapiens
cccaggaggtggaggttgcagc

SEQ ID NO: 9427088 - DNA, 22 bp, Homo sapiens
cccaggaggtggaggttgcagc

SEQ ID NO: 9427089 - DNA, 22 bp, Homo sapiens
tgccaaggagctggatcagggc

SEQ ID NO: 9427090 - DNA, 22 bp, Homo sapiens
tgcattattacaaggtaagact

SEQ ID NO: 9427091 - DNA, 22 bp, Homo sapiens
tgcattattcttttttggtagg

SEQ ID NO: 9427092 - DNA, 22 bp, Homo sapiens
tgcattatggctgagtctctca

SEQ ID NO: 9427093 - DNA, 22 bp, Homo sapiens
tgcattatggctgagtctctca

SEQ ID NO: 9427094 - DNA, 22 bp, Homo sapiens
tgcattcaaatcctgatcctgc

SEQ ID NO: 9427095 - DNA, 22 bp, Homo sapiens
tgcattatcgtcttgatcctct

SEQ ID NO: 9427096 - DNA, 22 bp, Homo sapiens
tgcattatctttaatgttctca

SEQ ID NO: 9427097 - DNA, 23 bp, Homo sapiens
tgcattatcctctctgaagacca

SEQ ID NO: 9427098 - DNA, 22 bp, Homo sapiens
tgcattatcatctggaagcttg

SEQ ID NO: 9427099 - DNA, 22 bp, Homo sapiens
tgcattatacatggatctaaag

SEQ ID NO: 9427100 - DNA, 22 bp, Homo sapiens
tgccaagtggagctcaggaatc

SEQ ID NO: 9427101 - DNA, 22 bp, Homo sapiens
tgccaagtcactagcaagtggg

SEQ ID NO: 9427102 - DNA, 22 bp, Homo sapiens
tgccaagggtatgggcaagata

SEQ ID NO: 9427103 - DNA, 22 bp, Homo sapiens
tgccaagggtatgggcaagata

SEQ ID NO: 9427104 - DNA, 22 bp, Homo sapiens
tgccaattagagacatccatct

SEQ ID NO: 9427105 - DNA, 22 bp, Homo sapiens
tgccaagtttctctcagggact

SEQ ID NO: 9427106 - DNA, 22 bp, Homo sapiens
tgccacagagactttcattgta

SEQ ID NO: 9427107 - DNA, 22 bp, Homo sapiens
tgccacagagactttcattgta

SEQ ID NO: 9427108 - DNA, 22 bp, Homo sapiens
tgccacaccaacatctttcagc

SEQ ID NO: 9427109 - DNA, 22 bp, Homo sapiens
tgcagggaggccccgcagccct

SEQ ID NO: 9427110 - DNA, 22 bp, Homo sapiens
tgcagggaccccgaggctctct

SEQ ID NO: 9427111 - DNA, 22 bp, Homo sapiens
tgcagggaccccgaggctctct

SEQ ID NO: 9427112 - DNA, 22 bp, Homo sapiens
tgcagggaccccgaggctctct

SEQ ID NO: 9427113 - DNA, 22 bp, Homo sapiens
tgcagggaccccgaggctctct

SEQ ID NO: 9427114 - DNA, 22 bp, Homo sapiens
tgcagggaccccgaggctctct

SEQ ID NO: 9427115 - DNA, 22 bp, Homo sapiens
tgcagggacaggctctggggat

SEQ ID NO: 9427116 - DNA, 22 bp, Homo sapiens
tgcagggacacgaagacaaata

SEQ ID NO: 9427117 - DNA, 22 bp, Homo sapiens
tgcagggacacgaagacaaata

SEQ ID NO: 9427118 - DNA, 22 bp, Homo sapiens
cccagctcttcaagtcaccccc

SEQ ID NO: 9427119 - DNA, 22 bp, Homo sapiens
cccagctccgagctccgagccg

SEQ ID NO: 9427120 - DNA, 22 bp, Homo sapiens
cccagctccttacagggccgaa

SEQ ID NO: 9427121 - DNA, 22 bp, Homo sapiens
tgcagggagggcccagcaatct

SEQ ID NO: 9427122 - DNA, 22 bp, Homo sapiens
tgcagggaggccccgcagccct

SEQ ID NO: 9427123 - DNA, 22 bp, Homo sapiens
tgcagggaatgcttgcagcatg

SEQ ID NO: 9427124 - DNA, 22 bp, Homo sapiens
tgcagggaatgcttgcagcatg

SEQ ID NO: 9427125 - DNA, 22 bp, Homo sapiens
tgcagggaatgcttgcagcatg

SEQ ID NO: 9427126 - DNA, 22 bp, Homo sapiens
tgcagggaatgcttgcagcatg

SEQ ID NO: 9427127 - DNA, 22 bp, Homo sapiens
tgcagggacacgaagacaaata

SEQ ID NO: 9427128 - DNA, 22 bp, Homo sapiens
tgcagggacacgaagacaaata

SEQ ID NO: 9427129 - DNA, 22 bp, Homo sapiens
tgcagggaatgcttgcagcatg

SEQ ID NO: 9427130 - DNA, 22 bp, Homo sapiens
tgcagggaatctgtggctggac

SEQ ID NO: 9427131 - DNA, 22 bp, Homo sapiens
cccagctcaagcagagagctaa

SEQ ID NO: 9427132 - DNA, 22 bp, Homo sapiens
cccagctcaagcagagagctaa

SEQ ID NO: 9427133 - DNA, 22 bp, Homo sapiens
cccagctacctctgctaggaga

SEQ ID NO: 9427134 - DNA, 23 bp, Homo sapiens
cccagcgctgagccctgcaggca

SEQ ID NO: 9427135 - DNA, 23 bp, Homo sapiens
cccagcgctgagccctgcaggca

SEQ ID NO: 9427136 - DNA, 22 bp, Homo sapiens
cccagcgagtttgccggtgaac

SEQ ID NO: 9427137 - DNA, 22 bp, Homo sapiens
cccagcgagtttgccggtgaac

SEQ ID NO: 9427138 - DNA, 22 bp, Homo sapiens
cccagcgagtttgccggtgaac

SEQ ID NO: 9427139 - DNA, 22 bp, Homo sapiens
cccagcctgtgacagccgtcct

SEQ ID NO: 9427140 - DNA, 22 bp, Homo sapiens
cccagcctgtgacagccgtcct

SEQ ID NO: 9427141 - DNA, 22 bp, Homo sapiens
cccagcctgtgacagccgtcct

SEQ ID NO: 9427142 - DNA, 22 bp, Homo sapiens
cccagcctgtctttcccaatga

SEQ ID NO: 9427143 - DNA, 22 bp, Homo sapiens
cccagcctgtctttcccaatga

SEQ ID NO: 9427144 - DNA, 22 bp, Homo sapiens
cccagcctggtgcactgtgggg

SEQ ID NO: 9427145 - DNA, 22 bp, Homo sapiens
cccagcctttgcttcctggttc

SEQ ID NO: 9427146 - DNA, 22 bp, Homo sapiens
cccagcctttgcttcctggttc

SEQ ID NO: 9427147 - DNA, 22 bp, Homo sapiens
cccagcctttgcttcctggttc

SEQ ID NO: 9427148 - DNA, 22 bp, Homo sapiens
cccagccttccaccctggacta

SEQ ID NO: 9427149 - DNA, 22 bp, Homo sapiens
cccagccttccaccctggacta

SEQ ID NO: 9427150 - DNA, 22 bp, Homo sapiens
cccagcctactctgccatagca

SEQ ID NO: 9427151 - DNA, 21 bp, Homo sapiens
tctgtggcggactctaggccc

SEQ ID NO: 9427152 - DNA, 22 bp, Homo sapiens
tctgtggcctgtgtccaagtgc

SEQ ID NO: 9427153 - DNA, 22 bp, Homo sapiens
cccagcctactctgccatagca

SEQ ID NO: 9427154 - DNA, 21 bp, Homo sapiens
tctgtggcggactctaggccc

SEQ ID NO: 9427155 - DNA, 22 bp, Homo sapiens
cccagcctactctgccatagca

SEQ ID NO: 9427156 - DNA, 22 bp, Homo sapiens
cccagcctactctgccatagca

SEQ ID NO: 9427157 - DNA, 22 bp, Homo sapiens
tctgtggcccaagtgatggctg

SEQ ID NO: 9427158 - DNA, 22 bp, Homo sapiens
cccagctcttcaagtcaccccc

SEQ ID NO: 9427159 - DNA, 22 bp, Homo sapiens
cccagctcttcaagtcaccccc

SEQ ID NO: 9427160 - DNA, 22 bp, Homo sapiens
cccagctcttcaagtcaccccc

SEQ ID NO: 9427161 - DNA, 22 bp, Homo sapiens
cccagctcttcaagtcaccccc

SEQ ID NO: 9427162 - DNA, 22 bp, Homo sapiens
cccagctcttcctgggagctaa

SEQ ID NO: 9427163 - DNA, 22 bp, Homo sapiens
cccagctcttcctgggagctaa

SEQ ID NO: 9427164 - DNA, 22 bp, Homo sapiens
cccagctcttcctgggagctaa

SEQ ID NO: 9427165 - DNA, 22 bp, Homo sapiens
cccagctcttcctgggagctaa

SEQ ID NO: 9427166 - DNA, 22 bp, Homo sapiens
cccagctcttttagcggcatct

SEQ ID NO: 9427167 - DNA, 22 bp, Homo sapiens
cccagctcttttagcggcatct

SEQ ID NO: 9427168 - DNA, 22 bp, Homo sapiens
cccagctcttttagcggcatct

SEQ ID NO: 9427169 - DNA, 22 bp, Homo sapiens
cccagctcttcctgggagctaa

SEQ ID NO: 9427170 - DNA, 23 bp, Homo sapiens
cccagctgagacttcctgaactc

SEQ ID NO: 9427171 - DNA, 22 bp, Homo sapiens
cccagctgatttttgcagagat

SEQ ID NO: 9427172 - DNA, 22 bp, Homo sapiens
cccagctgatttttgcagagat

SEQ ID NO: 9427173 - DNA, 22 bp, Homo sapiens
cccagctgatttttgcagagat

SEQ ID NO: 9427174 - DNA, 22 bp, Homo sapiens
cccagctgcacctctatggcct

SEQ ID NO: 9427175 - DNA, 23 bp, Homo sapiens
cccagctgcagacaagggagggt

SEQ ID NO: 9427176 - DNA, 22 bp, Homo sapiens
cccagctgcacctctatggcct

SEQ ID NO: 9427177 - DNA, 17 bp, Homo sapiens
cccagctgcgtctgagg

SEQ ID NO: 9427178 - DNA, 17 bp, Homo sapiens
cccagctgcgtctgagg

SEQ ID NO: 9427179 - DNA, 23 bp, Homo sapiens
cccagctggaagttagaggacca

SEQ ID NO: 9427180 - DNA, 22 bp, Homo sapiens
cccagctgtaacgggtctgcac

SEQ ID NO: 9427181 - DNA, 22 bp, Homo sapiens
cccagctgtaacgggtctgcac

SEQ ID NO: 9427182 - DNA, 22 bp, Homo sapiens
cccagctgtaacgggtctgcac

SEQ ID NO: 9427183 - DNA, 18 bp, Homo sapiens
cccagctggtgggtcagt

SEQ ID NO: 9427184 - DNA, 17 bp, Homo sapiens
cccagctggcagtgccg

SEQ ID NO: 9427185 - DNA, 17 bp, Homo sapiens
cccagctggcagtgccg

SEQ ID NO: 9427186 - DNA, 22 bp, Homo sapiens
cccagctggccaggtggctttg

SEQ ID NO: 9427187 - DNA, 22 bp, Homo sapiens
tgcatcacttagctgcacaact

SEQ ID NO: 9427188 - DNA, 22 bp, Homo sapiens
tgcatgtttctgtatgttaatg

SEQ ID NO: 9427189 - DNA, 22 bp, Homo sapiens
tgcatcagaggatagctgcagt

SEQ ID NO: 9427190 - DNA, 22 bp, Homo sapiens
tgcattaaaaccatcgaccatc

SEQ ID NO: 9427191 - DNA, 22 bp, Homo sapiens
tgcattaaaatgatggagaaat

SEQ ID NO: 9427192 - DNA, 22 bp, Homo sapiens
tgcattaaaatgtgcctctctt

SEQ ID NO: 9427193 - DNA, 22 bp, Homo sapiens
tgcattaaatataatctgttga

SEQ ID NO: 9427194 - DNA, 22 bp, Homo sapiens
tgcattaaatataatctgttga

SEQ ID NO: 9427195 - DNA, 22 bp, Homo sapiens
tgcattaagtgtctgcatatgg

SEQ ID NO: 9427196 - DNA, 20 bp, Homo sapiens
tgcattaagtggcattgagc

SEQ ID NO: 9427197 - DNA, 22 bp, Homo sapiens
tgcattaaggtaattgtataat

SEQ ID NO: 9427198 - DNA, 22 bp, Homo sapiens
tgcattaagtgtctgcatatgg

SEQ ID NO: 9427199 - DNA, 22 bp, Homo sapiens
tgcattaagtgtctgcatatgg

SEQ ID NO: 9427200 - DNA, 22 bp, Homo sapiens
tgcattaaggccattgaaattt

SEQ ID NO: 9427201 - DNA, 22 bp, Homo sapiens
tgcattaagggcctggagatac

SEQ ID NO: 9427202 - DNA, 22 bp, Homo sapiens
tgcattaaggtaattgtataat

SEQ ID NO: 9427203 - DNA, 22 bp, Homo sapiens
tgcattaagggcctggagatac

SEQ ID NO: 9427204 - DNA, 22 bp, Homo sapiens
tgcattaagaatttctgaggat

SEQ ID NO: 9427205 - DNA, 22 bp, Homo sapiens
tgcattaaatataatctgttga

SEQ ID NO: 9427206 - DNA, 22 bp, Homo sapiens
tgcattaagcacacttttgaat

SEQ ID NO: 9427207 - DNA, 22 bp, Homo sapiens
tgcattaaggccattgaaattt

SEQ ID NO: 9427208 - DNA, 22 bp, Homo sapiens
cccaggaaacccgaaggcgacc

SEQ ID NO: 9427209 - DNA, 22 bp, Homo sapiens
cccaggaaaagcagtgccagca

SEQ ID NO: 9427210 - DNA, 22 bp, Homo sapiens
cccaggaaagagactgctgggt

SEQ ID NO: 9427211 - DNA, 22 bp, Homo sapiens
cccaggaaagaatttagagcca

SEQ ID NO: 9427212 - DNA, 19 bp, Homo sapiens
cccagctgttcttccacca

SEQ ID NO: 9427213 - DNA, 19 bp, Homo sapiens
cccagctgttcttccacca

SEQ ID NO: 9427214 - DNA, 22 bp, Homo sapiens
cccagcttgcaaatgggttgct

SEQ ID NO: 9427215 - DNA, 22 bp, Homo sapiens
cccagcttgcccaggactgagg

SEQ ID NO: 9427216 - DNA, 22 bp, Homo sapiens
tgtgagcagagacatgaaaagc

SEQ ID NO: 9427217 - DNA, 20 bp, Homo sapiens
tgtgagcagatgctgagtga

SEQ ID NO: 9427218 - DNA, 22 bp, Homo sapiens
tgtgaggacctcagcagagtct

SEQ ID NO: 9427219 - DNA, 22 bp, Homo sapiens
tgtgaggagtaggctgagggtg

SEQ ID NO: 9427220 - DNA, 22 bp, Homo sapiens
tgtgagggttttaagggaatga

SEQ ID NO: 9427221 - DNA, 21 bp, Homo sapiens
cctggctgcacagttgctggt

SEQ ID NO: 9427222 - DNA, 21 bp, Homo sapiens
cctggctgcacagttgctggt

SEQ ID NO: 9427223 - DNA, 22 bp, Homo sapiens
tgtgaggcctagacagcctggg

SEQ ID NO: 9427224 - DNA, 22 bp, Homo sapiens
tgtgaggcctagacagcctggg

SEQ ID NO: 9427225 - DNA, 22 bp, Homo sapiens
tgtgaaggcagagccagtgaaa

SEQ ID NO: 9427226 - DNA, 22 bp, Homo sapiens
tgtgaaggagcatgcagagggg

SEQ ID NO: 9427227 - DNA, 22 bp, Homo sapiens
tgtgaaggagatgaagggagtg

SEQ ID NO: 9427228 - DNA, 23 bp, Homo sapiens
tgtgaaggtgggtccaagggctg

SEQ ID NO: 9427229 - DNA, 22 bp, Homo sapiens
tgtgaaggtaaggaggggcaag

SEQ ID NO: 9427230 - DNA, 22 bp, Homo sapiens
tgtgaagatttggcatgcagaa

SEQ ID NO: 9427231 - DNA, 22 bp, Homo sapiens
tgtgaagaattaatgtgaatca

SEQ ID NO: 9427232 - DNA, 22 bp, Homo sapiens
tgtgaagaattaatgtgaatca

SEQ ID NO: 9427233 - DNA, 22 bp, Homo sapiens
cctggctgaacaaagtccctcc

SEQ ID NO: 9427234 - DNA, 22 bp, Homo sapiens
cctggctcttctgtgtcagccc

SEQ ID NO: 9427235 - DNA, 22 bp, Homo sapiens
cctggctgaaccaatgaagtgg

SEQ ID NO: 9427236 - DNA, 22 bp, Homo sapiens
cctggctctgaagtccacatca

SEQ ID NO: 9427237 - DNA, 19 bp, Homo sapiens
cctggctctgagcccagcc

SEQ ID NO: 9427238 - DNA, 19 bp, Homo sapiens
cctggctctgagcccagcc

SEQ ID NO: 9427239 - DNA, 22 bp, Homo sapiens
cctggctcttcgggagtttgtt

SEQ ID NO: 9427240 - DNA, 19 bp, Homo sapiens
cctggctctgagcccagcc

SEQ ID NO: 9427241 - DNA, 22 bp, Homo sapiens
cctggctcttctgtgtcagccc

SEQ ID NO: 9427242 - DNA, 22 bp, Homo sapiens
cctggctcttctgtgtcagccc

SEQ ID NO: 9427243 - DNA, 23 bp, Homo sapiens
cctggctgacctgaaggtgtagt

SEQ ID NO: 9427244 - DNA, 22 bp, Homo sapiens
cctggctgagggacctcgggta

SEQ ID NO: 9427245 - DNA, 22 bp, Homo sapiens
cctggctgaggggccaaggacc

SEQ ID NO: 9427246 - DNA, 22 bp, Homo sapiens
cctggctgaggggccaaggacc

SEQ ID NO: 9427247 - DNA, 21 bp, Homo sapiens
cctggctgcacagttgctggt

SEQ ID NO: 9427248 - DNA, 22 bp, Homo sapiens
tgtctgggtcacccctcctggc

SEQ ID NO: 9427249 - DNA, 23 bp, Homo sapiens
tgtctggggcgccagaagagaga

SEQ ID NO: 9427250 - DNA, 21 bp, Homo sapiens
cctggctgcacagttgctggt

SEQ ID NO: 9427251 - DNA, 22 bp, Homo sapiens
tgtctggggaactgtgcatcca

SEQ ID NO: 9427252 - DNA, 23 bp, Homo sapiens
tgtctggggcgccagaagagaga

SEQ ID NO: 9427253 - DNA, 22 bp, Homo sapiens
tgtctttagttgcttagatttg

SEQ ID NO: 9427254 - DNA, 22 bp, Homo sapiens
tgtctttagagtcacaaaacca

SEQ ID NO: 9427255 - DNA, 22 bp, Homo sapiens
tgtctttagccagcagtcttct

SEQ ID NO: 9427256 - DNA, 22 bp, Homo sapiens
tgtctgtctttagtgagattgc

SEQ ID NO: 9427257 - DNA, 22 bp, Homo sapiens
tgtctttacttaataaatatac

SEQ ID NO: 9427258 - DNA, 22 bp, Homo sapiens
tgtctttagaaagaagcagaca

SEQ ID NO: 9427259 - DNA, 22 bp, Homo sapiens
tgtctttacttagaagttcagg

SEQ ID NO: 9427260 - DNA, 22 bp, Homo sapiens
tgtctgtcccctgccttgaggg

SEQ ID NO: 9427261 - DNA, 22 bp, Homo sapiens
tgtctgtccttgtttggtatca

SEQ ID NO: 9427262 - DNA, 22 bp, Homo sapiens
tgtctgtcctgcttccttggac

SEQ ID NO: 9427263 - DNA, 17 bp, Homo sapiens
tgtctgtcatcagttcc

SEQ ID NO: 9427264 - DNA, 22 bp, Homo sapiens
tgtctgtcatcagggatatcct

SEQ ID NO: 9427265 - DNA, 22 bp, Homo sapiens
tgtctgtcagatattaagtttc

SEQ ID NO: 9427266 - DNA, 22 bp, Homo sapiens
tgtctgtaggtgtaatagagct

SEQ ID NO: 9427267 - DNA, 22 bp, Homo sapiens
tgtctggtttgaagtccatgat

SEQ ID NO: 9427268 - DNA, 23 bp, Homo sapiens
tgtctggttcatgcttattttgg

SEQ ID NO: 9427269 - DNA, 22 bp, Homo sapiens
tgtctggtgggttgacaggcag

SEQ ID NO: 9427270 - DNA, 22 bp, Homo sapiens
tgtctggtgggttgacaggcag

SEQ ID NO: 9427271 - DNA, 22 bp, Homo sapiens
tgtctggtgggttgacaggcag

SEQ ID NO: 9427272 - DNA, 22 bp, Homo sapiens
tgtctggtgggttgacaggcag

SEQ ID NO: 9427273 - DNA, 22 bp, Homo sapiens
cctgggaacagcagagtcctgg

SEQ ID NO: 9427274 - DNA, 22 bp, Homo sapiens
cctgggaaagtgaggtcattat

SEQ ID NO: 9427275 - DNA, 22 bp, Homo sapiens
cctgggaaagtgaggtcattat

SEQ ID NO: 9427276 - DNA, 23 bp, Homo sapiens
cctgggaaaactgctgatcttgc

SEQ ID NO: 9427277 - DNA, 18 bp, Homo sapiens
cctggcttttctacttgc

SEQ ID NO: 9427278 - DNA, 20 bp, Homo sapiens
cctggctttgcatctgtgat

SEQ ID NO: 9427279 - DNA, 22 bp, Homo sapiens
cctggctttctcatttacaggc

SEQ ID NO: 9427280 - DNA, 20 bp, Homo sapiens
cctggctttgcagcatgaga

SEQ ID NO: 9427281 - DNA, 20 bp, Homo sapiens
cctggctttgcagcatgaga

SEQ ID NO: 9427282 - DNA, 22 bp, Homo sapiens
cctggcttccttcatgacctgg

SEQ ID NO: 9427283 - DNA, 22 bp, Homo sapiens
cctggcttctataccaccaggt

SEQ ID NO: 9427284 - DNA, 22 bp, Homo sapiens
cctggcttctgggtctgtgaga

SEQ ID NO: 9427285 - DNA, 22 bp, Homo sapiens
cctggctgtgtgaccttggcaa

SEQ ID NO: 9427286 - DNA, 22 bp, Homo sapiens
cctggctgtgtgaccttggcaa

SEQ ID NO: 9427287 - DNA, 22 bp, Homo sapiens
cctggctgtggcggtgctctca

SEQ ID NO: 9427288 - DNA, 22 bp, Homo sapiens
cctggctgtggcggtgctctca

SEQ ID NO: 9427289 - DNA, 22 bp, Homo sapiens
cctggctgtggcggtgctctca

SEQ ID NO: 9427290 - DNA, 21 bp, Homo sapiens
cctggcttcagggtgcactgg

SEQ ID NO: 9427291 - DNA, 21 bp, Homo sapiens
cctggcttcagggtgcactgg

SEQ ID NO: 9427292 - DNA, 22 bp, Homo sapiens
cctggcttatttttatagcagt

SEQ ID NO: 9427293 - DNA, 22 bp, Homo sapiens
cctggcttccatatggcacata

SEQ ID NO: 9427294 - DNA, 22 bp, Homo sapiens
cctggctgcccatggaccctct

SEQ ID NO: 9427295 - DNA, 22 bp, Homo sapiens
cctggctgcccatggaccctct

SEQ ID NO: 9427296 - DNA, 20 bp, Homo sapiens
cctggctgcattcaggacgg

SEQ ID NO: 9427297 - DNA, 22 bp, Homo sapiens
cctggctgcattttgctggatg

SEQ ID NO: 9427298 - DNA, 22 bp, Homo sapiens
cctggctgctctgatgagcgcc

SEQ ID NO: 9427299 - DNA, 22 bp, Homo sapiens
cctggctgctgtcactgaccat

SEQ ID NO: 9427300 - DNA, 22 bp, Homo sapiens
cctggctgctatagcagcatgt

SEQ ID NO: 9427301 - DNA, 22 bp, Homo sapiens
cctggctgtcgttttgtgaaat

SEQ ID NO: 9427302 - DNA, 19 bp, Homo sapiens
cctggctgtgaagcctgca

SEQ ID NO: 9427303 - DNA, 23 bp, Homo sapiens
cctggctgtggatttgggcctgc

SEQ ID NO: 9427304 - DNA, 22 bp, Homo sapiens
cctggctgtgcattgccggccc

SEQ ID NO: 9427305 - DNA, 22 bp, Homo sapiens
tgtgcttctgcagagactattt

SEQ ID NO: 9427306 - DNA, 22 bp, Homo sapiens
tgtgcttctgcagagactattt

SEQ ID NO: 9427307 - DNA, 22 bp, Homo sapiens
tgtgcttcttgcagctcctgta

SEQ ID NO: 9427308 - DNA, 22 bp, Homo sapiens
tgtgcttctcacatcactgttg

SEQ ID NO: 9427309 - DNA, 22 bp, Homo sapiens
tgtgcttctcacatcactgttg

SEQ ID NO: 9427310 - DNA, 22 bp, Homo sapiens
tgtgctgtcagtatcaagggat

SEQ ID NO: 9427311 - DNA, 22 bp, Homo sapiens
tgtgctgtcagtatcaagggat

SEQ ID NO: 9427312 - DNA, 22 bp, Homo sapiens
tgtgctggtacatgtgaggatg

SEQ ID NO: 9427313 - DNA, 22 bp, Homo sapiens
tgtgctggtacatgtgaggatg

SEQ ID NO: 9427314 - DNA, 22 bp, Homo sapiens
tgtgctggtacatgtgaggatg

SEQ ID NO: 9427315 - DNA, 22 bp, Homo sapiens
tgtgctggggtccagctgagcc

SEQ ID NO: 9427316 - DNA, 22 bp, Homo sapiens
tgtgctgggagatagagggagg

SEQ ID NO: 9427317 - DNA, 22 bp, Homo sapiens
tgtgctgggagatagagggagg

SEQ ID NO: 9427318 - DNA, 22 bp, Homo sapiens
tgtgctgggaaatggcaggata

SEQ ID NO: 9427319 - DNA, 22 bp, Homo sapiens
tgtgctgggaaatggcaggata

SEQ ID NO: 9427320 - DNA, 23 bp, Homo sapiens
tgtgctggcatctcaggctttgg

SEQ ID NO: 9427321 - DNA, 22 bp, Homo sapiens
tgtgctgggaaatggcaggata

SEQ ID NO: 9427322 - DNA, 22 bp, Homo sapiens
tgtgcccattacacagaggcat

SEQ ID NO: 9427323 - DNA, 22 bp, Homo sapiens
tgtgcccagactgcctcagtga

SEQ ID NO: 9427324 - DNA, 20 bp, Homo sapiens
tgtgcccaatgtccaggttc

SEQ ID NO: 9427325 - DNA, 22 bp, Homo sapiens
tgtgcccatccctctggagtgt

SEQ ID NO: 9427326 - DNA, 22 bp, Homo sapiens
tgtgcccatccctctggagtgt

SEQ ID NO: 9427327 - DNA, 20 bp, Homo sapiens
tgtgcccagcagaggctgcc

SEQ ID NO: 9427328 - DNA, 22 bp, Homo sapiens
tgtgccagtgccttgggtatta

SEQ ID NO: 9427329 - DNA, 22 bp, Homo sapiens
cctgggaaagtgaggtcattat

SEQ ID NO: 9427330 - DNA, 22 bp, Homo sapiens
cctgggaagcccatagcagctt

SEQ ID NO: 9427331 - DNA, 22 bp, Homo sapiens
cctgggaagagctgacaggagg

SEQ ID NO: 9427332 - DNA, 22 bp, Homo sapiens
cctgggaagagctgacaggagg

SEQ ID NO: 9427333 - DNA, 22 bp, Homo sapiens
cctgggaacagtgggttggctc

SEQ ID NO: 9427334 - DNA, 22 bp, Homo sapiens
cctgggaagaccggcagtgggg

SEQ ID NO: 9427335 - DNA, 22 bp, Homo sapiens
cctgggagagtctgtggtctcc

SEQ ID NO: 9427336 - DNA, 22 bp, Homo sapiens
cctgggagagtctgtggtctcc

SEQ ID NO: 9427337 - DNA, 22 bp, Homo sapiens
cctgggagagctgcccgggtga

SEQ ID NO: 9427338 - DNA, 22 bp, Homo sapiens
cctgggagagctgcccgggtga

SEQ ID NO: 9427339 - DNA, 22 bp, Homo sapiens
cctgggagagccatctgtggcc

SEQ ID NO: 9427340 - DNA, 22 bp, Homo sapiens
cctgggagagccatctgtggcc

SEQ ID NO: 9427341 - DNA, 22 bp, Homo sapiens
cctgggagccgactgactgtgc

SEQ ID NO: 9427342 - DNA, 22 bp, Homo sapiens
tgtgccagcctctggctgtgtc

SEQ ID NO: 9427343 - DNA, 21 bp, Homo sapiens
cctgggagatcagctgccttc

SEQ ID NO: 9427344 - DNA, 21 bp, Homo sapiens
cctgggagatcagctgccttc

SEQ ID NO: 9427345 - DNA, 21 bp, Homo sapiens
cctgggagatcagctgccttc

SEQ ID NO: 9427346 - DNA, 22 bp, Homo sapiens
cctgggagccaagcctctgtgt

SEQ ID NO: 9427347 - DNA, 22 bp, Homo sapiens
tgtgtgtatatgcatttatcta

SEQ ID NO: 9427348 - DNA, 22 bp, Homo sapiens
tgtgtgtcactgaaagaaatct

SEQ ID NO: 9427349 - DNA, 22 bp, Homo sapiens
tgtgtgtcagtcttgtttaggg

SEQ ID NO: 9427350 - DNA, 22 bp, Homo sapiens
tgtgtgtcagagtctccatggt

SEQ ID NO: 9427351 - DNA, 22 bp, Homo sapiens
tgtgtgtcagtcttgtttaggg

SEQ ID NO: 9427352 - DNA, 22 bp, Homo sapiens
tgtgtgtcactgaaagaaatct

SEQ ID NO: 9427353 - DNA, 22 bp, Homo sapiens
tgtgtgtcagagtctccatggt

SEQ ID NO: 9427354 - DNA, 22 bp, Homo sapiens
tgtgtgtcagcccaagggcctt

SEQ ID NO: 9427355 - DNA, 22 bp, Homo sapiens
tgtgtgtataataatgtctgca

SEQ ID NO: 9427356 - DNA, 22 bp, Homo sapiens
tgtgtggtgaagcagagatgct

SEQ ID NO: 9427357 - DNA, 22 bp, Homo sapiens
tgtgtgtataataatgtctgca

SEQ ID NO: 9427358 - DNA, 22 bp, Homo sapiens
tgtgtgtataataatgtctgca

SEQ ID NO: 9427359 - DNA, 22 bp, Homo sapiens
tgtgtgtataataatgtctgca

SEQ ID NO: 9427360 - DNA, 19 bp, Homo sapiens
tgtgtgggtttagagtagt

SEQ ID NO: 9427361 - DNA, 22 bp, Homo sapiens
tgtgtgggtggtaaggaaggcc

SEQ ID NO: 9427362 - DNA, 19 bp, Homo sapiens
tgtgtgggtttagagtagt

SEQ ID NO: 9427363 - DNA, 22 bp, Homo sapiens
tgtgtgtctgcacatgtataat

SEQ ID NO: 9427364 - DNA, 22 bp, Homo sapiens
tgtgtgtcatttagggtggagc

SEQ ID NO: 9427365 - DNA, 22 bp, Homo sapiens
tgtgtgtcatttagggtggagc

SEQ ID NO: 9427366 - DNA, 22 bp, Homo sapiens
tgtgtgtccttgacctcagtgg

SEQ ID NO: 9427367 - DNA, 19 bp, Homo sapiens
cctgggcctccatcacccc

SEQ ID NO: 9427368 - DNA, 19 bp, Homo sapiens
cctgggcctccatcacccc

SEQ ID NO: 9427369 - DNA, 22 bp, Homo sapiens
cctgggcctcacccagctcttg

SEQ ID NO: 9427370 - DNA, 22 bp, Homo sapiens
tgtgtgtctggaagctcaggga

SEQ ID NO: 9427371 - DNA, 22 bp, Homo sapiens
cctgggcctctcaaagtgctgg

SEQ ID NO: 9427372 - DNA, 22 bp, Homo sapiens
cctgggcctctcaaagtgctgg

SEQ ID NO: 9427373 - DNA, 22 bp, Homo sapiens
cctgggcctctcaaagtgctgg

SEQ ID NO: 9427374 - DNA, 22 bp, Homo sapiens
cctgggcctgaaaacatttctc

SEQ ID NO: 9427375 - DNA, 22 bp, Homo sapiens
cctgggcctgaaaacatttctc

SEQ ID NO: 9427376 - DNA, 22 bp, Homo sapiens
cctgggcctggcgggtcggctc

SEQ ID NO: 9427377 - DNA, 22 bp, Homo sapiens
cctgggcctggcgggtcggctc

SEQ ID NO: 9427378 - DNA, 22 bp, Homo sapiens
cctgggcctggcgggtcggctc

SEQ ID NO: 9427379 - DNA, 22 bp, Homo sapiens
cctgggcctggcgggtcggctc

SEQ ID NO: 9427380 - DNA, 22 bp, Homo sapiens
cctgggctcaagcgatcttgtc

SEQ ID NO: 9427381 - DNA, 22 bp, Homo sapiens
cctgggcttccacgagcagagg

SEQ ID NO: 9427382 - DNA, 22 bp, Homo sapiens
cctgggcttccacgagcagagg

SEQ ID NO: 9427383 - DNA, 22 bp, Homo sapiens
cctgggctttgagggcaggatg

SEQ ID NO: 9427384 - DNA, 22 bp, Homo sapiens
cctgggcttccacgagcagagg

SEQ ID NO: 9427385 - DNA, 22 bp, Homo sapiens
cctgggctttgctggcaaggcc

SEQ ID NO: 9427386 - DNA, 22 bp, Homo sapiens
cctgggctttgctggcaaggcc

SEQ ID NO: 9427387 - DNA, 22 bp, Homo sapiens
cctgggccttgacctcgtgggc

SEQ ID NO: 9427388 - DNA, 22 bp, Homo sapiens
cctgggccttgacctcgtgggc

SEQ ID NO: 9427389 - DNA, 22 bp, Homo sapiens
cctgggccttgacctcgtgggc

SEQ ID NO: 9427390 - DNA, 22 bp, Homo sapiens
cctgggccttgacctcgtgggc

SEQ ID NO: 9427391 - DNA, 20 bp, Homo sapiens
cctgggctcaaagcatcctc

SEQ ID NO: 9427392 - DNA, 20 bp, Homo sapiens
cctgggctcaaagcatcctc

SEQ ID NO: 9427393 - DNA, 20 bp, Homo sapiens
cctgggctcaaagcatcctc

SEQ ID NO: 9427394 - DNA, 22 bp, Homo sapiens
cctggggaagtcacttctcttt

SEQ ID NO: 9427395 - DNA, 22 bp, Homo sapiens
cctggggaaaagcaggcattta

SEQ ID NO: 9427396 - DNA, 22 bp, Homo sapiens
cctggggaaaagcaggcattta

SEQ ID NO: 9427397 - DNA, 22 bp, Homo sapiens
cctggggaaaagcaggcattta

SEQ ID NO: 9427398 - DNA, 22 bp, Homo sapiens
cctgggctttgctggcaaggcc

SEQ ID NO: 9427399 - DNA, 22 bp, Homo sapiens
cctgggctttggaacagtactt

SEQ ID NO: 9427400 - DNA, 22 bp, Homo sapiens
cctggggaatcttgcaggggaa

SEQ ID NO: 9427401 - DNA, 22 bp, Homo sapiens
cctggggaatcttgcaggggaa

SEQ ID NO: 9427402 - DNA, 22 bp, Homo sapiens
cctggggaatcttgcaggggaa

SEQ ID NO: 9427403 - DNA, 22 bp, Homo sapiens
cctggggaatagagtcaagggg

SEQ ID NO: 9427404 - DNA, 22 bp, Homo sapiens
cctggggaatagagtcaagggg

SEQ ID NO: 9427405 - DNA, 22 bp, Homo sapiens
cctggggaatagagtcaagggg

SEQ ID NO: 9427406 - DNA, 22 bp, Homo sapiens
cctggggaatagagtcaagggg

SEQ ID NO: 9427407 - DNA, 22 bp, Homo sapiens
cctggggaagtcacttctcttt

SEQ ID NO: 9427408 - DNA, 22 bp, Homo sapiens
cctggggaatagagtcaagggg

SEQ ID NO: 9427409 - DNA, 22 bp, Homo sapiens
cctgggtctgtattggtaggta

SEQ ID NO: 9427410 - DNA, 22 bp, Homo sapiens
cctgggtctggtcactaagtca

SEQ ID NO: 9427411 - DNA, 22 bp, Homo sapiens
cctgggtctggtcactaagtca

SEQ ID NO: 9427412 - DNA, 19 bp, Homo sapiens
cctgggtctgcagcattca

SEQ ID NO: 9427413 - DNA, 19 bp, Homo sapiens
cctgggtctgcagcattca

SEQ ID NO: 9427414 - DNA, 22 bp, Homo sapiens
cctgggtcttcagtctgctggt

SEQ ID NO: 9427415 - DNA, 22 bp, Homo sapiens
cctgggtcttggttcatgctct

SEQ ID NO: 9427416 - DNA, 22 bp, Homo sapiens
cctgggtcttggttcatgctct

SEQ ID NO: 9427417 - DNA, 22 bp, Homo sapiens
cctgggtctcctcctgctggct

SEQ ID NO: 9427418 - DNA, 22 bp, Homo sapiens
cctgggtcctggcagcctcctg

SEQ ID NO: 9427419 - DNA, 22 bp, Homo sapiens
cctgggtctatagacttcaaga

SEQ ID NO: 9427420 - DNA, 22 bp, Homo sapiens
cctgggtcccagccaggctttg

SEQ ID NO: 9427421 - DNA, 22 bp, Homo sapiens
cctgggtcccatcccagagtga

SEQ ID NO: 9427422 - DNA, 22 bp, Homo sapiens
cctgggtcccatcccagagtga

SEQ ID NO: 9427423 - DNA, 22 bp, Homo sapiens
cctgggtcctggcagcctcctg

SEQ ID NO: 9427424 - DNA, 22 bp, Homo sapiens
cctgggtccctgagagatgatt

SEQ ID NO: 9427425 - DNA, 22 bp, Homo sapiens
cctgggtcccatcccagagtga

SEQ ID NO: 9427426 - DNA, 22 bp, Homo sapiens
cctgggtgacccgtgagcgtcc

SEQ ID NO: 9427427 - DNA, 22 bp, Homo sapiens
cctgggtgacagagtgagacct

SEQ ID NO: 9427428 - DNA, 22 bp, Homo sapiens
cctgggtgacccgtgagcgtcc

SEQ ID NO: 9427429 - DNA, 22 bp, Homo sapiens
cctgggtggcagaggttgcagt

SEQ ID NO: 9427430 - DNA, 22 bp, Homo sapiens
cctgggtgatgtgctgccctcg

SEQ ID NO: 9427431 - DNA, 22 bp, Homo sapiens
cctgggtgatgtgctgccctcg

SEQ ID NO: 9427432 - DNA, 22 bp, Homo sapiens
cctgggtgcccggcccttctct

SEQ ID NO: 9427433 - DNA, 22 bp, Homo sapiens
cctgggtgaaatctctcctgca

SEQ ID NO: 9427434 - DNA, 22 bp, Homo sapiens
cctgggtgacagagtgagacct

SEQ ID NO: 9427435 - DNA, 22 bp, Homo sapiens
cctgggtgaatgatattctaaa

SEQ ID NO: 9427436 - DNA, 22 bp, Homo sapiens
cctgggtccaccctgtgaagta

SEQ ID NO: 9427437 - DNA, 22 bp, Homo sapiens
cctgggtcccagccaggctttg

SEQ ID NO: 9427438 - DNA, 19 bp, Homo sapiens
cctgggtccactcagacta

SEQ ID NO: 9427439 - DNA, 22 bp, Homo sapiens
cctggggctccagagcagcgga

SEQ ID NO: 9427440 - DNA, 19 bp, Homo sapiens
tgtgttcattcatcagagg

SEQ ID NO: 9427441 - DNA, 22 bp, Homo sapiens
tgtgttcatgttgattcatagc

SEQ ID NO: 9427442 - DNA, 23 bp, Homo sapiens
tgtgttctcacacagatgcagta

SEQ ID NO: 9427443 - DNA, 23 bp, Homo sapiens
tgtgttctcacacagatgcagta

SEQ ID NO: 9427444 - DNA, 22 bp, Homo sapiens
tgtgttcatcatgatatcaggt

SEQ ID NO: 9427445 - DNA, 22 bp, Homo sapiens
tgtgttcatctttaaagggaag

SEQ ID NO: 9427446 - DNA, 22 bp, Homo sapiens
tgtgttcatgtatgtatacata

SEQ ID NO: 9427447 - DNA, 22 bp, Homo sapiens
tgtgttcatgtcactggaatcc

SEQ ID NO: 9427448 - DNA, 22 bp, Homo sapiens
tgtgttcagtatgacattcaca

SEQ ID NO: 9427449 - DNA, 22 bp, Homo sapiens
tgtgttcaccaaagtgtagaaa

SEQ ID NO: 9427450 - DNA, 22 bp, Homo sapiens
cctggggacctgcctcagccct

SEQ ID NO: 9427451 - DNA, 22 bp, Homo sapiens
tgtgttcaatcaccaaaggtat

SEQ ID NO: 9427452 - DNA, 22 bp, Homo sapiens
tgtgttcaatgacttcatcttt

SEQ ID NO: 9427453 - DNA, 22 bp, Homo sapiens
cctggggaatcttgcaggggaa

SEQ ID NO: 9427454 - DNA, 22 bp, Homo sapiens
cctggggaatcttgcaggggaa

SEQ ID NO: 9427455 - DNA, 22 bp, Homo sapiens
cctggggacctgcctcagccct

SEQ ID NO: 9427456 - DNA, 22 bp, Homo sapiens
cctggggacctgcctcagccct

SEQ ID NO: 9427457 - DNA, 15 bp, Homo sapiens
tgtggctggctcctg

SEQ ID NO: 9427458 - DNA, 22 bp, Homo sapiens
tgtggctggattgattttacct

SEQ ID NO: 9427459 - DNA, 22 bp, Homo sapiens
tgtggctgctcaggtgcagacc

SEQ ID NO: 9427460 - DNA, 22 bp, Homo sapiens
tgtggctgctcctgggtggtca

SEQ ID NO: 9427461 - DNA, 22 bp, Homo sapiens
tgtggctgggaagaaggtaact

SEQ ID NO: 9427462 - DNA, 22 bp, Homo sapiens
tgtggctgggctaataggcaaa

SEQ ID NO: 9427463 - DNA, 22 bp, Homo sapiens
tgtggctgtgccgtcacacgtg

SEQ ID NO: 9427464 - DNA, 22 bp, Homo sapiens
tgtggctgtctgttctcctagg

SEQ ID NO: 9427465 - DNA, 22 bp, Homo sapiens
tgtggctgtctgttctcctagg

SEQ ID NO: 9427466 - DNA, 22 bp, Homo sapiens
tgtggctggtctccgagcgtcg

SEQ ID NO: 9427467 - DNA, 18 bp, Homo sapiens
tgtggctggtccacactg

SEQ ID NO: 9427468 - DNA, 22 bp, Homo sapiens
tgtggctgtggatgctttccag

SEQ ID NO: 9427469 - DNA, 22 bp, Homo sapiens
tgtggctgtggttttcataaat

SEQ ID NO: 9427470 - DNA, 22 bp, Homo sapiens
cctgggagctgtggaaaggctg

SEQ ID NO: 9427471 - DNA, 22 bp, Homo sapiens
tgtggctgtgtccacctgctgc

SEQ ID NO: 9427472 - DNA, 22 bp, Homo sapiens
tgtggctgttgaggaccccaag

SEQ ID NO: 9427473 - DNA, 22 bp, Homo sapiens
tgtggcttttgctagctttgca

SEQ ID NO: 9427474 - DNA, 22 bp, Homo sapiens
cctgggaggcagaggttgcagt

SEQ ID NO: 9427475 - DNA, 22 bp, Homo sapiens
cctgggaggcagaggttgcagt

SEQ ID NO: 9427476 - DNA, 19 bp, Homo sapiens
cctgggaggcggaggttgc

SEQ ID NO: 9427477 - DNA, 22 bp, Homo sapiens
cctgggagctgtggaaaggctg

SEQ ID NO: 9427478 - DNA, 22 bp, Homo sapiens
cctgggagctgtggaaaggctg

SEQ ID NO: 9427479 - DNA, 21 bp, Homo sapiens
tgtggctgcctctggccctgg

SEQ ID NO: 9427480 - DNA, 22 bp, Homo sapiens
tgtggcagggatactgaggcag

SEQ ID NO: 9427481 - DNA, 22 bp, Homo sapiens
tgtggcagggatactgaggcag

SEQ ID NO: 9427482 - DNA, 22 bp, Homo sapiens
tgtggcagggatactgaggcag

SEQ ID NO: 9427483 - DNA, 22 bp, Homo sapiens
tgtggcaggcattctgaggctg

SEQ ID NO: 9427484 - DNA, 22 bp, Homo sapiens
tgtggcaggcattctgaggctg

SEQ ID NO: 9427485 - DNA, 22 bp, Homo sapiens
tgtggcaggcattctgaggctg

SEQ ID NO: 9427486 - DNA, 22 bp, Homo sapiens
tgtggcaggcaagatgtacaga

SEQ ID NO: 9427487 - DNA, 22 bp, Homo sapiens
tgtggcaggatgcggaagatgc

SEQ ID NO: 9427488 - DNA, 22 bp, Homo sapiens
tgtggcaggcaagatgtacaga

SEQ ID NO: 9427489 - DNA, 20 bp, Homo sapiens
tgtggcaggatgagggcgga

SEQ ID NO: 9427490 - DNA, 22 bp, Homo sapiens
tgtggcaggaagagcttctgag

SEQ ID NO: 9427491 - DNA, 20 bp, Homo sapiens
tgtggcaggatgagggcgga

SEQ ID NO: 9427492 - DNA, 22 bp, Homo sapiens
tgtggcagctggaggtggagaa

SEQ ID NO: 9427493 - DNA, 22 bp, Homo sapiens
tgtgcttgtcgtggagccaggc

SEQ ID NO: 9427494 - DNA, 22 bp, Homo sapiens
tgtgctttcaaagttaagtaaa

SEQ ID NO: 9427495 - DNA, 22 bp, Homo sapiens
tgtgctttcaaagttaagtaaa

SEQ ID NO: 9427496 - DNA, 22 bp, Homo sapiens
tgtgctttggttttacaggatg

SEQ ID NO: 9427497 - DNA, 20 bp, Homo sapiens
tgtggaaaaacagaagcaga

SEQ ID NO: 9427498 - DNA, 22 bp, Homo sapiens
tgtgcttttctctgctcctgga

SEQ ID NO: 9427499 - DNA, 22 bp, Homo sapiens
tgtgctttggttttacaggatg

SEQ ID NO: 9427500 - DNA, 22 bp, Homo sapiens
tgtgctttggttttacaggatg

SEQ ID NO: 9427501 - DNA, 22 bp, Homo sapiens
tgtgctttggttttacaggatg

SEQ ID NO: 9427502 - DNA, 22 bp, Homo sapiens
tgtgggggtacacgtacacatg

SEQ ID NO: 9427503 - DNA, 22 bp, Homo sapiens
tgtgggggtacacgtacacatg

SEQ ID NO: 9427504 - DNA, 22 bp, Homo sapiens
tgtgggggtacacgtacacatg

SEQ ID NO: 9427505 - DNA, 22 bp, Homo sapiens
tgtgggggtacacgtacacatg

SEQ ID NO: 9427506 - DNA, 22 bp, Homo sapiens
tgtgtctgtcctcggttgatgc

SEQ ID NO: 9427507 - DNA, 22 bp, Homo sapiens
tgtggggctgtcaggcaactgg

SEQ ID NO: 9427508 - DNA, 22 bp, Homo sapiens
tgtggggctgtggtgttcttct

SEQ ID NO: 9427509 - DNA, 22 bp, Homo sapiens
tgtggggctgtggtgttcttct

SEQ ID NO: 9427510 - DNA, 22 bp, Homo sapiens
tgtgtggggaaggaaggagctg

SEQ ID NO: 9427511 - DNA, 22 bp, Homo sapiens
tgtgtgggtggtaaggaaggcc

SEQ ID NO: 9427512 - DNA, 22 bp, Homo sapiens
tgtgtgggcgaagacagccttt

SEQ ID NO: 9427513 - DNA, 21 bp, Homo sapiens
tgtgtgggcatatctgctgca

SEQ ID NO: 9427514 - DNA, 22 bp, Homo sapiens
tgtgtctggataggtaatggat

SEQ ID NO: 9427515 - DNA, 22 bp, Homo sapiens
tgtgtctgtgtatacacggcat

SEQ ID NO: 9427516 - DNA, 23 bp, Homo sapiens
tgtgtctgtttagggaggatgtg

SEQ ID NO: 9427517 - DNA, 21 bp, Homo sapiens
tgtgtgggcatatctgctgca

SEQ ID NO: 9427518 - DNA, 22 bp, Homo sapiens
cctgggcctatcctagaaccaa

SEQ ID NO: 9427519 - DNA, 22 bp, Homo sapiens
cctgggcctcacccagctcttg

SEQ ID NO: 9427520 - DNA, 22 bp, Homo sapiens
cctgggcctcacccagctcttg

SEQ ID NO: 9427521 - DNA, 22 bp, Homo sapiens
cctgggcctcacccagctcttg

SEQ ID NO: 9427522 - DNA, 22 bp, Homo sapiens
cctgggcctcacccagctcttg

SEQ ID NO: 9427523 - DNA, 22 bp, Homo sapiens
tgtggggcagctagccggcctg

SEQ ID NO: 9427524 - DNA, 22 bp, Homo sapiens
tgtggggctccctggcagcctg

SEQ ID NO: 9427525 - DNA, 19 bp, Homo sapiens
cctgggaggcggaggttgc

SEQ ID NO: 9427526 - DNA, 22 bp, Homo sapiens
cctgggaggcggaggttgcagg

SEQ ID NO: 9427527 - DNA, 22 bp, Homo sapiens
cctgggaggcggaggttgcagg

SEQ ID NO: 9427528 - DNA, 22 bp, Homo sapiens
cctgggaggcggaggttgcagt

SEQ ID NO: 9427529 - DNA, 22 bp, Homo sapiens
cctgggaggcggaggttgcagt

SEQ ID NO: 9427530 - DNA, 22 bp, Homo sapiens
cctgggcaatatagtgaggccc

SEQ ID NO: 9427531 - DNA, 22 bp, Homo sapiens
cctgggcaatatagtgaggccc

SEQ ID NO: 9427532 - DNA, 22 bp, Homo sapiens
cctgggcataaatcactccaag

SEQ ID NO: 9427533 - DNA, 22 bp, Homo sapiens
cctgggcatcaacaagcagaga

SEQ ID NO: 9427534 - DNA, 22 bp, Homo sapiens
cctgggcatcaacaagcagaga

SEQ ID NO: 9427535 - DNA, 23 bp, Homo sapiens
cctgggcattggctgcagcttct

SEQ ID NO: 9427536 - DNA, 23 bp, Homo sapiens
cctgggcattggctgcagcttct

SEQ ID NO: 9427537 - DNA, 22 bp, Homo sapiens
cctgggccctcaccgccggtgg

SEQ ID NO: 9427538 - DNA, 22 bp, Homo sapiens
cctgggccctcaccgccggtgg

SEQ ID NO: 9427539 - DNA, 22 bp, Homo sapiens
cctgggcctatcctagaaccaa

SEQ ID NO: 9427540 - DNA, 22 bp, Homo sapiens
cctgggccaggcttgggaatgc

SEQ ID NO: 9427541 - DNA, 21 bp, Homo sapiens
cctgggccaaattccctggac

SEQ ID NO: 9427542 - DNA, 21 bp, Homo sapiens
cctgggccaaattccctggac

SEQ ID NO: 9427543 - DNA, 21 bp, Homo sapiens
cctgggccaaattccctggac

SEQ ID NO: 9427544 - DNA, 22 bp, Homo sapiens
cctgggccaggcttgggaatgc

SEQ ID NO: 9427545 - DNA, 22 bp, Homo sapiens
cctggagcacagcccagtccca

SEQ ID NO: 9427546 - DNA, 22 bp, Homo sapiens
cctggagcacagcccagtccca

SEQ ID NO: 9427547 - DNA, 22 bp, Homo sapiens
cctggagcacagcccagtccca

SEQ ID NO: 9427548 - DNA, 22 bp, Homo sapiens
cctggagatttcttcaagcttt

SEQ ID NO: 9427549 - DNA, 22 bp, Homo sapiens
cctggagattatttggtccaat

SEQ ID NO: 9427550 - DNA, 22 bp, Homo sapiens
cctggagcacatggcaggaggc

SEQ ID NO: 9427551 - DNA, 19 bp, Homo sapiens
cctggaggtgaaggttctc

SEQ ID NO: 9427552 - DNA, 19 bp, Homo sapiens
cctggaggtgaaggttctc

SEQ ID NO: 9427553 - DNA, 22 bp, Homo sapiens
cctggaggtggaggttgcagtg

SEQ ID NO: 9427554 - DNA, 22 bp, Homo sapiens
cctggagcacatggcaggaggc

SEQ ID NO: 9427555 - DNA, 22 bp, Homo sapiens
cctggagcacatggcaggaggc

SEQ ID NO: 9427556 - DNA, 22 bp, Homo sapiens
cctggagcacatggcaggaggc

SEQ ID NO: 9427557 - DNA, 22 bp, Homo sapiens
cctggcacatagcaacccctcc

SEQ ID NO: 9427558 - DNA, 22 bp, Homo sapiens
cctggcacatagtaagtactag

SEQ ID NO: 9427559 - DNA, 22 bp, Homo sapiens
tgtagtgtagcagggtgggaca

SEQ ID NO: 9427560 - DNA, 22 bp, Homo sapiens
tgtagtaagtgcgcaataaata

SEQ ID NO: 9427561 - DNA, 22 bp, Homo sapiens
tgtagtagcattcacgaagtgt

SEQ ID NO: 9427562 - DNA, 22 bp, Homo sapiens
tgtagtagcattcacgaagtgt

SEQ ID NO: 9427563 - DNA, 22 bp, Homo sapiens
tgtagtccaggaattgtgtctg

SEQ ID NO: 9427564 - DNA, 22 bp, Homo sapiens
cctggagaggagaaagggccca

SEQ ID NO: 9427565 - DNA, 22 bp, Homo sapiens
cctggagaggagaaagggccca

SEQ ID NO: 9427566 - DNA, 22 bp, Homo sapiens
cctggagagctcgggccaggca

SEQ ID NO: 9427567 - DNA, 22 bp, Homo sapiens
cctggagagctcgggccaggca

SEQ ID NO: 9427568 - DNA, 22 bp, Homo sapiens
cctggagagctcgggccaggca

SEQ ID NO: 9427569 - DNA, 22 bp, Homo sapiens
cctggagaggcgctgcagagga

SEQ ID NO: 9427570 - DNA, 22 bp, Homo sapiens
cctggagattatttggtccaat

SEQ ID NO: 9427571 - DNA, 22 bp, Homo sapiens
cctggagattatttggtccaat

SEQ ID NO: 9427572 - DNA, 22 bp, Homo sapiens
cctggagaggcgctgcagagga

SEQ ID NO: 9427573 - DNA, 22 bp, Homo sapiens
cctggagaggcgctgcagagga

SEQ ID NO: 9427574 - DNA, 22 bp, Homo sapiens
tgtaggaatggattctagaagg

SEQ ID NO: 9427575 - DNA, 22 bp, Homo sapiens
tgtaggaatggattctagaagg

SEQ ID NO: 9427576 - DNA, 22 bp, Homo sapiens
tgtaggaattccagtgacttca

SEQ ID NO: 9427577 - DNA, 22 bp, Homo sapiens
tgtaccaagacaaatcagaaac

SEQ ID NO: 9427578 - DNA, 22 bp, Homo sapiens
tgtaccaaacccatcataacta

SEQ ID NO: 9427579 - DNA, 22 bp, Homo sapiens
tgtaaactgtagaaaatacttt

SEQ ID NO: 9427580 - DNA, 22 bp, Homo sapiens
tgtaaactgcttctcaccaagg

SEQ ID NO: 9427581 - DNA, 22 bp, Homo sapiens
tgtaaacatatgtatgtatgta

SEQ ID NO: 9427582 - DNA, 22 bp, Homo sapiens
tgtaaactgagggtagctgatt

SEQ ID NO: 9427583 - DNA, 22 bp, Homo sapiens
tgtaaactagggctgataaggg

SEQ ID NO: 9427584 - DNA, 22 bp, Homo sapiens
tgtaaactagggctgataaggg

SEQ ID NO: 9427585 - DNA, 22 bp, Homo sapiens
tgtaaactagggctgataaggg

SEQ ID NO: 9427586 - DNA, 22 bp, Homo sapiens
tgtaaaccagggtcatccttag

SEQ ID NO: 9427587 - DNA, 23 bp, Homo sapiens
tgtaggctaagtcccataaatca

SEQ ID NO: 9427588 - DNA, 22 bp, Homo sapiens
tgtagggactgaggctggagag

SEQ ID NO: 9427589 - DNA, 22 bp, Homo sapiens
tgtaggcacatgtatatatccc

SEQ ID NO: 9427590 - DNA, 22 bp, Homo sapiens
tgtagggaggaagggttggaaa

SEQ ID NO: 9427591 - DNA, 20 bp, Homo sapiens
tgtaggtgtacagtaaggag

SEQ ID NO: 9427592 - DNA, 22 bp, Homo sapiens
tgtagtaaacactattctgatc

SEQ ID NO: 9427593 - DNA, 22 bp, Homo sapiens
cctggcacatgatagatgctca

SEQ ID NO: 9427594 - DNA, 22 bp, Homo sapiens
cctggcacatgatagatgctca

SEQ ID NO: 9427595 - DNA, 22 bp, Homo sapiens
cctggcacatgcagtactcaag

SEQ ID NO: 9427596 - DNA, 22 bp, Homo sapiens
cctggcacatagtgggcatgca

SEQ ID NO: 9427597 - DNA, 22 bp, Homo sapiens
cctggcacctgtgttttctgga

SEQ ID NO: 9427598 - DNA, 22 bp, Homo sapiens
cctggcaccttcacagactact

SEQ ID NO: 9427599 - DNA, 22 bp, Homo sapiens
cctggcacgaagggctgaggtt

SEQ ID NO: 9427600 - DNA, 22 bp, Homo sapiens
cctggcacgaagggctgaggtt

SEQ ID NO: 9427601 - DNA, 22 bp, Homo sapiens
cctggcactgaccaggcactga

SEQ ID NO: 9427602 - DNA, 22 bp, Homo sapiens
cctggcagaatattaaagtgca

SEQ ID NO: 9427603 - DNA, 22 bp, Homo sapiens
tgtatgtggctacttttcttgc

SEQ ID NO: 9427604 - DNA, 22 bp, Homo sapiens
tgtatgtgtggatagatgtata

SEQ ID NO: 9427605 - DNA, 22 bp, Homo sapiens
tgtatgtgtggatagatgtata

SEQ ID NO: 9427606 - DNA, 22 bp, Homo sapiens
tgtatgtgtatgtacatatgca

SEQ ID NO: 9427607 - DNA, 22 bp, Homo sapiens
tgtatgtatgtatgtatttggg

SEQ ID NO: 9427608 - DNA, 22 bp, Homo sapiens
tgtatgtatgcatcttttatgt

SEQ ID NO: 9427609 - DNA, 22 bp, Homo sapiens
tgtatgtatacactgatcatca

SEQ ID NO: 9427610 - DNA, 22 bp, Homo sapiens
cctggcagacagcactgaagct

SEQ ID NO: 9427611 - DNA, 22 bp, Homo sapiens
cctggcagaatattaaagtgca

SEQ ID NO: 9427612 - DNA, 22 bp, Homo sapiens
cctggcagacagcactgaagct

SEQ ID NO: 9427613 - DNA, 22 bp, Homo sapiens
cctggcagacagcactgaagct

SEQ ID NO: 9427614 - DNA, 22 bp, Homo sapiens
tgtcatgtaacctttctgagcc

SEQ ID NO: 9427615 - DNA, 22 bp, Homo sapiens
tgtcatgggtctaaacattgat

SEQ ID NO: 9427616 - DNA, 22 bp, Homo sapiens
tgtcatggtagctgaaggatgt

SEQ ID NO: 9427617 - DNA, 22 bp, Homo sapiens
tgtcatggggaaaataacagac

SEQ ID NO: 9427618 - DNA, 22 bp, Homo sapiens
tgtcaggagccaccagcactcc

SEQ ID NO: 9427619 - DNA, 22 bp, Homo sapiens
tgtcatgcccaggagcaaggta

SEQ ID NO: 9427620 - DNA, 22 bp, Homo sapiens
tgtcatgcccaggagcaaggta

SEQ ID NO: 9427621 - DNA, 22 bp, Homo sapiens
tgtattatgattgttgttcatg

SEQ ID NO: 9427622 - DNA, 22 bp, Homo sapiens
tgtattcaacttcttaaaaatt

SEQ ID NO: 9427623 - DNA, 22 bp, Homo sapiens
tgtattcaacttcttaaaaatt

SEQ ID NO: 9427624 - DNA, 22 bp, Homo sapiens
tgtcagctggagatggcatggg

SEQ ID NO: 9427625 - DNA, 22 bp, Homo sapiens
tgtcaggacacagctttctgtg

SEQ ID NO: 9427626 - DNA, 22 bp, Homo sapiens
tgtcaggacacagctttctgtg

SEQ ID NO: 9427627 - DNA, 22 bp, Homo sapiens
tgtattcagtgatttcacaata

SEQ ID NO: 9427628 - DNA, 22 bp, Homo sapiens
tgtattcagggacatatatgta

SEQ ID NO: 9427629 - DNA, 22 bp, Homo sapiens
tgtattaacattaataaaatgg

SEQ ID NO: 9427630 - DNA, 22 bp, Homo sapiens
tgtattaacattaataaaatgg

SEQ ID NO: 9427631 - DNA, 22 bp, Homo sapiens
tgtattacaaagaagaggctgg

SEQ ID NO: 9427632 - DNA, 22 bp, Homo sapiens
tggtggctgtaagggagagaag

SEQ ID NO: 9427633 - DNA, 17 bp, Homo sapiens
tggtggctggagtcagg

SEQ ID NO: 9427634 - DNA, 22 bp, Homo sapiens
tggtggctgttgcagaactgag

SEQ ID NO: 9427635 - DNA, 22 bp, Homo sapiens
tggtggcttctgaggatggcga

SEQ ID NO: 9427636 - DNA, 23 bp, Homo sapiens
tggtggcttgtggtggccaccag

SEQ ID NO: 9427637 - DNA, 23 bp, Homo sapiens
tggtggcttgtggtggccaccag

SEQ ID NO: 9427638 - DNA, 22 bp, Homo sapiens
tggtggctcacgtctgtaatct

SEQ ID NO: 9427639 - DNA, 22 bp, Homo sapiens
tggtggctaccaggtcctgggg

SEQ ID NO: 9427640 - DNA, 22 bp, Homo sapiens
tggtggctcacacctgtaatcc

SEQ ID NO: 9427641 - DNA, 22 bp, Homo sapiens
tggtgctgcaggtgggcacagt

SEQ ID NO: 9427642 - DNA, 22 bp, Homo sapiens
tggtgctgcaggtgggcacagt

SEQ ID NO: 9427643 - DNA, 22 bp, Homo sapiens
tggtgctgcaggtgggcacagt

SEQ ID NO: 9427644 - DNA, 22 bp, Homo sapiens
tggtgctgataatggcaggatt

SEQ ID NO: 9427645 - DNA, 22 bp, Homo sapiens
tggtgctgataatggcaggatt

SEQ ID NO: 9427646 - DNA, 22 bp, Homo sapiens
tggtgctgccacctcctctgct

SEQ ID NO: 9427647 - DNA, 22 bp, Homo sapiens
tggtgctgccacctcctctgct

SEQ ID NO: 9427648 - DNA, 22 bp, Homo sapiens
tggtgctgtggaggggcagaag

SEQ ID NO: 9427649 - DNA, 22 bp, Homo sapiens
tggtgctgtggaggggcagaag

SEQ ID NO: 9427650 - DNA, 22 bp, Homo sapiens
tggtgctgtggaggggcagaag

SEQ ID NO: 9427651 - DNA, 22 bp, Homo sapiens
tggtgctgtgatacgaggcact

SEQ ID NO: 9427652 - DNA, 22 bp, Homo sapiens
tggtgctgcctcagatgcctta

SEQ ID NO: 9427653 - DNA, 22 bp, Homo sapiens
cctggagacgaggctggaccat

SEQ ID NO: 9427654 - DNA, 22 bp, Homo sapiens
cctggagacgaggctggaccat

SEQ ID NO: 9427655 - DNA, 22 bp, Homo sapiens
cctggagacgaggctggaccat

SEQ ID NO: 9427656 - DNA, 22 bp, Homo sapiens
cctggagacccacttctgccaa

SEQ ID NO: 9427657 - DNA, 22 bp, Homo sapiens
cctggagacctgatggcagcgg

SEQ ID NO: 9427658 - DNA, 22 bp, Homo sapiens
cctggagacctgatggcagcgg

SEQ ID NO: 9427659 - DNA, 22 bp, Homo sapiens
cctggagagagaggccaactgc

SEQ ID NO: 9427660 - DNA, 22 bp, Homo sapiens
cctggagagctcgggccaggca

SEQ ID NO: 9427661 - DNA, 22 bp, Homo sapiens
tgtaaacagccccatggagagc

SEQ ID NO: 9427662 - DNA, 22 bp, Homo sapiens
tgtaaacatatcagactttctt

SEQ ID NO: 9427663 - DNA, 22 bp, Homo sapiens
tgtaaacagtaggactaaagag

SEQ ID NO: 9427664 - DNA, 22 bp, Homo sapiens
tgtaaacagtaggactaaagag

SEQ ID NO: 9427665 - DNA, 21 bp, Homo sapiens
cctggagacaaagacagggtg

SEQ ID NO: 9427666 - DNA, 22 bp, Homo sapiens
cctggacttgatattctctttc

SEQ ID NO: 9427667 - DNA, 22 bp, Homo sapiens
cctggactttcatttccccttg

SEQ ID NO: 9427668 - DNA, 22 bp, Homo sapiens
cctggactttcaggactactgt

SEQ ID NO: 9427669 - DNA, 22 bp, Homo sapiens
cctggagaccagaggatacttc

SEQ ID NO: 9427670 - DNA, 22 bp, Homo sapiens
cctggagaccagaggatacttc

SEQ ID NO: 9427671 - DNA, 21 bp, Homo sapiens
cctggagacaaagacagggtg

SEQ ID NO: 9427672 - DNA, 21 bp, Homo sapiens
cctggagacaaagacagggtg

SEQ ID NO: 9427673 - DNA, 22 bp, Homo sapiens
cctggactgtgtcctgtggtca

SEQ ID NO: 9427674 - DNA, 21 bp, Homo sapiens
cctggactgggagcagcactg

SEQ ID NO: 9427675 - DNA, 22 bp, Homo sapiens
cctggactcagaggtgctggtg

SEQ ID NO: 9427676 - DNA, 22 bp, Homo sapiens
cctggactcagaggtgctggtg

SEQ ID NO: 9427677 - DNA, 22 bp, Homo sapiens
cctggaaacacatgatgatgaa

SEQ ID NO: 9427678 - DNA, 22 bp, Homo sapiens
cctctgtgcctcgtgtcctctg

SEQ ID NO: 9427679 - DNA, 22 bp, Homo sapiens
cctctgtgcaggaaatacatgt

SEQ ID NO: 9427680 - DNA, 22 bp, Homo sapiens
cctctgtgcctcgtgtcctctg

SEQ ID NO: 9427681 - DNA, 22 bp, Homo sapiens
tggtccagtgacagataggcac

SEQ ID NO: 9427682 - DNA, 18 bp, Homo sapiens
tggtccagttcagatata

SEQ ID NO: 9427683 - DNA, 22 bp, Homo sapiens
tggtccagtcgttcctttcctt

SEQ ID NO: 9427684 - DNA, 22 bp, Homo sapiens
tggtccctaggaaagcagtgtt

SEQ ID NO: 9427685 - DNA, 22 bp, Homo sapiens
tggtccctagcacagctgtcct

SEQ ID NO: 9427686 - DNA, 22 bp, Homo sapiens
tggtccctagcacagctgtcct

SEQ ID NO: 9427687 - DNA, 22 bp, Homo sapiens
tggtccctgaagagagaccttg

SEQ ID NO: 9427688 - DNA, 22 bp, Homo sapiens
tggtccctagtgtgggagcttg

SEQ ID NO: 9427689 - DNA, 23 bp, Homo sapiens
tggtccctcaaggaggccagggc

SEQ ID NO: 9427690 - DNA, 22 bp, Homo sapiens
tggtccctttctactgagcaca

SEQ ID NO: 9427691 - DNA, 22 bp, Homo sapiens
tggtccctttgactgcccgcca

SEQ ID NO: 9427692 - DNA, 22 bp, Homo sapiens
tggtccctttgactgcccgcca

SEQ ID NO: 9427693 - DNA, 21 bp, Homo sapiens
tggtccctttcagagtctgga

SEQ ID NO: 9427694 - DNA, 22 bp, Homo sapiens
tggtccctgatctaatgtctca

SEQ ID NO: 9427695 - DNA, 22 bp, Homo sapiens
tggtccctgcgttaagagcact

SEQ ID NO: 9427696 - DNA, 22 bp, Homo sapiens
tggtccctgcctgccaagtgct

SEQ ID NO: 9427697 - DNA, 22 bp, Homo sapiens
tggtcccattgttctgcccagg

SEQ ID NO: 9427698 - DNA, 19 bp, Homo sapiens
tggtcccatactgctggcc

SEQ ID NO: 9427699 - DNA, 22 bp, Homo sapiens
tggtccatgcccacggaatgtg

SEQ ID NO: 9427700 - DNA, 22 bp, Homo sapiens
tggtccatgtcctccatctctc

SEQ ID NO: 9427701 - DNA, 22 bp, Homo sapiens
tggtccatgttcccagaagaca

SEQ ID NO: 9427702 - DNA, 22 bp, Homo sapiens
cctgcccactccaggagcaact

SEQ ID NO: 9427703 - DNA, 22 bp, Homo sapiens
cctgcccactgcccggtcagcc

SEQ ID NO: 9427704 - DNA, 22 bp, Homo sapiens
cctgcccactccaggagcaact

SEQ ID NO: 9427705 - DNA, 22 bp, Homo sapiens
cctgcccacagagagggtgcat

SEQ ID NO: 9427706 - DNA, 22 bp, Homo sapiens
cctgcccacagagagggtgcat

SEQ ID NO: 9427707 - DNA, 22 bp, Homo sapiens
cctgccatgccagcatgcccgt

SEQ ID NO: 9427708 - DNA, 22 bp, Homo sapiens
cctgccatcagaaacactcaaa

SEQ ID NO: 9427709 - DNA, 22 bp, Homo sapiens
cctgccatggtagacttccagg

SEQ ID NO: 9427710 - DNA, 22 bp, Homo sapiens
cctgcccacacagcaattttaa

SEQ ID NO: 9427711 - DNA, 22 bp, Homo sapiens
cctgcccacagagagggtgcat

SEQ ID NO: 9427712 - DNA, 22 bp, Homo sapiens
cctgccagtgcctcccactggt

SEQ ID NO: 9427713 - DNA, 22 bp, Homo sapiens
cctgccagtgcctcccactggt

SEQ ID NO: 9427714 - DNA, 22 bp, Homo sapiens
cctgccagtgaagctgacgggc

SEQ ID NO: 9427715 - DNA, 22 bp, Homo sapiens
cctgccagtgcctcccactggt

SEQ ID NO: 9427716 - DNA, 22 bp, Homo sapiens
cctgccagtgaagctgacgggc

SEQ ID NO: 9427717 - DNA, 20 bp, Homo sapiens
tggtcctcacaggtcctccc

SEQ ID NO: 9427718 - DNA, 20 bp, Homo sapiens
tggtcctcacaggtcctccc

SEQ ID NO: 9427719 - DNA, 20 bp, Homo sapiens
tggtcctcacaggtcctccc

SEQ ID NO: 9427720 - DNA, 22 bp, Homo sapiens
cctgcccactgcccggtcagcc

SEQ ID NO: 9427721 - DNA, 17 bp, Homo sapiens
cctgcccagagacagat

SEQ ID NO: 9427722 - DNA, 17 bp, Homo sapiens
cctgcccagagacagat

SEQ ID NO: 9427723 - DNA, 17 bp, Homo sapiens
cctgcccagagacagat

SEQ ID NO: 9427724 - DNA, 17 bp, Homo sapiens
cctgcccagagacagat

SEQ ID NO: 9427725 - DNA, 17 bp, Homo sapiens
cctgcccagagacagat

SEQ ID NO: 9427726 - DNA, 22 bp, Homo sapiens
tggtcttgtactatgttgcatt

SEQ ID NO: 9427727 - DNA, 22 bp, Homo sapiens
cctggcaggtagcattgaggag

SEQ ID NO: 9427728 - DNA, 22 bp, Homo sapiens
cctggcaggtggaggttgcagt

SEQ ID NO: 9427729 - DNA, 22 bp, Homo sapiens
cctggcaggtggcgccctcggc

SEQ ID NO: 9427730 - DNA, 22 bp, Homo sapiens
cctggcaggtggcgccctcggc

SEQ ID NO: 9427731 - DNA, 22 bp, Homo sapiens
cctggcaggtggcgccctcggc

SEQ ID NO: 9427732 - DNA, 22 bp, Homo sapiens
cctggcaggtggcgccctcggc

SEQ ID NO: 9427733 - DNA, 22 bp, Homo sapiens
cctggcaggttacaaccagtta

SEQ ID NO: 9427734 - DNA, 22 bp, Homo sapiens
cctggcagtcaggggagtcctt

SEQ ID NO: 9427735 - DNA, 22 bp, Homo sapiens
cctggcaggcccctcctggatt

SEQ ID NO: 9427736 - DNA, 22 bp, Homo sapiens
cctggcaggcaagaggaaggga

SEQ ID NO: 9427737 - DNA, 22 bp, Homo sapiens
cctggcaggcaagaggaaggga

SEQ ID NO: 9427738 - DNA, 22 bp, Homo sapiens
cctggcaggcaagaggaaggga

SEQ ID NO: 9427739 - DNA, 22 bp, Homo sapiens
cctggcaggctggggacagtgc

SEQ ID NO: 9427740 - DNA, 22 bp, Homo sapiens
cctggcaggctggggacagtgc

SEQ ID NO: 9427741 - DNA, 20 bp, Homo sapiens
cctggcaggcgggttactta

SEQ ID NO: 9427742 - DNA, 20 bp, Homo sapiens
cctggcaggcgggttactta

SEQ ID NO: 9427743 - DNA, 22 bp, Homo sapiens
cctggcaggctggggacagtgc

SEQ ID NO: 9427744 - DNA, 22 bp, Homo sapiens
cctggcaggctggggacagtgc

SEQ ID NO: 9427745 - DNA, 22 bp, Homo sapiens
tgtcatgtttcatgtttgtagg

SEQ ID NO: 9427746 - DNA, 22 bp, Homo sapiens
tgtcatgtttcatgtttgtagg

SEQ ID NO: 9427747 - DNA, 22 bp, Homo sapiens
tgtcatgttttcctacaaggta

SEQ ID NO: 9427748 - DNA, 22 bp, Homo sapiens
tgtcattatttgcctactgact

SEQ ID NO: 9427749 - DNA, 22 bp, Homo sapiens
tgtcattatgaggattacaata

SEQ ID NO: 9427750 - DNA, 22 bp, Homo sapiens
tgtcattagtttcagccattct

SEQ ID NO: 9427751 - DNA, 22 bp, Homo sapiens
tgtcattagtttcagccattct

SEQ ID NO: 9427752 - DNA, 22 bp, Homo sapiens
cctggcagactgtgagggcagg

SEQ ID NO: 9427753 - DNA, 22 bp, Homo sapiens
cctggcagactgtgagggcagg

SEQ ID NO: 9427754 - DNA, 22 bp, Homo sapiens
cctggcagactgtgagggcagg

SEQ ID NO: 9427755 - DNA, 22 bp, Homo sapiens
cctggcagactgtgagggcagg

SEQ ID NO: 9427756 - DNA, 23 bp, Homo sapiens
cctggcagcaaacgaggaggtta

SEQ ID NO: 9427757 - DNA, 22 bp, Homo sapiens
cctggcagactgtgagggcagg

SEQ ID NO: 9427758 - DNA, 22 bp, Homo sapiens
cctggcagactgtgagggcagg

SEQ ID NO: 9427759 - DNA, 23 bp, Homo sapiens
cctggcagcaaacgaggaggtta

SEQ ID NO: 9427760 - DNA, 23 bp, Homo sapiens
cctggcagcaaacgaggaggtta

SEQ ID NO: 9427761 - DNA, 23 bp, Homo sapiens
cctggcagcaaacgaggaggtta

SEQ ID NO: 9427762 - DNA, 23 bp, Homo sapiens
cctggcagcaaacgaggaggtta

SEQ ID NO: 9427763 - DNA, 23 bp, Homo sapiens
cctggcagcaaacgaggaggtta

SEQ ID NO: 9427764 - DNA, 22 bp, Homo sapiens
cctggcagcagcacatgccttc

SEQ ID NO: 9427765 - DNA, 22 bp, Homo sapiens
cctggcagcagcacatgccttc

SEQ ID NO: 9427766 - DNA, 22 bp, Homo sapiens
cctggcagcattggtagagatt

SEQ ID NO: 9427767 - DNA, 22 bp, Homo sapiens
cctggcagcaggtgggcccgtg

SEQ ID NO: 9427768 - DNA, 22 bp, Homo sapiens
cctggcagcattggtagagatt

SEQ ID NO: 9427769 - DNA, 22 bp, Homo sapiens
cctggcagcattggtagagatt

SEQ ID NO: 9427770 - DNA, 18 bp, Homo sapiens
cctggcagccatgcgcgc

SEQ ID NO: 9427771 - DNA, 18 bp, Homo sapiens
cctggcagccatgcgcgc

SEQ ID NO: 9427772 - DNA, 23 bp, Homo sapiens
tgtcccagagggagggataggct

SEQ ID NO: 9427773 - DNA, 22 bp, Homo sapiens
tgtcccactgacttcacatcca

SEQ ID NO: 9427774 - DNA, 22 bp, Homo sapiens
tgtcccagacacagtatgcgct

SEQ ID NO: 9427775 - DNA, 22 bp, Homo sapiens
tgtcccagatcacaggagggga

SEQ ID NO: 9427776 - DNA, 22 bp, Homo sapiens
tgtcccagcactttgggagtct

SEQ ID NO: 9427777 - DNA, 22 bp, Homo sapiens
tgtcctcgctgagcatcttata

SEQ ID NO: 9427778 - DNA, 22 bp, Homo sapiens
tgtcctccaggacctgcagggc

SEQ ID NO: 9427779 - DNA, 22 bp, Homo sapiens
tgtccatggatagagctgctcg

SEQ ID NO: 9427780 - DNA, 22 bp, Homo sapiens
tgtcccaaccctgagaagattc

SEQ ID NO: 9427781 - DNA, 17 bp, Homo sapiens
tgtccatttgcctggag

SEQ ID NO: 9427782 - DNA, 22 bp, Homo sapiens
tgtccatggagaagctcagggc

SEQ ID NO: 9427783 - DNA, 22 bp, Homo sapiens
tgtccagtgattctcatgagcc

SEQ ID NO: 9427784 - DNA, 22 bp, Homo sapiens
tgtccataaattcacaagtgta

SEQ ID NO: 9427785 - DNA, 22 bp, Homo sapiens
tgtccaggttagcttcaaacac

SEQ ID NO: 9427786 - DNA, 22 bp, Homo sapiens
cctggccatttgaacttcagac

SEQ ID NO: 9427787 - DNA, 22 bp, Homo sapiens
cctggccatagggcccaggaaa

SEQ ID NO: 9427788 - DNA, 22 bp, Homo sapiens
cctggcagttttgcccaggatt

SEQ ID NO: 9427789 - DNA, 22 bp, Homo sapiens
cctggcagttcatcaaatggca

SEQ ID NO: 9427790 - DNA, 22 bp, Homo sapiens
cctggcagttcatcaaatggca

SEQ ID NO: 9427791 - DNA, 22 bp, Homo sapiens
cctggcagtggtgaagaagagg

SEQ ID NO: 9427792 - DNA, 22 bp, Homo sapiens
cctggcagtggtgaagaagagg

SEQ ID NO: 9427793 - DNA, 22 bp, Homo sapiens
cctggccagcgccggctgctcg

SEQ ID NO: 9427794 - DNA, 22 bp, Homo sapiens
cctggccagcgccggctgctcg

SEQ ID NO: 9427795 - DNA, 22 bp, Homo sapiens
cctggccagcgccggctgctcg

SEQ ID NO: 9427796 - DNA, 22 bp, Homo sapiens
cctggccagccagggctggggt

SEQ ID NO: 9427797 - DNA, 22 bp, Homo sapiens
cctggccagccagggctggggt

SEQ ID NO: 9427798 - DNA, 22 bp, Homo sapiens
cctggccagccagggctggggt

SEQ ID NO: 9427799 - DNA, 22 bp, Homo sapiens
cctggcatgtcctcctggcatg

SEQ ID NO: 9427800 - DNA, 22 bp, Homo sapiens
cctggcatgtcctcctggcatg

SEQ ID NO: 9427801 - DNA, 22 bp, Homo sapiens
cctggcatggggtctccagcca

SEQ ID NO: 9427802 - DNA, 22 bp, Homo sapiens
cctggccagtttccaggccctg

SEQ ID NO: 9427803 - DNA, 22 bp, Homo sapiens
cctggccagggtctgggctgct

SEQ ID NO: 9427804 - DNA, 22 bp, Homo sapiens
cctggccagggtctgggctgct

SEQ ID NO: 9427805 - DNA, 22 bp, Homo sapiens
cctggccagggtctgggctgct

SEQ ID NO: 9427806 - DNA, 22 bp, Homo sapiens
cctggccagtttccaggccctg

SEQ ID NO: 9427807 - DNA, 22 bp, Homo sapiens
cctggccagtttccaggccctg

SEQ ID NO: 9427808 - DNA, 22 bp, Homo sapiens
cctggccaggctccaagtactg

SEQ ID NO: 9427809 - DNA, 22 bp, Homo sapiens
cctggccaggctctcagcactg

SEQ ID NO: 9427810 - DNA, 22 bp, Homo sapiens
cctggccaggctctcagcactg

SEQ ID NO: 9427811 - DNA, 22 bp, Homo sapiens
cctggccaggctctcagcactg

SEQ ID NO: 9427812 - DNA, 22 bp, Homo sapiens
cctggccaggctctcagcactg

SEQ ID NO: 9427813 - DNA, 22 bp, Homo sapiens
cctggccaggcatggagtcaca

SEQ ID NO: 9427814 - DNA, 22 bp, Homo sapiens
cctggccaggcatggagtcaca

SEQ ID NO: 9427815 - DNA, 22 bp, Homo sapiens
cctggccagctaattgcccatc

SEQ ID NO: 9427816 - DNA, 22 bp, Homo sapiens
cctggccagctaattgcccatc

SEQ ID NO: 9427817 - DNA, 22 bp, Homo sapiens
cctggctcccggaacagggtct

SEQ ID NO: 9427818 - DNA, 22 bp, Homo sapiens
cctggctccctgcacagggctc

SEQ ID NO: 9427819 - DNA, 22 bp, Homo sapiens
cctggctccctggacctcatta

SEQ ID NO: 9427820 - DNA, 22 bp, Homo sapiens
cctggctccctggacctcatta

SEQ ID NO: 9427821 - DNA, 22 bp, Homo sapiens
cctggctccggttcaagggaaa

SEQ ID NO: 9427822 - DNA, 22 bp, Homo sapiens
cctggctcctgcctctgcaggg

SEQ ID NO: 9427823 - DNA, 22 bp, Homo sapiens
cctggctcctgcctctgcaggg

SEQ ID NO: 9427824 - DNA, 22 bp, Homo sapiens
cctggctcctgcctctgcaggg

SEQ ID NO: 9427825 - DNA, 22 bp, Homo sapiens
cctggctcctgcctctgcaggg

SEQ ID NO: 9427826 - DNA, 22 bp, Homo sapiens
cctggctcctgcctctgcaggg

SEQ ID NO: 9427827 - DNA, 22 bp, Homo sapiens
cctggctcctgcctctgcaggg

SEQ ID NO: 9427828 - DNA, 22 bp, Homo sapiens
cctggctcctgcacagatcttt

SEQ ID NO: 9427829 - DNA, 22 bp, Homo sapiens
cctggctcctgcacagatcttt

SEQ ID NO: 9427830 - DNA, 22 bp, Homo sapiens
cctggctcctgcacagatcttt

SEQ ID NO: 9427831 - DNA, 22 bp, Homo sapiens
cctggctccgtgtcacgtgccc

SEQ ID NO: 9427832 - DNA, 22 bp, Homo sapiens
cctggctccgtgtcacgtgccc

SEQ ID NO: 9427833 - DNA, 22 bp, Homo sapiens
cctggctctctgcagatcctgg

SEQ ID NO: 9427834 - DNA, 22 bp, Homo sapiens
cctggctctctgcagatcctgg

SEQ ID NO: 9427835 - DNA, 22 bp, Homo sapiens
cctggctctgaagtccacatca

SEQ ID NO: 9427836 - DNA, 22 bp, Homo sapiens
cctggctctgaagtccacatca

SEQ ID NO: 9427837 - DNA, 22 bp, Homo sapiens
cctggctctgaagtccacatca

SEQ ID NO: 9427838 - DNA, 22 bp, Homo sapiens
cctggctctgaagtccacatca

SEQ ID NO: 9427839 - DNA, 22 bp, Homo sapiens
cctggctctgaagtccacatca

SEQ ID NO: 9427840 - DNA, 22 bp, Homo sapiens
cctggctctctgcagatcctgg

SEQ ID NO: 9427841 - DNA, 22 bp, Homo sapiens
cctggctctagaggccactcct

SEQ ID NO: 9427842 - DNA, 22 bp, Homo sapiens
cctggctctagaggccactcct

SEQ ID NO: 9427843 - DNA, 22 bp, Homo sapiens
cctggctctagaggccactcct

SEQ ID NO: 9427844 - DNA, 22 bp, Homo sapiens
cctggctcgctgacctcagggg

SEQ ID NO: 9427845 - DNA, 22 bp, Homo sapiens
cctggctcgctgacctcagggg

SEQ ID NO: 9427846 - DNA, 22 bp, Homo sapiens
cctggctcgctgacctcagggg

SEQ ID NO: 9427847 - DNA, 22 bp, Homo sapiens
cctggctcctgcctctgcaggg

SEQ ID NO: 9427848 - DNA, 22 bp, Homo sapiens
cctggctcctgcctctgcaggg

SEQ ID NO: 9427849 - DNA, 22 bp, Homo sapiens
cctggctcgctgacctcagggg

SEQ ID NO: 9427850 - DNA, 22 bp, Homo sapiens
cctggctcgctgacctcagggg

SEQ ID NO: 9427851 - DNA, 22 bp, Homo sapiens
cctggctcgctgacctcagggg

SEQ ID NO: 9427852 - DNA, 22 bp, Homo sapiens
cctggctctagaggccactcct

SEQ ID NO: 9427853 - DNA, 22 bp, Homo sapiens
cctggctcgctgacctcagggg

SEQ ID NO: 9427854 - DNA, 22 bp, Homo sapiens
cctggctctagaggccactcct

SEQ ID NO: 9427855 - DNA, 22 bp, Homo sapiens
cctggctctagaggccactcct

SEQ ID NO: 9427856 - DNA, 22 bp, Homo sapiens
cctggccctggaatagggcagg

SEQ ID NO: 9427857 - DNA, 19 bp, Homo sapiens
cctggccctgctgcgcggg

SEQ ID NO: 9427858 - DNA, 19 bp, Homo sapiens
cctggccctgctgcgcggg

SEQ ID NO: 9427859 - DNA, 22 bp, Homo sapiens
cctggccgacatggtgaaacgc

SEQ ID NO: 9427860 - DNA, 22 bp, Homo sapiens
cctggccggtatcccacctcct

SEQ ID NO: 9427861 - DNA, 22 bp, Homo sapiens
cctggccggtatcccacctcct

SEQ ID NO: 9427862 - DNA, 22 bp, Homo sapiens
cctggccgcggagcccttccag

SEQ ID NO: 9427863 - DNA, 22 bp, Homo sapiens
cctggccgcggagcccttccag

SEQ ID NO: 9427864 - DNA, 22 bp, Homo sapiens
cctggcctcagcctagggctga

SEQ ID NO: 9427865 - DNA, 22 bp, Homo sapiens
cctggcctcagcctagggctga

SEQ ID NO: 9427866 - DNA, 22 bp, Homo sapiens
cctggctcccccatcatagctg

SEQ ID NO: 9427867 - DNA, 22 bp, Homo sapiens
cctggctcccccatcatagctg

SEQ ID NO: 9427868 - DNA, 22 bp, Homo sapiens
cctggctcccccatcatagctg

SEQ ID NO: 9427869 - DNA, 21 bp, Homo sapiens
cctggctccagaacttccggt

SEQ ID NO: 9427870 - DNA, 21 bp, Homo sapiens
cctggctccagaacttccggt

SEQ ID NO: 9427871 - DNA, 22 bp, Homo sapiens
cctggctccagctgcctgtcct

SEQ ID NO: 9427872 - DNA, 22 bp, Homo sapiens
cctggctccagctgcctgtcct

SEQ ID NO: 9427873 - DNA, 22 bp, Homo sapiens
cctggctccagctgcctgtcct

SEQ ID NO: 9427874 - DNA, 22 bp, Homo sapiens
cctggcctggcactccctctgc

SEQ ID NO: 9427875 - DNA, 22 bp, Homo sapiens
cctggcctgctcggctcttaag

SEQ ID NO: 9427876 - DNA, 22 bp, Homo sapiens
cctggcctctccgagtaacctg

SEQ ID NO: 9427877 - DNA, 22 bp, Homo sapiens
cctggcctgtgaatctgagagc

SEQ ID NO: 9427878 - DNA, 22 bp, Homo sapiens
cctggcctgtgaatctgagagc

SEQ ID NO: 9427879 - DNA, 22 bp, Homo sapiens
cctggctccaaagctgtgactc

SEQ ID NO: 9427880 - DNA, 22 bp, Homo sapiens
cctggcctgtgaatctgagagc

SEQ ID NO: 9427881 - DNA, 22 bp, Homo sapiens
cctggcctgtgaatctgagagc

SEQ ID NO: 9427882 - DNA, 22 bp, Homo sapiens
cctggcctgtgaatctgagagc

SEQ ID NO: 9427883 - DNA, 22 bp, Homo sapiens
tgtcctggagtgcttgggggaa

SEQ ID NO: 9427884 - DNA, 22 bp, Homo sapiens
tgtcctggagacacaaggtggt

SEQ ID NO: 9427885 - DNA, 22 bp, Homo sapiens
tgtcctggagttataatgcctg

SEQ ID NO: 9427886 - DNA, 22 bp, Homo sapiens
tgtcctggatcatgcctctgaa

SEQ ID NO: 9427887 - DNA, 22 bp, Homo sapiens
tgtcctggaaaaatggagagtt

SEQ ID NO: 9427888 - DNA, 22 bp, Homo sapiens
tgtcctggaaaaatggagagtt

SEQ ID NO: 9427889 - DNA, 22 bp, Homo sapiens
tgtcctggacaacagcccctag

SEQ ID NO: 9427890 - DNA, 22 bp, Homo sapiens
tgtcctggagacacaaggtggt

SEQ ID NO: 9427891 - DNA, 22 bp, Homo sapiens
tgtcctggatcatgcctctgaa

SEQ ID NO: 9427892 - DNA, 22 bp, Homo sapiens
tgtctattaattccacataaaa

SEQ ID NO: 9427893 - DNA, 22 bp, Homo sapiens
tgtctattaattccacataaaa

SEQ ID NO: 9427894 - DNA, 22 bp, Homo sapiens
tgtctattaacacaagaaagga

SEQ ID NO: 9427895 - DNA, 22 bp, Homo sapiens
tgtctatttgaattatcctaat

SEQ ID NO: 9427896 - DNA, 22 bp, Homo sapiens
tgtctattttacagcatacatt

SEQ ID NO: 9427897 - DNA, 22 bp, Homo sapiens
tgtctattcccccacctccgtt

SEQ ID NO: 9427898 - DNA, 22 bp, Homo sapiens
tgtctcagatacgccatcaagg

SEQ ID NO: 9427899 - DNA, 18 bp, Homo sapiens
tgtctcaggctgaaacag

SEQ ID NO: 9427900 - DNA, 22 bp, Homo sapiens
tgtctcagggcagcagcagggg

SEQ ID NO: 9427901 - DNA, 22 bp, Homo sapiens
tgtctcagggcagcagcagggg

SEQ ID NO: 9427902 - DNA, 22 bp, Homo sapiens
tgtctcagaatggctcataata

SEQ ID NO: 9427903 - DNA, 22 bp, Homo sapiens
tgtctcagagtgttgtattaga

SEQ ID NO: 9427904 - DNA, 19 bp, Homo sapiens
tgtctcagtgtcccttcct

SEQ ID NO: 9427905 - DNA, 22 bp, Homo sapiens
tgtctcatctcttaaccccact

SEQ ID NO: 9427906 - DNA, 22 bp, Homo sapiens
tgtctcatctcttaaccccact

SEQ ID NO: 9427907 - DNA, 22 bp, Homo sapiens
tgtctctgggtgattcagtcct

SEQ ID NO: 9427908 - DNA, 22 bp, Homo sapiens
tgtctctggctgcagcctgttc

SEQ ID NO: 9427909 - DNA, 22 bp, Homo sapiens
tgtctctggcccatgagcagag

SEQ ID NO: 9427910 - DNA, 22 bp, Homo sapiens
tgtctctggcccatgagcagag

SEQ ID NO: 9427911 - DNA, 22 bp, Homo sapiens
tgtctctggctgcagcctgttc

SEQ ID NO: 9427912 - DNA, 22 bp, Homo sapiens
tgtctctgtctcccaggttgtg

SEQ ID NO: 9427913 - DNA, 22 bp, Homo sapiens
tgtctctgtctcccaggttgtg

SEQ ID NO: 9427914 - DNA, 22 bp, Homo sapiens
tgtctctgtgactccttccgcc

SEQ ID NO: 9427915 - DNA, 22 bp, Homo sapiens
tgtctctgtgactccttccgcc

SEQ ID NO: 9427916 - DNA, 22 bp, Homo sapiens
tgtctctgtgagatctgacgat

SEQ ID NO: 9427917 - DNA, 22 bp, Homo sapiens
tgtctctgtgcatttgtgcttc

SEQ ID NO: 9427918 - DNA, 22 bp, Homo sapiens
tgtctctgtgcatttgtgcttc

SEQ ID NO: 9427919 - DNA, 22 bp, Homo sapiens
tgtctcttactttgattcttgg

SEQ ID NO: 9427920 - DNA, 22 bp, Homo sapiens
tgtctcttcccactcagacccc

SEQ ID NO: 9427921 - DNA, 22 bp, Homo sapiens
tgtctcttggctctatcactta

SEQ ID NO: 9427922 - DNA, 22 bp, Homo sapiens
tgtctcttgagctgcctgatgc

SEQ ID NO: 9427923 - DNA, 22 bp, Homo sapiens
tgtctcttctgcctccagctgt

SEQ ID NO: 9427924 - DNA, 22 bp, Homo sapiens
gcagggtgacgttgcccacctc

SEQ ID NO: 9427925 - DNA, 22 bp, Homo sapiens
gcagggtgacgttgcccacctc

SEQ ID NO: 9427926 - DNA, 22 bp, Homo sapiens
gcagggtgacgttgcccacctc

SEQ ID NO: 9427927 - DNA, 22 bp, Homo sapiens
gcagggtgatagtgaggctcag

SEQ ID NO: 9427928 - DNA, 22 bp, Homo sapiens
gcagggtgatagtgaggctcag

SEQ ID NO: 9427929 - DNA, 22 bp, Homo sapiens
gcagggtggatggcagggccag

SEQ ID NO: 9427930 - DNA, 22 bp, Homo sapiens
gcaggtggaagcagcagactca

SEQ ID NO: 9427931 - DNA, 19 bp, Homo sapiens
gcagggtggcagagctctt

SEQ ID NO: 9427932 - DNA, 22 bp, Homo sapiens
gcaggtggagcagtagtctggt

SEQ ID NO: 9427933 - DNA, 22 bp, Homo sapiens
gcaggtggagcagtagtctggt

SEQ ID NO: 9427934 - DNA, 19 bp, Homo sapiens
gcaggtggatgtggtcagc

SEQ ID NO: 9427935 - DNA, 22 bp, Homo sapiens
gcaggtggattatcagaagtgc

SEQ ID NO: 9427936 - DNA, 19 bp, Homo sapiens
gcaggtggatgtggtcagc

SEQ ID NO: 9427937 - DNA, 22 bp, Homo sapiens
gcaggtgggagccgctgcctga

SEQ ID NO: 9427938 - DNA, 22 bp, Homo sapiens
gcaggtggcagaggtgggatct

SEQ ID NO: 9427939 - DNA, 22 bp, Homo sapiens
gcaggtggattatcagaagtgc

SEQ ID NO: 9427940 - DNA, 22 bp, Homo sapiens
gcaggtggattatcagaagtgc

SEQ ID NO: 9427941 - DNA, 22 bp, Homo sapiens
gcaggtggcagaggtgggatct

SEQ ID NO: 9427942 - DNA, 22 bp, Homo sapiens
gcaggtggcagaggtgggatct

SEQ ID NO: 9427943 - DNA, 22 bp, Homo sapiens
gcaggtggtgggggagccgttc

SEQ ID NO: 9427944 - DNA, 22 bp, Homo sapiens
gcaggtggtgggggagccgttc

SEQ ID NO: 9427945 - DNA, 22 bp, Homo sapiens
gcaggtggtgggggagccgttc

SEQ ID NO: 9427946 - DNA, 22 bp, Homo sapiens
gcaggtggttaaggtcccatgt

SEQ ID NO: 9427947 - DNA, 23 bp, Homo sapiens
gcaggtggttcgaacagaagttt

SEQ ID NO: 9427948 - DNA, 22 bp, Homo sapiens
gcaggtggtccccgtggagtgg

SEQ ID NO: 9427949 - DNA, 22 bp, Homo sapiens
gcaggtggtccccgtggagtgg

SEQ ID NO: 9427950 - DNA, 22 bp, Homo sapiens
gcaggtggtccccgtggagtgg

SEQ ID NO: 9427951 - DNA, 22 bp, Homo sapiens
gcaggtgggagccgctgcctga

SEQ ID NO: 9427952 - DNA, 22 bp, Homo sapiens
gcaggtggggctgctaccagaa

SEQ ID NO: 9427953 - DNA, 22 bp, Homo sapiens
gcaggtggggctgctaccagaa

SEQ ID NO: 9427954 - DNA, 22 bp, Homo sapiens
gcaggtgggggtcggtgcatct

SEQ ID NO: 9427955 - DNA, 22 bp, Homo sapiens
gcaggtgggggtcggtgcatct

SEQ ID NO: 9427956 - DNA, 22 bp, Homo sapiens
gcaggtgggggtcggtgcatct

SEQ ID NO: 9427957 - DNA, 22 bp, Homo sapiens
gcaggtgggggtcggtgcatct

SEQ ID NO: 9427958 - DNA, 22 bp, Homo sapiens
gcagtggggcaatcatagctca

SEQ ID NO: 9427959 - DNA, 22 bp, Homo sapiens
gcagtggggcgctgggagttgg

SEQ ID NO: 9427960 - DNA, 22 bp, Homo sapiens
gcagtggggcgctgggagttgg

SEQ ID NO: 9427961 - DNA, 22 bp, Homo sapiens
gcagtgggcctgaggaagggtg

SEQ ID NO: 9427962 - DNA, 22 bp, Homo sapiens
gcagtggggaatgctggggaga

SEQ ID NO: 9427963 - DNA, 22 bp, Homo sapiens
gcagtgggcctgaggaagggtg

SEQ ID NO: 9427964 - DNA, 22 bp, Homo sapiens
gcagtgggcaacaagagctgga

SEQ ID NO: 9427965 - DNA, 22 bp, Homo sapiens
gcagtgggcaacaagagctgga

SEQ ID NO: 9427966 - DNA, 22 bp, Homo sapiens
gcagtgtagactttagttgatg

SEQ ID NO: 9427967 - DNA, 22 bp, Homo sapiens
gcagtgtcagtgcctgggtggt

SEQ ID NO: 9427968 - DNA, 19 bp, Homo sapiens
gcagtgtcatggtaggagc

SEQ ID NO: 9427969 - DNA, 22 bp, Homo sapiens
gcagtgtccagggtggtctgca

SEQ ID NO: 9427970 - DNA, 21 bp, Homo sapiens
gcagtgtcatggtttcaagtt

SEQ ID NO: 9427971 - DNA, 23 bp, Homo sapiens
gcagtgtgaatccagtgtttcag

SEQ ID NO: 9427972 - DNA, 22 bp, Homo sapiens
gcagtgtctttgacctccaccc

SEQ ID NO: 9427973 - DNA, 22 bp, Homo sapiens
gcagtgttatgttttctataat

SEQ ID NO: 9427974 - DNA, 22 bp, Homo sapiens
gcagtgttaggaataaaaatga

SEQ ID NO: 9427975 - DNA, 22 bp, Homo sapiens
gcagtacacacatatgtattcg

SEQ ID NO: 9427976 - DNA, 22 bp, Homo sapiens
gcagtagagaagccaggctgta

SEQ ID NO: 9427977 - DNA, 23 bp, Homo sapiens
gcaggtggttcgaacagaagttt

SEQ ID NO: 9427978 - DNA, 23 bp, Homo sapiens
gcaggtggttcgaacagaagttt

SEQ ID NO: 9427979 - DNA, 22 bp, Homo sapiens
gcaggtgtgaatgtgaattaag

SEQ ID NO: 9427980 - DNA, 22 bp, Homo sapiens
gcagtagtttcaaaacaagaaa

SEQ ID NO: 9427981 - DNA, 22 bp, Homo sapiens
gcagtagtttatggctaaacct

SEQ ID NO: 9427982 - DNA, 22 bp, Homo sapiens
gcagtgggagcttaggcagtgc

SEQ ID NO: 9427983 - DNA, 22 bp, Homo sapiens
gcagtgggagcttaggcagtgc

SEQ ID NO: 9427984 - DNA, 22 bp, Homo sapiens
gcagtgggcaacaagagctgga

SEQ ID NO: 9427985 - DNA, 22 bp, Homo sapiens
gcagtgggcaacaagagctgga

SEQ ID NO: 9427986 - DNA, 22 bp, Homo sapiens
gcagtgggcaacaagagctgga

SEQ ID NO: 9427987 - DNA, 22 bp, Homo sapiens
gcagtaggagtttccagggtgg

SEQ ID NO: 9427988 - DNA, 22 bp, Homo sapiens
gcagtagcagtatccagaagca

SEQ ID NO: 9427989 - DNA, 22 bp, Homo sapiens
gcagtaggagggacaactacct

SEQ ID NO: 9427990 - DNA, 18 bp, Homo sapiens
gcagtaggcgcgcaggac

SEQ ID NO: 9427991 - DNA, 22 bp, Homo sapiens
gcagtaggggctggagggctgt

SEQ ID NO: 9427992 - DNA, 22 bp, Homo sapiens
gccaataaatggaaaagatgga

SEQ ID NO: 9427993 - DNA, 22 bp, Homo sapiens
gccaatagcaatttctaggccc

SEQ ID NO: 9427994 - DNA, 22 bp, Homo sapiens
gccaataggaagagaaagatgg

SEQ ID NO: 9427995 - DNA, 22 bp, Homo sapiens
gccaatgacagtctcagttctg

SEQ ID NO: 9427996 - DNA, 22 bp, Homo sapiens
gccaatttatagccaaaaatca

SEQ ID NO: 9427997 - DNA, 23 bp, Homo sapiens
gccaatttagtaaaggcagtggg

SEQ ID NO: 9427998 - DNA, 22 bp, Homo sapiens
gcatgtttcttaagattgcatt

SEQ ID NO: 9427999 - DNA, 22 bp, Homo sapiens
gcatgttttgcaacaagtgacc

SEQ ID NO: 9428000 - DNA, 22 bp, Homo sapiens
gcatgttttgcaacaagtgacc

SEQ ID NO: 9428001 - DNA, 22 bp, Homo sapiens
gcatgtgttatttctctgtggg

SEQ ID NO: 9428002 - DNA, 22 bp, Homo sapiens
gcatgtgttagagtgtgcatgc

SEQ ID NO: 9428003 - DNA, 22 bp, Homo sapiens
gcatgtgttattttatgtatga

SEQ ID NO: 9428004 - DNA, 22 bp, Homo sapiens
gccacagcaacaataatgcagc

SEQ ID NO: 9428005 - DNA, 22 bp, Homo sapiens
gccacagacagagagtctagtg

SEQ ID NO: 9428006 - DNA, 22 bp, Homo sapiens
gccacagacagagagtctagtg

SEQ ID NO: 9428007 - DNA, 22 bp, Homo sapiens
gccacagacagagagtctagtg

SEQ ID NO: 9428008 - DNA, 22 bp, Homo sapiens
gccacagacagagagtctagtg

SEQ ID NO: 9428009 - DNA, 22 bp, Homo sapiens
gccacacttattctcatgcaca

SEQ ID NO: 9428010 - DNA, 22 bp, Homo sapiens
gccacactgcttctttgagcct

SEQ ID NO: 9428011 - DNA, 23 bp, Homo sapiens
gccaatttttgactgtcagtagg

SEQ ID NO: 9428012 - DNA, 22 bp, Homo sapiens
gccaatttatcttactcgtgct

SEQ ID NO: 9428013 - DNA, 22 bp, Homo sapiens
gccaatttcctgaggtaaagct

SEQ ID NO: 9428014 - DNA, 22 bp, Homo sapiens
gccacagccgaacccttgggcc

SEQ ID NO: 9428015 - DNA, 22 bp, Homo sapiens
gccacagccgaacccttgggcc

SEQ ID NO: 9428016 - DNA, 22 bp, Homo sapiens
gccacagcctctgggaaaactc

SEQ ID NO: 9428017 - DNA, 22 bp, Homo sapiens
gccacagcctctgggaaaactc

SEQ ID NO: 9428018 - DNA, 22 bp, Homo sapiens
gccacagcccgagcaccatgag

SEQ ID NO: 9428019 - DNA, 22 bp, Homo sapiens
gccacagcccgagcaccatgag

SEQ ID NO: 9428020 - DNA, 22 bp, Homo sapiens
gccacagcagggccctctcagg

SEQ ID NO: 9428021 - DNA, 22 bp, Homo sapiens
gccacagcagggccctctcagg

SEQ ID NO: 9428022 - DNA, 22 bp, Homo sapiens
gcatggtggagtctgagcaggg

SEQ ID NO: 9428023 - DNA, 22 bp, Homo sapiens
gcatggtggccttagggtagcc

SEQ ID NO: 9428024 - DNA, 22 bp, Homo sapiens
gcatggtgacatcatgtgaatg

SEQ ID NO: 9428025 - DNA, 22 bp, Homo sapiens
gcatggtggagtctgagcaggg

SEQ ID NO: 9428026 - DNA, 22 bp, Homo sapiens
gcatgtctgtaattacagagcc

SEQ ID NO: 9428027 - DNA, 20 bp, Homo sapiens
gcatgtcagaaatcaatggg

SEQ ID NO: 9428028 - DNA, 22 bp, Homo sapiens
gcatgggaggacagtctgggct

SEQ ID NO: 9428029 - DNA, 22 bp, Homo sapiens
gcatgggcaagaggactggggg

SEQ ID NO: 9428030 - DNA, 22 bp, Homo sapiens
gcatgggaggacagtctgggct

SEQ ID NO: 9428031 - DNA, 22 bp, Homo sapiens
gcatgtgtccctcagtctgtgc

SEQ ID NO: 9428032 - DNA, 22 bp, Homo sapiens
gcatgtggtgctgaggctgtcg

SEQ ID NO: 9428033 - DNA, 22 bp, Homo sapiens
gcatgtggtgggctggccactc

SEQ ID NO: 9428034 - DNA, 22 bp, Homo sapiens
gcatgtggcccaaggaggctgt

SEQ ID NO: 9428035 - DNA, 22 bp, Homo sapiens
gcatgtggatggagctaaataa

SEQ ID NO: 9428036 - DNA, 22 bp, Homo sapiens
gcatgtggcccaaggaggctgt

SEQ ID NO: 9428037 - DNA, 22 bp, Homo sapiens
gcatgtggccttcaggctggaa

SEQ ID NO: 9428038 - DNA, 22 bp, Homo sapiens
gccagcaccagctactagtcac

SEQ ID NO: 9428039 - DNA, 19 bp, Homo sapiens
gccagcacatgtcttctag

SEQ ID NO: 9428040 - DNA, 22 bp, Homo sapiens
gccagcaccttagcatgaatca

SEQ ID NO: 9428041 - DNA, 20 bp, Homo sapiens
gccagcacagggagcagttc

SEQ ID NO: 9428042 - DNA, 19 bp, Homo sapiens
gccagcagaatgatgaggc

SEQ ID NO: 9428043 - DNA, 19 bp, Homo sapiens
gccagcagaatgatgaggc

SEQ ID NO: 9428044 - DNA, 19 bp, Homo sapiens
gccagcagaatgatgaggc

SEQ ID NO: 9428045 - DNA, 22 bp, Homo sapiens
gccagcagccacagaagtcact

SEQ ID NO: 9428046 - DNA, 19 bp, Homo sapiens
gccagcagaatgatgaggc

SEQ ID NO: 9428047 - DNA, 22 bp, Homo sapiens
gccagcagccacagaagtcact

SEQ ID NO: 9428048 - DNA, 22 bp, Homo sapiens
gccagcagcgagagtttaacct

SEQ ID NO: 9428049 - DNA, 22 bp, Homo sapiens
gccagcagctcttgggcgggca

SEQ ID NO: 9428050 - DNA, 22 bp, Homo sapiens
gccagcagctcttgggcgggca

SEQ ID NO: 9428051 - DNA, 22 bp, Homo sapiens
gccagcagctcttgggcgggca

SEQ ID NO: 9428052 - DNA, 22 bp, Homo sapiens
gccagcagctgtggggtggcca

SEQ ID NO: 9428053 - DNA, 22 bp, Homo sapiens
gccagcagctgtggggtggcca

SEQ ID NO: 9428054 - DNA, 22 bp, Homo sapiens
gccagcagctgtggggtggcca

SEQ ID NO: 9428055 - DNA, 22 bp, Homo sapiens
gccagcagctgtggggtggcca

SEQ ID NO: 9428056 - DNA, 22 bp, Homo sapiens
gccagcagggaagccttgggct

SEQ ID NO: 9428057 - DNA, 22 bp, Homo sapiens
gccagcagggaagccttgggct

SEQ ID NO: 9428058 - DNA, 22 bp, Homo sapiens
gccacagcggggccgctagagc

SEQ ID NO: 9428059 - DNA, 22 bp, Homo sapiens
gccacagcggggccgctagagc

SEQ ID NO: 9428060 - DNA, 22 bp, Homo sapiens
gccacagctcacgttccccatt

SEQ ID NO: 9428061 - DNA, 22 bp, Homo sapiens
gccacagctccagtcaggtgac

SEQ ID NO: 9428062 - DNA, 22 bp, Homo sapiens
gccacaggaaagcaccctggag

SEQ ID NO: 9428063 - DNA, 22 bp, Homo sapiens
gccacaggaaagcaccctggag

SEQ ID NO: 9428064 - DNA, 19 bp, Homo sapiens
gccacaggatgaagtttgg

SEQ ID NO: 9428065 - DNA, 22 bp, Homo sapiens
gccacaggcacttaagggctgg

SEQ ID NO: 9428066 - DNA, 22 bp, Homo sapiens
gccacaggaaagcaccctggag

SEQ ID NO: 9428067 - DNA, 22 bp, Homo sapiens
gccacagcttagatcacagcct

SEQ ID NO: 9428068 - DNA, 22 bp, Homo sapiens
gccagcaaagcaagttgtcagc

SEQ ID NO: 9428069 - DNA, 22 bp, Homo sapiens
gccagatttacagatttgccct

SEQ ID NO: 9428070 - DNA, 22 bp, Homo sapiens
gccagatttacagatttgccct

SEQ ID NO: 9428071 - DNA, 22 bp, Homo sapiens
gccagatgccgtaaagatgggc

SEQ ID NO: 9428072 - DNA, 22 bp, Homo sapiens
gccagatctgacatagtggaag

SEQ ID NO: 9428073 - DNA, 22 bp, Homo sapiens
gccacaggctccagcatcagta

SEQ ID NO: 9428074 - DNA, 22 bp, Homo sapiens
gccacaggctccagcatcagta

SEQ ID NO: 9428075 - DNA, 20 bp, Homo sapiens
gccagaggccggcaggggct

SEQ ID NO: 9428076 - DNA, 20 bp, Homo sapiens
gccagaggccggcaggggct

SEQ ID NO: 9428077 - DNA, 20 bp, Homo sapiens
gccagaggccggcaggggct

SEQ ID NO: 9428078 - DNA, 22 bp, Homo sapiens
gcagggggtcattcacgctggc

SEQ ID NO: 9428079 - DNA, 22 bp, Homo sapiens
gcagggtgacgttgcccacctc

SEQ ID NO: 9428080 - DNA, 22 bp, Homo sapiens
gcagggtgaaggtcacatagaa

SEQ ID NO: 9428081 - DNA, 22 bp, Homo sapiens
gcagggtgaaggtcacatagaa

SEQ ID NO: 9428082 - DNA, 22 bp, Homo sapiens
gcagggggtcattcacgctggc

SEQ ID NO: 9428083 - DNA, 22 bp, Homo sapiens
gcagggggtcattcacgctggc

SEQ ID NO: 9428084 - DNA, 22 bp, Homo sapiens
gcaggggctgagcaccagcggg

SEQ ID NO: 9428085 - DNA, 22 bp, Homo sapiens
gcaggggctgctgggaactcgg

SEQ ID NO: 9428086 - DNA, 22 bp, Homo sapiens
gcaggggctgagcaccagcggg

SEQ ID NO: 9428087 - DNA, 22 bp, Homo sapiens
gcaggggctgagcaccagcggg

SEQ ID NO: 9428088 - DNA, 22 bp, Homo sapiens
gcaggggctgagcaccagcggg

SEQ ID NO: 9428089 - DNA, 22 bp, Homo sapiens
gcaggggctactctgagcttcc

SEQ ID NO: 9428090 - DNA, 22 bp, Homo sapiens
gcaggggcaggagatctcaggc

SEQ ID NO: 9428091 - DNA, 22 bp, Homo sapiens
gcaggggcaggagatctcaggc

SEQ ID NO: 9428092 - DNA, 22 bp, Homo sapiens
gcagggcagccacaggccccct

SEQ ID NO: 9428093 - DNA, 22 bp, Homo sapiens
gcaggggctactctgagcttcc

SEQ ID NO: 9428094 - DNA, 22 bp, Homo sapiens
gcaggggctactctgagcttcc

SEQ ID NO: 9428095 - DNA, 22 bp, Homo sapiens
gcaggggcggctgggtttccag

SEQ ID NO: 9428096 - DNA, 22 bp, Homo sapiens
gcaggggctaaggacacagaga

SEQ ID NO: 9428097 - DNA, 22 bp, Homo sapiens
gcaggggctaaggacacagaga

SEQ ID NO: 9428098 - DNA, 22 bp, Homo sapiens
gcagggcagaaggtgctgagga

SEQ ID NO: 9428099 - DNA, 22 bp, Homo sapiens
gcagggcagacctccagcctat

SEQ ID NO: 9428100 - DNA, 22 bp, Homo sapiens
gcagggcagacctccagcctat

SEQ ID NO: 9428101 - DNA, 22 bp, Homo sapiens
gcagggcagagggagaatctct

SEQ ID NO: 9428102 - DNA, 22 bp, Homo sapiens
gcagggcagagggagaatctct

SEQ ID NO: 9428103 - DNA, 22 bp, Homo sapiens
gcagggcacagacagtgccaag

SEQ ID NO: 9428104 - DNA, 22 bp, Homo sapiens
gcagggcacagacagtgccaag

SEQ ID NO: 9428105 - DNA, 22 bp, Homo sapiens
gcagggcacagacagtgccaag

SEQ ID NO: 9428106 - DNA, 22 bp, Homo sapiens
gcagggcagaaggtgctgagga

SEQ ID NO: 9428107 - DNA, 22 bp, Homo sapiens
gcagggcagaaggtgctgagga

SEQ ID NO: 9428108 - DNA, 22 bp, Homo sapiens
gcagggcaaatgtggaaaggag

SEQ ID NO: 9428109 - DNA, 20 bp, Homo sapiens
gcagggcaagggatatgaaa

SEQ ID NO: 9428110 - DNA, 22 bp, Homo sapiens
gcagggcaaatgtggaaaggag

SEQ ID NO: 9428111 - DNA, 22 bp, Homo sapiens
gcagggcacaaggacgcacagg

SEQ ID NO: 9428112 - DNA, 22 bp, Homo sapiens
gcagggcacacaagaatgataa

SEQ ID NO: 9428113 - DNA, 22 bp, Homo sapiens
gcagggcacaaggacgcacagg

SEQ ID NO: 9428114 - DNA, 22 bp, Homo sapiens
gcagggaagacccggagcagcg

SEQ ID NO: 9428115 - DNA, 22 bp, Homo sapiens
gcagggacgccagggacagcaa

SEQ ID NO: 9428116 - DNA, 22 bp, Homo sapiens
gcagggcaaacccaggtgttca

SEQ ID NO: 9428117 - DNA, 22 bp, Homo sapiens
gcagggcaaacccaggtgttca

SEQ ID NO: 9428118 - DNA, 22 bp, Homo sapiens
gcagggcaaacccaggtgttca

SEQ ID NO: 9428119 - DNA, 22 bp, Homo sapiens
gcagggacgccagggacagcaa

SEQ ID NO: 9428120 - DNA, 22 bp, Homo sapiens
gcaggcttgggacgagctggag

SEQ ID NO: 9428121 - DNA, 22 bp, Homo sapiens
gcaggcttgggacgagctggag

SEQ ID NO: 9428122 - DNA, 22 bp, Homo sapiens
gcaggcttatggggagacagag

SEQ ID NO: 9428123 - DNA, 21 bp, Homo sapiens
gcaggctggtcaaacctcagt

SEQ ID NO: 9428124 - DNA, 22 bp, Homo sapiens
gcaggctggtctgaccatccct

SEQ ID NO: 9428125 - DNA, 22 bp, Homo sapiens
gcaggctgtggtatgttgggca

SEQ ID NO: 9428126 - DNA, 22 bp, Homo sapiens
gcaggctggggtagccccactt

SEQ ID NO: 9428127 - DNA, 22 bp, Homo sapiens
gcaggctggggtagccccactt

SEQ ID NO: 9428128 - DNA, 22 bp, Homo sapiens
gcaggctggggtagccccactt

SEQ ID NO: 9428129 - DNA, 21 bp, Homo sapiens
gcaggctggtcaaacctcagt

SEQ ID NO: 9428130 - DNA, 21 bp, Homo sapiens
gcaggctggtcaaacctcagt

SEQ ID NO: 9428131 - DNA, 21 bp, Homo sapiens
gcaggctggtcaaacctcagt

SEQ ID NO: 9428132 - DNA, 22 bp, Homo sapiens
gcaggctggaggctgttctggg

SEQ ID NO: 9428133 - DNA, 22 bp, Homo sapiens
gcaggctggaggctgttctggg

SEQ ID NO: 9428134 - DNA, 22 bp, Homo sapiens
gcaggctgccaccttctgagtt

SEQ ID NO: 9428135 - DNA, 22 bp, Homo sapiens
gcaggctgctgagatccttagg

SEQ ID NO: 9428136 - DNA, 22 bp, Homo sapiens
gcaggcagaggtggaggagaca

SEQ ID NO: 9428137 - DNA, 22 bp, Homo sapiens
gcaggcagaggtggaggagaca

SEQ ID NO: 9428138 - DNA, 22 bp, Homo sapiens
gcaggctgccaccttctgagtt

SEQ ID NO: 9428139 - DNA, 17 bp, Homo sapiens
gcaggcactgctgcctg

SEQ ID NO: 9428140 - DNA, 17 bp, Homo sapiens
gcaggcactgctgcctg

SEQ ID NO: 9428141 - DNA, 21 bp, Homo sapiens
gcaggcactctagaggagctg

SEQ ID NO: 9428142 - DNA, 22 bp, Homo sapiens
gcaggcactcctaggaccatca

SEQ ID NO: 9428143 - DNA, 22 bp, Homo sapiens
gcaggcagaggtggaggagaca

SEQ ID NO: 9428144 - DNA, 22 bp, Homo sapiens
gcaggcagagaggggtttccag

SEQ ID NO: 9428145 - DNA, 22 bp, Homo sapiens
gcagcgtggggacaggagctca

SEQ ID NO: 9428146 - DNA, 22 bp, Homo sapiens
gcagcgtggggctgagtcagct

SEQ ID NO: 9428147 - DNA, 18 bp, Homo sapiens
gcagctagccaggggggc

SEQ ID NO: 9428148 - DNA, 18 bp, Homo sapiens
gcagctagccaggggggc

SEQ ID NO: 9428149 - DNA, 23 bp, Homo sapiens
gcagcgtccgcaccccggccggg

SEQ ID NO: 9428150 - DNA, 22 bp, Homo sapiens
gcagcctctgcagttcaggagg

SEQ ID NO: 9428151 - DNA, 22 bp, Homo sapiens
gcagcctctgcagttcaggagg

SEQ ID NO: 9428152 - DNA, 22 bp, Homo sapiens
gcagcctctgatgatggccgta

SEQ ID NO: 9428153 - DNA, 22 bp, Homo sapiens
gcagcctctgcagttcaggagg

SEQ ID NO: 9428154 - DNA, 22 bp, Homo sapiens
gcagcctctgatgatggccgta

SEQ ID NO: 9428155 - DNA, 22 bp, Homo sapiens
gcagagccttgcgtcatgtgcc

SEQ ID NO: 9428156 - DNA, 22 bp, Homo sapiens
gcagagccttgcgtcatgtgcc

SEQ ID NO: 9428157 - DNA, 22 bp, Homo sapiens
gcagagcctgtgtctgagcaaa

SEQ ID NO: 9428158 - DNA, 22 bp, Homo sapiens
gcagagccgtgaatggatttca

SEQ ID NO: 9428159 - DNA, 22 bp, Homo sapiens
gcagagcctgacgggatttttc

SEQ ID NO: 9428160 - DNA, 21 bp, Homo sapiens
gcagagccggggcgagaaggc

SEQ ID NO: 9428161 - DNA, 22 bp, Homo sapiens
gcagagcccctcaagccagcct

SEQ ID NO: 9428162 - DNA, 21 bp, Homo sapiens
gcagagccggggcgagaaggc

SEQ ID NO: 9428163 - DNA, 22 bp, Homo sapiens
gcagctgaaagggatctctaca

SEQ ID NO: 9428164 - DNA, 22 bp, Homo sapiens
gcagctgaagctgcagttccag

SEQ ID NO: 9428165 - DNA, 20 bp, Homo sapiens
gcagctgaaagtatgacacc

SEQ ID NO: 9428166 - DNA, 22 bp, Homo sapiens
gcagctgaatgtccattgctgc

SEQ ID NO: 9428167 - DNA, 18 bp, Homo sapiens
gcagctgacactggagtt

SEQ ID NO: 9428168 - DNA, 18 bp, Homo sapiens
gcagctgacactggagtt

SEQ ID NO: 9428169 - DNA, 22 bp, Homo sapiens
gcagctctggggcaggcctgag

SEQ ID NO: 9428170 - DNA, 22 bp, Homo sapiens
gcagctctggggcaggcctgag

SEQ ID NO: 9428171 - DNA, 22 bp, Homo sapiens
gcagctcacacagcaagttttg

SEQ ID NO: 9428172 - DNA, 22 bp, Homo sapiens
gcagctcacagtctccgccatc

SEQ ID NO: 9428173 - DNA, 22 bp, Homo sapiens
gcagctccttcaatctcaccat

SEQ ID NO: 9428174 - DNA, 22 bp, Homo sapiens
gcagctcccttgaacttctcct

SEQ ID NO: 9428175 - DNA, 19 bp, Homo sapiens
gcaggcacagccctgggtg

SEQ ID NO: 9428176 - DNA, 22 bp, Homo sapiens
gcaggagttagggtaaaaatga

SEQ ID NO: 9428177 - DNA, 22 bp, Homo sapiens
gcaggagttcaattgcccatga

SEQ ID NO: 9428178 - DNA, 22 bp, Homo sapiens
gcaggcaattttggaaggtcag

SEQ ID NO: 9428179 - DNA, 23 bp, Homo sapiens
gcaggagttcctggactccagga

SEQ ID NO: 9428180 - DNA, 22 bp, Homo sapiens
gcaggagttcaattgcccatga

SEQ ID NO: 9428181 - DNA, 22 bp, Homo sapiens
gcaggcaccgggttgctcccct

SEQ ID NO: 9428182 - DNA, 22 bp, Homo sapiens
gcaggcaccacggctcaggtct

SEQ ID NO: 9428183 - DNA, 22 bp, Homo sapiens
gcaggcaccacggctcaggtct

SEQ ID NO: 9428184 - DNA, 22 bp, Homo sapiens
gcaggcaccgcggcggcaggtt

SEQ ID NO: 9428185 - DNA, 22 bp, Homo sapiens
gcaggagccacttcagggatgc

SEQ ID NO: 9428186 - DNA, 22 bp, Homo sapiens
gcaggagccacttcagggatgc

SEQ ID NO: 9428187 - DNA, 22 bp, Homo sapiens
gcaggagagccagcaggcttcc

SEQ ID NO: 9428188 - DNA, 22 bp, Homo sapiens
gcaggagccaggccgagctggt

SEQ ID NO: 9428189 - DNA, 22 bp, Homo sapiens
gcaggagccaggccgagctggt

SEQ ID NO: 9428190 - DNA, 22 bp, Homo sapiens
gcaggagttaggcgtcgtggat

SEQ ID NO: 9428191 - DNA, 22 bp, Homo sapiens
gcaggagttaggcgtcgtggat

SEQ ID NO: 9428192 - DNA, 22 bp, Homo sapiens
gcaggagctcgtttccaggctg

SEQ ID NO: 9428193 - DNA, 22 bp, Homo sapiens
gcaggagctgctctcctgacga

SEQ ID NO: 9428194 - DNA, 22 bp, Homo sapiens
gcaggagccctggcatgttctt

SEQ ID NO: 9428195 - DNA, 22 bp, Homo sapiens
gcaggagctcgtttccaggctg

SEQ ID NO: 9428196 - DNA, 22 bp, Homo sapiens
gcaggagctcgtttccaggctg

SEQ ID NO: 9428197 - DNA, 22 bp, Homo sapiens
gcagctgagagaagaacagggc

SEQ ID NO: 9428198 - DNA, 22 bp, Homo sapiens
gcagctgacatctggctgggcc

SEQ ID NO: 9428199 - DNA, 22 bp, Homo sapiens
gcagctgacatctggctgggcc

SEQ ID NO: 9428200 - DNA, 22 bp, Homo sapiens
gcaggacagcaggatgcttaga

SEQ ID NO: 9428201 - DNA, 22 bp, Homo sapiens
gcaggacagcaggatgcttaga

SEQ ID NO: 9428202 - DNA, 22 bp, Homo sapiens
gcaggacagacccaagcagtct

SEQ ID NO: 9428203 - DNA, 22 bp, Homo sapiens
gcaggacaggcgttggtccagt

SEQ ID NO: 9428204 - DNA, 22 bp, Homo sapiens
gcaggacaggcgttggtccagt

SEQ ID NO: 9428205 - DNA, 22 bp, Homo sapiens
gcaggacattcagtgaatgggc

SEQ ID NO: 9428206 - DNA, 22 bp, Homo sapiens
gcaggagagccagcaggcttcc

SEQ ID NO: 9428207 - DNA, 22 bp, Homo sapiens
gcaggagagccagcaggcttcc

SEQ ID NO: 9428208 - DNA, 22 bp, Homo sapiens
gcaggagccacttcagggatgc

SEQ ID NO: 9428209 - DNA, 22 bp, Homo sapiens
gcaggagagccagcaggcttcc

SEQ ID NO: 9428210 - DNA, 22 bp, Homo sapiens
gcaggagactggctgtggtagt

SEQ ID NO: 9428211 - DNA, 22 bp, Homo sapiens
gcaggagactggctgtggtagt

SEQ ID NO: 9428212 - DNA, 22 bp, Homo sapiens
gcaggagagccagcaggcttcc

SEQ ID NO: 9428213 - DNA, 22 bp, Homo sapiens
gcaggagactggctgtggtagt

SEQ ID NO: 9428214 - DNA, 22 bp, Homo sapiens
gcaggagactggctgtggtagt

SEQ ID NO: 9428215 - DNA, 22 bp, Homo sapiens
gcaggagactggctgtggtagt

SEQ ID NO: 9428216 - DNA, 22 bp, Homo sapiens
gcaggagacaactgtaaggaga

SEQ ID NO: 9428217 - DNA, 22 bp, Homo sapiens
gcaggagaacaaagcaagctgc

SEQ ID NO: 9428218 - DNA, 22 bp, Homo sapiens
gcaggagaaatgaagattgggt

SEQ ID NO: 9428219 - DNA, 22 bp, Homo sapiens
gcaggagaaatgaagattgggt

SEQ ID NO: 9428220 - DNA, 22 bp, Homo sapiens
gcaggagaaatgaagattgggt

SEQ ID NO: 9428221 - DNA, 22 bp, Homo sapiens
gcaggagaacaaagcaagctgc

SEQ ID NO: 9428222 - DNA, 22 bp, Homo sapiens
gcaggagaacaaagcaagctgc

SEQ ID NO: 9428223 - DNA, 22 bp, Homo sapiens
gcaggagaacaaagcaagctgc

SEQ ID NO: 9428224 - DNA, 22 bp, Homo sapiens
gcaggagaacaaagcaagctgc

SEQ ID NO: 9428225 - DNA, 22 bp, Homo sapiens
gcaggagaacaaagcaagctgc

SEQ ID NO: 9428226 - DNA, 22 bp, Homo sapiens
gcacccagtgggatgcttagca

SEQ ID NO: 9428227 - DNA, 22 bp, Homo sapiens
gcacccagtgggatgcttagca

SEQ ID NO: 9428228 - DNA, 22 bp, Homo sapiens
gcacccagtttgtctcagggtt

SEQ ID NO: 9428229 - DNA, 22 bp, Homo sapiens
gcacccagggcaggaagtgagg

SEQ ID NO: 9428230 - DNA, 22 bp, Homo sapiens
gcacccagggcaggaagtgagg

SEQ ID NO: 9428231 - DNA, 22 bp, Homo sapiens
gcacccagtttgtctcagggtt

SEQ ID NO: 9428232 - DNA, 22 bp, Homo sapiens
gcacccagtttgtctcagggtt

SEQ ID NO: 9428233 - DNA, 22 bp, Homo sapiens
gcacccatgctcttgtctcagg

SEQ ID NO: 9428234 - DNA, 22 bp, Homo sapiens
gcacccaggcttgggcagcaac

SEQ ID NO: 9428235 - DNA, 22 bp, Homo sapiens
gcacccaggccggcgactgcag

SEQ ID NO: 9428236 - DNA, 22 bp, Homo sapiens
gcacccaggcttgggcagcaac

SEQ ID NO: 9428237 - DNA, 22 bp, Homo sapiens
gcacccagggacttggctggcc

SEQ ID NO: 9428238 - DNA, 22 bp, Homo sapiens
gcacccagggcaggaagtgagg

SEQ ID NO: 9428239 - DNA, 22 bp, Homo sapiens
gcacccaggcttgggcagcaac

SEQ ID NO: 9428240 - DNA, 22 bp, Homo sapiens
gcacccagggacttggctggcc

SEQ ID NO: 9428241 - DNA, 22 bp, Homo sapiens
gcacccagggacttggctggcc

SEQ ID NO: 9428242 - DNA, 22 bp, Homo sapiens
gcacaataacagccaaggttat

SEQ ID NO: 9428243 - DNA, 22 bp, Homo sapiens
gcacaagggtggtctctggagc

SEQ ID NO: 9428244 - DNA, 22 bp, Homo sapiens
gcacaaggagcagtgtatgaaa

SEQ ID NO: 9428245 - DNA, 22 bp, Homo sapiens
gcacaataacagccaaggttat

SEQ ID NO: 9428246 - DNA, 22 bp, Homo sapiens
gcacaattccatgggacagccc

SEQ ID NO: 9428247 - DNA, 22 bp, Homo sapiens
gcacaatggaccgtgtgctctg

SEQ ID NO: 9428248 - DNA, 16 bp, Homo sapiens
gcacacacatcaatga

SEQ ID NO: 9428249 - DNA, 22 bp, Homo sapiens
gcacaattccatgggacagccc

SEQ ID NO: 9428250 - DNA, 16 bp, Homo sapiens
gcacacacatcaatga

SEQ ID NO: 9428251 - DNA, 22 bp, Homo sapiens
gcacacacatgtgagtacatgc

SEQ ID NO: 9428252 - DNA, 22 bp, Homo sapiens
gcacccaggcactttcctttct

SEQ ID NO: 9428253 - DNA, 22 bp, Homo sapiens
gcacacactgttttcctcacat

SEQ ID NO: 9428254 - DNA, 22 bp, Homo sapiens
gcacccaggccggcgactgcag

SEQ ID NO: 9428255 - DNA, 22 bp, Homo sapiens
gcacccaggcactttcctttct

SEQ ID NO: 9428256 - DNA, 22 bp, Homo sapiens
gcacacactgttttcctcacat

SEQ ID NO: 9428257 - DNA, 22 bp, Homo sapiens
gcacacacatgtgagtacatgc

SEQ ID NO: 9428258 - DNA, 22 bp, Homo sapiens
gcacacacatgtgagtacatgc

SEQ ID NO: 9428259 - DNA, 22 bp, Homo sapiens
gcacctcattttgcaggtagaa

SEQ ID NO: 9428260 - DNA, 22 bp, Homo sapiens
gcacctgaacgacctgctccag

SEQ ID NO: 9428261 - DNA, 22 bp, Homo sapiens
gcacctgattgatttcactgct

SEQ ID NO: 9428262 - DNA, 22 bp, Homo sapiens
gcacctgaggaggcatctggag

SEQ ID NO: 9428263 - DNA, 22 bp, Homo sapiens
gcacctgcaggatgagccaggg

SEQ ID NO: 9428264 - DNA, 22 bp, Homo sapiens
gcacctgctcacacatgtgact

SEQ ID NO: 9428265 - DNA, 22 bp, Homo sapiens
gcacctgctgggtgtagaggct

SEQ ID NO: 9428266 - DNA, 22 bp, Homo sapiens
gcacctggacagtgaccctagc

SEQ ID NO: 9428267 - DNA, 22 bp, Homo sapiens
gcacctggacagtgaccctagc

SEQ ID NO: 9428268 - DNA, 22 bp, Homo sapiens
gcacctggctgcccaggtggag

SEQ ID NO: 9428269 - DNA, 20 bp, Homo sapiens
gcacttggctgctgcttctc

SEQ ID NO: 9428270 - DNA, 22 bp, Homo sapiens
gcaccctagagttgcctgagga

SEQ ID NO: 9428271 - DNA, 22 bp, Homo sapiens
gcaccctctgagctccgctccg

SEQ ID NO: 9428272 - DNA, 22 bp, Homo sapiens
gcaccctctgagctccgctccg

SEQ ID NO: 9428273 - DNA, 19 bp, Homo sapiens
gcaccctgaggtcatggcc

SEQ ID NO: 9428274 - DNA, 19 bp, Homo sapiens
gcaccctgaggtcatggcc

SEQ ID NO: 9428275 - DNA, 19 bp, Homo sapiens
gcaccccatcttcctcctg

SEQ ID NO: 9428276 - DNA, 23 bp, Homo sapiens
gcaccccagatgtgattagttag

SEQ ID NO: 9428277 - DNA, 22 bp, Homo sapiens
gcacccctgcgtgccttccctt

SEQ ID NO: 9428278 - DNA, 22 bp, Homo sapiens
gcacccctcagcttgtttacta

SEQ ID NO: 9428279 - DNA, 22 bp, Homo sapiens
gcacccctggacggtagggcca

SEQ ID NO: 9428280 - DNA, 22 bp, Homo sapiens
gcacccctggacggtagggcca

SEQ ID NO: 9428281 - DNA, 19 bp, Homo sapiens
gcaccctgaggtcatggcc

SEQ ID NO: 9428282 - DNA, 22 bp, Homo sapiens
gcaccctgtcaaaatggaccaa

SEQ ID NO: 9428283 - DNA, 19 bp, Homo sapiens
gcaccctggccactcccac

SEQ ID NO: 9428284 - DNA, 22 bp, Homo sapiens
gcaccgccttggaccgcccgct

SEQ ID NO: 9428285 - DNA, 22 bp, Homo sapiens
gcaccgccttggaccgcccgct

SEQ ID NO: 9428286 - DNA, 22 bp, Homo sapiens
gcaccctgtttatcctgagttc

SEQ ID NO: 9428287 - DNA, 22 bp, Homo sapiens
gcagagccaggagcccaggatc

SEQ ID NO: 9428288 - DNA, 22 bp, Homo sapiens
gcagagccaggctggggcaggt

SEQ ID NO: 9428289 - DNA, 22 bp, Homo sapiens
gcagagccagaatggccaggac

SEQ ID NO: 9428290 - DNA, 22 bp, Homo sapiens
gcagagccaggagagacccttg

SEQ ID NO: 9428291 - DNA, 22 bp, Homo sapiens
gcagagccaggagagacccttg

SEQ ID NO: 9428292 - DNA, 22 bp, Homo sapiens
gcagagcccctcaagccagcct

SEQ ID NO: 9428293 - DNA, 22 bp, Homo sapiens
gcagagccccattgctggcggg

SEQ ID NO: 9428294 - DNA, 22 bp, Homo sapiens
gcagagcattggagggaccctg

SEQ ID NO: 9428295 - DNA, 22 bp, Homo sapiens
gcagagcattggagggaccctg

SEQ ID NO: 9428296 - DNA, 22 bp, Homo sapiens
gcagagcagtgcttgcccagcg

SEQ ID NO: 9428297 - DNA, 22 bp, Homo sapiens
gcagagcagtgcttgcccagcg

SEQ ID NO: 9428298 - DNA, 18 bp, Homo sapiens
gcagagcatcaagggtta

SEQ ID NO: 9428299 - DNA, 22 bp, Homo sapiens
gcagagcatgtcctcaggacag

SEQ ID NO: 9428300 - DNA, 22 bp, Homo sapiens
gcagaagctgggcagcgaggtg

SEQ ID NO: 9428301 - DNA, 22 bp, Homo sapiens
gcagaaggatccgcaggtgcaa

SEQ ID NO: 9428302 - DNA, 22 bp, Homo sapiens
gcagagcagtgcttgcccagcg

SEQ ID NO: 9428303 - DNA, 22 bp, Homo sapiens
gcagagcagtgcttgcccagcg

SEQ ID NO: 9428304 - DNA, 22 bp, Homo sapiens
gcagaaggatccgcaggtgcaa

SEQ ID NO: 9428305 - DNA, 22 bp, Homo sapiens
gcagaagcccggtcagcgcacg

SEQ ID NO: 9428306 - DNA, 22 bp, Homo sapiens
gcagaagctgggagaagggatt

SEQ ID NO: 9428307 - DNA, 22 bp, Homo sapiens
gcagaagctgggagaagggatt

SEQ ID NO: 9428308 - DNA, 22 bp, Homo sapiens
gcagaagcagggcaggggcaaa

SEQ ID NO: 9428309 - DNA, 22 bp, Homo sapiens
gcagaagcacaggtgacgggcc

SEQ ID NO: 9428310 - DNA, 22 bp, Homo sapiens
gcagaagaccatggtggaaaga

SEQ ID NO: 9428311 - DNA, 22 bp, Homo sapiens
gcagaagaccatggtggaaaga

SEQ ID NO: 9428312 - DNA, 22 bp, Homo sapiens
gcagaagaccatggtggaaaga

SEQ ID NO: 9428313 - DNA, 22 bp, Homo sapiens
gcagaacctgaattgaacattg

SEQ ID NO: 9428314 - DNA, 22 bp, Homo sapiens
gcagaagaccatggtggaaaga

SEQ ID NO: 9428315 - DNA, 22 bp, Homo sapiens
gcagaacatttcacagtatctt

SEQ ID NO: 9428316 - DNA, 22 bp, Homo sapiens
gcagaaccataaattcaggtaa

SEQ ID NO: 9428317 - DNA, 22 bp, Homo sapiens
gcagaacatttcacagtatctt

SEQ ID NO: 9428318 - DNA, 22 bp, Homo sapiens
gcagaacagtctgtcggttcta

SEQ ID NO: 9428319 - DNA, 22 bp, Homo sapiens
gcagaacatggaaagagaacta

SEQ ID NO: 9428320 - DNA, 22 bp, Homo sapiens
gcagaacatggaaagagaacta

SEQ ID NO: 9428321 - DNA, 23 bp, Homo sapiens
gcacttttataggtggggaaaca

SEQ ID NO: 9428322 - DNA, 22 bp, Homo sapiens
gcacttttcaaagcttcctgtg

SEQ ID NO: 9428323 - DNA, 17 bp, Homo sapiens
gcagaaaagtcaaggga

SEQ ID NO: 9428324 - DNA, 17 bp, Homo sapiens
gcagaaaagtcaaggga

SEQ ID NO: 9428325 - DNA, 22 bp, Homo sapiens
gcactttgcccctcctttggca

SEQ ID NO: 9428326 - DNA, 22 bp, Homo sapiens
gcactttaaatgttcacggaaa

SEQ ID NO: 9428327 - DNA, 22 bp, Homo sapiens
gcagaaaccacagtgtctttta

SEQ ID NO: 9428328 - DNA, 22 bp, Homo sapiens
gcagaaaccacagtgtctttta

SEQ ID NO: 9428329 - DNA, 21 bp, Homo sapiens
gcagaaaggaatcttaggtcc

SEQ ID NO: 9428330 - DNA, 22 bp, Homo sapiens
gcagaaatatgatgcataaagg

SEQ ID NO: 9428331 - DNA, 22 bp, Homo sapiens
gcagaacaacgtaggagtggag

SEQ ID NO: 9428332 - DNA, 21 bp, Homo sapiens
gattttaaagagactgccaca

SEQ ID NO: 9428333 - DNA, 21 bp, Homo sapiens
gattttaaagagactgccaca

SEQ ID NO: 9428334 - DNA, 22 bp, Homo sapiens
gatttgtgctcattttccatta

SEQ ID NO: 9428335 - DNA, 22 bp, Homo sapiens
gatttgtctatattcaaatatg

SEQ ID NO: 9428336 - DNA, 22 bp, Homo sapiens
gatttgtttcaagttagcatct

SEQ ID NO: 9428337 - DNA, 22 bp, Homo sapiens
gatttgtttcaagttagcatct

SEQ ID NO: 9428338 - DNA, 22 bp, Homo sapiens
gatttgtttcaagttagcatct

SEQ ID NO: 9428339 - DNA, 22 bp, Homo sapiens
gattttaattataggaggtcct

SEQ ID NO: 9428340 - DNA, 22 bp, Homo sapiens
gattttatagtcaggaaaaaga

SEQ ID NO: 9428341 - DNA, 22 bp, Homo sapiens
gattttatatggcatactgtgg

SEQ ID NO: 9428342 - DNA, 22 bp, Homo sapiens
gattttatctttgtgtgcagta

SEQ ID NO: 9428343 - DNA, 22 bp, Homo sapiens
gattttatctttgtgtgcagta

SEQ ID NO: 9428344 - DNA, 22 bp, Homo sapiens
gattttattagcccaaactttg

SEQ ID NO: 9428345 - DNA, 22 bp, Homo sapiens
gattttattagcccaaactttg

SEQ ID NO: 9428346 - DNA, 22 bp, Homo sapiens
gattttatatggcatactgtgg

SEQ ID NO: 9428347 - DNA, 22 bp, Homo sapiens
gattttatcgtcatccttctgg

SEQ ID NO: 9428348 - DNA, 22 bp, Homo sapiens
gattttattagcccaaactttg

SEQ ID NO: 9428349 - DNA, 22 bp, Homo sapiens
gatttctttaggtgtaatagtg

SEQ ID NO: 9428350 - DNA, 22 bp, Homo sapiens
gatttctttagctcatcagatc

SEQ ID NO: 9428351 - DNA, 22 bp, Homo sapiens
gatttctttgaattagagaggt

SEQ ID NO: 9428352 - DNA, 22 bp, Homo sapiens
gatttctttatgaagtacagaa

SEQ ID NO: 9428353 - DNA, 22 bp, Homo sapiens
gatttctttatgaagtacagaa

SEQ ID NO: 9428354 - DNA, 22 bp, Homo sapiens
gatttcttgataattcaaatcc

SEQ ID NO: 9428355 - DNA, 22 bp, Homo sapiens
gatttcttgataattcaaatcc

SEQ ID NO: 9428356 - DNA, 22 bp, Homo sapiens
gatttctttagctcatcagatc

SEQ ID NO: 9428357 - DNA, 22 bp, Homo sapiens
gatttcttggcccactctcaga

SEQ ID NO: 9428358 - DNA, 22 bp, Homo sapiens
gatttcttggcccactctcaga

SEQ ID NO: 9428359 - DNA, 22 bp, Homo sapiens
gatttcttggcccactctcaga

SEQ ID NO: 9428360 - DNA, 20 bp, Homo sapiens
gatttgctgaacttttatga

SEQ ID NO: 9428361 - DNA, 22 bp, Homo sapiens
gatttgtagcttttcagtctgt

SEQ ID NO: 9428362 - DNA, 22 bp, Homo sapiens
gatttgtagttttatgtgtcag

SEQ ID NO: 9428363 - DNA, 21 bp, Homo sapiens
gatttgtattattggttccaa

SEQ ID NO: 9428364 - DNA, 22 bp, Homo sapiens
gatttgtagcttttcagtctgt

SEQ ID NO: 9428365 - DNA, 22 bp, Homo sapiens
gatttctttgcaagctgtgttc

SEQ ID NO: 9428366 - DNA, 22 bp, Homo sapiens
gatttctttgaattagagaggt

SEQ ID NO: 9428367 - DNA, 22 bp, Homo sapiens
gatttctttgtacccacaatcc

SEQ ID NO: 9428368 - DNA, 22 bp, Homo sapiens
gatttctttgcaagctgtgttc

SEQ ID NO: 9428369 - DNA, 22 bp, Homo sapiens
gatttctttgcaagctgtgttc

SEQ ID NO: 9428370 - DNA, 22 bp, Homo sapiens
gatttcttgataagtagtgtga

SEQ ID NO: 9428371 - DNA, 22 bp, Homo sapiens
gatttcttgacccctgtctcag

SEQ ID NO: 9428372 - DNA, 22 bp, Homo sapiens
gatttcttgagcaagttgctta

SEQ ID NO: 9428373 - DNA, 22 bp, Homo sapiens
gatttcttgagcaagttgctta

SEQ ID NO: 9428374 - DNA, 22 bp, Homo sapiens
gatttcttgagcaagttgctta

SEQ ID NO: 9428375 - DNA, 22 bp, Homo sapiens
gatttcttcatttgtggtgaat

SEQ ID NO: 9428376 - DNA, 22 bp, Homo sapiens
gatttcttcatttgtggtgaat

SEQ ID NO: 9428377 - DNA, 22 bp, Homo sapiens
gatttcttcattcattagatgg

SEQ ID NO: 9428378 - DNA, 22 bp, Homo sapiens
gatttcttctctcccaagagga

SEQ ID NO: 9428379 - DNA, 22 bp, Homo sapiens
gatttcttctctcccaagagga

SEQ ID NO: 9428380 - DNA, 22 bp, Homo sapiens
gatttcttgacccctgtctcag

SEQ ID NO: 9428381 - DNA, 22 bp, Homo sapiens
gatttcttcaggagcagaggag

SEQ ID NO: 9428382 - DNA, 22 bp, Homo sapiens
gatttcttcaggagcagaggag

SEQ ID NO: 9428383 - DNA, 22 bp, Homo sapiens
gatttcaagcccccagagattc

SEQ ID NO: 9428384 - DNA, 22 bp, Homo sapiens
gcaaaaaatgcttgttgcttag

SEQ ID NO: 9428385 - DNA, 22 bp, Homo sapiens
gatttttcagtataaaatatat

SEQ ID NO: 9428386 - DNA, 22 bp, Homo sapiens
gcaaacataatatgaagacact

SEQ ID NO: 9428387 - DNA, 22 bp, Homo sapiens
gcaaacagccaggcgcagaagt

SEQ ID NO: 9428388 - DNA, 22 bp, Homo sapiens
gatttttatataaagtgagaaa

SEQ ID NO: 9428389 - DNA, 22 bp, Homo sapiens
gattttcttgggaaacaatgag

SEQ ID NO: 9428390 - DNA, 22 bp, Homo sapiens
gattttctgagccttcaaattt

SEQ ID NO: 9428391 - DNA, 22 bp, Homo sapiens
gcaaacatgctgagaaataaga

SEQ ID NO: 9428392 - DNA, 22 bp, Homo sapiens
gcaaacatgctgagaaataaga

SEQ ID NO: 9428393 - DNA, 22 bp, Homo sapiens
gcaaacattcaggagtacagga

SEQ ID NO: 9428394 - DNA, 22 bp, Homo sapiens
gcaaacatgttgtgagatacca

SEQ ID NO: 9428395 - DNA, 22 bp, Homo sapiens
gcaatataaccagttgtcatgc

SEQ ID NO: 9428396 - DNA, 22 bp, Homo sapiens
gcaatagattatgatctacagt

SEQ ID NO: 9428397 - DNA, 22 bp, Homo sapiens
gcaatagattatgatctacagt

SEQ ID NO: 9428398 - DNA, 22 bp, Homo sapiens
gcaaactggcaaacctgtctgt

SEQ ID NO: 9428399 - DNA, 22 bp, Homo sapiens
gcaaactgatttccaagtccgt

SEQ ID NO: 9428400 - DNA, 22 bp, Homo sapiens
gcaaactgcattctatagcttg

SEQ ID NO: 9428401 - DNA, 22 bp, Homo sapiens
gcaaacattccacagaaggaag

SEQ ID NO: 9428402 - DNA, 22 bp, Homo sapiens
gcaatgcaatcagatgattatt

SEQ ID NO: 9428403 - DNA, 22 bp, Homo sapiens
gcaatgaataaataatgtttag

SEQ ID NO: 9428404 - DNA, 22 bp, Homo sapiens
gcaatgagcacccagagggcag

SEQ ID NO: 9428405 - DNA, 22 bp, Homo sapiens
gcaatctgggcaagcaggtagt

SEQ ID NO: 9428406 - DNA, 17 bp, Homo sapiens
gcaatctcagtctcctt

SEQ ID NO: 9428407 - DNA, 20 bp, Homo sapiens
gcaattaatttttggttaca

SEQ ID NO: 9428408 - DNA, 22 bp, Homo sapiens
gcaatgcatatgtgggtagcat

SEQ ID NO: 9428409 - DNA, 20 bp, Homo sapiens
gcaatggcgtgctagttctg

SEQ ID NO: 9428410 - DNA, 22 bp, Homo sapiens
gcaatgggcacagcccagccca

SEQ ID NO: 9428411 - DNA, 22 bp, Homo sapiens
gcaatgtctagtctgagggctt

SEQ ID NO: 9428412 - DNA, 22 bp, Homo sapiens
gcaatgtctgcaatgggtgtgg

SEQ ID NO: 9428413 - DNA, 22 bp, Homo sapiens
gcaatgttgtgttggcattcta

SEQ ID NO: 9428414 - DNA, 20 bp, Homo sapiens
gcaatgttggttcctgtcac

SEQ ID NO: 9428415 - DNA, 22 bp, Homo sapiens
gcaatgtttttccttccatatt

SEQ ID NO: 9428416 - DNA, 22 bp, Homo sapiens
gcaatgtctgtgctaaaaactg

SEQ ID NO: 9428417 - DNA, 22 bp, Homo sapiens
gcaatgtctgtgctaaaaactg

SEQ ID NO: 9428418 - DNA, 22 bp, Homo sapiens
gcacaaagatgaatacagaatg

SEQ ID NO: 9428419 - DNA, 22 bp, Homo sapiens
gcacaaagatgaatacagaatg

SEQ ID NO: 9428420 - DNA, 22 bp, Homo sapiens
gcacaaactgcaattacttttg

SEQ ID NO: 9428421 - DNA, 22 bp, Homo sapiens
gcacaaactgcaattacttttg

SEQ ID NO: 9428422 - DNA, 22 bp, Homo sapiens
gcacaaaaggtacttcatgtag

SEQ ID NO: 9428423 - DNA, 22 bp, Homo sapiens
gcacaaaaggtacttcatgtag

SEQ ID NO: 9428424 - DNA, 22 bp, Homo sapiens
gcacaaaacacattttgacaat

SEQ ID NO: 9428425 - DNA, 22 bp, Homo sapiens
gcacaaaacacattttgacaat

SEQ ID NO: 9428426 - DNA, 22 bp, Homo sapiens
gcacaaggagcagtgtatgaaa

SEQ ID NO: 9428427 - DNA, 22 bp, Homo sapiens
gcacaagggtggtctctggagc

SEQ ID NO: 9428428 - DNA, 22 bp, Homo sapiens
gcacaaggagaattcattagtg

SEQ ID NO: 9428429 - DNA, 22 bp, Homo sapiens
gcacaagcagcccactgacatt

SEQ ID NO: 9428430 - DNA, 22 bp, Homo sapiens
gcacaagaaatcatggactgaa

SEQ ID NO: 9428431 - DNA, 22 bp, Homo sapiens
gcacaagaataaccatatttaa

SEQ ID NO: 9428432 - DNA, 22 bp, Homo sapiens
gcacaagaaatcatggactgaa

SEQ ID NO: 9428433 - DNA, 22 bp, Homo sapiens
gcacaaaggtggaaggaggaag

SEQ ID NO: 9428434 - DNA, 17 bp, Homo sapiens
gcacaaatcaattacta

SEQ ID NO: 9428435 - DNA, 22 bp, Homo sapiens
gattgtaaaacagatcattatc

SEQ ID NO: 9428436 - DNA, 22 bp, Homo sapiens
gattgtaaaacagatcattatc

SEQ ID NO: 9428437 - DNA, 21 bp, Homo sapiens
gattggttcactcatgttgac

SEQ ID NO: 9428438 - DNA, 22 bp, Homo sapiens
gattggttgaaagtagaatact

SEQ ID NO: 9428439 - DNA, 22 bp, Homo sapiens
gattgtaattctactttccgct

SEQ ID NO: 9428440 - DNA, 22 bp, Homo sapiens
gattgtaattttcaagaggtaa

SEQ ID NO: 9428441 - DNA, 22 bp, Homo sapiens
gattgcttctggaaagcagttt

SEQ ID NO: 9428442 - DNA, 22 bp, Homo sapiens
gattggagagtggaacatgctg

SEQ ID NO: 9428443 - DNA, 22 bp, Homo sapiens
gattgggggtcaggctcaggtc

SEQ ID NO: 9428444 - DNA, 22 bp, Homo sapiens
gattgagtctgaggatgctgca

SEQ ID NO: 9428445 - DNA, 22 bp, Homo sapiens
gattgaatcatatgaaattgtg

SEQ ID NO: 9428446 - DNA, 22 bp, Homo sapiens
gattgagtctgaggatgctgca

SEQ ID NO: 9428447 - DNA, 22 bp, Homo sapiens
gattgagtctgaggatgctgca

SEQ ID NO: 9428448 - DNA, 22 bp, Homo sapiens
gattgcttctggaaagcagttt

SEQ ID NO: 9428449 - DNA, 19 bp, Homo sapiens
gatttaaacgtggctctat

SEQ ID NO: 9428450 - DNA, 22 bp, Homo sapiens
gatttaaagtagacctttgttt

SEQ ID NO: 9428451 - DNA, 22 bp, Homo sapiens
gatttaaagtagacctttgttt

SEQ ID NO: 9428452 - DNA, 19 bp, Homo sapiens
gatttaaacgtggctctat

SEQ ID NO: 9428453 - DNA, 19 bp, Homo sapiens
gatttaaacgtggctctat

SEQ ID NO: 9428454 - DNA, 22 bp, Homo sapiens
gattgtggaagtcagtggttct

SEQ ID NO: 9428455 - DNA, 22 bp, Homo sapiens
gattgtctttattttatggcta

SEQ ID NO: 9428456 - DNA, 22 bp, Homo sapiens
gattgtctgtgatcatgagcaa

SEQ ID NO: 9428457 - DNA, 22 bp, Homo sapiens
gattgtggaagtcagtggttct

SEQ ID NO: 9428458 - DNA, 22 bp, Homo sapiens
gatttacagatctaagggtcac

SEQ ID NO: 9428459 - DNA, 22 bp, Homo sapiens
gatttacagatctaagggtcac

SEQ ID NO: 9428460 - DNA, 22 bp, Homo sapiens
gatttacaaagctctctagtgt

SEQ ID NO: 9428461 - DNA, 22 bp, Homo sapiens
gatttacaaagctctctagtgt

SEQ ID NO: 9428462 - DNA, 22 bp, Homo sapiens
gatttaaagtagacctttgttt

SEQ ID NO: 9428463 - DNA, 22 bp, Homo sapiens
gatttaaagtagacctttgttt

SEQ ID NO: 9428464 - DNA, 22 bp, Homo sapiens
gatttatagtatgtgctttcag

SEQ ID NO: 9428465 - DNA, 22 bp, Homo sapiens
gatttattggtctttcattggt

SEQ ID NO: 9428466 - DNA, 22 bp, Homo sapiens
gatttattgtccctgtcctgct

SEQ ID NO: 9428467 - DNA, 22 bp, Homo sapiens
gatttatttttaatcagcaggg

SEQ ID NO: 9428468 - DNA, 22 bp, Homo sapiens
gatttacagctatacccaatgg

SEQ ID NO: 9428469 - DNA, 22 bp, Homo sapiens
gatttacagctatacccaatgg

SEQ ID NO: 9428470 - DNA, 22 bp, Homo sapiens
gatttacagctatacccaatgg

SEQ ID NO: 9428471 - DNA, 22 bp, Homo sapiens
gatttacagctatacccaatgg

SEQ ID NO: 9428472 - DNA, 22 bp, Homo sapiens
gatttacagctatacccaatgg

SEQ ID NO: 9428473 - DNA, 22 bp, Homo sapiens
gatttacaggttaggtcctgta

SEQ ID NO: 9428474 - DNA, 22 bp, Homo sapiens
gatttacaggttaggtcctgta

SEQ ID NO: 9428475 - DNA, 22 bp, Homo sapiens
gatttataaaggttgcactgga

SEQ ID NO: 9428476 - DNA, 21 bp, Homo sapiens
gatttataagccttaagccta

SEQ ID NO: 9428477 - DNA, 21 bp, Homo sapiens
gatttagtggctgttctacct

SEQ ID NO: 9428478 - DNA, 21 bp, Homo sapiens
gatttagtggctgttctacct

SEQ ID NO: 9428479 - DNA, 22 bp, Homo sapiens
gatttagtgctgaaatccctgg

SEQ ID NO: 9428480 - DNA, 22 bp, Homo sapiens
gatgtgtttccaggatttgttt

SEQ ID NO: 9428481 - DNA, 22 bp, Homo sapiens
gatgtgtttccaggatttgttt

SEQ ID NO: 9428482 - DNA, 22 bp, Homo sapiens
gatgtgtttccaggatttgttt

SEQ ID NO: 9428483 - DNA, 22 bp, Homo sapiens
gatgttctagaagtgtggtgtt

SEQ ID NO: 9428484 - DNA, 22 bp, Homo sapiens
gatgtttatatctaacttaagt

SEQ ID NO: 9428485 - DNA, 21 bp, Homo sapiens
gatgttggaggctggggtctg

SEQ ID NO: 9428486 - DNA, 22 bp, Homo sapiens
gatgtttcccgttaagagaaaa

SEQ ID NO: 9428487 - DNA, 22 bp, Homo sapiens
gattaatagacacaaccaagct

SEQ ID NO: 9428488 - DNA, 22 bp, Homo sapiens
gattaattcaggatcaggaaat

SEQ ID NO: 9428489 - DNA, 22 bp, Homo sapiens
gattaatagtacaggttcttag

SEQ ID NO: 9428490 - DNA, 22 bp, Homo sapiens
gattaatagacacaaccaagct

SEQ ID NO: 9428491 - DNA, 22 bp, Homo sapiens
gattaatagtacaggttcttag

SEQ ID NO: 9428492 - DNA, 22 bp, Homo sapiens
gattacaattcaggttgataag

SEQ ID NO: 9428493 - DNA, 22 bp, Homo sapiens
gattacaaaggtccttttctct

SEQ ID NO: 9428494 - DNA, 22 bp, Homo sapiens
gattacattctccttgtattag

SEQ ID NO: 9428495 - DNA, 20 bp, Homo sapiens
gattacaaaatgaaatgcat

SEQ ID NO: 9428496 - DNA, 22 bp, Homo sapiens
gattacaaaactcatctatgac

SEQ ID NO: 9428497 - DNA, 22 bp, Homo sapiens
gattaaaaataacccatgctga

SEQ ID NO: 9428498 - DNA, 22 bp, Homo sapiens
gattaaaaataacccatgctga

SEQ ID NO: 9428499 - DNA, 22 bp, Homo sapiens
gattaaaaataacccatgctga

SEQ ID NO: 9428500 - DNA, 22 bp, Homo sapiens
gattaaaaataacccatgctga

SEQ ID NO: 9428501 - DNA, 21 bp, Homo sapiens
gattaaatttaagctacatgc

SEQ ID NO: 9428502 - DNA, 21 bp, Homo sapiens
gattaaatttaagctacatgc

SEQ ID NO: 9428503 - DNA, 21 bp, Homo sapiens
gattaaatttaagctacatgc

SEQ ID NO: 9428504 - DNA, 21 bp, Homo sapiens
gattaaatttaagctacatgc

SEQ ID NO: 9428505 - DNA, 22 bp, Homo sapiens
gattaacaaatttcatatccaa

SEQ ID NO: 9428506 - DNA, 22 bp, Homo sapiens
gattctttggcctttattgaca

SEQ ID NO: 9428507 - DNA, 22 bp, Homo sapiens
gattcacagtttaggctgggct

SEQ ID NO: 9428508 - DNA, 22 bp, Homo sapiens
gattcacagtttaggctgggct

SEQ ID NO: 9428509 - DNA, 22 bp, Homo sapiens
gattcacagtttaggctgggct

SEQ ID NO: 9428510 - DNA, 22 bp, Homo sapiens
gattcactcatattttacgttt

SEQ ID NO: 9428511 - DNA, 22 bp, Homo sapiens
gattcaaagttaatgaagatgc

SEQ ID NO: 9428512 - DNA, 22 bp, Homo sapiens
gattcaaagttaatgaagatgc

SEQ ID NO: 9428513 - DNA, 22 bp, Homo sapiens
gattcaatgttgcagatggaat

SEQ ID NO: 9428514 - DNA, 22 bp, Homo sapiens
gattcacagaacttagtcaagc

SEQ ID NO: 9428515 - DNA, 23 bp, Homo sapiens
gattcacagggtggtttatgggg

SEQ ID NO: 9428516 - DNA, 22 bp, Homo sapiens
gattcacaactgccctgaaggg

SEQ ID NO: 9428517 - DNA, 22 bp, Homo sapiens
gattcacagaacttagtcaagc

SEQ ID NO: 9428518 - DNA, 22 bp, Homo sapiens
gattcacaactgccctgaaggg

SEQ ID NO: 9428519 - DNA, 22 bp, Homo sapiens
gattaggacatggatgtatgtt

SEQ ID NO: 9428520 - DNA, 22 bp, Homo sapiens
gattagaagaacttgttagcct

SEQ ID NO: 9428521 - DNA, 22 bp, Homo sapiens
gattactgtctacttgggatag

SEQ ID NO: 9428522 - DNA, 22 bp, Homo sapiens
gattatggagaaataattagaa

SEQ ID NO: 9428523 - DNA, 22 bp, Homo sapiens
gattatcactgggtgtcttgag

SEQ ID NO: 9428524 - DNA, 22 bp, Homo sapiens
gattagtatccttattaagaga

SEQ ID NO: 9428525 - DNA, 22 bp, Homo sapiens
gattatataatggaagctcttg

SEQ ID NO: 9428526 - DNA, 22 bp, Homo sapiens
gattatggtaacaatgattaaa

SEQ ID NO: 9428527 - DNA, 22 bp, Homo sapiens
gattatggagaagaacaatgaa

SEQ ID NO: 9428528 - DNA, 22 bp, Homo sapiens
gattatggatggacagtggagc

SEQ ID NO: 9428529 - DNA, 22 bp, Homo sapiens
gattatggtagaaacaagaagt

SEQ ID NO: 9428530 - DNA, 22 bp, Homo sapiens
gattcaaagttaatgaagatgc

SEQ ID NO: 9428531 - DNA, 22 bp, Homo sapiens
gattcaaagacagactcatttc

SEQ ID NO: 9428532 - DNA, 22 bp, Homo sapiens
gattcaaaagtttgagctccaa

SEQ ID NO: 9428533 - DNA, 22 bp, Homo sapiens
gattcaaaaataagctcctatt

SEQ ID NO: 9428534 - DNA, 22 bp, Homo sapiens
gattattttgtgcaataatcgg

SEQ ID NO: 9428535 - DNA, 20 bp, Homo sapiens
gatgcattagatgcagggta

SEQ ID NO: 9428536 - DNA, 22 bp, Homo sapiens
gatgcattcgggatgtttactt

SEQ ID NO: 9428537 - DNA, 22 bp, Homo sapiens
gatgcctgtggtgagcacacat

SEQ ID NO: 9428538 - DNA, 22 bp, Homo sapiens
gatgcctgtggtgagcacacat

SEQ ID NO: 9428539 - DNA, 22 bp, Homo sapiens
gatgcctgtggtgagcacacat

SEQ ID NO: 9428540 - DNA, 22 bp, Homo sapiens
gatgcctgcatttcaggagagt

SEQ ID NO: 9428541 - DNA, 22 bp, Homo sapiens
gatgcctggcacccagcaagga

SEQ ID NO: 9428542 - DNA, 22 bp, Homo sapiens
gatgcctgcatttcaggagagt

SEQ ID NO: 9428543 - DNA, 22 bp, Homo sapiens
gatgctgagagattggagacta

SEQ ID NO: 9428544 - DNA, 22 bp, Homo sapiens
gatgcgggcccgctccactgcc

SEQ ID NO: 9428545 - DNA, 22 bp, Homo sapiens
gatgcgggcccgctccactgcc

SEQ ID NO: 9428546 - DNA, 22 bp, Homo sapiens
gatgcgggcccgctccactgcc

SEQ ID NO: 9428547 - DNA, 22 bp, Homo sapiens
gatgctaaaataattattttga

SEQ ID NO: 9428548 - DNA, 22 bp, Homo sapiens
gatgctgggaccacagagtgtt

SEQ ID NO: 9428549 - DNA, 22 bp, Homo sapiens
gatgctgggaccacagagtgtt

SEQ ID NO: 9428550 - DNA, 22 bp, Homo sapiens
gatgctgagctgtatggctggt

SEQ ID NO: 9428551 - DNA, 18 bp, Homo sapiens
gatggaaagtgtatgagt

SEQ ID NO: 9428552 - DNA, 22 bp, Homo sapiens
gatggaagaaaaatgcatgtct

SEQ ID NO: 9428553 - DNA, 22 bp, Homo sapiens
gatggaagaaaaatgcatgtct

SEQ ID NO: 9428554 - DNA, 22 bp, Homo sapiens
gatgcttttcttttcagcaaga

SEQ ID NO: 9428555 - DNA, 22 bp, Homo sapiens
gatgcttttcttttcagcaaga

SEQ ID NO: 9428556 - DNA, 22 bp, Homo sapiens
gatgctttctcctttctccacc

SEQ ID NO: 9428557 - DNA, 22 bp, Homo sapiens
gatgctgtgctatgtctacaga

SEQ ID NO: 9428558 - DNA, 22 bp, Homo sapiens
gatgcttacatagcccaagtgt

SEQ ID NO: 9428559 - DNA, 22 bp, Homo sapiens
gatgcttaagatgttggtggca

SEQ ID NO: 9428560 - DNA, 22 bp, Homo sapiens
gatgcttaccgacttacagtgc

SEQ ID NO: 9428561 - DNA, 22 bp, Homo sapiens
gatgctttccaagaaatcctca

SEQ ID NO: 9428562 - DNA, 22 bp, Homo sapiens
gatgctttccaagaaatcctca

SEQ ID NO: 9428563 - DNA, 22 bp, Homo sapiens
gatggaatgtcacttctgtggt

SEQ ID NO: 9428564 - DNA, 22 bp, Homo sapiens
gatggaatgaatggcagataca

SEQ ID NO: 9428565 - DNA, 22 bp, Homo sapiens
gatggacacctcctgaggttct

SEQ ID NO: 9428566 - DNA, 22 bp, Homo sapiens
gatggacagcctggaaggaaag

SEQ ID NO: 9428567 - DNA, 22 bp, Homo sapiens
gatggaatgaatggcagataca

SEQ ID NO: 9428568 - DNA, 22 bp, Homo sapiens
gatggaagaaaaatgcatgtct

SEQ ID NO: 9428569 - DNA, 22 bp, Homo sapiens
gatggaagaaaaatgcatgtct

SEQ ID NO: 9428570 - DNA, 22 bp, Homo sapiens
gatggaggaaaagttggaatgc

SEQ ID NO: 9428571 - DNA, 22 bp, Homo sapiens
gatggaggagatggcagggtgc

SEQ ID NO: 9428572 - DNA, 22 bp, Homo sapiens
gatggaggagatggcagggtgc

SEQ ID NO: 9428573 - DNA, 22 bp, Homo sapiens
gatggcccgctagctggcctct

SEQ ID NO: 9428574 - DNA, 22 bp, Homo sapiens
gatggcctgtatttgggccaga

SEQ ID NO: 9428575 - DNA, 22 bp, Homo sapiens
gatggcggtggccacctccttg

SEQ ID NO: 9428576 - DNA, 22 bp, Homo sapiens
gatggcctgtatttgggccaga

SEQ ID NO: 9428577 - DNA, 22 bp, Homo sapiens
gatggctgccttctccctgtgt

SEQ ID NO: 9428578 - DNA, 22 bp, Homo sapiens
gatggctggagccagtgctttg

SEQ ID NO: 9428579 - DNA, 22 bp, Homo sapiens
gatggctgtcttctccctgtgt

SEQ ID NO: 9428580 - DNA, 18 bp, Homo sapiens
gatgggagcaagagaaga

SEQ ID NO: 9428581 - DNA, 18 bp, Homo sapiens
gatgggagcaagagaaga

SEQ ID NO: 9428582 - DNA, 22 bp, Homo sapiens
gatggcttgcttagtgacagca

SEQ ID NO: 9428583 - DNA, 22 bp, Homo sapiens
gatggcttctgaatcagggcct

SEQ ID NO: 9428584 - DNA, 22 bp, Homo sapiens
gatggcttacagacagttagga

SEQ ID NO: 9428585 - DNA, 22 bp, Homo sapiens
gatgggctggggagaaagcatg

SEQ ID NO: 9428586 - DNA, 22 bp, Homo sapiens
gatgggctgtctgagcgctgtg

SEQ ID NO: 9428587 - DNA, 22 bp, Homo sapiens
gatgggcacggcagtctgagag

SEQ ID NO: 9428588 - DNA, 22 bp, Homo sapiens
gatgtacaagattgtaggaatg

SEQ ID NO: 9428589 - DNA, 22 bp, Homo sapiens
gatgtacaagtaaaatatgtgt

SEQ ID NO: 9428590 - DNA, 22 bp, Homo sapiens
gatgtaaatggtctttggcaga

SEQ ID NO: 9428591 - DNA, 22 bp, Homo sapiens
gatgtaatagatatagattgct

SEQ ID NO: 9428592 - DNA, 22 bp, Homo sapiens
gatgtaaagcttcagagccggc

SEQ ID NO: 9428593 - DNA, 22 bp, Homo sapiens
gatgtaaactgggacttcctag

SEQ ID NO: 9428594 - DNA, 22 bp, Homo sapiens
gatgtaaaattcttggttgtca

SEQ ID NO: 9428595 - DNA, 18 bp, Homo sapiens
gatgtaaaatagtagctt

SEQ ID NO: 9428596 - DNA, 22 bp, Homo sapiens
gatggtgtcccaggctcaggct

SEQ ID NO: 9428597 - DNA, 22 bp, Homo sapiens
gatgtaaaaactcctttcgaaa

SEQ ID NO: 9428598 - DNA, 22 bp, Homo sapiens
gatgtaaaacctatggagctga

SEQ ID NO: 9428599 - DNA, 22 bp, Homo sapiens
gatgggtgggttctgtgagagg

SEQ ID NO: 9428600 - DNA, 21 bp, Homo sapiens
gatggtagcctcatagaagta

SEQ ID NO: 9428601 - DNA, 22 bp, Homo sapiens
gatgggtagaagtggaagaggt

SEQ ID NO: 9428602 - DNA, 22 bp, Homo sapiens
gatggggttttgccaggctggt

SEQ ID NO: 9428603 - DNA, 22 bp, Homo sapiens
gatgggtgccccagacaagctg

SEQ ID NO: 9428604 - DNA, 22 bp, Homo sapiens
gatgggtgccccagacaagctg

SEQ ID NO: 9428605 - DNA, 22 bp, Homo sapiens
gatgggggccagggcctgcttt

SEQ ID NO: 9428606 - DNA, 22 bp, Homo sapiens
gatggggctggctttgagggtt

SEQ ID NO: 9428607 - DNA, 17 bp, Homo sapiens
gatggggctgacatcag

SEQ ID NO: 9428608 - DNA, 22 bp, Homo sapiens
gatggggatgagaagtgagcag

SEQ ID NO: 9428609 - DNA, 22 bp, Homo sapiens
gatggggatgagaagtgagcag

SEQ ID NO: 9428610 - DNA, 22 bp, Homo sapiens
gatgggcttcttccatgaagaa

SEQ ID NO: 9428611 - DNA, 22 bp, Homo sapiens
gatgtctgtctgagccgctgga

SEQ ID NO: 9428612 - DNA, 22 bp, Homo sapiens
gatgtcttaagcccagaagttc

SEQ ID NO: 9428613 - DNA, 22 bp, Homo sapiens
gatgtctgtgagatcaaactaa

SEQ ID NO: 9428614 - DNA, 22 bp, Homo sapiens
gatgtctgggtcttcctggctt

SEQ ID NO: 9428615 - DNA, 22 bp, Homo sapiens
gatgtctgggtgaggtctactg

SEQ ID NO: 9428616 - DNA, 22 bp, Homo sapiens
gatgtctgggtcttcctggctt

SEQ ID NO: 9428617 - DNA, 22 bp, Homo sapiens
gatgtctctgactaaggcagtg

SEQ ID NO: 9428618 - DNA, 22 bp, Homo sapiens
gatgtcttactaactagccttt

SEQ ID NO: 9428619 - DNA, 22 bp, Homo sapiens
gatgtcttactaactagccttt

SEQ ID NO: 9428620 - DNA, 22 bp, Homo sapiens
gatgtgtccccagaggattgaa

SEQ ID NO: 9428621 - DNA, 22 bp, Homo sapiens
gatgtgtgcttttcgcagtgtc

SEQ ID NO: 9428622 - DNA, 22 bp, Homo sapiens
gatgtgtctggctcccctgcaa

SEQ ID NO: 9428623 - DNA, 22 bp, Homo sapiens
gatgtgtctccgtttcaaggca

SEQ ID NO: 9428624 - DNA, 22 bp, Homo sapiens
gatgtgtctccatacaccaccc

SEQ ID NO: 9428625 - DNA, 20 bp, Homo sapiens
gatgtgtcctcagcagtggt

SEQ ID NO: 9428626 - DNA, 22 bp, Homo sapiens
gatgtgtcctagtacgggtggg

SEQ ID NO: 9428627 - DNA, 22 bp, Homo sapiens
gatgtgtccctttcaactcaga

SEQ ID NO: 9428628 - DNA, 22 bp, Homo sapiens
gatgtgtctattcaacatgaaa

SEQ ID NO: 9428629 - DNA, 22 bp, Homo sapiens
gatgtgtccttttctccatcca

SEQ ID NO: 9428630 - DNA, 22 bp, Homo sapiens
gatgtacactcagaaaagtcat

SEQ ID NO: 9428631 - DNA, 22 bp, Homo sapiens
gatgtacaggagtttttcaagg

SEQ ID NO: 9428632 - DNA, 22 bp, Homo sapiens
gatgtagattcatatgtggtgt

SEQ ID NO: 9428633 - DNA, 22 bp, Homo sapiens
gatgtagacacttggaggctta

SEQ ID NO: 9428634 - DNA, 22 bp, Homo sapiens
gatgtacttgccttatctatcc

SEQ ID NO: 9428635 - DNA, 22 bp, Homo sapiens
gatgtactttaaaatacttcag

SEQ ID NO: 9428636 - DNA, 22 bp, Homo sapiens
gatgtcctttgagggtatctgt

SEQ ID NO: 9428637 - DNA, 17 bp, Homo sapiens
gatgtcctctggactac

SEQ ID NO: 9428638 - DNA, 22 bp, Homo sapiens
gatgtcctgcagaaacatgaga

SEQ ID NO: 9428639 - DNA, 18 bp, Homo sapiens
gatgtctcgaggagacta

SEQ ID NO: 9428640 - DNA, 22 bp, Homo sapiens
gatgtctctcacatagaaggta

SEQ ID NO: 9428641 - DNA, 18 bp, Homo sapiens
gatgtctcgaggagacta

SEQ ID NO: 9428642 - DNA, 22 bp, Homo sapiens
gatgtcctatttccatactgta

SEQ ID NO: 9428643 - DNA, 22 bp, Homo sapiens
gatgtcatcaggctaagacact

SEQ ID NO: 9428644 - DNA, 22 bp, Homo sapiens
gatgtatagtatgtaatttctg

SEQ ID NO: 9428645 - DNA, 22 bp, Homo sapiens
gatgtatacttttctttctctg

SEQ ID NO: 9428646 - DNA, 22 bp, Homo sapiens
gatgtatagggccatgacacca

SEQ ID NO: 9428647 - DNA, 22 bp, Homo sapiens
gctctgaggctgtgaggtgctg

SEQ ID NO: 9428648 - DNA, 22 bp, Homo sapiens
gctctgagtaaatgaaagcatt

SEQ ID NO: 9428649 - DNA, 22 bp, Homo sapiens
gctctgaggctgggagcactct

SEQ ID NO: 9428650 - DNA, 22 bp, Homo sapiens
gctctgaggctgggagcactct

SEQ ID NO: 9428651 - DNA, 22 bp, Homo sapiens
gctctgaggagccaagaatgtg

SEQ ID NO: 9428652 - DNA, 22 bp, Homo sapiens
gctctgaggagccaagaatgtg

SEQ ID NO: 9428653 - DNA, 22 bp, Homo sapiens
gctctgagcccccagaagcaga

SEQ ID NO: 9428654 - DNA, 22 bp, Homo sapiens
gctctgagcccccagaagcaga

SEQ ID NO: 9428655 - DNA, 22 bp, Homo sapiens
gctctgagccgggggcctgtcc

SEQ ID NO: 9428656 - DNA, 22 bp, Homo sapiens
gctctgagccgggggcctgtcc

SEQ ID NO: 9428657 - DNA, 23 bp, Homo sapiens
gctctgaggaagttgggcacggg

SEQ ID NO: 9428658 - DNA, 22 bp, Homo sapiens
gctctgaggaccaattcctgtg

SEQ ID NO: 9428659 - DNA, 22 bp, Homo sapiens
gctctgagctgtcttgcaggtc

SEQ ID NO: 9428660 - DNA, 22 bp, Homo sapiens
gctctgagctcagcgtcagagt

SEQ ID NO: 9428661 - DNA, 22 bp, Homo sapiens
gctctgagtgatcagctgggaa

SEQ ID NO: 9428662 - DNA, 22 bp, Homo sapiens
gctctgagtctcagctaccaca

SEQ ID NO: 9428663 - DNA, 22 bp, Homo sapiens
gctctgagtcacactgccctgt

SEQ ID NO: 9428664 - DNA, 22 bp, Homo sapiens
gctctgagtgattaaggagctt

SEQ ID NO: 9428665 - DNA, 22 bp, Homo sapiens
gctctgagtgatcagctgggaa

SEQ ID NO: 9428666 - DNA, 23 bp, Homo sapiens
gctctgccacttaatagctgtgt

SEQ ID NO: 9428667 - DNA, 21 bp, Homo sapiens
gctctgccacttaccagattt

SEQ ID NO: 9428668 - DNA, 22 bp, Homo sapiens
gctctcttggtggctgtcctgg

SEQ ID NO: 9428669 - DNA, 22 bp, Homo sapiens
gctctctttaaactgcatggct

SEQ ID NO: 9428670 - DNA, 22 bp, Homo sapiens
gctctgagcagggagaaacagg

SEQ ID NO: 9428671 - DNA, 22 bp, Homo sapiens
gctctgagcactgtgcggctgg

SEQ ID NO: 9428672 - DNA, 22 bp, Homo sapiens
gctctgagcactgtgcggctgg

SEQ ID NO: 9428673 - DNA, 16 bp, Homo sapiens
gctcctgggccctcga

SEQ ID NO: 9428674 - DNA, 16 bp, Homo sapiens
gctcctgggccctcga

SEQ ID NO: 9428675 - DNA, 22 bp, Homo sapiens
gctcctggctctctgagggctg

SEQ ID NO: 9428676 - DNA, 22 bp, Homo sapiens
gctcctggctctggccaaggga

SEQ ID NO: 9428677 - DNA, 22 bp, Homo sapiens
gctcctggctctggccaaggga

SEQ ID NO: 9428678 - DNA, 22 bp, Homo sapiens
gctcctggcttcactgacatca

SEQ ID NO: 9428679 - DNA, 22 bp, Homo sapiens
gctcctggctctggccaaggga

SEQ ID NO: 9428680 - DNA, 22 bp, Homo sapiens
gctgaaatgggcactgaaggcc

SEQ ID NO: 9428681 - DNA, 18 bp, Homo sapiens
gctgagcaaattcctccc

SEQ ID NO: 9428682 - DNA, 22 bp, Homo sapiens
gctgagcaacgtggagagtttt

SEQ ID NO: 9428683 - DNA, 22 bp, Homo sapiens
gctgagcaacgtggagagtttt

SEQ ID NO: 9428684 - DNA, 22 bp, Homo sapiens
gctgagcacacctagggtagag

SEQ ID NO: 9428685 - DNA, 22 bp, Homo sapiens
gctgagcacagcaaagagacaa

SEQ ID NO: 9428686 - DNA, 20 bp, Homo sapiens
gctgaagaagtagcatgtac

SEQ ID NO: 9428687 - DNA, 21 bp, Homo sapiens
gctgaagaactctttattttc

SEQ ID NO: 9428688 - DNA, 22 bp, Homo sapiens
gctgagagtgggtgcagtgctt

SEQ ID NO: 9428689 - DNA, 22 bp, Homo sapiens
gctgagagtgggtgcagtgctt

SEQ ID NO: 9428690 - DNA, 22 bp, Homo sapiens
gctgagagtgggtgcagtgctt

SEQ ID NO: 9428691 - DNA, 22 bp, Homo sapiens
gctgagagtgtgagatcagatt

SEQ ID NO: 9428692 - DNA, 22 bp, Homo sapiens
gctgagagtgtaggatgtttac

SEQ ID NO: 9428693 - DNA, 22 bp, Homo sapiens
gctctgtgttccctccaggctc

SEQ ID NO: 9428694 - DNA, 21 bp, Homo sapiens
gctctgttattttctatgcag

SEQ ID NO: 9428695 - DNA, 22 bp, Homo sapiens
gctctgttgaagtagaatagac

SEQ ID NO: 9428696 - DNA, 22 bp, Homo sapiens
gctctgtttatccctgacaatt

SEQ ID NO: 9428697 - DNA, 22 bp, Homo sapiens
gctcttctcagattgtacactc

SEQ ID NO: 9428698 - DNA, 22 bp, Homo sapiens
gctcttctaaagaatgtacagg

SEQ ID NO: 9428699 - DNA, 22 bp, Homo sapiens
gctcttctaaagaatgtacagg

SEQ ID NO: 9428700 - DNA, 22 bp, Homo sapiens
gctctgtgttccctccaggctc

SEQ ID NO: 9428701 - DNA, 22 bp, Homo sapiens
gctctgtgtccacagctggaaa

SEQ ID NO: 9428702 - DNA, 22 bp, Homo sapiens
gctctgcccaaagctgtggctg

SEQ ID NO: 9428703 - DNA, 22 bp, Homo sapiens
gctctgcccaaagctgtggctg

SEQ ID NO: 9428704 - DNA, 17 bp, Homo sapiens
gctctgccaggaaagag

SEQ ID NO: 9428705 - DNA, 19 bp, Homo sapiens
gctctgccagtggtaacat

SEQ ID NO: 9428706 - DNA, 21 bp, Homo sapiens
gctctgccacttaccagattt

SEQ ID NO: 9428707 - DNA, 20 bp, Homo sapiens
gctctgccacttagaagctg

SEQ ID NO: 9428708 - DNA, 22 bp, Homo sapiens
gctctgccagacactgtggcca

SEQ ID NO: 9428709 - DNA, 22 bp, Homo sapiens
gctctgccagacactgtggcca

SEQ ID NO: 9428710 - DNA, 22 bp, Homo sapiens
gctccaggagctcacagctcgc

SEQ ID NO: 9428711 - DNA, 22 bp, Homo sapiens
gctccaggagagggaagcagat

SEQ ID NO: 9428712 - DNA, 22 bp, Homo sapiens
gctccaggagagggaagcagat

SEQ ID NO: 9428713 - DNA, 22 bp, Homo sapiens
gctccaggagctcacagctcgc

SEQ ID NO: 9428714 - DNA, 22 bp, Homo sapiens
gctccaggagctcacagctcgc

SEQ ID NO: 9428715 - DNA, 22 bp, Homo sapiens
gctcctctcccagagctgcagg

SEQ ID NO: 9428716 - DNA, 22 bp, Homo sapiens
gctccaggaggatgaccttcct

SEQ ID NO: 9428717 - DNA, 22 bp, Homo sapiens
gctccaggaggatgaccttcct

SEQ ID NO: 9428718 - DNA, 22 bp, Homo sapiens
gctcctctgtcaaatgagagtg

SEQ ID NO: 9428719 - DNA, 22 bp, Homo sapiens
gctcctggctccaggcagccaa

SEQ ID NO: 9428720 - DNA, 22 bp, Homo sapiens
gctcctggctccaggcagccaa

SEQ ID NO: 9428721 - DNA, 22 bp, Homo sapiens
gctcctggctccaggcagccaa

SEQ ID NO: 9428722 - DNA, 22 bp, Homo sapiens
gctcctggctctctgagggctg

SEQ ID NO: 9428723 - DNA, 22 bp, Homo sapiens
gctcctggctctctgagggctg

SEQ ID NO: 9428724 - DNA, 22 bp, Homo sapiens
gctcctggctctctgagggctg

SEQ ID NO: 9428725 - DNA, 22 bp, Homo sapiens
gctcctggcatcctgcttttaa

SEQ ID NO: 9428726 - DNA, 22 bp, Homo sapiens
gctcctggcaggcagtgtgtgt

SEQ ID NO: 9428727 - DNA, 22 bp, Homo sapiens
gctcctggccagcacagggccc

SEQ ID NO: 9428728 - DNA, 22 bp, Homo sapiens
gctcctggccagcacagggccc

SEQ ID NO: 9428729 - DNA, 22 bp, Homo sapiens
gctcctggccagcacagggccc

SEQ ID NO: 9428730 - DNA, 22 bp, Homo sapiens
gctcctggccagcacagggccc

SEQ ID NO: 9428731 - DNA, 22 bp, Homo sapiens
gctccaggaagggaaatctcca

SEQ ID NO: 9428732 - DNA, 22 bp, Homo sapiens
gctccaggagagggaagcagat

SEQ ID NO: 9428733 - DNA, 22 bp, Homo sapiens
gctccaggagagggaagcagat

SEQ ID NO: 9428734 - DNA, 22 bp, Homo sapiens
gctccagctcgtggctcccagc

SEQ ID NO: 9428735 - DNA, 22 bp, Homo sapiens
gctccagctcgtggctcccagc

SEQ ID NO: 9428736 - DNA, 22 bp, Homo sapiens
gctccagcacctagagcaggtc

SEQ ID NO: 9428737 - DNA, 22 bp, Homo sapiens
gctccagcacctagagcaggtc

SEQ ID NO: 9428738 - DNA, 22 bp, Homo sapiens
gctccagccacatggtagaagg

SEQ ID NO: 9428739 - DNA, 22 bp, Homo sapiens
gctccagccacatggtagaagg

SEQ ID NO: 9428740 - DNA, 22 bp, Homo sapiens
gctccagctccggctccgaagc

SEQ ID NO: 9428741 - DNA, 22 bp, Homo sapiens
gctccagagcagagactaggtt

SEQ ID NO: 9428742 - DNA, 22 bp, Homo sapiens
gctccactgtttattggcagaa

SEQ ID NO: 9428743 - DNA, 22 bp, Homo sapiens
gctccacttccttctgccctca

SEQ ID NO: 9428744 - DNA, 22 bp, Homo sapiens
gctccactgcccctgggcaccg

SEQ ID NO: 9428745 - DNA, 22 bp, Homo sapiens
gctccacttgcagctaggcttg

SEQ ID NO: 9428746 - DNA, 22 bp, Homo sapiens
gctccacaaataatggaacctg

SEQ ID NO: 9428747 - DNA, 22 bp, Homo sapiens
gctccaaggtatccaccagggt

SEQ ID NO: 9428748 - DNA, 22 bp, Homo sapiens
gctccactaggaatctgctctt

SEQ ID NO: 9428749 - DNA, 22 bp, Homo sapiens
gctccactaggaatctgctctt

SEQ ID NO: 9428750 - DNA, 22 bp, Homo sapiens
gctccacaaataatggaacctg

SEQ ID NO: 9428751 - DNA, 22 bp, Homo sapiens
gctccaaagtccagctgtttcc

SEQ ID NO: 9428752 - DNA, 22 bp, Homo sapiens
gctccaaagtacagtgacttac

SEQ ID NO: 9428753 - DNA, 22 bp, Homo sapiens
gctcagaaaagtgaggctcagt

SEQ ID NO: 9428754 - DNA, 22 bp, Homo sapiens
gctcagaccccaccctggcaga

SEQ ID NO: 9428755 - DNA, 22 bp, Homo sapiens
gctcagagatggggaatgaaaa

SEQ ID NO: 9428756 - DNA, 22 bp, Homo sapiens
gctcagactctggcctgatgat

SEQ ID NO: 9428757 - DNA, 22 bp, Homo sapiens
gctcagagatgtctgctgcctt

SEQ ID NO: 9428758 - DNA, 22 bp, Homo sapiens
gctcatgactgtaatcccagca

SEQ ID NO: 9428759 - DNA, 22 bp, Homo sapiens
gctcatgactgtaatcccagca

SEQ ID NO: 9428760 - DNA, 22 bp, Homo sapiens
gctcatgactgtaatcccagca

SEQ ID NO: 9428761 - DNA, 22 bp, Homo sapiens
gctcatgactgtaatcccagca

SEQ ID NO: 9428762 - DNA, 22 bp, Homo sapiens
gctcatgactgtaatcccagca

SEQ ID NO: 9428763 - DNA, 23 bp, Homo sapiens
gctcatctagaatggtttcagct

SEQ ID NO: 9428764 - DNA, 22 bp, Homo sapiens
gctcatctggggctttcagctt

SEQ ID NO: 9428765 - DNA, 22 bp, Homo sapiens
gctcagagcactcagactcagc

SEQ ID NO: 9428766 - DNA, 22 bp, Homo sapiens
gctcagagcccgaggcttgcat

SEQ ID NO: 9428767 - DNA, 20 bp, Homo sapiens
gctcagagcctgaacttcat

SEQ ID NO: 9428768 - DNA, 22 bp, Homo sapiens
gcctgttttagatgcattgatg

SEQ ID NO: 9428769 - DNA, 22 bp, Homo sapiens
gctcactgcaacctctgcttcc

SEQ ID NO: 9428770 - DNA, 22 bp, Homo sapiens
gctcactgcaacctctgcctcc

SEQ ID NO: 9428771 - DNA, 22 bp, Homo sapiens
gctcactgcaacctctgcctcc

SEQ ID NO: 9428772 - DNA, 22 bp, Homo sapiens
gctcactgcaacctctgcctcc

SEQ ID NO: 9428773 - DNA, 22 bp, Homo sapiens
gctcactgccattctctagatg

SEQ ID NO: 9428774 - DNA, 22 bp, Homo sapiens
gctcactggcctgaagaggacg

SEQ ID NO: 9428775 - DNA, 22 bp, Homo sapiens
gctcactgcaagctctgcctcc

SEQ ID NO: 9428776 - DNA, 22 bp, Homo sapiens
gctcactgcaagctctgcctcc

SEQ ID NO: 9428777 - DNA, 22 bp, Homo sapiens
gctcactgcaagctctgcctcc

SEQ ID NO: 9428778 - DNA, 22 bp, Homo sapiens
gctgggcagcaggctctccggg

SEQ ID NO: 9428779 - DNA, 22 bp, Homo sapiens
gctgggcagcaggctctccggg

SEQ ID NO: 9428780 - DNA, 22 bp, Homo sapiens
gctgggcagcctggccgctgcc

SEQ ID NO: 9428781 - DNA, 22 bp, Homo sapiens
gctgggcagcctggccgctgcc

SEQ ID NO: 9428782 - DNA, 22 bp, Homo sapiens
gctgggcagcctggccgctgcc

SEQ ID NO: 9428783 - DNA, 22 bp, Homo sapiens
gctgggcagcctggccgctgcc

SEQ ID NO: 9428784 - DNA, 22 bp, Homo sapiens
gctgggcagctgaggcctctca

SEQ ID NO: 9428785 - DNA, 22 bp, Homo sapiens
gctgggcagctgaggcctctca

SEQ ID NO: 9428786 - DNA, 22 bp, Homo sapiens
gctgggcagctgaggcctctca

SEQ ID NO: 9428787 - DNA, 22 bp, Homo sapiens
gctgggcagctgaggcctctca

SEQ ID NO: 9428788 - DNA, 22 bp, Homo sapiens
gctgggcaggcctcgtgagggc

SEQ ID NO: 9428789 - DNA, 22 bp, Homo sapiens
gctgggcaggcctcgtgagggc

SEQ ID NO: 9428790 - DNA, 22 bp, Homo sapiens
gctgggcaggcctcgtgagggc

SEQ ID NO: 9428791 - DNA, 22 bp, Homo sapiens
gctgggcaagtgccttgggttt

SEQ ID NO: 9428792 - DNA, 22 bp, Homo sapiens
gctgggcaaggctgaagctacc

SEQ ID NO: 9428793 - DNA, 22 bp, Homo sapiens
gctgggcaacgggcagaaagat

SEQ ID NO: 9428794 - DNA, 22 bp, Homo sapiens
gctgggcaacggaagagagaaa

SEQ ID NO: 9428795 - DNA, 22 bp, Homo sapiens
gctgggcaatgccagagaggag

SEQ ID NO: 9428796 - DNA, 22 bp, Homo sapiens
gctgggcaatgccagagaggag

SEQ ID NO: 9428797 - DNA, 22 bp, Homo sapiens
gctgggcactgtcccataggct

SEQ ID NO: 9428798 - DNA, 22 bp, Homo sapiens
gctgggcactgtcccataggct

SEQ ID NO: 9428799 - DNA, 22 bp, Homo sapiens
gctggccttgtgtctgaggaag

SEQ ID NO: 9428800 - DNA, 22 bp, Homo sapiens
gctggccttgtgtctgaggaag

SEQ ID NO: 9428801 - DNA, 22 bp, Homo sapiens
gctggccttgtgtctgaggaag

SEQ ID NO: 9428802 - DNA, 22 bp, Homo sapiens
gctggccttgaggtgtctttat

SEQ ID NO: 9428803 - DNA, 22 bp, Homo sapiens
gctggcctgggctcaagaccag

SEQ ID NO: 9428804 - DNA, 22 bp, Homo sapiens
gctggccttctgcagagttctg

SEQ ID NO: 9428805 - DNA, 22 bp, Homo sapiens
gctggcctgggcagcctgtcgg

SEQ ID NO: 9428806 - DNA, 22 bp, Homo sapiens
gctggcctgggcagcctgtcgg

SEQ ID NO: 9428807 - DNA, 22 bp, Homo sapiens
gctggcctgctgggcaccaccg

SEQ ID NO: 9428808 - DNA, 22 bp, Homo sapiens
gctggcctgctgggcaccaccg

SEQ ID NO: 9428809 - DNA, 22 bp, Homo sapiens
gctggcctgcgagggcaggctg

SEQ ID NO: 9428810 - DNA, 22 bp, Homo sapiens
gctggcctgcgagggcaggctg

SEQ ID NO: 9428811 - DNA, 22 bp, Homo sapiens
gctggcctgcgagggcaggctg

SEQ ID NO: 9428812 - DNA, 22 bp, Homo sapiens
gctgggagttactgtctccttt

SEQ ID NO: 9428813 - DNA, 22 bp, Homo sapiens
gctgggatggagactgcagtga

SEQ ID NO: 9428814 - DNA, 22 bp, Homo sapiens
gctgggatgcgtcttcccaggc

SEQ ID NO: 9428815 - DNA, 22 bp, Homo sapiens
gctgggatgcgtcttcccaggc

SEQ ID NO: 9428816 - DNA, 22 bp, Homo sapiens
gctgggagtgggcaagatgaga

SEQ ID NO: 9428817 - DNA, 22 bp, Homo sapiens
gctgggagtgggcaagatgaga

SEQ ID NO: 9428818 - DNA, 22 bp, Homo sapiens
gctgggagtgggcaagatgaga

SEQ ID NO: 9428819 - DNA, 22 bp, Homo sapiens
gctggcggcagtggtgtctctg

SEQ ID NO: 9428820 - DNA, 22 bp, Homo sapiens
gctggcctttgaggaagctgcg

SEQ ID NO: 9428821 - DNA, 22 bp, Homo sapiens
gctggcctttgaggaagctgcg

SEQ ID NO: 9428822 - DNA, 22 bp, Homo sapiens
gctggcctcctgctagatggaa

SEQ ID NO: 9428823 - DNA, 22 bp, Homo sapiens
gctggccgaacggtgccctggc

SEQ ID NO: 9428824 - DNA, 22 bp, Homo sapiens
gctggcccagggtcacctagga

SEQ ID NO: 9428825 - DNA, 22 bp, Homo sapiens
gctggcccagtgacccacagtg

SEQ ID NO: 9428826 - DNA, 22 bp, Homo sapiens
gctggccccgagtgctacgctc

SEQ ID NO: 9428827 - DNA, 22 bp, Homo sapiens
gctggccccgagtgctacgctc

SEQ ID NO: 9428828 - DNA, 22 bp, Homo sapiens
gctggagctgcagcctgggcct

SEQ ID NO: 9428829 - DNA, 22 bp, Homo sapiens
gctggccagggctgctcgcgga

SEQ ID NO: 9428830 - DNA, 22 bp, Homo sapiens
gctggccagtgtcccagggatc

SEQ ID NO: 9428831 - DNA, 22 bp, Homo sapiens
gctggcccagggtcacctagga

SEQ ID NO: 9428832 - DNA, 22 bp, Homo sapiens
gctggcctgaccagccacaggc

SEQ ID NO: 9428833 - DNA, 22 bp, Homo sapiens
gctggcctctggagaagggctt

SEQ ID NO: 9428834 - DNA, 22 bp, Homo sapiens
gctggcctctggagaagggctt

SEQ ID NO: 9428835 - DNA, 22 bp, Homo sapiens
gctggcctctacaggccggcca

SEQ ID NO: 9428836 - DNA, 22 bp, Homo sapiens
gctggcctctggagaagggctt

SEQ ID NO: 9428837 - DNA, 22 bp, Homo sapiens
gctggcctctacaggccggcca

SEQ ID NO: 9428838 - DNA, 22 bp, Homo sapiens
gctggcctctacaggccggcca

SEQ ID NO: 9428839 - DNA, 22 bp, Homo sapiens
gctggcctcgcaggcaggatgt

SEQ ID NO: 9428840 - DNA, 22 bp, Homo sapiens
gctggcctcgcaggcaggatgt

SEQ ID NO: 9428841 - DNA, 22 bp, Homo sapiens
gctggcctgagggccgaggctc

SEQ ID NO: 9428842 - DNA, 22 bp, Homo sapiens
gctggcctgagggccgaggctc

SEQ ID NO: 9428843 - DNA, 22 bp, Homo sapiens
gctggcctgcaaagcccggctg

SEQ ID NO: 9428844 - DNA, 22 bp, Homo sapiens
gctggcctgacctgaggctggg

SEQ ID NO: 9428845 - DNA, 22 bp, Homo sapiens
gctggcctgacctgaggctggg

SEQ ID NO: 9428846 - DNA, 22 bp, Homo sapiens
gctggcctgagggccgaggctc

SEQ ID NO: 9428847 - DNA, 22 bp, Homo sapiens
gctggcctgacctgaggctggg

SEQ ID NO: 9428848 - DNA, 22 bp, Homo sapiens
gctggcctgacctgaggctggg

SEQ ID NO: 9428849 - DNA, 22 bp, Homo sapiens
gctggcctgacctgaggctggg

SEQ ID NO: 9428850 - DNA, 22 bp, Homo sapiens
gctggcctgacctgaggctggg

SEQ ID NO: 9428851 - DNA, 22 bp, Homo sapiens
gctggcctgacctgaggctggg

SEQ ID NO: 9428852 - DNA, 22 bp, Homo sapiens
gctggcctgaccagccacaggc

SEQ ID NO: 9428853 - DNA, 22 bp, Homo sapiens
gctggagatgctatgcagaggg

SEQ ID NO: 9428854 - DNA, 22 bp, Homo sapiens
gctggagatgctatgcagaggg

SEQ ID NO: 9428855 - DNA, 22 bp, Homo sapiens
gctggagatgctatgcagaggg

SEQ ID NO: 9428856 - DNA, 22 bp, Homo sapiens
gctggagatgctatgcagaggg

SEQ ID NO: 9428857 - DNA, 22 bp, Homo sapiens
gctggagctgagttccctgggc

SEQ ID NO: 9428858 - DNA, 22 bp, Homo sapiens
gctggagccttctgctctgttg

SEQ ID NO: 9428859 - DNA, 22 bp, Homo sapiens
gctggagcgggttcgggccgct

SEQ ID NO: 9428860 - DNA, 22 bp, Homo sapiens
gctggagcgggttcgggccgct

SEQ ID NO: 9428861 - DNA, 22 bp, Homo sapiens
gctggagcgggttcgggccgct

SEQ ID NO: 9428862 - DNA, 22 bp, Homo sapiens
gctggagatagtaggatccata

SEQ ID NO: 9428863 - DNA, 22 bp, Homo sapiens
gctggagatagtaggatccata

SEQ ID NO: 9428864 - DNA, 22 bp, Homo sapiens
gctggagatagtaggatccata

SEQ ID NO: 9428865 - DNA, 22 bp, Homo sapiens
gctggagatagaatggccactg

SEQ ID NO: 9428866 - DNA, 22 bp, Homo sapiens
gctggagatagaatggccactg

SEQ ID NO: 9428867 - DNA, 22 bp, Homo sapiens
gctggagatagaatggccactg

SEQ ID NO: 9428868 - DNA, 22 bp, Homo sapiens
gctggagatactgctcagtatc

SEQ ID NO: 9428869 - DNA, 22 bp, Homo sapiens
gctggagatactgctcagtatc

SEQ ID NO: 9428870 - DNA, 22 bp, Homo sapiens
gctggagagtagtaagcagtta

SEQ ID NO: 9428871 - DNA, 22 bp, Homo sapiens
gctggagagtagtaagcagtta

SEQ ID NO: 9428872 - DNA, 22 bp, Homo sapiens
gctggagaggggtcactctgag

SEQ ID NO: 9428873 - DNA, 22 bp, Homo sapiens
gctggagaggggtcactctgag

SEQ ID NO: 9428874 - DNA, 22 bp, Homo sapiens
gctggagatactgctcagtatc

SEQ ID NO: 9428875 - DNA, 22 bp, Homo sapiens
gctggagatactgctcagtatc

SEQ ID NO: 9428876 - DNA, 22 bp, Homo sapiens
gctggagagtgaggggagcaag

SEQ ID NO: 9428877 - DNA, 22 bp, Homo sapiens
gctgctctcagagctcatgctg

SEQ ID NO: 9428878 - DNA, 22 bp, Homo sapiens
gctgctctcagagctcatgctg

SEQ ID NO: 9428879 - DNA, 22 bp, Homo sapiens
gctgctctcatagatggcttca

SEQ ID NO: 9428880 - DNA, 22 bp, Homo sapiens
gctgctctccaagcctccttga

SEQ ID NO: 9428881 - DNA, 22 bp, Homo sapiens
gctgctctccaagcctccttga

SEQ ID NO: 9428882 - DNA, 20 bp, Homo sapiens
gctgctctccacggtctgca

SEQ ID NO: 9428883 - DNA, 22 bp, Homo sapiens
gctgctctccatggccgtgagt

SEQ ID NO: 9428884 - DNA, 22 bp, Homo sapiens
gctgctctggctctgcagtgtc

SEQ ID NO: 9428885 - DNA, 22 bp, Homo sapiens
gctgctctggctctgcagtgtc

SEQ ID NO: 9428886 - DNA, 19 bp, Homo sapiens
gctgctctgggtctcatct

SEQ ID NO: 9428887 - DNA, 22 bp, Homo sapiens
gctgctctgaaaatgactgttg

SEQ ID NO: 9428888 - DNA, 22 bp, Homo sapiens
gctgctctgaaaatgactgttg

SEQ ID NO: 9428889 - DNA, 22 bp, Homo sapiens
gctgctctctccctaagttggg

SEQ ID NO: 9428890 - DNA, 22 bp, Homo sapiens
gctgcctgggcaggaggcgctg

SEQ ID NO: 9428891 - DNA, 22 bp, Homo sapiens
gctgcctgggcaggaggcgctg

SEQ ID NO: 9428892 - DNA, 22 bp, Homo sapiens
gctgcctgggcaggaggcgctg

SEQ ID NO: 9428893 - DNA, 22 bp, Homo sapiens
gctgcctgggctggcattccca

SEQ ID NO: 9428894 - DNA, 22 bp, Homo sapiens
gctgcctggtttctcagctgca

SEQ ID NO: 9428895 - DNA, 22 bp, Homo sapiens
gctgcctgggctggcattccca

SEQ ID NO: 9428896 - DNA, 22 bp, Homo sapiens
gctgcctgggctggcattccca

SEQ ID NO: 9428897 - DNA, 22 bp, Homo sapiens
gctgcctgtcccaggatgagga

SEQ ID NO: 9428898 - DNA, 22 bp, Homo sapiens
gctgcctggtttctcagctgca

SEQ ID NO: 9428899 - DNA, 22 bp, Homo sapiens
gctgcctggtttctcagctgca

SEQ ID NO: 9428900 - DNA, 22 bp, Homo sapiens
gctgcctggtttctcagctgca

SEQ ID NO: 9428901 - DNA, 22 bp, Homo sapiens
gctgcctgtcccaggatgagga

SEQ ID NO: 9428902 - DNA, 22 bp, Homo sapiens
gctgctctacccatgcatctgt

SEQ ID NO: 9428903 - DNA, 22 bp, Homo sapiens
gctgctctacccatgcatctgt

SEQ ID NO: 9428904 - DNA, 21 bp, Homo sapiens
gctgctgcccctagtgaggcc

SEQ ID NO: 9428905 - DNA, 22 bp, Homo sapiens
gctgctgatgggcagggagtcg

SEQ ID NO: 9428906 - DNA, 22 bp, Homo sapiens
gctgctgcaagagccagctctt

SEQ ID NO: 9428907 - DNA, 22 bp, Homo sapiens
gctgctcttgaggggctcactg

SEQ ID NO: 9428908 - DNA, 22 bp, Homo sapiens
gctgctgagaattgcaggcaag

SEQ ID NO: 9428909 - DNA, 22 bp, Homo sapiens
gctgctctgtgacagcctccgg

SEQ ID NO: 9428910 - DNA, 22 bp, Homo sapiens
gctgctcttgaggggctcactg

SEQ ID NO: 9428911 - DNA, 22 bp, Homo sapiens
gctgctcttgaggggctcactg

SEQ ID NO: 9428912 - DNA, 22 bp, Homo sapiens
gctgctctgtgacagcctccgg

SEQ ID NO: 9428913 - DNA, 22 bp, Homo sapiens
gctgctctgtgacagcctccgg

SEQ ID NO: 9428914 - DNA, 19 bp, Homo sapiens
gctgctgctcctccctcgc

SEQ ID NO: 9428915 - DNA, 19 bp, Homo sapiens
gctgctgctcctccctcgc

SEQ ID NO: 9428916 - DNA, 22 bp, Homo sapiens
gctgctgcgcttgtctactgtt

SEQ ID NO: 9428917 - DNA, 22 bp, Homo sapiens
gctgctgccgcggccgctggga

SEQ ID NO: 9428918 - DNA, 22 bp, Homo sapiens
gctgctgcctgtagccagggtg

SEQ ID NO: 9428919 - DNA, 16 bp, Homo sapiens
gctgctgcttcctgct

SEQ ID NO: 9428920 - DNA, 21 bp, Homo sapiens
gctggagagccaggcaggggc

SEQ ID NO: 9428921 - DNA, 21 bp, Homo sapiens
gctggagagccaggcaggggc

SEQ ID NO: 9428922 - DNA, 21 bp, Homo sapiens
gctggagagccaggcaggggc

SEQ ID NO: 9428923 - DNA, 22 bp, Homo sapiens
gctggagaggatcccaaagcca

SEQ ID NO: 9428924 - DNA, 21 bp, Homo sapiens
gctggagagccaggcaggggc

SEQ ID NO: 9428925 - DNA, 22 bp, Homo sapiens
gctggagaggggtcactctgag

SEQ ID NO: 9428926 - DNA, 22 bp, Homo sapiens
gctggagaggggtcactctgag

SEQ ID NO: 9428927 - DNA, 22 bp, Homo sapiens
gctgcctggctttagtccactt

SEQ ID NO: 9428928 - DNA, 22 bp, Homo sapiens
gctgcctggctttagtccactt

SEQ ID NO: 9428929 - DNA, 22 bp, Homo sapiens
gctgcctgggcaggaggcgctg

SEQ ID NO: 9428930 - DNA, 22 bp, Homo sapiens
gctgcctgggcaggaggcgctg

SEQ ID NO: 9428931 - DNA, 22 bp, Homo sapiens
gctgcctgggcaggaggcgctg

SEQ ID NO: 9428932 - DNA, 22 bp, Homo sapiens
gctgcctggctgatgaaaattc

SEQ ID NO: 9428933 - DNA, 22 bp, Homo sapiens
gctgcctggatttgcaatcctc

SEQ ID NO: 9428934 - DNA, 22 bp, Homo sapiens
gctgcctggatttgcaatcctc

SEQ ID NO: 9428935 - DNA, 22 bp, Homo sapiens
gctgcctggagctcagcctgcc

SEQ ID NO: 9428936 - DNA, 22 bp, Homo sapiens
gctgcctggagctcagcctgcc

SEQ ID NO: 9428937 - DNA, 22 bp, Homo sapiens
gctgcctggaataacggctggc

SEQ ID NO: 9428938 - DNA, 22 bp, Homo sapiens
gctgcctggagaggcagggatg

SEQ ID NO: 9428939 - DNA, 22 bp, Homo sapiens
gctgcctggaataacggctggc

SEQ ID NO: 9428940 - DNA, 22 bp, Homo sapiens
gctgcctggagaggcagggatg

SEQ ID NO: 9428941 - DNA, 22 bp, Homo sapiens
gctgcctggagaggcagggatg

SEQ ID NO: 9428942 - DNA, 22 bp, Homo sapiens
gctgcctggagctcagcctgcc

SEQ ID NO: 9428943 - DNA, 22 bp, Homo sapiens
gctgcctggagctcagcctgcc

SEQ ID NO: 9428944 - DNA, 22 bp, Homo sapiens
gctgcctgatcatacaccaggg

SEQ ID NO: 9428945 - DNA, 22 bp, Homo sapiens
gctgcctgatcatacaccaggg

SEQ ID NO: 9428946 - DNA, 22 bp, Homo sapiens
gctgcctgatcatacaccaggg

SEQ ID NO: 9428947 - DNA, 22 bp, Homo sapiens
gctgcctgatgtccagcaggac

SEQ ID NO: 9428948 - DNA, 22 bp, Homo sapiens
gctgcctgatgtccagcaggac

SEQ ID NO: 9428949 - DNA, 22 bp, Homo sapiens
gctgcctgctcacccggcctgg

SEQ ID NO: 9428950 - DNA, 22 bp, Homo sapiens
gctgcctgctcacccggcctgg

SEQ ID NO: 9428951 - DNA, 22 bp, Homo sapiens
gctgcctgccttgcctggagga

SEQ ID NO: 9428952 - DNA, 22 bp, Homo sapiens
gctgcctgccttgcctggagga

SEQ ID NO: 9428953 - DNA, 22 bp, Homo sapiens
gctgcctgccttgcctggagga

SEQ ID NO: 9428954 - DNA, 22 bp, Homo sapiens
gctgcctgccttgcctggagga

SEQ ID NO: 9428955 - DNA, 22 bp, Homo sapiens
gctgcctgctcacccggcctgg

SEQ ID NO: 9428956 - DNA, 22 bp, Homo sapiens
gctgcctgcttcatgtgggaga

SEQ ID NO: 9428957 - DNA, 22 bp, Homo sapiens
gctgcctgctcggctcctggga

SEQ ID NO: 9428958 - DNA, 22 bp, Homo sapiens
gctgcctgctcggctcctggga

SEQ ID NO: 9428959 - DNA, 22 bp, Homo sapiens
gctgcctggaataacggctggc

SEQ ID NO: 9428960 - DNA, 22 bp, Homo sapiens
gctgcctgcttcatgtgggaga

SEQ ID NO: 9428961 - DNA, 22 bp, Homo sapiens
gctgcctggaataacggctggc

SEQ ID NO: 9428962 - DNA, 22 bp, Homo sapiens
gctgcctggaataacggctggc

SEQ ID NO: 9428963 - DNA, 22 bp, Homo sapiens
gctgcctgctcacccggcctgg

SEQ ID NO: 9428964 - DNA, 22 bp, Homo sapiens
gctgcctgctcggctcctggga

SEQ ID NO: 9428965 - DNA, 22 bp, Homo sapiens
gctgcctgctcggctcctggga

SEQ ID NO: 9428966 - DNA, 22 bp, Homo sapiens
gctgcctgctcggctcctggga

SEQ ID NO: 9428967 - DNA, 22 bp, Homo sapiens
gctgaggcaagatttgaaccca

SEQ ID NO: 9428968 - DNA, 22 bp, Homo sapiens
gctgaggcagtccacccttgtg

SEQ ID NO: 9428969 - DNA, 22 bp, Homo sapiens
gctgcctgaagtgtctacactg

SEQ ID NO: 9428970 - DNA, 22 bp, Homo sapiens
gctgcctgaatgaaccttgttc

SEQ ID NO: 9428971 - DNA, 22 bp, Homo sapiens
gctgcctgatcatacaccaggg

SEQ ID NO: 9428972 - DNA, 22 bp, Homo sapiens
gctgaggcaagatttgaaccca

SEQ ID NO: 9428973 - DNA, 22 bp, Homo sapiens
gctgaggcaaatagttttaagt

SEQ ID NO: 9428974 - DNA, 22 bp, Homo sapiens
gctgaggcaaaccaagaatgta

SEQ ID NO: 9428975 - DNA, 22 bp, Homo sapiens
gctgaggcaaatagttttaagt

SEQ ID NO: 9428976 - DNA, 22 bp, Homo sapiens
gctgaggcaaaccaagaatgta

SEQ ID NO: 9428977 - DNA, 22 bp, Homo sapiens
gctgaggcaaaccaagaatgta

SEQ ID NO: 9428978 - DNA, 22 bp, Homo sapiens
gctgaggcaaaccaagaatgta

SEQ ID NO: 9428979 - DNA, 22 bp, Homo sapiens
gctgaggattacttgaagtcag

SEQ ID NO: 9428980 - DNA, 22 bp, Homo sapiens
gctgaggatatagcaggaacaa

SEQ ID NO: 9428981 - DNA, 20 bp, Homo sapiens
gctgaggattcctggcccct

SEQ ID NO: 9428982 - DNA, 22 bp, Homo sapiens
gctgaggattgaagagttgcca

SEQ ID NO: 9428983 - DNA, 22 bp, Homo sapiens
gctgagccacaggcagtgcact

SEQ ID NO: 9428984 - DNA, 22 bp, Homo sapiens
gctgagcaggtttgatgctttt

SEQ ID NO: 9428985 - DNA, 22 bp, Homo sapiens
gctgagctagctatctcagtct

SEQ ID NO: 9428986 - DNA, 22 bp, Homo sapiens
gctgaggatatagcaggaacaa

SEQ ID NO: 9428987 - DNA, 22 bp, Homo sapiens
gcctggagcctcagcaaggagg

SEQ ID NO: 9428988 - DNA, 22 bp, Homo sapiens
gcctggagcctcagcaaggagg

SEQ ID NO: 9428989 - DNA, 22 bp, Homo sapiens
gcctggagcctcagcaaggagg

SEQ ID NO: 9428990 - DNA, 22 bp, Homo sapiens
gcctggacaccgcccttgcaga

SEQ ID NO: 9428991 - DNA, 22 bp, Homo sapiens
gcctggagggatagaatgcaag

SEQ ID NO: 9428992 - DNA, 22 bp, Homo sapiens
gcctggagggatagaatgcaag

SEQ ID NO: 9428993 - DNA, 22 bp, Homo sapiens
gcctggagggatagaatgcaag

SEQ ID NO: 9428994 - DNA, 22 bp, Homo sapiens
gcctggagggctctagagaggc

SEQ ID NO: 9428995 - DNA, 22 bp, Homo sapiens
gcctggaggggacagtctctgg

SEQ ID NO: 9428996 - DNA, 22 bp, Homo sapiens
gcctggaggggccagggtggta

SEQ ID NO: 9428997 - DNA, 22 bp, Homo sapiens
gcctggaggggccagggtggta

SEQ ID NO: 9428998 - DNA, 22 bp, Homo sapiens
gcctgctgggagacacccccag

SEQ ID NO: 9428999 - DNA, 22 bp, Homo sapiens
gcctgctgggagacacccccag

SEQ ID NO: 9429000 - DNA, 23 bp, Homo sapiens
gcctgctggtcacctaatctgcc

SEQ ID NO: 9429001 - DNA, 23 bp, Homo sapiens
gcctgctggtcacctaatctgcc

SEQ ID NO: 9429002 - DNA, 23 bp, Homo sapiens
gcctgctgtcacagcgggcccag

SEQ ID NO: 9429003 - DNA, 23 bp, Homo sapiens
gcctgctgtcacagcgggcccag

SEQ ID NO: 9429004 - DNA, 22 bp, Homo sapiens
gcctgctctccggatccctgat

SEQ ID NO: 9429005 - DNA, 22 bp, Homo sapiens
gcctgctcagacctagcaggcc

SEQ ID NO: 9429006 - DNA, 22 bp, Homo sapiens
gcctgctcagacctagcaggcc

SEQ ID NO: 9429007 - DNA, 22 bp, Homo sapiens
gcctgccttttggaggcacatt

SEQ ID NO: 9429008 - DNA, 22 bp, Homo sapiens
gcctgccttttggaggcacatt

SEQ ID NO: 9429009 - DNA, 22 bp, Homo sapiens
gcctgccttttggaggcacatt

SEQ ID NO: 9429010 - DNA, 22 bp, Homo sapiens
gcctgcctttgtgaggaagcgg

SEQ ID NO: 9429011 - DNA, 22 bp, Homo sapiens
gcctgccttttggaggcacatt

SEQ ID NO: 9429012 - DNA, 22 bp, Homo sapiens
gcctgcctttgtgaggaagcgg

SEQ ID NO: 9429013 - DNA, 22 bp, Homo sapiens
gcctgctttgtgcctgatcttt

SEQ ID NO: 9429014 - DNA, 22 bp, Homo sapiens
gcctgcttcacggacaggcctc

SEQ ID NO: 9429015 - DNA, 22 bp, Homo sapiens
gcctgcttcctagccttccaag

SEQ ID NO: 9429016 - DNA, 22 bp, Homo sapiens
gcctgctttaagtctgttgcct

SEQ ID NO: 9429017 - DNA, 22 bp, Homo sapiens
gcctgctgttgagggaagagct

SEQ ID NO: 9429018 - DNA, 22 bp, Homo sapiens
gcctgctgttgagggaagagct

SEQ ID NO: 9429019 - DNA, 22 bp, Homo sapiens
gcctgctgttgagggaagagct

SEQ ID NO: 9429020 - DNA, 21 bp, Homo sapiens
gcctgctgttcaccctgccac

SEQ ID NO: 9429021 - DNA, 22 bp, Homo sapiens
gcctgctgttaactgcaggaat

SEQ ID NO: 9429022 - DNA, 21 bp, Homo sapiens
gcctgctgttcaccctgccac

SEQ ID NO: 9429023 - DNA, 22 bp, Homo sapiens
gcctgctgttaactgcaggaat

SEQ ID NO: 9429024 - DNA, 22 bp, Homo sapiens
gcctgctgtcctgattcccatg

SEQ ID NO: 9429025 - DNA, 22 bp, Homo sapiens
gcctgccttcggtgcgcagcgg

SEQ ID NO: 9429026 - DNA, 22 bp, Homo sapiens
gcctgcctgttggctgaggtgc

SEQ ID NO: 9429027 - DNA, 22 bp, Homo sapiens
gcctgcctgttggctgaggtgc

SEQ ID NO: 9429028 - DNA, 22 bp, Homo sapiens
gcctgcctttgtatgaccctga

SEQ ID NO: 9429029 - DNA, 22 bp, Homo sapiens
gcctgcctttgtatgaccctga

SEQ ID NO: 9429030 - DNA, 22 bp, Homo sapiens
gcctgccttcggtgcgcagcgg

SEQ ID NO: 9429031 - DNA, 22 bp, Homo sapiens
gcctgccttcggtgcgcagcgg

SEQ ID NO: 9429032 - DNA, 22 bp, Homo sapiens
gcctgccttcggtgcgcagcgg

SEQ ID NO: 9429033 - DNA, 22 bp, Homo sapiens
gcctgcctgctgtgtgcaagtt

SEQ ID NO: 9429034 - DNA, 19 bp, Homo sapiens
gcctgcctgggtttctgag

SEQ ID NO: 9429035 - DNA, 22 bp, Homo sapiens
gcctgcctggagcttgaggtga

SEQ ID NO: 9429036 - DNA, 22 bp, Homo sapiens
gcctgcctgctgtgtgcaagtt

SEQ ID NO: 9429037 - DNA, 22 bp, Homo sapiens
gcctgcctggagcttgaggtga

SEQ ID NO: 9429038 - DNA, 22 bp, Homo sapiens
gcctgcctgctgtcatctgcct

SEQ ID NO: 9429039 - DNA, 22 bp, Homo sapiens
gcctgcctgctgtcatctgcct

SEQ ID NO: 9429040 - DNA, 22 bp, Homo sapiens
gcctgcctgctgtcatctgcct

SEQ ID NO: 9429041 - DNA, 22 bp, Homo sapiens
gcctgcctgctgtcatctgcct

SEQ ID NO: 9429042 - DNA, 21 bp, Homo sapiens
gcctgcctgcgtgaccctctt

SEQ ID NO: 9429043 - DNA, 23 bp, Homo sapiens
gcctctggagccccagtgctcag

SEQ ID NO: 9429044 - DNA, 17 bp, Homo sapiens
gcctctgcttgtgtcat

SEQ ID NO: 9429045 - DNA, 22 bp, Homo sapiens
gcctctggaagtgggaaggggt

SEQ ID NO: 9429046 - DNA, 22 bp, Homo sapiens
gcctctggaagaattacatcca

SEQ ID NO: 9429047 - DNA, 22 bp, Homo sapiens
gcctctggaagtgggaaggggt

SEQ ID NO: 9429048 - DNA, 20 bp, Homo sapiens
gcctctggagccaaggacca

SEQ ID NO: 9429049 - DNA, 20 bp, Homo sapiens
gcctctggagccaaggacca

SEQ ID NO: 9429050 - DNA, 23 bp, Homo sapiens
gcctctggagccccagtgctcag

SEQ ID NO: 9429051 - DNA, 23 bp, Homo sapiens
gcctctggagccccagtgctcag

SEQ ID NO: 9429052 - DNA, 20 bp, Homo sapiens
gcctgcctcagctagctgag

SEQ ID NO: 9429053 - DNA, 20 bp, Homo sapiens
gcctgcctcagctagctgag

SEQ ID NO: 9429054 - DNA, 22 bp, Homo sapiens
gcctgcctcaaaatcccagttc

SEQ ID NO: 9429055 - DNA, 22 bp, Homo sapiens
gcctgcctcaaaatcccagttc

SEQ ID NO: 9429056 - DNA, 22 bp, Homo sapiens
gcctgcctgaaggctgtaccag

SEQ ID NO: 9429057 - DNA, 22 bp, Homo sapiens
gcctgcctgaaggctgtaccag

SEQ ID NO: 9429058 - DNA, 23 bp, Homo sapiens
gcctgcctgacctgtgcaaagtc

SEQ ID NO: 9429059 - DNA, 23 bp, Homo sapiens
gcctgcctgacctgtgcaaagtc

SEQ ID NO: 9429060 - DNA, 22 bp, Homo sapiens
gcctgggaaatggtggggtcag

SEQ ID NO: 9429061 - DNA, 22 bp, Homo sapiens
gcctgggaaatggtggggtcag

SEQ ID NO: 9429062 - DNA, 22 bp, Homo sapiens
gcctggccgggtcttggatttt

SEQ ID NO: 9429063 - DNA, 22 bp, Homo sapiens
gcctggccgctccgagctccgc

SEQ ID NO: 9429064 - DNA, 22 bp, Homo sapiens
gcctggcctgaactaggaggtg

SEQ ID NO: 9429065 - DNA, 22 bp, Homo sapiens
gcctggcctgaactaggaggtg

SEQ ID NO: 9429066 - DNA, 22 bp, Homo sapiens
gcctggcttttgcctcatgttc

SEQ ID NO: 9429067 - DNA, 22 bp, Homo sapiens
gcctggccgctccgagctccgc

SEQ ID NO: 9429068 - DNA, 22 bp, Homo sapiens
gcctggccgctccgagctccgc

SEQ ID NO: 9429069 - DNA, 22 bp, Homo sapiens
gcctggcccagggctcttgttg

SEQ ID NO: 9429070 - DNA, 22 bp, Homo sapiens
gcctggcccagggctccgcagg

SEQ ID NO: 9429071 - DNA, 22 bp, Homo sapiens
gcctggcccagggctcttgttg

SEQ ID NO: 9429072 - DNA, 22 bp, Homo sapiens
gcctggcccagggctccgcagg

SEQ ID NO: 9429073 - DNA, 23 bp, Homo sapiens
gcctggccaccccagggctgctt

SEQ ID NO: 9429074 - DNA, 23 bp, Homo sapiens
gcctggccaccccagggctgctt

SEQ ID NO: 9429075 - DNA, 22 bp, Homo sapiens
gcctggccaacgtggtgaaacc

SEQ ID NO: 9429076 - DNA, 23 bp, Homo sapiens
gcctggccaccccagggctgctt

SEQ ID NO: 9429077 - DNA, 23 bp, Homo sapiens
gcctggccaccccagggctgctt

SEQ ID NO: 9429078 - DNA, 17 bp, Homo sapiens
gcctggcccagcctggc

SEQ ID NO: 9429079 - DNA, 17 bp, Homo sapiens
gcctggcccagcctggc

SEQ ID NO: 9429080 - DNA, 17 bp, Homo sapiens
gcctggcccagcctggc

SEQ ID NO: 9429081 - DNA, 17 bp, Homo sapiens
gcctggcccagcctggc

SEQ ID NO: 9429082 - DNA, 22 bp, Homo sapiens
gcctggcattacagcactcctg

SEQ ID NO: 9429083 - DNA, 22 bp, Homo sapiens
gcctggcagtggggccctggga

SEQ ID NO: 9429084 - DNA, 22 bp, Homo sapiens
gcctggagtactccttgaagtg

SEQ ID NO: 9429085 - DNA, 22 bp, Homo sapiens
gcctggcaggcctgttggggct

SEQ ID NO: 9429086 - DNA, 22 bp, Homo sapiens
gcctggcaggcctgggccagca

SEQ ID NO: 9429087 - DNA, 22 bp, Homo sapiens
gcctggcaggcctcatgagggg

SEQ ID NO: 9429088 - DNA, 22 bp, Homo sapiens
gcctgtgctttcttccctcctg

SEQ ID NO: 9429089 - DNA, 22 bp, Homo sapiens
gcctgtggccgactgagagcct

SEQ ID NO: 9429090 - DNA, 22 bp, Homo sapiens
gcctgtggccgactgagagcct

SEQ ID NO: 9429091 - DNA, 22 bp, Homo sapiens
gcctgtggcccaactgtctgtc

SEQ ID NO: 9429092 - DNA, 22 bp, Homo sapiens
gcctggtgtccagaggcgagtg

SEQ ID NO: 9429093 - DNA, 22 bp, Homo sapiens
gcctggtgtgcgccgcgcagct

SEQ ID NO: 9429094 - DNA, 22 bp, Homo sapiens
gcctgtgcttaactgacgtgag

SEQ ID NO: 9429095 - DNA, 22 bp, Homo sapiens
gcctggtgtgcgccgcgcagct

SEQ ID NO: 9429096 - DNA, 22 bp, Homo sapiens
gcctgtcaattttgtgtacaat

SEQ ID NO: 9429097 - DNA, 22 bp, Homo sapiens
gcctgtgtggatgcgccggtgc

SEQ ID NO: 9429098 - DNA, 22 bp, Homo sapiens
gcctgtgtggatgcgccggtgc

SEQ ID NO: 9429099 - DNA, 22 bp, Homo sapiens
gcctgttgggtaacagagttca

SEQ ID NO: 9429100 - DNA, 22 bp, Homo sapiens
gcctgttctgccctgagagcct

SEQ ID NO: 9429101 - DNA, 22 bp, Homo sapiens
gcctgttccttagtggcttcac

SEQ ID NO: 9429102 - DNA, 20 bp, Homo sapiens
gcctgttcacaggcttcttg

SEQ ID NO: 9429103 - DNA, 18 bp, Homo sapiens
gcctgttccctactatcc

SEQ ID NO: 9429104 - DNA, 22 bp, Homo sapiens
gcctgtgtcatgtagtagcttc

SEQ ID NO: 9429105 - DNA, 22 bp, Homo sapiens
gcctgtgtctgggtggccagag

SEQ ID NO: 9429106 - DNA, 22 bp, Homo sapiens
gcctgtgtcatgtagtagcttc

SEQ ID NO: 9429107 - DNA, 21 bp, Homo sapiens
gcctgtgtaaattgagtttcc

SEQ ID NO: 9429108 - DNA, 21 bp, Homo sapiens
gcctgggaagagaaaggtaag

SEQ ID NO: 9429109 - DNA, 22 bp, Homo sapiens
gcctgggactggatgtgtttgt

SEQ ID NO: 9429110 - DNA, 23 bp, Homo sapiens
gcctgggactggtagtgtgacct

SEQ ID NO: 9429111 - DNA, 22 bp, Homo sapiens
gcctgggactgcagatccccag

SEQ ID NO: 9429112 - DNA, 22 bp, Homo sapiens
gcctgggatagaggcaatgcat

SEQ ID NO: 9429113 - DNA, 21 bp, Homo sapiens
gcctgggatagtggcctccgg

SEQ ID NO: 9429114 - DNA, 20 bp, Homo sapiens
gcctgggattatccactggt

SEQ ID NO: 9429115 - DNA, 22 bp, Homo sapiens
gcctgggattcccagaggggca

SEQ ID NO: 9429116 - DNA, 22 bp, Homo sapiens
gccgccatatcatctgcctctt

SEQ ID NO: 9429117 - DNA, 22 bp, Homo sapiens
gccgccctctgcaggggctgag

SEQ ID NO: 9429118 - DNA, 22 bp, Homo sapiens
gccgccatatcatctgcctctt

SEQ ID NO: 9429119 - DNA, 22 bp, Homo sapiens
gccgcgtcgatgccctctagtt

SEQ ID NO: 9429120 - DNA, 22 bp, Homo sapiens
gccgaggaagcattcctaggag

SEQ ID NO: 9429121 - DNA, 20 bp, Homo sapiens
gccgactgccttgtgagcct

SEQ ID NO: 9429122 - DNA, 20 bp, Homo sapiens
gccgactgccttgtgagcct

SEQ ID NO: 9429123 - DNA, 22 bp, Homo sapiens
gccgaagacgctgggcgtgggc

SEQ ID NO: 9429124 - DNA, 22 bp, Homo sapiens
gccgggaccaaggccacggagc

SEQ ID NO: 9429125 - DNA, 22 bp, Homo sapiens
gccggggctggggagagacatg

SEQ ID NO: 9429126 - DNA, 22 bp, Homo sapiens
gccgggttcaagccattctcct

SEQ ID NO: 9429127 - DNA, 22 bp, Homo sapiens
gccgggttcaagccattctcct

SEQ ID NO: 9429128 - DNA, 22 bp, Homo sapiens
gccgtgcgtgcgcaggtgctgt

SEQ ID NO: 9429129 - DNA, 22 bp, Homo sapiens
gccggggctggggagagacatg

SEQ ID NO: 9429130 - DNA, 22 bp, Homo sapiens
gccggggctggggagagacatg

SEQ ID NO: 9429131 - DNA, 19 bp, Homo sapiens
gccgggggcgccccgctct

SEQ ID NO: 9429132 - DNA, 22 bp, Homo sapiens
gccgggttcaagccattctcct

SEQ ID NO: 9429133 - DNA, 22 bp, Homo sapiens
gccgggtgcagcgggcccgcca

SEQ ID NO: 9429134 - DNA, 22 bp, Homo sapiens
gcctcctgtcccaggctgagga

SEQ ID NO: 9429135 - DNA, 22 bp, Homo sapiens
gcctcctgtcccaggctgagga

SEQ ID NO: 9429136 - DNA, 22 bp, Homo sapiens
gcctcctgttatgccatgtgcc

SEQ ID NO: 9429137 - DNA, 22 bp, Homo sapiens
gcctcctgttatgccatgtgcc

SEQ ID NO: 9429138 - DNA, 22 bp, Homo sapiens
gcctcctgttatgccatgtgcc

SEQ ID NO: 9429139 - DNA, 22 bp, Homo sapiens
gcctcctgtcccaggctgagga

SEQ ID NO: 9429140 - DNA, 22 bp, Homo sapiens
gcctctgccctcctgggactgc

SEQ ID NO: 9429141 - DNA, 22 bp, Homo sapiens
gcctctgcggggcccgagcccg

SEQ ID NO: 9429142 - DNA, 22 bp, Homo sapiens
gccctctgatgctcaccgagga

SEQ ID NO: 9429143 - DNA, 22 bp, Homo sapiens
gccctctgcacagctctgagca

SEQ ID NO: 9429144 - DNA, 22 bp, Homo sapiens
gccctctgccacaggacgccag

SEQ ID NO: 9429145 - DNA, 22 bp, Homo sapiens
gccctctgcacagctctgagca

SEQ ID NO: 9429146 - DNA, 22 bp, Homo sapiens
gccctctgcacagctctgagca

SEQ ID NO: 9429147 - DNA, 22 bp, Homo sapiens
gccctctgccacaggacgccag

SEQ ID NO: 9429148 - DNA, 20 bp, Homo sapiens
gccctctgcctccctcagcg

SEQ ID NO: 9429149 - DNA, 22 bp, Homo sapiens
gccctctgctcagctcctcagc

SEQ ID NO: 9429150 - DNA, 20 bp, Homo sapiens
gccctctgcctccctcagcg

SEQ ID NO: 9429151 - DNA, 22 bp, Homo sapiens
gccctgttttgaaacttgcata

SEQ ID NO: 9429152 - DNA, 22 bp, Homo sapiens
gccctgttgtcggacgtcaagg

SEQ ID NO: 9429153 - DNA, 22 bp, Homo sapiens
gcccttacagggtggtcagcca

SEQ ID NO: 9429154 - DNA, 22 bp, Homo sapiens
gccctctggcacagagatgcag

SEQ ID NO: 9429155 - DNA, 22 bp, Homo sapiens
gccctgttatccagatgaggat

SEQ ID NO: 9429156 - DNA, 22 bp, Homo sapiens
gccctgttctggacaggcacaa

SEQ ID NO: 9429157 - DNA, 22 bp, Homo sapiens
gccctctggcacagagatgcag

SEQ ID NO: 9429158 - DNA, 22 bp, Homo sapiens
gccctctgctggcctcacctcg

SEQ ID NO: 9429159 - DNA, 22 bp, Homo sapiens
gccctctgctcagctcctcagc

SEQ ID NO: 9429160 - DNA, 22 bp, Homo sapiens
gcccttggaaagccaaggcagc

SEQ ID NO: 9429161 - DNA, 22 bp, Homo sapiens
gcccttggaaagccaaggcagc

SEQ ID NO: 9429162 - DNA, 22 bp, Homo sapiens
gcccttggaagcggcaggtagc

SEQ ID NO: 9429163 - DNA, 22 bp, Homo sapiens
gcccttggaagcggcaggtagc

SEQ ID NO: 9429164 - DNA, 22 bp, Homo sapiens
gcccttgggaggttccactggg

SEQ ID NO: 9429165 - DNA, 22 bp, Homo sapiens
gccctttcttcttctggactgg

SEQ ID NO: 9429166 - DNA, 22 bp, Homo sapiens
gcccttctgctgttaggtagcc

SEQ ID NO: 9429167 - DNA, 22 bp, Homo sapiens
gcccttcacgatggtatcttag

SEQ ID NO: 9429168 - DNA, 22 bp, Homo sapiens
gcccttcatttatagttggaat

SEQ ID NO: 9429169 - DNA, 22 bp, Homo sapiens
gcccttcagttactccttgatg

SEQ ID NO: 9429170 - DNA, 22 bp, Homo sapiens
gccctcagagttccccacagtg

SEQ ID NO: 9429171 - DNA, 22 bp, Homo sapiens
gccctcagagttccccacagtg

SEQ ID NO: 9429172 - DNA, 22 bp, Homo sapiens
gccctcagatgggaaaggaggg

SEQ ID NO: 9429173 - DNA, 22 bp, Homo sapiens
gccctcagcaggaaagatcaac

SEQ ID NO: 9429174 - DNA, 22 bp, Homo sapiens
gcccaggctggagtgcagtggc

SEQ ID NO: 9429175 - DNA, 22 bp, Homo sapiens
gcccaggctggagtgcagtggc

SEQ ID NO: 9429176 - DNA, 22 bp, Homo sapiens
gcccaggctggagtgcagtggc

SEQ ID NO: 9429177 - DNA, 22 bp, Homo sapiens
gcccaggctggagtgcagtggc

SEQ ID NO: 9429178 - DNA, 22 bp, Homo sapiens
gcccaggctggagtgcagtggt

SEQ ID NO: 9429179 - DNA, 19 bp, Homo sapiens
gccctcaggcagctccatc

SEQ ID NO: 9429180 - DNA, 22 bp, Homo sapiens
gccctcaggacaaggttacgct

SEQ ID NO: 9429181 - DNA, 17 bp, Homo sapiens
gccctcagctttaacca

SEQ ID NO: 9429182 - DNA, 22 bp, Homo sapiens
gccctcagctcctggacacatg

SEQ ID NO: 9429183 - DNA, 22 bp, Homo sapiens
gccctcagctcctggacacatg

SEQ ID NO: 9429184 - DNA, 22 bp, Homo sapiens
gccctcagcttgatgttgttct

SEQ ID NO: 9429185 - DNA, 22 bp, Homo sapiens
gccctcagcatcctcagggcca

SEQ ID NO: 9429186 - DNA, 22 bp, Homo sapiens
gccctcagctcctggacacatg

SEQ ID NO: 9429187 - DNA, 22 bp, Homo sapiens
gccctcagcaggaaagatcaac

SEQ ID NO: 9429188 - DNA, 22 bp, Homo sapiens
gccctcagcaggaaagatcaac

SEQ ID NO: 9429189 - DNA, 22 bp, Homo sapiens
gccctcagcatcctcagggcca

SEQ ID NO: 9429190 - DNA, 22 bp, Homo sapiens
gccctcagcatcctcagggcca

SEQ ID NO: 9429191 - DNA, 22 bp, Homo sapiens
gccctcagtggattcttattgt

SEQ ID NO: 9429192 - DNA, 22 bp, Homo sapiens
gccctctcttctgcagcctcca

SEQ ID NO: 9429193 - DNA, 22 bp, Homo sapiens
gccctctcttctgcagcctcca

SEQ ID NO: 9429194 - DNA, 22 bp, Homo sapiens
gccctcagtgaccactgattca

SEQ ID NO: 9429195 - DNA, 20 bp, Homo sapiens
gccctcagtcttgtctttat

SEQ ID NO: 9429196 - DNA, 20 bp, Homo sapiens
gccctcagtcttgtctttat

SEQ ID NO: 9429197 - DNA, 23 bp, Homo sapiens
gccctcagtagaaaatgttagaa

SEQ ID NO: 9429198 - DNA, 23 bp, Homo sapiens
gccctcagtagaaaatgttagaa

SEQ ID NO: 9429199 - DNA, 23 bp, Homo sapiens
gccctcagtagaaaatgttagaa

SEQ ID NO: 9429200 - DNA, 21 bp, Homo sapiens
gccctcaggggaggatggcct

SEQ ID NO: 9429201 - DNA, 21 bp, Homo sapiens
gccctcaggggaggatggcct

SEQ ID NO: 9429202 - DNA, 15 bp, Homo sapiens
gccctcaggcgacac

SEQ ID NO: 9429203 - DNA, 22 bp, Homo sapiens
gccctcaggcagggagtctttc

SEQ ID NO: 9429204 - DNA, 19 bp, Homo sapiens
gccctcaggcagctccatc

SEQ ID NO: 9429205 - DNA, 19 bp, Homo sapiens
gccctcaggcagctccatc

SEQ ID NO: 9429206 - DNA, 22 bp, Homo sapiens
gccctcaggcagggagtctttc

SEQ ID NO: 9429207 - DNA, 19 bp, Homo sapiens
gccctcaggcagctccatc

SEQ ID NO: 9429208 - DNA, 22 bp, Homo sapiens
gccaggctgactcccccggcct

SEQ ID NO: 9429209 - DNA, 22 bp, Homo sapiens
gccaggctgaggctctggaaga

SEQ ID NO: 9429210 - DNA, 22 bp, Homo sapiens
gccaggctgactcccccggcct

SEQ ID NO: 9429211 - DNA, 22 bp, Homo sapiens
gccaggctcttccatttgggtc

SEQ ID NO: 9429212 - DNA, 19 bp, Homo sapiens
gccaggctcttattctgtg

SEQ ID NO: 9429213 - DNA, 22 bp, Homo sapiens
gccagcagggcccaaatgctgg

SEQ ID NO: 9429214 - DNA, 22 bp, Homo sapiens
gccaggctgccttatctctagc

SEQ ID NO: 9429215 - DNA, 22 bp, Homo sapiens
gccaggctgctccagggaggcc

SEQ ID NO: 9429216 - DNA, 22 bp, Homo sapiens
gccaggctggtgtcacaactct

SEQ ID NO: 9429217 - DNA, 22 bp, Homo sapiens
gccaggctggtgtcacaactct

SEQ ID NO: 9429218 - DNA, 22 bp, Homo sapiens
gccataaatgaaggaaaggtat

SEQ ID NO: 9429219 - DNA, 22 bp, Homo sapiens
gccagtttccacctaggcaatt

SEQ ID NO: 9429220 - DNA, 22 bp, Homo sapiens
gccataaaatgtggatgaggga

SEQ ID NO: 9429221 - DNA, 19 bp, Homo sapiens
gccagtgtgtggtacagtg

SEQ ID NO: 9429222 - DNA, 22 bp, Homo sapiens
gccagtgttattcctggggctg

SEQ ID NO: 9429223 - DNA, 22 bp, Homo sapiens
gccagtgtgcaagaggccacca

SEQ ID NO: 9429224 - DNA, 22 bp, Homo sapiens
gccagtggtcactgaggaagaa

SEQ ID NO: 9429225 - DNA, 22 bp, Homo sapiens
gccagtgggtagttggagctgg

SEQ ID NO: 9429226 - DNA, 22 bp, Homo sapiens
gccagtgggtagttggagctgg

SEQ ID NO: 9429227 - DNA, 22 bp, Homo sapiens
gccagtggtagaggggaggccg

SEQ ID NO: 9429228 - DNA, 22 bp, Homo sapiens
gccagtgggacccgctgtgggc

SEQ ID NO: 9429229 - DNA, 22 bp, Homo sapiens
gccagtgggacccgctgtgggc

SEQ ID NO: 9429230 - DNA, 22 bp, Homo sapiens
gccaggctgtttttattactgt

SEQ ID NO: 9429231 - DNA, 22 bp, Homo sapiens
gccaggctgtggggaacttgaa

SEQ ID NO: 9429232 - DNA, 20 bp, Homo sapiens
gcccaggatctctgaggcat

SEQ ID NO: 9429233 - DNA, 22 bp, Homo sapiens
gcccaggagttggtggctgcag

SEQ ID NO: 9429234 - DNA, 22 bp, Homo sapiens
gcccaggagttggaggctgcag

SEQ ID NO: 9429235 - DNA, 22 bp, Homo sapiens
gcccaggagttggtggctgcag

SEQ ID NO: 9429236 - DNA, 22 bp, Homo sapiens
gcccaggatggctggaggtgct

SEQ ID NO: 9429237 - DNA, 20 bp, Homo sapiens
gcccaggatctctgaggcat

SEQ ID NO: 9429238 - DNA, 20 bp, Homo sapiens
gcccaggatctctgaggcat

SEQ ID NO: 9429239 - DNA, 20 bp, Homo sapiens
gcccaggatctctgaggcat

SEQ ID NO: 9429240 - DNA, 22 bp, Homo sapiens
gcccaggctggagtgcagtagc

SEQ ID NO: 9429241 - DNA, 22 bp, Homo sapiens
gcccaggctggagtgcagtagc

SEQ ID NO: 9429242 - DNA, 22 bp, Homo sapiens
gcccaggctagcgtagagtgca

SEQ ID NO: 9429243 - DNA, 22 bp, Homo sapiens
gcccaggctagcgtagagtgca

SEQ ID NO: 9429244 - DNA, 22 bp, Homo sapiens
gcccaggctggagtgcagtagc

SEQ ID NO: 9429245 - DNA, 22 bp, Homo sapiens
gcccaggctggagtgcagtggc

SEQ ID NO: 9429246 - DNA, 22 bp, Homo sapiens
gcccaggctggagtgcagtggc

SEQ ID NO: 9429247 - DNA, 22 bp, Homo sapiens
gcccaggctggagtgcagtagc

SEQ ID NO: 9429248 - DNA, 22 bp, Homo sapiens
gcccaggatggctggaggtgct

SEQ ID NO: 9429249 - DNA, 22 bp, Homo sapiens
gcccaggatggctggaggtgct

SEQ ID NO: 9429250 - DNA, 22 bp, Homo sapiens
gcccaggatggctggaggtgct

SEQ ID NO: 9429251 - DNA, 22 bp, Homo sapiens
gcccaggatggtgtgtagtggt

SEQ ID NO: 9429252 - DNA, 22 bp, Homo sapiens
gcccaggctagcgtagagtgca

SEQ ID NO: 9429253 - DNA, 22 bp, Homo sapiens
gcccaggaggagaggctgcagt

SEQ ID NO: 9429254 - DNA, 18 bp, Homo sapiens
gccattcttctaagtact

SEQ ID NO: 9429255 - DNA, 22 bp, Homo sapiens
gccattcttaacagtcatcact

SEQ ID NO: 9429256 - DNA, 22 bp, Homo sapiens
gcccaggagttggaggctgcag

SEQ ID NO: 9429257 - DNA, 22 bp, Homo sapiens
gcccaggagttgaatgcagcag

SEQ ID NO: 9429258 - DNA, 22 bp, Homo sapiens
gcccaggagttgaatgcagcag

SEQ ID NO: 9429259 - DNA, 22 bp, Homo sapiens
gcccaggagttggaggctgcag

SEQ ID NO: 9429260 - DNA, 22 bp, Homo sapiens
gcccaggaggagaggctgcagt

SEQ ID NO: 9429261 - DNA, 22 bp, Homo sapiens
gcccaggaggtcaagtagctat

SEQ ID NO: 9429262 - DNA, 22 bp, Homo sapiens
gcccaggaggtcaagtagctat

SEQ ID NO: 9429263 - DNA, 22 bp, Homo sapiens
gccatggggctcagctgcacta

SEQ ID NO: 9429264 - DNA, 22 bp, Homo sapiens
gccatgtcctgggcatctgcca

SEQ ID NO: 9429265 - DNA, 22 bp, Homo sapiens
gccatgtgggcagaggaggctg

SEQ ID NO: 9429266 - DNA, 21 bp, Homo sapiens
gccatgtttccttactaagag

SEQ ID NO: 9429267 - DNA, 22 bp, Homo sapiens
gccatgttttggtaaataccat

SEQ ID NO: 9429268 - DNA, 23 bp, Homo sapiens
gccatggctgccccacaggcctc

SEQ ID NO: 9429269 - DNA, 23 bp, Homo sapiens
gccatcacgttcaaccaaagcct

SEQ ID NO: 9429270 - DNA, 22 bp, Homo sapiens
gaaaacatccagagatagacct

SEQ ID NO: 9429271 - DNA, 22 bp, Homo sapiens
gaaaacatccagagatagacct

SEQ ID NO: 9429272 - DNA, 22 bp, Homo sapiens
gaaaacatccagagatagacct

SEQ ID NO: 9429273 - DNA, 22 bp, Homo sapiens
gaaaacatccagagatagacct

SEQ ID NO: 9429274 - DNA, 22 bp, Homo sapiens
gaaaagagtcctgtgtgaggag

SEQ ID NO: 9429275 - DNA, 21 bp, Homo sapiens
gaaaagcaagggagtagaaca

SEQ ID NO: 9429276 - DNA, 21 bp, Homo sapiens
gaaaagcaagggagtagaaca

SEQ ID NO: 9429277 - DNA, 21 bp, Homo sapiens
gaaaagcaagggagtagaaca

SEQ ID NO: 9429278 - DNA, 21 bp, Homo sapiens
gaaaagcaagggagtagaaca

SEQ ID NO: 9429279 - DNA, 21 bp, Homo sapiens
gaaaagcaagggagtagaaca

SEQ ID NO: 9429280 - DNA, 22 bp, Homo sapiens
gaaaaggaaatttatagagatc

SEQ ID NO: 9429281 - DNA, 22 bp, Homo sapiens
gaaaaggaaatttatagagatc

SEQ ID NO: 9429282 - DNA, 21 bp, Homo sapiens
gaaaagcaagggagtagaaca

SEQ ID NO: 9429283 - DNA, 21 bp, Homo sapiens
gaaaagcaagggagtagaaca

SEQ ID NO: 9429284 - DNA, 21 bp, Homo sapiens
gaaaagcaagggagtagaaca

SEQ ID NO: 9429285 - DNA, 21 bp, Homo sapiens
gaaaagcaagggagtagaaca

SEQ ID NO: 9429286 - DNA, 21 bp, Homo sapiens
gaaaagcaagggagtagaaca

SEQ ID NO: 9429287 - DNA, 22 bp, Homo sapiens
gaaaaggccactcctaggagct

SEQ ID NO: 9429288 - DNA, 22 bp, Homo sapiens
gaaaaggccactcctaggagct

SEQ ID NO: 9429289 - DNA, 22 bp, Homo sapiens
gaaaaggccactcctaggagct

SEQ ID NO: 9429290 - DNA, 22 bp, Homo sapiens
gaaaaggcctggggcaaagtgt

SEQ ID NO: 9429291 - DNA, 22 bp, Homo sapiens
gaaaaggcctccccataggaat

SEQ ID NO: 9429292 - DNA, 22 bp, Homo sapiens
gaaaaggcctccccataggaat

SEQ ID NO: 9429293 - DNA, 22 bp, Homo sapiens
gaaaaggcctccccataggaat

SEQ ID NO: 9429294 - DNA, 22 bp, Homo sapiens
gaaaaggattggtaaaatatct

SEQ ID NO: 9429295 - DNA, 22 bp, Homo sapiens
gaaaaggcagagttccggggaa

SEQ ID NO: 9429296 - DNA, 22 bp, Homo sapiens
gaaaaggcagagttccggggaa

SEQ ID NO: 9429297 - DNA, 22 bp, Homo sapiens
gaaaaggattggtaaaatatct

SEQ ID NO: 9429298 - DNA, 22 bp, Homo sapiens
gaaaagggcaagagagagggca

SEQ ID NO: 9429299 - DNA, 22 bp, Homo sapiens
gaaaaggctgcccacttattga

SEQ ID NO: 9429300 - DNA, 22 bp, Homo sapiens
gaaaaggctctcactccctccg

SEQ ID NO: 9429301 - DNA, 22 bp, Homo sapiens
gaaaaggctgcccacttattga

SEQ ID NO: 9429302 - DNA, 22 bp, Homo sapiens
gaaaaggcctggggcaaagtgt

SEQ ID NO: 9429303 - DNA, 22 bp, Homo sapiens
gaaaaggctctcactccctccg

SEQ ID NO: 9429304 - DNA, 22 bp, Homo sapiens
gaaaagggcaagagagagggca

SEQ ID NO: 9429305 - DNA, 22 bp, Homo sapiens
gaaaagtacacagcccaaacat

SEQ ID NO: 9429306 - DNA, 22 bp, Homo sapiens
gaaaagtaaacactaggggtca

SEQ ID NO: 9429307 - DNA, 22 bp, Homo sapiens
gaaaagtatgtttattttgact

SEQ ID NO: 9429308 - DNA, 22 bp, Homo sapiens
gaaaagtatgtttattttgact

SEQ ID NO: 9429309 - DNA, 22 bp, Homo sapiens
ctttgtgtctgttaataattat

SEQ ID NO: 9429310 - DNA, 22 bp, Homo sapiens
ctttgtgatagtgttaagacca

SEQ ID NO: 9429311 - DNA, 22 bp, Homo sapiens
ctttgtgatagtgttaagacca

SEQ ID NO: 9429312 - DNA, 22 bp, Homo sapiens
ctttgttatctgtaaatggtta

SEQ ID NO: 9429313 - DNA, 22 bp, Homo sapiens
ctttgttctgcacacacagaca

SEQ ID NO: 9429314 - DNA, 22 bp, Homo sapiens
ctttgtttatatttctcctcga

SEQ ID NO: 9429315 - DNA, 22 bp, Homo sapiens
ctttgtttatatttctcctcga

SEQ ID NO: 9429316 - DNA, 22 bp, Homo sapiens
cttttaagggataataagatgt

SEQ ID NO: 9429317 - DNA, 22 bp, Homo sapiens
cttttaatgagcattgctgtct

SEQ ID NO: 9429318 - DNA, 22 bp, Homo sapiens
cttttaagggataataagatgt

SEQ ID NO: 9429319 - DNA, 22 bp, Homo sapiens
ctttgttttactcagaggcatg

SEQ ID NO: 9429320 - DNA, 22 bp, Homo sapiens
ctttgttttactcagaggcatg

SEQ ID NO: 9429321 - DNA, 22 bp, Homo sapiens
ctttgttttactcagaggcatg

SEQ ID NO: 9429322 - DNA, 22 bp, Homo sapiens
gaaaacactttgatctgaaagt

SEQ ID NO: 9429323 - DNA, 17 bp, Homo sapiens
cttttaatttacttccc

SEQ ID NO: 9429324 - DNA, 22 bp, Homo sapiens
cttttaatgggagcagtatttg

SEQ ID NO: 9429325 - DNA, 22 bp, Homo sapiens
gaaagtgccagaataggaggcc

SEQ ID NO: 9429326 - DNA, 22 bp, Homo sapiens
gaaagtgcctcagtcctcttat

SEQ ID NO: 9429327 - DNA, 22 bp, Homo sapiens
gaaagtgcctcagtcctcttat

SEQ ID NO: 9429328 - DNA, 18 bp, Homo sapiens
gaaagtgcggggcagggg

SEQ ID NO: 9429329 - DNA, 18 bp, Homo sapiens
gaaagtgcggggcagggg

SEQ ID NO: 9429330 - DNA, 22 bp, Homo sapiens
gaaaggttgggtgaatggtgga

SEQ ID NO: 9429331 - DNA, 22 bp, Homo sapiens
gaaagtgccagaataggaggcc

SEQ ID NO: 9429332 - DNA, 22 bp, Homo sapiens
gaaagtgcatgtgcccaccatt

SEQ ID NO: 9429333 - DNA, 22 bp, Homo sapiens
gaaagtgcatgtgcccaccatt

SEQ ID NO: 9429334 - DNA, 22 bp, Homo sapiens
gaaaggggcatgtagggatcac

SEQ ID NO: 9429335 - DNA, 17 bp, Homo sapiens
gaaaggtcctagaaatc

SEQ ID NO: 9429336 - DNA, 21 bp, Homo sapiens
gaaaggtcttaacttacagag

SEQ ID NO: 9429337 - DNA, 22 bp, Homo sapiens
gaaagggagtggacaacaggca

SEQ ID NO: 9429338 - DNA, 22 bp, Homo sapiens
gaaagggagtggacaacaggca

SEQ ID NO: 9429339 - DNA, 22 bp, Homo sapiens
gaaagggcatgggcatgacaac

SEQ ID NO: 9429340 - DNA, 22 bp, Homo sapiens
gaaagtgcttagagtgtggtat

SEQ ID NO: 9429341 - DNA, 22 bp, Homo sapiens
gaaagtgcttttgagtgtgtgc

SEQ ID NO: 9429342 - DNA, 22 bp, Homo sapiens
gaaagtgcttttgagtgtgtgc

SEQ ID NO: 9429343 - DNA, 22 bp, Homo sapiens
gaaagtgcttttgagtgtgtgc

SEQ ID NO: 9429344 - DNA, 22 bp, Homo sapiens
gaaagtgctaggaagtgttaga

SEQ ID NO: 9429345 - DNA, 22 bp, Homo sapiens
gaaagtgctaggaagtgttaga

SEQ ID NO: 9429346 - DNA, 22 bp, Homo sapiens
gaaagtgctaggaagtgttaga

SEQ ID NO: 9429347 - DNA, 22 bp, Homo sapiens
gaaagtgcttagagtgtggtat

SEQ ID NO: 9429348 - DNA, 22 bp, Homo sapiens
gaaagtgctctctctatacaca

SEQ ID NO: 9429349 - DNA, 18 bp, Homo sapiens
gaaagtgcggggcagggg

SEQ ID NO: 9429350 - DNA, 22 bp, Homo sapiens
gaaagtgctctctctatacaca

SEQ ID NO: 9429351 - DNA, 22 bp, Homo sapiens
gaaagtttctcacacatgcaga

SEQ ID NO: 9429352 - DNA, 22 bp, Homo sapiens
gaaagtttctcacacatgcaga

SEQ ID NO: 9429353 - DNA, 22 bp, Homo sapiens
gaaagtttataggttatataat

SEQ ID NO: 9429354 - DNA, 22 bp, Homo sapiens
gaaagtttataggttatataat

SEQ ID NO: 9429355 - DNA, 22 bp, Homo sapiens
gaaagggagtgaagatggtata

SEQ ID NO: 9429356 - DNA, 22 bp, Homo sapiens
gaaaggcttggttttgaatata

SEQ ID NO: 9429357 - DNA, 22 bp, Homo sapiens
gaaaggcttgcttttgctcggt

SEQ ID NO: 9429358 - DNA, 22 bp, Homo sapiens
gaaaggcttaaattgtaagggc

SEQ ID NO: 9429359 - DNA, 22 bp, Homo sapiens
gaaaggcttgagacattgatga

SEQ ID NO: 9429360 - DNA, 22 bp, Homo sapiens
gaaaggcttcttaagcttcact

SEQ ID NO: 9429361 - DNA, 22 bp, Homo sapiens
gaaaggctgcatctcgcctcag

SEQ ID NO: 9429362 - DNA, 19 bp, Homo sapiens
gaaaggctgctgctacctg

SEQ ID NO: 9429363 - DNA, 22 bp, Homo sapiens
gaaaggctgggatttagcgctg

SEQ ID NO: 9429364 - DNA, 22 bp, Homo sapiens
gaaaggctactgtcatcaatta

SEQ ID NO: 9429365 - DNA, 22 bp, Homo sapiens
gaaaggctaaaattataagggt

SEQ ID NO: 9429366 - DNA, 22 bp, Homo sapiens
gaaaggccagctcacagatgag

SEQ ID NO: 9429367 - DNA, 22 bp, Homo sapiens
gaaaggcatcttcagtctctga

SEQ ID NO: 9429368 - DNA, 22 bp, Homo sapiens
gaaaggccaccatgccagggac

SEQ ID NO: 9429369 - DNA, 22 bp, Homo sapiens
gaaaggctcagaagtttgtatt

SEQ ID NO: 9429370 - DNA, 22 bp, Homo sapiens
gaaaggctcactttagatcatg

SEQ ID NO: 9429371 - DNA, 22 bp, Homo sapiens
gaaaggctatgagtttggtata

SEQ ID NO: 9429372 - DNA, 22 bp, Homo sapiens
gaaaggctcagattcccccagg

SEQ ID NO: 9429373 - DNA, 23 bp, Homo sapiens
gaaaggctctgggacccccaact

SEQ ID NO: 9429374 - DNA, 18 bp, Homo sapiens
gaaaatactctgggctca

SEQ ID NO: 9429375 - DNA, 21 bp, Homo sapiens
gaaaatacaatgagcttgacc

SEQ ID NO: 9429376 - DNA, 18 bp, Homo sapiens
gaaaatactctgggctca

SEQ ID NO: 9429377 - DNA, 21 bp, Homo sapiens
gaaaatacaatgagcttgacc

SEQ ID NO: 9429378 - DNA, 21 bp, Homo sapiens
gaaaatacaatgagcttgacc

SEQ ID NO: 9429379 - DNA, 22 bp, Homo sapiens
gaaaggcatcttcagtctctga

SEQ ID NO: 9429380 - DNA, 22 bp, Homo sapiens
gaaaggcagtacagctgagcct

SEQ ID NO: 9429381 - DNA, 22 bp, Homo sapiens
gaaaggcagtacagctgagcct

SEQ ID NO: 9429382 - DNA, 22 bp, Homo sapiens
gaaaggcagtacagctgagcct

SEQ ID NO: 9429383 - DNA, 22 bp, Homo sapiens
gaaaggcagtacagctgagcct

SEQ ID NO: 9429384 - DNA, 22 bp, Homo sapiens
gaaaatacaaatagccttgaaa

SEQ ID NO: 9429385 - DNA, 22 bp, Homo sapiens
gaaaatacaaatagccttgaaa

SEQ ID NO: 9429386 - DNA, 22 bp, Homo sapiens
gaaaatacaaatagccttgaaa

SEQ ID NO: 9429387 - DNA, 22 bp, Homo sapiens
gaaaatacaaatagccttgaaa

SEQ ID NO: 9429388 - DNA, 22 bp, Homo sapiens
gaaaatacaaatagccttgaaa

SEQ ID NO: 9429389 - DNA, 21 bp, Homo sapiens
gaaaatacaatgagcttgacc

SEQ ID NO: 9429390 - DNA, 22 bp, Homo sapiens
gaacagagttgaaacaaggctg

SEQ ID NO: 9429391 - DNA, 22 bp, Homo sapiens
gaacagatgggctcagatcctg

SEQ ID NO: 9429392 - DNA, 22 bp, Homo sapiens
gaacagatgggctcagatcctg

SEQ ID NO: 9429393 - DNA, 22 bp, Homo sapiens
gaacagagctgactacaaggca

SEQ ID NO: 9429394 - DNA, 23 bp, Homo sapiens
gaacccagctctgccacttgcca

SEQ ID NO: 9429395 - DNA, 23 bp, Homo sapiens
gaacccagctctgccacttgcca

SEQ ID NO: 9429396 - DNA, 22 bp, Homo sapiens
gaacccagccagactccctaca

SEQ ID NO: 9429397 - DNA, 22 bp, Homo sapiens
gaacctctagtttgttctttga

SEQ ID NO: 9429398 - DNA, 22 bp, Homo sapiens
gaaccccaacttataagacaga

SEQ ID NO: 9429399 - DNA, 22 bp, Homo sapiens
gaacactgaggacactgagaat

SEQ ID NO: 9429400 - DNA, 22 bp, Homo sapiens
gaacactgaggacactgagaat

SEQ ID NO: 9429401 - DNA, 22 bp, Homo sapiens
gaacactgaggacactgagaat

SEQ ID NO: 9429402 - DNA, 22 bp, Homo sapiens
gaacactgaggacactgagaat

SEQ ID NO: 9429403 - DNA, 22 bp, Homo sapiens
gaacactgctgttgggttctga

SEQ ID NO: 9429404 - DNA, 22 bp, Homo sapiens
gaacactgtttcttcgtgaaca

SEQ ID NO: 9429405 - DNA, 22 bp, Homo sapiens
gaacactggggtatcattgagc

SEQ ID NO: 9429406 - DNA, 22 bp, Homo sapiens
gaacactgtttcttcgtgaaca

SEQ ID NO: 9429407 - DNA, 22 bp, Homo sapiens
gaacactggggtatcattgagc

SEQ ID NO: 9429408 - DNA, 22 bp, Homo sapiens
gaacactggggtatcattgagc

SEQ ID NO: 9429409 - DNA, 22 bp, Homo sapiens
gaacactggggtatcattgagc

SEQ ID NO: 9429410 - DNA, 22 bp, Homo sapiens
gaacagaattaccgaagatctg

SEQ ID NO: 9429411 - DNA, 22 bp, Homo sapiens
gaacagaattaccgaagatctg

SEQ ID NO: 9429412 - DNA, 22 bp, Homo sapiens
gaacagaattaccgaagatctg

SEQ ID NO: 9429413 - DNA, 22 bp, Homo sapiens
gaacactgtttcttcgtgaaca

SEQ ID NO: 9429414 - DNA, 22 bp, Homo sapiens
gaacactgtttcttcgtgaaca

SEQ ID NO: 9429415 - DNA, 22 bp, Homo sapiens
gaacacttgctgttaataagtg

SEQ ID NO: 9429416 - DNA, 22 bp, Homo sapiens
gaacactttaacattccttttc

SEQ ID NO: 9429417 - DNA, 22 bp, Homo sapiens
gaacctgagcgggcagcaagcg

SEQ ID NO: 9429418 - DNA, 22 bp, Homo sapiens
gaacctctcagcagccatgatc

SEQ ID NO: 9429419 - DNA, 22 bp, Homo sapiens
gaacctctatatttgtgacatc

SEQ ID NO: 9429420 - DNA, 22 bp, Homo sapiens
gaacctctcagcagccatgatc

SEQ ID NO: 9429421 - DNA, 20 bp, Homo sapiens
gaacctctcccagcccctgg

SEQ ID NO: 9429422 - DNA, 22 bp, Homo sapiens
gaacctctttagtgcatccttc

SEQ ID NO: 9429423 - DNA, 22 bp, Homo sapiens
gaacctctttgtgcttcagctt

SEQ ID NO: 9429424 - DNA, 22 bp, Homo sapiens
gaacctctttaaagaacagaat

SEQ ID NO: 9429425 - DNA, 22 bp, Homo sapiens
gaactacagtaagaattgatgt

SEQ ID NO: 9429426 - DNA, 22 bp, Homo sapiens
gaacgtaaatgttcatgtttga

SEQ ID NO: 9429427 - DNA, 22 bp, Homo sapiens
gaactaaatgaaattactggtg

SEQ ID NO: 9429428 - DNA, 20 bp, Homo sapiens
gaacggcaatggagctggca

SEQ ID NO: 9429429 - DNA, 22 bp, Homo sapiens
gaacgctgtcattgcagcatgg

SEQ ID NO: 9429430 - DNA, 22 bp, Homo sapiens
gaactctgagaggagcacaggc

SEQ ID NO: 9429431 - DNA, 19 bp, Homo sapiens
gaactctgcagactgggaa

SEQ ID NO: 9429432 - DNA, 22 bp, Homo sapiens
gaactctgggcaagccaagggc

SEQ ID NO: 9429433 - DNA, 22 bp, Homo sapiens
gaactcaacgctttcttaggag

SEQ ID NO: 9429434 - DNA, 22 bp, Homo sapiens
gaactcaacacagtatttggta

SEQ ID NO: 9429435 - DNA, 22 bp, Homo sapiens
gaactcagagcctgagctagga

SEQ ID NO: 9429436 - DNA, 19 bp, Homo sapiens
gaactgaggtctgaggctt

SEQ ID NO: 9429437 - DNA, 22 bp, Homo sapiens
gaactgaaacttggtttaaagc

SEQ ID NO: 9429438 - DNA, 22 bp, Homo sapiens
gaactgaagacttttactgtac

SEQ ID NO: 9429439 - DNA, 22 bp, Homo sapiens
gaactggttacagagggatgtt

SEQ ID NO: 9429440 - DNA, 22 bp, Homo sapiens
gaactgtagagaatacatttct

SEQ ID NO: 9429441 - DNA, 22 bp, Homo sapiens
gaactgtaaaataattggcaat

SEQ ID NO: 9429442 - DNA, 22 bp, Homo sapiens
gaaataatacagtgctcttctc

SEQ ID NO: 9429443 - DNA, 22 bp, Homo sapiens
gaaataatacagtgctcttctc

SEQ ID NO: 9429444 - DNA, 22 bp, Homo sapiens
gaaataatacagtgctcttctc

SEQ ID NO: 9429445 - DNA, 22 bp, Homo sapiens
gaaataacctcatgcaccatga

SEQ ID NO: 9429446 - DNA, 22 bp, Homo sapiens
gaaataacctcatgcaccatga

SEQ ID NO: 9429447 - DNA, 22 bp, Homo sapiens
gaaagttttcatatataccaaa

SEQ ID NO: 9429448 - DNA, 22 bp, Homo sapiens
gaaataacagctctggaagagt

SEQ ID NO: 9429449 - DNA, 22 bp, Homo sapiens
gaaagttttctcacacagtaat

SEQ ID NO: 9429450 - DNA, 22 bp, Homo sapiens
gaaagttttctcacacagtaat

SEQ ID NO: 9429451 - DNA, 22 bp, Homo sapiens
gaaagttttctcacacagtaat

SEQ ID NO: 9429452 - DNA, 22 bp, Homo sapiens
gaaagttttcatatataccaaa

SEQ ID NO: 9429453 - DNA, 22 bp, Homo sapiens
gaaagtttgcctctctcttgag

SEQ ID NO: 9429454 - DNA, 22 bp, Homo sapiens
gaaagtttcttcattaagatgt

SEQ ID NO: 9429455 - DNA, 22 bp, Homo sapiens
gaaagtttcttcattaagatgt

SEQ ID NO: 9429456 - DNA, 17 bp, Homo sapiens
gaaagtttctctctctt

SEQ ID NO: 9429457 - DNA, 22 bp, Homo sapiens
gaaataattctgtgtctgaaca

SEQ ID NO: 9429458 - DNA, 22 bp, Homo sapiens
gaaataattctgtgtctgaaca

SEQ ID NO: 9429459 - DNA, 22 bp, Homo sapiens
gaaataatttagaaggtattcc

SEQ ID NO: 9429460 - DNA, 22 bp, Homo sapiens
gaaataatttagaaggtattcc

SEQ ID NO: 9429461 - DNA, 22 bp, Homo sapiens
gaaataatttagaaggtattcc

SEQ ID NO: 9429462 - DNA, 22 bp, Homo sapiens
gaaataatttagaaggtattcc

SEQ ID NO: 9429463 - DNA, 22 bp, Homo sapiens
gaaataatacagtgctcttctc

SEQ ID NO: 9429464 - DNA, 22 bp, Homo sapiens
gaaataattctgtgtctgaaca

SEQ ID NO: 9429465 - DNA, 22 bp, Homo sapiens
gaaataattctgtgtctgaaca

SEQ ID NO: 9429466 - DNA, 22 bp, Homo sapiens
gaaataattctgtgtctgaaca

SEQ ID NO: 9429467 - DNA, 22 bp, Homo sapiens
gaaataatttagaaggtattcc

SEQ ID NO: 9429468 - DNA, 22 bp, Homo sapiens
gaaatacaaagccagccatttt

SEQ ID NO: 9429469 - DNA, 22 bp, Homo sapiens
gaaatacaaagccagccatttt

SEQ ID NO: 9429470 - DNA, 22 bp, Homo sapiens
gaaatacaaagccagccatttt

SEQ ID NO: 9429471 - DNA, 22 bp, Homo sapiens
gaacacaggtggcccggcaggg

SEQ ID NO: 9429472 - DNA, 22 bp, Homo sapiens
gaacacagcggggcttacccgg

SEQ ID NO: 9429473 - DNA, 22 bp, Homo sapiens
gaacacagtcaagggctgctgt

SEQ ID NO: 9429474 - DNA, 22 bp, Homo sapiens
gaacacagtcaagggctgctgt

SEQ ID NO: 9429475 - DNA, 22 bp, Homo sapiens
gaacacagtcaagggctgctgt

SEQ ID NO: 9429476 - DNA, 22 bp, Homo sapiens
gaacacagtcaagggctgctgt

SEQ ID NO: 9429477 - DNA, 22 bp, Homo sapiens
gaacacagtggttgtttggagg

SEQ ID NO: 9429478 - DNA, 22 bp, Homo sapiens
gaacacatcacattttacagtg

SEQ ID NO: 9429479 - DNA, 22 bp, Homo sapiens
gaacacattagtctgagttggc

SEQ ID NO: 9429480 - DNA, 22 bp, Homo sapiens
gaacacatgtcctccttggatt

SEQ ID NO: 9429481 - DNA, 22 bp, Homo sapiens
gaacacatgattataaatgcta

SEQ ID NO: 9429482 - DNA, 22 bp, Homo sapiens
gaacacatttctctgactgtag

SEQ ID NO: 9429483 - DNA, 22 bp, Homo sapiens
gaacacatttctctgactgtag

SEQ ID NO: 9429484 - DNA, 22 bp, Homo sapiens
gaacactgagaaagtcagcttt

SEQ ID NO: 9429485 - DNA, 22 bp, Homo sapiens
gaacactgagagagatgggcag

SEQ ID NO: 9429486 - DNA, 22 bp, Homo sapiens
gaacactgacattttcctgact

SEQ ID NO: 9429487 - DNA, 22 bp, Homo sapiens
gaacactgagaaagtcagcttt

SEQ ID NO: 9429488 - DNA, 22 bp, Homo sapiens
gaacactgacattttcctgact

SEQ ID NO: 9429489 - DNA, 22 bp, Homo sapiens
gaacactgacattttcctgact

SEQ ID NO: 9429490 - DNA, 22 bp, Homo sapiens
gaaatacaaatgcctagatcct

SEQ ID NO: 9429491 - DNA, 19 bp, Homo sapiens
gaacaatttgttagctctc

SEQ ID NO: 9429492 - DNA, 22 bp, Homo sapiens
gaaatttattatctacatcatt

SEQ ID NO: 9429493 - DNA, 22 bp, Homo sapiens
gaaatttacaactttctcatgg

SEQ ID NO: 9429494 - DNA, 22 bp, Homo sapiens
gaacacaactcagaatgctggt

SEQ ID NO: 9429495 - DNA, 22 bp, Homo sapiens
gaacacaactcagaatgctggt

SEQ ID NO: 9429496 - DNA, 22 bp, Homo sapiens
gaacacagcagggataaccact

SEQ ID NO: 9429497 - DNA, 22 bp, Homo sapiens
gaacacagcagggataaccact

SEQ ID NO: 9429498 - DNA, 22 bp, Homo sapiens
gaacacagcagggataaccact

SEQ ID NO: 9429499 - DNA, 22 bp, Homo sapiens
gaacacagaagaatttctaaga

SEQ ID NO: 9429500 - DNA, 22 bp, Homo sapiens
gaacacaactcagaatgctggt

SEQ ID NO: 9429501 - DNA, 22 bp, Homo sapiens
gaacacaagcgtatgtctttgt

SEQ ID NO: 9429502 - DNA, 22 bp, Homo sapiens
cttgggaaaccaatgggctcct

SEQ ID NO: 9429503 - DNA, 19 bp, Homo sapiens
cttggcttagcttcttagc

SEQ ID NO: 9429504 - DNA, 22 bp, Homo sapiens
cttggctttagaacatgggagc

SEQ ID NO: 9429505 - DNA, 22 bp, Homo sapiens
cttggctgtcataaggtcctgg

SEQ ID NO: 9429506 - DNA, 22 bp, Homo sapiens
cttggctggaactcctgagaaa

SEQ ID NO: 9429507 - DNA, 22 bp, Homo sapiens
cttggctggaactcctgagaaa

SEQ ID NO: 9429508 - DNA, 21 bp, Homo sapiens
cttggctgcagtgacaggcat

SEQ ID NO: 9429509 - DNA, 22 bp, Homo sapiens
cttggctgaactccaggatgca

SEQ ID NO: 9429510 - DNA, 22 bp, Homo sapiens
cttgaatgaaaccaactgatga

SEQ ID NO: 9429511 - DNA, 22 bp, Homo sapiens
cttgaatgggccataagacggt

SEQ ID NO: 9429512 - DNA, 22 bp, Homo sapiens
cttgaatggtatgagagtaatt

SEQ ID NO: 9429513 - DNA, 22 bp, Homo sapiens
cttgaatgtaaataatgtacag

SEQ ID NO: 9429514 - DNA, 22 bp, Homo sapiens
cttgaagattgatccagtttga

SEQ ID NO: 9429515 - DNA, 22 bp, Homo sapiens
cttgaagagtgggaaggatttg

SEQ ID NO: 9429516 - DNA, 22 bp, Homo sapiens
cttgaagagtaaattggtacac

SEQ ID NO: 9429517 - DNA, 17 bp, Homo sapiens
cttggcacctctgccat

SEQ ID NO: 9429518 - DNA, 22 bp, Homo sapiens
cttggcacgtgataggtgttga

SEQ ID NO: 9429519 - DNA, 22 bp, Homo sapiens
cttggcacttgggcagtgagca

SEQ ID NO: 9429520 - DNA, 22 bp, Homo sapiens
cttggcacttgggcagtgagca

SEQ ID NO: 9429521 - DNA, 22 bp, Homo sapiens
cttgggagtagaggcaggagca

SEQ ID NO: 9429522 - DNA, 22 bp, Homo sapiens
cttgggcccccacacgagctcg

SEQ ID NO: 9429523 - DNA, 22 bp, Homo sapiens
cttgggccttgagaatgttctg

SEQ ID NO: 9429524 - DNA, 22 bp, Homo sapiens
cttgggccagcccagggggcat

SEQ ID NO: 9429525 - DNA, 22 bp, Homo sapiens
cttgggaggagaacaaagctcc

SEQ ID NO: 9429526 - DNA, 22 bp, Homo sapiens
cttgggagacacaagaagacat

SEQ ID NO: 9429527 - DNA, 22 bp, Homo sapiens
cttgggagtagaggcaggagca

SEQ ID NO: 9429528 - DNA, 22 bp, Homo sapiens
cttggggctttgtgtgtaggat

SEQ ID NO: 9429529 - DNA, 22 bp, Homo sapiens
ctttacaacctaagttgaagct

SEQ ID NO: 9429530 - DNA, 22 bp, Homo sapiens
ctttacaacctaagttgaagct

SEQ ID NO: 9429531 - DNA, 22 bp, Homo sapiens
cttggggctgtcactctggcat

SEQ ID NO: 9429532 - DNA, 22 bp, Homo sapiens
cttggggcagtgcttggcacat

SEQ ID NO: 9429533 - DNA, 22 bp, Homo sapiens
cttggggcagcccaggctgagc

SEQ ID NO: 9429534 - DNA, 22 bp, Homo sapiens
cttggggcagcccaggctgagc

SEQ ID NO: 9429535 - DNA, 22 bp, Homo sapiens
cttggggcagcccaggctgagc

SEQ ID NO: 9429536 - DNA, 22 bp, Homo sapiens
cttgggctcagcaccgtgtgga

SEQ ID NO: 9429537 - DNA, 22 bp, Homo sapiens
cttgggcttagaaggtaagtga

SEQ ID NO: 9429538 - DNA, 22 bp, Homo sapiens
cttggggaagccactgatccct

SEQ ID NO: 9429539 - DNA, 22 bp, Homo sapiens
cttggggattttaaagacctct

SEQ ID NO: 9429540 - DNA, 22 bp, Homo sapiens
cttggggaggacgcagtgtcct

SEQ ID NO: 9429541 - DNA, 22 bp, Homo sapiens
cttggggatgcaaagccagtgt

SEQ ID NO: 9429542 - DNA, 22 bp, Homo sapiens
cttggggaggacgcagtgtcct

SEQ ID NO: 9429543 - DNA, 22 bp, Homo sapiens
cttggggaagccactgatccct

SEQ ID NO: 9429544 - DNA, 22 bp, Homo sapiens
ctttggcagacattaggggtga

SEQ ID NO: 9429545 - DNA, 22 bp, Homo sapiens
ctttggcagcctcagctgcagg

SEQ ID NO: 9429546 - DNA, 22 bp, Homo sapiens
ctttatgactgagttgtcaatt

SEQ ID NO: 9429547 - DNA, 22 bp, Homo sapiens
ctttatgaaaaccagattgggg

SEQ ID NO: 9429548 - DNA, 22 bp, Homo sapiens
ctttatgaaaacctgaattatg

SEQ ID NO: 9429549 - DNA, 22 bp, Homo sapiens
ctttatgaaaaccagattgggg

SEQ ID NO: 9429550 - DNA, 22 bp, Homo sapiens
ctttatgaacctgttcagcttg

SEQ ID NO: 9429551 - DNA, 22 bp, Homo sapiens
ctttatgaaggaacaatgctcc

SEQ ID NO: 9429552 - DNA, 22 bp, Homo sapiens
ctttgtatttaatagctgtctt

SEQ ID NO: 9429553 - DNA, 22 bp, Homo sapiens
ctttgtatctaaatatcttgaa

SEQ ID NO: 9429554 - DNA, 22 bp, Homo sapiens
ctttgtatctaaatatcttgaa

SEQ ID NO: 9429555 - DNA, 22 bp, Homo sapiens
ctttgtatggtggcacttccgt

SEQ ID NO: 9429556 - DNA, 22 bp, Homo sapiens
ctttgtatggtggcacttccgt

SEQ ID NO: 9429557 - DNA, 22 bp, Homo sapiens
ctttgtaatcattcccttggtt

SEQ ID NO: 9429558 - DNA, 22 bp, Homo sapiens
ctttgtaagtctttctccaaga

SEQ ID NO: 9429559 - DNA, 22 bp, Homo sapiens
ctttgtaagtctttctccaaga

SEQ ID NO: 9429560 - DNA, 22 bp, Homo sapiens
ctttggttctgtccttcccaga

SEQ ID NO: 9429561 - DNA, 22 bp, Homo sapiens
ctttggttctgtccttcccaga

SEQ ID NO: 9429562 - DNA, 21 bp, Homo sapiens
ctttggtttcctcctgccttc

SEQ ID NO: 9429563 - DNA, 22 bp, Homo sapiens
ctttagatttctatgtatcact

SEQ ID NO: 9429564 - DNA, 20 bp, Homo sapiens
ctttagttattaacagcact

SEQ ID NO: 9429565 - DNA, 20 bp, Homo sapiens
ctttagttattaacagcact

SEQ ID NO: 9429566 - DNA, 20 bp, Homo sapiens
ctttagttattaacagcact

SEQ ID NO: 9429567 - DNA, 22 bp, Homo sapiens
ctttagtttaagaacatgatga

SEQ ID NO: 9429568 - DNA, 22 bp, Homo sapiens
ctttagtttgtaagagcaagag

SEQ ID NO: 9429569 - DNA, 22 bp, Homo sapiens
ctttagttttcatcaaatctat

SEQ ID NO: 9429570 - DNA, 22 bp, Homo sapiens
ctttagtttgtgatacgaagat

SEQ ID NO: 9429571 - DNA, 22 bp, Homo sapiens
ctttagttctagaaagtgaaac

SEQ ID NO: 9429572 - DNA, 22 bp, Homo sapiens
ctttagaatttgatataatcaa

SEQ ID NO: 9429573 - DNA, 22 bp, Homo sapiens
ctttagaatttgatataatcaa

SEQ ID NO: 9429574 - DNA, 22 bp, Homo sapiens
ctttagaatttgatataatcaa

SEQ ID NO: 9429575 - DNA, 22 bp, Homo sapiens
ctttagaatttgatataatcaa

SEQ ID NO: 9429576 - DNA, 22 bp, Homo sapiens
ctttagaatttgatataatcaa

SEQ ID NO: 9429577 - DNA, 22 bp, Homo sapiens
ctttagaatttcatgtttggtc

SEQ ID NO: 9429578 - DNA, 22 bp, Homo sapiens
ctttacaacctaagttgaagct

SEQ ID NO: 9429579 - DNA, 22 bp, Homo sapiens
ctttacaacctaagttgaagct

SEQ ID NO: 9429580 - DNA, 22 bp, Homo sapiens
ctttacaattcaagggaactct

SEQ ID NO: 9429581 - DNA, 20 bp, Homo sapiens
ctttagaagaacccaagcat

SEQ ID NO: 9429582 - DNA, 22 bp, Homo sapiens
ctttagaaatctggatgtattt

SEQ ID NO: 9429583 - DNA, 22 bp, Homo sapiens
ctttagaaatctggatgtattt

SEQ ID NO: 9429584 - DNA, 22 bp, Homo sapiens
ctttagaagggtaacggaatta

SEQ ID NO: 9429585 - DNA, 20 bp, Homo sapiens
ctttagaagaacccaagcat

SEQ ID NO: 9429586 - DNA, 22 bp, Homo sapiens
ctggctgggagctcgcctgcgg

SEQ ID NO: 9429587 - DNA, 22 bp, Homo sapiens
ctggctggaggtgagtcactga

SEQ ID NO: 9429588 - DNA, 22 bp, Homo sapiens
ctggctggagtgcaggtgagtg

SEQ ID NO: 9429589 - DNA, 22 bp, Homo sapiens
ctggctggagtgcaggtgagtg

SEQ ID NO: 9429590 - DNA, 22 bp, Homo sapiens
ctggctggaggtgagtcactga

SEQ ID NO: 9429591 - DNA, 22 bp, Homo sapiens
ctggctggggtccatcctctaa

SEQ ID NO: 9429592 - DNA, 22 bp, Homo sapiens
ctggctggggtaccagttgaac

SEQ ID NO: 9429593 - DNA, 22 bp, Homo sapiens
ctggctgggcagacagaatgct

SEQ ID NO: 9429594 - DNA, 22 bp, Homo sapiens
ctggctgggcagacagaatgct

SEQ ID NO: 9429595 - DNA, 22 bp, Homo sapiens
ctggctgggcagacagaatgct

SEQ ID NO: 9429596 - DNA, 22 bp, Homo sapiens
ctggctggtcatgtcatgagcc

SEQ ID NO: 9429597 - DNA, 22 bp, Homo sapiens
ctggctggtcatgtcatgagcc

SEQ ID NO: 9429598 - DNA, 22 bp, Homo sapiens
ctggctggtcctcggggacagc

SEQ ID NO: 9429599 - DNA, 22 bp, Homo sapiens
ctggctggtcctcggggacagc

SEQ ID NO: 9429600 - DNA, 22 bp, Homo sapiens
ctggctggtcctcggggacagc

SEQ ID NO: 9429601 - DNA, 22 bp, Homo sapiens
ctggctggtagaattgtgacct

SEQ ID NO: 9429602 - DNA, 22 bp, Homo sapiens
ctggctggggtccatcctctaa

SEQ ID NO: 9429603 - DNA, 22 bp, Homo sapiens
ctggctgggttccaggattcca

SEQ ID NO: 9429604 - DNA, 22 bp, Homo sapiens
ctggctgggttccaggattcca

SEQ ID NO: 9429605 - DNA, 22 bp, Homo sapiens
cttctcagtcacctgtgagtct

SEQ ID NO: 9429606 - DNA, 22 bp, Homo sapiens
ctggctgtgaaatggcagtgtc

SEQ ID NO: 9429607 - DNA, 22 bp, Homo sapiens
cttctccagccacgcccactcc

SEQ ID NO: 9429608 - DNA, 22 bp, Homo sapiens
cttctcattcaagcaaaacaga

SEQ ID NO: 9429609 - DNA, 22 bp, Homo sapiens
cttctcggccgtgtggatgcgc

SEQ ID NO: 9429610 - DNA, 22 bp, Homo sapiens
cttctctccctggcactcagac

SEQ ID NO: 9429611 - DNA, 22 bp, Homo sapiens
cttctctccctggcactcagac

SEQ ID NO: 9429612 - DNA, 22 bp, Homo sapiens
cttctctccctggcactcagac

SEQ ID NO: 9429613 - DNA, 22 bp, Homo sapiens
cttctctccctggcactcagac

SEQ ID NO: 9429614 - DNA, 22 bp, Homo sapiens
cttctctcggtgcatccctcac

SEQ ID NO: 9429615 - DNA, 22 bp, Homo sapiens
cttctctcggtgcatccctcac

SEQ ID NO: 9429616 - DNA, 22 bp, Homo sapiens
cttctctcggtgcatccctcac

SEQ ID NO: 9429617 - DNA, 22 bp, Homo sapiens
ctggctggtctgagcagtcgca

SEQ ID NO: 9429618 - DNA, 22 bp, Homo sapiens
ctggctggtctgagcagtcgca

SEQ ID NO: 9429619 - DNA, 22 bp, Homo sapiens
ctggctggttactatttctggt

SEQ ID NO: 9429620 - DNA, 22 bp, Homo sapiens
ctggctgtcttctgggagctgt

SEQ ID NO: 9429621 - DNA, 22 bp, Homo sapiens
cttctctgcccataggaaatgc

SEQ ID NO: 9429622 - DNA, 22 bp, Homo sapiens
cttctctggctcctcagcgccc

SEQ ID NO: 9429623 - DNA, 22 bp, Homo sapiens
cttctctggctcctcagcgccc

SEQ ID NO: 9429624 - DNA, 22 bp, Homo sapiens
cttctctgacagtctgtttcac

SEQ ID NO: 9429625 - DNA, 22 bp, Homo sapiens
cttctctgcaccccacttttgc

SEQ ID NO: 9429626 - DNA, 22 bp, Homo sapiens
cttctctctgcataggcatggg

SEQ ID NO: 9429627 - DNA, 22 bp, Homo sapiens
cttctctctgcataggcatggg

SEQ ID NO: 9429628 - DNA, 22 bp, Homo sapiens
cttctctctgcataggcatggg

SEQ ID NO: 9429629 - DNA, 22 bp, Homo sapiens
cttctcttcctttgtcaactga

SEQ ID NO: 9429630 - DNA, 22 bp, Homo sapiens
cttctcttcctttgtcaactga

SEQ ID NO: 9429631 - DNA, 22 bp, Homo sapiens
cttctcttgggtgtggtgtctt

SEQ ID NO: 9429632 - DNA, 22 bp, Homo sapiens
cttctctgtcacagggttacgt

SEQ ID NO: 9429633 - DNA, 22 bp, Homo sapiens
cttctctggctcctcagcgccc

SEQ ID NO: 9429634 - DNA, 22 bp, Homo sapiens
cttctctggctcctcagcgccc

SEQ ID NO: 9429635 - DNA, 22 bp, Homo sapiens
cttctcttcccagggacacagg

SEQ ID NO: 9429636 - DNA, 22 bp, Homo sapiens
cttctctgtgtagagattcaga

SEQ ID NO: 9429637 - DNA, 22 bp, Homo sapiens
cttctctgtgtagagattcaga

SEQ ID NO: 9429638 - DNA, 22 bp, Homo sapiens
cttcttcttttaataaatgtct

SEQ ID NO: 9429639 - DNA, 22 bp, Homo sapiens
cttctcttggtagttcttgttg

SEQ ID NO: 9429640 - DNA, 22 bp, Homo sapiens
cttcttgaaacctgctccctca

SEQ ID NO: 9429641 - DNA, 22 bp, Homo sapiens
cttcttcttttgtgggtggtaa

SEQ ID NO: 9429642 - DNA, 22 bp, Homo sapiens
cttcttgaagtcctccagaagt

SEQ ID NO: 9429643 - DNA, 19 bp, Homo sapiens
cttcttgataaggttcttt

SEQ ID NO: 9429644 - DNA, 19 bp, Homo sapiens
cttcttgataaggttcttt

SEQ ID NO: 9429645 - DNA, 22 bp, Homo sapiens
cttgaaagcacttagtaaatta

SEQ ID NO: 9429646 - DNA, 22 bp, Homo sapiens
cttgaaaataagaaagactttc

SEQ ID NO: 9429647 - DNA, 22 bp, Homo sapiens
cttgaagaaatggagacaggat

SEQ ID NO: 9429648 - DNA, 22 bp, Homo sapiens
cttgaaatgacaggagcacatc

SEQ ID NO: 9429649 - DNA, 22 bp, Homo sapiens
cttctttcccaggcatgtttta

SEQ ID NO: 9429650 - DNA, 22 bp, Homo sapiens
cttctttcccaggcatgtttta

SEQ ID NO: 9429651 - DNA, 22 bp, Homo sapiens
cttctttcccaggcatgtttta

SEQ ID NO: 9429652 - DNA, 22 bp, Homo sapiens
cttctttcttttgatcacaggt

SEQ ID NO: 9429653 - DNA, 22 bp, Homo sapiens
cttctttcttttgatcacaggt

SEQ ID NO: 9429654 - DNA, 22 bp, Homo sapiens
cttctttccttcctccagtggc

SEQ ID NO: 9429655 - DNA, 22 bp, Homo sapiens
cttctttcttttgatcacaggt

SEQ ID NO: 9429656 - DNA, 22 bp, Homo sapiens
cttctttgaaaaaggcagtcag

SEQ ID NO: 9429657 - DNA, 22 bp, Homo sapiens
cttctttgaaaaaggcagtcag

SEQ ID NO: 9429658 - DNA, 22 bp, Homo sapiens
gaaggagagggtcaaggataat

SEQ ID NO: 9429659 - DNA, 22 bp, Homo sapiens
gaaggagagggtcaaggataat

SEQ ID NO: 9429660 - DNA, 22 bp, Homo sapiens
gaaggagagggtcaaggataat

SEQ ID NO: 9429661 - DNA, 22 bp, Homo sapiens
gaaggagaggattgtgaggctg

SEQ ID NO: 9429662 - DNA, 22 bp, Homo sapiens
gaaggagaggattgtgaggctg

SEQ ID NO: 9429663 - DNA, 22 bp, Homo sapiens
gaaggagagggtcaaggataat

SEQ ID NO: 9429664 - DNA, 22 bp, Homo sapiens
gaaggagagggtcaaggataat

SEQ ID NO: 9429665 - DNA, 22 bp, Homo sapiens
gaaggagagggtcaaggataat

SEQ ID NO: 9429666 - DNA, 22 bp, Homo sapiens
gaaggcctaggaaggaagcctt

SEQ ID NO: 9429667 - DNA, 22 bp, Homo sapiens
gaaggcccgccctgagcaaggg

SEQ ID NO: 9429668 - DNA, 22 bp, Homo sapiens
gaaggccctggtattcttgagg

SEQ ID NO: 9429669 - DNA, 22 bp, Homo sapiens
gaaggccctgttttccctattt

SEQ ID NO: 9429670 - DNA, 17 bp, Homo sapiens
gaaggcctgcacaggcc

SEQ ID NO: 9429671 - DNA, 22 bp, Homo sapiens
gaaggcggacgccagggggtcg

SEQ ID NO: 9429672 - DNA, 22 bp, Homo sapiens
gaaggagagaaaggcaattctg

SEQ ID NO: 9429673 - DNA, 22 bp, Homo sapiens
gaaggagagaaaggcaattctg

SEQ ID NO: 9429674 - DNA, 22 bp, Homo sapiens
gaaggagagagacatcgtccct

SEQ ID NO: 9429675 - DNA, 22 bp, Homo sapiens
gaaggagagaaaggcaattctg

SEQ ID NO: 9429676 - DNA, 21 bp, Homo sapiens
gaaggagaaagcaagtgctgc

SEQ ID NO: 9429677 - DNA, 22 bp, Homo sapiens
gaaggagaccctgaagatgctg

SEQ ID NO: 9429678 - DNA, 21 bp, Homo sapiens
gaaggagaaagcaagtgctgc

SEQ ID NO: 9429679 - DNA, 22 bp, Homo sapiens
gaaggagaccctgaagatgctg

SEQ ID NO: 9429680 - DNA, 22 bp, Homo sapiens
gaaggagaccctgaagatgctg

SEQ ID NO: 9429681 - DNA, 22 bp, Homo sapiens
gaaggagaggattgtgaggctg

SEQ ID NO: 9429682 - DNA, 22 bp, Homo sapiens
gaaggagaggattgtgaggctg

SEQ ID NO: 9429683 - DNA, 22 bp, Homo sapiens
gaaggagaggattgtgaggctg

SEQ ID NO: 9429684 - DNA, 19 bp, Homo sapiens
gaaggagagctgagttagg

SEQ ID NO: 9429685 - DNA, 21 bp, Homo sapiens
gaaggagaaagcaagtgctgc

SEQ ID NO: 9429686 - DNA, 21 bp, Homo sapiens
gaaggagaaagcaagtgctgc

SEQ ID NO: 9429687 - DNA, 21 bp, Homo sapiens
gaaggagaaagcaagtgctgc

SEQ ID NO: 9429688 - DNA, 21 bp, Homo sapiens
gaaggagaaagcaagtgctgc

SEQ ID NO: 9429689 - DNA, 22 bp, Homo sapiens
gaaggaagtttattttagaaga

SEQ ID NO: 9429690 - DNA, 22 bp, Homo sapiens
gaaggaagtgctcatactagtt

SEQ ID NO: 9429691 - DNA, 22 bp, Homo sapiens
gaaggaagtgctcatactagtt

SEQ ID NO: 9429692 - DNA, 22 bp, Homo sapiens
gaaggaagtcattagtgcagac

SEQ ID NO: 9429693 - DNA, 22 bp, Homo sapiens
gaaggaagtcattagtgcagac

SEQ ID NO: 9429694 - DNA, 22 bp, Homo sapiens
gaaggaagtcattagtgcagac

SEQ ID NO: 9429695 - DNA, 20 bp, Homo sapiens
gaaggaagggggcaaggtga

SEQ ID NO: 9429696 - DNA, 20 bp, Homo sapiens
gaaggaagggggcaaggtga

SEQ ID NO: 9429697 - DNA, 22 bp, Homo sapiens
gaaggaagtcattagtgcagac

SEQ ID NO: 9429698 - DNA, 20 bp, Homo sapiens
gaaggaagggggcaaggtga

SEQ ID NO: 9429699 - DNA, 20 bp, Homo sapiens
gaactgtgcactggtcacag

SEQ ID NO: 9429700 - DNA, 22 bp, Homo sapiens
gaactgtgtttgtttctaggtc

SEQ ID NO: 9429701 - DNA, 22 bp, Homo sapiens
gaactgtgtttgtttctaggtc

SEQ ID NO: 9429702 - DNA, 22 bp, Homo sapiens
gaaggaagggctggctgtcttg

SEQ ID NO: 9429703 - DNA, 22 bp, Homo sapiens
gaaggaagggctggctgtcttg

SEQ ID NO: 9429704 - DNA, 22 bp, Homo sapiens
gaaggaagggctggctgtcttg

SEQ ID NO: 9429705 - DNA, 22 bp, Homo sapiens
gaaggaagctgtctggatgtgt

SEQ ID NO: 9429706 - DNA, 22 bp, Homo sapiens
gaaggaaggaaaaatatattta

SEQ ID NO: 9429707 - DNA, 22 bp, Homo sapiens
gaacttaacggcaactatttaa

SEQ ID NO: 9429708 - DNA, 22 bp, Homo sapiens
gaaggaagccgtttctctccag

SEQ ID NO: 9429709 - DNA, 22 bp, Homo sapiens
gaaggaagccgtttctctccag

SEQ ID NO: 9429710 - DNA, 22 bp, Homo sapiens
gaaggaagccgtttctctccag

SEQ ID NO: 9429711 - DNA, 22 bp, Homo sapiens
gaaggaagccgtttctctccag

SEQ ID NO: 9429712 - DNA, 22 bp, Homo sapiens
gaaggaagctgtctggatgtgt

SEQ ID NO: 9429713 - DNA, 22 bp, Homo sapiens
gaaggaagccgtttctctccag

SEQ ID NO: 9429714 - DNA, 22 bp, Homo sapiens
gaaggaagctgtctggatgtgt

SEQ ID NO: 9429715 - DNA, 19 bp, Homo sapiens
gaaggctgaaatgaagcac

SEQ ID NO: 9429716 - DNA, 22 bp, Homo sapiens
gaaggctctggggattgagata

SEQ ID NO: 9429717 - DNA, 19 bp, Homo sapiens
gaaggctgaaatgaagcac

SEQ ID NO: 9429718 - DNA, 19 bp, Homo sapiens
gaaggctgaaatgaagcac

SEQ ID NO: 9429719 - DNA, 22 bp, Homo sapiens
gaaggctaaaggggcagaggtt

SEQ ID NO: 9429720 - DNA, 22 bp, Homo sapiens
gaaggctaaaggggcagaggtt

SEQ ID NO: 9429721 - DNA, 22 bp, Homo sapiens
gaaggctagaaacgatgcttat

SEQ ID NO: 9429722 - DNA, 22 bp, Homo sapiens
gaaggctacttctcctcagggc

SEQ ID NO: 9429723 - DNA, 22 bp, Homo sapiens
gaaggctatatgactcagccct

SEQ ID NO: 9429724 - DNA, 22 bp, Homo sapiens
gaaggctgcgaggggagtgccg

SEQ ID NO: 9429725 - DNA, 22 bp, Homo sapiens
gaaggctgagcagacaggccaa

SEQ ID NO: 9429726 - DNA, 22 bp, Homo sapiens
gaaggctgagtgggtacggagg

SEQ ID NO: 9429727 - DNA, 22 bp, Homo sapiens
gaaggctgagcagacaggccaa

SEQ ID NO: 9429728 - DNA, 22 bp, Homo sapiens
gaaggctgagcagacaggccaa

SEQ ID NO: 9429729 - DNA, 22 bp, Homo sapiens
gaaggctgagtgggtacggagg

SEQ ID NO: 9429730 - DNA, 22 bp, Homo sapiens
gaaggctgcatggaggctgtgg

SEQ ID NO: 9429731 - DNA, 22 bp, Homo sapiens
gaaggctgcgaggggagtgccg

SEQ ID NO: 9429732 - DNA, 22 bp, Homo sapiens
gaagggaaggaaagaaccagca

SEQ ID NO: 9429733 - DNA, 22 bp, Homo sapiens
gaagtcttttcttccacccaaa

SEQ ID NO: 9429734 - DNA, 22 bp, Homo sapiens
gaagtaacattacttttcatga

SEQ ID NO: 9429735 - DNA, 18 bp, Homo sapiens
gaagtgaagtgactcaat

SEQ ID NO: 9429736 - DNA, 22 bp, Homo sapiens
gaagtggaagccatcggcagtc

SEQ ID NO: 9429737 - DNA, 22 bp, Homo sapiens
gaagtgcaaaaccacatggtaa

SEQ ID NO: 9429738 - DNA, 22 bp, Homo sapiens
gaagtgaagagattagaaatca

SEQ ID NO: 9429739 - DNA, 22 bp, Homo sapiens
gaagtgaagagattagaaatca

SEQ ID NO: 9429740 - DNA, 22 bp, Homo sapiens
gaagtgaaggttactctagatt

SEQ ID NO: 9429741 - DNA, 23 bp, Homo sapiens
gaagtgtctgagctgtatttttc

SEQ ID NO: 9429742 - DNA, 22 bp, Homo sapiens
gaagtgtctccgtttttaaagg

SEQ ID NO: 9429743 - DNA, 22 bp, Homo sapiens
gaagtgtgaaggtgatgtggag

SEQ ID NO: 9429744 - DNA, 22 bp, Homo sapiens
gaagtgtgcacatcttacaagt

SEQ ID NO: 9429745 - DNA, 22 bp, Homo sapiens
gaagttacatactgtcacttct

SEQ ID NO: 9429746 - DNA, 22 bp, Homo sapiens
gaagttaccgaacctctccatg

SEQ ID NO: 9429747 - DNA, 22 bp, Homo sapiens
gaagtgggctttgtggtcagct

SEQ ID NO: 9429748 - DNA, 22 bp, Homo sapiens
gaagtgggctttgtggtcagct

SEQ ID NO: 9429749 - DNA, 22 bp, Homo sapiens
gaagtgggctttgtggtcagct

SEQ ID NO: 9429750 - DNA, 22 bp, Homo sapiens
gaagtggaattactgggtcata

SEQ ID NO: 9429751 - DNA, 22 bp, Homo sapiens
gaagtggaagccatcggcagtc

SEQ ID NO: 9429752 - DNA, 22 bp, Homo sapiens
gaagtgggtggtgatatcactg

SEQ ID NO: 9429753 - DNA, 22 bp, Homo sapiens
gaatttaagaggatgaatctgt

SEQ ID NO: 9429754 - DNA, 22 bp, Homo sapiens
gaatttaaatttaaatctacca

SEQ ID NO: 9429755 - DNA, 22 bp, Homo sapiens
gaatttaaatttaaatctacca

SEQ ID NO: 9429756 - DNA, 22 bp, Homo sapiens
gacacagagataggcctgtgtt

SEQ ID NO: 9429757 - DNA, 22 bp, Homo sapiens
gaatttaaggaccaagcatttt

SEQ ID NO: 9429758 - DNA, 22 bp, Homo sapiens
gaattgtagagggaacagaagc

SEQ ID NO: 9429759 - DNA, 22 bp, Homo sapiens
gaattgtattgatttttcagag

SEQ ID NO: 9429760 - DNA, 22 bp, Homo sapiens
gaattgtattgatttttcagag

SEQ ID NO: 9429761 - DNA, 22 bp, Homo sapiens
gaattgtattgatttttcagag

SEQ ID NO: 9429762 - DNA, 22 bp, Homo sapiens
gaattgggggttttgcaaggca

SEQ ID NO: 9429763 - DNA, 22 bp, Homo sapiens
gaattgggggttttgcaaggca

SEQ ID NO: 9429764 - DNA, 22 bp, Homo sapiens
gaattgtaagtaccagcatgct

SEQ ID NO: 9429765 - DNA, 22 bp, Homo sapiens
gaattgtaagtaccagcatgct

SEQ ID NO: 9429766 - DNA, 22 bp, Homo sapiens
gaattgtacgctttacataggt

SEQ ID NO: 9429767 - DNA, 22 bp, Homo sapiens
gaattgtactgcaatcagggga

SEQ ID NO: 9429768 - DNA, 22 bp, Homo sapiens
gaattctagggtaaatatccta

SEQ ID NO: 9429769 - DNA, 22 bp, Homo sapiens
gaattctagtcacacacattca

SEQ ID NO: 9429770 - DNA, 22 bp, Homo sapiens
gaattctagtcacacacattca

SEQ ID NO: 9429771 - DNA, 22 bp, Homo sapiens
gaattctgggagagatctgaca

SEQ ID NO: 9429772 - DNA, 22 bp, Homo sapiens
gaattctgggagagatctgaca

SEQ ID NO: 9429773 - DNA, 22 bp, Homo sapiens
gaattctgtcgcttactagatg

SEQ ID NO: 9429774 - DNA, 22 bp, Homo sapiens
gaattctgtcgcttactagatg

SEQ ID NO: 9429775 - DNA, 22 bp, Homo sapiens
gaattctgtcgcttactagatg

SEQ ID NO: 9429776 - DNA, 22 bp, Homo sapiens
gaattctgggagagatctgaca

SEQ ID NO: 9429777 - DNA, 22 bp, Homo sapiens
gaattctggttttgaaatgaat

SEQ ID NO: 9429778 - DNA, 22 bp, Homo sapiens
gaattctggttttgaaatgaat

SEQ ID NO: 9429779 - DNA, 22 bp, Homo sapiens
gaattcttctgtctttaactga

SEQ ID NO: 9429780 - DNA, 23 bp, Homo sapiens
gaattcttaaggtcactaaagtc

SEQ ID NO: 9429781 - DNA, 22 bp, Homo sapiens
gaattctttgatcttaatcttg

SEQ ID NO: 9429782 - DNA, 22 bp, Homo sapiens
gaattcttttctttctgaaagt

SEQ ID NO: 9429783 - DNA, 22 bp, Homo sapiens
gaattcttttctttctgaaagt

SEQ ID NO: 9429784 - DNA, 19 bp, Homo sapiens
gaattatttttatgggatg

SEQ ID NO: 9429785 - DNA, 22 bp, Homo sapiens
gaattataggtttgcatgctaa

SEQ ID NO: 9429786 - DNA, 22 bp, Homo sapiens
gaattataggtttgcatgctaa

SEQ ID NO: 9429787 - DNA, 22 bp, Homo sapiens
gaattcaagtgcaatggtatat

SEQ ID NO: 9429788 - DNA, 22 bp, Homo sapiens
gaattcacttgtcttccatttt

SEQ ID NO: 9429789 - DNA, 22 bp, Homo sapiens
gaattccactttggcttttggg

SEQ ID NO: 9429790 - DNA, 22 bp, Homo sapiens
gaattcctctgagctaggagat

SEQ ID NO: 9429791 - DNA, 22 bp, Homo sapiens
gaattataaactagtgacttca

SEQ ID NO: 9429792 - DNA, 22 bp, Homo sapiens
gaattataaactagtgacttca

SEQ ID NO: 9429793 - DNA, 22 bp, Homo sapiens
gaattataaactagtgacttca

SEQ ID NO: 9429794 - DNA, 22 bp, Homo sapiens
gaattataggcaaagcagtcat

SEQ ID NO: 9429795 - DNA, 22 bp, Homo sapiens
gaattataggcaaagcagtcat

SEQ ID NO: 9429796 - DNA, 22 bp, Homo sapiens
gaattacatgaccctgagtaga

SEQ ID NO: 9429797 - DNA, 22 bp, Homo sapiens
gaagttattttacctgttaaag

SEQ ID NO: 9429798 - DNA, 22 bp, Homo sapiens
gaagttattttacctgttaaag

SEQ ID NO: 9429799 - DNA, 22 bp, Homo sapiens
gaagttattttacctgttaaag

SEQ ID NO: 9429800 - DNA, 22 bp, Homo sapiens
gaagttatcaggattaaagttg

SEQ ID NO: 9429801 - DNA, 22 bp, Homo sapiens
gaagttatttgctatctactga

SEQ ID NO: 9429802 - DNA, 22 bp, Homo sapiens
gaagttatcaaagatgtattct

SEQ ID NO: 9429803 - DNA, 22 bp, Homo sapiens
gaagttatcaggattaaagttg

SEQ ID NO: 9429804 - DNA, 22 bp, Homo sapiens
gaagttatcaggattaaagttg

SEQ ID NO: 9429805 - DNA, 22 bp, Homo sapiens
gaagttcaactgccatgcttgg

SEQ ID NO: 9429806 - DNA, 22 bp, Homo sapiens
gaagttctagaactgtgccctt

SEQ ID NO: 9429807 - DNA, 22 bp, Homo sapiens
gaagttccagtgatataaaact

SEQ ID NO: 9429808 - DNA, 22 bp, Homo sapiens
gaagttcctcgtaggagtctct

SEQ ID NO: 9429809 - DNA, 22 bp, Homo sapiens
gacacagagctcacagtctcct

SEQ ID NO: 9429810 - DNA, 22 bp, Homo sapiens
gacacagagctcacagtctcct

SEQ ID NO: 9429811 - DNA, 22 bp, Homo sapiens
gacacagagctcacagtctcct

SEQ ID NO: 9429812 - DNA, 22 bp, Homo sapiens
gacacagagataggcctgtgtt

SEQ ID NO: 9429813 - DNA, 22 bp, Homo sapiens
gacacagagtattttaagtact

SEQ ID NO: 9429814 - DNA, 22 bp, Homo sapiens
gacacagctaatggcttaggac

SEQ ID NO: 9429815 - DNA, 22 bp, Homo sapiens
gacacagatgatcaggtgtgga

SEQ ID NO: 9429816 - DNA, 22 bp, Homo sapiens
gacacagctttctgaagagcat

SEQ ID NO: 9429817 - DNA, 22 bp, Homo sapiens
gacacagcttgatgagggcttt

SEQ ID NO: 9429818 - DNA, 22 bp, Homo sapiens
gacacagcttgatgagggcttt

SEQ ID NO: 9429819 - DNA, 22 bp, Homo sapiens
gacacagcttgatgagggcttt

SEQ ID NO: 9429820 - DNA, 22 bp, Homo sapiens
gacacagatatctctgagatta

SEQ ID NO: 9429821 - DNA, 22 bp, Homo sapiens
gacacagatatctctgagatta

SEQ ID NO: 9429822 - DNA, 22 bp, Homo sapiens
gacacagatgatcaggtgtgga

SEQ ID NO: 9429823 - DNA, 22 bp, Homo sapiens
gacacagatgatcaggtgtgga

SEQ ID NO: 9429824 - DNA, 20 bp, Homo sapiens
gacacaggcagtcctcagag

SEQ ID NO: 9429825 - DNA, 20 bp, Homo sapiens
gacacaggcagtcctcagag

SEQ ID NO: 9429826 - DNA, 22 bp, Homo sapiens
gacacaggattcctggctctgc

SEQ ID NO: 9429827 - DNA, 22 bp, Homo sapiens
gacacaggattcctggctctgc

SEQ ID NO: 9429828 - DNA, 18 bp, Homo sapiens
gacacaggagagagtccc

SEQ ID NO: 9429829 - DNA, 23 bp, Homo sapiens
gacacaggagcacccagctgagc

SEQ ID NO: 9429830 - DNA, 22 bp, Homo sapiens
gacacaggaaaagctccagccc

SEQ ID NO: 9429831 - DNA, 22 bp, Homo sapiens
gacacagctttctgaagagcat

SEQ ID NO: 9429832 - DNA, 22 bp, Homo sapiens
gacacaggggggcgctagaaga

SEQ ID NO: 9429833 - DNA, 22 bp, Homo sapiens
gacacaggggggcgctagaaga

SEQ ID NO: 9429834 - DNA, 22 bp, Homo sapiens
gacacagggggatgtgtggacg

SEQ ID NO: 9429835 - DNA, 22 bp, Homo sapiens
gacacagggggatgtgtggacg

SEQ ID NO: 9429836 - DNA, 22 bp, Homo sapiens
gacacagggacgtgctctgcct

SEQ ID NO: 9429837 - DNA, 22 bp, Homo sapiens
gacacagggggatgtgtggacg

SEQ ID NO: 9429838 - DNA, 22 bp, Homo sapiens
gacagctgtggagaggcatgtg

SEQ ID NO: 9429839 - DNA, 22 bp, Homo sapiens
gacagctgtggagaggcatgtg

SEQ ID NO: 9429840 - DNA, 22 bp, Homo sapiens
gacagctgtggagaggcatgtg

SEQ ID NO: 9429841 - DNA, 22 bp, Homo sapiens
gacagctgtggagaggcatgtg

SEQ ID NO: 9429842 - DNA, 22 bp, Homo sapiens
gacaggaacataaatgtaggag

SEQ ID NO: 9429843 - DNA, 22 bp, Homo sapiens
gacagctgtgcaggagaagggg

SEQ ID NO: 9429844 - DNA, 18 bp, Homo sapiens
gacagctgtcctgagccc

SEQ ID NO: 9429845 - DNA, 18 bp, Homo sapiens
gacagctgtcctgagccc

SEQ ID NO: 9429846 - DNA, 19 bp, Homo sapiens
gacaggaaggctaccagta

SEQ ID NO: 9429847 - DNA, 19 bp, Homo sapiens
gacaggaaggctaccagta

SEQ ID NO: 9429848 - DNA, 22 bp, Homo sapiens
gacaggaacataaatgtaggag

SEQ ID NO: 9429849 - DNA, 22 bp, Homo sapiens
gacaggaacataaatgtaggag

SEQ ID NO: 9429850 - DNA, 22 bp, Homo sapiens
gacaggaacataaatgtaggag

SEQ ID NO: 9429851 - DNA, 22 bp, Homo sapiens
gacaggaagtctgaaggaggga

SEQ ID NO: 9429852 - DNA, 22 bp, Homo sapiens
gacaggaagtctgaaggaggga

SEQ ID NO: 9429853 - DNA, 19 bp, Homo sapiens
gacaggaaggctaccagta

SEQ ID NO: 9429854 - DNA, 22 bp, Homo sapiens
gacaggaatgtgtggatgcgga

SEQ ID NO: 9429855 - DNA, 22 bp, Homo sapiens
gacaggaatgtgtggatgcgga

SEQ ID NO: 9429856 - DNA, 20 bp, Homo sapiens
gacaggagagttaggtaggt

SEQ ID NO: 9429857 - DNA, 20 bp, Homo sapiens
gacaggagagttaggtaggt

SEQ ID NO: 9429858 - DNA, 20 bp, Homo sapiens
gacaggagagttaggtaggt

SEQ ID NO: 9429859 - DNA, 20 bp, Homo sapiens
gacaggagagttaggtaggt

SEQ ID NO: 9429860 - DNA, 20 bp, Homo sapiens
gacaggagagttaggtaggt

SEQ ID NO: 9429861 - DNA, 22 bp, Homo sapiens
gacaggcaggccagggctgtgg

SEQ ID NO: 9429862 - DNA, 22 bp, Homo sapiens
gacaggcaggccagggctgtgg

SEQ ID NO: 9429863 - DNA, 22 bp, Homo sapiens
gacaggccagacaggagactga

SEQ ID NO: 9429864 - DNA, 22 bp, Homo sapiens
gacaggcatgctttcaggacta

SEQ ID NO: 9429865 - DNA, 22 bp, Homo sapiens
gaccaggctgttccagtctaac

SEQ ID NO: 9429866 - DNA, 22 bp, Homo sapiens
gaccatcctggccaacgtggta

SEQ ID NO: 9429867 - DNA, 22 bp, Homo sapiens
gaccagttttctgctttggaag

SEQ ID NO: 9429868 - DNA, 22 bp, Homo sapiens
gaccaggtccaaagctactgtc

SEQ ID NO: 9429869 - DNA, 22 bp, Homo sapiens
gaccagtaaccagtgaccagtg

SEQ ID NO: 9429870 - DNA, 21 bp, Homo sapiens
gacaggcaaggagtcacttag

SEQ ID NO: 9429871 - DNA, 20 bp, Homo sapiens
gacaggagagttaggtaggt

SEQ ID NO: 9429872 - DNA, 22 bp, Homo sapiens
gacaggaggcagagctcaggtg

SEQ ID NO: 9429873 - DNA, 22 bp, Homo sapiens
gacaggaggcagagctcaggtg

SEQ ID NO: 9429874 - DNA, 22 bp, Homo sapiens
gacaggaggcagagctcaggtg

SEQ ID NO: 9429875 - DNA, 22 bp, Homo sapiens
gacaggaggcagagctcaggtg

SEQ ID NO: 9429876 - DNA, 22 bp, Homo sapiens
gacccaggggcagggagaaagt

SEQ ID NO: 9429877 - DNA, 22 bp, Homo sapiens
gacccagggtatccagagctgc

SEQ ID NO: 9429878 - DNA, 22 bp, Homo sapiens
gacccagggtatccagagctgc

SEQ ID NO: 9429879 - DNA, 22 bp, Homo sapiens
gacccaggagagagggttgcat

SEQ ID NO: 9429880 - DNA, 22 bp, Homo sapiens
gacccaggagtgcagagagtgg

SEQ ID NO: 9429881 - DNA, 22 bp, Homo sapiens
gacccaggagtgcagagagtgg

SEQ ID NO: 9429882 - DNA, 22 bp, Homo sapiens
gacccaggctcgtgggacggct

SEQ ID NO: 9429883 - DNA, 22 bp, Homo sapiens
gacccagaggcctgacagtgtg

SEQ ID NO: 9429884 - DNA, 22 bp, Homo sapiens
gacccagaggcctgacagtgtg

SEQ ID NO: 9429885 - DNA, 22 bp, Homo sapiens
gaccatttttacagagcattca

SEQ ID NO: 9429886 - DNA, 22 bp, Homo sapiens
gaccatttttacagagcattca

SEQ ID NO: 9429887 - DNA, 22 bp, Homo sapiens
gaccatttgctagtaaattgca

SEQ ID NO: 9429888 - DNA, 22 bp, Homo sapiens
gaccatttgctagtaaattgca

SEQ ID NO: 9429889 - DNA, 22 bp, Homo sapiens
gaccatttgttgaaaagattat

SEQ ID NO: 9429890 - DNA, 22 bp, Homo sapiens
gaccattagctgctattcagta

SEQ ID NO: 9429891 - DNA, 22 bp, Homo sapiens
gaccattagctgctattcagta

SEQ ID NO: 9429892 - DNA, 22 bp, Homo sapiens
gaccatttcaggggcagggact

SEQ ID NO: 9429893 - DNA, 22 bp, Homo sapiens
gaccatttccaccatgggcaca

SEQ ID NO: 9429894 - DNA, 22 bp, Homo sapiens
gaccatttctaggaatcagact

SEQ ID NO: 9429895 - DNA, 22 bp, Homo sapiens
gacccagctaaccaggtgggga

SEQ ID NO: 9429896 - DNA, 18 bp, Homo sapiens
gacccagcagatgggctt

SEQ ID NO: 9429897 - DNA, 22 bp, Homo sapiens
gacccagcttaagtcacatgtt

SEQ ID NO: 9429898 - DNA, 22 bp, Homo sapiens
gacccaggaagctacttctggt

SEQ ID NO: 9429899 - DNA, 18 bp, Homo sapiens
gacccaggaaagagtcct

SEQ ID NO: 9429900 - DNA, 18 bp, Homo sapiens
gacccaggaaagagtcct

SEQ ID NO: 9429901 - DNA, 22 bp, Homo sapiens
gacccagcttaagtcacatgtt

SEQ ID NO: 9429902 - DNA, 18 bp, Homo sapiens
gacccaggaaagagtcct

SEQ ID NO: 9429903 - DNA, 22 bp, Homo sapiens
gactgtgccagtcagtgggcgg

SEQ ID NO: 9429904 - DNA, 22 bp, Homo sapiens
gactggtttctagcctcatagt

SEQ ID NO: 9429905 - DNA, 22 bp, Homo sapiens
gactggtttgccaccgacagat

SEQ ID NO: 9429906 - DNA, 22 bp, Homo sapiens
gactggtaaggtattggaattc

SEQ ID NO: 9429907 - DNA, 22 bp, Homo sapiens
gactgtggcaggctcagcactg

SEQ ID NO: 9429908 - DNA, 22 bp, Homo sapiens
gacccagggtggtcacctgaaa

SEQ ID NO: 9429909 - DNA, 22 bp, Homo sapiens
gacccagggtggtcacctgaaa

SEQ ID NO: 9429910 - DNA, 22 bp, Homo sapiens
gacccagggtttctgcacaggg

SEQ ID NO: 9429911 - DNA, 22 bp, Homo sapiens
gacccagggtttctgcacaggg

SEQ ID NO: 9429912 - DNA, 22 bp, Homo sapiens
gactgcttatatgttaaagata

SEQ ID NO: 9429913 - DNA, 22 bp, Homo sapiens
gactgcttaaatatatgatgtt

SEQ ID NO: 9429914 - DNA, 22 bp, Homo sapiens
gactggttgaactcaggacaga

SEQ ID NO: 9429915 - DNA, 22 bp, Homo sapiens
gactggttgctaagcacagctt

SEQ ID NO: 9429916 - DNA, 22 bp, Homo sapiens
gactggttatccccagcacaca

SEQ ID NO: 9429917 - DNA, 22 bp, Homo sapiens
gactggtcttttgtgatggatg

SEQ ID NO: 9429918 - DNA, 22 bp, Homo sapiens
gactggggtaaggtgaggaggt

SEQ ID NO: 9429919 - DNA, 22 bp, Homo sapiens
gactggaaagcctgtcctcaga

SEQ ID NO: 9429920 - DNA, 22 bp, Homo sapiens
gactggaaagcctgtcctcaga

SEQ ID NO: 9429921 - DNA, 22 bp, Homo sapiens
gacttcttcatgtcttttccac

SEQ ID NO: 9429922 - DNA, 19 bp, Homo sapiens
gacttctgatgtccagatg

SEQ ID NO: 9429923 - DNA, 22 bp, Homo sapiens
gacttgggagtcttctgagatg

SEQ ID NO: 9429924 - DNA, 22 bp, Homo sapiens
gacttgggggaagatgtggctg

SEQ ID NO: 9429925 - DNA, 22 bp, Homo sapiens
gacttgggtgtcggggcagtct

SEQ ID NO: 9429926 - DNA, 22 bp, Homo sapiens
gacttgggtgtcggggcagtct

SEQ ID NO: 9429927 - DNA, 20 bp, Homo sapiens
gacttcccatatcttcttca

SEQ ID NO: 9429928 - DNA, 20 bp, Homo sapiens
gacttcaatttctatctttt

SEQ ID NO: 9429929 - DNA, 19 bp, Homo sapiens
gacttctgatgtccagatg

SEQ ID NO: 9429930 - DNA, 22 bp, Homo sapiens
gacttctgaattcctatcaggt

SEQ ID NO: 9429931 - DNA, 22 bp, Homo sapiens
gacttctcccaaccatcagagg

SEQ ID NO: 9429932 - DNA, 22 bp, Homo sapiens
gacttctcccaaccatcagagg

SEQ ID NO: 9429933 - DNA, 22 bp, Homo sapiens
gacttaatttccactttctgct

SEQ ID NO: 9429934 - DNA, 17 bp, Homo sapiens
gacttcaacttctgctg

SEQ ID NO: 9429935 - DNA, 22 bp, Homo sapiens
gacttcaaaagctgacattcat

SEQ ID NO: 9429936 - DNA, 22 bp, Homo sapiens
gactgtggtctgttctccaggt

SEQ ID NO: 9429937 - DNA, 22 bp, Homo sapiens
gactgtgtccatgtgctggatt

SEQ ID NO: 9429938 - DNA, 22 bp, Homo sapiens
gagacacaggtggttcctgtca

SEQ ID NO: 9429939 - DNA, 22 bp, Homo sapiens
gagacacagttatcaggcatac

SEQ ID NO: 9429940 - DNA, 22 bp, Homo sapiens
gagacacagttatcaggcatac

SEQ ID NO: 9429941 - DNA, 22 bp, Homo sapiens
gagacacagcagatattcaatc

SEQ ID NO: 9429942 - DNA, 22 bp, Homo sapiens
gagacacaggcacagaagaggc

SEQ ID NO: 9429943 - DNA, 22 bp, Homo sapiens
gagacacaggcacagaagaggc

SEQ ID NO: 9429944 - DNA, 22 bp, Homo sapiens
gagacacagttatcaggcatac

SEQ ID NO: 9429945 - DNA, 22 bp, Homo sapiens
gagacactcaacaaagatatga

SEQ ID NO: 9429946 - DNA, 22 bp, Homo sapiens
gagacacttgctgtgaggtcgc

SEQ ID NO: 9429947 - DNA, 18 bp, Homo sapiens
gagacacaagggcctgga

SEQ ID NO: 9429948 - DNA, 18 bp, Homo sapiens
gagacacaagggcctgga

SEQ ID NO: 9429949 - DNA, 22 bp, Homo sapiens
gagacacaagaagacatgcaca

SEQ ID NO: 9429950 - DNA, 22 bp, Homo sapiens
gagacacaatttccccatccta

SEQ ID NO: 9429951 - DNA, 22 bp, Homo sapiens
gagacacacattctggagagaa

SEQ ID NO: 9429952 - DNA, 22 bp, Homo sapiens
gagacacacacaggaggtggca

SEQ ID NO: 9429953 - DNA, 22 bp, Homo sapiens
gagacacacccaaggttatgag

SEQ ID NO: 9429954 - DNA, 22 bp, Homo sapiens
gagacacacccaaggttatgag

SEQ ID NO: 9429955 - DNA, 22 bp, Homo sapiens
gacttttagaatggtgaggaat

SEQ ID NO: 9429956 - DNA, 22 bp, Homo sapiens
gacttttccatcatccccctta

SEQ ID NO: 9429957 - DNA, 22 bp, Homo sapiens
gacttttctgagacaatgcttt

SEQ ID NO: 9429958 - DNA, 22 bp, Homo sapiens
gactttggtttgagcaagtcag

SEQ ID NO: 9429959 - DNA, 22 bp, Homo sapiens
gactttgtaggtaattgtgtct

SEQ ID NO: 9429960 - DNA, 22 bp, Homo sapiens
gactttgtaggtaattgtgtct

SEQ ID NO: 9429961 - DNA, 22 bp, Homo sapiens
gactttgtgccaaacgccagaa

SEQ ID NO: 9429962 - DNA, 22 bp, Homo sapiens
gactttgtgccaaacgccagaa

SEQ ID NO: 9429963 - DNA, 22 bp, Homo sapiens
gagaaaagcgaaggacctggag

SEQ ID NO: 9429964 - DNA, 22 bp, Homo sapiens
gagaaaagcgaaggacctggag

SEQ ID NO: 9429965 - DNA, 22 bp, Homo sapiens
gagaaaatagcatgtgtagtat

SEQ ID NO: 9429966 - DNA, 22 bp, Homo sapiens
gagaaaatgtcagacttggtcg

SEQ ID NO: 9429967 - DNA, 22 bp, Homo sapiens
gagaaacaacacttgatgcctt

SEQ ID NO: 9429968 - DNA, 22 bp, Homo sapiens
gagaaaatcttgggtcaagaat

SEQ ID NO: 9429969 - DNA, 22 bp, Homo sapiens
gagaaaatcttgggtcaagaat

SEQ ID NO: 9429970 - DNA, 22 bp, Homo sapiens
gagaaaatcttgggtcaagaat

SEQ ID NO: 9429971 - DNA, 22 bp, Homo sapiens
gagacacaagaagacatgcaca

SEQ ID NO: 9429972 - DNA, 22 bp, Homo sapiens
gagaaacaacacttgatgcctt

SEQ ID NO: 9429973 - DNA, 22 bp, Homo sapiens
gagacacaagaagacatgcaca

SEQ ID NO: 9429974 - DNA, 22 bp, Homo sapiens
gagaaacaacacttgatgcctt

SEQ ID NO: 9429975 - DNA, 22 bp, Homo sapiens
gagaaacaacacttgatgcctt

SEQ ID NO: 9429976 - DNA, 22 bp, Homo sapiens
gactttattatagtggcaatag

SEQ ID NO: 9429977 - DNA, 22 bp, Homo sapiens
gactttattactaaccctgtga

SEQ ID NO: 9429978 - DNA, 22 bp, Homo sapiens
gagagtctaggaacctcatata

SEQ ID NO: 9429979 - DNA, 22 bp, Homo sapiens
gagagtccttagtttgcaggta

SEQ ID NO: 9429980 - DNA, 22 bp, Homo sapiens
gagaggtacaccctttaaactt

SEQ ID NO: 9429981 - DNA, 22 bp, Homo sapiens
gagaggtacggaaagagcgtgg

SEQ ID NO: 9429982 - DNA, 20 bp, Homo sapiens
gagagctggggatgaggctg

SEQ ID NO: 9429983 - DNA, 22 bp, Homo sapiens
gagaggtaatttgaagtgcaaa

SEQ ID NO: 9429984 - DNA, 22 bp, Homo sapiens
gagagctgggttcaagtagctg

SEQ ID NO: 9429985 - DNA, 22 bp, Homo sapiens
gagagctggattctggataggt

SEQ ID NO: 9429986 - DNA, 22 bp, Homo sapiens
gagagctggagttatttctctg

SEQ ID NO: 9429987 - DNA, 22 bp, Homo sapiens
gagagctgggctttgggtgaag

SEQ ID NO: 9429988 - DNA, 22 bp, Homo sapiens
gagagctgggctttgggtgaag

SEQ ID NO: 9429989 - DNA, 20 bp, Homo sapiens
gagagctggggatgaggctg

SEQ ID NO: 9429990 - DNA, 22 bp, Homo sapiens
gagagctgaggggcctggcact

SEQ ID NO: 9429991 - DNA, 22 bp, Homo sapiens
gagagctgatagatgagctact

SEQ ID NO: 9429992 - DNA, 22 bp, Homo sapiens
gagagctgatagatgagctact

SEQ ID NO: 9429993 - DNA, 22 bp, Homo sapiens
gagagctgcagccgagaggggg

SEQ ID NO: 9429994 - DNA, 17 bp, Homo sapiens
gagagctgctgcttccg

SEQ ID NO: 9429995 - DNA, 17 bp, Homo sapiens
gagagctgctgcttccg

SEQ ID NO: 9429996 - DNA, 20 bp, Homo sapiens
gagagctggaaataaagtcc

SEQ ID NO: 9429997 - DNA, 18 bp, Homo sapiens
gagagctgctacctagct

SEQ ID NO: 9429998 - DNA, 22 bp, Homo sapiens
gagagctgcattctcagacaca

SEQ ID NO: 9429999 - DNA, 22 bp, Homo sapiens
gagacagagatcttgctgagtc

SEQ ID NO: 9430000 - DNA, 22 bp, Homo sapiens
gagacagagatcttgctgagtc

SEQ ID NO: 9430001 - DNA, 22 bp, Homo sapiens
gagacagagatcttgctgagtc

SEQ ID NO: 9430002 - DNA, 22 bp, Homo sapiens
gagagcccttaggtttagagtt

SEQ ID NO: 9430003 - DNA, 22 bp, Homo sapiens
gagagccctgctcctatcccag

SEQ ID NO: 9430004 - DNA, 22 bp, Homo sapiens
gagagcctgccagtgagtgtat

SEQ ID NO: 9430005 - DNA, 22 bp, Homo sapiens
gaggtgtcatgagggcctgctc

SEQ ID NO: 9430006 - DNA, 20 bp, Homo sapiens
gagtcacagaagaagctgaa

SEQ ID NO: 9430007 - DNA, 22 bp, Homo sapiens
gagtcactgtttcccggctctg

SEQ ID NO: 9430008 - DNA, 22 bp, Homo sapiens
gagtcactgaggagggtactca

SEQ ID NO: 9430009 - DNA, 22 bp, Homo sapiens
gaggtggttcaggtagagccca

SEQ ID NO: 9430010 - DNA, 22 bp, Homo sapiens
gaggtggtggtggaggcatagc

SEQ ID NO: 9430011 - DNA, 22 bp, Homo sapiens
gaggtggtggtggaggcatagc

SEQ ID NO: 9430012 - DNA, 22 bp, Homo sapiens
gaggtggtggtggaggcatagc

SEQ ID NO: 9430013 - DNA, 22 bp, Homo sapiens
gaggtgggtgtatcacaggtca

SEQ ID NO: 9430014 - DNA, 19 bp, Homo sapiens
gaggtgggtccccgcagcc

SEQ ID NO: 9430015 - DNA, 19 bp, Homo sapiens
gaggtgggtccccgcagcc

SEQ ID NO: 9430016 - DNA, 19 bp, Homo sapiens
gaggtgggtccccgcagcc

SEQ ID NO: 9430017 - DNA, 22 bp, Homo sapiens
gaggtgggtgtatcacaggtca

SEQ ID NO: 9430018 - DNA, 22 bp, Homo sapiens
gaggtgggtgtatcacaggtca

SEQ ID NO: 9430019 - DNA, 22 bp, Homo sapiens
gaggtgggtgtatcacaggtca

SEQ ID NO: 9430020 - DNA, 22 bp, Homo sapiens
gaggtgggtgtatcacaggtca

SEQ ID NO: 9430021 - DNA, 22 bp, Homo sapiens
gagtcaggctagggtgacaggc

SEQ ID NO: 9430022 - DNA, 22 bp, Homo sapiens
gagtcaggctagggtgacaggc

SEQ ID NO: 9430023 - DNA, 22 bp, Homo sapiens
gagtcaggagttatgctccacc

SEQ ID NO: 9430024 - DNA, 22 bp, Homo sapiens
gagtcagattgcagacagggct

SEQ ID NO: 9430025 - DNA, 22 bp, Homo sapiens
gagtcctgaatcctgtggcaac

SEQ ID NO: 9430026 - DNA, 22 bp, Homo sapiens
gagtcccaggatatgtgctgtt

SEQ ID NO: 9430027 - DNA, 22 bp, Homo sapiens
gagtccagttgttcacagaggc

SEQ ID NO: 9430028 - DNA, 22 bp, Homo sapiens
gagtccagttgttcacagaggc

SEQ ID NO: 9430029 - DNA, 22 bp, Homo sapiens
gagtccagttgttcacagaggc

SEQ ID NO: 9430030 - DNA, 22 bp, Homo sapiens
gagtcccaggatatgtgctgtt

SEQ ID NO: 9430031 - DNA, 22 bp, Homo sapiens
gagtccagttctttccagcagt

SEQ ID NO: 9430032 - DNA, 22 bp, Homo sapiens
gagtccagttctttccagcagt

SEQ ID NO: 9430033 - DNA, 22 bp, Homo sapiens
gagtccagagattaagcacctc

SEQ ID NO: 9430034 - DNA, 22 bp, Homo sapiens
gagtccagacaccatacctgat

SEQ ID NO: 9430035 - DNA, 22 bp, Homo sapiens
gagtccaagctagagccactca

SEQ ID NO: 9430036 - DNA, 22 bp, Homo sapiens
gaggtaggtgtaggaggcctgc

SEQ ID NO: 9430037 - DNA, 22 bp, Homo sapiens
gaggtaggtgtaggaggcctgc

SEQ ID NO: 9430038 - DNA, 22 bp, Homo sapiens
gaggtaacactgttcagtgggc

SEQ ID NO: 9430039 - DNA, 22 bp, Homo sapiens
gaggtaacaactgaaatgagaa

SEQ ID NO: 9430040 - DNA, 22 bp, Homo sapiens
gaggtaacactgttcagtgggc

SEQ ID NO: 9430041 - DNA, 22 bp, Homo sapiens
gaggtaggtgtaggaggcctgc

SEQ ID NO: 9430042 - DNA, 22 bp, Homo sapiens
gaggtaggtgtaggaggcctgc

SEQ ID NO: 9430043 - DNA, 22 bp, Homo sapiens
gaggtcaaggtcaagagacaga

SEQ ID NO: 9430044 - DNA, 22 bp, Homo sapiens
gaggtcaaggtcaagagacaga

SEQ ID NO: 9430045 - DNA, 19 bp, Homo sapiens
gaggtcagcaagaagtatt

SEQ ID NO: 9430046 - DNA, 19 bp, Homo sapiens
gaggtcagcaagaagtatt

SEQ ID NO: 9430047 - DNA, 22 bp, Homo sapiens
gaggtatcttagagagtgtaga

SEQ ID NO: 9430048 - DNA, 22 bp, Homo sapiens
gaggtatcttagagagtgtaga

SEQ ID NO: 9430049 - DNA, 23 bp, Homo sapiens
gaggtcaaggctgcagtgattgc

SEQ ID NO: 9430050 - DNA, 22 bp, Homo sapiens
gaggggcgtcctgagtgggcct

SEQ ID NO: 9430051 - DNA, 22 bp, Homo sapiens
gagggtgtctggatgctagact

SEQ ID NO: 9430052 - DNA, 22 bp, Homo sapiens
gaggggcctggcgaggacatgt

SEQ ID NO: 9430053 - DNA, 22 bp, Homo sapiens
gaggggcctggcgaggacatgt

SEQ ID NO: 9430054 - DNA, 22 bp, Homo sapiens
gaggggccggcatgtgcctctc

SEQ ID NO: 9430055 - DNA, 22 bp, Homo sapiens
gaggggcctggcactgagctgg

SEQ ID NO: 9430056 - DNA, 22 bp, Homo sapiens
gaggggcctggcactgagctgg

SEQ ID NO: 9430057 - DNA, 22 bp, Homo sapiens
gaggtcagtcagaccagggttt

SEQ ID NO: 9430058 - DNA, 22 bp, Homo sapiens
gaggtcaggggagaggctgatg

SEQ ID NO: 9430059 - DNA, 22 bp, Homo sapiens
gaggtcaggggagaggctgatg

SEQ ID NO: 9430060 - DNA, 22 bp, Homo sapiens
gaggtccactgaggcaacaggg

SEQ ID NO: 9430061 - DNA, 22 bp, Homo sapiens
gaggtccactgaggcaacaggg

SEQ ID NO: 9430062 - DNA, 22 bp, Homo sapiens
gaggtccactgaggcaacaggg

SEQ ID NO: 9430063 - DNA, 22 bp, Homo sapiens
gaggtccaacacaatgggtgtt

SEQ ID NO: 9430064 - DNA, 22 bp, Homo sapiens
gaggtccaacacaatgggtgtt

SEQ ID NO: 9430065 - DNA, 22 bp, Homo sapiens
gaggtcaggctcaagctgggcc

SEQ ID NO: 9430066 - DNA, 22 bp, Homo sapiens
gaggtcaggctcaagctgggcc

SEQ ID NO: 9430067 - DNA, 22 bp, Homo sapiens
gaggtcaggcttgcagcagggt

SEQ ID NO: 9430068 - DNA, 22 bp, Homo sapiens
gaggtgggatgtgtgtgctact

SEQ ID NO: 9430069 - DNA, 22 bp, Homo sapiens
gaggtgggatgtgtgtgctact

SEQ ID NO: 9430070 - DNA, 22 bp, Homo sapiens
gaggtgggcggatcacaaggtc

SEQ ID NO: 9430071 - DNA, 22 bp, Homo sapiens
gaggtgggcggatcacaaggtc

SEQ ID NO: 9430072 - DNA, 22 bp, Homo sapiens
gaggtgggcggatcacaaggtc

SEQ ID NO: 9430073 - DNA, 22 bp, Homo sapiens
gaggtgggcggatcacaaggtc

SEQ ID NO: 9430074 - DNA, 22 bp, Homo sapiens
gaggtgggagggcagtccctaa

SEQ ID NO: 9430075 - DNA, 22 bp, Homo sapiens
gaggtccagggtggggcctgag

SEQ ID NO: 9430076 - DNA, 22 bp, Homo sapiens
gaggtccagggtggggcctgag

SEQ ID NO: 9430077 - DNA, 22 bp, Homo sapiens
gaggtccagagcaggttcagtg

SEQ ID NO: 9430078 - DNA, 22 bp, Homo sapiens
gaggtccagccaagcggcaagg

SEQ ID NO: 9430079 - DNA, 22 bp, Homo sapiens
gaggtccagccaagcggcaagg

SEQ ID NO: 9430080 - DNA, 22 bp, Homo sapiens
gaggtccagggtggggcctgag

SEQ ID NO: 9430081 - DNA, 22 bp, Homo sapiens
gagggatgcagaaacagaggcc

SEQ ID NO: 9430082 - DNA, 22 bp, Homo sapiens
gaggctgggggctgccttcctc

SEQ ID NO: 9430083 - DNA, 22 bp, Homo sapiens
gagggatggtagttgacactga

SEQ ID NO: 9430084 - DNA, 22 bp, Homo sapiens
gagggatgcagaaacagaggcc

SEQ ID NO: 9430085 - DNA, 22 bp, Homo sapiens
gagggcagagtctaatgatgca

SEQ ID NO: 9430086 - DNA, 16 bp, Homo sapiens
gagggcagaggcggaa

SEQ ID NO: 9430087 - DNA, 16 bp, Homo sapiens
gagggcagaggcggaa

SEQ ID NO: 9430088 - DNA, 16 bp, Homo sapiens
gagggcagaggcggaa

SEQ ID NO: 9430089 - DNA, 16 bp, Homo sapiens
gagggcagaggcggaa

SEQ ID NO: 9430090 - DNA, 22 bp, Homo sapiens
gagggcagagacagtgattcac

SEQ ID NO: 9430091 - DNA, 22 bp, Homo sapiens
gagggcagagacagtgattcac

SEQ ID NO: 9430092 - DNA, 16 bp, Homo sapiens
gagggcagaggcggaa

SEQ ID NO: 9430093 - DNA, 16 bp, Homo sapiens
gaggctggcagatgtc

SEQ ID NO: 9430094 - DNA, 22 bp, Homo sapiens
gaggctgggaagtccaagacca

SEQ ID NO: 9430095 - DNA, 22 bp, Homo sapiens
gaggctgggaagtccaagatca

SEQ ID NO: 9430096 - DNA, 22 bp, Homo sapiens
gaggctgggaagtccaagacca

SEQ ID NO: 9430097 - DNA, 22 bp, Homo sapiens
gaggctgggaagtccaatatca

SEQ ID NO: 9430098 - DNA, 22 bp, Homo sapiens
gaggctgggggctgccttcctc

SEQ ID NO: 9430099 - DNA, 22 bp, Homo sapiens
gaggctgggggctgccttcctc

SEQ ID NO: 9430100 - DNA, 22 bp, Homo sapiens
gaggcctgaggctgcctggagc

SEQ ID NO: 9430101 - DNA, 22 bp, Homo sapiens
gaggcctgcagcgtggtccctg

SEQ ID NO: 9430102 - DNA, 22 bp, Homo sapiens
gaggcctgcagcgtggtccctg

SEQ ID NO: 9430103 - DNA, 22 bp, Homo sapiens
gaggcctgctttggcactctgg

SEQ ID NO: 9430104 - DNA, 22 bp, Homo sapiens
gaggcctgctttggcactctgg

SEQ ID NO: 9430105 - DNA, 22 bp, Homo sapiens
gaggcctgctttggcactctgg

SEQ ID NO: 9430106 - DNA, 22 bp, Homo sapiens
gaggctggacgtgcatttctac

SEQ ID NO: 9430107 - DNA, 22 bp, Homo sapiens
gaggctggaatattagaaatgt

SEQ ID NO: 9430108 - DNA, 22 bp, Homo sapiens
gaggctgcccacacctgcgccg

SEQ ID NO: 9430109 - DNA, 22 bp, Homo sapiens
gaggctgcccacacctgcgccg

SEQ ID NO: 9430110 - DNA, 22 bp, Homo sapiens
gaggctggaggtcaaagatgaa

SEQ ID NO: 9430111 - DNA, 22 bp, Homo sapiens
gaggctggagatattccaatct

SEQ ID NO: 9430112 - DNA, 22 bp, Homo sapiens
gaggctggaggtcaaagatgaa

SEQ ID NO: 9430113 - DNA, 22 bp, Homo sapiens
gaggctggaggtcaaagatgaa

SEQ ID NO: 9430114 - DNA, 22 bp, Homo sapiens
gaggctggaggtcaaagatgaa

SEQ ID NO: 9430115 - DNA, 22 bp, Homo sapiens
gaggctggcagaaaagcacagg

SEQ ID NO: 9430116 - DNA, 16 bp, Homo sapiens
gaggctggcagatgtc

SEQ ID NO: 9430117 - DNA, 22 bp, Homo sapiens
gaggctggcagaaaagcacagg

SEQ ID NO: 9430118 - DNA, 21 bp, Homo sapiens
gaggggcagctcttagcatta

SEQ ID NO: 9430119 - DNA, 22 bp, Homo sapiens
gaggggcaggattattgggatt

SEQ ID NO: 9430120 - DNA, 22 bp, Homo sapiens
gaggggcagaggtagagaacaa

SEQ ID NO: 9430121 - DNA, 22 bp, Homo sapiens
gaggggcagaggtagagaacaa

SEQ ID NO: 9430122 - DNA, 22 bp, Homo sapiens
gaggggcagttgattgtgctat

SEQ ID NO: 9430123 - DNA, 22 bp, Homo sapiens
gaggggcagttgattgtgctat

SEQ ID NO: 9430124 - DNA, 22 bp, Homo sapiens
gaggggcacagtaaagggtccc

SEQ ID NO: 9430125 - DNA, 22 bp, Homo sapiens
gaggggcacagtaaagggtccc

SEQ ID NO: 9430126 - DNA, 22 bp, Homo sapiens
gaggggcagaatgtgatcaggg

SEQ ID NO: 9430127 - DNA, 22 bp, Homo sapiens
gaggggagtaaagtcatgttac

SEQ ID NO: 9430128 - DNA, 22 bp, Homo sapiens
gaggggagtaaagtcatgttac

SEQ ID NO: 9430129 - DNA, 22 bp, Homo sapiens
gaggggagtgtcctccgggccc

SEQ ID NO: 9430130 - DNA, 22 bp, Homo sapiens
gaggggagtgtcctccgggccc

SEQ ID NO: 9430131 - DNA, 22 bp, Homo sapiens
gaggggatgcagagaggcttat

SEQ ID NO: 9430132 - DNA, 22 bp, Homo sapiens
gaggggcaagaagttggcctct

SEQ ID NO: 9430133 - DNA, 22 bp, Homo sapiens
gaggggcaagaagttggcctct

SEQ ID NO: 9430134 - DNA, 22 bp, Homo sapiens
gaggggcaatgagggaaagagt

SEQ ID NO: 9430135 - DNA, 22 bp, Homo sapiens
gaggggcaagaagttggcctct

SEQ ID NO: 9430136 - DNA, 22 bp, Homo sapiens
gaggggcacagcagctgttgca

SEQ ID NO: 9430137 - DNA, 22 bp, Homo sapiens
gaggggcacagcagctgttgca

SEQ ID NO: 9430138 - DNA, 22 bp, Homo sapiens
gaggggcacagcagctgttgca

SEQ ID NO: 9430139 - DNA, 22 bp, Homo sapiens
gaggggcaatgagggaaagagt

SEQ ID NO: 9430140 - DNA, 22 bp, Homo sapiens
gaggggcaatgagggaaagagt

SEQ ID NO: 9430141 - DNA, 22 bp, Homo sapiens
gagggcagagtctaatgatgca

SEQ ID NO: 9430142 - DNA, 22 bp, Homo sapiens
gagggcagagtctaatgatgca

SEQ ID NO: 9430143 - DNA, 22 bp, Homo sapiens
gagggcagagtctaatgatgca

SEQ ID NO: 9430144 - DNA, 20 bp, Homo sapiens
gagggcaggcacccatttca

SEQ ID NO: 9430145 - DNA, 22 bp, Homo sapiens
gagggcaggggtcttgcacggt

SEQ ID NO: 9430146 - DNA, 20 bp, Homo sapiens
gagggcaggcacccatttca

SEQ ID NO: 9430147 - DNA, 22 bp, Homo sapiens
gagggcaggggtcttgcacggt

SEQ ID NO: 9430148 - DNA, 22 bp, Homo sapiens
gagggcaggggtcttgcacggt

SEQ ID NO: 9430149 - DNA, 22 bp, Homo sapiens
gagggcagtagcctcgtaccct

SEQ ID NO: 9430150 - DNA, 22 bp, Homo sapiens
gagggcagtagcctcgtaccct

SEQ ID NO: 9430151 - DNA, 22 bp, Homo sapiens
gagggcagtagcctcgtaccct

SEQ ID NO: 9430152 - DNA, 22 bp, Homo sapiens
gaggggaaagtgtgaggctgcg

SEQ ID NO: 9430153 - DNA, 22 bp, Homo sapiens
gaggggaaagtgtgaggctgcg

SEQ ID NO: 9430154 - DNA, 22 bp, Homo sapiens
gaggggaaagtgtgaggctgcg

SEQ ID NO: 9430155 - DNA, 22 bp, Homo sapiens
gagggccaactagcaccacttt

SEQ ID NO: 9430156 - DNA, 22 bp, Homo sapiens
gagggcagtgaattttgaagct

SEQ ID NO: 9430157 - DNA, 22 bp, Homo sapiens
gagggcagtgaattttgaagct

SEQ ID NO: 9430158 - DNA, 22 bp, Homo sapiens
gagggcagtgaattttgaagct

SEQ ID NO: 9430159 - DNA, 22 bp, Homo sapiens
gaggcagcaggctgaggaggat

SEQ ID NO: 9430160 - DNA, 22 bp, Homo sapiens
gaggcagcagaacatggaagag

SEQ ID NO: 9430161 - DNA, 22 bp, Homo sapiens
gaggcagcaggctgaggaggat

SEQ ID NO: 9430162 - DNA, 22 bp, Homo sapiens
gaggcagcaggctgaggaggat

SEQ ID NO: 9430163 - DNA, 22 bp, Homo sapiens
gaggcagcaggctgaggaggat

SEQ ID NO: 9430164 - DNA, 22 bp, Homo sapiens
gaggcagcgggtcaggaccgtg

SEQ ID NO: 9430165 - DNA, 23 bp, Homo sapiens
gaggcagctcctgcagtgccctg

SEQ ID NO: 9430166 - DNA, 18 bp, Homo sapiens
gaggcagctagcaatttt

SEQ ID NO: 9430167 - DNA, 22 bp, Homo sapiens
gaggcagctcttctgaatgggg

SEQ ID NO: 9430168 - DNA, 23 bp, Homo sapiens
gaggcagctcctgcagtgccctg

SEQ ID NO: 9430169 - DNA, 22 bp, Homo sapiens
gaggcccagtcctgcaagcacg

SEQ ID NO: 9430170 - DNA, 22 bp, Homo sapiens
gaggcccagcattcagggcagg

SEQ ID NO: 9430171 - DNA, 22 bp, Homo sapiens
gaggcccagcagcgcaggtctt

SEQ ID NO: 9430172 - DNA, 22 bp, Homo sapiens
gaggcagctgggctggtggttt

SEQ ID NO: 9430173 - DNA, 22 bp, Homo sapiens
gaggcagctgaaggagtgacag

SEQ ID NO: 9430174 - DNA, 22 bp, Homo sapiens
gaggcagctgggctggtggttt

SEQ ID NO: 9430175 - DNA, 22 bp, Homo sapiens
gaggcctcttctttgttaacct

SEQ ID NO: 9430176 - DNA, 22 bp, Homo sapiens
gaggcctctgtcccgccaggga

SEQ ID NO: 9430177 - DNA, 22 bp, Homo sapiens
gaggcctgaaaggggacctatg

SEQ ID NO: 9430178 - DNA, 22 bp, Homo sapiens
gaggcctgaaaggggacctatg

SEQ ID NO: 9430179 - DNA, 18 bp, Homo sapiens
gaggcctgagaaccaggt

SEQ ID NO: 9430180 - DNA, 22 bp, Homo sapiens
gaggcctgaggctgcctggagc

SEQ ID NO: 9430181 - DNA, 22 bp, Homo sapiens
gaggcctgaggctgcctggagc

SEQ ID NO: 9430182 - DNA, 22 bp, Homo sapiens
gaggcctcctctgagacatctg

SEQ ID NO: 9430183 - DNA, 22 bp, Homo sapiens
gaggcctctgtcccaccaggga

SEQ ID NO: 9430184 - DNA, 22 bp, Homo sapiens
gaggcctcaggaatgtcgtgtg

SEQ ID NO: 9430185 - DNA, 21 bp, Homo sapiens
gaggcctcagcctcagctcct

SEQ ID NO: 9430186 - DNA, 22 bp, Homo sapiens
gaggcctcctctgagacatctg

SEQ ID NO: 9430187 - DNA, 22 bp, Homo sapiens
gaggcctcatgaggtgagcatt

SEQ ID NO: 9430188 - DNA, 22 bp, Homo sapiens
gaggcctcaggcgtgggaaggg

SEQ ID NO: 9430189 - DNA, 19 bp, Homo sapiens
gaggcccatgagggtgctc

SEQ ID NO: 9430190 - DNA, 22 bp, Homo sapiens
gaggcccagtggagggccatgg

SEQ ID NO: 9430191 - DNA, 19 bp, Homo sapiens
gaggcccatgagggtgctc

SEQ ID NO: 9430192 - DNA, 22 bp, Homo sapiens
gaggcccagtcctgcaagcacg

SEQ ID NO: 9430193 - DNA, 22 bp, Homo sapiens
gaggcccagtcctgcaagcacg

SEQ ID NO: 9430194 - DNA, 22 bp, Homo sapiens
gaggccctccagctgtcagctg

SEQ ID NO: 9430195 - DNA, 22 bp, Homo sapiens
gaggccctcttgccacaatgaa

SEQ ID NO: 9430196 - DNA, 22 bp, Homo sapiens
gaggccctccagctgtcagctg

SEQ ID NO: 9430197 - DNA, 22 bp, Homo sapiens
gaggccctccagctgtcagctg

SEQ ID NO: 9430198 - DNA, 21 bp, Homo sapiens
gaggcccatgggacaggggct

SEQ ID NO: 9430199 - DNA, 22 bp, Homo sapiens
gaggccctcttgccacaatgaa

SEQ ID NO: 9430200 - DNA, 22 bp, Homo sapiens
gaggccctgaagacagctgggg

SEQ ID NO: 9430201 - DNA, 22 bp, Homo sapiens
gaggccctgaagacagctgggg

SEQ ID NO: 9430202 - DNA, 22 bp, Homo sapiens
gaggccctgaagacagctgggg

SEQ ID NO: 9430203 - DNA, 22 bp, Homo sapiens
gaggccctggtaggtcagagtg

SEQ ID NO: 9430204 - DNA, 21 bp, Homo sapiens
gaggcctcagcctcagctcct

SEQ ID NO: 9430205 - DNA, 20 bp, Homo sapiens
gaggcctcagcctcagctcc

SEQ ID NO: 9430206 - DNA, 22 bp, Homo sapiens
gaggcctagtctgcctgctcac

SEQ ID NO: 9430207 - DNA, 22 bp, Homo sapiens
gaggccctggtaggtcagagtg

SEQ ID NO: 9430208 - DNA, 20 bp, Homo sapiens
gaggcctcagcctcagctcc

SEQ ID NO: 9430209 - DNA, 19 bp, Homo sapiens
gaggaggcttcagctttct

SEQ ID NO: 9430210 - DNA, 19 bp, Homo sapiens
gaggaggcttcagctttct

SEQ ID NO: 9430211 - DNA, 19 bp, Homo sapiens
gaggaggcttcagctttct

SEQ ID NO: 9430212 - DNA, 22 bp, Homo sapiens
gaggaggcttccgggaggcacg

SEQ ID NO: 9430213 - DNA, 22 bp, Homo sapiens
gaggaggcttccgggaggcacg

SEQ ID NO: 9430214 - DNA, 22 bp, Homo sapiens
gaggaggcttccgggaggcacg

SEQ ID NO: 9430215 - DNA, 22 bp, Homo sapiens
gaggaggctggcgccgcctgcc

SEQ ID NO: 9430216 - DNA, 22 bp, Homo sapiens
gaggaggctggcgccgcctgcc

SEQ ID NO: 9430217 - DNA, 22 bp, Homo sapiens
gaggaggctgtttctctgcatt

SEQ ID NO: 9430218 - DNA, 22 bp, Homo sapiens
gaggaggctgtttctctgcatt

SEQ ID NO: 9430219 - DNA, 22 bp, Homo sapiens
gaggaggctgtttctctgcatt

SEQ ID NO: 9430220 - DNA, 22 bp, Homo sapiens
gaggaggctgtttctctgcatt

SEQ ID NO: 9430221 - DNA, 22 bp, Homo sapiens
gaggaggctgtttctctgcatt

SEQ ID NO: 9430222 - DNA, 22 bp, Homo sapiens
gaggagggagctggaagctctt

SEQ ID NO: 9430223 - DNA, 22 bp, Homo sapiens
gaggagggagctggaagctctt

SEQ ID NO: 9430224 - DNA, 22 bp, Homo sapiens
gaggagggagctggaagctctt

SEQ ID NO: 9430225 - DNA, 22 bp, Homo sapiens
gaggagggagctggaagctctt

SEQ ID NO: 9430226 - DNA, 22 bp, Homo sapiens
gaggaggcttccgggaggcacg

SEQ ID NO: 9430227 - DNA, 22 bp, Homo sapiens
gaggagggagaattaggcttaa

SEQ ID NO: 9430228 - DNA, 22 bp, Homo sapiens
gaggagggagctggaagctctt

SEQ ID NO: 9430229 - DNA, 22 bp, Homo sapiens
gaggagggagctggaagctctt

SEQ ID NO: 9430230 - DNA, 22 bp, Homo sapiens
gaggagggagctggaagctctt

SEQ ID NO: 9430231 - DNA, 22 bp, Homo sapiens
gaggagggagctggaagctctt

SEQ ID NO: 9430232 - DNA, 22 bp, Homo sapiens
gaggcagagtcacaaagagtct

SEQ ID NO: 9430233 - DNA, 22 bp, Homo sapiens
gaggcagagtcacaaagagtct

SEQ ID NO: 9430234 - DNA, 22 bp, Homo sapiens
gaggcagaggttgcagtgagct

SEQ ID NO: 9430235 - DNA, 22 bp, Homo sapiens
gaggcagaggttgttgcagtga

SEQ ID NO: 9430236 - DNA, 22 bp, Homo sapiens
gaggcagaggttgttgcagtga

SEQ ID NO: 9430237 - DNA, 22 bp, Homo sapiens
gaggcagcagaacatggaagag

SEQ ID NO: 9430238 - DNA, 22 bp, Homo sapiens
gaggcagagtgcaccccaggag

SEQ ID NO: 9430239 - DNA, 22 bp, Homo sapiens
gaggcagagtgcaccccaggag

SEQ ID NO: 9430240 - DNA, 22 bp, Homo sapiens
gaggcagagtgcaccccaggag

SEQ ID NO: 9430241 - DNA, 22 bp, Homo sapiens
gaggcagagtgcaccccaggag

SEQ ID NO: 9430242 - DNA, 22 bp, Homo sapiens
gaggcagaggttgcagtgagct

SEQ ID NO: 9430243 - DNA, 22 bp, Homo sapiens
gaggcagaggttgcagtgagct

SEQ ID NO: 9430244 - DNA, 22 bp, Homo sapiens
gaggaggtggaattccaggaat

SEQ ID NO: 9430245 - DNA, 22 bp, Homo sapiens
gaggaggtggagtcatgcagag

SEQ ID NO: 9430246 - DNA, 22 bp, Homo sapiens
gaggaggtggaattccaggaat

SEQ ID NO: 9430247 - DNA, 22 bp, Homo sapiens
gaggaggtctcctccgcagggg

SEQ ID NO: 9430248 - DNA, 22 bp, Homo sapiens
gaggaggtcccccgacatgcct

SEQ ID NO: 9430249 - DNA, 22 bp, Homo sapiens
gaggaggtcgctgctgagcccc

SEQ ID NO: 9430250 - DNA, 22 bp, Homo sapiens
gaggaggtcgctgctgagcccc

SEQ ID NO: 9430251 - DNA, 22 bp, Homo sapiens
gaggagggttggccttaggtag

SEQ ID NO: 9430252 - DNA, 22 bp, Homo sapiens
gaggagggttggccttaggtag

SEQ ID NO: 9430253 - DNA, 22 bp, Homo sapiens
gaggagggttggccttaggtag

SEQ ID NO: 9430254 - DNA, 22 bp, Homo sapiens
gaggagggttggccttaggtag

SEQ ID NO: 9430255 - DNA, 22 bp, Homo sapiens
gaggacaaagcccaggtgctgg

SEQ ID NO: 9430256 - DNA, 22 bp, Homo sapiens
gaggacacaaagtggctgagat

SEQ ID NO: 9430257 - DNA, 22 bp, Homo sapiens
gaggacacaaagtggctgagat

SEQ ID NO: 9430258 - DNA, 23 bp, Homo sapiens
gaggacacagcccagacagccgt

SEQ ID NO: 9430259 - DNA, 22 bp, Homo sapiens
gaggaatgtcagcacaggcctc

SEQ ID NO: 9430260 - DNA, 22 bp, Homo sapiens
gaggacaaagcccaggtgctgg

SEQ ID NO: 9430261 - DNA, 22 bp, Homo sapiens
gaggacaaagcccaggtgctgg

SEQ ID NO: 9430262 - DNA, 22 bp, Homo sapiens
gaggaagtctctctacaagaaa

SEQ ID NO: 9430263 - DNA, 22 bp, Homo sapiens
gaggaaggtcccatcagaattt

SEQ ID NO: 9430264 - DNA, 22 bp, Homo sapiens
gaggaagtttacaaagcatctg

SEQ ID NO: 9430265 - DNA, 21 bp, Homo sapiens
gaggaatggtttgcaaagcac

SEQ ID NO: 9430266 - DNA, 22 bp, Homo sapiens
gaggacagctctaactaaagtc

SEQ ID NO: 9430267 - DNA, 22 bp, Homo sapiens
gaggacagcttagggcttcctg

SEQ ID NO: 9430268 - DNA, 22 bp, Homo sapiens
gaggacagcttagggcttcctg

SEQ ID NO: 9430269 - DNA, 22 bp, Homo sapiens
gaggacagcttagggcttcctg

SEQ ID NO: 9430270 - DNA, 22 bp, Homo sapiens
gaggacagagccgcctggcaag

SEQ ID NO: 9430271 - DNA, 22 bp, Homo sapiens
gaggacagagccgcctggcaag

SEQ ID NO: 9430272 - DNA, 22 bp, Homo sapiens
gaggacagagccgcctggcaag

SEQ ID NO: 9430273 - DNA, 22 bp, Homo sapiens
gaggacacatgactccagcagg

SEQ ID NO: 9430274 - DNA, 22 bp, Homo sapiens
gaggacacctcacagcctcaca

SEQ ID NO: 9430275 - DNA, 22 bp, Homo sapiens
gagctgggacttggaatccaca

SEQ ID NO: 9430276 - DNA, 22 bp, Homo sapiens
gagctgggacttggaatccaca

SEQ ID NO: 9430277 - DNA, 22 bp, Homo sapiens
gagctgggagctgggatttgga

SEQ ID NO: 9430278 - DNA, 22 bp, Homo sapiens
gagctgggaggactgggaactt

SEQ ID NO: 9430279 - DNA, 22 bp, Homo sapiens
gagctgggagttatagcatgtt

SEQ ID NO: 9430280 - DNA, 22 bp, Homo sapiens
gagctgggaggactgggaactt

SEQ ID NO: 9430281 - DNA, 22 bp, Homo sapiens
gagctgggagttatagcatgtt

SEQ ID NO: 9430282 - DNA, 22 bp, Homo sapiens
gagctgggagttatagcatgtt

SEQ ID NO: 9430283 - DNA, 22 bp, Homo sapiens
gaggaagagagctctgccttgt

SEQ ID NO: 9430284 - DNA, 22 bp, Homo sapiens
gaggaagagagctctgccttgt

SEQ ID NO: 9430285 - DNA, 22 bp, Homo sapiens
gaggaagagcatggccagtttc

SEQ ID NO: 9430286 - DNA, 22 bp, Homo sapiens
gaggaagatggttgagtggtcc

SEQ ID NO: 9430287 - DNA, 22 bp, Homo sapiens
gaggaagagcatggccagtttc

SEQ ID NO: 9430288 - DNA, 23 bp, Homo sapiens
gagctgggatacaggcttactgc

SEQ ID NO: 9430289 - DNA, 22 bp, Homo sapiens
gagctgggagttatagcatgtt

SEQ ID NO: 9430290 - DNA, 22 bp, Homo sapiens
gaggaagggctgcctgccgggc

SEQ ID NO: 9430291 - DNA, 22 bp, Homo sapiens
gaggaagatggttgagtggtcc

SEQ ID NO: 9430292 - DNA, 22 bp, Homo sapiens
gaggaagggctgcctgccgggc

SEQ ID NO: 9430293 - DNA, 22 bp, Homo sapiens
gaggaaggtcccatcagaattt

SEQ ID NO: 9430294 - DNA, 22 bp, Homo sapiens
gagatacagttggctgcaggct

SEQ ID NO: 9430295 - DNA, 22 bp, Homo sapiens
gagatatgttggcagctggtat

SEQ ID NO: 9430296 - DNA, 22 bp, Homo sapiens
gagatccagatttccattcctt

SEQ ID NO: 9430297 - DNA, 22 bp, Homo sapiens
gagataaagctaccatgttgat

SEQ ID NO: 9430298 - DNA, 22 bp, Homo sapiens
gagataaagctaccatgttgat

SEQ ID NO: 9430299 - DNA, 22 bp, Homo sapiens
gagataataatcgcttgatgga

SEQ ID NO: 9430300 - DNA, 22 bp, Homo sapiens
gagataactctaggtcttcgag

SEQ ID NO: 9430301 - DNA, 22 bp, Homo sapiens
gagatacagttggctgcaggct

SEQ ID NO: 9430302 - DNA, 22 bp, Homo sapiens
gagatacacaggcagaaaaaga

SEQ ID NO: 9430303 - DNA, 22 bp, Homo sapiens
gagagtggaaagcaagctgagt

SEQ ID NO: 9430304 - DNA, 22 bp, Homo sapiens
gagagtgctgaacggcaagggt

SEQ ID NO: 9430305 - DNA, 22 bp, Homo sapiens
gagagtggaaagcaagctgagt

SEQ ID NO: 9430306 - DNA, 22 bp, Homo sapiens
gagagtggatggagctgcgaag

SEQ ID NO: 9430307 - DNA, 22 bp, Homo sapiens
gagagtggatggagctgcgaag

SEQ ID NO: 9430308 - DNA, 22 bp, Homo sapiens
gagagtggatggagctgcgaag

SEQ ID NO: 9430309 - DNA, 22 bp, Homo sapiens
gagagtgagatcctcctgggga

SEQ ID NO: 9430310 - DNA, 22 bp, Homo sapiens
gagagtgaggcatcaggggcag

SEQ ID NO: 9430311 - DNA, 22 bp, Homo sapiens
gagagtgaggcctgggaatcta

SEQ ID NO: 9430312 - DNA, 22 bp, Homo sapiens
gagagtctagtgcacctagttt

SEQ ID NO: 9430313 - DNA, 22 bp, Homo sapiens
gagagtctagtgcacctagttt

SEQ ID NO: 9430314 - DNA, 22 bp, Homo sapiens
gagagtctagtgcacctagttt

SEQ ID NO: 9430315 - DNA, 22 bp, Homo sapiens
gagagtctaggaacctcatata

SEQ ID NO: 9430316 - DNA, 22 bp, Homo sapiens
gagctggcacagaaggatctta

SEQ ID NO: 9430317 - DNA, 22 bp, Homo sapiens
gagctggcacagaaggatctta

SEQ ID NO: 9430318 - DNA, 22 bp, Homo sapiens
gagctggaggcagtgctgaggt

SEQ ID NO: 9430319 - DNA, 22 bp, Homo sapiens
gagctggccgcagagagggcag

SEQ ID NO: 9430320 - DNA, 22 bp, Homo sapiens
gagctggctcctccgaggatgg

SEQ ID NO: 9430321 - DNA, 22 bp, Homo sapiens
gagctggctccgccatgctgct

SEQ ID NO: 9430322 - DNA, 22 bp, Homo sapiens
gagctggcctcaggcacaggag

SEQ ID NO: 9430323 - DNA, 22 bp, Homo sapiens
gagctggctgtggttgagtgca

SEQ ID NO: 9430324 - DNA, 22 bp, Homo sapiens
gagctgggacatgggtcctctc

SEQ ID NO: 9430325 - DNA, 22 bp, Homo sapiens
gagtgtctgtattttgggcaag

SEQ ID NO: 9430326 - DNA, 22 bp, Homo sapiens
gagtgtctgaattagagcacaa

SEQ ID NO: 9430327 - DNA, 22 bp, Homo sapiens
gagtgtctcacagtagcatttt

SEQ ID NO: 9430328 - DNA, 21 bp, Homo sapiens
gagtgtctaatccaggctgtc

SEQ ID NO: 9430329 - DNA, 22 bp, Homo sapiens
gagtgtctatgtttagtctttc

SEQ ID NO: 9430330 - DNA, 21 bp, Homo sapiens
gagtgtctaatccaggctgtc

SEQ ID NO: 9430331 - DNA, 22 bp, Homo sapiens
gagtgtctaatcacgtttcaca

SEQ ID NO: 9430332 - DNA, 22 bp, Homo sapiens
gagtgtccgtgcagccccagac

SEQ ID NO: 9430333 - DNA, 22 bp, Homo sapiens
gagtgtccgtgcagccccagac

SEQ ID NO: 9430334 - DNA, 22 bp, Homo sapiens
gagtgtcagtgcttggggctac

SEQ ID NO: 9430335 - DNA, 22 bp, Homo sapiens
gagtgtcagcagggcagagcac

SEQ ID NO: 9430336 - DNA, 22 bp, Homo sapiens
gagtgtcagtgcctggcttgtt

SEQ ID NO: 9430337 - DNA, 21 bp, Homo sapiens
gagtgtcagcaagaggtttgg

SEQ ID NO: 9430338 - DNA, 22 bp, Homo sapiens
gagtgtcacttgatgcagggca

SEQ ID NO: 9430339 - DNA, 22 bp, Homo sapiens
gagtgtcaaggctctctttggc

SEQ ID NO: 9430340 - DNA, 22 bp, Homo sapiens
gagtgtcacagggtaattgttt

SEQ ID NO: 9430341 - DNA, 22 bp, Homo sapiens
gagtgggtgagagacttggcac

SEQ ID NO: 9430342 - DNA, 22 bp, Homo sapiens
gagtggttagaagtagtgtggc

SEQ ID NO: 9430343 - DNA, 22 bp, Homo sapiens
gagtgggtgacagaaggaggta

SEQ ID NO: 9430344 - DNA, 22 bp, Homo sapiens
gagtgggtccacagaggtgaca

SEQ ID NO: 9430345 - DNA, 22 bp, Homo sapiens
gagtgggtaaaggtgcttggct

SEQ ID NO: 9430346 - DNA, 22 bp, Homo sapiens
gagtgggtaccggagcaggtgc

SEQ ID NO: 9430347 - DNA, 22 bp, Homo sapiens
gagtggggtctgggcatcagtc

SEQ ID NO: 9430348 - DNA, 22 bp, Homo sapiens
gagtggggtctgggcatcagtc

SEQ ID NO: 9430349 - DNA, 22 bp, Homo sapiens
gagtggggtctgggcatcagtc

SEQ ID NO: 9430350 - DNA, 22 bp, Homo sapiens
gagtgggtaaaggtgcttggct

SEQ ID NO: 9430351 - DNA, 22 bp, Homo sapiens
gagtggggtctgggcatcagtc

SEQ ID NO: 9430352 - DNA, 22 bp, Homo sapiens
gagtggggtctgggcatcagtc

SEQ ID NO: 9430353 - DNA, 22 bp, Homo sapiens
gagtggggggtccgtctcagtg

SEQ ID NO: 9430354 - DNA, 22 bp, Homo sapiens
gagtggggggtccgtctcagtg

SEQ ID NO: 9430355 - DNA, 22 bp, Homo sapiens
gagtggggggtccgtctcagtg

SEQ ID NO: 9430356 - DNA, 22 bp, Homo sapiens
gagtggggggtccgtctcagtg

SEQ ID NO: 9430357 - DNA, 22 bp, Homo sapiens
gagtggggggtccgtctcagtg

SEQ ID NO: 9430358 - DNA, 22 bp, Homo sapiens
gagtggggggtccgtctcagtg

SEQ ID NO: 9430359 - DNA, 22 bp, Homo sapiens
gagtggggtctgggcatcagtc

SEQ ID NO: 9430360 - DNA, 22 bp, Homo sapiens
gagtggggtctgggcatcagtc

SEQ ID NO: 9430361 - DNA, 22 bp, Homo sapiens
gagtggggtctgggcatcagtc

SEQ ID NO: 9430362 - DNA, 22 bp, Homo sapiens
gagtggggtctgggcatcagtc

SEQ ID NO: 9430363 - DNA, 22 bp, Homo sapiens
gagtgtgttctttatgctgtga

SEQ ID NO: 9430364 - DNA, 22 bp, Homo sapiens
gagtgtgttattaaagatggaa

SEQ ID NO: 9430365 - DNA, 22 bp, Homo sapiens
gagtgtgttctttatgctgtga

SEQ ID NO: 9430366 - DNA, 22 bp, Homo sapiens
gagtgtggtgaacaggagcacc

SEQ ID NO: 9430367 - DNA, 22 bp, Homo sapiens
gagtgtgtcggtcagcgtggcg

SEQ ID NO: 9430368 - DNA, 22 bp, Homo sapiens
gagtgtgggggtgctgaggaca

SEQ ID NO: 9430369 - DNA, 22 bp, Homo sapiens
gagtgtgtcggtcagcgtggcg

SEQ ID NO: 9430370 - DNA, 22 bp, Homo sapiens
gagttaaagtacctttgtatgt

SEQ ID NO: 9430371 - DNA, 22 bp, Homo sapiens
gagttaaagtacctttgtatgt

SEQ ID NO: 9430372 - DNA, 22 bp, Homo sapiens
gagttaaaggaaaataacttta

SEQ ID NO: 9430373 - DNA, 22 bp, Homo sapiens
gagttaaaggcagttgaggaaa

SEQ ID NO: 9430374 - DNA, 22 bp, Homo sapiens
gagttaaaagccctctcagcag

SEQ ID NO: 9430375 - DNA, 22 bp, Homo sapiens
gagttaaaagccctctcagcag

SEQ ID NO: 9430376 - DNA, 22 bp, Homo sapiens
gagttctggtcagcagggcagc

SEQ ID NO: 9430377 - DNA, 22 bp, Homo sapiens
gagttctcaagcaatcaaagag

SEQ ID NO: 9430378 - DNA, 22 bp, Homo sapiens
gagttctattatggttagaagt

SEQ ID NO: 9430379 - DNA, 22 bp, Homo sapiens
gagtgtctgtggggcatggaca

SEQ ID NO: 9430380 - DNA, 22 bp, Homo sapiens
gagtgtctgtgacagctcatga

SEQ ID NO: 9430381 - DNA, 22 bp, Homo sapiens
gagtgtggatcccagaagcaga

SEQ ID NO: 9430382 - DNA, 22 bp, Homo sapiens
gagtgtgggcacgggggccttg

SEQ ID NO: 9430383 - DNA, 22 bp, Homo sapiens
gagtgtggtatgctctgaggct

SEQ ID NO: 9430384 - DNA, 22 bp, Homo sapiens
gagtgtggtatgctctgaggct

SEQ ID NO: 9430385 - DNA, 22 bp, Homo sapiens
gagtgtggtgaacaggagcacc

SEQ ID NO: 9430386 - DNA, 22 bp, Homo sapiens
gagtgtggtgaacaggagcacc

SEQ ID NO: 9430387 - DNA, 22 bp, Homo sapiens
gagtgtgggggtgctgaggaca

SEQ ID NO: 9430388 - DNA, 22 bp, Homo sapiens
gagtgtgggtctcagctttaag

SEQ ID NO: 9430389 - DNA, 22 bp, Homo sapiens
gataaacttgtggagttttggt

SEQ ID NO: 9430390 - DNA, 22 bp, Homo sapiens
gataaagcaaggatgactgaag

SEQ ID NO: 9430391 - DNA, 22 bp, Homo sapiens
gataaactggaaccattgcctc

SEQ ID NO: 9430392 - DNA, 22 bp, Homo sapiens
gataaacttgtggagttttggt

SEQ ID NO: 9430393 - DNA, 22 bp, Homo sapiens
gataaagcaggtaggagaagat

SEQ ID NO: 9430394 - DNA, 21 bp, Homo sapiens
gataaagcagcttgcctaagg

SEQ ID NO: 9430395 - DNA, 22 bp, Homo sapiens
gataaagtagatttgttctaga

SEQ ID NO: 9430396 - DNA, 22 bp, Homo sapiens
gataaatggctgaagaaatagt

SEQ ID NO: 9430397 - DNA, 22 bp, Homo sapiens
gataaatggctgaagaaatagt

SEQ ID NO: 9430398 - DNA, 22 bp, Homo sapiens
gataaattatcaggggtttaaa

SEQ ID NO: 9430399 - DNA, 20 bp, Homo sapiens
gataaattgtctcttaagtg

SEQ ID NO: 9430400 - DNA, 22 bp, Homo sapiens
gataacaatatgaagtagatat

SEQ ID NO: 9430401 - DNA, 22 bp, Homo sapiens
gataacaatatgaagtagatat

SEQ ID NO: 9430402 - DNA, 22 bp, Homo sapiens
gataaattgcactttttcttac

SEQ ID NO: 9430403 - DNA, 22 bp, Homo sapiens
gataaattgcactttttcttac

SEQ ID NO: 9430404 - DNA, 20 bp, Homo sapiens
gataaattgtctcttaagtg

SEQ ID NO: 9430405 - DNA, 20 bp, Homo sapiens
gataaattgtctcttaagtg

SEQ ID NO: 9430406 - DNA, 22 bp, Homo sapiens
gataaacacaaggtgatttcat

SEQ ID NO: 9430407 - DNA, 22 bp, Homo sapiens
gataaaattcttattttacccg

SEQ ID NO: 9430408 - DNA, 22 bp, Homo sapiens
gataaacacaaggtgatttcat

SEQ ID NO: 9430409 - DNA, 22 bp, Homo sapiens
gataaacacaaggtgatttcat

SEQ ID NO: 9430410 - DNA, 22 bp, Homo sapiens
gataaacattcttgcacatgtg

SEQ ID NO: 9430411 - DNA, 22 bp, Homo sapiens
gataaacactaaggtcgctgaa

SEQ ID NO: 9430412 - DNA, 22 bp, Homo sapiens
gataaaataactatggaatact

SEQ ID NO: 9430413 - DNA, 22 bp, Homo sapiens
gagtttttccaaggtcacatga

SEQ ID NO: 9430414 - DNA, 22 bp, Homo sapiens
gataaaagaggaaatttgttca

SEQ ID NO: 9430415 - DNA, 22 bp, Homo sapiens
gataaaataactatggaatact

SEQ ID NO: 9430416 - DNA, 22 bp, Homo sapiens
gagtttgtaaactattcactaa

SEQ ID NO: 9430417 - DNA, 22 bp, Homo sapiens
gagtttggcctccccagcagtt

SEQ ID NO: 9430418 - DNA, 22 bp, Homo sapiens
gagtttccaaatccctgaaggg

SEQ ID NO: 9430419 - DNA, 22 bp, Homo sapiens
gagtttcttaacaggtggaagc

SEQ ID NO: 9430420 - DNA, 22 bp, Homo sapiens
gagtttaaataacacatttcca

SEQ ID NO: 9430421 - DNA, 22 bp, Homo sapiens
gagtttattcaggaaatagcca

SEQ ID NO: 9430422 - DNA, 22 bp, Homo sapiens
gagttctgttccttgggagttt

SEQ ID NO: 9430423 - DNA, 22 bp, Homo sapiens
gagttctgtgattatttgggac

SEQ ID NO: 9430424 - DNA, 22 bp, Homo sapiens
gagtttaaaacgcttgtattta

SEQ ID NO: 9430425 - DNA, 22 bp, Homo sapiens
gagtttaaagcatacatatttt

SEQ ID NO: 9430426 - DNA, 22 bp, Homo sapiens
gagttgttcaacgtgtgtgaaa

SEQ ID NO: 9430427 - DNA, 22 bp, Homo sapiens
gagtgcagtatgagaggctgct

SEQ ID NO: 9430428 - DNA, 23 bp, Homo sapiens
gagtgcagaatagacatgcagtg

SEQ ID NO: 9430429 - DNA, 22 bp, Homo sapiens
gagtgcagtggcgtgatctctg

SEQ ID NO: 9430430 - DNA, 22 bp, Homo sapiens
gagtgcagtggcgtgatctctg

SEQ ID NO: 9430431 - DNA, 22 bp, Homo sapiens
gagtgcagtatgagaggctgct

SEQ ID NO: 9430432 - DNA, 22 bp, Homo sapiens
gagtgcagtatgagaggctgct

SEQ ID NO: 9430433 - DNA, 22 bp, Homo sapiens
gagtgcgtgtttggggatgtgg

SEQ ID NO: 9430434 - DNA, 22 bp, Homo sapiens
gagtgccatgtgttacctctgg

SEQ ID NO: 9430435 - DNA, 22 bp, Homo sapiens
gagtgctgaatgcgagaacaga

SEQ ID NO: 9430436 - DNA, 22 bp, Homo sapiens
gagtgctggggtgcagagaggt

SEQ ID NO: 9430437 - DNA, 22 bp, Homo sapiens
gagtgctggggtgcagagaggt

SEQ ID NO: 9430438 - DNA, 17 bp, Homo sapiens
gagtgctggtggagctc

SEQ ID NO: 9430439 - DNA, 22 bp, Homo sapiens
gagtgctgtatctgagaaagca

SEQ ID NO: 9430440 - DNA, 17 bp, Homo sapiens
gagtgctggtggagctc

SEQ ID NO: 9430441 - DNA, 17 bp, Homo sapiens
gagtgctggtggagctc

SEQ ID NO: 9430442 - DNA, 22 bp, Homo sapiens
gagtgctgcttgggatagtgag

SEQ ID NO: 9430443 - DNA, 22 bp, Homo sapiens
gagtgctgcttgggatagtgag

SEQ ID NO: 9430444 - DNA, 22 bp, Homo sapiens
gagtgctgctaatgcaagggtg

SEQ ID NO: 9430445 - DNA, 22 bp, Homo sapiens
gagtgctggaggtgtgagtggg

SEQ ID NO: 9430446 - DNA, 22 bp, Homo sapiens
gagtgctggaggtgtgagtggg

SEQ ID NO: 9430447 - DNA, 22 bp, Homo sapiens
gagtgctggggtgcagagaggt

SEQ ID NO: 9430448 - DNA, 22 bp, Homo sapiens
gagtgctggaggtgtgagtggg

SEQ ID NO: 9430449 - DNA, 21 bp, Homo sapiens
gagtggaacgctcttcacacc

SEQ ID NO: 9430450 - DNA, 22 bp, Homo sapiens
gagtggagatcgtgccactgca

SEQ ID NO: 9430451 - DNA, 21 bp, Homo sapiens
gagtggaacgctcttcacacc

SEQ ID NO: 9430452 - DNA, 22 bp, Homo sapiens
gagtgctgtatctgagaaagca

SEQ ID NO: 9430453 - DNA, 22 bp, Homo sapiens
gagtgcttgcatatttattgtc

SEQ ID NO: 9430454 - DNA, 22 bp, Homo sapiens
gagtggagatcgtgccactgca

SEQ ID NO: 9430455 - DNA, 22 bp, Homo sapiens
gagtggagatcgtgccactgca

SEQ ID NO: 9430456 - DNA, 21 bp, Homo sapiens
gagtggaacgctcttcacacc

SEQ ID NO: 9430457 - DNA, 22 bp, Homo sapiens
gagtggagatcgtgccactgca

SEQ ID NO: 9430458 - DNA, 22 bp, Homo sapiens
gagtggagatcgtgccactgca

SEQ ID NO: 9430459 - DNA, 22 bp, Homo sapiens
gagtggagatcgtgccactgca

SEQ ID NO: 9430460 - DNA, 22 bp, Homo sapiens
gagtggagcaaaagaggtagat

SEQ ID NO: 9430461 - DNA, 22 bp, Homo sapiens
gagtggagcaaaagaggtagat

SEQ ID NO: 9430462 - DNA, 22 bp, Homo sapiens
gagtggagcaaaagaggtagat

SEQ ID NO: 9430463 - DNA, 22 bp, Homo sapiens
gagtggagcaaaagaggtagat

SEQ ID NO: 9430464 - DNA, 22 bp, Homo sapiens
gagtggagcaaaagaggtagat

SEQ ID NO: 9430465 - DNA, 22 bp, Homo sapiens
gagtggagcaaaagaggtagat

SEQ ID NO: 9430466 - DNA, 22 bp, Homo sapiens
gagtggctgtgtacatgcccag

SEQ ID NO: 9430467 - DNA, 22 bp, Homo sapiens
gagtggctccaatttggtccta

SEQ ID NO: 9430468 - DNA, 21 bp, Homo sapiens
gagtgggacatgggagtggtt

SEQ ID NO: 9430469 - DNA, 21 bp, Homo sapiens
gagtgggacatgggagtggtt

SEQ ID NO: 9430470 - DNA, 22 bp, Homo sapiens
gagtgggcaccgtgggcacact

SEQ ID NO: 9430471 - DNA, 22 bp, Homo sapiens
gagtggggctttaaaggctcag

SEQ ID NO: 9430472 - DNA, 22 bp, Homo sapiens
gagtggggctttaaaggctcag

SEQ ID NO: 9430473 - DNA, 22 bp, Homo sapiens
gagtggggctttaaaggctcag

SEQ ID NO: 9430474 - DNA, 22 bp, Homo sapiens
gagtggggctttaaaggctcag

SEQ ID NO: 9430475 - DNA, 22 bp, Homo sapiens
gagtcctgatccttagctctcc

SEQ ID NO: 9430476 - DNA, 22 bp, Homo sapiens
gagtcctgcccttgtgtagtcc

SEQ ID NO: 9430477 - DNA, 22 bp, Homo sapiens
gagtcctgctttcaattctttt

SEQ ID NO: 9430478 - DNA, 22 bp, Homo sapiens
gagtcctggaaccctgaatgct

SEQ ID NO: 9430479 - DNA, 22 bp, Homo sapiens
gagtcctggagaaacgcaggtg

SEQ ID NO: 9430480 - DNA, 22 bp, Homo sapiens
gagtcctggcgtccaatttcct

SEQ ID NO: 9430481 - DNA, 21 bp, Homo sapiens
gagtcctggctagggtggcag

SEQ ID NO: 9430482 - DNA, 19 bp, Homo sapiens
gagtcctgtgctccttgtt

SEQ ID NO: 9430483 - DNA, 22 bp, Homo sapiens
gagtcctgttgtcccagatggg

SEQ ID NO: 9430484 - DNA, 21 bp, Homo sapiens
gagtccttccaatgtcctcag

SEQ ID NO: 9430485 - DNA, 22 bp, Homo sapiens
gagtcctttgttccttgccaca

SEQ ID NO: 9430486 - DNA, 22 bp, Homo sapiens
gagtccttctggctggcaggat

SEQ ID NO: 9430487 - DNA, 22 bp, Homo sapiens
gagtccttctggctggcaggat

SEQ ID NO: 9430488 - DNA, 22 bp, Homo sapiens
gagtccttttgtgccacaggga

SEQ ID NO: 9430489 - DNA, 22 bp, Homo sapiens
gagtccttttgtgccacaggga

SEQ ID NO: 9430490 - DNA, 22 bp, Homo sapiens
gagtccttttctctgtccactg

SEQ ID NO: 9430491 - DNA, 22 bp, Homo sapiens
gagtcggaggcaggagacctgg

SEQ ID NO: 9430492 - DNA, 22 bp, Homo sapiens
gagtctagctgcagaggaccct

SEQ ID NO: 9430493 - DNA, 22 bp, Homo sapiens
gagtctatctcactcccccagg

SEQ ID NO: 9430494 - DNA, 18 bp, Homo sapiens
gagtcgtcggagagtctg

SEQ ID NO: 9430495 - DNA, 22 bp, Homo sapiens
gagtctttggtaaagtctgctg

SEQ ID NO: 9430496 - DNA, 22 bp, Homo sapiens
gagtgacaggaatatttatctg

SEQ ID NO: 9430497 - DNA, 18 bp, Homo sapiens
gagtctttgttactgctg

SEQ ID NO: 9430498 - DNA, 22 bp, Homo sapiens
gagtctggtgatggtcattgtc

SEQ ID NO: 9430499 - DNA, 22 bp, Homo sapiens
gagtctttctgggcttgttctt

SEQ ID NO: 9430500 - DNA, 22 bp, Homo sapiens
gagtcttctacgctcacacaaa

SEQ ID NO: 9430501 - DNA, 22 bp, Homo sapiens
gagtcttctacgctcacacaaa

SEQ ID NO: 9430502 - DNA, 22 bp, Homo sapiens
gagtctggaatgatgaagacct

SEQ ID NO: 9430503 - DNA, 22 bp, Homo sapiens
gagtctgagagcctaatgacct

SEQ ID NO: 9430504 - DNA, 22 bp, Homo sapiens
gagtctggccctgatgcatcat

SEQ ID NO: 9430505 - DNA, 22 bp, Homo sapiens
gagtctggccctgatgcatcat

SEQ ID NO: 9430506 - DNA, 22 bp, Homo sapiens
gagtctggccctgatgcatcat

SEQ ID NO: 9430507 - DNA, 22 bp, Homo sapiens
gagtctggactattctggtctt

SEQ ID NO: 9430508 - DNA, 22 bp, Homo sapiens
gagtgattggagttagcattct

SEQ ID NO: 9430509 - DNA, 22 bp, Homo sapiens
gagtgattgctcctttaaactt

SEQ ID NO: 9430510 - DNA, 22 bp, Homo sapiens
gagtgcagaaattcccttcctg

SEQ ID NO: 9430511 - DNA, 22 bp, Homo sapiens
gagtgcaatgtagacatcaggg

SEQ ID NO: 9430512 - DNA, 22 bp, Homo sapiens
gagtgagtggccaggaggcaga

SEQ ID NO: 9430513 - DNA, 22 bp, Homo sapiens
gagtgagtgctgggctgaggct

SEQ ID NO: 9430514 - DNA, 22 bp, Homo sapiens
gagtgagggccaacatccagct

SEQ ID NO: 9430515 - DNA, 22 bp, Homo sapiens
gagtgagggccaacatccagct

SEQ ID NO: 9430516 - DNA, 22 bp, Homo sapiens
gagtgagggcagcaggggctgc

SEQ ID NO: 9430517 - DNA, 22 bp, Homo sapiens
gagtgagggcagcaggggctgc

SEQ ID NO: 9430518 - DNA, 22 bp, Homo sapiens
gagtgaggctggaatcatggct

SEQ ID NO: 9430519 - DNA, 22 bp, Homo sapiens
gagtgactattggatcagaatt

SEQ ID NO: 9430520 - DNA, 22 bp, Homo sapiens
gatatactgtctgtattacata

SEQ ID NO: 9430521 - DNA, 22 bp, Homo sapiens
gatataggttcatagtgttaca

SEQ ID NO: 9430522 - DNA, 22 bp, Homo sapiens
gatataggttcatagtgttaca

SEQ ID NO: 9430523 - DNA, 22 bp, Homo sapiens
gatatacataggtttctatgca

SEQ ID NO: 9430524 - DNA, 22 bp, Homo sapiens
gatataggttcatagtgttaca

SEQ ID NO: 9430525 - DNA, 18 bp, Homo sapiens
gatatataggaggaaagt

SEQ ID NO: 9430526 - DNA, 21 bp, Homo sapiens
gatatttatgactcattcctt

SEQ ID NO: 9430527 - DNA, 22 bp, Homo sapiens
gatatttacattaagcacattg

SEQ ID NO: 9430528 - DNA, 22 bp, Homo sapiens
gatatttattaagtggttggta

SEQ ID NO: 9430529 - DNA, 22 bp, Homo sapiens
gatattttgagaaatcctatga

SEQ ID NO: 9430530 - DNA, 22 bp, Homo sapiens
gatattttgagaaatcctatga

SEQ ID NO: 9430531 - DNA, 22 bp, Homo sapiens
gatatttttaggtgatgcaggc

SEQ ID NO: 9430532 - DNA, 22 bp, Homo sapiens
gatattttcgcagggagaattc

SEQ ID NO: 9430533 - DNA, 22 bp, Homo sapiens
gatattttcattcggatgctca

SEQ ID NO: 9430534 - DNA, 22 bp, Homo sapiens
gatattttcagtctcctttcaa

SEQ ID NO: 9430535 - DNA, 22 bp, Homo sapiens
gatattttcagtctcctttcaa

SEQ ID NO: 9430536 - DNA, 22 bp, Homo sapiens
gatattttcagtctcctttcaa

SEQ ID NO: 9430537 - DNA, 22 bp, Homo sapiens
gatcatttacttgttctggact

SEQ ID NO: 9430538 - DNA, 22 bp, Homo sapiens
gatcatttcagtccagtaaata

SEQ ID NO: 9430539 - DNA, 22 bp, Homo sapiens
gatcattgaacaggcactggag

SEQ ID NO: 9430540 - DNA, 22 bp, Homo sapiens
gatcatcatggctctggagctg

SEQ ID NO: 9430541 - DNA, 22 bp, Homo sapiens
gatcagtaagtgaataatgagt

SEQ ID NO: 9430542 - DNA, 22 bp, Homo sapiens
gatcagtgttttgtgcattctt

SEQ ID NO: 9430543 - DNA, 22 bp, Homo sapiens
gatcagtgaactatactgcctc

SEQ ID NO: 9430544 - DNA, 22 bp, Homo sapiens
gatcaatggtgtaacttgtcct

SEQ ID NO: 9430545 - DNA, 22 bp, Homo sapiens
gatcaatactattaagatcata

SEQ ID NO: 9430546 - DNA, 22 bp, Homo sapiens
gatcacaatttagactttttaa

SEQ ID NO: 9430547 - DNA, 22 bp, Homo sapiens
gatcacataatttggaaacagc

SEQ ID NO: 9430548 - DNA, 22 bp, Homo sapiens
gatcacataatttggaaacagc

SEQ ID NO: 9430549 - DNA, 22 bp, Homo sapiens
gatcacatgaatggaatagaag

SEQ ID NO: 9430550 - DNA, 22 bp, Homo sapiens
gatcacatgagttatctaactt

SEQ ID NO: 9430551 - DNA, 22 bp, Homo sapiens
gatcacatctttatgagtattt

SEQ ID NO: 9430552 - DNA, 22 bp, Homo sapiens
gatcacatgaatggaatagaag

SEQ ID NO: 9430553 - DNA, 22 bp, Homo sapiens
gatcacatgaatggaatagaag

SEQ ID NO: 9430554 - DNA, 22 bp, Homo sapiens
gatatttttagtatttctgcct

SEQ ID NO: 9430555 - DNA, 22 bp, Homo sapiens
gatatttttagtatttctgcct

SEQ ID NO: 9430556 - DNA, 22 bp, Homo sapiens
gatatttttgcagacacctggg

SEQ ID NO: 9430557 - DNA, 22 bp, Homo sapiens
gatcaaaagctgggttctaaaa

SEQ ID NO: 9430558 - DNA, 22 bp, Homo sapiens
gatcaacaaatgtcctttgtga

SEQ ID NO: 9430559 - DNA, 22 bp, Homo sapiens
gatagagactataatgctcttt

SEQ ID NO: 9430560 - DNA, 22 bp, Homo sapiens
gatagaaaggtgttgaaatcca

SEQ ID NO: 9430561 - DNA, 22 bp, Homo sapiens
gatagagaaacacagataaatg

SEQ ID NO: 9430562 - DNA, 22 bp, Homo sapiens
gatagcaacatagaacagaatt

SEQ ID NO: 9430563 - DNA, 22 bp, Homo sapiens
gatagaaagagtggttcttttt

SEQ ID NO: 9430564 - DNA, 22 bp, Homo sapiens
gatagaaagaatatagattcca

SEQ ID NO: 9430565 - DNA, 22 bp, Homo sapiens
gatataaattaatcaagtgcaa

SEQ ID NO: 9430566 - DNA, 22 bp, Homo sapiens
gatataaattaatcaagtgcaa

SEQ ID NO: 9430567 - DNA, 22 bp, Homo sapiens
gatataaattaatcaagtgcaa

SEQ ID NO: 9430568 - DNA, 22 bp, Homo sapiens
gatataaattaatcaagtgcaa

SEQ ID NO: 9430569 - DNA, 22 bp, Homo sapiens
gatataaattaatcaagtgcaa

SEQ ID NO: 9430570 - DNA, 22 bp, Homo sapiens
gatatacaatccacagttgatt

SEQ ID NO: 9430571 - DNA, 22 bp, Homo sapiens
gatatacagagcattctttgat

SEQ ID NO: 9430572 - DNA, 22 bp, Homo sapiens
gatagctgctgggatattttta

SEQ ID NO: 9430573 - DNA, 22 bp, Homo sapiens
gatagctgctgggatattttta

SEQ ID NO: 9430574 - DNA, 19 bp, Homo sapiens
gatataaagagatggtgaa

SEQ ID NO: 9430575 - DNA, 19 bp, Homo sapiens
gatataaagagatggtgaa

SEQ ID NO: 9430576 - DNA, 22 bp, Homo sapiens
gatagtcacctcccttaacttt

SEQ ID NO: 9430577 - DNA, 22 bp, Homo sapiens
gatacacagggctaagatggat

SEQ ID NO: 9430578 - DNA, 22 bp, Homo sapiens
gatacacattttagctttgtct

SEQ ID NO: 9430579 - DNA, 22 bp, Homo sapiens
gatacacacccttgataggact

SEQ ID NO: 9430580 - DNA, 22 bp, Homo sapiens
gataatatctggtttattcacc

SEQ ID NO: 9430581 - DNA, 20 bp, Homo sapiens
gatacacagcacagagggcc

SEQ ID NO: 9430582 - DNA, 22 bp, Homo sapiens
gataaggactttggggtctaca

SEQ ID NO: 9430583 - DNA, 22 bp, Homo sapiens
gataataagcacagcaggatgt

SEQ ID NO: 9430584 - DNA, 22 bp, Homo sapiens
gataataagcacagcaggatgt

SEQ ID NO: 9430585 - DNA, 22 bp, Homo sapiens
gataagttatgtaacttgctca

SEQ ID NO: 9430586 - DNA, 19 bp, Homo sapiens
gataagtttccaggtaact

SEQ ID NO: 9430587 - DNA, 22 bp, Homo sapiens
gataatatctggtttattcacc

SEQ ID NO: 9430588 - DNA, 22 bp, Homo sapiens
gataatatctggtttattcacc

SEQ ID NO: 9430589 - DNA, 23 bp, Homo sapiens
gatacactccctgctgggcactg

SEQ ID NO: 9430590 - DNA, 22 bp, Homo sapiens
gatacactggccaagtggagga

SEQ ID NO: 9430591 - DNA, 21 bp, Homo sapiens
gatacagagggccactgattg

SEQ ID NO: 9430592 - DNA, 22 bp, Homo sapiens
gatacagacaccactcttttcc

SEQ ID NO: 9430593 - DNA, 22 bp, Homo sapiens
gatacagatctttaactgccct

SEQ ID NO: 9430594 - DNA, 22 bp, Homo sapiens
gatacattttatctcctaacag

SEQ ID NO: 9430595 - DNA, 22 bp, Homo sapiens
gatacattgagggtggaggacc

SEQ ID NO: 9430596 - DNA, 22 bp, Homo sapiens
gatacatttcaaggaggactgg

SEQ ID NO: 9430597 - DNA, 22 bp, Homo sapiens
gatacataaaaatgtgctctat

SEQ ID NO: 9430598 - DNA, 22 bp, Homo sapiens
gatacattccatttctacttaa

SEQ ID NO: 9430599 - DNA, 22 bp, Homo sapiens
gatacattccgggagggctacc

SEQ ID NO: 9430600 - DNA, 22 bp, Homo sapiens
gatgatgtgtcccaagaagtag

SEQ ID NO: 9430601 - DNA, 22 bp, Homo sapiens
gatgcaaaagtatcattttaat

SEQ ID NO: 9430602 - DNA, 22 bp, Homo sapiens
gatgattttgatgcagtaaaga

SEQ ID NO: 9430603 - DNA, 22 bp, Homo sapiens
gatgcaaaccttacatggacct

SEQ ID NO: 9430604 - DNA, 22 bp, Homo sapiens
gatgcaaactgtgacatagagt

SEQ ID NO: 9430605 - DNA, 22 bp, Homo sapiens
gatgcaaaccttacatggacct

SEQ ID NO: 9430606 - DNA, 22 bp, Homo sapiens
gatgcaaaccttacatggacct

SEQ ID NO: 9430607 - DNA, 22 bp, Homo sapiens
gatgcaaaccttacatggacct

SEQ ID NO: 9430608 - DNA, 22 bp, Homo sapiens
gatgcaaagaggaccttcagta

SEQ ID NO: 9430609 - DNA, 22 bp, Homo sapiens
gatgcaaagaggaccttcagta

SEQ ID NO: 9430610 - DNA, 22 bp, Homo sapiens
gatgcaaactgtgacatagagt

SEQ ID NO: 9430611 - DNA, 22 bp, Homo sapiens
gatgcacggtcatgtcttttca

SEQ ID NO: 9430612 - DNA, 22 bp, Homo sapiens
gatgcacaggtgagcaggtgca

SEQ ID NO: 9430613 - DNA, 22 bp, Homo sapiens
gatgcaaagcatttttgtgtgt

SEQ ID NO: 9430614 - DNA, 22 bp, Homo sapiens
gatgcaaagataaaacagacgc

SEQ ID NO: 9430615 - DNA, 22 bp, Homo sapiens
gatgcaaagataaaacagacgc

SEQ ID NO: 9430616 - DNA, 22 bp, Homo sapiens
gatgcagggctggcaggagctt

SEQ ID NO: 9430617 - DNA, 22 bp, Homo sapiens
gatgcatgtatggagtgagggt

SEQ ID NO: 9430618 - DNA, 22 bp, Homo sapiens
gatgcagggcagctctgggaca

SEQ ID NO: 9430619 - DNA, 22 bp, Homo sapiens
gatgcagggcagctctgggaca

SEQ ID NO: 9430620 - DNA, 22 bp, Homo sapiens
gatgcagggaacttagtgggct

SEQ ID NO: 9430621 - DNA, 22 bp, Homo sapiens
gatgaattctggcttggacaga

SEQ ID NO: 9430622 - DNA, 22 bp, Homo sapiens
gatgaatgggtacacaggatga

SEQ ID NO: 9430623 - DNA, 22 bp, Homo sapiens
gatgaattgttatggctacgag

SEQ ID NO: 9430624 - DNA, 22 bp, Homo sapiens
gatgaattgaaatcattgggca

SEQ ID NO: 9430625 - DNA, 22 bp, Homo sapiens
gatgacaacttgtttctgttat

SEQ ID NO: 9430626 - DNA, 22 bp, Homo sapiens
gatgacaagatctggatttgaa

SEQ ID NO: 9430627 - DNA, 22 bp, Homo sapiens
gatgacagtgagtaaccccaac

SEQ ID NO: 9430628 - DNA, 22 bp, Homo sapiens
gatgacagttctagcatctgaa

SEQ ID NO: 9430629 - DNA, 22 bp, Homo sapiens
gatgacagcagctgtggctcac

SEQ ID NO: 9430630 - DNA, 22 bp, Homo sapiens
gatgacagcagctgtggctcac

SEQ ID NO: 9430631 - DNA, 22 bp, Homo sapiens
gatgacagcagctgtggctcac

SEQ ID NO: 9430632 - DNA, 22 bp, Homo sapiens
gatgacacttgtgagaaatcaa

SEQ ID NO: 9430633 - DNA, 22 bp, Homo sapiens
gatgacaagatctggatttgaa

SEQ ID NO: 9430634 - DNA, 22 bp, Homo sapiens
gatgacactaagcatgttgtgg

SEQ ID NO: 9430635 - DNA, 21 bp, Homo sapiens
gatgaagcaatctttctgttg

SEQ ID NO: 9430636 - DNA, 22 bp, Homo sapiens
gatgaagaggcactgacatatt

SEQ ID NO: 9430637 - DNA, 22 bp, Homo sapiens
gatgaagccccagtgtaagtaa

SEQ ID NO: 9430638 - DNA, 22 bp, Homo sapiens
gatgaagctaaatctaaggttt

SEQ ID NO: 9430639 - DNA, 22 bp, Homo sapiens
gatgaagctatttggttggcac

SEQ ID NO: 9430640 - DNA, 22 bp, Homo sapiens
gatgaagcctgacttctcggtg

SEQ ID NO: 9430641 - DNA, 22 bp, Homo sapiens
gatgaagctttgaagtctaatc

SEQ ID NO: 9430642 - DNA, 18 bp, Homo sapiens
gatgaagctgctggggat

SEQ ID NO: 9430643 - DNA, 22 bp, Homo sapiens
gatgaagtcattatccttttgg

SEQ ID NO: 9430644 - DNA, 22 bp, Homo sapiens
gatgaggaaaccaaggctcagg

SEQ ID NO: 9430645 - DNA, 22 bp, Homo sapiens
gatgaggaatgctcagctcaat

SEQ ID NO: 9430646 - DNA, 22 bp, Homo sapiens
gatgatgggttgatgtgaaggg

SEQ ID NO: 9430647 - DNA, 22 bp, Homo sapiens
gatgatggtggacagctggtta

SEQ ID NO: 9430648 - DNA, 22 bp, Homo sapiens
gatgatgggttgatgtgaaggg

SEQ ID NO: 9430649 - DNA, 22 bp, Homo sapiens
gatgaggaatgctcagctcaat

SEQ ID NO: 9430650 - DNA, 22 bp, Homo sapiens
gatgagaaatggacaggagtgg

SEQ ID NO: 9430651 - DNA, 22 bp, Homo sapiens
gatgacttatgtttacaaatgt

SEQ ID NO: 9430652 - DNA, 22 bp, Homo sapiens
gatgacttatgtttacaaatgt

SEQ ID NO: 9430653 - DNA, 22 bp, Homo sapiens
gatgacagttctagcatctgaa

SEQ ID NO: 9430654 - DNA, 22 bp, Homo sapiens
gatgaaattgttttgatacttt

SEQ ID NO: 9430655 - DNA, 22 bp, Homo sapiens
gatgaaatttgaaaatagtgtt

SEQ ID NO: 9430656 - DNA, 22 bp, Homo sapiens
gatgaaatgtgaaagttctggg

SEQ ID NO: 9430657 - DNA, 22 bp, Homo sapiens
gatgaaatccagatcacaggtg

SEQ ID NO: 9430658 - DNA, 22 bp, Homo sapiens
gatgaaatagcaaaggcatttg

SEQ ID NO: 9430659 - DNA, 17 bp, Homo sapiens
gatgaaatgatgcacac

SEQ ID NO: 9430660 - DNA, 22 bp, Homo sapiens
gatgaaatagaattaatttagg

SEQ ID NO: 9430661 - DNA, 22 bp, Homo sapiens
gatgaaaaaagacgagcatata

SEQ ID NO: 9430662 - DNA, 22 bp, Homo sapiens
gatctttcatctatgtatttag

SEQ ID NO: 9430663 - DNA, 22 bp, Homo sapiens
gatcttttcagaatttatcagt

SEQ ID NO: 9430664 - DNA, 22 bp, Homo sapiens
gatgaaaaattgctgtgtcata

SEQ ID NO: 9430665 - DNA, 22 bp, Homo sapiens
gatgaaaaattgctgtgtcata

SEQ ID NO: 9430666 - DNA, 22 bp, Homo sapiens
gatgaaaaaagacgagcatata

SEQ ID NO: 9430667 - DNA, 22 bp, Homo sapiens
gatgaaaatcttgagatgtcga

SEQ ID NO: 9430668 - DNA, 22 bp, Homo sapiens
gatcttctctttagtagaaaca

SEQ ID NO: 9430669 - DNA, 22 bp, Homo sapiens
gatctttatactgtaataatga

SEQ ID NO: 9430670 - DNA, 22 bp, Homo sapiens
gatcccttgggccaaggagttg

SEQ ID NO: 9430671 - DNA, 22 bp, Homo sapiens
gatctggtacaggcctgcagcc

SEQ ID NO: 9430672 - DNA, 22 bp, Homo sapiens
gatctgggagcctcatggagac

SEQ ID NO: 9430673 - DNA, 22 bp, Homo sapiens
gatctgttataatctcttttat

SEQ ID NO: 9430674 - DNA, 22 bp, Homo sapiens
gatctgtcctggcagttaacac

SEQ ID NO: 9430675 - DNA, 22 bp, Homo sapiens
gatctggtttcatcatggactt

SEQ ID NO: 9430676 - DNA, 22 bp, Homo sapiens
gatctggtttcatcatggactt

SEQ ID NO: 9430677 - DNA, 22 bp, Homo sapiens
gatctggtctttgattagacac

SEQ ID NO: 9430678 - DNA, 22 bp, Homo sapiens
gatcattttgatgcccttttag

SEQ ID NO: 9430679 - DNA, 22 bp, Homo sapiens
gatcatttgactttataaggct

SEQ ID NO: 9430680 - DNA, 22 bp, Homo sapiens
gatcatttgcaggaaacattaa

SEQ ID NO: 9430681 - DNA, 22 bp, Homo sapiens
gatccaaattattttttagagg

SEQ ID NO: 9430682 - DNA, 22 bp, Homo sapiens
gatccagtggtttctccatgta

SEQ ID NO: 9430683 - DNA, 22 bp, Homo sapiens
gatccccagggcaggcctcccg

SEQ ID NO: 9430684 - DNA, 22 bp, Homo sapiens
gatccctgccctcagcctggac

SEQ ID NO: 9430685 - DNA, 22 bp, Homo sapiens
gatccctgccctcagcctggac

SEQ ID NO: 9430686 - DNA, 22 bp, Homo sapiens
gatccagcttctacacagagct

SEQ ID NO: 9430687 - DNA, 22 bp, Homo sapiens
gcttcctggaacaactgttgct

SEQ ID NO: 9430688 - DNA, 22 bp, Homo sapiens
gcttcctgggacaggctatgtg

SEQ ID NO: 9430689 - DNA, 22 bp, Homo sapiens
gcttcctggagggagagagctg

SEQ ID NO: 9430690 - DNA, 22 bp, Homo sapiens
gcttcctggagggagagagctg

SEQ ID NO: 9430691 - DNA, 22 bp, Homo sapiens
gcttcatgccaggaggtttaag

SEQ ID NO: 9430692 - DNA, 22 bp, Homo sapiens
gcttcattaactcagagttttg

SEQ ID NO: 9430693 - DNA, 22 bp, Homo sapiens
gcttcagactgtgcttctgttg

SEQ ID NO: 9430694 - DNA, 22 bp, Homo sapiens
gcttcagattcctcttctgtaa

SEQ ID NO: 9430695 - DNA, 22 bp, Homo sapiens
gcttcagattcttttcatgtct

SEQ ID NO: 9430696 - DNA, 22 bp, Homo sapiens
gcttcagattcttttcatgtct

SEQ ID NO: 9430697 - DNA, 22 bp, Homo sapiens
gcttcagaagttgggctctgac

SEQ ID NO: 9430698 - DNA, 22 bp, Homo sapiens
gcttcagaagttgggctctgac

SEQ ID NO: 9430699 - DNA, 22 bp, Homo sapiens
gcttcacagaatcaatagttgg

SEQ ID NO: 9430700 - DNA, 22 bp, Homo sapiens
gcttcacagaatcaatagttgg

SEQ ID NO: 9430701 - DNA, 20 bp, Homo sapiens
gcttcaaagccatcctttta

SEQ ID NO: 9430702 - DNA, 22 bp, Homo sapiens
gcttcaaattaaggtgaatccc

SEQ ID NO: 9430703 - DNA, 22 bp, Homo sapiens
gcttcacactaaaaatgttaaa

SEQ ID NO: 9430704 - DNA, 22 bp, Homo sapiens
gcttcacaacttcttaattctt

SEQ ID NO: 9430705 - DNA, 22 bp, Homo sapiens
gcttcacaacttcttaattctt

SEQ ID NO: 9430706 - DNA, 22 bp, Homo sapiens
gcttcaaagaacaaagggaggc

SEQ ID NO: 9430707 - DNA, 22 bp, Homo sapiens
gcttcaaagattcacagtttca

SEQ ID NO: 9430708 - DNA, 22 bp, Homo sapiens
gcttcaaactgagcttcaagtg

SEQ ID NO: 9430709 - DNA, 22 bp, Homo sapiens
gcttattttcaccttctctcag

SEQ ID NO: 9430710 - DNA, 22 bp, Homo sapiens
gcttattttcaccttctctcag

SEQ ID NO: 9430711 - DNA, 22 bp, Homo sapiens
gcttctaattttttacagaata

SEQ ID NO: 9430712 - DNA, 22 bp, Homo sapiens
gcttctaacctgcttcctgtag

SEQ ID NO: 9430713 - DNA, 22 bp, Homo sapiens
gcttctatcctaccatgtcttg

SEQ ID NO: 9430714 - DNA, 22 bp, Homo sapiens
gcttctcaattctcaccctcca

SEQ ID NO: 9430715 - DNA, 22 bp, Homo sapiens
gcttctatcctaccatgtcttg

SEQ ID NO: 9430716 - DNA, 22 bp, Homo sapiens
gcttctcaattctcaccctcca

SEQ ID NO: 9430717 - DNA, 22 bp, Homo sapiens
gcttctgatgtcagacttctgg

SEQ ID NO: 9430718 - DNA, 22 bp, Homo sapiens
gcttctgcgcacgcttcttccc

SEQ ID NO: 9430719 - DNA, 22 bp, Homo sapiens
gcttctgccttgcactttgtca

SEQ ID NO: 9430720 - DNA, 23 bp, Homo sapiens
gcttctgccatttgctagctgtg

SEQ ID NO: 9430721 - DNA, 22 bp, Homo sapiens
gcttctgcgcctagcctcaggt

SEQ ID NO: 9430722 - DNA, 22 bp, Homo sapiens
gcttctggaagcatatgcaaga

SEQ ID NO: 9430723 - DNA, 22 bp, Homo sapiens
gcttctgctgttgaagccacca

SEQ ID NO: 9430724 - DNA, 22 bp, Homo sapiens
gcttctgatgtcagacttctgg

SEQ ID NO: 9430725 - DNA, 22 bp, Homo sapiens
gcttctgcagccaaagaagccg

SEQ ID NO: 9430726 - DNA, 22 bp, Homo sapiens
gcttctgcagagccgtcctgag

SEQ ID NO: 9430727 - DNA, 23 bp, Homo sapiens
gcttctgccatttgctagctgtg

SEQ ID NO: 9430728 - DNA, 22 bp, Homo sapiens
gcttctgcagggtcctcgctgt

SEQ ID NO: 9430729 - DNA, 22 bp, Homo sapiens
gcttcctgtccctcagccatga

SEQ ID NO: 9430730 - DNA, 22 bp, Homo sapiens
gcttcctgtaggcaggtccaag

SEQ ID NO: 9430731 - DNA, 22 bp, Homo sapiens
gcttcctgtatcctcctgtacc

SEQ ID NO: 9430732 - DNA, 22 bp, Homo sapiens
gcttcctgtatcctcctgtacc

SEQ ID NO: 9430733 - DNA, 17 bp, Homo sapiens
gcttcctgtgctgggga

SEQ ID NO: 9430734 - DNA, 22 bp, Homo sapiens
gcttccttattgttgccatagt

SEQ ID NO: 9430735 - DNA, 22 bp, Homo sapiens
gcttcggggtccaagcgcgtgt

SEQ ID NO: 9430736 - DNA, 22 bp, Homo sapiens
gcttccttgggaaaattagatg

SEQ ID NO: 9430737 - DNA, 22 bp, Homo sapiens
gcttccttgggaaaattagatg

SEQ ID NO: 9430738 - DNA, 22 bp, Homo sapiens
gcttccttctaccacatcatgc

SEQ ID NO: 9430739 - DNA, 22 bp, Homo sapiens
gcttccttctaccacatcatgc

SEQ ID NO: 9430740 - DNA, 22 bp, Homo sapiens
gctgggctgagctagacttggc

SEQ ID NO: 9430741 - DNA, 22 bp, Homo sapiens
gctgggctgagctagacttggc

SEQ ID NO: 9430742 - DNA, 22 bp, Homo sapiens
gctgggctgagctagacttggc

SEQ ID NO: 9430743 - DNA, 22 bp, Homo sapiens
gctgggctgcgtcggggaagcc

SEQ ID NO: 9430744 - DNA, 22 bp, Homo sapiens
gctgggctgcgtcggggaagcc

SEQ ID NO: 9430745 - DNA, 22 bp, Homo sapiens
gctgggctgcgtcggggaagcc

SEQ ID NO: 9430746 - DNA, 22 bp, Homo sapiens
gctgggctgcccaacctctgac

SEQ ID NO: 9430747 - DNA, 22 bp, Homo sapiens
gcttacaagatcgtgctccagt

SEQ ID NO: 9430748 - DNA, 22 bp, Homo sapiens
gcttacaagccagctgtaccac

SEQ ID NO: 9430749 - DNA, 22 bp, Homo sapiens
gcttacaaacaacagaaattaa

SEQ ID NO: 9430750 - DNA, 22 bp, Homo sapiens
gcttacaaacaacagaaattaa

SEQ ID NO: 9430751 - DNA, 22 bp, Homo sapiens
gctgggctgcgtcggggaagcc

SEQ ID NO: 9430752 - DNA, 22 bp, Homo sapiens
gcttattaggttatttcaagga

SEQ ID NO: 9430753 - DNA, 22 bp, Homo sapiens
gcttattttcaccttctctcag

SEQ ID NO: 9430754 - DNA, 22 bp, Homo sapiens
gcttagtcaattataaataggc

SEQ ID NO: 9430755 - DNA, 22 bp, Homo sapiens
gcttagtcctagtgtactaaat

SEQ ID NO: 9430756 - DNA, 22 bp, Homo sapiens
gcttagtgaaacaacctttggc

SEQ ID NO: 9430757 - DNA, 22 bp, Homo sapiens
gcttagtgaaacaacctttggc

SEQ ID NO: 9430758 - DNA, 22 bp, Homo sapiens
gcttagtcaattataaataggc

SEQ ID NO: 9430759 - DNA, 22 bp, Homo sapiens
gcttagaagtacacatgccttt

SEQ ID NO: 9430760 - DNA, 22 bp, Homo sapiens
gcttacaggtgaggcagcaaga

SEQ ID NO: 9430761 - DNA, 22 bp, Homo sapiens
gcttacaagggtaggaagtcta

SEQ ID NO: 9430762 - DNA, 22 bp, Homo sapiens
gcttacaatcatttcagtttag

SEQ ID NO: 9430763 - DNA, 22 bp, Homo sapiens
gcttacaatcatttcagtttag

SEQ ID NO: 9430764 - DNA, 22 bp, Homo sapiens
gctgggctccaggccagggtga

SEQ ID NO: 9430765 - DNA, 22 bp, Homo sapiens
gctgggctccaccctcaactgt

SEQ ID NO: 9430766 - DNA, 22 bp, Homo sapiens
gctgggctcatttgtgtgtctg

SEQ ID NO: 9430767 - DNA, 22 bp, Homo sapiens
gctgggctcatttgtgtgtctg

SEQ ID NO: 9430768 - DNA, 22 bp, Homo sapiens
gctgggctcatttgtgtgtctg

SEQ ID NO: 9430769 - DNA, 22 bp, Homo sapiens
gctgggcaggcctcgtgagggc

SEQ ID NO: 9430770 - DNA, 22 bp, Homo sapiens
gctgggccagagcagcagcact

SEQ ID NO: 9430771 - DNA, 22 bp, Homo sapiens
gctgggcagtgagtgagtcctt

SEQ ID NO: 9430772 - DNA, 22 bp, Homo sapiens
gctgggcatgtgaccaacagaa

SEQ ID NO: 9430773 - DNA, 22 bp, Homo sapiens
gctgggcatgtgaccaacagaa

SEQ ID NO: 9430774 - DNA, 22 bp, Homo sapiens
gctgggctcagacctagtgaac

SEQ ID NO: 9430775 - DNA, 22 bp, Homo sapiens
gctgggctcagacctagtgaac

SEQ ID NO: 9430776 - DNA, 22 bp, Homo sapiens
gctgggctcagacctagtgaac

SEQ ID NO: 9430777 - DNA, 22 bp, Homo sapiens
gctgggctgagctagacttggc

SEQ ID NO: 9430778 - DNA, 22 bp, Homo sapiens
gctgggctgagaagttaagcaa

SEQ ID NO: 9430779 - DNA, 22 bp, Homo sapiens
gctgggctctttacccctgtac

SEQ ID NO: 9430780 - DNA, 22 bp, Homo sapiens
gctgggctctttacccctgtac

SEQ ID NO: 9430781 - DNA, 22 bp, Homo sapiens
gctgggctcttatcacctgtac

SEQ ID NO: 9430782 - DNA, 22 bp, Homo sapiens
gctgggctcttatcacctgtac

SEQ ID NO: 9430783 - DNA, 21 bp, Homo sapiens
gctgggctccagtctgccgct

SEQ ID NO: 9430784 - DNA, 22 bp, Homo sapiens
gctgggctcgttcccacacgcg

SEQ ID NO: 9430785 - DNA, 21 bp, Homo sapiens
gctgggctccagtctgccgct

SEQ ID NO: 9430786 - DNA, 22 bp, Homo sapiens
gctgggctcgttcccacacgcg

SEQ ID NO: 9430787 - DNA, 22 bp, Homo sapiens
gctgggctctgtcatgccttcc

SEQ ID NO: 9430788 - DNA, 22 bp, Homo sapiens
gcttctggaggagctgggctga

SEQ ID NO: 9430789 - DNA, 22 bp, Homo sapiens
gcttctggagtcttcagaggaa

SEQ ID NO: 9430790 - DNA, 22 bp, Homo sapiens
gcttctggaggagctgggctga

SEQ ID NO: 9430791 - DNA, 17 bp, Homo sapiens
gcttctggagcttctgt

SEQ ID NO: 9430792 - DNA, 22 bp, Homo sapiens
gcttctggaagctgcttctgcc

SEQ ID NO: 9430793 - DNA, 22 bp, Homo sapiens
gcttctgggcacctgaacagga

SEQ ID NO: 9430794 - DNA, 22 bp, Homo sapiens
gcttctggggttctggcatgct

SEQ ID NO: 9430795 - DNA, 22 bp, Homo sapiens
gcttctggggttctggcatgct

SEQ ID NO: 9430796 - DNA, 22 bp, Homo sapiens
ggaaaacaagagaatgatgttt

SEQ ID NO: 9430797 - DNA, 22 bp, Homo sapiens
ggaaaacaagagaatgatgttt

SEQ ID NO: 9430798 - DNA, 20 bp, Homo sapiens
ggaaaaatgcatgctcaaga

SEQ ID NO: 9430799 - DNA, 20 bp, Homo sapiens
ggaaaaatgcatgctcaaga

SEQ ID NO: 9430800 - DNA, 20 bp, Homo sapiens
ggaaaaatgcatgctcaaga

SEQ ID NO: 9430801 - DNA, 22 bp, Homo sapiens
ggaaaacagcgattggtatcat

SEQ ID NO: 9430802 - DNA, 22 bp, Homo sapiens
ggaaacaaaccactcatggtgg

SEQ ID NO: 9430803 - DNA, 22 bp, Homo sapiens
ggaaacatattctgatgtgcat

SEQ ID NO: 9430804 - DNA, 19 bp, Homo sapiens
ggaaacaggggccagagga

SEQ ID NO: 9430805 - DNA, 22 bp, Homo sapiens
ggaaacagagggcacctgagcc

SEQ ID NO: 9430806 - DNA, 22 bp, Homo sapiens
ggaaacagcaaattatggcaat

SEQ ID NO: 9430807 - DNA, 22 bp, Homo sapiens
ggaaacagctctttggggctgt

SEQ ID NO: 9430808 - DNA, 22 bp, Homo sapiens
ggaaactgcttacactagaggg

SEQ ID NO: 9430809 - DNA, 22 bp, Homo sapiens
ggaaagaaagtgtgaacaactt

SEQ ID NO: 9430810 - DNA, 22 bp, Homo sapiens
ggaaagaaagtgtgaacaactt

SEQ ID NO: 9430811 - DNA, 22 bp, Homo sapiens
ggaaactgagtgacactccctc

SEQ ID NO: 9430812 - DNA, 22 bp, Homo sapiens
ggaaaccaggactgcaccgtct

SEQ ID NO: 9430813 - DNA, 22 bp, Homo sapiens
ggaaagagctaaaagggtgaga

SEQ ID NO: 9430814 - DNA, 22 bp, Homo sapiens
ggaaagagctaaaagggtgaga

SEQ ID NO: 9430815 - DNA, 22 bp, Homo sapiens
ggaaagagctaaaagggtgaga

SEQ ID NO: 9430816 - DNA, 22 bp, Homo sapiens
ggaaagagggacccagcttggt

SEQ ID NO: 9430817 - DNA, 22 bp, Homo sapiens
ggaaagccaggtgctctggtgt

SEQ ID NO: 9430818 - DNA, 22 bp, Homo sapiens
ggaaagcatccaggtgccccca

SEQ ID NO: 9430819 - DNA, 22 bp, Homo sapiens
ggaactgaatgtctcggtataa

SEQ ID NO: 9430820 - DNA, 22 bp, Homo sapiens
ggaactgaatgtctcggtataa

SEQ ID NO: 9430821 - DNA, 22 bp, Homo sapiens
ggaactcctgctccaagcagct

SEQ ID NO: 9430822 - DNA, 22 bp, Homo sapiens
ggaaagaatagagactttatca

SEQ ID NO: 9430823 - DNA, 22 bp, Homo sapiens
ggaaagaatagagactttatca

SEQ ID NO: 9430824 - DNA, 21 bp, Homo sapiens
ggaaagaaggcaaggctcagg

SEQ ID NO: 9430825 - DNA, 21 bp, Homo sapiens
ggaaagaaggcaaggctcagg

SEQ ID NO: 9430826 - DNA, 21 bp, Homo sapiens
ggaaagaaggcaaggctcagg

SEQ ID NO: 9430827 - DNA, 22 bp, Homo sapiens
ggaaagaaccctggatggctgg

SEQ ID NO: 9430828 - DNA, 22 bp, Homo sapiens
ggaaagagcccagcagtgcttg

SEQ ID NO: 9430829 - DNA, 23 bp, Homo sapiens
ggaaagagaggagttgtgcatag

SEQ ID NO: 9430830 - DNA, 22 bp, Homo sapiens
ggaaagagaagttgggaggaat

SEQ ID NO: 9430831 - DNA, 22 bp, Homo sapiens
ggaaagaatcaagtgatcctgt

SEQ ID NO: 9430832 - DNA, 22 bp, Homo sapiens
ggaagaaaatgggcaacaggtg

SEQ ID NO: 9430833 - DNA, 22 bp, Homo sapiens
ggaagaaaatgggcaacaggtg

SEQ ID NO: 9430834 - DNA, 22 bp, Homo sapiens
ggaagaaagacatttattttga

SEQ ID NO: 9430835 - DNA, 22 bp, Homo sapiens
ggaagaaaatgggcaacaggtg

SEQ ID NO: 9430836 - DNA, 22 bp, Homo sapiens
ggaagaaagcacacaaacttga

SEQ ID NO: 9430837 - DNA, 22 bp, Homo sapiens
ggaagaaagacatttattttga

SEQ ID NO: 9430838 - DNA, 22 bp, Homo sapiens
ggaagaaagacatttattttga

SEQ ID NO: 9430839 - DNA, 22 bp, Homo sapiens
ggaagaaagcacacaaacttga

SEQ ID NO: 9430840 - DNA, 22 bp, Homo sapiens
ggaagaaagcacacaaacttga

SEQ ID NO: 9430841 - DNA, 22 bp, Homo sapiens
ggaagaaaggtggacaacaggt

SEQ ID NO: 9430842 - DNA, 22 bp, Homo sapiens
ggaagaaaggtggacaacaggt

SEQ ID NO: 9430843 - DNA, 22 bp, Homo sapiens
ggaagaaaggtggacaacaggt

SEQ ID NO: 9430844 - DNA, 22 bp, Homo sapiens
ggaagaaaggtggacaacaggt

SEQ ID NO: 9430845 - DNA, 22 bp, Homo sapiens
ggaagaaaggtggacaacaggt

SEQ ID NO: 9430846 - DNA, 22 bp, Homo sapiens
ggaagaaaggtggacaacaggt

SEQ ID NO: 9430847 - DNA, 22 bp, Homo sapiens
ggaagaaagtagaaaaccgtgg

SEQ ID NO: 9430848 - DNA, 22 bp, Homo sapiens
ggaagaaagtagaaaaccgtgg

SEQ ID NO: 9430849 - DNA, 22 bp, Homo sapiens
ggaagaaaagcttccagcgcct

SEQ ID NO: 9430850 - DNA, 22 bp, Homo sapiens
ggaagaaaagcttccagcgcct

SEQ ID NO: 9430851 - DNA, 22 bp, Homo sapiens
ggaagaaaagcttccagcgcct

SEQ ID NO: 9430852 - DNA, 18 bp, Homo sapiens
ggaagaaaaggaactcag

SEQ ID NO: 9430853 - DNA, 18 bp, Homo sapiens
ggaagaaaaggaactcag

SEQ ID NO: 9430854 - DNA, 18 bp, Homo sapiens
ggaagaaaaggaactcag

SEQ ID NO: 9430855 - DNA, 17 bp, Homo sapiens
ggaagaaaaggatcatc

SEQ ID NO: 9430856 - DNA, 17 bp, Homo sapiens
ggaagaaaaggatcatc

SEQ ID NO: 9430857 - DNA, 17 bp, Homo sapiens
ggaagaaaaggatcatc

SEQ ID NO: 9430858 - DNA, 17 bp, Homo sapiens
ggaagaaaaggatcatc

SEQ ID NO: 9430859 - DNA, 22 bp, Homo sapiens
ggaagaaaatgggcaacaggtg

SEQ ID NO: 9430860 - DNA, 22 bp, Homo sapiens
ggaactgaatgtctcggtataa

SEQ ID NO: 9430861 - DNA, 22 bp, Homo sapiens
ggaactgaatgtctcggtataa

SEQ ID NO: 9430862 - DNA, 22 bp, Homo sapiens
ggaacttatactgccagattct

SEQ ID NO: 9430863 - DNA, 22 bp, Homo sapiens
ggaactttaggatcctggctca

SEQ ID NO: 9430864 - DNA, 19 bp, Homo sapiens
ggaaggtgacagtggtgaa

SEQ ID NO: 9430865 - DNA, 19 bp, Homo sapiens
ggaaggtgacagtggtgaa

SEQ ID NO: 9430866 - DNA, 22 bp, Homo sapiens
ggaaggtgaggtaaggtcttgt

SEQ ID NO: 9430867 - DNA, 22 bp, Homo sapiens
ggaaggtgctccctggacagag

SEQ ID NO: 9430868 - DNA, 22 bp, Homo sapiens
ggaaggggttaggggtccctga

SEQ ID NO: 9430869 - DNA, 22 bp, Homo sapiens
ggaagggagtagttggaatgca

SEQ ID NO: 9430870 - DNA, 22 bp, Homo sapiens
ggaagaaatgctcttctatgcg

SEQ ID NO: 9430871 - DNA, 22 bp, Homo sapiens
ggaagaaatgctcttctatgcg

SEQ ID NO: 9430872 - DNA, 22 bp, Homo sapiens
ggaagaaatgctcttctatgcg

SEQ ID NO: 9430873 - DNA, 22 bp, Homo sapiens
ggaagaaatctggttaagagat

SEQ ID NO: 9430874 - DNA, 22 bp, Homo sapiens
ggaagggcaataaaatctcagg

SEQ ID NO: 9430875 - DNA, 22 bp, Homo sapiens
ggaaggggtgggtgagcctcag

SEQ ID NO: 9430876 - DNA, 22 bp, Homo sapiens
ggaagtttgggagctggtaatc

SEQ ID NO: 9430877 - DNA, 22 bp, Homo sapiens
ggaatatagccagtaacagtca

SEQ ID NO: 9430878 - DNA, 19 bp, Homo sapiens
ggagaagcatctagaaata

SEQ ID NO: 9430879 - DNA, 22 bp, Homo sapiens
ggagaagccacacattgggtgt

SEQ ID NO: 9430880 - DNA, 22 bp, Homo sapiens
ggaatcagaattactgaatgga

SEQ ID NO: 9430881 - DNA, 22 bp, Homo sapiens
ggagaagcaggtgctttgggtc

SEQ ID NO: 9430882 - DNA, 19 bp, Homo sapiens
ggagaagcccaggaatcct

SEQ ID NO: 9430883 - DNA, 22 bp, Homo sapiens
ggagaaggaagaaagctactat

SEQ ID NO: 9430884 - DNA, 18 bp, Homo sapiens
ggaaggtgctggagtgca

SEQ ID NO: 9430885 - DNA, 18 bp, Homo sapiens
ggaaggtgctggagtgca

SEQ ID NO: 9430886 - DNA, 22 bp, Homo sapiens
ggaaggtttttctcctggtggg

SEQ ID NO: 9430887 - DNA, 18 bp, Homo sapiens
ggaaggtgctggagtgca

SEQ ID NO: 9430888 - DNA, 22 bp, Homo sapiens
ggaagttcagttgctagtttca

SEQ ID NO: 9430889 - DNA, 22 bp, Homo sapiens
ggaagtgaggaaatattttgtt

SEQ ID NO: 9430890 - DNA, 22 bp, Homo sapiens
ggaagtgaggaattaggtttat

SEQ ID NO: 9430891 - DNA, 22 bp, Homo sapiens
ggagaaggcacacccacctctg

SEQ ID NO: 9430892 - DNA, 21 bp, Homo sapiens
ggagaaggacaatgttgagta

SEQ ID NO: 9430893 - DNA, 21 bp, Homo sapiens
ggagaaggacaatgttgagta

SEQ ID NO: 9430894 - DNA, 21 bp, Homo sapiens
ggagaaggacaatgttgagta

SEQ ID NO: 9430895 - DNA, 21 bp, Homo sapiens
ggagaaggacaatgttgagta

SEQ ID NO: 9430896 - DNA, 22 bp, Homo sapiens
ggagaaggaatattggagtagg

SEQ ID NO: 9430897 - DNA, 22 bp, Homo sapiens
ggagaaggaatattggagtagg

SEQ ID NO: 9430898 - DNA, 22 bp, Homo sapiens
ggagaaggaagaaagctactat

SEQ ID NO: 9430899 - DNA, 22 bp, Homo sapiens
ggagaaggaatattggagtagg

SEQ ID NO: 9430900 - DNA, 22 bp, Homo sapiens
ggagaaggaatattggagtagg

SEQ ID NO: 9430901 - DNA, 22 bp, Homo sapiens
ggagaaggaatattggagtagg

SEQ ID NO: 9430902 - DNA, 22 bp, Homo sapiens
ggagaaggaatattggagtagg

SEQ ID NO: 9430903 - DNA, 22 bp, Homo sapiens
ggagaaggaatattggagtagg

SEQ ID NO: 9430904 - DNA, 22 bp, Homo sapiens
ggagaaggaagaaagctactat

SEQ ID NO: 9430905 - DNA, 22 bp, Homo sapiens
ggagaaggaagaaagctactat

SEQ ID NO: 9430906 - DNA, 22 bp, Homo sapiens
ggagaaggaagaaagctactat

SEQ ID NO: 9430907 - DNA, 22 bp, Homo sapiens
ggagaaggaagaaagctactat

SEQ ID NO: 9430908 - DNA, 17 bp, Homo sapiens
ggagacagggtctttaa

SEQ ID NO: 9430909 - DNA, 22 bp, Homo sapiens
ggagaggcttggcccagcctgg

SEQ ID NO: 9430910 - DNA, 17 bp, Homo sapiens
ggagacagggtctttaa

SEQ ID NO: 9430911 - DNA, 22 bp, Homo sapiens
ggagacagcaggaagaaatatc

SEQ ID NO: 9430912 - DNA, 22 bp, Homo sapiens
ggagacactggaaagtattaca

SEQ ID NO: 9430913 - DNA, 22 bp, Homo sapiens
ggagaaggtggctcagcaaagg

SEQ ID NO: 9430914 - DNA, 22 bp, Homo sapiens
ggagaaggtggctcagcaaagg

SEQ ID NO: 9430915 - DNA, 22 bp, Homo sapiens
ggagaaggtggctcagcaaagg

SEQ ID NO: 9430916 - DNA, 22 bp, Homo sapiens
ggagacacccacattgctgggt

SEQ ID NO: 9430917 - DNA, 22 bp, Homo sapiens
ggagacaatggaggccaaaaga

SEQ ID NO: 9430918 - DNA, 23 bp, Homo sapiens
ggagacaaggtaccacgttaaca

SEQ ID NO: 9430919 - DNA, 22 bp, Homo sapiens
ggagaatgattctttgctcact

SEQ ID NO: 9430920 - DNA, 22 bp, Homo sapiens
ggagatgctttccagtggggat

SEQ ID NO: 9430921 - DNA, 22 bp, Homo sapiens
ggagatgctttccagtggggat

SEQ ID NO: 9430922 - DNA, 22 bp, Homo sapiens
ggagcctggttactagagcctg

SEQ ID NO: 9430923 - DNA, 22 bp, Homo sapiens
ggagcctggttactagagcctg

SEQ ID NO: 9430924 - DNA, 22 bp, Homo sapiens
ggagcctgtgcccaagcccaga

SEQ ID NO: 9430925 - DNA, 22 bp, Homo sapiens
ggagatgctatgtagtttggtt

SEQ ID NO: 9430926 - DNA, 20 bp, Homo sapiens
ggagatgcagcccaggtgcc

SEQ ID NO: 9430927 - DNA, 22 bp, Homo sapiens
ggagatgccagaattgcaaatt

SEQ ID NO: 9430928 - DNA, 22 bp, Homo sapiens
ggagcctgtggctgcttgaagc

SEQ ID NO: 9430929 - DNA, 22 bp, Homo sapiens
ggagcctgtgggatgagatgtg

SEQ ID NO: 9430930 - DNA, 22 bp, Homo sapiens
ggagcctgtgggatgagatgtg

SEQ ID NO: 9430931 - DNA, 22 bp, Homo sapiens
ggagcctgtgcccaagcccaga

SEQ ID NO: 9430932 - DNA, 22 bp, Homo sapiens
ggagcctgtggccgtcacgact

SEQ ID NO: 9430933 - DNA, 22 bp, Homo sapiens
ggagcgtgcactccaggccctt

SEQ ID NO: 9430934 - DNA, 22 bp, Homo sapiens
ggagcctgttagttgagtgctc

SEQ ID NO: 9430935 - DNA, 22 bp, Homo sapiens
ggagaggggaacttgttgcttg

SEQ ID NO: 9430936 - DNA, 22 bp, Homo sapiens
ggagaggggcaagtttatctag

SEQ ID NO: 9430937 - DNA, 22 bp, Homo sapiens
ggagaggggaacttgttgcttg

SEQ ID NO: 9430938 - DNA, 22 bp, Homo sapiens
ggagagggtaggggtcctgccc

SEQ ID NO: 9430939 - DNA, 23 bp, Homo sapiens
ggagaggggtgtgggcatcttta

SEQ ID NO: 9430940 - DNA, 23 bp, Homo sapiens
ggagaggggtgtgggcatcttta

SEQ ID NO: 9430941 - DNA, 23 bp, Homo sapiens
ggagaggggtgtgggcatcttta

SEQ ID NO: 9430942 - DNA, 22 bp, Homo sapiens
ggagagggggctccctgcttgg

SEQ ID NO: 9430943 - DNA, 22 bp, Homo sapiens
ggagagggggctccctgcttgg

SEQ ID NO: 9430944 - DNA, 23 bp, Homo sapiens
ggagaggggtgtgggcatcttta

SEQ ID NO: 9430945 - DNA, 22 bp, Homo sapiens
ggagagggggctccctgcttgg

SEQ ID NO: 9430946 - DNA, 22 bp, Homo sapiens
ggagatctgagagctggaagtg

SEQ ID NO: 9430947 - DNA, 17 bp, Homo sapiens
ggagatctggcagaggg

SEQ ID NO: 9430948 - DNA, 17 bp, Homo sapiens
ggagatctggcagaggg

SEQ ID NO: 9430949 - DNA, 22 bp, Homo sapiens
ggagaggtgcaggtcagtggca

SEQ ID NO: 9430950 - DNA, 22 bp, Homo sapiens
ggagaggtgcaggtcagtggca

SEQ ID NO: 9430951 - DNA, 22 bp, Homo sapiens
ggagagggtaggggtcctgccc

SEQ ID NO: 9430952 - DNA, 22 bp, Homo sapiens
ggagagggtaggggtcctgccc

SEQ ID NO: 9430953 - DNA, 22 bp, Homo sapiens
ggagagggtaggggtcctgccc

SEQ ID NO: 9430954 - DNA, 22 bp, Homo sapiens
ggagagggtaggggtcctgccc

SEQ ID NO: 9430955 - DNA, 22 bp, Homo sapiens
ggagagggtaggggtcctgccc

SEQ ID NO: 9430956 - DNA, 22 bp, Homo sapiens
ggagagggtgtggaaagttatc

SEQ ID NO: 9430957 - DNA, 22 bp, Homo sapiens
ggagctgcaagtgttgagagct

SEQ ID NO: 9430958 - DNA, 22 bp, Homo sapiens
ggagctgcacgctctgaagcct

SEQ ID NO: 9430959 - DNA, 22 bp, Homo sapiens
ggagctgatggtagaagaatga

SEQ ID NO: 9430960 - DNA, 22 bp, Homo sapiens
ggagctgatggtagaagaatga

SEQ ID NO: 9430961 - DNA, 22 bp, Homo sapiens
ggaggaaaggctccctccctct

SEQ ID NO: 9430962 - DNA, 22 bp, Homo sapiens
ggaggaaaggctccctccctct

SEQ ID NO: 9430963 - DNA, 22 bp, Homo sapiens
ggaggaaatccttagtaaggca

SEQ ID NO: 9430964 - DNA, 22 bp, Homo sapiens
ggagctgaggtaacagtgagtg

SEQ ID NO: 9430965 - DNA, 22 bp, Homo sapiens
ggagctgaggtaacagtgagtg

SEQ ID NO: 9430966 - DNA, 22 bp, Homo sapiens
ggagctctcctgatgtgaagat

SEQ ID NO: 9430967 - DNA, 22 bp, Homo sapiens
ggagctctcctgatgtgaagat

SEQ ID NO: 9430968 - DNA, 22 bp, Homo sapiens
ggagctcaggcccagcaaggcc

SEQ ID NO: 9430969 - DNA, 22 bp, Homo sapiens
ggagctcagtggggggactgtg

SEQ ID NO: 9430970 - DNA, 22 bp, Homo sapiens
ggagctcctggcagtgacagag

SEQ ID NO: 9430971 - DNA, 22 bp, Homo sapiens
ggaggagcatgagagggtagtg

SEQ ID NO: 9430972 - DNA, 22 bp, Homo sapiens
ggaggagcatgagagggtagtg

SEQ ID NO: 9430973 - DNA, 22 bp, Homo sapiens
ggaggagcatgagagggtagtg

SEQ ID NO: 9430974 - DNA, 22 bp, Homo sapiens
ggaggacaggggctgcagcaca

SEQ ID NO: 9430975 - DNA, 22 bp, Homo sapiens
ggaggacaggggctgcagcaca

SEQ ID NO: 9430976 - DNA, 22 bp, Homo sapiens
ggaggacactggctctgccttc

SEQ ID NO: 9430977 - DNA, 22 bp, Homo sapiens
ggaggacactggctctgccttc

SEQ ID NO: 9430978 - DNA, 22 bp, Homo sapiens
ggaggaaatgaaaggagggttt

SEQ ID NO: 9430979 - DNA, 22 bp, Homo sapiens
ggaggaaatccttagtaaggca

SEQ ID NO: 9430980 - DNA, 22 bp, Homo sapiens
ggaggaagaggttgttctctca

SEQ ID NO: 9430981 - DNA, 22 bp, Homo sapiens
ggaggaaatgaaaggagggttt

SEQ ID NO: 9430982 - DNA, 22 bp, Homo sapiens
ggaggaagcacacggcttgtat

SEQ ID NO: 9430983 - DNA, 22 bp, Homo sapiens
ggaggaagcacacggcttgtat

SEQ ID NO: 9430984 - DNA, 22 bp, Homo sapiens
ggaggaagggcccaggctttat

SEQ ID NO: 9430985 - DNA, 22 bp, Homo sapiens
ggaggaagggcccaggctttat

SEQ ID NO: 9430986 - DNA, 22 bp, Homo sapiens
ggaggaagtgcagttctactac

SEQ ID NO: 9430987 - DNA, 22 bp, Homo sapiens
ggaggaagggtagcataatgta

SEQ ID NO: 9430988 - DNA, 22 bp, Homo sapiens
ggaggaagggtagcataatgta

SEQ ID NO: 9430989 - DNA, 22 bp, Homo sapiens
ggaggaagggcccaggctttat

SEQ ID NO: 9430990 - DNA, 22 bp, Homo sapiens
ggaggaagccctcggtgcccca

SEQ ID NO: 9430991 - DNA, 22 bp, Homo sapiens
ggaggccatagtttgggagtca

SEQ ID NO: 9430992 - DNA, 22 bp, Homo sapiens
ggaggccagtcctggccgggct

SEQ ID NO: 9430993 - DNA, 22 bp, Homo sapiens
ggaggccagtcctggccgggct

SEQ ID NO: 9430994 - DNA, 22 bp, Homo sapiens
ggaggccatcagggagggcatt

SEQ ID NO: 9430995 - DNA, 22 bp, Homo sapiens
ggaggccatgaggctctaggtg

SEQ ID NO: 9430996 - DNA, 22 bp, Homo sapiens
ggaggccatgaggctctaggtg

SEQ ID NO: 9430997 - DNA, 22 bp, Homo sapiens
ggaggccatctggctggaggct

SEQ ID NO: 9430998 - DNA, 22 bp, Homo sapiens
ggaggccatcagggagggcatt

SEQ ID NO: 9430999 - DNA, 22 bp, Homo sapiens
ggaggccatcagggagggcatt

SEQ ID NO: 9431000 - DNA, 22 bp, Homo sapiens
ggaggccagcctgaggctgagg

SEQ ID NO: 9431001 - DNA, 22 bp, Homo sapiens
ggaggccagcctgaggctgagg

SEQ ID NO: 9431002 - DNA, 22 bp, Homo sapiens
ggaggccagcctgaggctgagg

SEQ ID NO: 9431003 - DNA, 22 bp, Homo sapiens
ggaggccaggaagagccgccct

SEQ ID NO: 9431004 - DNA, 22 bp, Homo sapiens
ggaggccaggatgggaactcaa

SEQ ID NO: 9431005 - DNA, 22 bp, Homo sapiens
ggaggccaggatgggaactcaa

SEQ ID NO: 9431006 - DNA, 22 bp, Homo sapiens
ggaggccaggaaggctcggaga

SEQ ID NO: 9431007 - DNA, 22 bp, Homo sapiens
ggaggccaggaagagccgccct

SEQ ID NO: 9431008 - DNA, 22 bp, Homo sapiens
ggaggccagggacccagtcagc

SEQ ID NO: 9431009 - DNA, 22 bp, Homo sapiens
ggaggccagggacccagtcagc

SEQ ID NO: 9431010 - DNA, 22 bp, Homo sapiens
ggaggccagggacccagtcagc

SEQ ID NO: 9431011 - DNA, 15 bp, Homo sapiens
ggaggccaggctgtg

SEQ ID NO: 9431012 - DNA, 22 bp, Homo sapiens
ggaggccaggtgggagtcatct

SEQ ID NO: 9431013 - DNA, 22 bp, Homo sapiens
ggaggccagggtgggtggatcg

SEQ ID NO: 9431014 - DNA, 22 bp, Homo sapiens
ggaggaggcaagtaccagatgc

SEQ ID NO: 9431015 - DNA, 22 bp, Homo sapiens
ggaggaggcaagtaccagatgc

SEQ ID NO: 9431016 - DNA, 22 bp, Homo sapiens
ggaggagctgctgtgggggccc

SEQ ID NO: 9431017 - DNA, 22 bp, Homo sapiens
ggaggcagaatagagtgtgggt

SEQ ID NO: 9431018 - DNA, 22 bp, Homo sapiens
ggaggaggcggcagaagttcct

SEQ ID NO: 9431019 - DNA, 22 bp, Homo sapiens
ggaggcagaatagagtgtgggt

SEQ ID NO: 9431020 - DNA, 22 bp, Homo sapiens
ggaggcagaatagagtgtgggt

SEQ ID NO: 9431021 - DNA, 22 bp, Homo sapiens
ggaggcagaatagagtgtgggt

SEQ ID NO: 9431022 - DNA, 22 bp, Homo sapiens
ggaggccaaggcgggcggatca

SEQ ID NO: 9431023 - DNA, 22 bp, Homo sapiens
ggaggcagaatagagtgtgggt

SEQ ID NO: 9431024 - DNA, 22 bp, Homo sapiens
ggaggccaagtcactgacctgg

SEQ ID NO: 9431025 - DNA, 22 bp, Homo sapiens
ggaggccaaggtgggcggatca

SEQ ID NO: 9431026 - DNA, 22 bp, Homo sapiens
ggaggccaccatggagtcactt

SEQ ID NO: 9431027 - DNA, 22 bp, Homo sapiens
ggaggccaccatggagtcactt

SEQ ID NO: 9431028 - DNA, 22 bp, Homo sapiens
ggaggccaattttctaactgca

SEQ ID NO: 9431029 - DNA, 22 bp, Homo sapiens
ggaggccacctgacctgctgtt

SEQ ID NO: 9431030 - DNA, 22 bp, Homo sapiens
ggaggccacctgacctgctgtt

SEQ ID NO: 9431031 - DNA, 22 bp, Homo sapiens
ggaggccagcctgaggctgagg

SEQ ID NO: 9431032 - DNA, 22 bp, Homo sapiens
ggaggccagaatctgtgttgga

SEQ ID NO: 9431033 - DNA, 22 bp, Homo sapiens
ggaggccacggtttagcaccga

SEQ ID NO: 9431034 - DNA, 22 bp, Homo sapiens
ggagttccagaccagactggcc

SEQ ID NO: 9431035 - DNA, 22 bp, Homo sapiens
ggagttcaggaatgaaaatgtt

SEQ ID NO: 9431036 - DNA, 22 bp, Homo sapiens
ggagttcaggaatgaaaatgtt

SEQ ID NO: 9431037 - DNA, 22 bp, Homo sapiens
ggagttccagaatctgcttttt

SEQ ID NO: 9431038 - DNA, 17 bp, Homo sapiens
ggagttctgcagtcagg

SEQ ID NO: 9431039 - DNA, 22 bp, Homo sapiens
ggcaaggaagaagccatgatgt

SEQ ID NO: 9431040 - DNA, 22 bp, Homo sapiens
ggagttgattttggatatatta

SEQ ID NO: 9431041 - DNA, 22 bp, Homo sapiens
ggagttgattttggatatatta

SEQ ID NO: 9431042 - DNA, 22 bp, Homo sapiens
ggagttgattttggatatatta

SEQ ID NO: 9431043 - DNA, 22 bp, Homo sapiens
ggagtggtgtcactgagaggaa

SEQ ID NO: 9431044 - DNA, 22 bp, Homo sapiens
ggagtggtgtcactgagaggaa

SEQ ID NO: 9431045 - DNA, 22 bp, Homo sapiens
ggagtgtggagaggacatgggt

SEQ ID NO: 9431046 - DNA, 22 bp, Homo sapiens
ggagtgtgattgttctctgtta

SEQ ID NO: 9431047 - DNA, 22 bp, Homo sapiens
ggagttcaaatcttttggatct

SEQ ID NO: 9431048 - DNA, 22 bp, Homo sapiens
ggagttcaccaaggttatgcag

SEQ ID NO: 9431049 - DNA, 22 bp, Homo sapiens
ggagttcacgatgttggccagg

SEQ ID NO: 9431050 - DNA, 22 bp, Homo sapiens
ggagttcaggaaaggagccaga

SEQ ID NO: 9431051 - DNA, 22 bp, Homo sapiens
ggagttcactgtgcaggctctg

SEQ ID NO: 9431052 - DNA, 22 bp, Homo sapiens
ggagtgtggagaggacatgggt

SEQ ID NO: 9431053 - DNA, 22 bp, Homo sapiens
ggagtgtgggatggagctcagg

SEQ ID NO: 9431054 - DNA, 22 bp, Homo sapiens
ggcacacaaaggcagcatttga

SEQ ID NO: 9431055 - DNA, 22 bp, Homo sapiens
ggcaagggacggccgtgagaca

SEQ ID NO: 9431056 - DNA, 22 bp, Homo sapiens
ggcaaggccttgcccagcattc

SEQ ID NO: 9431057 - DNA, 22 bp, Homo sapiens
ggcacacatggtggttggtgaa

SEQ ID NO: 9431058 - DNA, 22 bp, Homo sapiens
ggcacacatggtggttggtgaa

SEQ ID NO: 9431059 - DNA, 22 bp, Homo sapiens
ggcacacatggtggttggtgaa

SEQ ID NO: 9431060 - DNA, 22 bp, Homo sapiens
ggcacacatagatctgcactgg

SEQ ID NO: 9431061 - DNA, 22 bp, Homo sapiens
ggcacacagcttggcaggagat

SEQ ID NO: 9431062 - DNA, 22 bp, Homo sapiens
ggcacagagaggccctggaagg

SEQ ID NO: 9431063 - DNA, 22 bp, Homo sapiens
ggcacagagcccagcttcctag

SEQ ID NO: 9431064 - DNA, 22 bp, Homo sapiens
ggcacagagcaggccactaatc

SEQ ID NO: 9431065 - DNA, 22 bp, Homo sapiens
ggcacagagaggccctggaagg

SEQ ID NO: 9431066 - DNA, 22 bp, Homo sapiens
ggagtggcctctcctgtgcagg

SEQ ID NO: 9431067 - DNA, 22 bp, Homo sapiens
ggagtggcctctcctgtgcagg

SEQ ID NO: 9431068 - DNA, 22 bp, Homo sapiens
ggagtggcagctaggctgtcag

SEQ ID NO: 9431069 - DNA, 22 bp, Homo sapiens
ggagtggccacgactgggagat

SEQ ID NO: 9431070 - DNA, 22 bp, Homo sapiens
ggagtggcagctaggctgtcag

SEQ ID NO: 9431071 - DNA, 22 bp, Homo sapiens
ggagtggcagagagggtatact

SEQ ID NO: 9431072 - DNA, 22 bp, Homo sapiens
ggagtggcagcgaggatcagat

SEQ ID NO: 9431073 - DNA, 22 bp, Homo sapiens
ggagtggcactctgaggcgggg

SEQ ID NO: 9431074 - DNA, 22 bp, Homo sapiens
ggagtgctttgaagccttcatt

SEQ ID NO: 9431075 - DNA, 22 bp, Homo sapiens
ggagtggctatttgtgctggtt

SEQ ID NO: 9431076 - DNA, 22 bp, Homo sapiens
ggagtggctgtttctgccccca

SEQ ID NO: 9431077 - DNA, 22 bp, Homo sapiens
ggagtgggaacaatgacatggt

SEQ ID NO: 9431078 - DNA, 22 bp, Homo sapiens
ggagtgggaacaatgacatggt

SEQ ID NO: 9431079 - DNA, 22 bp, Homo sapiens
ggagtgggaacaatgacatggt

SEQ ID NO: 9431080 - DNA, 22 bp, Homo sapiens
ggagtgggaacaatgacatggt

SEQ ID NO: 9431081 - DNA, 22 bp, Homo sapiens
ggagtgggaacaatgacatggt

SEQ ID NO: 9431082 - DNA, 22 bp, Homo sapiens
ggagtgggaacaatgacatggt

SEQ ID NO: 9431083 - DNA, 22 bp, Homo sapiens
ggagtgggcagcactgccctgt

SEQ ID NO: 9431084 - DNA, 22 bp, Homo sapiens
ggagtggtggtcaggccatggc

SEQ ID NO: 9431085 - DNA, 22 bp, Homo sapiens
ggagtggtggtcaggccatggc

SEQ ID NO: 9431086 - DNA, 19 bp, Homo sapiens
ggagtgggtagttagtggt

SEQ ID NO: 9431087 - DNA, 19 bp, Homo sapiens
ggagtgggtagttagtggt

SEQ ID NO: 9431088 - DNA, 19 bp, Homo sapiens
ggagtgggtagttagtggt

SEQ ID NO: 9431089 - DNA, 22 bp, Homo sapiens
ggcacagagcccagcttcctag

SEQ ID NO: 9431090 - DNA, 22 bp, Homo sapiens
ggcacagagctccagccttggc

SEQ ID NO: 9431091 - DNA, 22 bp, Homo sapiens
ggcacagagctccagccttggc

SEQ ID NO: 9431092 - DNA, 22 bp, Homo sapiens
ggcacagagctttgtcccagtt

SEQ ID NO: 9431093 - DNA, 22 bp, Homo sapiens
ggcacagagctccagccttggc

SEQ ID NO: 9431094 - DNA, 22 bp, Homo sapiens
ggcacagaggttgcctccagat

SEQ ID NO: 9431095 - DNA, 22 bp, Homo sapiens
ggcacagaggttgcctccagat

SEQ ID NO: 9431096 - DNA, 22 bp, Homo sapiens
ggcacagagctttgtcccagtt

SEQ ID NO: 9431097 - DNA, 22 bp, Homo sapiens
ggcacagagttggcagagctgc

SEQ ID NO: 9431098 - DNA, 22 bp, Homo sapiens
ggcacagagttggcagagctgc

SEQ ID NO: 9431099 - DNA, 23 bp, Homo sapiens
ggcacagatgctgagcatgtgca

SEQ ID NO: 9431100 - DNA, 22 bp, Homo sapiens
ggcacagatagatcaagtgtct

SEQ ID NO: 9431101 - DNA, 23 bp, Homo sapiens
ggcacagatgctgagcatgtgca

SEQ ID NO: 9431102 - DNA, 23 bp, Homo sapiens
ggcacagatgctgagcatgtgca

SEQ ID NO: 9431103 - DNA, 23 bp, Homo sapiens
ggcacagatgctgagcatgtgca

SEQ ID NO: 9431104 - DNA, 22 bp, Homo sapiens
ggcacagcacagagcacatgta

SEQ ID NO: 9431105 - DNA, 22 bp, Homo sapiens
ggcacagcacagagcacatgta

SEQ ID NO: 9431106 - DNA, 22 bp, Homo sapiens
ggcacagcacagtggacccagg

SEQ ID NO: 9431107 - DNA, 22 bp, Homo sapiens
ggcacagcaccttttcacattg

SEQ ID NO: 9431108 - DNA, 22 bp, Homo sapiens
ggcacagcactgtaggcctggg

SEQ ID NO: 9431109 - DNA, 22 bp, Homo sapiens
ggcagacacaaaaacataaggt

SEQ ID NO: 9431110 - DNA, 22 bp, Homo sapiens
ggcagacacaaaaacataaggt

SEQ ID NO: 9431111 - DNA, 22 bp, Homo sapiens
ggcagacacaaaaacataaggt

SEQ ID NO: 9431112 - DNA, 22 bp, Homo sapiens
ggcagagaatctggctgtttac

SEQ ID NO: 9431113 - DNA, 21 bp, Homo sapiens
ggcagagaagctggaagttgg

SEQ ID NO: 9431114 - DNA, 22 bp, Homo sapiens
ggcagagaatctggctgtttac

SEQ ID NO: 9431115 - DNA, 21 bp, Homo sapiens
ggcagagaagctggaagttgg

SEQ ID NO: 9431116 - DNA, 21 bp, Homo sapiens
ggcagagaagctggaagttgg

SEQ ID NO: 9431117 - DNA, 20 bp, Homo sapiens
ggcagacctgctgagagccc

SEQ ID NO: 9431118 - DNA, 22 bp, Homo sapiens
ggcagacacctttatgtctaat

SEQ ID NO: 9431119 - DNA, 19 bp, Homo sapiens
ggcagacacagttgacatg

SEQ ID NO: 9431120 - DNA, 22 bp, Homo sapiens
ggcagacctctccagccccaca

SEQ ID NO: 9431121 - DNA, 23 bp, Homo sapiens
ggcagagagcatggctggggccc

SEQ ID NO: 9431122 - DNA, 22 bp, Homo sapiens
ggcagaggaagctggaagtggg

SEQ ID NO: 9431123 - DNA, 22 bp, Homo sapiens
ggcagagactgggttggcagag

SEQ ID NO: 9431124 - DNA, 23 bp, Homo sapiens
ggcagagagcatggctggggccc

SEQ ID NO: 9431125 - DNA, 22 bp, Homo sapiens
ggcagagacaccgaatgactct

SEQ ID NO: 9431126 - DNA, 22 bp, Homo sapiens
ggcagagactgggttggcagag

SEQ ID NO: 9431127 - DNA, 22 bp, Homo sapiens
ggcaggcgtggtggcctcagaa

SEQ ID NO: 9431128 - DNA, 22 bp, Homo sapiens
ggcaggctagcactgatgtcct

SEQ ID NO: 9431129 - DNA, 22 bp, Homo sapiens
ggcaggctagcactgatgtcct

SEQ ID NO: 9431130 - DNA, 22 bp, Homo sapiens
ggcaggctagcactgatgtcct

SEQ ID NO: 9431131 - DNA, 22 bp, Homo sapiens
ggcaggcgtggtggcctcagaa

SEQ ID NO: 9431132 - DNA, 22 bp, Homo sapiens
ggcaggctgcttgggtcatgtc

SEQ ID NO: 9431133 - DNA, 22 bp, Homo sapiens
ggcaggctgcttgggtcatgtc

SEQ ID NO: 9431134 - DNA, 22 bp, Homo sapiens
ggcaggctgcttgggtcatgtc

SEQ ID NO: 9431135 - DNA, 22 bp, Homo sapiens
ggcaggctgcttgggtcatgtc

SEQ ID NO: 9431136 - DNA, 22 bp, Homo sapiens
ggcaggctcttggccttatgag

SEQ ID NO: 9431137 - DNA, 22 bp, Homo sapiens
ggcaggctcttggccttatgag

SEQ ID NO: 9431138 - DNA, 22 bp, Homo sapiens
ggcaggctcttggccttatgag

SEQ ID NO: 9431139 - DNA, 18 bp, Homo sapiens
ggcaggctctctgggtca

SEQ ID NO: 9431140 - DNA, 18 bp, Homo sapiens
ggcaggctctctgggtca

SEQ ID NO: 9431141 - DNA, 18 bp, Homo sapiens
ggcaggctctctgggtca

SEQ ID NO: 9431142 - DNA, 22 bp, Homo sapiens
ggcaggctccaagcatcctatg

SEQ ID NO: 9431143 - DNA, 22 bp, Homo sapiens
ggcaggctccaagcatcctatg

SEQ ID NO: 9431144 - DNA, 22 bp, Homo sapiens
ggcaggctccaagcatcctatg

SEQ ID NO: 9431145 - DNA, 22 bp, Homo sapiens
ggcaggctcagcagccaaggag

SEQ ID NO: 9431146 - DNA, 22 bp, Homo sapiens
ggcaggctcagcagccaaggag

SEQ ID NO: 9431147 - DNA, 22 bp, Homo sapiens
ggcaggctccgtgttccattcc

SEQ ID NO: 9431148 - DNA, 22 bp, Homo sapiens
ggcaggctccgtgttccattcc

SEQ ID NO: 9431149 - DNA, 22 bp, Homo sapiens
ggcaggctccagagccctctcc

SEQ ID NO: 9431150 - DNA, 22 bp, Homo sapiens
ggcaggctccagagccctctcc

SEQ ID NO: 9431151 - DNA, 22 bp, Homo sapiens
ggcaggctgggtgtcatggagt

SEQ ID NO: 9431152 - DNA, 22 bp, Homo sapiens
ggcaggctgggtgtcatggagt

SEQ ID NO: 9431153 - DNA, 22 bp, Homo sapiens
ggcaggctgggtgtcatggagt

SEQ ID NO: 9431154 - DNA, 22 bp, Homo sapiens
ggcaggtgaggcatgtgcctgg

SEQ ID NO: 9431155 - DNA, 22 bp, Homo sapiens
ggcaggtgaggcatgtgcctgg

SEQ ID NO: 9431156 - DNA, 22 bp, Homo sapiens
ggcaggtgaggcatgtgcctgg

SEQ ID NO: 9431157 - DNA, 22 bp, Homo sapiens
ggcaggctgggagtcatcagag

SEQ ID NO: 9431158 - DNA, 22 bp, Homo sapiens
ggcaggctgggagtcatcagag

SEQ ID NO: 9431159 - DNA, 22 bp, Homo sapiens
ggcaggctgggagtcatcagag

SEQ ID NO: 9431160 - DNA, 22 bp, Homo sapiens
ggcaggctgggagtcatcagag

SEQ ID NO: 9431161 - DNA, 22 bp, Homo sapiens
ggcaggctgcttgggtcatgtc

SEQ ID NO: 9431162 - DNA, 22 bp, Homo sapiens
ggcaggctggctttgttccagg

SEQ ID NO: 9431163 - DNA, 19 bp, Homo sapiens
ggcaggctggatagagagg

SEQ ID NO: 9431164 - DNA, 19 bp, Homo sapiens
ggcaggctggatagagagg

SEQ ID NO: 9431165 - DNA, 20 bp, Homo sapiens
ggcaggtgctcgcttggtct

SEQ ID NO: 9431166 - DNA, 20 bp, Homo sapiens
ggcaggtgctcgcttggtct

SEQ ID NO: 9431167 - DNA, 22 bp, Homo sapiens
ggcaggtgctaagagaggtaaa

SEQ ID NO: 9431168 - DNA, 22 bp, Homo sapiens
ggcaggtgctaagagaggtaaa

SEQ ID NO: 9431169 - DNA, 22 bp, Homo sapiens
ggcaggtgctaagagaggtaaa

SEQ ID NO: 9431170 - DNA, 22 bp, Homo sapiens
ggcaggtgcgcatgttgcatta

SEQ ID NO: 9431171 - DNA, 22 bp, Homo sapiens
ggcaggtgcgcatgttgcatta

SEQ ID NO: 9431172 - DNA, 22 bp, Homo sapiens
ggcaggtgcgcatgttgcatta

SEQ ID NO: 9431173 - DNA, 22 bp, Homo sapiens
ggcaggtgctaagagaggtaaa

SEQ ID NO: 9431174 - DNA, 17 bp, Homo sapiens
ggcaggtgcggggccgc

SEQ ID NO: 9431175 - DNA, 22 bp, Homo sapiens
ggcagctgcacgttgtcccgtc

SEQ ID NO: 9431176 - DNA, 17 bp, Homo sapiens
ggcagctgccacttttt

SEQ ID NO: 9431177 - DNA, 22 bp, Homo sapiens
ggcagctgcacgttgtcccgtc

SEQ ID NO: 9431178 - DNA, 22 bp, Homo sapiens
ggcagctgcaaatctgctctgt

SEQ ID NO: 9431179 - DNA, 22 bp, Homo sapiens
ggcagctgcaaatctgctctgt

SEQ ID NO: 9431180 - DNA, 22 bp, Homo sapiens
ggcagctctgctccttggctcc

SEQ ID NO: 9431181 - DNA, 22 bp, Homo sapiens
ggcagctctgatgatgctctgg

SEQ ID NO: 9431182 - DNA, 22 bp, Homo sapiens
ggcagctctgctaattgagcct

SEQ ID NO: 9431183 - DNA, 19 bp, Homo sapiens
ggcagctggacgctgttca

SEQ ID NO: 9431184 - DNA, 19 bp, Homo sapiens
ggcagctggacgctgttca

SEQ ID NO: 9431185 - DNA, 22 bp, Homo sapiens
ggcagctgctgcattacgttgt

SEQ ID NO: 9431186 - DNA, 22 bp, Homo sapiens
ggcagctgctgcattacgttgt

SEQ ID NO: 9431187 - DNA, 22 bp, Homo sapiens
ggcagctgctgcattacgttgt

SEQ ID NO: 9431188 - DNA, 22 bp, Homo sapiens
ggcagctggcctcctcgcccac

SEQ ID NO: 9431189 - DNA, 22 bp, Homo sapiens
ggcagctggcctcctcgcccac

SEQ ID NO: 9431190 - DNA, 22 bp, Homo sapiens
ggcagctggcctcctcgcccac

SEQ ID NO: 9431191 - DNA, 22 bp, Homo sapiens
ggcagaggaagctggaagtggg

SEQ ID NO: 9431192 - DNA, 22 bp, Homo sapiens
ggcagctcgtcaggctgcggcg

SEQ ID NO: 9431193 - DNA, 20 bp, Homo sapiens
ggcagctctagtcgaggccc

SEQ ID NO: 9431194 - DNA, 22 bp, Homo sapiens
ggcagaggaagctggaagtggg

SEQ ID NO: 9431195 - DNA, 22 bp, Homo sapiens
ggcagaggaagctggaagtggg

SEQ ID NO: 9431196 - DNA, 22 bp, Homo sapiens
ggcagaggaagctggaagtggg

SEQ ID NO: 9431197 - DNA, 22 bp, Homo sapiens
ggcagaggaagctggaagtggg

SEQ ID NO: 9431198 - DNA, 22 bp, Homo sapiens
ggcagaggaagctggaagtggg

SEQ ID NO: 9431199 - DNA, 22 bp, Homo sapiens
ggcagaggaagctggaagtggg

SEQ ID NO: 9431200 - DNA, 22 bp, Homo sapiens
ggcagaggaagctggaagtggg

SEQ ID NO: 9431201 - DNA, 22 bp, Homo sapiens
ggcagctggggcagtgccctgt

SEQ ID NO: 9431202 - DNA, 22 bp, Homo sapiens
ggcagctggggcagtgccctgt

SEQ ID NO: 9431203 - DNA, 22 bp, Homo sapiens
ggcagctggggcagtgccctgt

SEQ ID NO: 9431204 - DNA, 23 bp, Homo sapiens
ggcagctgggcagcactcatggg

SEQ ID NO: 9431205 - DNA, 23 bp, Homo sapiens
ggcagctgggcagcactcatggg

SEQ ID NO: 9431206 - DNA, 23 bp, Homo sapiens
ggcagctgggcagcactcatggg

SEQ ID NO: 9431207 - DNA, 22 bp, Homo sapiens
ggcagctgggttggccagaaac

SEQ ID NO: 9431208 - DNA, 22 bp, Homo sapiens
ggcagctggttctttccattaa

SEQ ID NO: 9431209 - DNA, 22 bp, Homo sapiens
ggcagctgggttggccagaaac

SEQ ID NO: 9431210 - DNA, 22 bp, Homo sapiens
ggcagctgggttggccagaaac

SEQ ID NO: 9431211 - DNA, 22 bp, Homo sapiens
ggcagctgggtcacaccgatct

SEQ ID NO: 9431212 - DNA, 22 bp, Homo sapiens
ggcagctgggttggccagaaac

SEQ ID NO: 9431213 - DNA, 22 bp, Homo sapiens
ggcagctgggtgcctaataatg

SEQ ID NO: 9431214 - DNA, 22 bp, Homo sapiens
ggcagctgtctctgagttagca

SEQ ID NO: 9431215 - DNA, 22 bp, Homo sapiens
ggcagctgtctctgagttagca

SEQ ID NO: 9431216 - DNA, 22 bp, Homo sapiens
ggcagctgtctctgagttagca

SEQ ID NO: 9431217 - DNA, 22 bp, Homo sapiens
ggcaggcagatggctgcaccaa

SEQ ID NO: 9431218 - DNA, 22 bp, Homo sapiens
ggcaggcagatggctgcaccaa

SEQ ID NO: 9431219 - DNA, 22 bp, Homo sapiens
ggcaggcagatggctgcaccaa

SEQ ID NO: 9431220 - DNA, 22 bp, Homo sapiens
ggcagctgtgaagtgcctcaca

SEQ ID NO: 9431221 - DNA, 22 bp, Homo sapiens
ggcagctgtaagatgagtgaat

SEQ ID NO: 9431222 - DNA, 22 bp, Homo sapiens
ggcagctgtctcattcacacct

SEQ ID NO: 9431223 - DNA, 22 bp, Homo sapiens
ggcagctggttctttccattaa

SEQ ID NO: 9431224 - DNA, 22 bp, Homo sapiens
ggcagctggttctttccattaa

SEQ ID NO: 9431225 - DNA, 22 bp, Homo sapiens
ggcagctggttctttccattaa

SEQ ID NO: 9431226 - DNA, 22 bp, Homo sapiens
ggagggctcgtcatccaccact

SEQ ID NO: 9431227 - DNA, 22 bp, Homo sapiens
ggagggctcgtcatccaccact

SEQ ID NO: 9431228 - DNA, 22 bp, Homo sapiens
ggagggctcgtcatccaccact

SEQ ID NO: 9431229 - DNA, 22 bp, Homo sapiens
ggagggctcgtcatccaccact

SEQ ID NO: 9431230 - DNA, 22 bp, Homo sapiens
ggagggctgagactggggtctg

SEQ ID NO: 9431231 - DNA, 22 bp, Homo sapiens
ggagggctgagactggggtctg

SEQ ID NO: 9431232 - DNA, 22 bp, Homo sapiens
ggagggctgccacccgctcacg

SEQ ID NO: 9431233 - DNA, 22 bp, Homo sapiens
ggagggctgccacccgctcacg

SEQ ID NO: 9431234 - DNA, 22 bp, Homo sapiens
ggagggctgagactggggtctg

SEQ ID NO: 9431235 - DNA, 22 bp, Homo sapiens
ggagggctgagactggggtctg

SEQ ID NO: 9431236 - DNA, 22 bp, Homo sapiens
ggagggctcaattgactcctga

SEQ ID NO: 9431237 - DNA, 22 bp, Homo sapiens
ggagggctcaattgactcctga

SEQ ID NO: 9431238 - DNA, 22 bp, Homo sapiens
ggagggctcaattgactcctga

SEQ ID NO: 9431239 - DNA, 22 bp, Homo sapiens
ggagggctcaattgactcctga

SEQ ID NO: 9431240 - DNA, 22 bp, Homo sapiens
ggagggctccctgggagtggat

SEQ ID NO: 9431241 - DNA, 22 bp, Homo sapiens
ggagggctccctgggagtggat

SEQ ID NO: 9431242 - DNA, 22 bp, Homo sapiens
ggagggctccctgggagtggat

SEQ ID NO: 9431243 - DNA, 22 bp, Homo sapiens
ggagggctccctgggagtggat

SEQ ID NO: 9431244 - DNA, 23 bp, Homo sapiens
ggagggcttcatcagacccccag

SEQ ID NO: 9431245 - DNA, 18 bp, Homo sapiens
ggagggctttggggactg

SEQ ID NO: 9431246 - DNA, 22 bp, Homo sapiens
ggagggctgtagaggagacctg

SEQ ID NO: 9431247 - DNA, 23 bp, Homo sapiens
ggagggcttcatcagacccccag

SEQ ID NO: 9431248 - DNA, 23 bp, Homo sapiens
ggagggcttcatcagacccccag

SEQ ID NO: 9431249 - DNA, 18 bp, Homo sapiens
ggagggctttggggactg

SEQ ID NO: 9431250 - DNA, 18 bp, Homo sapiens
ggagggctttggggactg

SEQ ID NO: 9431251 - DNA, 18 bp, Homo sapiens
ggagggctttggggactg

SEQ ID NO: 9431252 - DNA, 22 bp, Homo sapiens
ggaggggaactaatcccgtgac

SEQ ID NO: 9431253 - DNA, 22 bp, Homo sapiens
ggaggggaactaatcccgtgac

SEQ ID NO: 9431254 - DNA, 22 bp, Homo sapiens
ggagggctgccaggtggagcgg

SEQ ID NO: 9431255 - DNA, 22 bp, Homo sapiens
ggagggctgccaggtggagcgg

SEQ ID NO: 9431256 - DNA, 22 bp, Homo sapiens
ggagggctgccaggtggagcgg

SEQ ID NO: 9431257 - DNA, 22 bp, Homo sapiens
ggagggctgtagaggagacctg

SEQ ID NO: 9431258 - DNA, 22 bp, Homo sapiens
ggagggctgccaggtggagcgg

SEQ ID NO: 9431259 - DNA, 22 bp, Homo sapiens
ggagggctgccaggtggagcgg

SEQ ID NO: 9431260 - DNA, 22 bp, Homo sapiens
ggagggctgccaggtggagcgg

SEQ ID NO: 9431261 - DNA, 22 bp, Homo sapiens
ggagggctgccaggtggagcgg

SEQ ID NO: 9431262 - DNA, 22 bp, Homo sapiens
ggagggacccactctagaggtg

SEQ ID NO: 9431263 - DNA, 22 bp, Homo sapiens
ggagggacccactctagaggtg

SEQ ID NO: 9431264 - DNA, 22 bp, Homo sapiens
ggagggagagtgaccctaccaa

SEQ ID NO: 9431265 - DNA, 22 bp, Homo sapiens
ggagggagagtgaccctaccaa

SEQ ID NO: 9431266 - DNA, 22 bp, Homo sapiens
ggagggagagtgaccctaccaa

SEQ ID NO: 9431267 - DNA, 22 bp, Homo sapiens
ggagggagcagagaacccaacc

SEQ ID NO: 9431268 - DNA, 22 bp, Homo sapiens
ggagggcagagtcccctgctga

SEQ ID NO: 9431269 - DNA, 21 bp, Homo sapiens
ggagggcagcccagactggct

SEQ ID NO: 9431270 - DNA, 21 bp, Homo sapiens
ggagggcagcccagactggct

SEQ ID NO: 9431271 - DNA, 20 bp, Homo sapiens
ggagggcagctgagagttgg

SEQ ID NO: 9431272 - DNA, 22 bp, Homo sapiens
ggagggcatcaatcaggcctgg

SEQ ID NO: 9431273 - DNA, 22 bp, Homo sapiens
ggagggcatcaatcaggcctgg

SEQ ID NO: 9431274 - DNA, 22 bp, Homo sapiens
ggagggcatcaatcaggcctgg

SEQ ID NO: 9431275 - DNA, 22 bp, Homo sapiens
ggagggcccctccagtgggcag

SEQ ID NO: 9431276 - DNA, 22 bp, Homo sapiens
ggaggctctaaactttccttgg

SEQ ID NO: 9431277 - DNA, 22 bp, Homo sapiens
ggaggctctcctggccttgtct

SEQ ID NO: 9431278 - DNA, 22 bp, Homo sapiens
ggaggctcgctggtcgcacagc

SEQ ID NO: 9431279 - DNA, 22 bp, Homo sapiens
ggaggctcctaagctgacttga

SEQ ID NO: 9431280 - DNA, 22 bp, Homo sapiens
ggaggctcccacgcagctcaca

SEQ ID NO: 9431281 - DNA, 22 bp, Homo sapiens
ggaggctgagaagtccaagatc

SEQ ID NO: 9431282 - DNA, 22 bp, Homo sapiens
ggaggctcttgagaggggagta

SEQ ID NO: 9431283 - DNA, 22 bp, Homo sapiens
ggaggctcttgagaggggagta

SEQ ID NO: 9431284 - DNA, 22 bp, Homo sapiens
ggaggctgagaagtccaagatc

SEQ ID NO: 9431285 - DNA, 22 bp, Homo sapiens
ggaggctgagaagtccaagatc

SEQ ID NO: 9431286 - DNA, 22 bp, Homo sapiens
ggaggctgagaagtccaagatc

SEQ ID NO: 9431287 - DNA, 22 bp, Homo sapiens
ggaggctgagaagtccaagatc

SEQ ID NO: 9431288 - DNA, 22 bp, Homo sapiens
ggaggctgagaagtccaagatc

SEQ ID NO: 9431289 - DNA, 19 bp, Homo sapiens
ggaggcttcttggggtcgg

SEQ ID NO: 9431290 - DNA, 22 bp, Homo sapiens
ggaggctgctgcctcacgtggg

SEQ ID NO: 9431291 - DNA, 22 bp, Homo sapiens
ggaggctgctgcctcacgtggg

SEQ ID NO: 9431292 - DNA, 22 bp, Homo sapiens
ggaggctgaggcccctcacagg

SEQ ID NO: 9431293 - DNA, 22 bp, Homo sapiens
ggaggctgaggcccctcacagg

SEQ ID NO: 9431294 - DNA, 22 bp, Homo sapiens
ggaggctgaggcccctcacagg

SEQ ID NO: 9431295 - DNA, 22 bp, Homo sapiens
ggaggctgaggcccctcacagg

SEQ ID NO: 9431296 - DNA, 22 bp, Homo sapiens
ggaggctgaggcaggcggatca

SEQ ID NO: 9431297 - DNA, 22 bp, Homo sapiens
ggaggctgaggcaggcggatca

SEQ ID NO: 9431298 - DNA, 22 bp, Homo sapiens
ggaggctgagaggtcgcagtgg

SEQ ID NO: 9431299 - DNA, 22 bp, Homo sapiens
ggaggctgaggcaggcggatca

SEQ ID NO: 9431300 - DNA, 22 bp, Homo sapiens
ggaggcctggacttcctgatgg

SEQ ID NO: 9431301 - DNA, 22 bp, Homo sapiens
ggaggcctcagtaccttgcttt

SEQ ID NO: 9431302 - DNA, 22 bp, Homo sapiens
ggaggcctcatcttgccccgtg

SEQ ID NO: 9431303 - DNA, 22 bp, Homo sapiens
ggaggcctcctgggggaggttc

SEQ ID NO: 9431304 - DNA, 22 bp, Homo sapiens
ggaggcctcctgggggaggttc

SEQ ID NO: 9431305 - DNA, 22 bp, Homo sapiens
ggaggcctagccagctccagtt

SEQ ID NO: 9431306 - DNA, 22 bp, Homo sapiens
ggaggcctagaaaagtggttct

SEQ ID NO: 9431307 - DNA, 22 bp, Homo sapiens
ggaggccatgggcagaatcttt

SEQ ID NO: 9431308 - DNA, 22 bp, Homo sapiens
ggaggcccagaaggaagcccag

SEQ ID NO: 9431309 - DNA, 22 bp, Homo sapiens
ggaggcccagagaggtgaagtg

SEQ ID NO: 9431310 - DNA, 22 bp, Homo sapiens
ggaggcggaggttgcagtgagc

SEQ ID NO: 9431311 - DNA, 22 bp, Homo sapiens
ggaggcggaggttgcagtgagc

SEQ ID NO: 9431312 - DNA, 22 bp, Homo sapiens
ggaggcggaggttgcagtgagt

SEQ ID NO: 9431313 - DNA, 22 bp, Homo sapiens
ggaggcggaggttgcagtgagt

SEQ ID NO: 9431314 - DNA, 22 bp, Homo sapiens
ggaggcggggaaggcatcccat

SEQ ID NO: 9431315 - DNA, 22 bp, Homo sapiens
ggaggctccatgagctcctgca

SEQ ID NO: 9431316 - DNA, 22 bp, Homo sapiens
ggaggctccatgagctcctgca

SEQ ID NO: 9431317 - DNA, 22 bp, Homo sapiens
ggaggctcagtgaggaaatgga

SEQ ID NO: 9431318 - DNA, 23 bp, Homo sapiens
ggaggctcaagtatcacgggcag

SEQ ID NO: 9431319 - DNA, 22 bp, Homo sapiens
ggaggtcaaatggagggctggg

SEQ ID NO: 9431320 - DNA, 22 bp, Homo sapiens
ggaggtggaggttgcagtgagc

SEQ ID NO: 9431321 - DNA, 22 bp, Homo sapiens
ggaggtcccaggcctggcagca

SEQ ID NO: 9431322 - DNA, 22 bp, Homo sapiens
ggaggtcatagctgtgcaggta

SEQ ID NO: 9431323 - DNA, 22 bp, Homo sapiens
ggaggtggcagagggacattct

SEQ ID NO: 9431324 - DNA, 22 bp, Homo sapiens
ggaggtggcagagggacattct

SEQ ID NO: 9431325 - DNA, 22 bp, Homo sapiens
ggaggtggaggttgcagtgagc

SEQ ID NO: 9431326 - DNA, 22 bp, Homo sapiens
ggaggtggaggttgcagtgagc

SEQ ID NO: 9431327 - DNA, 22 bp, Homo sapiens
ggaggtggaggttgcagtgagc

SEQ ID NO: 9431328 - DNA, 22 bp, Homo sapiens
ggaggtggaggttgcagtgagc

SEQ ID NO: 9431329 - DNA, 22 bp, Homo sapiens
ggaggtggaggttgcagtgagc

SEQ ID NO: 9431330 - DNA, 22 bp, Homo sapiens
ggagggtggcagcgtcctgggc

SEQ ID NO: 9431331 - DNA, 20 bp, Homo sapiens
ggagggtggaagaaagcaag

SEQ ID NO: 9431332 - DNA, 22 bp, Homo sapiens
ggagggtggcagcgtcctgggc

SEQ ID NO: 9431333 - DNA, 22 bp, Homo sapiens
ggagggtggcagcgtcctgggc

SEQ ID NO: 9431334 - DNA, 22 bp, Homo sapiens
ggagggtggcagcgtcctgggc

SEQ ID NO: 9431335 - DNA, 22 bp, Homo sapiens
ggaggtatttgtcaatctgttt

SEQ ID NO: 9431336 - DNA, 22 bp, Homo sapiens
ggaggtagtctgagtcataggc

SEQ ID NO: 9431337 - DNA, 22 bp, Homo sapiens
ggaggtagtctgagtcataggc

SEQ ID NO: 9431338 - DNA, 22 bp, Homo sapiens
ggaggtagcctcaaaagcagct

SEQ ID NO: 9431339 - DNA, 22 bp, Homo sapiens
ggaggtggcctgaaaatgtggc

SEQ ID NO: 9431340 - DNA, 22 bp, Homo sapiens
ggaggtggcctgaaaatgtggc

SEQ ID NO: 9431341 - DNA, 22 bp, Homo sapiens
ggaggtgggagacataggcggc

SEQ ID NO: 9431342 - DNA, 22 bp, Homo sapiens
ggaggtgggagcctccagtggt

SEQ ID NO: 9431343 - DNA, 22 bp, Homo sapiens
ggaggtgggagcctccagtggt

SEQ ID NO: 9431344 - DNA, 22 bp, Homo sapiens
ggaggtgggagcctccagtggt

SEQ ID NO: 9431345 - DNA, 22 bp, Homo sapiens
ggaggtgggattaggacctaaa

SEQ ID NO: 9431346 - DNA, 22 bp, Homo sapiens
ggaggtgggattaggacctaaa

SEQ ID NO: 9431347 - DNA, 22 bp, Homo sapiens
ggaggttctctctttgcagagc

SEQ ID NO: 9431348 - DNA, 22 bp, Homo sapiens
ggagtaaggctcagaggaaatg

SEQ ID NO: 9431349 - DNA, 22 bp, Homo sapiens
ggagtagctgcattccgagcac

SEQ ID NO: 9431350 - DNA, 22 bp, Homo sapiens
ggagtaggccccgggagagagt

SEQ ID NO: 9431351 - DNA, 22 bp, Homo sapiens
ggagtaggagtagaactcatca

SEQ ID NO: 9431352 - DNA, 22 bp, Homo sapiens
ggaggtggtggcagtgacaatt

SEQ ID NO: 9431353 - DNA, 22 bp, Homo sapiens
ggaggtggtggcagtgacaatt

SEQ ID NO: 9431354 - DNA, 22 bp, Homo sapiens
ggaggtggtttgatttctatat

SEQ ID NO: 9431355 - DNA, 22 bp, Homo sapiens
ggaggtgggctaaggactctct

SEQ ID NO: 9431356 - DNA, 22 bp, Homo sapiens
ggaggtgggctaaggactctct

SEQ ID NO: 9431357 - DNA, 22 bp, Homo sapiens
ggaggtgggctaaggactctct

SEQ ID NO: 9431358 - DNA, 22 bp, Homo sapiens
ggaggtgggctaaggactctct

SEQ ID NO: 9431359 - DNA, 22 bp, Homo sapiens
ggaggtggtggcagtgacaatt

SEQ ID NO: 9431360 - DNA, 22 bp, Homo sapiens
ggaggtggtggcagtgacaatt

SEQ ID NO: 9431361 - DNA, 22 bp, Homo sapiens
ggaggggtgagaatggctgcct

SEQ ID NO: 9431362 - DNA, 22 bp, Homo sapiens
ggaggggtgagaatggctgcct

SEQ ID NO: 9431363 - DNA, 22 bp, Homo sapiens
ggaggggtgagaatggctgcct

SEQ ID NO: 9431364 - DNA, 22 bp, Homo sapiens
ggaggggtgctcagctgtcacg

SEQ ID NO: 9431365 - DNA, 22 bp, Homo sapiens
ggaggggtgctcagctgtcacg

SEQ ID NO: 9431366 - DNA, 22 bp, Homo sapiens
ggagggggactgacactgattt

SEQ ID NO: 9431367 - DNA, 22 bp, Homo sapiens
ggaggggtctctagcgaggaga

SEQ ID NO: 9431368 - DNA, 22 bp, Homo sapiens
ggaggggtctctagcgaggaga

SEQ ID NO: 9431369 - DNA, 22 bp, Homo sapiens
ggaggggtctctagcgaggaga

SEQ ID NO: 9431370 - DNA, 22 bp, Homo sapiens
ggaggggtctctagcgaggaga

SEQ ID NO: 9431371 - DNA, 22 bp, Homo sapiens
ggagggtccatcttgtgaaaag

SEQ ID NO: 9431372 - DNA, 22 bp, Homo sapiens
ggagggtctaagggagaactga

SEQ ID NO: 9431373 - DNA, 22 bp, Homo sapiens
ggagggtctaagggagaactga

SEQ ID NO: 9431374 - DNA, 22 bp, Homo sapiens
ggagggtgcagaccctttgcaa

SEQ ID NO: 9431375 - DNA, 22 bp, Homo sapiens
ggagggtgcttaagttgtgttt

SEQ ID NO: 9431376 - DNA, 22 bp, Homo sapiens
ggagggtgcattttaccctgtg

SEQ ID NO: 9431377 - DNA, 22 bp, Homo sapiens
ggagggtgcattttaccctgtg

SEQ ID NO: 9431378 - DNA, 22 bp, Homo sapiens
ggaggggtggaaggagtgcctg

SEQ ID NO: 9431379 - DNA, 22 bp, Homo sapiens
ggaggggtggaaggagtgcctg

SEQ ID NO: 9431380 - DNA, 22 bp, Homo sapiens
ggaggggtggaaggagtgcctg

SEQ ID NO: 9431381 - DNA, 22 bp, Homo sapiens
ggaggggtggtcacctggcagg

SEQ ID NO: 9431382 - DNA, 22 bp, Homo sapiens
ggaggggtggtcacctggcagg

SEQ ID NO: 9431383 - DNA, 22 bp, Homo sapiens
ggaggggtggtcgcgaagagca

SEQ ID NO: 9431384 - DNA, 22 bp, Homo sapiens
ggaggggtggtcgcgaagagca

SEQ ID NO: 9431385 - DNA, 22 bp, Homo sapiens
ggagggtccactgtgaggcaga

SEQ ID NO: 9431386 - DNA, 22 bp, Homo sapiens
ggagggtccactgtgaggcaga

SEQ ID NO: 9431387 - DNA, 22 bp, Homo sapiens
ggagggtccactgtgaggcaga

SEQ ID NO: 9431388 - DNA, 22 bp, Homo sapiens
ggaggggagtctcccaaagccg

SEQ ID NO: 9431389 - DNA, 22 bp, Homo sapiens
ggaggggaggtccagctgatct

SEQ ID NO: 9431390 - DNA, 22 bp, Homo sapiens
ggaggggaggtccagctgatct

SEQ ID NO: 9431391 - DNA, 22 bp, Homo sapiens
ggaggggaggtccagctgatct

SEQ ID NO: 9431392 - DNA, 22 bp, Homo sapiens
ggaggggaggattaatgacaaa

SEQ ID NO: 9431393 - DNA, 22 bp, Homo sapiens
ggaggggaggattaatgacaaa

SEQ ID NO: 9431394 - DNA, 22 bp, Homo sapiens
ggaggggagatgtttgggctca

SEQ ID NO: 9431395 - DNA, 22 bp, Homo sapiens
ggaggggagatgtttgggctca

SEQ ID NO: 9431396 - DNA, 22 bp, Homo sapiens
ggaggggagatgtttgggctca

SEQ ID NO: 9431397 - DNA, 22 bp, Homo sapiens
ggaggggagatgtttgggctca

SEQ ID NO: 9431398 - DNA, 22 bp, Homo sapiens
ggagggggaaactttggctgcc

SEQ ID NO: 9431399 - DNA, 22 bp, Homo sapiens
ggagggggaaactttggctgcc

SEQ ID NO: 9431400 - DNA, 22 bp, Homo sapiens
ggagggggaaactttggctgcc

SEQ ID NO: 9431401 - DNA, 22 bp, Homo sapiens
ggagggggaagaagctaaagac

SEQ ID NO: 9431402 - DNA, 22 bp, Homo sapiens
ggagggggaagaagctaaagac

SEQ ID NO: 9431403 - DNA, 22 bp, Homo sapiens
ggagggggaagaagctaaagac

SEQ ID NO: 9431404 - DNA, 22 bp, Homo sapiens
ggagggggaattcagccccagc

SEQ ID NO: 9431405 - DNA, 22 bp, Homo sapiens
ggagggggaattcagccccagc

SEQ ID NO: 9431406 - DNA, 19 bp, Homo sapiens
ggccttgctctgtggcagc

SEQ ID NO: 9431407 - DNA, 22 bp, Homo sapiens
ggccttgctgcttccagaaggt

SEQ ID NO: 9431408 - DNA, 23 bp, Homo sapiens
ggccttgcagtaaaccaaatgac

SEQ ID NO: 9431409 - DNA, 22 bp, Homo sapiens
ggccttgagagccagtgcaggc

SEQ ID NO: 9431410 - DNA, 22 bp, Homo sapiens
ggccttgacctcagtgggtttg

SEQ ID NO: 9431411 - DNA, 22 bp, Homo sapiens
ggccttgatcctccagagcact

SEQ ID NO: 9431412 - DNA, 22 bp, Homo sapiens
ggccttgatcctccagagcact

SEQ ID NO: 9431413 - DNA, 22 bp, Homo sapiens
ggccttccagggaagacagggc

SEQ ID NO: 9431414 - DNA, 22 bp, Homo sapiens
ggccttccattgctcttttcta

SEQ ID NO: 9431415 - DNA, 21 bp, Homo sapiens
ggccttcccctgcagtctccg

SEQ ID NO: 9431416 - DNA, 22 bp, Homo sapiens
ggccttccatctgcctctgttt

SEQ ID NO: 9431417 - DNA, 22 bp, Homo sapiens
ggccttcacgtgacctggcgtg

SEQ ID NO: 9431418 - DNA, 22 bp, Homo sapiens
ggccttccttcccagcctactg

SEQ ID NO: 9431419 - DNA, 22 bp, Homo sapiens
ggccttccttcccagcctactg

SEQ ID NO: 9431420 - DNA, 22 bp, Homo sapiens
ggccttcctgttgtgtccaccg

SEQ ID NO: 9431421 - DNA, 22 bp, Homo sapiens
ggccttcctgttgtgtccaccg

SEQ ID NO: 9431422 - DNA, 21 bp, Homo sapiens
ggccttcccctgcagtctccg

SEQ ID NO: 9431423 - DNA, 21 bp, Homo sapiens
ggccttcccctgcagtctccg

SEQ ID NO: 9431424 - DNA, 22 bp, Homo sapiens
ggccttcctggcggctcagggt

SEQ ID NO: 9431425 - DNA, 22 bp, Homo sapiens
ggccttccatctgcctctgttt

SEQ ID NO: 9431426 - DNA, 22 bp, Homo sapiens
ggcccctgtaaaatgtacatgt

SEQ ID NO: 9431427 - DNA, 22 bp, Homo sapiens
ggccctctgcctgtgctggcga

SEQ ID NO: 9431428 - DNA, 22 bp, Homo sapiens
ggccctctggcttccgcatggg

SEQ ID NO: 9431429 - DNA, 22 bp, Homo sapiens
ggccctctgtggctgccatgga

SEQ ID NO: 9431430 - DNA, 22 bp, Homo sapiens
ggccctgaagtgattgtgagtt

SEQ ID NO: 9431431 - DNA, 22 bp, Homo sapiens
ggccctctgtggctgccatgga

SEQ ID NO: 9431432 - DNA, 22 bp, Homo sapiens
ggccctgagctgaagtactgtg

SEQ ID NO: 9431433 - DNA, 22 bp, Homo sapiens
ggccctgagctgaagtactgtg

SEQ ID NO: 9431434 - DNA, 22 bp, Homo sapiens
ggccctgcaaggtacccaggcc

SEQ ID NO: 9431435 - DNA, 22 bp, Homo sapiens
ggcctggctggttcagtaccct

SEQ ID NO: 9431436 - DNA, 22 bp, Homo sapiens
ggcctgggcccactgtcaagag

SEQ ID NO: 9431437 - DNA, 22 bp, Homo sapiens
ggcctgggcctttgtgttttga

SEQ ID NO: 9431438 - DNA, 22 bp, Homo sapiens
ggcctggctggttcagtaccct

SEQ ID NO: 9431439 - DNA, 22 bp, Homo sapiens
ggcctggctggttcagtaccct

SEQ ID NO: 9431440 - DNA, 22 bp, Homo sapiens
ggcctggctggttcagtaccct

SEQ ID NO: 9431441 - DNA, 22 bp, Homo sapiens
ggctcaggacacagtggtttag

SEQ ID NO: 9431442 - DNA, 22 bp, Homo sapiens
ggctcagcttggtgcgcagaaa

SEQ ID NO: 9431443 - DNA, 22 bp, Homo sapiens
ggctcaggccagaccacgactc

SEQ ID NO: 9431444 - DNA, 22 bp, Homo sapiens
ggctcaggatgagccttctcat

SEQ ID NO: 9431445 - DNA, 22 bp, Homo sapiens
ggctcaggatgagccttctcat

SEQ ID NO: 9431446 - DNA, 22 bp, Homo sapiens
ggctcaggactgcagcgtagag

SEQ ID NO: 9431447 - DNA, 22 bp, Homo sapiens
ggctcaggatgagccttctcat

SEQ ID NO: 9431448 - DNA, 22 bp, Homo sapiens
ggctcaggactgcagcgtagag

SEQ ID NO: 9431449 - DNA, 22 bp, Homo sapiens
ggccttggctcctgcagggagt

SEQ ID NO: 9431450 - DNA, 22 bp, Homo sapiens
ggccttggagtcctccactgga

SEQ ID NO: 9431451 - DNA, 22 bp, Homo sapiens
ggctcagcacagggctggcatc

SEQ ID NO: 9431452 - DNA, 18 bp, Homo sapiens
ggctcagcaggctctctc

SEQ ID NO: 9431453 - DNA, 18 bp, Homo sapiens
ggctcagcaggctctctc

SEQ ID NO: 9431454 - DNA, 22 bp, Homo sapiens
ggctccaagtctcagagtgaag

SEQ ID NO: 9431455 - DNA, 22 bp, Homo sapiens
ggctccaacactaaatgtgttt

SEQ ID NO: 9431456 - DNA, 22 bp, Homo sapiens
ggctccaagtctcagagtgaag

SEQ ID NO: 9431457 - DNA, 22 bp, Homo sapiens
ggctccaacactaaatgtgttt

SEQ ID NO: 9431458 - DNA, 22 bp, Homo sapiens
ggctccacaattacacactgga

SEQ ID NO: 9431459 - DNA, 22 bp, Homo sapiens
ggctccaccctgcttccagaag

SEQ ID NO: 9431460 - DNA, 23 bp, Homo sapiens
ggctcctgcttcatgtcccacct

SEQ ID NO: 9431461 - DNA, 23 bp, Homo sapiens
ggctcctgcttcatgtcccacct

SEQ ID NO: 9431462 - DNA, 22 bp, Homo sapiens
ggctcctgcacctgtccctctg

SEQ ID NO: 9431463 - DNA, 22 bp, Homo sapiens
ggctcctgcacctgtccctctg

SEQ ID NO: 9431464 - DNA, 22 bp, Homo sapiens
ggctcctggaaagccctcgctc

SEQ ID NO: 9431465 - DNA, 22 bp, Homo sapiens
ggctcagtaagtcaggttcatt

SEQ ID NO: 9431466 - DNA, 22 bp, Homo sapiens
ggctcaggtttccttcccagct

SEQ ID NO: 9431467 - DNA, 22 bp, Homo sapiens
ggctcaggtttaaagtgcttta

SEQ ID NO: 9431468 - DNA, 22 bp, Homo sapiens
ggctcaggccagaccacgactc

SEQ ID NO: 9431469 - DNA, 19 bp, Homo sapiens
ggctcagtgacataggtgc

SEQ ID NO: 9431470 - DNA, 22 bp, Homo sapiens
ggctcagtgggaacaagctgag

SEQ ID NO: 9431471 - DNA, 22 bp, Homo sapiens
ggctcatatcccggccatcatt

SEQ ID NO: 9431472 - DNA, 20 bp, Homo sapiens
ggctcatcttgtctgctgac

SEQ ID NO: 9431473 - DNA, 22 bp, Homo sapiens
ggctcatgtatgaaagggtgtg

SEQ ID NO: 9431474 - DNA, 22 bp, Homo sapiens
ggctccaaagggcagtgtgagg

SEQ ID NO: 9431475 - DNA, 22 bp, Homo sapiens
ggctccaaagggcagtgtgagg

SEQ ID NO: 9431476 - DNA, 22 bp, Homo sapiens
ggccagactgagtgaggtcaag

SEQ ID NO: 9431477 - DNA, 22 bp, Homo sapiens
ggccagagaagtcagacccttg

SEQ ID NO: 9431478 - DNA, 22 bp, Homo sapiens
ggccagaagttggaaaagagcc

SEQ ID NO: 9431479 - DNA, 22 bp, Homo sapiens
ggccagacatatcgctcccaaa

SEQ ID NO: 9431480 - DNA, 22 bp, Homo sapiens
ggccagaagttggaaaagagcc

SEQ ID NO: 9431481 - DNA, 22 bp, Homo sapiens
ggccagaagttggaaaagagcc

SEQ ID NO: 9431482 - DNA, 22 bp, Homo sapiens
ggcaggtggaaggtctccattc

SEQ ID NO: 9431483 - DNA, 22 bp, Homo sapiens
ggccacctctgccctactgagt

SEQ ID NO: 9431484 - DNA, 22 bp, Homo sapiens
ggcaggtgcttgtcgaaggcct

SEQ ID NO: 9431485 - DNA, 22 bp, Homo sapiens
ggcaggtgctctgtgggcctgg

SEQ ID NO: 9431486 - DNA, 22 bp, Homo sapiens
ggcaggtgctgggagcatctca

SEQ ID NO: 9431487 - DNA, 22 bp, Homo sapiens
ggcaggtgctctgtgggcctgg

SEQ ID NO: 9431488 - DNA, 22 bp, Homo sapiens
ggcaggtgctctgtgggcctgg

SEQ ID NO: 9431489 - DNA, 22 bp, Homo sapiens
ggcaggtgctctgtgggcctgg

SEQ ID NO: 9431490 - DNA, 22 bp, Homo sapiens
ggcaggtgctctgtgggcctgg

SEQ ID NO: 9431491 - DNA, 22 bp, Homo sapiens
ggccatgggaagaggtggagag

SEQ ID NO: 9431492 - DNA, 18 bp, Homo sapiens
ggccagagggagggtccc

SEQ ID NO: 9431493 - DNA, 18 bp, Homo sapiens
ggccagagggagggtccc

SEQ ID NO: 9431494 - DNA, 18 bp, Homo sapiens
ggccagagggagggtccc

SEQ ID NO: 9431495 - DNA, 18 bp, Homo sapiens
ggccagagggagggtccc

SEQ ID NO: 9431496 - DNA, 22 bp, Homo sapiens
ggccagaggtggtacatagctt

SEQ ID NO: 9431497 - DNA, 22 bp, Homo sapiens
ggccagagggagggcacaaatc

SEQ ID NO: 9431498 - DNA, 17 bp, Homo sapiens
ggccagaggcggggctg

SEQ ID NO: 9431499 - DNA, 22 bp, Homo sapiens
ggccagaggccacagctgtgtc

SEQ ID NO: 9431500 - DNA, 22 bp, Homo sapiens
ggccagaggccacagctgtgtc

SEQ ID NO: 9431501 - DNA, 22 bp, Homo sapiens
ggccagaggccacagctgtgtc

SEQ ID NO: 9431502 - DNA, 22 bp, Homo sapiens
ggccagaggccacagctgtgtc

SEQ ID NO: 9431503 - DNA, 22 bp, Homo sapiens
ggccagaggccacagctgtgtc

SEQ ID NO: 9431504 - DNA, 22 bp, Homo sapiens
ggccagaggacctctcatagcc

SEQ ID NO: 9431505 - DNA, 22 bp, Homo sapiens
ggccagagctcaaacagtcgca

SEQ ID NO: 9431506 - DNA, 22 bp, Homo sapiens
ggccagagctgacctatcaatg

SEQ ID NO: 9431507 - DNA, 22 bp, Homo sapiens
ggccagagagcagccaggattc

SEQ ID NO: 9431508 - DNA, 22 bp, Homo sapiens
ggccagagagcagccaggattc

SEQ ID NO: 9431509 - DNA, 22 bp, Homo sapiens
ggcccagccttggggtttcttt

SEQ ID NO: 9431510 - DNA, 22 bp, Homo sapiens
ggcccagccttggggtttcttt

SEQ ID NO: 9431511 - DNA, 22 bp, Homo sapiens
ggcccagcctggcaacaatgac

SEQ ID NO: 9431512 - DNA, 22 bp, Homo sapiens
ggcccagcctggcaacaatgac

SEQ ID NO: 9431513 - DNA, 22 bp, Homo sapiens
ggcccagccggcgagtctcgcg

SEQ ID NO: 9431514 - DNA, 22 bp, Homo sapiens
ggcccagcctcagacatgccct

SEQ ID NO: 9431515 - DNA, 22 bp, Homo sapiens
ggcccagcctcagacatgccct

SEQ ID NO: 9431516 - DNA, 22 bp, Homo sapiens
ggccccagattctgggctgggt

SEQ ID NO: 9431517 - DNA, 22 bp, Homo sapiens
ggccccaggtagaagatataga

SEQ ID NO: 9431518 - DNA, 22 bp, Homo sapiens
ggcccagcgaggccacctacag

SEQ ID NO: 9431519 - DNA, 22 bp, Homo sapiens
ggccccagattctgggctgggt

SEQ ID NO: 9431520 - DNA, 22 bp, Homo sapiens
ggccccacgggggagtcctagt

SEQ ID NO: 9431521 - DNA, 23 bp, Homo sapiens
ggcccccggaacgctctgtgacc

SEQ ID NO: 9431522 - DNA, 21 bp, Homo sapiens
ggccccgcagacccagcacgt

SEQ ID NO: 9431523 - DNA, 22 bp, Homo sapiens
ggccccaggtctgaacacgctg

SEQ ID NO: 9431524 - DNA, 22 bp, Homo sapiens
ggccccaggtctgaacacgctg

SEQ ID NO: 9431525 - DNA, 22 bp, Homo sapiens
ggccccagttcactcctggccg

SEQ ID NO: 9431526 - DNA, 22 bp, Homo sapiens
ggccccagttcactcctggccg

SEQ ID NO: 9431527 - DNA, 22 bp, Homo sapiens
ggccccagttcactcctggccg

SEQ ID NO: 9431528 - DNA, 22 bp, Homo sapiens
ggcccctcagcatctgagtcag

SEQ ID NO: 9431529 - DNA, 22 bp, Homo sapiens
ggcccctgcggactgcctagag

SEQ ID NO: 9431530 - DNA, 22 bp, Homo sapiens
ggcccagcccgagtcagccttc

SEQ ID NO: 9431531 - DNA, 22 bp, Homo sapiens
ggcccagccggcgagtctcgcg

SEQ ID NO: 9431532 - DNA, 22 bp, Homo sapiens
ggcccacatggaagcatcgagg

SEQ ID NO: 9431533 - DNA, 22 bp, Homo sapiens
ggcccacactgacagctgagct

SEQ ID NO: 9431534 - DNA, 22 bp, Homo sapiens
ggcccagaaaaaggcttagaat

SEQ ID NO: 9431535 - DNA, 22 bp, Homo sapiens
ggcccagaaaaaggcttagaat

SEQ ID NO: 9431536 - DNA, 22 bp, Homo sapiens
ggcccaaggcccaggtcgagct

SEQ ID NO: 9431537 - DNA, 22 bp, Homo sapiens
ggcccacactgacagctgagct

SEQ ID NO: 9431538 - DNA, 19 bp, Homo sapiens
ggcccaagtactgagtgcc

SEQ ID NO: 9431539 - DNA, 19 bp, Homo sapiens
ggcccaagtactgagtgcc

SEQ ID NO: 9431540 - DNA, 22 bp, Homo sapiens
ggccatttgctttattcacttc

SEQ ID NO: 9431541 - DNA, 22 bp, Homo sapiens
ggccatttgcttggagaacttt

SEQ ID NO: 9431542 - DNA, 22 bp, Homo sapiens
ggccattttataggcagtgggg

SEQ ID NO: 9431543 - DNA, 22 bp, Homo sapiens
ggccatggtggtttgagcacct

SEQ ID NO: 9431544 - DNA, 17 bp, Homo sapiens
ggccatggtgcaaggtt

SEQ ID NO: 9431545 - DNA, 17 bp, Homo sapiens
ggccatggtgcaaggtt

SEQ ID NO: 9431546 - DNA, 20 bp, Homo sapiens
ggccatgggttgcctgaggt

SEQ ID NO: 9431547 - DNA, 22 bp, Homo sapiens
ggccatggggacagagggtgaa

SEQ ID NO: 9431548 - DNA, 22 bp, Homo sapiens
ggccatggtcatgggtgagctt

SEQ ID NO: 9431549 - DNA, 22 bp, Homo sapiens
ggccatggtcatgggtgagctt

SEQ ID NO: 9431550 - DNA, 22 bp, Homo sapiens
ggccatggtcatgggtgagctt

SEQ ID NO: 9431551 - DNA, 23 bp, Homo sapiens
ggcttcagtgagagtccctgctg

SEQ ID NO: 9431552 - DNA, 22 bp, Homo sapiens
ggcttcagtgactggtgccctc

SEQ ID NO: 9431553 - DNA, 19 bp, Homo sapiens
ggctgtggtggtgccttgc

SEQ ID NO: 9431554 - DNA, 22 bp, Homo sapiens
ggctgtgtggccgtgggctcta

SEQ ID NO: 9431555 - DNA, 22 bp, Homo sapiens
ggcttccaaggtcctctccacc

SEQ ID NO: 9431556 - DNA, 22 bp, Homo sapiens
ggcttcatttctgtccttgatt

SEQ ID NO: 9431557 - DNA, 22 bp, Homo sapiens
ggcttcagtgagctgagctcac

SEQ ID NO: 9431558 - DNA, 22 bp, Homo sapiens
ggcttccccacaaagcacacaa

SEQ ID NO: 9431559 - DNA, 22 bp, Homo sapiens
ggcttcccctccagtgctctgt

SEQ ID NO: 9431560 - DNA, 22 bp, Homo sapiens
ggcttccctgtttgctgtgcct

SEQ ID NO: 9431561 - DNA, 22 bp, Homo sapiens
ggcttccagctgggccttggag

SEQ ID NO: 9431562 - DNA, 22 bp, Homo sapiens
ggcttccagtgatgcctctttg

SEQ ID NO: 9431563 - DNA, 17 bp, Homo sapiens
ggcttccaggtggctct

SEQ ID NO: 9431564 - DNA, 17 bp, Homo sapiens
ggcttccaggtggctct

SEQ ID NO: 9431565 - DNA, 22 bp, Homo sapiens
ggctgtggtggcatccctgagc

SEQ ID NO: 9431566 - DNA, 22 bp, Homo sapiens
ggctgtggtctgggtgctcccc

SEQ ID NO: 9431567 - DNA, 19 bp, Homo sapiens
ggctgtggtggtgccttgc

SEQ ID NO: 9431568 - DNA, 22 bp, Homo sapiens
ggctgtggtggcatccctgagc

SEQ ID NO: 9431569 - DNA, 22 bp, Homo sapiens
ggctggcttgccaagctcaggg

SEQ ID NO: 9431570 - DNA, 22 bp, Homo sapiens
ggctggcttgccaagctcaggg

SEQ ID NO: 9431571 - DNA, 22 bp, Homo sapiens
ggctggcttgccaagctcaggg

SEQ ID NO: 9431572 - DNA, 22 bp, Homo sapiens
ggctggctgtgccctgtactct

SEQ ID NO: 9431573 - DNA, 22 bp, Homo sapiens
ggctggctggctggtagacaag

SEQ ID NO: 9431574 - DNA, 22 bp, Homo sapiens
ggctggctggctggtagacaag

SEQ ID NO: 9431575 - DNA, 22 bp, Homo sapiens
ggctggctggctggtagacaag

SEQ ID NO: 9431576 - DNA, 22 bp, Homo sapiens
ggctggctggcttagcagagga

SEQ ID NO: 9431577 - DNA, 22 bp, Homo sapiens
ggctggctggcttagcagagga

SEQ ID NO: 9431578 - DNA, 22 bp, Homo sapiens
ggctggctggctggtagacaag

SEQ ID NO: 9431579 - DNA, 22 bp, Homo sapiens
ggctggctggcttagcagagga

SEQ ID NO: 9431580 - DNA, 22 bp, Homo sapiens
ggctggctggcttagcagagga

SEQ ID NO: 9431581 - DNA, 22 bp, Homo sapiens
ggctggctgtgccctgtactct

SEQ ID NO: 9431582 - DNA, 22 bp, Homo sapiens
ggctggctggcttagcagagga

SEQ ID NO: 9431583 - DNA, 22 bp, Homo sapiens
ggctggctgtgccctgtactct

SEQ ID NO: 9431584 - DNA, 22 bp, Homo sapiens
ggctggctggatgaatggatta

SEQ ID NO: 9431585 - DNA, 22 bp, Homo sapiens
ggctggctgcatgccccctcct

SEQ ID NO: 9431586 - DNA, 22 bp, Homo sapiens
ggctggctggatgaatggatta

SEQ ID NO: 9431587 - DNA, 22 bp, Homo sapiens
ggctggctgcatgccccctcct

SEQ ID NO: 9431588 - DNA, 22 bp, Homo sapiens
ggctggctgataaagggttgag

SEQ ID NO: 9431589 - DNA, 22 bp, Homo sapiens
ggctggctgataaagggttgag

SEQ ID NO: 9431590 - DNA, 22 bp, Homo sapiens
ggctggctgataaagggttgag

SEQ ID NO: 9431591 - DNA, 22 bp, Homo sapiens
ggctggctcttaccgacagcgt

SEQ ID NO: 9431592 - DNA, 22 bp, Homo sapiens
ggctggctatctgtggttgcct

SEQ ID NO: 9431593 - DNA, 22 bp, Homo sapiens
ggctggctcagggcttgagaga

SEQ ID NO: 9431594 - DNA, 22 bp, Homo sapiens
ggctggctcagggcttgagaga

SEQ ID NO: 9431595 - DNA, 22 bp, Homo sapiens
ggctggctatctgtggttgcct

SEQ ID NO: 9431596 - DNA, 22 bp, Homo sapiens
ggctggctcatgcaaagggtga

SEQ ID NO: 9431597 - DNA, 22 bp, Homo sapiens
ggctggctccacctaggtagct

SEQ ID NO: 9431598 - DNA, 22 bp, Homo sapiens
ggctggctccacctaggtagct

SEQ ID NO: 9431599 - DNA, 18 bp, Homo sapiens
ggcttctcactgacctca

SEQ ID NO: 9431600 - DNA, 22 bp, Homo sapiens
ggctttgggccctcaagtctcc

SEQ ID NO: 9431601 - DNA, 18 bp, Homo sapiens
ggctttggctcttaccgc

SEQ ID NO: 9431602 - DNA, 22 bp, Homo sapiens
ggcttcctatcccatctgagtg

SEQ ID NO: 9431603 - DNA, 22 bp, Homo sapiens
gggaacagaggagggtgttgct

SEQ ID NO: 9431604 - DNA, 22 bp, Homo sapiens
gggaacagaggagggtgttgct

SEQ ID NO: 9431605 - DNA, 22 bp, Homo sapiens
gggaacacagacttgatgatga

SEQ ID NO: 9431606 - DNA, 22 bp, Homo sapiens
gggaaattttaggtttgtctcg

SEQ ID NO: 9431607 - DNA, 22 bp, Homo sapiens
gggaaattgtgtgagatctttg

SEQ ID NO: 9431608 - DNA, 22 bp, Homo sapiens
gggaaattgtcaacactctcaa

SEQ ID NO: 9431609 - DNA, 22 bp, Homo sapiens
gggaaatctcgtcctctattta

SEQ ID NO: 9431610 - DNA, 22 bp, Homo sapiens
gggaaattaatgactggttgga

SEQ ID NO: 9431611 - DNA, 21 bp, Homo sapiens
gggaaattaggattgctcatc

SEQ ID NO: 9431612 - DNA, 22 bp, Homo sapiens
gggaaattgtaacaagtctgtt

SEQ ID NO: 9431613 - DNA, 21 bp, Homo sapiens
gggaaattaggattgctcatc

SEQ ID NO: 9431614 - DNA, 19 bp, Homo sapiens
gggaaattcacttgcttcc

SEQ ID NO: 9431615 - DNA, 22 bp, Homo sapiens
ggctttggtagacacagattga

SEQ ID NO: 9431616 - DNA, 22 bp, Homo sapiens
gggaaaggatcagtgggaggct

SEQ ID NO: 9431617 - DNA, 22 bp, Homo sapiens
gggaaaggatcagtgggaggct

SEQ ID NO: 9431618 - DNA, 22 bp, Homo sapiens
gggaagaagacatggtgaaggc

SEQ ID NO: 9431619 - DNA, 22 bp, Homo sapiens
gggaactgtttaacaggggttt

SEQ ID NO: 9431620 - DNA, 22 bp, Homo sapiens
gggaacctgccccaggcctctg

SEQ ID NO: 9431621 - DNA, 22 bp, Homo sapiens
gggaacagggcctgagctgggg

SEQ ID NO: 9431622 - DNA, 22 bp, Homo sapiens
gggaacagggcctgagctgggg

SEQ ID NO: 9431623 - DNA, 22 bp, Homo sapiens
gggaacagcttgggctctgcca

SEQ ID NO: 9431624 - DNA, 22 bp, Homo sapiens
gggaaccacccctctgccctga

SEQ ID NO: 9431625 - DNA, 22 bp, Homo sapiens
gggaaccacccctctgccctga

SEQ ID NO: 9431626 - DNA, 22 bp, Homo sapiens
gggaacagagtgccagactgac

SEQ ID NO: 9431627 - DNA, 22 bp, Homo sapiens
gggaacagagtgccagactgac

SEQ ID NO: 9431628 - DNA, 22 bp, Homo sapiens
gggaacagagtgccagactgac

SEQ ID NO: 9431629 - DNA, 22 bp, Homo sapiens
gggaacagagtgccagactgac

SEQ ID NO: 9431630 - DNA, 22 bp, Homo sapiens
gggaacagcatatctgaagggt

SEQ ID NO: 9431631 - DNA, 22 bp, Homo sapiens
gggaacagcatatctgaagggt

SEQ ID NO: 9431632 - DNA, 22 bp, Homo sapiens
gggaacagcttgggctctgcca

SEQ ID NO: 9431633 - DNA, 22 bp, Homo sapiens
gggaagacttagtcggttcaat

SEQ ID NO: 9431634 - DNA, 22 bp, Homo sapiens
gggaagagaccgtaccctggcc

SEQ ID NO: 9431635 - DNA, 22 bp, Homo sapiens
gggaagagaggaggtggtttcg

SEQ ID NO: 9431636 - DNA, 22 bp, Homo sapiens
gggaagagaggaggtggtttcg

SEQ ID NO: 9431637 - DNA, 22 bp, Homo sapiens
gggaccaggtcagggctctgac

SEQ ID NO: 9431638 - DNA, 23 bp, Homo sapiens
gggaccaggcccttcctggtttg

SEQ ID NO: 9431639 - DNA, 22 bp, Homo sapiens
gggaagagatttccacatcatt

SEQ ID NO: 9431640 - DNA, 18 bp, Homo sapiens
gggaagaggatctggccc

SEQ ID NO: 9431641 - DNA, 22 bp, Homo sapiens
gggaagagatttccacatcatt

SEQ ID NO: 9431642 - DNA, 22 bp, Homo sapiens
gggaagagatttccacatcatt

SEQ ID NO: 9431643 - DNA, 22 bp, Homo sapiens
ggctgcaggatgcccagccgtg

SEQ ID NO: 9431644 - DNA, 22 bp, Homo sapiens
ggctgcaggatgcccagccgtg

SEQ ID NO: 9431645 - DNA, 22 bp, Homo sapiens
ggctgcaggatgcccagccgtg

SEQ ID NO: 9431646 - DNA, 20 bp, Homo sapiens
ggctgcaggactcattggct

SEQ ID NO: 9431647 - DNA, 22 bp, Homo sapiens
ggctgcaggatgcccagccgtg

SEQ ID NO: 9431648 - DNA, 22 bp, Homo sapiens
ggctgcaggaacgacggagggg

SEQ ID NO: 9431649 - DNA, 22 bp, Homo sapiens
ggctgcaggaacgacggagggg

SEQ ID NO: 9431650 - DNA, 22 bp, Homo sapiens
ggctgcaggaacgacggagggg

SEQ ID NO: 9431651 - DNA, 22 bp, Homo sapiens
ggctgcaggaacgacggagggg

SEQ ID NO: 9431652 - DNA, 22 bp, Homo sapiens
ggctgcaggatgcccagccgtg

SEQ ID NO: 9431653 - DNA, 22 bp, Homo sapiens
ggctgcaggcagaggctgtctg

SEQ ID NO: 9431654 - DNA, 19 bp, Homo sapiens
ggctgcctggagcgagggc

SEQ ID NO: 9431655 - DNA, 19 bp, Homo sapiens
ggctgcctggagcgagggc

SEQ ID NO: 9431656 - DNA, 19 bp, Homo sapiens
ggctgcctggagcgagggc

SEQ ID NO: 9431657 - DNA, 22 bp, Homo sapiens
ggctgcaggcagaggctgtctg

SEQ ID NO: 9431658 - DNA, 22 bp, Homo sapiens
ggctgcaggcagaggctgtctg

SEQ ID NO: 9431659 - DNA, 22 bp, Homo sapiens
ggctgcaggcagaggctgtctg

SEQ ID NO: 9431660 - DNA, 22 bp, Homo sapiens
ggctgccttcagactccagctt

SEQ ID NO: 9431661 - DNA, 22 bp, Homo sapiens
ggctgccttcagactccagctt

SEQ ID NO: 9431662 - DNA, 22 bp, Homo sapiens
ggctgccttcatagaccatggg

SEQ ID NO: 9431663 - DNA, 22 bp, Homo sapiens
ggctgccttcagactccagctt

SEQ ID NO: 9431664 - DNA, 22 bp, Homo sapiens
ggctgccttcatagaccatggg

SEQ ID NO: 9431665 - DNA, 22 bp, Homo sapiens
ggctgccttcagactccagctt

SEQ ID NO: 9431666 - DNA, 22 bp, Homo sapiens
ggctgcctgttgagtatgtccc

SEQ ID NO: 9431667 - DNA, 18 bp, Homo sapiens
ggctgcctgttcctgaag

SEQ ID NO: 9431668 - DNA, 22 bp, Homo sapiens
ggctgcctgttgagtatgtccc

SEQ ID NO: 9431669 - DNA, 22 bp, Homo sapiens
ggctgcctgtgcccaggcacac

SEQ ID NO: 9431670 - DNA, 22 bp, Homo sapiens
ggctgcctgtgcccaggcacac

SEQ ID NO: 9431671 - DNA, 22 bp, Homo sapiens
ggctgcctgtgcccaggcacac

SEQ ID NO: 9431672 - DNA, 22 bp, Homo sapiens
ggctgcctggtttagtgctgac

SEQ ID NO: 9431673 - DNA, 22 bp, Homo sapiens
ggctgcctgggagccctcctct

SEQ ID NO: 9431674 - DNA, 22 bp, Homo sapiens
ggctgcctgggagccctcctct

SEQ ID NO: 9431675 - DNA, 21 bp, Homo sapiens
ggctgcctgggaagaagaaga

SEQ ID NO: 9431676 - DNA, 22 bp, Homo sapiens
ggctgcctgggagccctcctct

SEQ ID NO: 9431677 - DNA, 22 bp, Homo sapiens
ggctgcctgggagccctcctct

SEQ ID NO: 9431678 - DNA, 22 bp, Homo sapiens
ggctgcctggtttagtgctgac

SEQ ID NO: 9431679 - DNA, 22 bp, Homo sapiens
ggctgcctgtgcccaggcacac

SEQ ID NO: 9431680 - DNA, 22 bp, Homo sapiens
ggctgcctggtttagtgctgac

SEQ ID NO: 9431681 - DNA, 22 bp, Homo sapiens
ggctgcctgtgcccaggcacac

SEQ ID NO: 9431682 - DNA, 22 bp, Homo sapiens
ggctgcctgtgcccaggcacac

SEQ ID NO: 9431683 - DNA, 23 bp, Homo sapiens
ggctggcccggggctgctcctga

SEQ ID NO: 9431684 - DNA, 23 bp, Homo sapiens
ggctggcccggggctgctcctga

SEQ ID NO: 9431685 - DNA, 23 bp, Homo sapiens
ggctggcccggggctgctcctga

SEQ ID NO: 9431686 - DNA, 23 bp, Homo sapiens
ggctggcccggggctgctcctga

SEQ ID NO: 9431687 - DNA, 22 bp, Homo sapiens
ggctggcctcagggtcctcgct

SEQ ID NO: 9431688 - DNA, 22 bp, Homo sapiens
ggctggcctcagggtcctcgct

SEQ ID NO: 9431689 - DNA, 23 bp, Homo sapiens
ggctgctcttttcatgctgtttc

SEQ ID NO: 9431690 - DNA, 22 bp, Homo sapiens
ggctgctgaacaagggaaccct

SEQ ID NO: 9431691 - DNA, 22 bp, Homo sapiens
ggctgctgaacaagggaaccct

SEQ ID NO: 9431692 - DNA, 22 bp, Homo sapiens
ggctgctgaacaagggaaccct

SEQ ID NO: 9431693 - DNA, 23 bp, Homo sapiens
ggctggcccggggctgctcctga

SEQ ID NO: 9431694 - DNA, 23 bp, Homo sapiens
ggctggcccggggctgctcctga

SEQ ID NO: 9431695 - DNA, 22 bp, Homo sapiens
ggctggcctctacagggaggca

SEQ ID NO: 9431696 - DNA, 22 bp, Homo sapiens
ggctggcctgtgtggccgccac

SEQ ID NO: 9431697 - DNA, 22 bp, Homo sapiens
ggctggcctctacagggaggca

SEQ ID NO: 9431698 - DNA, 22 bp, Homo sapiens
ggctggcctctacagggaggca

SEQ ID NO: 9431699 - DNA, 22 bp, Homo sapiens
ggctggcctctacagggaggca

SEQ ID NO: 9431700 - DNA, 22 bp, Homo sapiens
ggctggctatctgtggttgcct

SEQ ID NO: 9431701 - DNA, 22 bp, Homo sapiens
ggctggctacattggaggaagg

SEQ ID NO: 9431702 - DNA, 22 bp, Homo sapiens
ggctggctacattggaggaagg

SEQ ID NO: 9431703 - DNA, 22 bp, Homo sapiens
ggctgctcggagcctcctgtga

SEQ ID NO: 9431704 - DNA, 22 bp, Homo sapiens
ggctgctcggcagctcctgagc

SEQ ID NO: 9431705 - DNA, 22 bp, Homo sapiens
ggctgccttgaccctggctccg

SEQ ID NO: 9431706 - DNA, 22 bp, Homo sapiens
ggctgctcggagcctcctgtga

SEQ ID NO: 9431707 - DNA, 19 bp, Homo sapiens
ggctgccttctgctcatct

SEQ ID NO: 9431708 - DNA, 22 bp, Homo sapiens
ggctgccttccctgagccccgg

SEQ ID NO: 9431709 - DNA, 19 bp, Homo sapiens
ggctgccttctgctcatct

SEQ ID NO: 9431710 - DNA, 22 bp, Homo sapiens
ggctgccttccctgagccccgg

SEQ ID NO: 9431711 - DNA, 22 bp, Homo sapiens
ggctgccttccctgagccccgg

SEQ ID NO: 9431712 - DNA, 22 bp, Homo sapiens
ggctgccttcatagaccatggg

SEQ ID NO: 9431713 - DNA, 22 bp, Homo sapiens
ggctgccttcatagaccatggg

SEQ ID NO: 9431714 - DNA, 22 bp, Homo sapiens
ggctgccttccctgagccccgg

SEQ ID NO: 9431715 - DNA, 22 bp, Homo sapiens
ggctgctctgcacaggggctgg

SEQ ID NO: 9431716 - DNA, 22 bp, Homo sapiens
ggctgctcggcagctcctgagc

SEQ ID NO: 9431717 - DNA, 22 bp, Homo sapiens
ggctgctcggcagctcctgagc

SEQ ID NO: 9431718 - DNA, 22 bp, Homo sapiens
ggctgctcttcttggcgacctc

SEQ ID NO: 9431719 - DNA, 23 bp, Homo sapiens
ggctgctcttttcatgctgtttc

SEQ ID NO: 9431720 - DNA, 22 bp, Homo sapiens
ggctgctctgccttccagctgg

SEQ ID NO: 9431721 - DNA, 22 bp, Homo sapiens
ggctctcagggaaaggcctccc

SEQ ID NO: 9431722 - DNA, 22 bp, Homo sapiens
ggctcgtgtccagtatagaaag

SEQ ID NO: 9431723 - DNA, 22 bp, Homo sapiens
ggctcgagcagctgtgtaggat

SEQ ID NO: 9431724 - DNA, 22 bp, Homo sapiens
ggctctagagactctagagaaa

SEQ ID NO: 9431725 - DNA, 20 bp, Homo sapiens
ggctccttctttcatggccc

SEQ ID NO: 9431726 - DNA, 22 bp, Homo sapiens
ggctcctgttttaaaaggtgaa

SEQ ID NO: 9431727 - DNA, 22 bp, Homo sapiens
ggctccttatctctcctatgcc

SEQ ID NO: 9431728 - DNA, 22 bp, Homo sapiens
ggctccttcaaagcacctggct

SEQ ID NO: 9431729 - DNA, 22 bp, Homo sapiens
ggctccttcaaagcacctggct

SEQ ID NO: 9431730 - DNA, 22 bp, Homo sapiens
ggctcctggggaggtgagcttg

SEQ ID NO: 9431731 - DNA, 22 bp, Homo sapiens
ggctcctgggcagctgctccct

SEQ ID NO: 9431732 - DNA, 22 bp, Homo sapiens
ggctcctgggcagctgctccct

SEQ ID NO: 9431733 - DNA, 22 bp, Homo sapiens
ggctcctgggcagctgctccct

SEQ ID NO: 9431734 - DNA, 22 bp, Homo sapiens
ggctcctgggatgggactgagc

SEQ ID NO: 9431735 - DNA, 22 bp, Homo sapiens
ggctcctgggagatagaggtca

SEQ ID NO: 9431736 - DNA, 23 bp, Homo sapiens
ggctcctggattcaaatcctgcc

SEQ ID NO: 9431737 - DNA, 23 bp, Homo sapiens
ggctcctggattcaaatcctgcc

SEQ ID NO: 9431738 - DNA, 22 bp, Homo sapiens
ggctcctggaggcaccactggt

SEQ ID NO: 9431739 - DNA, 22 bp, Homo sapiens
ggctcctggaggcaccactggt

SEQ ID NO: 9431740 - DNA, 22 bp, Homo sapiens
ggctgcagaagtacttccggat

SEQ ID NO: 9431741 - DNA, 19 bp, Homo sapiens
ggctgcagagccccggcgc

SEQ ID NO: 9431742 - DNA, 19 bp, Homo sapiens
ggctgcagagccccggcgc

SEQ ID NO: 9431743 - DNA, 19 bp, Homo sapiens
ggctgcagagccccggcgc

SEQ ID NO: 9431744 - DNA, 22 bp, Homo sapiens
ggctgcagaggcccccagtggg

SEQ ID NO: 9431745 - DNA, 22 bp, Homo sapiens
ggctgcagaggcccccagtggg

SEQ ID NO: 9431746 - DNA, 22 bp, Homo sapiens
ggctgcagaggcgatctgaggt

SEQ ID NO: 9431747 - DNA, 22 bp, Homo sapiens
ggctgcagcggattggggattg

SEQ ID NO: 9431748 - DNA, 22 bp, Homo sapiens
ggctgcagaggcccccagtggg

SEQ ID NO: 9431749 - DNA, 22 bp, Homo sapiens
ggctgcagaggcccccagtggg

SEQ ID NO: 9431750 - DNA, 22 bp, Homo sapiens
ggctgcagagctggtgccctgg

SEQ ID NO: 9431751 - DNA, 22 bp, Homo sapiens
ggctgcagagctggtgccctgg

SEQ ID NO: 9431752 - DNA, 17 bp, Homo sapiens
ggctgcaaaggctctgg

SEQ ID NO: 9431753 - DNA, 19 bp, Homo sapiens
ggctgatgtagacagtgtc

SEQ ID NO: 9431754 - DNA, 22 bp, Homo sapiens
ggctgcagaagtacttccggat

SEQ ID NO: 9431755 - DNA, 19 bp, Homo sapiens
ggctgatgtagacagtgtc

SEQ ID NO: 9431756 - DNA, 22 bp, Homo sapiens
ggctgatgggcatgagctgtca

SEQ ID NO: 9431757 - DNA, 22 bp, Homo sapiens
ggctgatgggcatgagctgtca

SEQ ID NO: 9431758 - DNA, 22 bp, Homo sapiens
ggctgatgagcttagctagaga

SEQ ID NO: 9431759 - DNA, 22 bp, Homo sapiens
ggctgatgagcttagctagaga

SEQ ID NO: 9431760 - DNA, 22 bp, Homo sapiens
ggctgatgagcttagctagaga

SEQ ID NO: 9431761 - DNA, 22 bp, Homo sapiens
ggctgatgagcttagctagaga

SEQ ID NO: 9431762 - DNA, 22 bp, Homo sapiens
ggctgagttgagaggattactt

SEQ ID NO: 9431763 - DNA, 19 bp, Homo sapiens
ggctctcccttgagagagc

SEQ ID NO: 9431764 - DNA, 22 bp, Homo sapiens
ggctctccactatggatgagaa

SEQ ID NO: 9431765 - DNA, 22 bp, Homo sapiens
ggctctccactatggatgagaa

SEQ ID NO: 9431766 - DNA, 22 bp, Homo sapiens
ggctctccactatggatgagaa

SEQ ID NO: 9431767 - DNA, 22 bp, Homo sapiens
gggctctggtacttcctggctc

SEQ ID NO: 9431768 - DNA, 22 bp, Homo sapiens
gggctctggtacttcctggctc

SEQ ID NO: 9431769 - DNA, 22 bp, Homo sapiens
gggctctggtcctgaactgaag

SEQ ID NO: 9431770 - DNA, 20 bp, Homo sapiens
gggctctgtaaggttgaaag

SEQ ID NO: 9431771 - DNA, 22 bp, Homo sapiens
gggctctggtgctattgacgaa

SEQ ID NO: 9431772 - DNA, 22 bp, Homo sapiens
gggctctggtgccttcacagaa

SEQ ID NO: 9431773 - DNA, 22 bp, Homo sapiens
gggctctggtgccttcacagaa

SEQ ID NO: 9431774 - DNA, 22 bp, Homo sapiens
gggctctgtccattccttcata

SEQ ID NO: 9431775 - DNA, 22 bp, Homo sapiens
gggctctgtccattccttcata

SEQ ID NO: 9431776 - DNA, 22 bp, Homo sapiens
gggctctgtgcaccccagcacc

SEQ ID NO: 9431777 - DNA, 22 bp, Homo sapiens
gggctctgtgcaccccagcacc

SEQ ID NO: 9431778 - DNA, 22 bp, Homo sapiens
gggctctgtgcaccccagcacc

SEQ ID NO: 9431779 - DNA, 22 bp, Homo sapiens
gggctctgtgcaccccagcacc

SEQ ID NO: 9431780 - DNA, 22 bp, Homo sapiens
gggctctgtggatgtgagagct

SEQ ID NO: 9431781 - DNA, 22 bp, Homo sapiens
gggctctgtggatgtgagagct

SEQ ID NO: 9431782 - DNA, 22 bp, Homo sapiens
gggctctgtggatgtgagagct

SEQ ID NO: 9431783 - DNA, 22 bp, Homo sapiens
gggctctgtggatgtgagagct

SEQ ID NO: 9431784 - DNA, 22 bp, Homo sapiens
gggctctgtggcttccttctta

SEQ ID NO: 9431785 - DNA, 22 bp, Homo sapiens
gggctctggtacttcctggctc

SEQ ID NO: 9431786 - DNA, 22 bp, Homo sapiens
gggctctgggtcgtgtctccat

SEQ ID NO: 9431787 - DNA, 22 bp, Homo sapiens
gggctctgggtcgtgtctccat

SEQ ID NO: 9431788 - DNA, 22 bp, Homo sapiens
gggctctggggtgccctggcat

SEQ ID NO: 9431789 - DNA, 22 bp, Homo sapiens
gggctaggcttggccagcactg

SEQ ID NO: 9431790 - DNA, 22 bp, Homo sapiens
gggctagaatccgcgtctcttg

SEQ ID NO: 9431791 - DNA, 20 bp, Homo sapiens
gggctagaccagggcagagg

SEQ ID NO: 9431792 - DNA, 22 bp, Homo sapiens
gggctagaagttagctagagaa

SEQ ID NO: 9431793 - DNA, 20 bp, Homo sapiens
gggctagaccagggcagagg

SEQ ID NO: 9431794 - DNA, 22 bp, Homo sapiens
gggctagcctcttccctgctcc

SEQ ID NO: 9431795 - DNA, 22 bp, Homo sapiens
gggctagcctcttccctgctcc

SEQ ID NO: 9431796 - DNA, 22 bp, Homo sapiens
gggctagcctcttccctgctcc

SEQ ID NO: 9431797 - DNA, 22 bp, Homo sapiens
gggctagcctcttccctgctcc

SEQ ID NO: 9431798 - DNA, 22 bp, Homo sapiens
gggctagcctcttccctgctcc

SEQ ID NO: 9431799 - DNA, 22 bp, Homo sapiens
gggctgagacgatggggtcttc

SEQ ID NO: 9431800 - DNA, 22 bp, Homo sapiens
gggctgagacgatggggtcttc

SEQ ID NO: 9431801 - DNA, 22 bp, Homo sapiens
gggctgagacgatggggtcttc

SEQ ID NO: 9431802 - DNA, 22 bp, Homo sapiens
gggctgagagctggaatctgag

SEQ ID NO: 9431803 - DNA, 22 bp, Homo sapiens
gggctgagaattcagctttcct

SEQ ID NO: 9431804 - DNA, 22 bp, Homo sapiens
gggctgagaattcagctttcct

SEQ ID NO: 9431805 - DNA, 22 bp, Homo sapiens
gggctgagacgatggggtcttc

SEQ ID NO: 9431806 - DNA, 22 bp, Homo sapiens
gggctgagaagttgatcccaag

SEQ ID NO: 9431807 - DNA, 22 bp, Homo sapiens
gggctgagaattcagctttcct

SEQ ID NO: 9431808 - DNA, 22 bp, Homo sapiens
gggctgagaattcagctttcct

SEQ ID NO: 9431809 - DNA, 22 bp, Homo sapiens
gggctgagaagttgatcccaag

SEQ ID NO: 9431810 - DNA, 22 bp, Homo sapiens
gggctgagaagttgatcccaag

SEQ ID NO: 9431811 - DNA, 22 bp, Homo sapiens
gggctctgtggcttccttctta

SEQ ID NO: 9431812 - DNA, 22 bp, Homo sapiens
gggctctgtggttgtgctttgt

SEQ ID NO: 9431813 - DNA, 22 bp, Homo sapiens
gggctctgtggttgtgctttgt

SEQ ID NO: 9431814 - DNA, 22 bp, Homo sapiens
gggctctgtgttctagctctcg

SEQ ID NO: 9431815 - DNA, 22 bp, Homo sapiens
gggctctgtgttctagctctcg

SEQ ID NO: 9431816 - DNA, 22 bp, Homo sapiens
gggctctgtggttgtgctttgt

SEQ ID NO: 9431817 - DNA, 22 bp, Homo sapiens
gggctgcttttttcttagcaga

SEQ ID NO: 9431818 - DNA, 22 bp, Homo sapiens
gggctgcttttaagggtctcag

SEQ ID NO: 9431819 - DNA, 22 bp, Homo sapiens
gggctggacatctaaggtagct

SEQ ID NO: 9431820 - DNA, 22 bp, Homo sapiens
gggctgcttttaagggtctcag

SEQ ID NO: 9431821 - DNA, 22 bp, Homo sapiens
gggctgcttgctggagacagac

SEQ ID NO: 9431822 - DNA, 22 bp, Homo sapiens
gggctgcttggaggaggcgctc

SEQ ID NO: 9431823 - DNA, 22 bp, Homo sapiens
gggctgcttgctggagacagac

SEQ ID NO: 9431824 - DNA, 22 bp, Homo sapiens
gggctgcttgctggagacagac

SEQ ID NO: 9431825 - DNA, 22 bp, Homo sapiens
gggctgcttatactgatgataa

SEQ ID NO: 9431826 - DNA, 22 bp, Homo sapiens
gggctgctgtgttcctgaggca

SEQ ID NO: 9431827 - DNA, 22 bp, Homo sapiens
gggctggagatgcttatggaga

SEQ ID NO: 9431828 - DNA, 22 bp, Homo sapiens
gggctggagccagctgtggctg

SEQ ID NO: 9431829 - DNA, 22 bp, Homo sapiens
gggctggagccagctgtggctg

SEQ ID NO: 9431830 - DNA, 22 bp, Homo sapiens
gggctggatctcctgcaggcag

SEQ ID NO: 9431831 - DNA, 22 bp, Homo sapiens
gggctggagcctggcggtggtt

SEQ ID NO: 9431832 - DNA, 22 bp, Homo sapiens
gggctggagacaagtgagccgc

SEQ ID NO: 9431833 - DNA, 21 bp, Homo sapiens
gggctggacatggtggctcat

SEQ ID NO: 9431834 - DNA, 21 bp, Homo sapiens
gggctggacatggtggctcat

SEQ ID NO: 9431835 - DNA, 22 bp, Homo sapiens
gggctggaccgctcgcctccct

SEQ ID NO: 9431836 - DNA, 22 bp, Homo sapiens
gggctggaccgctcgcctccct

SEQ ID NO: 9431837 - DNA, 22 bp, Homo sapiens
gggctggaccgcgacccctgag

SEQ ID NO: 9431838 - DNA, 22 bp, Homo sapiens
gggctggcaggacctgggctga

SEQ ID NO: 9431839 - DNA, 22 bp, Homo sapiens
gggctggcaggacctgggctga

SEQ ID NO: 9431840 - DNA, 22 bp, Homo sapiens
gggctggcaggacctgggctga

SEQ ID NO: 9431841 - DNA, 22 bp, Homo sapiens
gggctggcatcagttgccgaga

SEQ ID NO: 9431842 - DNA, 22 bp, Homo sapiens
gggctggcatcagttgccgaga

SEQ ID NO: 9431843 - DNA, 22 bp, Homo sapiens
ggggaaggattgagttgaccca

SEQ ID NO: 9431844 - DNA, 22 bp, Homo sapiens
gggctggcatcggttgctgaga

SEQ ID NO: 9431845 - DNA, 22 bp, Homo sapiens
gggctggattactgaactgagt

SEQ ID NO: 9431846 - DNA, 22 bp, Homo sapiens
gggctggatgtttgatgacgaa

SEQ ID NO: 9431847 - DNA, 17 bp, Homo sapiens
gggctggatggccatgg

SEQ ID NO: 9431848 - DNA, 22 bp, Homo sapiens
ggggacagttaaagaccaagac

SEQ ID NO: 9431849 - DNA, 23 bp, Homo sapiens
ggggacagttcccactggggtct

SEQ ID NO: 9431850 - DNA, 23 bp, Homo sapiens
ggggacagttcccactggggtct

SEQ ID NO: 9431851 - DNA, 23 bp, Homo sapiens
ggggacagttcccactggggtct

SEQ ID NO: 9431852 - DNA, 22 bp, Homo sapiens
ggggaccctcaggactgcgtct

SEQ ID NO: 9431853 - DNA, 22 bp, Homo sapiens
ggggaccctcaggactgcgtct

SEQ ID NO: 9431854 - DNA, 22 bp, Homo sapiens
ggggacagtcgatctagtgatt

SEQ ID NO: 9431855 - DNA, 22 bp, Homo sapiens
ggggacagtcgatctagtgatt

SEQ ID NO: 9431856 - DNA, 22 bp, Homo sapiens
ggggacagtcgatctagtgatt

SEQ ID NO: 9431857 - DNA, 22 bp, Homo sapiens
ggggacagtcgatctagtgatt

SEQ ID NO: 9431858 - DNA, 22 bp, Homo sapiens
ggggacagtcgatctagtgatt

SEQ ID NO: 9431859 - DNA, 22 bp, Homo sapiens
ggggacagttaaagaccaagac

SEQ ID NO: 9431860 - DNA, 22 bp, Homo sapiens
ggggacagttaaagaccaagac

SEQ ID NO: 9431861 - DNA, 22 bp, Homo sapiens
ggggacagtcgatctagtgatt

SEQ ID NO: 9431862 - DNA, 22 bp, Homo sapiens
ggggaaggattgagttgaccca

SEQ ID NO: 9431863 - DNA, 16 bp, Homo sapiens
ggggaaggcaagaggg

SEQ ID NO: 9431864 - DNA, 16 bp, Homo sapiens
ggggaaggcaagaggg

SEQ ID NO: 9431865 - DNA, 16 bp, Homo sapiens
ggggaaggcaagaggg

SEQ ID NO: 9431866 - DNA, 22 bp, Homo sapiens
ggggaagggagtccaagtgtta

SEQ ID NO: 9431867 - DNA, 22 bp, Homo sapiens
ggggaagggagtccaagtgtta

SEQ ID NO: 9431868 - DNA, 22 bp, Homo sapiens
ggggaagggagtccaagtgtta

SEQ ID NO: 9431869 - DNA, 22 bp, Homo sapiens
ggggaagggagtccaagtgtta

SEQ ID NO: 9431870 - DNA, 23 bp, Homo sapiens
ggggacagagggcagcccgcatc

SEQ ID NO: 9431871 - DNA, 23 bp, Homo sapiens
ggggacagagggcagcccgcatc

SEQ ID NO: 9431872 - DNA, 23 bp, Homo sapiens
ggggacagagggcagcccgcatc

SEQ ID NO: 9431873 - DNA, 23 bp, Homo sapiens
ggggacagagggcagcccgcatc

SEQ ID NO: 9431874 - DNA, 23 bp, Homo sapiens
ggggaagtggcagtgagtgaggc

SEQ ID NO: 9431875 - DNA, 23 bp, Homo sapiens
ggggaagtggcagtgagtgaggc

SEQ ID NO: 9431876 - DNA, 23 bp, Homo sapiens
ggggaagtggcagtgagtgaggc

SEQ ID NO: 9431877 - DNA, 20 bp, Homo sapiens
ggggaagtcactgcagtcag

SEQ ID NO: 9431878 - DNA, 22 bp, Homo sapiens
ggggaagggagtccaagtgtta

SEQ ID NO: 9431879 - DNA, 22 bp, Homo sapiens
gggtctctcatgcagttgctgt

SEQ ID NO: 9431880 - DNA, 22 bp, Homo sapiens
gggtctcctgagagaagatgct

SEQ ID NO: 9431881 - DNA, 22 bp, Homo sapiens
gggtctcctaatggaggatgac

SEQ ID NO: 9431882 - DNA, 22 bp, Homo sapiens
gggtctccatgttaacatcact

SEQ ID NO: 9431883 - DNA, 22 bp, Homo sapiens
gggtctccatgttaacatcact

SEQ ID NO: 9431884 - DNA, 22 bp, Homo sapiens
gggtctggacggctgcaggaag

SEQ ID NO: 9431885 - DNA, 22 bp, Homo sapiens
gggtctggacggctgcaggaag

SEQ ID NO: 9431886 - DNA, 22 bp, Homo sapiens
gggtctggagatccgggtgaag

SEQ ID NO: 9431887 - DNA, 22 bp, Homo sapiens
gggtctggagatccgggtgaag

SEQ ID NO: 9431888 - DNA, 22 bp, Homo sapiens
gggtctggacggctgcaggaag

SEQ ID NO: 9431889 - DNA, 22 bp, Homo sapiens
gggtctgctccacctgcagccc

SEQ ID NO: 9431890 - DNA, 22 bp, Homo sapiens
gggtctgagctgaggggaaatc

SEQ ID NO: 9431891 - DNA, 22 bp, Homo sapiens
gggtctgggcaggcgcttcctc

SEQ ID NO: 9431892 - DNA, 22 bp, Homo sapiens
gggtgaagctcctgcaggggcc

SEQ ID NO: 9431893 - DNA, 22 bp, Homo sapiens
gggtctggagggcagcccttct

SEQ ID NO: 9431894 - DNA, 22 bp, Homo sapiens
gggtctggcatgctgagatgga

SEQ ID NO: 9431895 - DNA, 22 bp, Homo sapiens
gggtctggcatgctgagatgga

SEQ ID NO: 9431896 - DNA, 22 bp, Homo sapiens
gggtgaagctcctgcaggggcc

SEQ ID NO: 9431897 - DNA, 20 bp, Homo sapiens
gggtgagatgtaggagaggg

SEQ ID NO: 9431898 - DNA, 20 bp, Homo sapiens
gggtgagatgtaggagaggg

SEQ ID NO: 9431899 - DNA, 22 bp, Homo sapiens
gggtgagacagaaagagcaaaa

SEQ ID NO: 9431900 - DNA, 17 bp, Homo sapiens
gggtgggcactgctggc

SEQ ID NO: 9431901 - DNA, 23 bp, Homo sapiens
gggtgggccaaattaggtagcct

SEQ ID NO: 9431902 - DNA, 17 bp, Homo sapiens
gggtgggcactgctggc

SEQ ID NO: 9431903 - DNA, 17 bp, Homo sapiens
gggtgggcactgctggc

SEQ ID NO: 9431904 - DNA, 22 bp, Homo sapiens
gggtgggatggcaggagccgct

SEQ ID NO: 9431905 - DNA, 22 bp, Homo sapiens
gggtgggcctgtctggccatgt

SEQ ID NO: 9431906 - DNA, 22 bp, Homo sapiens
gggtgggcctgtctggccatgt

SEQ ID NO: 9431907 - DNA, 22 bp, Homo sapiens
gggtgggcccagcccagagaag

SEQ ID NO: 9431908 - DNA, 22 bp, Homo sapiens
gggtgggcccagcccagagaag

SEQ ID NO: 9431909 - DNA, 20 bp, Homo sapiens
gggtgagatgtaggagaggg

SEQ ID NO: 9431910 - DNA, 22 bp, Homo sapiens
gggtgaggagctgccagtcatg

SEQ ID NO: 9431911 - DNA, 22 bp, Homo sapiens
gggtgaggagctgccagtcatg

SEQ ID NO: 9431912 - DNA, 22 bp, Homo sapiens
gggtgaggagctgccagtcatg

SEQ ID NO: 9431913 - DNA, 22 bp, Homo sapiens
gggtgggaacaggatgccagga

SEQ ID NO: 9431914 - DNA, 22 bp, Homo sapiens
gggtgggaacaggatgccagga

SEQ ID NO: 9431915 - DNA, 22 bp, Homo sapiens
gggtgggaacaggatgccagga

SEQ ID NO: 9431916 - DNA, 22 bp, Homo sapiens
gggtgggaaggctaagggattg

SEQ ID NO: 9431917 - DNA, 22 bp, Homo sapiens
gggtgggatgccgctgtctcca

SEQ ID NO: 9431918 - DNA, 22 bp, Homo sapiens
gggtgggatgccgctgtctcca

SEQ ID NO: 9431919 - DNA, 22 bp, Homo sapiens
gggtgggatggcaggagccgct

SEQ ID NO: 9431920 - DNA, 22 bp, Homo sapiens
gggggctccaggcgagaatgtg

SEQ ID NO: 9431921 - DNA, 22 bp, Homo sapiens
gggggctgaggctgttctgagg

SEQ ID NO: 9431922 - DNA, 19 bp, Homo sapiens
ggggagaactagagacagc

SEQ ID NO: 9431923 - DNA, 22 bp, Homo sapiens
gggggctagagagatgaaatat

SEQ ID NO: 9431924 - DNA, 22 bp, Homo sapiens
ggggactgaggcactgaaggtg

SEQ ID NO: 9431925 - DNA, 22 bp, Homo sapiens
ggggactgccttccacagacac

SEQ ID NO: 9431926 - DNA, 22 bp, Homo sapiens
ggggaccctcaggactgcgtct

SEQ ID NO: 9431927 - DNA, 22 bp, Homo sapiens
ggggaccctcaggactgcgtct

SEQ ID NO: 9431928 - DNA, 22 bp, Homo sapiens
ggggaccctcaggactgcgtct

SEQ ID NO: 9431929 - DNA, 22 bp, Homo sapiens
ggggacgggacttagcatgagt

SEQ ID NO: 9431930 - DNA, 22 bp, Homo sapiens
ggggactctgcttctgggatca

SEQ ID NO: 9431931 - DNA, 22 bp, Homo sapiens
gggggctgaggctgttctgagg

SEQ ID NO: 9431932 - DNA, 22 bp, Homo sapiens
gggggctgaggctgttctgagg

SEQ ID NO: 9431933 - DNA, 22 bp, Homo sapiens
gggggctgatcatttactgggc

SEQ ID NO: 9431934 - DNA, 22 bp, Homo sapiens
gggggctggaatatccatcaac

SEQ ID NO: 9431935 - DNA, 22 bp, Homo sapiens
gggggctggaatatccatcaac

SEQ ID NO: 9431936 - DNA, 22 bp, Homo sapiens
gggggctggactttcccacaca

SEQ ID NO: 9431937 - DNA, 22 bp, Homo sapiens
gggggctggactttcccacaca

SEQ ID NO: 9431938 - DNA, 23 bp, Homo sapiens
gggggctggttgactctctgcag

SEQ ID NO: 9431939 - DNA, 22 bp, Homo sapiens
gggggctgtcctgtgcattgta

SEQ ID NO: 9431940 - DNA, 22 bp, Homo sapiens
gggggctgtcctgtgcattgta

SEQ ID NO: 9431941 - DNA, 22 bp, Homo sapiens
gggggctgtcctgtgcattgta

SEQ ID NO: 9431942 - DNA, 22 bp, Homo sapiens
ggggggtgctgatcagtggagc

SEQ ID NO: 9431943 - DNA, 22 bp, Homo sapiens
ggggggtgctgatcagtggagc

SEQ ID NO: 9431944 - DNA, 22 bp, Homo sapiens
ggggggtgctgatcagtggagc

SEQ ID NO: 9431945 - DNA, 22 bp, Homo sapiens
ggggggtgacaagtagaggttg

SEQ ID NO: 9431946 - DNA, 22 bp, Homo sapiens
ggggggtgacaagtagaggttg

SEQ ID NO: 9431947 - DNA, 22 bp, Homo sapiens
gggggtgacgatggcagctggt

SEQ ID NO: 9431948 - DNA, 22 bp, Homo sapiens
gggggtaggcagacaaggacat

SEQ ID NO: 9431949 - DNA, 20 bp, Homo sapiens
ggggggcttcagggcctgtg

SEQ ID NO: 9431950 - DNA, 20 bp, Homo sapiens
ggggggcttcagggcctgtg

SEQ ID NO: 9431951 - DNA, 20 bp, Homo sapiens
ggggggcttcagggcctgtg

SEQ ID NO: 9431952 - DNA, 20 bp, Homo sapiens
ggggggcttcagggcctgtg

SEQ ID NO: 9431953 - DNA, 22 bp, Homo sapiens
ggggggctgttctggacaggaa

SEQ ID NO: 9431954 - DNA, 23 bp, Homo sapiens
gggggctggttgactctctgcag

SEQ ID NO: 9431955 - DNA, 22 bp, Homo sapiens
ggggggctgttctggacaggaa

SEQ ID NO: 9431956 - DNA, 22 bp, Homo sapiens
ggggggctgttctggacaggaa

SEQ ID NO: 9431957 - DNA, 22 bp, Homo sapiens
ggggggcagctgtcctggccat

SEQ ID NO: 9431958 - DNA, 22 bp, Homo sapiens
gggtccagggacgtttctgcag

SEQ ID NO: 9431959 - DNA, 22 bp, Homo sapiens
gggtccagggccagtggctgag

SEQ ID NO: 9431960 - DNA, 22 bp, Homo sapiens
gggggtggttctaagtcctata

SEQ ID NO: 9431961 - DNA, 22 bp, Homo sapiens
gggggtggttctaagtcctata

SEQ ID NO: 9431962 - DNA, 22 bp, Homo sapiens
gggggtgaggacaggagcactg

SEQ ID NO: 9431963 - DNA, 22 bp, Homo sapiens
gggggtggttctaagtcctata

SEQ ID NO: 9431964 - DNA, 22 bp, Homo sapiens
gggggtgagcctgccaggccca

SEQ ID NO: 9431965 - DNA, 22 bp, Homo sapiens
gggcagcacgtttcaggaggat

SEQ ID NO: 9431966 - DNA, 22 bp, Homo sapiens
gggcagcacgtttcaggaggat

SEQ ID NO: 9431967 - DNA, 22 bp, Homo sapiens
gggcagcacgtttcaggaggat

SEQ ID NO: 9431968 - DNA, 22 bp, Homo sapiens
gggcagcacgtttcaggaggat

SEQ ID NO: 9431969 - DNA, 22 bp, Homo sapiens
gggcagcagaattggacagaaa

SEQ ID NO: 9431970 - DNA, 22 bp, Homo sapiens
gggcagcactcatacctatatt

SEQ ID NO: 9431971 - DNA, 18 bp, Homo sapiens
gggcagcacagcagcctc

SEQ ID NO: 9431972 - DNA, 18 bp, Homo sapiens
gggcagcacagcagcctc

SEQ ID NO: 9431973 - DNA, 21 bp, Homo sapiens
gggcagcacgtcattcctgtg

SEQ ID NO: 9431974 - DNA, 22 bp, Homo sapiens
gggcagcagaattggacagaaa

SEQ ID NO: 9431975 - DNA, 20 bp, Homo sapiens
gggcagcctcgggagtgggt

SEQ ID NO: 9431976 - DNA, 20 bp, Homo sapiens
gggcagcaagacatttgaca

SEQ ID NO: 9431977 - DNA, 22 bp, Homo sapiens
gggcagcaaatctgagtctggt

SEQ ID NO: 9431978 - DNA, 18 bp, Homo sapiens
gggcagcacagcagcctc

SEQ ID NO: 9431979 - DNA, 18 bp, Homo sapiens
gggcagcacagcagcctc

SEQ ID NO: 9431980 - DNA, 22 bp, Homo sapiens
gggcagcacagacagtgaaggc

SEQ ID NO: 9431981 - DNA, 22 bp, Homo sapiens
gggcagcacagacagtgaaggc

SEQ ID NO: 9431982 - DNA, 22 bp, Homo sapiens
gggcagatcacctgaggtcagg

SEQ ID NO: 9431983 - DNA, 22 bp, Homo sapiens
gggcagaggttcaacttcaaca

SEQ ID NO: 9431984 - DNA, 22 bp, Homo sapiens
gggcagatgtctggacacctca

SEQ ID NO: 9431985 - DNA, 18 bp, Homo sapiens
gggcagatgtcccaagat

SEQ ID NO: 9431986 - DNA, 22 bp, Homo sapiens
gggcagatggggcacaggctga

SEQ ID NO: 9431987 - DNA, 22 bp, Homo sapiens
gggcagatcacctgaggtcagg

SEQ ID NO: 9431988 - DNA, 22 bp, Homo sapiens
gggcagatcacctgaggtcagg

SEQ ID NO: 9431989 - DNA, 22 bp, Homo sapiens
gggccacaggccttgcccgcag

SEQ ID NO: 9431990 - DNA, 22 bp, Homo sapiens
gggccacaggagaggctgtcag

SEQ ID NO: 9431991 - DNA, 22 bp, Homo sapiens
gggccacattgaagggtgggta

SEQ ID NO: 9431992 - DNA, 22 bp, Homo sapiens
gggccaggagtggagatatggg

SEQ ID NO: 9431993 - DNA, 22 bp, Homo sapiens
gggccaggagtggagatatggg

SEQ ID NO: 9431994 - DNA, 22 bp, Homo sapiens
gggccaggagtggagatatggg

SEQ ID NO: 9431995 - DNA, 22 bp, Homo sapiens
gggccaggagtggagatatggg

SEQ ID NO: 9431996 - DNA, 22 bp, Homo sapiens
gggccaggtatcgtctttagta

SEQ ID NO: 9431997 - DNA, 22 bp, Homo sapiens
gggccaggtcggtgaatggtca

SEQ ID NO: 9431998 - DNA, 22 bp, Homo sapiens
gggccaggtggaccccagcctc

SEQ ID NO: 9431999 - DNA, 22 bp, Homo sapiens
gggccaggtcggtgaatggtca

SEQ ID NO: 9432000 - DNA, 22 bp, Homo sapiens
gggccaggtcggtgaatggtca

SEQ ID NO: 9432001 - DNA, 22 bp, Homo sapiens
gggccaggtggaccccagcctc

SEQ ID NO: 9432002 - DNA, 22 bp, Homo sapiens
gggccaggtggaccccagcctc

SEQ ID NO: 9432003 - DNA, 22 bp, Homo sapiens
gggccacaggagaggctgtcag

SEQ ID NO: 9432004 - DNA, 21 bp, Homo sapiens
gggccacaccttctgcagacc

SEQ ID NO: 9432005 - DNA, 21 bp, Homo sapiens
gggccacaccttctgcagacc

SEQ ID NO: 9432006 - DNA, 22 bp, Homo sapiens
gggcagctcctgtggaatccac

SEQ ID NO: 9432007 - DNA, 22 bp, Homo sapiens
gggcagctcctgtggaatccac

SEQ ID NO: 9432008 - DNA, 22 bp, Homo sapiens
gggcagctcggaagtgggaaag

SEQ ID NO: 9432009 - DNA, 22 bp, Homo sapiens
gggcagctcggaagtgggaaag

SEQ ID NO: 9432010 - DNA, 22 bp, Homo sapiens
gggcagctcagccaccatgcag

SEQ ID NO: 9432011 - DNA, 22 bp, Homo sapiens
gggcagctagccctctagccca

SEQ ID NO: 9432012 - DNA, 22 bp, Homo sapiens
gggcggggggagctggaatgaa

SEQ ID NO: 9432013 - DNA, 22 bp, Homo sapiens
gggcggggcttccgtcctccac

SEQ ID NO: 9432014 - DNA, 22 bp, Homo sapiens
gggcggatcatttgaggtcagg

SEQ ID NO: 9432015 - DNA, 22 bp, Homo sapiens
gggcggatcacctgaggtcagg

SEQ ID NO: 9432016 - DNA, 22 bp, Homo sapiens
gggcggatcacctgaggtcagg

SEQ ID NO: 9432017 - DNA, 22 bp, Homo sapiens
gggcggatcatttgaggtcagg

SEQ ID NO: 9432018 - DNA, 22 bp, Homo sapiens
gggcggatcatttgaggtcagg

SEQ ID NO: 9432019 - DNA, 22 bp, Homo sapiens
gggcggatcacctgaggtcagg

SEQ ID NO: 9432020 - DNA, 22 bp, Homo sapiens
gggcgtggatggtcagtgcagg

SEQ ID NO: 9432021 - DNA, 22 bp, Homo sapiens
gggcgtgaccatctgggagctc

SEQ ID NO: 9432022 - DNA, 22 bp, Homo sapiens
gggcgtgaccatctgggagctc

SEQ ID NO: 9432023 - DNA, 22 bp, Homo sapiens
gggcggggggagctggaatgaa

SEQ ID NO: 9432024 - DNA, 22 bp, Homo sapiens
gggcggggtggctcatgcctgt

SEQ ID NO: 9432025 - DNA, 22 bp, Homo sapiens
gggcggggggagctggaatgaa

SEQ ID NO: 9432026 - DNA, 22 bp, Homo sapiens
gggctactgagctggaactggg

SEQ ID NO: 9432027 - DNA, 22 bp, Homo sapiens
gggctactgagctggaactggg

SEQ ID NO: 9432028 - DNA, 22 bp, Homo sapiens
gggctactgagctggaactggg

SEQ ID NO: 9432029 - DNA, 22 bp, Homo sapiens
gggctagaagttagctagagaa

SEQ ID NO: 9432030 - DNA, 22 bp, Homo sapiens
gggcccagcactggctgggatc

SEQ ID NO: 9432031 - DNA, 22 bp, Homo sapiens
gggcccagcactggctgggatc

SEQ ID NO: 9432032 - DNA, 22 bp, Homo sapiens
gggcccagcactggctgggatc

SEQ ID NO: 9432033 - DNA, 22 bp, Homo sapiens
gggcccagcactggctgggatc

SEQ ID NO: 9432034 - DNA, 23 bp, Homo sapiens
gggcccagcacaggacctggcag

SEQ ID NO: 9432035 - DNA, 23 bp, Homo sapiens
gggcccagcacaggacctggcag

SEQ ID NO: 9432036 - DNA, 22 bp, Homo sapiens
gggccagtgagtcgggagagct

SEQ ID NO: 9432037 - DNA, 22 bp, Homo sapiens
gggccatgagaggttcatcaac

SEQ ID NO: 9432038 - DNA, 22 bp, Homo sapiens
gggcctgtctcactccctggtt

SEQ ID NO: 9432039 - DNA, 22 bp, Homo sapiens
gggcctgtgtgttcaggagcct

SEQ ID NO: 9432040 - DNA, 22 bp, Homo sapiens
gggcctggtgcttctgactcct

SEQ ID NO: 9432041 - DNA, 22 bp, Homo sapiens
gggcctggtgcttctgactcct

SEQ ID NO: 9432042 - DNA, 22 bp, Homo sapiens
gggcccagcgtggttccatctg

SEQ ID NO: 9432043 - DNA, 22 bp, Homo sapiens
gggcccagcgtggttccatctg

SEQ ID NO: 9432044 - DNA, 19 bp, Homo sapiens
gggcccagcatggagggtt

SEQ ID NO: 9432045 - DNA, 22 bp, Homo sapiens
gggcccagccctctgctcactg

SEQ ID NO: 9432046 - DNA, 22 bp, Homo sapiens
gggcccagccctctgctcactg

SEQ ID NO: 9432047 - DNA, 19 bp, Homo sapiens
gggcccagcatggagggtt

SEQ ID NO: 9432048 - DNA, 19 bp, Homo sapiens
gggcccagcatggagggtt

SEQ ID NO: 9432049 - DNA, 19 bp, Homo sapiens
gggcccagcatggagggtt

SEQ ID NO: 9432050 - DNA, 19 bp, Homo sapiens
gggcccagcatggagggtt

SEQ ID NO: 9432051 - DNA, 22 bp, Homo sapiens
gggatggggagctggaaagggg

SEQ ID NO: 9432052 - DNA, 22 bp, Homo sapiens
gggatggggagctggaaagggg

SEQ ID NO: 9432053 - DNA, 22 bp, Homo sapiens
gggatggggagctggaaagggg

SEQ ID NO: 9432054 - DNA, 22 bp, Homo sapiens
gggcagaggggcgcttccctct

SEQ ID NO: 9432055 - DNA, 22 bp, Homo sapiens
gggcagaggggcgcttccctct

SEQ ID NO: 9432056 - DNA, 22 bp, Homo sapiens
gggcagaggggcgcttccctct

SEQ ID NO: 9432057 - DNA, 22 bp, Homo sapiens
gggcagaggggcgcttccctct

SEQ ID NO: 9432058 - DNA, 22 bp, Homo sapiens
gggatggggagctggaaagggg

SEQ ID NO: 9432059 - DNA, 22 bp, Homo sapiens
gggatggggagctggaaagggg

SEQ ID NO: 9432060 - DNA, 22 bp, Homo sapiens
gggatggggagctggaaagggg

SEQ ID NO: 9432061 - DNA, 22 bp, Homo sapiens
gggatggggagctggaaagggg

SEQ ID NO: 9432062 - DNA, 22 bp, Homo sapiens
gggatggggagctggaaagggg

SEQ ID NO: 9432063 - DNA, 22 bp, Homo sapiens
gggatggagggtagagcaagtg

SEQ ID NO: 9432064 - DNA, 22 bp, Homo sapiens
gggatggacttggggactccag

SEQ ID NO: 9432065 - DNA, 22 bp, Homo sapiens
gggatggacttggggactccag

SEQ ID NO: 9432066 - DNA, 22 bp, Homo sapiens
gggatggatcttggctgaggct

SEQ ID NO: 9432067 - DNA, 22 bp, Homo sapiens
gggatggctgcctgcatcagga

SEQ ID NO: 9432068 - DNA, 22 bp, Homo sapiens
gggatggctcaaaggagtcagg

SEQ ID NO: 9432069 - DNA, 22 bp, Homo sapiens
gggatggatcttggctgaggct

SEQ ID NO: 9432070 - DNA, 22 bp, Homo sapiens
gggatggatcttggctgaggct

SEQ ID NO: 9432071 - DNA, 19 bp, Homo sapiens
gggatgcactctgaccact

SEQ ID NO: 9432072 - DNA, 19 bp, Homo sapiens
gggatgcactctgaccact

SEQ ID NO: 9432073 - DNA, 22 bp, Homo sapiens
gggatgctggtgcctgtggcac

SEQ ID NO: 9432074 - DNA, 22 bp, Homo sapiens
gggatggactgacggtagcgcg

SEQ ID NO: 9432075 - DNA, 22 bp, Homo sapiens
gggatggactgacggtagcgcg

SEQ ID NO: 9432076 - DNA, 22 bp, Homo sapiens
gggatgcagtcagagcccctgt

SEQ ID NO: 9432077 - DNA, 22 bp, Homo sapiens
gggagggacacaaagagttccc

SEQ ID NO: 9432078 - DNA, 22 bp, Homo sapiens
gggatctgacttgctggtgggt

SEQ ID NO: 9432079 - DNA, 21 bp, Homo sapiens
gggatctgaggcaagtctcct

SEQ ID NO: 9432080 - DNA, 22 bp, Homo sapiens
gggatctgagtaggcagaagct

SEQ ID NO: 9432081 - DNA, 22 bp, Homo sapiens
gggatctgagttgtcaggaagg

SEQ ID NO: 9432082 - DNA, 22 bp, Homo sapiens
gggatctgagtaggcagaagct

SEQ ID NO: 9432083 - DNA, 22 bp, Homo sapiens
gggatctgatgcactgctgaaa

SEQ ID NO: 9432084 - DNA, 22 bp, Homo sapiens
gggagggaaagcttgatctgtc

SEQ ID NO: 9432085 - DNA, 22 bp, Homo sapiens
gggagggaaagcttgatctgtc

SEQ ID NO: 9432086 - DNA, 22 bp, Homo sapiens
gggaggcttgagccatactgcc

SEQ ID NO: 9432087 - DNA, 22 bp, Homo sapiens
gggaggctggctctggccacag

SEQ ID NO: 9432088 - DNA, 22 bp, Homo sapiens
gggaggctggctctggccacag

SEQ ID NO: 9432089 - DNA, 22 bp, Homo sapiens
gggagggaaggtacctgtgtga

SEQ ID NO: 9432090 - DNA, 22 bp, Homo sapiens
gggagggaaggtacctgtgtga

SEQ ID NO: 9432091 - DNA, 22 bp, Homo sapiens
gggagggaaggtacctgtgtga

SEQ ID NO: 9432092 - DNA, 22 bp, Homo sapiens
gggagggaaagcttgatctgtc

SEQ ID NO: 9432093 - DNA, 22 bp, Homo sapiens
gggagggaaggaccttatgaat

SEQ ID NO: 9432094 - DNA, 22 bp, Homo sapiens
gggagggaaggaccttatgaat

SEQ ID NO: 9432095 - DNA, 22 bp, Homo sapiens
gggagggaaggaggcgccgtgt

SEQ ID NO: 9432096 - DNA, 18 bp, Homo sapiens
gggaggccccagcaggag

SEQ ID NO: 9432097 - DNA, 18 bp, Homo sapiens
gggaggccccagcaggag

SEQ ID NO: 9432098 - DNA, 22 bp, Homo sapiens
gggaggcgccgagggtagctaa

SEQ ID NO: 9432099 - DNA, 22 bp, Homo sapiens
gggaggctcagtggtgtcctct

SEQ ID NO: 9432100 - DNA, 22 bp, Homo sapiens
gggaggctgccatccttcagga

SEQ ID NO: 9432101 - DNA, 22 bp, Homo sapiens
gggaggctgccatccttcagga

SEQ ID NO: 9432102 - DNA, 22 bp, Homo sapiens
gggaggctggctctggccacag

SEQ ID NO: 9432103 - DNA, 22 bp, Homo sapiens
gggaggctctgctcagcccccg

SEQ ID NO: 9432104 - DNA, 22 bp, Homo sapiens
gggaggctgccatccttcagga

SEQ ID NO: 9432105 - DNA, 22 bp, Homo sapiens
gggaggctgccatccttcagga

SEQ ID NO: 9432106 - DNA, 22 bp, Homo sapiens
gggaggctctgctcagcccccg

SEQ ID NO: 9432107 - DNA, 22 bp, Homo sapiens
gggaggctctgctcagcccccg

SEQ ID NO: 9432108 - DNA, 22 bp, Homo sapiens
gggaggctcagtggtgtcctct

SEQ ID NO: 9432109 - DNA, 20 bp, Homo sapiens
gggagaagggctgatgagag

SEQ ID NO: 9432110 - DNA, 20 bp, Homo sapiens
gggagaagggctgatgagag

SEQ ID NO: 9432111 - DNA, 20 bp, Homo sapiens
gggagaagggctgatgagag

SEQ ID NO: 9432112 - DNA, 20 bp, Homo sapiens
gggagaagggctgatgagag

SEQ ID NO: 9432113 - DNA, 22 bp, Homo sapiens
gggagaaggaggactgtgctgt

SEQ ID NO: 9432114 - DNA, 22 bp, Homo sapiens
gggagaaggagctagttcttga

SEQ ID NO: 9432115 - DNA, 22 bp, Homo sapiens
gggaggagggtgctggctaaac

SEQ ID NO: 9432116 - DNA, 20 bp, Homo sapiens
gggaggccccagagtccagg

SEQ ID NO: 9432117 - DNA, 22 bp, Homo sapiens
gggaggagggtgctggctaaac

SEQ ID NO: 9432118 - DNA, 22 bp, Homo sapiens
gggaggaggaatgttttgtgta

SEQ ID NO: 9432119 - DNA, 22 bp, Homo sapiens
gggaggagcttggagattcact

SEQ ID NO: 9432120 - DNA, 20 bp, Homo sapiens
gggagaagggctgatgagag

SEQ ID NO: 9432121 - DNA, 22 bp, Homo sapiens
gggacgacaggctctgtggtag

SEQ ID NO: 9432122 - DNA, 22 bp, Homo sapiens
gggacctgaggccctgctccac

SEQ ID NO: 9432123 - DNA, 22 bp, Homo sapiens
gggaccataactaggcatgatg

SEQ ID NO: 9432124 - DNA, 22 bp, Homo sapiens
gggaccctcaacatctgcttct

SEQ ID NO: 9432125 - DNA, 22 bp, Homo sapiens
gggaccagtgtctgtgagaaaa

SEQ ID NO: 9432126 - DNA, 22 bp, Homo sapiens
gggaccagtgtctgtgagaaaa

SEQ ID NO: 9432127 - DNA, 22 bp, Homo sapiens
gggaccaggtcagggctctgac

SEQ ID NO: 9432128 - DNA, 22 bp, Homo sapiens
gggagaaggagctagttcttga

SEQ ID NO: 9432129 - DNA, 22 bp, Homo sapiens
gggagaagaatgtgtcaattgt

SEQ ID NO: 9432130 - DNA, 22 bp, Homo sapiens
gggactccagggccactgggcc

SEQ ID NO: 9432131 - DNA, 22 bp, Homo sapiens
gggactccataagcacatggat

SEQ ID NO: 9432132 - DNA, 22 bp, Homo sapiens
gggacgagatcttggcagtgtg

SEQ ID NO: 9432133 - DNA, 22 bp, Homo sapiens
gggacgagccccaggctggagg

SEQ ID NO: 9432134 - DNA, 22 bp, Homo sapiens
gtgcgtgtgcctatcaataaag

SEQ ID NO: 9432135 - DNA, 22 bp, Homo sapiens
gtgctaagtgcaggatattgaa

SEQ ID NO: 9432136 - DNA, 20 bp, Homo sapiens
gtgctaagtactgtgaaggg

SEQ ID NO: 9432137 - DNA, 22 bp, Homo sapiens
gtgctacagactgagtacactt

SEQ ID NO: 9432138 - DNA, 22 bp, Homo sapiens
gtgctacagactgagtacactt

SEQ ID NO: 9432139 - DNA, 22 bp, Homo sapiens
gtgcgggggttcccagcagccg

SEQ ID NO: 9432140 - DNA, 22 bp, Homo sapiens
gtgcgggggttcccagcagccg

SEQ ID NO: 9432141 - DNA, 22 bp, Homo sapiens
gtgcgggcctgggggtttctct

SEQ ID NO: 9432142 - DNA, 22 bp, Homo sapiens
gtgcgtcctgggggctgggtcg

SEQ ID NO: 9432143 - DNA, 22 bp, Homo sapiens
gtgcgtggttctagatcctgtc

SEQ ID NO: 9432144 - DNA, 22 bp, Homo sapiens
gtgcgtgaggcccctgagcgaa

SEQ ID NO: 9432145 - DNA, 22 bp, Homo sapiens
gtgcgcttcttcctgagccagg

SEQ ID NO: 9432146 - DNA, 23 bp, Homo sapiens
gtgcgccaggacaacctgacgga

SEQ ID NO: 9432147 - DNA, 23 bp, Homo sapiens
gtgcgccaggacaacctgacgga

SEQ ID NO: 9432148 - DNA, 22 bp, Homo sapiens
gtgcgggcctgggggtttctct

SEQ ID NO: 9432149 - DNA, 22 bp, Homo sapiens
gtgcgggcctgggggtttctct

SEQ ID NO: 9432150 - DNA, 22 bp, Homo sapiens
gtgccttccccggtggtctgtt

SEQ ID NO: 9432151 - DNA, 22 bp, Homo sapiens
gtgccttttcttcatagttact

SEQ ID NO: 9432152 - DNA, 22 bp, Homo sapiens
gtgcctttgtgtctaaaacagc

SEQ ID NO: 9432153 - DNA, 20 bp, Homo sapiens
gtgcctggagaagaggctgt

SEQ ID NO: 9432154 - DNA, 20 bp, Homo sapiens
gtgcctggagaagaggctgt

SEQ ID NO: 9432155 - DNA, 20 bp, Homo sapiens
gtgcctggagaagaggctgt

SEQ ID NO: 9432156 - DNA, 22 bp, Homo sapiens
gtgcctggcacacagaaggcaa

SEQ ID NO: 9432157 - DNA, 20 bp, Homo sapiens
gtgcctggagaagaggctgt

SEQ ID NO: 9432158 - DNA, 20 bp, Homo sapiens
gtgcctggagaagaggctgt

SEQ ID NO: 9432159 - DNA, 22 bp, Homo sapiens
gtgcctggagctaatgtgtata

SEQ ID NO: 9432160 - DNA, 22 bp, Homo sapiens
gtgcctggcatgcgccggtgct

SEQ ID NO: 9432161 - DNA, 22 bp, Homo sapiens
gtgcctgtttgtagactggaca

SEQ ID NO: 9432162 - DNA, 22 bp, Homo sapiens
gtgcctgtttcttttgaattca

SEQ ID NO: 9432163 - DNA, 22 bp, Homo sapiens
gtgcctggcagggtcagctgct

SEQ ID NO: 9432164 - DNA, 22 bp, Homo sapiens
gtgcctggcagggtcagctgct

SEQ ID NO: 9432165 - DNA, 22 bp, Homo sapiens
gtgcctggcagggtcagctgct

SEQ ID NO: 9432166 - DNA, 22 bp, Homo sapiens
gtgcctggcagggtcagctgct

SEQ ID NO: 9432167 - DNA, 22 bp, Homo sapiens
gtggaagggactgcctagagga

SEQ ID NO: 9432168 - DNA, 20 bp, Homo sapiens
gtggaatgcactctgtgctg

SEQ ID NO: 9432169 - DNA, 22 bp, Homo sapiens
gtggaatggccatgggatcctt

SEQ ID NO: 9432170 - DNA, 22 bp, Homo sapiens
gtggaatgtccttgatcataag

SEQ ID NO: 9432171 - DNA, 22 bp, Homo sapiens
gtggaattatgcatttcttcac

SEQ ID NO: 9432172 - DNA, 22 bp, Homo sapiens
gtggaaggtgctagaacaagga

SEQ ID NO: 9432173 - DNA, 22 bp, Homo sapiens
gtggaatgaatagatttgcatt

SEQ ID NO: 9432174 - DNA, 22 bp, Homo sapiens
gtggaagaggcaagatagctct

SEQ ID NO: 9432175 - DNA, 22 bp, Homo sapiens
gtggaagcctactcttgtggtt

SEQ ID NO: 9432176 - DNA, 22 bp, Homo sapiens
gtggaagcagtaaggcaagttt

SEQ ID NO: 9432177 - DNA, 22 bp, Homo sapiens
gtggaacatgtccatatacatt

SEQ ID NO: 9432178 - DNA, 22 bp, Homo sapiens
gtggaacagcctgtgcaaacct

SEQ ID NO: 9432179 - DNA, 22 bp, Homo sapiens
gtgctttttataaggcagactg

SEQ ID NO: 9432180 - DNA, 22 bp, Homo sapiens
gtgctttttcaatcagaaggga

SEQ ID NO: 9432181 - DNA, 22 bp, Homo sapiens
gtggaaaactgagaaaattgct

SEQ ID NO: 9432182 - DNA, 22 bp, Homo sapiens
gtgctttttcaatcagaaggga

SEQ ID NO: 9432183 - DNA, 22 bp, Homo sapiens
gtggaaatagtttggttataga

SEQ ID NO: 9432184 - DNA, 22 bp, Homo sapiens
gtggaaatgcccccaaatagtg

SEQ ID NO: 9432185 - DNA, 22 bp, Homo sapiens
gtgacagagtgagaccctgtct

SEQ ID NO: 9432186 - DNA, 22 bp, Homo sapiens
gtgacagatttgctgcgcatgg

SEQ ID NO: 9432187 - DNA, 22 bp, Homo sapiens
gtgacagcatgaggaatcaatg

SEQ ID NO: 9432188 - DNA, 22 bp, Homo sapiens
gtgacagattatagggagcgtt

SEQ ID NO: 9432189 - DNA, 22 bp, Homo sapiens
gtgacagagttttagatctcat

SEQ ID NO: 9432190 - DNA, 22 bp, Homo sapiens
gtgacaggcatggggtcatgca

SEQ ID NO: 9432191 - DNA, 22 bp, Homo sapiens
gtgacagctccttggttagatg

SEQ ID NO: 9432192 - DNA, 22 bp, Homo sapiens
gtgacagccttcagtgtctctg

SEQ ID NO: 9432193 - DNA, 22 bp, Homo sapiens
gtgacagcctcttgggaggttg

SEQ ID NO: 9432194 - DNA, 22 bp, Homo sapiens
gtgacagctccttggttagatg

SEQ ID NO: 9432195 - DNA, 18 bp, Homo sapiens
gtgacagctgctagctca

SEQ ID NO: 9432196 - DNA, 22 bp, Homo sapiens
gtgacaggcccagtgggatgca

SEQ ID NO: 9432197 - DNA, 22 bp, Homo sapiens
gtgacaggccactgcggctctg

SEQ ID NO: 9432198 - DNA, 22 bp, Homo sapiens
gtgacaggcccagtgggatgca

SEQ ID NO: 9432199 - DNA, 20 bp, Homo sapiens
gtgaagggagtcaggtgtgc

SEQ ID NO: 9432200 - DNA, 22 bp, Homo sapiens
gtgaaggccagtagggtcctgg

SEQ ID NO: 9432201 - DNA, 22 bp, Homo sapiens
gtgacactggtttaggtatgta

SEQ ID NO: 9432202 - DNA, 22 bp, Homo sapiens
gtgacacccgcatgccactgtg

SEQ ID NO: 9432203 - DNA, 22 bp, Homo sapiens
gtgacagaaacagggctagaat

SEQ ID NO: 9432204 - DNA, 22 bp, Homo sapiens
gtgacaaaaacactgattattt

SEQ ID NO: 9432205 - DNA, 22 bp, Homo sapiens
gtgacaaaggtcaagcttttga

SEQ ID NO: 9432206 - DNA, 22 bp, Homo sapiens
gtgacaaatgcaaattgggctg

SEQ ID NO: 9432207 - DNA, 22 bp, Homo sapiens
gtgaccagagcgggagattggg

SEQ ID NO: 9432208 - DNA, 20 bp, Homo sapiens
gtgaccagaagacagtgggt

SEQ ID NO: 9432209 - DNA, 22 bp, Homo sapiens
gtgaccagccagtgctgtctgt

SEQ ID NO: 9432210 - DNA, 22 bp, Homo sapiens
gtgaccagcccatagagaggcg

SEQ ID NO: 9432211 - DNA, 20 bp, Homo sapiens
gtgaccagaagacagtgggt

SEQ ID NO: 9432212 - DNA, 22 bp, Homo sapiens
gtgacatttcgtgacgtgagaa

SEQ ID NO: 9432213 - DNA, 22 bp, Homo sapiens
gtgacatttttactgatgagag

SEQ ID NO: 9432214 - DNA, 22 bp, Homo sapiens
gtgacattttttaagcccttgt

SEQ ID NO: 9432215 - DNA, 22 bp, Homo sapiens
gtgacagtgacagctagatagt

SEQ ID NO: 9432216 - DNA, 22 bp, Homo sapiens
gtgacaggtatactcaccattg

SEQ ID NO: 9432217 - DNA, 22 bp, Homo sapiens
gtgacagtcaaagacatgactt

SEQ ID NO: 9432218 - DNA, 22 bp, Homo sapiens
gtgacattgctaggaacagatt

SEQ ID NO: 9432219 - DNA, 22 bp, Homo sapiens
gtgacattgctaggaacagatt

SEQ ID NO: 9432220 - DNA, 22 bp, Homo sapiens
gtgacattcaggatatcaatgg

SEQ ID NO: 9432221 - DNA, 22 bp, Homo sapiens
gtgacatttacgaatcttatcc

SEQ ID NO: 9432222 - DNA, 22 bp, Homo sapiens
gtgacatttacgaatcttatcc

SEQ ID NO: 9432223 - DNA, 22 bp, Homo sapiens
gtgacatttattagatgcttac

SEQ ID NO: 9432224 - DNA, 22 bp, Homo sapiens
gtgcctgctgcagctgagcagt

SEQ ID NO: 9432225 - DNA, 22 bp, Homo sapiens
gtgcctgctgcagagtcgctgt

SEQ ID NO: 9432226 - DNA, 22 bp, Homo sapiens
gtgcctgctgcagagtcgctgt

SEQ ID NO: 9432227 - DNA, 22 bp, Homo sapiens
gtgcctgctacctgacttgttt

SEQ ID NO: 9432228 - DNA, 22 bp, Homo sapiens
gtgcctgccccactcctcagca

SEQ ID NO: 9432229 - DNA, 22 bp, Homo sapiens
gtgcctgctacctgacttgttt

SEQ ID NO: 9432230 - DNA, 22 bp, Homo sapiens
gtgaccagtgatgctgaggagt

SEQ ID NO: 9432231 - DNA, 22 bp, Homo sapiens
gtgaccagttggcaggggtggg

SEQ ID NO: 9432232 - DNA, 22 bp, Homo sapiens
gtgaccagttggcaggggtggg

SEQ ID NO: 9432233 - DNA, 22 bp, Homo sapiens
gtgcctgcagcaatccatggca

SEQ ID NO: 9432234 - DNA, 22 bp, Homo sapiens
gtgcctgcagcaatccatggca

SEQ ID NO: 9432235 - DNA, 22 bp, Homo sapiens
gtgcctgccccactcctcagca

SEQ ID NO: 9432236 - DNA, 22 bp, Homo sapiens
gtgcctgccccactcctcagca

SEQ ID NO: 9432237 - DNA, 22 bp, Homo sapiens
gtgcctgcaggtgccggcttca

SEQ ID NO: 9432238 - DNA, 22 bp, Homo sapiens
gtgcctggaactgggtaggctg

SEQ ID NO: 9432239 - DNA, 22 bp, Homo sapiens
gtgcctgctgcagctgagcagt

SEQ ID NO: 9432240 - DNA, 22 bp, Homo sapiens
gtgcctggaactgggtaggctg

SEQ ID NO: 9432241 - DNA, 22 bp, Homo sapiens
gtgcctggaatgcgcctcggcg

SEQ ID NO: 9432242 - DNA, 22 bp, Homo sapiens
gtgcctggaatgcgcctcggcg

SEQ ID NO: 9432243 - DNA, 22 bp, Homo sapiens
gtgcctggaatgcgcctcggcg

SEQ ID NO: 9432244 - DNA, 22 bp, Homo sapiens
gtgcctggaccctctttccgga

SEQ ID NO: 9432245 - DNA, 22 bp, Homo sapiens
gtggcagagggtgagctggact

SEQ ID NO: 9432246 - DNA, 22 bp, Homo sapiens
gtggcagagggtgagctggact

SEQ ID NO: 9432247 - DNA, 22 bp, Homo sapiens
gtggcagagggtgagctggact

SEQ ID NO: 9432248 - DNA, 22 bp, Homo sapiens
gtggcagagggtgagctggact

SEQ ID NO: 9432249 - DNA, 22 bp, Homo sapiens
gtggcagagggtgagctggact

SEQ ID NO: 9432250 - DNA, 22 bp, Homo sapiens
gtggcagaggctgtgaggatgc

SEQ ID NO: 9432251 - DNA, 22 bp, Homo sapiens
gtggcagaggctgtgaggatgc

SEQ ID NO: 9432252 - DNA, 22 bp, Homo sapiens
gtggcagaggctctgggaccag

SEQ ID NO: 9432253 - DNA, 22 bp, Homo sapiens
gtggcagaggctctgggaccag

SEQ ID NO: 9432254 - DNA, 22 bp, Homo sapiens
gtggcagagccttgcggctttg

SEQ ID NO: 9432255 - DNA, 22 bp, Homo sapiens
gtggcagagccgtgcaggtagg

SEQ ID NO: 9432256 - DNA, 22 bp, Homo sapiens
gtggcagattgctcaccatggt

SEQ ID NO: 9432257 - DNA, 22 bp, Homo sapiens
gtggcagattgctcaccatggt

SEQ ID NO: 9432258 - DNA, 22 bp, Homo sapiens
gtggcagagttgctgactagaa

SEQ ID NO: 9432259 - DNA, 22 bp, Homo sapiens
gtggcagagttgctgactagaa

SEQ ID NO: 9432260 - DNA, 22 bp, Homo sapiens
gtggcagaggttcctcagtgtg

SEQ ID NO: 9432261 - DNA, 22 bp, Homo sapiens
gtggcagaggttcctcagtgtg

SEQ ID NO: 9432262 - DNA, 22 bp, Homo sapiens
gtggcagaggttcctcagtgtg

SEQ ID NO: 9432263 - DNA, 22 bp, Homo sapiens
gtggcagaggttcctcagtgtg

SEQ ID NO: 9432264 - DNA, 22 bp, Homo sapiens
gtggcagagtgcggttctgacc

SEQ ID NO: 9432265 - DNA, 22 bp, Homo sapiens
gtggcagagtgcggttctgacc

SEQ ID NO: 9432266 - DNA, 22 bp, Homo sapiens
gtggcagagttcaggcgtttgg

SEQ ID NO: 9432267 - DNA, 22 bp, Homo sapiens
gtggcagcggcccaggccgtct

SEQ ID NO: 9432268 - DNA, 22 bp, Homo sapiens
gtggcagcggcccaggccgtct

SEQ ID NO: 9432269 - DNA, 22 bp, Homo sapiens
gtggcagctacatttaatgcaa

SEQ ID NO: 9432270 - DNA, 22 bp, Homo sapiens
gtggcagcggtgtgcaaggagg

SEQ ID NO: 9432271 - DNA, 22 bp, Homo sapiens
gtggcagctcatgttgttttaa

SEQ ID NO: 9432272 - DNA, 16 bp, Homo sapiens
gtggcagccccttctc

SEQ ID NO: 9432273 - DNA, 22 bp, Homo sapiens
gtggcagccgcaggccctgtgt

SEQ ID NO: 9432274 - DNA, 18 bp, Homo sapiens
gtggcagcctttggcttt

SEQ ID NO: 9432275 - DNA, 19 bp, Homo sapiens
gtggcagcagatttggtgt

SEQ ID NO: 9432276 - DNA, 22 bp, Homo sapiens
gtggcagcagaggggtggtatg

SEQ ID NO: 9432277 - DNA, 22 bp, Homo sapiens
gtggcagcagaggggtggtatg

SEQ ID NO: 9432278 - DNA, 22 bp, Homo sapiens
gtggcagcatggcttttagctg

SEQ ID NO: 9432279 - DNA, 22 bp, Homo sapiens
gtggcagccatgagaatataac

SEQ ID NO: 9432280 - DNA, 22 bp, Homo sapiens
gtggcagcaggtactcacgcac

SEQ ID NO: 9432281 - DNA, 22 bp, Homo sapiens
gtggcagcaggtactcacgcac

SEQ ID NO: 9432282 - DNA, 22 bp, Homo sapiens
gtggcagcaaaatcctgcattc

SEQ ID NO: 9432283 - DNA, 22 bp, Homo sapiens
gtggcagcaaatgcctggacta

SEQ ID NO: 9432284 - DNA, 22 bp, Homo sapiens
gtggatggagctggaagccatt

SEQ ID NO: 9432285 - DNA, 22 bp, Homo sapiens
gtggatggagctggaagccatt

SEQ ID NO: 9432286 - DNA, 22 bp, Homo sapiens
gtggatggagcagtgacccagg

SEQ ID NO: 9432287 - DNA, 22 bp, Homo sapiens
gtggattacaagacagttgaga

SEQ ID NO: 9432288 - DNA, 22 bp, Homo sapiens
gtggatggctagttgagaaggg

SEQ ID NO: 9432289 - DNA, 22 bp, Homo sapiens
gtggcacatgctgctgcttctg

SEQ ID NO: 9432290 - DNA, 22 bp, Homo sapiens
gtggcacagtgggagagcccca

SEQ ID NO: 9432291 - DNA, 22 bp, Homo sapiens
gtggcacattggtagggtctgt

SEQ ID NO: 9432292 - DNA, 22 bp, Homo sapiens
gtggcagagccaaggctggagc

SEQ ID NO: 9432293 - DNA, 22 bp, Homo sapiens
gtggcagagccaggctttgaac

SEQ ID NO: 9432294 - DNA, 22 bp, Homo sapiens
gtggcagagccgtgcaggtagg

SEQ ID NO: 9432295 - DNA, 22 bp, Homo sapiens
gtggacaggcaggctgtcgggg

SEQ ID NO: 9432296 - DNA, 22 bp, Homo sapiens
gtggacatgcatacatatgttt

SEQ ID NO: 9432297 - DNA, 22 bp, Homo sapiens
gtggaccaaggtggaagataaa

SEQ ID NO: 9432298 - DNA, 22 bp, Homo sapiens
gtggactggcagtgaccttggt

SEQ ID NO: 9432299 - DNA, 22 bp, Homo sapiens
gtggagagagataagcctggtc

SEQ ID NO: 9432300 - DNA, 22 bp, Homo sapiens
gtggagagagataagcctggtc

SEQ ID NO: 9432301 - DNA, 22 bp, Homo sapiens
gtggacagagataataaactga

SEQ ID NO: 9432302 - DNA, 22 bp, Homo sapiens
gtggacagagctagaaaatgtg

SEQ ID NO: 9432303 - DNA, 22 bp, Homo sapiens
gtggacagagactaaatgttgt

SEQ ID NO: 9432304 - DNA, 22 bp, Homo sapiens
gtggaatttttacctatgaatg

SEQ ID NO: 9432305 - DNA, 22 bp, Homo sapiens
gtggacagacataatcctaatt

SEQ ID NO: 9432306 - DNA, 22 bp, Homo sapiens
gtggaattgctggataatatca

SEQ ID NO: 9432307 - DNA, 22 bp, Homo sapiens
gtggacagcttctaggtgccag

SEQ ID NO: 9432308 - DNA, 22 bp, Homo sapiens
gtggacagagataataaactga

SEQ ID NO: 9432309 - DNA, 22 bp, Homo sapiens
gtggagccctgccttgctcatg

SEQ ID NO: 9432310 - DNA, 22 bp, Homo sapiens
gtggagccctgccttgctcatg

SEQ ID NO: 9432311 - DNA, 22 bp, Homo sapiens
gtggagccctggtagggacccc

SEQ ID NO: 9432312 - DNA, 22 bp, Homo sapiens
gtggaggaaaagaagttgggtg

SEQ ID NO: 9432313 - DNA, 22 bp, Homo sapiens
gtggaggacaaaagaagccttt

SEQ ID NO: 9432314 - DNA, 22 bp, Homo sapiens
gtggaggaagggattcagacca

SEQ ID NO: 9432315 - DNA, 22 bp, Homo sapiens
gtggaggacaaaagaagccttt

SEQ ID NO: 9432316 - DNA, 22 bp, Homo sapiens
gtggaggacaaaagaagccttt

SEQ ID NO: 9432317 - DNA, 22 bp, Homo sapiens
gtggagggaatgaatcttctct

SEQ ID NO: 9432318 - DNA, 22 bp, Homo sapiens
gtggagggaatgaatcttctct

SEQ ID NO: 9432319 - DNA, 22 bp, Homo sapiens
gtggagggaatgaatcttctct

SEQ ID NO: 9432320 - DNA, 22 bp, Homo sapiens
gtggagggtgagctcatgtttg

SEQ ID NO: 9432321 - DNA, 22 bp, Homo sapiens
gtggagggaatgaatcttctct

SEQ ID NO: 9432322 - DNA, 22 bp, Homo sapiens
gtggaggacaaaagaagccttt

SEQ ID NO: 9432323 - DNA, 22 bp, Homo sapiens
gtggaggagaggcgccttgcgg

SEQ ID NO: 9432324 - DNA, 22 bp, Homo sapiens
gtggaggagaggcgccttgcgg

SEQ ID NO: 9432325 - DNA, 18 bp, Homo sapiens
gtggagggttctcagaat

SEQ ID NO: 9432326 - DNA, 18 bp, Homo sapiens
gtggagggttctcagaat

SEQ ID NO: 9432327 - DNA, 18 bp, Homo sapiens
gtggagggttctcagaat

SEQ ID NO: 9432328 - DNA, 22 bp, Homo sapiens
gtggagggtttgcaatgtgcag

SEQ ID NO: 9432329 - DNA, 22 bp, Homo sapiens
gtggagggtttgcaatgtgcag

SEQ ID NO: 9432330 - DNA, 22 bp, Homo sapiens
gtggagggtgattgccggctgt

SEQ ID NO: 9432331 - DNA, 22 bp, Homo sapiens
gtggagggtgattgccggctgt

SEQ ID NO: 9432332 - DNA, 22 bp, Homo sapiens
gtggagggtgattgccggctgt

SEQ ID NO: 9432333 - DNA, 22 bp, Homo sapiens
gtggagggtgattgccggctgt

SEQ ID NO: 9432334 - DNA, 22 bp, Homo sapiens
gtggagggtttgcaatgtgcag

SEQ ID NO: 9432335 - DNA, 22 bp, Homo sapiens
gtggaggtcccgggcaggagca

SEQ ID NO: 9432336 - DNA, 22 bp, Homo sapiens
gtggaggtcccgggcaggagca

SEQ ID NO: 9432337 - DNA, 22 bp, Homo sapiens
gtggagtgcaacggttggagtt

SEQ ID NO: 9432338 - DNA, 22 bp, Homo sapiens
gtggagtggcctggccctgaga

SEQ ID NO: 9432339 - DNA, 22 bp, Homo sapiens
gtggatgatgagtgactacaga

SEQ ID NO: 9432340 - DNA, 22 bp, Homo sapiens
gtggatgcttaggcagcctggg

SEQ ID NO: 9432341 - DNA, 22 bp, Homo sapiens
gtggatgattgactctgtagac

SEQ ID NO: 9432342 - DNA, 22 bp, Homo sapiens
gtggatctggctgtgtcctggc

SEQ ID NO: 9432343 - DNA, 22 bp, Homo sapiens
gtggatctggctctgtctggtc

SEQ ID NO: 9432344 - DNA, 22 bp, Homo sapiens
gtggatctcattcaccatggct

SEQ ID NO: 9432345 - DNA, 22 bp, Homo sapiens
gtggctctccattgacatggaa

SEQ ID NO: 9432346 - DNA, 22 bp, Homo sapiens
gtggctctcgccagcctgcggg

SEQ ID NO: 9432347 - DNA, 22 bp, Homo sapiens
gtggctctgtaaaatgcctgca

SEQ ID NO: 9432348 - DNA, 22 bp, Homo sapiens
gtggctctggctttccaggcgg

SEQ ID NO: 9432349 - DNA, 22 bp, Homo sapiens
gtggctgcagagccagcaagct

SEQ ID NO: 9432350 - DNA, 22 bp, Homo sapiens
gtggctgcagagccagcaagct

SEQ ID NO: 9432351 - DNA, 22 bp, Homo sapiens
gtggctgcagagccagcaagct

SEQ ID NO: 9432352 - DNA, 17 bp, Homo sapiens
gtggctgcacacacatg

SEQ ID NO: 9432353 - DNA, 17 bp, Homo sapiens
gtggctgcacacacatg

SEQ ID NO: 9432354 - DNA, 22 bp, Homo sapiens
gtggctgagcagcagagagctg

SEQ ID NO: 9432355 - DNA, 22 bp, Homo sapiens
gtggctgagtggtcgagtcaga

SEQ ID NO: 9432356 - DNA, 22 bp, Homo sapiens
gtggctgacaaccactggagga

SEQ ID NO: 9432357 - DNA, 22 bp, Homo sapiens
gtggctctaggtgagcatggag

SEQ ID NO: 9432358 - DNA, 22 bp, Homo sapiens
gtggctccttttcaggaggctg

SEQ ID NO: 9432359 - DNA, 19 bp, Homo sapiens
gtggctcatgtagtgggcc

SEQ ID NO: 9432360 - DNA, 22 bp, Homo sapiens
gtggctccgcaggctccattct

SEQ ID NO: 9432361 - DNA, 22 bp, Homo sapiens
gtggctcagcggagctctgcac

SEQ ID NO: 9432362 - DNA, 22 bp, Homo sapiens
gtggctcagttaacttccatgt

SEQ ID NO: 9432363 - DNA, 22 bp, Homo sapiens
gtggctcagttaacttccatgt

SEQ ID NO: 9432364 - DNA, 22 bp, Homo sapiens
gtggctcatctttgggaagtaa

SEQ ID NO: 9432365 - DNA, 22 bp, Homo sapiens
gtggctcatctttgggaagtaa

SEQ ID NO: 9432366 - DNA, 19 bp, Homo sapiens
gtggctcatgtagtgggcc

SEQ ID NO: 9432367 - DNA, 22 bp, Homo sapiens
gtggctcagcggagctctgcac

SEQ ID NO: 9432368 - DNA, 22 bp, Homo sapiens
gtggcctggctggcaccacctc

SEQ ID NO: 9432369 - DNA, 22 bp, Homo sapiens
gtggcctggcgagctggcgcgg

SEQ ID NO: 9432370 - DNA, 22 bp, Homo sapiens
gtggccctgtgaacagcgcagt

SEQ ID NO: 9432371 - DNA, 20 bp, Homo sapiens
gtggcccttaaagagggaag

SEQ ID NO: 9432372 - DNA, 22 bp, Homo sapiens
gtggcccttgaagcagcttcat

SEQ ID NO: 9432373 - DNA, 22 bp, Homo sapiens
gtggcccttggagttgtgacct

SEQ ID NO: 9432374 - DNA, 22 bp, Homo sapiens
gtggccctggagttgtgacact

SEQ ID NO: 9432375 - DNA, 22 bp, Homo sapiens
gtggccctgtcccaggcctcct

SEQ ID NO: 9432376 - DNA, 21 bp, Homo sapiens
gtggccctggtgtggctgcac

SEQ ID NO: 9432377 - DNA, 22 bp, Homo sapiens
gtggccctttgttttgatacct

SEQ ID NO: 9432378 - DNA, 22 bp, Homo sapiens
gtggccgccaggtcctcgtcca

SEQ ID NO: 9432379 - DNA, 22 bp, Homo sapiens
gtggcctctgttggctcctagg

SEQ ID NO: 9432380 - DNA, 22 bp, Homo sapiens
gtggcctctgtgctcctgccta

SEQ ID NO: 9432381 - DNA, 20 bp, Homo sapiens
gtggcctctcacattctgag

SEQ ID NO: 9432382 - DNA, 20 bp, Homo sapiens
gtggcctctcacattctgag

SEQ ID NO: 9432383 - DNA, 22 bp, Homo sapiens
gtggcctggaaaggctggtctg

SEQ ID NO: 9432384 - DNA, 22 bp, Homo sapiens
gtggcctggatagactccatct

SEQ ID NO: 9432385 - DNA, 22 bp, Homo sapiens
gtggcctggatagactccatct

SEQ ID NO: 9432386 - DNA, 22 bp, Homo sapiens
gtggcttcatcaactgtgctta

SEQ ID NO: 9432387 - DNA, 22 bp, Homo sapiens
gtggcttccatgtgcatctgac

SEQ ID NO: 9432388 - DNA, 22 bp, Homo sapiens
gtgggagaaattagctctagtt

SEQ ID NO: 9432389 - DNA, 22 bp, Homo sapiens
gtgggagaaattagctctagtt

SEQ ID NO: 9432390 - DNA, 22 bp, Homo sapiens
gtgggagaagatttggtcatct

SEQ ID NO: 9432391 - DNA, 22 bp, Homo sapiens
gtgggagccctcagggaggtgc

SEQ ID NO: 9432392 - DNA, 22 bp, Homo sapiens
gtgggagccctcagggaggtgc

SEQ ID NO: 9432393 - DNA, 22 bp, Homo sapiens
gtgggatgcagtggtgagtggc

SEQ ID NO: 9432394 - DNA, 22 bp, Homo sapiens
gtgggatgcagtggtgagtggc

SEQ ID NO: 9432395 - DNA, 22 bp, Homo sapiens
gtgggagtggggaagcagagtg

SEQ ID NO: 9432396 - DNA, 22 bp, Homo sapiens
gtgggagtggggaagcagagtg

SEQ ID NO: 9432397 - DNA, 22 bp, Homo sapiens
gtgggagtggggaagcagagtg

SEQ ID NO: 9432398 - DNA, 22 bp, Homo sapiens
gtgggagctttggcatcaggct

SEQ ID NO: 9432399 - DNA, 22 bp, Homo sapiens
gtgggagctgcggaggcctggg

SEQ ID NO: 9432400 - DNA, 22 bp, Homo sapiens
gtgggagctgcggaggcctggg

SEQ ID NO: 9432401 - DNA, 22 bp, Homo sapiens
gtgggagctgcggaggcctggg

SEQ ID NO: 9432402 - DNA, 22 bp, Homo sapiens
gtggctgctacagagctggagg

SEQ ID NO: 9432403 - DNA, 22 bp, Homo sapiens
gtggctgctaagtctccttcct

SEQ ID NO: 9432404 - DNA, 22 bp, Homo sapiens
gtggctgctacagagctggagg

SEQ ID NO: 9432405 - DNA, 22 bp, Homo sapiens
gtggctgctcgggctccggccc

SEQ ID NO: 9432406 - DNA, 22 bp, Homo sapiens
gtggctgctggtactctgggaa

SEQ ID NO: 9432407 - DNA, 22 bp, Homo sapiens
gtggctgcagcccagcggcacg

SEQ ID NO: 9432408 - DNA, 22 bp, Homo sapiens
gtggctgcagagggcacagcat

SEQ ID NO: 9432409 - DNA, 22 bp, Homo sapiens
gtggctgcagagggcacagcat

SEQ ID NO: 9432410 - DNA, 22 bp, Homo sapiens
gtggctgcagagccagcaagct

SEQ ID NO: 9432411 - DNA, 22 bp, Homo sapiens
gtggctgcatcggggtgaccag

SEQ ID NO: 9432412 - DNA, 22 bp, Homo sapiens
gtggctgcagctctgaacggac

SEQ ID NO: 9432413 - DNA, 22 bp, Homo sapiens
gtggctgcagcggctgtggaga

SEQ ID NO: 9432414 - DNA, 22 bp, Homo sapiens
gtggctgcagcccagcggcacg

SEQ ID NO: 9432415 - DNA, 22 bp, Homo sapiens
gtggctgggctccgagcggctt

SEQ ID NO: 9432416 - DNA, 22 bp, Homo sapiens
gtggctgggctccgagcggctt

SEQ ID NO: 9432417 - DNA, 22 bp, Homo sapiens
gtggctgggctccgagcggctt

SEQ ID NO: 9432418 - DNA, 22 bp, Homo sapiens
gtggctgggctccgagcggctt

SEQ ID NO: 9432419 - DNA, 22 bp, Homo sapiens
gtggctgctgtcctctctggtt

SEQ ID NO: 9432420 - DNA, 22 bp, Homo sapiens
gtggcttcaccccagttgtctc

SEQ ID NO: 9432421 - DNA, 22 bp, Homo sapiens
gtggcttcacatggcatttggc

SEQ ID NO: 9432422 - DNA, 22 bp, Homo sapiens
gtggcttcaccccagttgtctc

SEQ ID NO: 9432423 - DNA, 22 bp, Homo sapiens
gtggctggtttcctgcatgcaa

SEQ ID NO: 9432424 - DNA, 22 bp, Homo sapiens
gtggctggtttcctgcatgcaa

SEQ ID NO: 9432425 - DNA, 22 bp, Homo sapiens
gtggctggtttcctgcatgcaa

SEQ ID NO: 9432426 - DNA, 22 bp, Homo sapiens
gtggctggtttcctgcatgcaa

SEQ ID NO: 9432427 - DNA, 22 bp, Homo sapiens
gtggccagaagactgcaatgct

SEQ ID NO: 9432428 - DNA, 22 bp, Homo sapiens
gtggccagaagactgcaatgct

SEQ ID NO: 9432429 - DNA, 22 bp, Homo sapiens
gtggccagaagttaagtggtta

SEQ ID NO: 9432430 - DNA, 22 bp, Homo sapiens
gtggccagaagttaagtggtta

SEQ ID NO: 9432431 - DNA, 22 bp, Homo sapiens
gtggccagaaccaggagaatga

SEQ ID NO: 9432432 - DNA, 22 bp, Homo sapiens
gtggccagaaccaggagaatga

SEQ ID NO: 9432433 - DNA, 22 bp, Homo sapiens
gtggccagaaccaggagaatga

SEQ ID NO: 9432434 - DNA, 22 bp, Homo sapiens
gtggccagaaccaggagaatga

SEQ ID NO: 9432435 - DNA, 22 bp, Homo sapiens
gtggccagaagactgcaatgct

SEQ ID NO: 9432436 - DNA, 22 bp, Homo sapiens
gtggccagaatcttgaggcctt

SEQ ID NO: 9432437 - DNA, 22 bp, Homo sapiens
gtggccagaatcttgaggcctt

SEQ ID NO: 9432438 - DNA, 22 bp, Homo sapiens
gtggccagaatcttgaggcctt

SEQ ID NO: 9432439 - DNA, 22 bp, Homo sapiens
gtggccagagattaaatagagt

SEQ ID NO: 9432440 - DNA, 22 bp, Homo sapiens
gtggccagaggatttgttcagt

SEQ ID NO: 9432441 - DNA, 22 bp, Homo sapiens
gtggccagagattaaatagagt

SEQ ID NO: 9432442 - DNA, 22 bp, Homo sapiens
gtggccagagattaaatagagt

SEQ ID NO: 9432443 - DNA, 22 bp, Homo sapiens
gtggccagagattaaatagagt

SEQ ID NO: 9432444 - DNA, 22 bp, Homo sapiens
gtggccagaggtcccatgtgtc

SEQ ID NO: 9432445 - DNA, 22 bp, Homo sapiens
gtggccagaggtcccatgtgtc

SEQ ID NO: 9432446 - DNA, 22 bp, Homo sapiens
gtggccagaggtcccatgtgtc

SEQ ID NO: 9432447 - DNA, 22 bp, Homo sapiens
gtggccagaggtcccatgtgtc

SEQ ID NO: 9432448 - DNA, 22 bp, Homo sapiens
gtggccagaggtcccatgtgtc

SEQ ID NO: 9432449 - DNA, 22 bp, Homo sapiens
gtggccagagtgtcattttatt

SEQ ID NO: 9432450 - DNA, 22 bp, Homo sapiens
gtggccagcaagtgctgcctct

SEQ ID NO: 9432451 - DNA, 22 bp, Homo sapiens
gtggccagcaagtgctgcctct

SEQ ID NO: 9432452 - DNA, 22 bp, Homo sapiens
gtggccagccagggtgctgatg

SEQ ID NO: 9432453 - DNA, 22 bp, Homo sapiens
gtggccagccagggtgctgatg

SEQ ID NO: 9432454 - DNA, 22 bp, Homo sapiens
gtggccagccagggtgctgatg

SEQ ID NO: 9432455 - DNA, 22 bp, Homo sapiens
gtggccagccagggtgctgatg

SEQ ID NO: 9432456 - DNA, 22 bp, Homo sapiens
gtggccagccagggtgctgatg

SEQ ID NO: 9432457 - DNA, 18 bp, Homo sapiens
gtggccagcctggtcttg

SEQ ID NO: 9432458 - DNA, 22 bp, Homo sapiens
gtggccagccccatggacagtt

SEQ ID NO: 9432459 - DNA, 22 bp, Homo sapiens
gtggccagccccatggacagtt

SEQ ID NO: 9432460 - DNA, 22 bp, Homo sapiens
gtggccagccccatggacagtt

SEQ ID NO: 9432461 - DNA, 22 bp, Homo sapiens
gtggccaggacattgccaggca

SEQ ID NO: 9432462 - DNA, 22 bp, Homo sapiens
gtggccaggacattgccaggca

SEQ ID NO: 9432463 - DNA, 22 bp, Homo sapiens
gtggccaggacattgccaggca

SEQ ID NO: 9432464 - DNA, 22 bp, Homo sapiens
gtggccaggacattgccaggca

SEQ ID NO: 9432465 - DNA, 22 bp, Homo sapiens
gtggccagctgtcagcaccctt

SEQ ID NO: 9432466 - DNA, 22 bp, Homo sapiens
gtggccagctgtcagcaccctt

SEQ ID NO: 9432467 - DNA, 18 bp, Homo sapiens
gtggccagcctggtcttg

SEQ ID NO: 9432468 - DNA, 22 bp, Homo sapiens
gtggcccacacagacagcatct

SEQ ID NO: 9432469 - DNA, 22 bp, Homo sapiens
gtggcccacttacgtcatgtgt

SEQ ID NO: 9432470 - DNA, 22 bp, Homo sapiens
gtggcccacttacgtcatgtgt

SEQ ID NO: 9432471 - DNA, 22 bp, Homo sapiens
gtggcccagccctacagaggac

SEQ ID NO: 9432472 - DNA, 22 bp, Homo sapiens
gtggcccagccctacagaggac

SEQ ID NO: 9432473 - DNA, 22 bp, Homo sapiens
gtggccaggagaccttgggcat

SEQ ID NO: 9432474 - DNA, 22 bp, Homo sapiens
gtggccaggagaccttgggcat

SEQ ID NO: 9432475 - DNA, 22 bp, Homo sapiens
gtggccaggagagggtgggaca

SEQ ID NO: 9432476 - DNA, 22 bp, Homo sapiens
gtggccaggagagggtgggaca

SEQ ID NO: 9432477 - DNA, 22 bp, Homo sapiens
gtggccctaacaccgtttctca

SEQ ID NO: 9432478 - DNA, 22 bp, Homo sapiens
gtggccctatttgaggacccca

SEQ ID NO: 9432479 - DNA, 22 bp, Homo sapiens
gtggccctcagcagttgccaag

SEQ ID NO: 9432480 - DNA, 22 bp, Homo sapiens
gtggccctgagccctttgacag

SEQ ID NO: 9432481 - DNA, 22 bp, Homo sapiens
gtggccctctgatagggtcagg

SEQ ID NO: 9432482 - DNA, 21 bp, Homo sapiens
gtggccctgccgcagtgtcca

SEQ ID NO: 9432483 - DNA, 22 bp, Homo sapiens
gtggcccaggttggagtgcagt

SEQ ID NO: 9432484 - DNA, 22 bp, Homo sapiens
gtggcccatcacgtttcgcctt

SEQ ID NO: 9432485 - DNA, 22 bp, Homo sapiens
gtggcccaggctggagtgcagt

SEQ ID NO: 9432486 - DNA, 22 bp, Homo sapiens
gtggcccaggcttggcgctggc

SEQ ID NO: 9432487 - DNA, 22 bp, Homo sapiens
gtggcccaggcaccctgatgac

SEQ ID NO: 9432488 - DNA, 22 bp, Homo sapiens
gtggcccaggcaccctgatgac

SEQ ID NO: 9432489 - DNA, 20 bp, Homo sapiens
gtggcagtggtggcagcagt

SEQ ID NO: 9432490 - DNA, 22 bp, Homo sapiens
gtggcagtgtggagggaggagt

SEQ ID NO: 9432491 - DNA, 22 bp, Homo sapiens
gtggcaggggtattccagctga

SEQ ID NO: 9432492 - DNA, 22 bp, Homo sapiens
gtggcagggtgctcatcatgca

SEQ ID NO: 9432493 - DNA, 22 bp, Homo sapiens
gtggcatggagaaggaggcagt

SEQ ID NO: 9432494 - DNA, 22 bp, Homo sapiens
gtggcatgatgtcggcttagtg

SEQ ID NO: 9432495 - DNA, 22 bp, Homo sapiens
gtggcattgccttctgcaggaa

SEQ ID NO: 9432496 - DNA, 22 bp, Homo sapiens
gtggcattaggccaggtgcata

SEQ ID NO: 9432497 - DNA, 22 bp, Homo sapiens
gtggccaaggcagagaaagagc

SEQ ID NO: 9432498 - DNA, 22 bp, Homo sapiens
gtggcagggcaatgctccctct

SEQ ID NO: 9432499 - DNA, 22 bp, Homo sapiens
gtggcagggagaagccattggg

SEQ ID NO: 9432500 - DNA, 22 bp, Homo sapiens
gtggcaggatcacggctcactg

SEQ ID NO: 9432501 - DNA, 20 bp, Homo sapiens
gtggcaggcagtgaaggagc

SEQ ID NO: 9432502 - DNA, 20 bp, Homo sapiens
gtggcaggcagtgaaggagc

SEQ ID NO: 9432503 - DNA, 22 bp, Homo sapiens
gtggcaggagagacacagccat

SEQ ID NO: 9432504 - DNA, 22 bp, Homo sapiens
gtggcaggagtgggccttgaag

SEQ ID NO: 9432505 - DNA, 22 bp, Homo sapiens
gtggcagctgtgggacactggt

SEQ ID NO: 9432506 - DNA, 22 bp, Homo sapiens
gtggcagctgtgttgcagtttt

SEQ ID NO: 9432507 - DNA, 22 bp, Homo sapiens
gtggcagctgtgttgcagtttt

SEQ ID NO: 9432508 - DNA, 22 bp, Homo sapiens
gtggcagctggtatgcagacag

SEQ ID NO: 9432509 - DNA, 22 bp, Homo sapiens
gtggcagctgtgggacactggt

SEQ ID NO: 9432510 - DNA, 22 bp, Homo sapiens
gtggcagctctcttgatttccc

SEQ ID NO: 9432511 - DNA, 22 bp, Homo sapiens
gtctgagactgggcacatacct

SEQ ID NO: 9432512 - DNA, 22 bp, Homo sapiens
gtctgaatgatgagtgggactc

SEQ ID NO: 9432513 - DNA, 22 bp, Homo sapiens
gtctgaatacgtacttgtgaag

SEQ ID NO: 9432514 - DNA, 22 bp, Homo sapiens
gtctgaagccagtggtagtccg

SEQ ID NO: 9432515 - DNA, 22 bp, Homo sapiens
gtctcttttatggtgagttgat

SEQ ID NO: 9432516 - DNA, 22 bp, Homo sapiens
gtctcttttatggtgagttgat

SEQ ID NO: 9432517 - DNA, 22 bp, Homo sapiens
gtctctgagctctgagctggct

SEQ ID NO: 9432518 - DNA, 22 bp, Homo sapiens
gtctctgagctctgagctggct

SEQ ID NO: 9432519 - DNA, 22 bp, Homo sapiens
gtctgaggaagatgcaggggga

SEQ ID NO: 9432520 - DNA, 22 bp, Homo sapiens
gtctgaggaagatgcaggggga

SEQ ID NO: 9432521 - DNA, 22 bp, Homo sapiens
gtctgaggaagatgcaggggga

SEQ ID NO: 9432522 - DNA, 22 bp, Homo sapiens
gtctgagcccccgggaagctgg

SEQ ID NO: 9432523 - DNA, 22 bp, Homo sapiens
gtctgagcaccctggcctgtca

SEQ ID NO: 9432524 - DNA, 22 bp, Homo sapiens
gtctgagcaccctggcctgtca

SEQ ID NO: 9432525 - DNA, 20 bp, Homo sapiens
gtctgaggagcagtgggaaa

SEQ ID NO: 9432526 - DNA, 20 bp, Homo sapiens
gtctgaggagcagtgggaaa

SEQ ID NO: 9432527 - DNA, 20 bp, Homo sapiens
gtctgaggagcagtgggaaa

SEQ ID NO: 9432528 - DNA, 22 bp, Homo sapiens
gtctgaggcctgaggccctggg

SEQ ID NO: 9432529 - DNA, 22 bp, Homo sapiens
gtctgaggcctgaggccctggg

SEQ ID NO: 9432530 - DNA, 22 bp, Homo sapiens
gtctgaggcctgaggccctggg

SEQ ID NO: 9432531 - DNA, 22 bp, Homo sapiens
gtctgaggcctgaggccctggg

SEQ ID NO: 9432532 - DNA, 22 bp, Homo sapiens
gtctgagggacagagtcctggc

SEQ ID NO: 9432533 - DNA, 22 bp, Homo sapiens
gtctgagggacagagtcctggc

SEQ ID NO: 9432534 - DNA, 22 bp, Homo sapiens
gtctgagggacagagtcctggc

SEQ ID NO: 9432535 - DNA, 22 bp, Homo sapiens
gtctgagggacagagtcctggc

SEQ ID NO: 9432536 - DNA, 22 bp, Homo sapiens
gtctgaggcgaggcctgagaac

SEQ ID NO: 9432537 - DNA, 22 bp, Homo sapiens
gtctgagggacagagtcctggc

SEQ ID NO: 9432538 - DNA, 22 bp, Homo sapiens
gtctgagggacagagtcctggc

SEQ ID NO: 9432539 - DNA, 22 bp, Homo sapiens
gtctgaggcgaggcctgagaac

SEQ ID NO: 9432540 - DNA, 22 bp, Homo sapiens
gtctgaggcgaggcctgagaac

SEQ ID NO: 9432541 - DNA, 22 bp, Homo sapiens
gtctgaggcgaggcctgagaac

SEQ ID NO: 9432542 - DNA, 22 bp, Homo sapiens
gtctgagggagaaggatctggg

SEQ ID NO: 9432543 - DNA, 22 bp, Homo sapiens
gtctgaggggtttcccaggaca

SEQ ID NO: 9432544 - DNA, 22 bp, Homo sapiens
gtctgagggagaaggatctggg

SEQ ID NO: 9432545 - DNA, 22 bp, Homo sapiens
gtctgaggggtttcccaggaca

SEQ ID NO: 9432546 - DNA, 22 bp, Homo sapiens
gtctgagggagaaggatctggg

SEQ ID NO: 9432547 - DNA, 22 bp, Homo sapiens
gtctgaggggtttcccaggaca

SEQ ID NO: 9432548 - DNA, 22 bp, Homo sapiens
gtctgagggtcatgggtctcac

SEQ ID NO: 9432549 - DNA, 22 bp, Homo sapiens
gtctgaggggtttcccaggaca

SEQ ID NO: 9432550 - DNA, 22 bp, Homo sapiens
gtccttcaagtaacctgggacc

SEQ ID NO: 9432551 - DNA, 22 bp, Homo sapiens
gtccttcaaggtccttggtgtg

SEQ ID NO: 9432552 - DNA, 22 bp, Homo sapiens
gtccttcaagtaacctgggacc

SEQ ID NO: 9432553 - DNA, 22 bp, Homo sapiens
gtccttcagcacctccctcggc

SEQ ID NO: 9432554 - DNA, 21 bp, Homo sapiens
gtccttcagcaagttagtggc

SEQ ID NO: 9432555 - DNA, 22 bp, Homo sapiens
gtccttcagcacctccctcggc

SEQ ID NO: 9432556 - DNA, 22 bp, Homo sapiens
gtccttcatttcctgatctcta

SEQ ID NO: 9432557 - DNA, 22 bp, Homo sapiens
gtccttcatttcctgatctcta

SEQ ID NO: 9432558 - DNA, 22 bp, Homo sapiens
gtccttcatctggagcctggtc

SEQ ID NO: 9432559 - DNA, 22 bp, Homo sapiens
gtccttcagctttatctgaaca

SEQ ID NO: 9432560 - DNA, 22 bp, Homo sapiens
gtccttcctgcagggatggatg

SEQ ID NO: 9432561 - DNA, 22 bp, Homo sapiens
gtccttccccagccagctctgg

SEQ ID NO: 9432562 - DNA, 22 bp, Homo sapiens
gtccttgagtaagtcatggtgg

SEQ ID NO: 9432563 - DNA, 22 bp, Homo sapiens
gtccttcttttcatccctggtt

SEQ ID NO: 9432564 - DNA, 22 bp, Homo sapiens
gtccttggcctgggtagagtgg

SEQ ID NO: 9432565 - DNA, 22 bp, Homo sapiens
gtccttggcacccatgtgattc

SEQ ID NO: 9432566 - DNA, 22 bp, Homo sapiens
gtccttggagtcaggcaaggct

SEQ ID NO: 9432567 - DNA, 22 bp, Homo sapiens
gtccttggcatcatgatttggt

SEQ ID NO: 9432568 - DNA, 22 bp, Homo sapiens
gtccttggcacccatgtgattc

SEQ ID NO: 9432569 - DNA, 22 bp, Homo sapiens
gtccttggcacccatgtgattc

SEQ ID NO: 9432570 - DNA, 22 bp, Homo sapiens
gtccttggagctcccctctgta

SEQ ID NO: 9432571 - DNA, 22 bp, Homo sapiens
gtccttggaggtgtggaatctg

SEQ ID NO: 9432572 - DNA, 22 bp, Homo sapiens
gtccttggctgtggctgtaatg

SEQ ID NO: 9432573 - DNA, 22 bp, Homo sapiens
gtccttggcttcttgttgactg

SEQ ID NO: 9432574 - DNA, 22 bp, Homo sapiens
gtccttggggtcatccattatc

SEQ ID NO: 9432575 - DNA, 22 bp, Homo sapiens
gtccttggcttgaggcacctca

SEQ ID NO: 9432576 - DNA, 22 bp, Homo sapiens
gtcggccacgcaggtgcggtag

SEQ ID NO: 9432577 - DNA, 22 bp, Homo sapiens
gtcctttcttaaattcctgctt

SEQ ID NO: 9432578 - DNA, 22 bp, Homo sapiens
gtcctttttgtaaaatattcat

SEQ ID NO: 9432579 - DNA, 22 bp, Homo sapiens
gtcctttgtctctgatccagga

SEQ ID NO: 9432580 - DNA, 22 bp, Homo sapiens
gtctgggcaagggagatggcgc

SEQ ID NO: 9432581 - DNA, 22 bp, Homo sapiens
gtctgggcaagggagatggcgc

SEQ ID NO: 9432582 - DNA, 22 bp, Homo sapiens
gtctgggattggggtaaagaag

SEQ ID NO: 9432583 - DNA, 22 bp, Homo sapiens
gtctggctttcatggctctgca

SEQ ID NO: 9432584 - DNA, 22 bp, Homo sapiens
gtctgggccaggcgagccgagg

SEQ ID NO: 9432585 - DNA, 22 bp, Homo sapiens
gtctgggcatcagactgcgggc

SEQ ID NO: 9432586 - DNA, 22 bp, Homo sapiens
gtctgggcaggaatctgcattc

SEQ ID NO: 9432587 - DNA, 22 bp, Homo sapiens
gtctgggcaggaatctgcattc

SEQ ID NO: 9432588 - DNA, 22 bp, Homo sapiens
gtctgggcagcagcatttctta

SEQ ID NO: 9432589 - DNA, 22 bp, Homo sapiens
gtctgggcaagggagatggcgc

SEQ ID NO: 9432590 - DNA, 22 bp, Homo sapiens
gtctgggcaagggagatggcgc

SEQ ID NO: 9432591 - DNA, 22 bp, Homo sapiens
gtctgggcaagggagatggcgc

SEQ ID NO: 9432592 - DNA, 22 bp, Homo sapiens
gtctgggcacctggcctgggaa

SEQ ID NO: 9432593 - DNA, 22 bp, Homo sapiens
gtctgggcacctggcctgggaa

SEQ ID NO: 9432594 - DNA, 22 bp, Homo sapiens
gtctgggcacctggcctgggaa

SEQ ID NO: 9432595 - DNA, 17 bp, Homo sapiens
gtctgggctttagagac

SEQ ID NO: 9432596 - DNA, 22 bp, Homo sapiens
gtctggggaagtcagggcatca

SEQ ID NO: 9432597 - DNA, 22 bp, Homo sapiens
gtctgggggtccgggtgcctgc

SEQ ID NO: 9432598 - DNA, 22 bp, Homo sapiens
gtctgggcttagggacatggca

SEQ ID NO: 9432599 - DNA, 22 bp, Homo sapiens
gtctgggcttcagagttagaga

SEQ ID NO: 9432600 - DNA, 22 bp, Homo sapiens
gtctgggcttagggacatggca

SEQ ID NO: 9432601 - DNA, 22 bp, Homo sapiens
gtctgggctcctggcaggcagc

SEQ ID NO: 9432602 - DNA, 22 bp, Homo sapiens
gtctgggctcctggcaggcagc

SEQ ID NO: 9432603 - DNA, 22 bp, Homo sapiens
gtctgggccaggcgagccgagg

SEQ ID NO: 9432604 - DNA, 22 bp, Homo sapiens
gtctgggctcccagggtcggcg

SEQ ID NO: 9432605 - DNA, 22 bp, Homo sapiens
gtctgggctcccagggtcggcg

SEQ ID NO: 9432606 - DNA, 22 bp, Homo sapiens
gtctgggctcccagggtcggcg

SEQ ID NO: 9432607 - DNA, 22 bp, Homo sapiens
gtctgggctcctggcaggcagc

SEQ ID NO: 9432608 - DNA, 22 bp, Homo sapiens
gtctgggctcctggcaggcagc

SEQ ID NO: 9432609 - DNA, 22 bp, Homo sapiens
gtctggcctgccagctctggtg

SEQ ID NO: 9432610 - DNA, 22 bp, Homo sapiens
gtctggctaggcacgccgtgtt

SEQ ID NO: 9432611 - DNA, 22 bp, Homo sapiens
gtctggccatttgcccattgtg

SEQ ID NO: 9432612 - DNA, 22 bp, Homo sapiens
gtctggccatttgcccattgtg

SEQ ID NO: 9432613 - DNA, 22 bp, Homo sapiens
gtctggcatatgcaaagtgcat

SEQ ID NO: 9432614 - DNA, 22 bp, Homo sapiens
gtctggcatatgcaaagtgcat

SEQ ID NO: 9432615 - DNA, 22 bp, Homo sapiens
gtctggcagatcgagcagccca

SEQ ID NO: 9432616 - DNA, 22 bp, Homo sapiens
gtctggcattcttcctggagaa

SEQ ID NO: 9432617 - DNA, 22 bp, Homo sapiens
gtctggctgataaaatgctctt

SEQ ID NO: 9432618 - DNA, 22 bp, Homo sapiens
gtctggctgtccagcttatcta

SEQ ID NO: 9432619 - DNA, 20 bp, Homo sapiens
gtctggcttcgtgattctgg

SEQ ID NO: 9432620 - DNA, 22 bp, Homo sapiens
gtctggctccgaggagtggcag

SEQ ID NO: 9432621 - DNA, 22 bp, Homo sapiens
gtctggctccgaggagtggcag

SEQ ID NO: 9432622 - DNA, 22 bp, Homo sapiens
gtctggctccgaggagtggcag

SEQ ID NO: 9432623 - DNA, 22 bp, Homo sapiens
gtctggctcgctctcgcccgtc

SEQ ID NO: 9432624 - DNA, 22 bp, Homo sapiens
gtctggctccgaggagtggcag

SEQ ID NO: 9432625 - DNA, 20 bp, Homo sapiens
gtctgcagtaagagggaata

SEQ ID NO: 9432626 - DNA, 22 bp, Homo sapiens
gtctgagggttgtgctggagga

SEQ ID NO: 9432627 - DNA, 22 bp, Homo sapiens
gtctgagggttgtgctggagga

SEQ ID NO: 9432628 - DNA, 22 bp, Homo sapiens
gtctgaggtcattagctctctt

SEQ ID NO: 9432629 - DNA, 22 bp, Homo sapiens
gtctgaggtcattagctctctt

SEQ ID NO: 9432630 - DNA, 22 bp, Homo sapiens
gtctgagggttgtgctggagga

SEQ ID NO: 9432631 - DNA, 22 bp, Homo sapiens
gtctgagggttgtgctggagga

SEQ ID NO: 9432632 - DNA, 22 bp, Homo sapiens
gtctgagggttgtgctggagga

SEQ ID NO: 9432633 - DNA, 22 bp, Homo sapiens
gtctgagggtcatgggtctcac

SEQ ID NO: 9432634 - DNA, 22 bp, Homo sapiens
gtctgagggtcatgggtctcac

SEQ ID NO: 9432635 - DNA, 22 bp, Homo sapiens
gtctgaggtcattagctctctt

SEQ ID NO: 9432636 - DNA, 21 bp, Homo sapiens
gtctgatgcttgatgcagttg

SEQ ID NO: 9432637 - DNA, 21 bp, Homo sapiens
gtctgatgcttgatgcagttg

SEQ ID NO: 9432638 - DNA, 22 bp, Homo sapiens
gtctgcagagggaaggcttcag

SEQ ID NO: 9432639 - DNA, 21 bp, Homo sapiens
gtctgcagaccccttcattgc

SEQ ID NO: 9432640 - DNA, 19 bp, Homo sapiens
gtcaggaagtactttccgg

SEQ ID NO: 9432641 - DNA, 19 bp, Homo sapiens
gtcaggaagtactttccgg

SEQ ID NO: 9432642 - DNA, 22 bp, Homo sapiens
gtcaggaagcaaggttgggcat

SEQ ID NO: 9432643 - DNA, 22 bp, Homo sapiens
gtcaggacaaggtggtctccag

SEQ ID NO: 9432644 - DNA, 22 bp, Homo sapiens
gtcaggacaaggtggtctccag

SEQ ID NO: 9432645 - DNA, 22 bp, Homo sapiens
gtcaggaagtggcattggagaa

SEQ ID NO: 9432646 - DNA, 22 bp, Homo sapiens
gtcaggaagtggcattggagaa

SEQ ID NO: 9432647 - DNA, 22 bp, Homo sapiens
gtcaggacattttaccatcctg

SEQ ID NO: 9432648 - DNA, 22 bp, Homo sapiens
gtcaggacaggctctggactga

SEQ ID NO: 9432649 - DNA, 22 bp, Homo sapiens
gtcaggactctgacccgtcccg

SEQ ID NO: 9432650 - DNA, 22 bp, Homo sapiens
gtcaggactctgacccgtcccg

SEQ ID NO: 9432651 - DNA, 22 bp, Homo sapiens
gtcaggactctgacccgtcccg

SEQ ID NO: 9432652 - DNA, 22 bp, Homo sapiens
gtcaggactctgacccgtcccg

SEQ ID NO: 9432653 - DNA, 22 bp, Homo sapiens
gtcaggagaggccatcagcttt

SEQ ID NO: 9432654 - DNA, 21 bp, Homo sapiens
gtcaggagccgtcttacattc

SEQ ID NO: 9432655 - DNA, 22 bp, Homo sapiens
gtcaggagatagggcaagcttc

SEQ ID NO: 9432656 - DNA, 20 bp, Homo sapiens
gtcaggattagtaaactctg

SEQ ID NO: 9432657 - DNA, 22 bp, Homo sapiens
gtcaggagagatcaggacagca

SEQ ID NO: 9432658 - DNA, 22 bp, Homo sapiens
gtcaggagagatcaggacagca

SEQ ID NO: 9432659 - DNA, 22 bp, Homo sapiens
gtcaggagagatcaggacagca

SEQ ID NO: 9432660 - DNA, 22 bp, Homo sapiens
gtcaggagagacctgttctcct

SEQ ID NO: 9432661 - DNA, 21 bp, Homo sapiens
gtcaggcccatagcagtgcct

SEQ ID NO: 9432662 - DNA, 22 bp, Homo sapiens
gtcaggccaatactctccagca

SEQ ID NO: 9432663 - DNA, 22 bp, Homo sapiens
gtcaggccaatactctccagca

SEQ ID NO: 9432664 - DNA, 22 bp, Homo sapiens
gtcaggccctggcagccgtgac

SEQ ID NO: 9432665 - DNA, 22 bp, Homo sapiens
gtcaggccctggcagccgtgac

SEQ ID NO: 9432666 - DNA, 21 bp, Homo sapiens
gtcaggcccatagcagtgcct

SEQ ID NO: 9432667 - DNA, 22 bp, Homo sapiens
gtccagggaaatagcgacaggg

SEQ ID NO: 9432668 - DNA, 22 bp, Homo sapiens
gtcaggccctggcagccgtgac

SEQ ID NO: 9432669 - DNA, 22 bp, Homo sapiens
gtccagggaaatagcgacaggg

SEQ ID NO: 9432670 - DNA, 22 bp, Homo sapiens
gtccagggaaatagcgacaggg

SEQ ID NO: 9432671 - DNA, 22 bp, Homo sapiens
gtccagggaaatagcgacaggg

SEQ ID NO: 9432672 - DNA, 18 bp, Homo sapiens
gtcaggcatgaatctggg

SEQ ID NO: 9432673 - DNA, 22 bp, Homo sapiens
gtcaggcagtggaaattaaaaa

SEQ ID NO: 9432674 - DNA, 22 bp, Homo sapiens
gtcaggcagcctggagattcag

SEQ ID NO: 9432675 - DNA, 22 bp, Homo sapiens
gtcaggcagcctggagattcag

SEQ ID NO: 9432676 - DNA, 22 bp, Homo sapiens
gtcaggcagcctggagattcag

SEQ ID NO: 9432677 - DNA, 18 bp, Homo sapiens
gtcaggcatgaatctggg

SEQ ID NO: 9432678 - DNA, 22 bp, Homo sapiens
gtcaggcatttaggatgagttc

SEQ ID NO: 9432679 - DNA, 19 bp, Homo sapiens
gtcaggcacgtgagagcat

SEQ ID NO: 9432680 - DNA, 19 bp, Homo sapiens
gtcaggcacgtgagagcat

SEQ ID NO: 9432681 - DNA, 19 bp, Homo sapiens
gtcaggcacgtgagagcat

SEQ ID NO: 9432682 - DNA, 22 bp, Homo sapiens
gtatgtgttgaattcaggggtc

SEQ ID NO: 9432683 - DNA, 22 bp, Homo sapiens
gtatgtgctgagctttccccgc

SEQ ID NO: 9432684 - DNA, 22 bp, Homo sapiens
gtatgtgaggttggtttccagg

SEQ ID NO: 9432685 - DNA, 22 bp, Homo sapiens
gtatgtgaggttggtttccagg

SEQ ID NO: 9432686 - DNA, 22 bp, Homo sapiens
gtatgtgaggttggtttccagg

SEQ ID NO: 9432687 - DNA, 22 bp, Homo sapiens
gtatgtgaggttggtttccagg

SEQ ID NO: 9432688 - DNA, 22 bp, Homo sapiens
gtatgtcaaaatctgcatgata

SEQ ID NO: 9432689 - DNA, 22 bp, Homo sapiens
gtatgtcagtgtttaggcaatg

SEQ ID NO: 9432690 - DNA, 20 bp, Homo sapiens
gtattacaggcttagaacca

SEQ ID NO: 9432691 - DNA, 22 bp, Homo sapiens
gtattacaaataaatgttactg

SEQ ID NO: 9432692 - DNA, 22 bp, Homo sapiens
gtattacaaataaatgttactg

SEQ ID NO: 9432693 - DNA, 22 bp, Homo sapiens
gtcagaggggcagctgccaggc

SEQ ID NO: 9432694 - DNA, 18 bp, Homo sapiens
gtcagaggatggggaaat

SEQ ID NO: 9432695 - DNA, 18 bp, Homo sapiens
gtcagaggatggggaaat

SEQ ID NO: 9432696 - DNA, 22 bp, Homo sapiens
gtcagaggaggctgagtaggaa

SEQ ID NO: 9432697 - DNA, 22 bp, Homo sapiens
gtcagctgcagtgggcacagcc

SEQ ID NO: 9432698 - DNA, 22 bp, Homo sapiens
gtcagctgcagtgggcacagcc

SEQ ID NO: 9432699 - DNA, 22 bp, Homo sapiens
gtcagctgcagtgggcacagcc

SEQ ID NO: 9432700 - DNA, 22 bp, Homo sapiens
gtcagctactgcagggaacttt

SEQ ID NO: 9432701 - DNA, 22 bp, Homo sapiens
gtcagaggggcagctgccaggc

SEQ ID NO: 9432702 - DNA, 22 bp, Homo sapiens
gtcagaggggcagctgccaggc

SEQ ID NO: 9432703 - DNA, 21 bp, Homo sapiens
gtcagctgtgtgtgaggaccc

SEQ ID NO: 9432704 - DNA, 22 bp, Homo sapiens
gtcagctgtctccccagagtgg

SEQ ID NO: 9432705 - DNA, 22 bp, Homo sapiens
gtcagctgtctccccagagtgg

SEQ ID NO: 9432706 - DNA, 22 bp, Homo sapiens
gtcagctgggcatctgcagatg

SEQ ID NO: 9432707 - DNA, 22 bp, Homo sapiens
gtcaggaaaaattgataatttt

SEQ ID NO: 9432708 - DNA, 23 bp, Homo sapiens
gtcagcttgaccagtggagagtc

SEQ ID NO: 9432709 - DNA, 22 bp, Homo sapiens
gtcaggaaaacccgggttgact

SEQ ID NO: 9432710 - DNA, 22 bp, Homo sapiens
gtccatccctatctgcattgct

SEQ ID NO: 9432711 - DNA, 22 bp, Homo sapiens
gtccatccagggtcaccatgac

SEQ ID NO: 9432712 - DNA, 22 bp, Homo sapiens
gtccagtcactgtcaatgttcc

SEQ ID NO: 9432713 - DNA, 22 bp, Homo sapiens
gtccagggccccgagcaccagg

SEQ ID NO: 9432714 - DNA, 22 bp, Homo sapiens
gtccagggccccgagcaccagg

SEQ ID NO: 9432715 - DNA, 22 bp, Homo sapiens
gtccagggggcttaagcaaact

SEQ ID NO: 9432716 - DNA, 22 bp, Homo sapiens
gtccagggggcttaagcaaact

SEQ ID NO: 9432717 - DNA, 22 bp, Homo sapiens
gtccagggctaaatcaggttcc

SEQ ID NO: 9432718 - DNA, 22 bp, Homo sapiens
gtccatctcttattgatcctaa

SEQ ID NO: 9432719 - DNA, 22 bp, Homo sapiens
gtccatctaagtatccagcctg

SEQ ID NO: 9432720 - DNA, 22 bp, Homo sapiens
gtccattttattcagagacttt

SEQ ID NO: 9432721 - DNA, 18 bp, Homo sapiens
gtccatggcctccaccca

SEQ ID NO: 9432722 - DNA, 22 bp, Homo sapiens
gtccattgttctatggctcaaa

SEQ ID NO: 9432723 - DNA, 22 bp, Homo sapiens
gtccattgttctatggctcaaa

SEQ ID NO: 9432724 - DNA, 22 bp, Homo sapiens
gtcccagggaagaaggcagcac

SEQ ID NO: 9432725 - DNA, 22 bp, Homo sapiens
gtcccagggaggttcagggctt

SEQ ID NO: 9432726 - DNA, 22 bp, Homo sapiens
gtcctgtgtgacttcccaaatg

SEQ ID NO: 9432727 - DNA, 22 bp, Homo sapiens
gtcctgtgtactcctgatactt

SEQ ID NO: 9432728 - DNA, 22 bp, Homo sapiens
gtcctggtagctggcttggtca

SEQ ID NO: 9432729 - DNA, 22 bp, Homo sapiens
gtcctgtgtaagtacttgctca

SEQ ID NO: 9432730 - DNA, 22 bp, Homo sapiens
gtcccatcccccttggcactca

SEQ ID NO: 9432731 - DNA, 22 bp, Homo sapiens
gtcctgggtccccgcaggtcag

SEQ ID NO: 9432732 - DNA, 22 bp, Homo sapiens
gtcctgggtccccgcaggtcag

SEQ ID NO: 9432733 - DNA, 22 bp, Homo sapiens
gtcctgggtccccgcaggtcag

SEQ ID NO: 9432734 - DNA, 22 bp, Homo sapiens
gtccttcaagagtcccctactg

SEQ ID NO: 9432735 - DNA, 22 bp, Homo sapiens
gtccttaaagagagcatcattc

SEQ ID NO: 9432736 - DNA, 22 bp, Homo sapiens
gtccttaacaaacggggaaaag

SEQ ID NO: 9432737 - DNA, 22 bp, Homo sapiens
gtcctgtgtgttgccggctgaa

SEQ ID NO: 9432738 - DNA, 22 bp, Homo sapiens
gtcctgtgtgttgccggctgaa

SEQ ID NO: 9432739 - DNA, 21 bp, Homo sapiens
gtcctgttcctgaaccttccc

SEQ ID NO: 9432740 - DNA, 22 bp, Homo sapiens
gtcccagggatgcagacatgag

SEQ ID NO: 9432741 - DNA, 22 bp, Homo sapiens
gtcccagggatgcagacatgag

SEQ ID NO: 9432742 - DNA, 22 bp, Homo sapiens
gtcccaggtcccagcacatctg

SEQ ID NO: 9432743 - DNA, 22 bp, Homo sapiens
gtcccaggtgcccagtgggcag

SEQ ID NO: 9432744 - DNA, 22 bp, Homo sapiens
gtcccaggtgcccagtgggcag

SEQ ID NO: 9432745 - DNA, 22 bp, Homo sapiens
gtcccataagtagtgcaacttg

SEQ ID NO: 9432746 - DNA, 22 bp, Homo sapiens
gtcccaggtgggctccacctct

SEQ ID NO: 9432747 - DNA, 22 bp, Homo sapiens
gtcccagttcctcctgtcagca

SEQ ID NO: 9432748 - DNA, 22 bp, Homo sapiens
ggtggccaggagacatttgtca

SEQ ID NO: 9432749 - DNA, 22 bp, Homo sapiens
ggtggcattcagaagagctggc

SEQ ID NO: 9432750 - DNA, 22 bp, Homo sapiens
ggtggccataggaccagcctgg

SEQ ID NO: 9432751 - DNA, 22 bp, Homo sapiens
ggtggccaggccagctctggcc

SEQ ID NO: 9432752 - DNA, 22 bp, Homo sapiens
ggtggcagttacaggggcaaat

SEQ ID NO: 9432753 - DNA, 22 bp, Homo sapiens
ggtggcagttacaggggcaaat

SEQ ID NO: 9432754 - DNA, 22 bp, Homo sapiens
ggtggcagcatggtcccagtgt

SEQ ID NO: 9432755 - DNA, 19 bp, Homo sapiens
ggtggcaggaataaaggtc

SEQ ID NO: 9432756 - DNA, 22 bp, Homo sapiens
ggtggcaggccctgagcatccc

SEQ ID NO: 9432757 - DNA, 22 bp, Homo sapiens
ggtggcaggccctgagcatccc

SEQ ID NO: 9432758 - DNA, 22 bp, Homo sapiens
ggtggcaggctggcattggcaa

SEQ ID NO: 9432759 - DNA, 22 bp, Homo sapiens
ggtggcaggccctgagcatccc

SEQ ID NO: 9432760 - DNA, 22 bp, Homo sapiens
ggtggcaggctggcattggcaa

SEQ ID NO: 9432761 - DNA, 22 bp, Homo sapiens
ggtggcaggctggcattggcaa

SEQ ID NO: 9432762 - DNA, 22 bp, Homo sapiens
ggtgtcaggaaaatctcagtgt

SEQ ID NO: 9432763 - DNA, 22 bp, Homo sapiens
ggtgtcagatttgacatccaga

SEQ ID NO: 9432764 - DNA, 22 bp, Homo sapiens
ggtgtcagcctgggagcctagc

SEQ ID NO: 9432765 - DNA, 20 bp, Homo sapiens
ggtgtcagggccatgcctgg

SEQ ID NO: 9432766 - DNA, 20 bp, Homo sapiens
ggtgtcagggccatgcctgg

SEQ ID NO: 9432767 - DNA, 22 bp, Homo sapiens
ggtgtcagtgaaggtagagttt

SEQ ID NO: 9432768 - DNA, 22 bp, Homo sapiens
ggtgtcagttgctcatcagagt

SEQ ID NO: 9432769 - DNA, 22 bp, Homo sapiens
ggtgtcagtgagagcacagtac

SEQ ID NO: 9432770 - DNA, 22 bp, Homo sapiens
ggtgtcagttgctcatcagagt

SEQ ID NO: 9432771 - DNA, 22 bp, Homo sapiens
ggtgtcctacagggccgcaggc

SEQ ID NO: 9432772 - DNA, 22 bp, Homo sapiens
ggtgtcccaggccagctgtgtg

SEQ ID NO: 9432773 - DNA, 23 bp, Homo sapiens
ggtggtggtgagtcacgggctca

SEQ ID NO: 9432774 - DNA, 23 bp, Homo sapiens
ggtggtggtgagtcacgggctca

SEQ ID NO: 9432775 - DNA, 22 bp, Homo sapiens
ggtggtggtcccgacttgggag

SEQ ID NO: 9432776 - DNA, 23 bp, Homo sapiens
ggtggtggtgagtcacgggctca

SEQ ID NO: 9432777 - DNA, 22 bp, Homo sapiens
ggtgtcagaagtgggatattac

SEQ ID NO: 9432778 - DNA, 22 bp, Homo sapiens
ggtgtcaatgctcccaccttgg

SEQ ID NO: 9432779 - DNA, 22 bp, Homo sapiens
ggtgtcaaaataccatttcagg

SEQ ID NO: 9432780 - DNA, 22 bp, Homo sapiens
ggtgtcaaattattgagtttca

SEQ ID NO: 9432781 - DNA, 22 bp, Homo sapiens
ggtggttcatgcctggaatccc

SEQ ID NO: 9432782 - DNA, 22 bp, Homo sapiens
ggtgtaagatgtcagctgagca

SEQ ID NO: 9432783 - DNA, 22 bp, Homo sapiens
ggtgtagctctgtgtcccactg

SEQ ID NO: 9432784 - DNA, 22 bp, Homo sapiens
ggtggttgcataggccagcagc

SEQ ID NO: 9432785 - DNA, 23 bp, Homo sapiens
ggtggtggtgagtcacgggctca

SEQ ID NO: 9432786 - DNA, 22 bp, Homo sapiens
ggtggttcacgcctataatccc

SEQ ID NO: 9432787 - DNA, 22 bp, Homo sapiens
ggtgagtttcatggttgtttac

SEQ ID NO: 9432788 - DNA, 22 bp, Homo sapiens
ggtgatcttgaactaaataaac

SEQ ID NO: 9432789 - DNA, 22 bp, Homo sapiens
ggtgcaaaaatctatcaccagc

SEQ ID NO: 9432790 - DNA, 22 bp, Homo sapiens
ggtgagtcatttggctcaagag

SEQ ID NO: 9432791 - DNA, 22 bp, Homo sapiens
ggtgagtccagagtccaaatcc

SEQ ID NO: 9432792 - DNA, 22 bp, Homo sapiens
ggtgagtgtcaatggttagagt

SEQ ID NO: 9432793 - DNA, 22 bp, Homo sapiens
ggtgagtgcctggcctggccac

SEQ ID NO: 9432794 - DNA, 22 bp, Homo sapiens
ggtgaggggctcctctgcccgg

SEQ ID NO: 9432795 - DNA, 21 bp, Homo sapiens
ggtgagtcttttcaagaggag

SEQ ID NO: 9432796 - DNA, 22 bp, Homo sapiens
ggtgcaggacgaagtgggggtt

SEQ ID NO: 9432797 - DNA, 22 bp, Homo sapiens
ggtgcaggacgaagtgggggtt

SEQ ID NO: 9432798 - DNA, 22 bp, Homo sapiens
ggtgcaggaaaattacctggag

SEQ ID NO: 9432799 - DNA, 22 bp, Homo sapiens
ggtgcaggaatctgcaattgaa

SEQ ID NO: 9432800 - DNA, 22 bp, Homo sapiens
ggtggcagaggtgcatcagccc

SEQ ID NO: 9432801 - DNA, 22 bp, Homo sapiens
ggtggcagagaggaggtagttt

SEQ ID NO: 9432802 - DNA, 22 bp, Homo sapiens
ggtggcagaggtgcatcagccc

SEQ ID NO: 9432803 - DNA, 22 bp, Homo sapiens
ggtggcagaggtgcatcagccc

SEQ ID NO: 9432804 - DNA, 22 bp, Homo sapiens
ggtggcagcatggtcccagtgt

SEQ ID NO: 9432805 - DNA, 22 bp, Homo sapiens
ggtgcaggagcggggtgctcgg

SEQ ID NO: 9432806 - DNA, 22 bp, Homo sapiens
ggtgcaggcggtggggcaagta

SEQ ID NO: 9432807 - DNA, 22 bp, Homo sapiens
ggtgcaggcggtggggcaagta

SEQ ID NO: 9432808 - DNA, 22 bp, Homo sapiens
ggtgaggggcacctctgcccgg

SEQ ID NO: 9432809 - DNA, 22 bp, Homo sapiens
ggtgaggggagagtgaaagaaa

SEQ ID NO: 9432810 - DNA, 22 bp, Homo sapiens
ggtgaggggagagtgaaagaaa

SEQ ID NO: 9432811 - DNA, 22 bp, Homo sapiens
gggtggggttcaggaatcttca

SEQ ID NO: 9432812 - DNA, 22 bp, Homo sapiens
ggtgaggggcacctctgcccgg

SEQ ID NO: 9432813 - DNA, 22 bp, Homo sapiens
ggtgaggggcacctctgcccgg

SEQ ID NO: 9432814 - DNA, 22 bp, Homo sapiens
ggtgaggggcgcctctgcccag

SEQ ID NO: 9432815 - DNA, 22 bp, Homo sapiens
ggtgaggggcgcctctgcccag

SEQ ID NO: 9432816 - DNA, 22 bp, Homo sapiens
ggtgaggggcgcctctgcccag

SEQ ID NO: 9432817 - DNA, 22 bp, Homo sapiens
ggtgaggggcgcctctgcccgg

SEQ ID NO: 9432818 - DNA, 22 bp, Homo sapiens
ggtgaggggcgcctctgcccgg

SEQ ID NO: 9432819 - DNA, 22 bp, Homo sapiens
ggtgaggggctcctctgcccgg

SEQ ID NO: 9432820 - DNA, 22 bp, Homo sapiens
ggtgaggggctcctctgcccgg

SEQ ID NO: 9432821 - DNA, 22 bp, Homo sapiens
ggtgaggggcgcctctgcccgg

SEQ ID NO: 9432822 - DNA, 22 bp, Homo sapiens
ggtgagggtaaatataggcaaa

SEQ ID NO: 9432823 - DNA, 22 bp, Homo sapiens
ggtgagggtaaatataggcaaa

SEQ ID NO: 9432824 - DNA, 22 bp, Homo sapiens
ggtgagggtaaatataggcaaa

SEQ ID NO: 9432825 - DNA, 22 bp, Homo sapiens
ggtgagggtaaatataggcaaa

SEQ ID NO: 9432826 - DNA, 22 bp, Homo sapiens
ggtgagggtaaatataggcaaa

SEQ ID NO: 9432827 - DNA, 22 bp, Homo sapiens
gggtggggccaggcaatttgca

SEQ ID NO: 9432828 - DNA, 22 bp, Homo sapiens
gggtggggccaggcaatttgca

SEQ ID NO: 9432829 - DNA, 22 bp, Homo sapiens
gggtgggcctgtctggccatgt

SEQ ID NO: 9432830 - DNA, 22 bp, Homo sapiens
gggtggggcccaggaaatctat

SEQ ID NO: 9432831 - DNA, 22 bp, Homo sapiens
gggtggggcccaggaaatctat

SEQ ID NO: 9432832 - DNA, 22 bp, Homo sapiens
gggtggggcccaggaaatctat

SEQ ID NO: 9432833 - DNA, 22 bp, Homo sapiens
gggtggggcccaggaaatctat

SEQ ID NO: 9432834 - DNA, 22 bp, Homo sapiens
gggtggggtgtatcggatccta

SEQ ID NO: 9432835 - DNA, 22 bp, Homo sapiens
gggtggggttcaggaatcttca

SEQ ID NO: 9432836 - DNA, 22 bp, Homo sapiens
gggtggggtgtatcggatccta

SEQ ID NO: 9432837 - DNA, 22 bp, Homo sapiens
gggtggggtgtatcggatccta

SEQ ID NO: 9432838 - DNA, 22 bp, Homo sapiens
gtacatctttaaattgttcagt

SEQ ID NO: 9432839 - DNA, 22 bp, Homo sapiens
gtacatgttggttgtttccagt

SEQ ID NO: 9432840 - DNA, 22 bp, Homo sapiens
gtacatgtgcacaatgtgcagg

SEQ ID NO: 9432841 - DNA, 22 bp, Homo sapiens
gtacatgtgcacaacatgcatg

SEQ ID NO: 9432842 - DNA, 22 bp, Homo sapiens
gtacatgcagattatagctaat

SEQ ID NO: 9432843 - DNA, 22 bp, Homo sapiens
gtacatgtcaaaaaatgcataa

SEQ ID NO: 9432844 - DNA, 22 bp, Homo sapiens
gtacatgtatgagatatgtgta

SEQ ID NO: 9432845 - DNA, 22 bp, Homo sapiens
gtacatttactgatgaaaagta

SEQ ID NO: 9432846 - DNA, 22 bp, Homo sapiens
gtacatttaggattcattgaaa

SEQ ID NO: 9432847 - DNA, 22 bp, Homo sapiens
gtatacatagatgatgaacaag

SEQ ID NO: 9432848 - DNA, 22 bp, Homo sapiens
gtatacatgtggtaaaatgcac

SEQ ID NO: 9432849 - DNA, 22 bp, Homo sapiens
gtacataagaaattactacaga

SEQ ID NO: 9432850 - DNA, 22 bp, Homo sapiens
gtacataattttcagccagttt

SEQ ID NO: 9432851 - DNA, 22 bp, Homo sapiens
gtacataaaggaggctctttgc

SEQ ID NO: 9432852 - DNA, 22 bp, Homo sapiens
gtacataaaatactgccatgta

SEQ ID NO: 9432853 - DNA, 22 bp, Homo sapiens
gtacagtagagccaggttcagt

SEQ ID NO: 9432854 - DNA, 22 bp, Homo sapiens
gtacagtagtaaaagtgaatga

SEQ ID NO: 9432855 - DNA, 19 bp, Homo sapiens
gtacagtctgtgggtttgg

SEQ ID NO: 9432856 - DNA, 20 bp, Homo sapiens
gtatataaccatagtgacta

SEQ ID NO: 9432857 - DNA, 20 bp, Homo sapiens
gtatataaccatagtgacta

SEQ ID NO: 9432858 - DNA, 22 bp, Homo sapiens
gtatagtttgcgatttgtggtt

SEQ ID NO: 9432859 - DNA, 22 bp, Homo sapiens
gtatagaaggatctggtgaatt

SEQ ID NO: 9432860 - DNA, 22 bp, Homo sapiens
gtatagttccaagcatattttg

SEQ ID NO: 9432861 - DNA, 22 bp, Homo sapiens
gtatacttgcagacatttatat

SEQ ID NO: 9432862 - DNA, 22 bp, Homo sapiens
gtatacttgcagacatttatat

SEQ ID NO: 9432863 - DNA, 22 bp, Homo sapiens
gtatagaaacccagaaagatag

SEQ ID NO: 9432864 - DNA, 22 bp, Homo sapiens
gtatatatcggcactattttaa

SEQ ID NO: 9432865 - DNA, 22 bp, Homo sapiens
gtatatatgtgtgaacatgtat

SEQ ID NO: 9432866 - DNA, 22 bp, Homo sapiens
gtatatatgtgtgaacatgtat

SEQ ID NO: 9432867 - DNA, 22 bp, Homo sapiens
gtatataaggtaaagcgattgt

SEQ ID NO: 9432868 - DNA, 22 bp, Homo sapiens
gtatataaggtaaagcgattgt

SEQ ID NO: 9432869 - DNA, 22 bp, Homo sapiens
gtatataaggtaaagcgattgt

SEQ ID NO: 9432870 - DNA, 20 bp, Homo sapiens
gtatataaccatagtgacta

SEQ ID NO: 9432871 - DNA, 18 bp, Homo sapiens
gtatatctgcacatatac

SEQ ID NO: 9432872 - DNA, 22 bp, Homo sapiens
gtatggatcacctgaggtcagc

SEQ ID NO: 9432873 - DNA, 22 bp, Homo sapiens
gtatggaagtataagttttgaa

SEQ ID NO: 9432874 - DNA, 22 bp, Homo sapiens
gtatgtatgtatatgtttaaga

SEQ ID NO: 9432875 - DNA, 21 bp, Homo sapiens
gtatgtatggataatgagagg

SEQ ID NO: 9432876 - DNA, 22 bp, Homo sapiens
gtatggatgtgtgaactggtta

SEQ ID NO: 9432877 - DNA, 20 bp, Homo sapiens
gtatatccattcatgcctct

SEQ ID NO: 9432878 - DNA, 22 bp, Homo sapiens
gtatatcagacactcatatgta

SEQ ID NO: 9432879 - DNA, 22 bp, Homo sapiens
gtatatcaccccaagcagctga

SEQ ID NO: 9432880 - DNA, 22 bp, Homo sapiens
gtatatatgtgtgaacatgtat

SEQ ID NO: 9432881 - DNA, 22 bp, Homo sapiens
gtatatatgtgtgaacatgtat

SEQ ID NO: 9432882 - DNA, 22 bp, Homo sapiens
gtatatattggataaaccagag

SEQ ID NO: 9432883 - DNA, 22 bp, Homo sapiens
gtaaatattaaaggctgctaga

SEQ ID NO: 9432884 - DNA, 22 bp, Homo sapiens
gtaaatattaaaggctgctaga

SEQ ID NO: 9432885 - DNA, 22 bp, Homo sapiens
gtaaatattaaaggctgctaga

SEQ ID NO: 9432886 - DNA, 22 bp, Homo sapiens
gtaaatattaaaggctgctaga

SEQ ID NO: 9432887 - DNA, 22 bp, Homo sapiens
gtaaatataaatgctagctgcc

SEQ ID NO: 9432888 - DNA, 22 bp, Homo sapiens
gtaaatataaatgctagctgcc

SEQ ID NO: 9432889 - DNA, 22 bp, Homo sapiens
gtaaatataaatgctagctgcc

SEQ ID NO: 9432890 - DNA, 22 bp, Homo sapiens
gtaaatattaaaggctgctaga

SEQ ID NO: 9432891 - DNA, 22 bp, Homo sapiens
gtaaatataaatgctagctgcc

SEQ ID NO: 9432892 - DNA, 22 bp, Homo sapiens
gtaaatattaaaggctgctaga

SEQ ID NO: 9432893 - DNA, 22 bp, Homo sapiens
gtaaatattaaaggctgctaga

SEQ ID NO: 9432894 - DNA, 22 bp, Homo sapiens
gtaaatataaatgctagctgcc

SEQ ID NO: 9432895 - DNA, 22 bp, Homo sapiens
gtaaatataaatgctagctgcc

SEQ ID NO: 9432896 - DNA, 22 bp, Homo sapiens
gtaaatataaatgctagctgcc

SEQ ID NO: 9432897 - DNA, 22 bp, Homo sapiens
gtaaataactggtaattggggt

SEQ ID NO: 9432898 - DNA, 22 bp, Homo sapiens
gtaaataactggtaattggggt

SEQ ID NO: 9432899 - DNA, 22 bp, Homo sapiens
gtaaataactggtaattggggt

SEQ ID NO: 9432900 - DNA, 22 bp, Homo sapiens
gtaaataactggtaattggggt

SEQ ID NO: 9432901 - DNA, 22 bp, Homo sapiens
gtacagcatttgaaattactgg

SEQ ID NO: 9432902 - DNA, 22 bp, Homo sapiens
gtacagcacagagcatcgcaca

SEQ ID NO: 9432903 - DNA, 22 bp, Homo sapiens
gtacaggaaggagggagtttca

SEQ ID NO: 9432904 - DNA, 22 bp, Homo sapiens
gtacagattaataatatactga

SEQ ID NO: 9432905 - DNA, 22 bp, Homo sapiens
gtacagaggttgctggaggctc

SEQ ID NO: 9432906 - DNA, 22 bp, Homo sapiens
gtacaggaaggagggagtttca

SEQ ID NO: 9432907 - DNA, 22 bp, Homo sapiens
gtacaggacatagacagagtag

SEQ ID NO: 9432908 - DNA, 22 bp, Homo sapiens
gtacaggaccgcggccccctgg

SEQ ID NO: 9432909 - DNA, 22 bp, Homo sapiens
gtacaggatgtgtaaacttggg

SEQ ID NO: 9432910 - DNA, 22 bp, Homo sapiens
gtacaggccaccactgaatttt

SEQ ID NO: 9432911 - DNA, 22 bp, Homo sapiens
gtacagggcccctcagcagggc

SEQ ID NO: 9432912 - DNA, 22 bp, Homo sapiens
gtacagaaggatttctagtagt

SEQ ID NO: 9432913 - DNA, 22 bp, Homo sapiens
gtacagaaggagctttggattc

SEQ ID NO: 9432914 - DNA, 22 bp, Homo sapiens
gtacacttgtcttgaacagcct

SEQ ID NO: 9432915 - DNA, 23 bp, Homo sapiens
gtaaaatacgcagtgcagtgtga

SEQ ID NO: 9432916 - DNA, 23 bp, Homo sapiens
gtaaaatacgcagtgcagtgtga

SEQ ID NO: 9432917 - DNA, 22 bp, Homo sapiens
ggtgtccgcgctgtagaaggtc

SEQ ID NO: 9432918 - DNA, 22 bp, Homo sapiens
ggtgtcctgggcaggcagctga

SEQ ID NO: 9432919 - DNA, 22 bp, Homo sapiens
ggtgtcctcatgattttctaga

SEQ ID NO: 9432920 - DNA, 22 bp, Homo sapiens
ggtgtcctcactatagcaagtc

SEQ ID NO: 9432921 - DNA, 22 bp, Homo sapiens
gtaaacattttcatctgtgccc

SEQ ID NO: 9432922 - DNA, 22 bp, Homo sapiens
gtaaacattttcatctgtgccc

SEQ ID NO: 9432923 - DNA, 22 bp, Homo sapiens
gtaaacattactgtgctgtata

SEQ ID NO: 9432924 - DNA, 22 bp, Homo sapiens
gtaaacattactgtgctgtata

SEQ ID NO: 9432925 - DNA, 22 bp, Homo sapiens
gtaaacatgctgtgtactcagc

SEQ ID NO: 9432926 - DNA, 22 bp, Homo sapiens
gtaaagaagtttttgaatgcat

SEQ ID NO: 9432927 - DNA, 22 bp, Homo sapiens
gtaaagaagtttttgaatgcat

SEQ ID NO: 9432928 - DNA, 22 bp, Homo sapiens
gtaaagaaggcaacctggttat

SEQ ID NO: 9432929 - DNA, 22 bp, Homo sapiens
gtaaactattctttcaggagct

SEQ ID NO: 9432930 - DNA, 22 bp, Homo sapiens
gtaaactatgggctttggagga

SEQ ID NO: 9432931 - DNA, 22 bp, Homo sapiens
gtaaactgattgttggagttac

SEQ ID NO: 9432932 - DNA, 22 bp, Homo sapiens
gtaaagctggagaggtctttta

SEQ ID NO: 9432933 - DNA, 22 bp, Homo sapiens
gtaaagtaaacccactttgtag

SEQ ID NO: 9432934 - DNA, 22 bp, Homo sapiens
gtaaagttctactagaatcaac

SEQ ID NO: 9432935 - DNA, 22 bp, Homo sapiens
gtaaataactggtaattggggt

SEQ ID NO: 9432936 - DNA, 22 bp, Homo sapiens
taagaaatttagttatagaatg

SEQ ID NO: 9432937 - DNA, 22 bp, Homo sapiens
taagaaatttagttatagaatg

SEQ ID NO: 9432938 - DNA, 22 bp, Homo sapiens
taagaaatttagttatagaatg

SEQ ID NO: 9432939 - DNA, 22 bp, Homo sapiens
taagaaatttagttatagaatg

SEQ ID NO: 9432940 - DNA, 22 bp, Homo sapiens
taagaaatttagttatagaatg

SEQ ID NO: 9432941 - DNA, 20 bp, Homo sapiens
taagaacaagactaggaagc

SEQ ID NO: 9432942 - DNA, 22 bp, Homo sapiens
taacagcagggttacaggcatt

SEQ ID NO: 9432943 - DNA, 22 bp, Homo sapiens
taacagcagggttacaggcatt

SEQ ID NO: 9432944 - DNA, 22 bp, Homo sapiens
taagaaatttagttatagaatg

SEQ ID NO: 9432945 - DNA, 22 bp, Homo sapiens
taacagcactggcaggcactgt

SEQ ID NO: 9432946 - DNA, 22 bp, Homo sapiens
taacagcactggcaggcactgt

SEQ ID NO: 9432947 - DNA, 22 bp, Homo sapiens
taacagaatttgctaaactccg

SEQ ID NO: 9432948 - DNA, 22 bp, Homo sapiens
taacagaatttgctaaactccg

SEQ ID NO: 9432949 - DNA, 22 bp, Homo sapiens
taacagagatagaaatgtaaag

SEQ ID NO: 9432950 - DNA, 22 bp, Homo sapiens
taacagagatagaaatgtaaag

SEQ ID NO: 9432951 - DNA, 22 bp, Homo sapiens
taacagaatttgctaaactccg

SEQ ID NO: 9432952 - DNA, 22 bp, Homo sapiens
taacagaatagcagaaacagaa

SEQ ID NO: 9432953 - DNA, 22 bp, Homo sapiens
taacagaatagcagaaacagaa

SEQ ID NO: 9432954 - DNA, 22 bp, Homo sapiens
taacagaatagcagaaacagaa

SEQ ID NO: 9432955 - DNA, 22 bp, Homo sapiens
taacagaatagcagaaacagaa

SEQ ID NO: 9432956 - DNA, 22 bp, Homo sapiens
taacactgtggtgttctttgtc

SEQ ID NO: 9432957 - DNA, 22 bp, Homo sapiens
taacactgtggtgttctttgtc

SEQ ID NO: 9432958 - DNA, 22 bp, Homo sapiens
taacactgtgtctgccatatcc

SEQ ID NO: 9432959 - DNA, 22 bp, Homo sapiens
taacactgtccaaagaattcca

SEQ ID NO: 9432960 - DNA, 22 bp, Homo sapiens
taacactgtccaaagaattcca

SEQ ID NO: 9432961 - DNA, 22 bp, Homo sapiens
taacactgtaaacctagatgtt

SEQ ID NO: 9432962 - DNA, 22 bp, Homo sapiens
taacactgtaaacctagatgtt

SEQ ID NO: 9432963 - DNA, 22 bp, Homo sapiens
taacactgtaaacctagatgtt

SEQ ID NO: 9432964 - DNA, 22 bp, Homo sapiens
taacactgtccaaagaattcca

SEQ ID NO: 9432965 - DNA, 22 bp, Homo sapiens
taacactgtccaaagaattcca

SEQ ID NO: 9432966 - DNA, 22 bp, Homo sapiens
taacactgtgcccagagtccca

SEQ ID NO: 9432967 - DNA, 22 bp, Homo sapiens
taacactgtgcccagagtccca

SEQ ID NO: 9432968 - DNA, 22 bp, Homo sapiens
taacactgtggtgttctttgtc

SEQ ID NO: 9432969 - DNA, 22 bp, Homo sapiens
taacactgatttgttctcaggg

SEQ ID NO: 9432970 - DNA, 22 bp, Homo sapiens
taacactgatttgttctcaggg

SEQ ID NO: 9432971 - DNA, 22 bp, Homo sapiens
taacactgaaaatgatgcatgt

SEQ ID NO: 9432972 - DNA, 22 bp, Homo sapiens
taacactgatttgttctcaggg

SEQ ID NO: 9432973 - DNA, 22 bp, Homo sapiens
taacactgccatgctggagtca

SEQ ID NO: 9432974 - DNA, 22 bp, Homo sapiens
taacactgccatgctggagtca

SEQ ID NO: 9432975 - DNA, 22 bp, Homo sapiens
taacactgcttcattttggaga

SEQ ID NO: 9432976 - DNA, 22 bp, Homo sapiens
taacactgcttcattttggaga

SEQ ID NO: 9432977 - DNA, 22 bp, Homo sapiens
taacactggagagttggttgtg

SEQ ID NO: 9432978 - DNA, 22 bp, Homo sapiens
taacactggcttttgctgaggc

SEQ ID NO: 9432979 - DNA, 22 bp, Homo sapiens
taacactggagagttggttgtg

SEQ ID NO: 9432980 - DNA, 22 bp, Homo sapiens
taacactggcttttgctgaggc

SEQ ID NO: 9432981 - DNA, 22 bp, Homo sapiens
taacactggtatttcatttagt

SEQ ID NO: 9432982 - DNA, 22 bp, Homo sapiens
taacactggtatttcatttagt

SEQ ID NO: 9432983 - DNA, 22 bp, Homo sapiens
taacactggtatttcatttagt

SEQ ID NO: 9432984 - DNA, 22 bp, Homo sapiens
taacactggttatccctgtgca

SEQ ID NO: 9432985 - DNA, 22 bp, Homo sapiens
taacactggttatccctgtgca

SEQ ID NO: 9432986 - DNA, 22 bp, Homo sapiens
taaatgacattcttaagtcttg

SEQ ID NO: 9432987 - DNA, 22 bp, Homo sapiens
taaatgacattcttaagtcttg

SEQ ID NO: 9432988 - DNA, 22 bp, Homo sapiens
taaatgaagctcatgggccaca

SEQ ID NO: 9432989 - DNA, 22 bp, Homo sapiens
taaatgagggctgacatgattg

SEQ ID NO: 9432990 - DNA, 22 bp, Homo sapiens
taaatgagggctgacatgattg

SEQ ID NO: 9432991 - DNA, 22 bp, Homo sapiens
taaatgagggctgacatgattg

SEQ ID NO: 9432992 - DNA, 22 bp, Homo sapiens
taaatgagtaatatagctgttt

SEQ ID NO: 9432993 - DNA, 22 bp, Homo sapiens
taaatgagtaatatagctgttt

SEQ ID NO: 9432994 - DNA, 22 bp, Homo sapiens
taaatgataataatgctagtgt

SEQ ID NO: 9432995 - DNA, 22 bp, Homo sapiens
taacactgaaaatgatgcatgt

SEQ ID NO: 9432996 - DNA, 22 bp, Homo sapiens
taacactgaaaatgatgcatgt

SEQ ID NO: 9432997 - DNA, 22 bp, Homo sapiens
taacactatccagatatgataa

SEQ ID NO: 9432998 - DNA, 22 bp, Homo sapiens
taaatcactcctaataatcagt

SEQ ID NO: 9432999 - DNA, 22 bp, Homo sapiens
taaatcacccatctcctaatct

SEQ ID NO: 9433000 - DNA, 22 bp, Homo sapiens
taaatagaatctaaactgctca

SEQ ID NO: 9433001 - DNA, 22 bp, Homo sapiens
taaatacttttactccactgat

SEQ ID NO: 9433002 - DNA, 22 bp, Homo sapiens
taaatacttttactccactgat

SEQ ID NO: 9433003 - DNA, 22 bp, Homo sapiens
taaatcagcctttgctatttta

SEQ ID NO: 9433004 - DNA, 22 bp, Homo sapiens
taaatcagcttatgccttttga

SEQ ID NO: 9433005 - DNA, 22 bp, Homo sapiens
taaatcaggaaggaaacttgga

SEQ ID NO: 9433006 - DNA, 22 bp, Homo sapiens
taaatcagtaaggcatattctc

SEQ ID NO: 9433007 - DNA, 22 bp, Homo sapiens
taaatcagtaaggcatattctc

SEQ ID NO: 9433008 - DNA, 22 bp, Homo sapiens
taaatcagtttctcttattggt

SEQ ID NO: 9433009 - DNA, 22 bp, Homo sapiens
taaatcagtaaggcatattctc

SEQ ID NO: 9433010 - DNA, 22 bp, Homo sapiens
taaatccagcttctaatttaga

SEQ ID NO: 9433011 - DNA, 22 bp, Homo sapiens
taaatccagcttctaatttaga

SEQ ID NO: 9433012 - DNA, 22 bp, Homo sapiens
taaatccagcttctaatttaga

SEQ ID NO: 9433013 - DNA, 22 bp, Homo sapiens
taaatctcagggaatatattga

SEQ ID NO: 9433014 - DNA, 22 bp, Homo sapiens
taaatctcctgtttttcatcta

SEQ ID NO: 9433015 - DNA, 21 bp, Homo sapiens
taaatctctgtattcttcagt

SEQ ID NO: 9433016 - DNA, 18 bp, Homo sapiens
taaatctctctttagtca

SEQ ID NO: 9433017 - DNA, 22 bp, Homo sapiens
taaatctctgctcctcttgggt

SEQ ID NO: 9433018 - DNA, 22 bp, Homo sapiens
taaatctcagcctttctgctta

SEQ ID NO: 9433019 - DNA, 22 bp, Homo sapiens
taaatctcagcctttctgctta

SEQ ID NO: 9433020 - DNA, 22 bp, Homo sapiens
taaatctcactgggtatattgg

SEQ ID NO: 9433021 - DNA, 22 bp, Homo sapiens
taaatgaaagggtttaatttat

SEQ ID NO: 9433022 - DNA, 22 bp, Homo sapiens
taaatgaaagggtttaatttat

SEQ ID NO: 9433023 - DNA, 22 bp, Homo sapiens
taaatgaaagggtttaatttat

SEQ ID NO: 9433024 - DNA, 22 bp, Homo sapiens
taaatgaaagggtttaatttat

SEQ ID NO: 9433025 - DNA, 22 bp, Homo sapiens
taaatcttgtggcaatgcttct

SEQ ID NO: 9433026 - DNA, 22 bp, Homo sapiens
taaatcttgtggcaatgcttct

SEQ ID NO: 9433027 - DNA, 22 bp, Homo sapiens
taaatcttctacatcatcataa

SEQ ID NO: 9433028 - DNA, 22 bp, Homo sapiens
taaatcttctacatcatcataa

SEQ ID NO: 9433029 - DNA, 22 bp, Homo sapiens
taaatactttacaggatgtctc

SEQ ID NO: 9433030 - DNA, 22 bp, Homo sapiens
taaaggcttttacaggagtgca

SEQ ID NO: 9433031 - DNA, 22 bp, Homo sapiens
taaatactttacaggatgtctc

SEQ ID NO: 9433032 - DNA, 22 bp, Homo sapiens
taaaggctttattttccagtca

SEQ ID NO: 9433033 - DNA, 22 bp, Homo sapiens
taaaggcttctgcagggactga

SEQ ID NO: 9433034 - DNA, 21 bp, Homo sapiens
taaaggctttagaatggcaaa

SEQ ID NO: 9433035 - DNA, 22 bp, Homo sapiens
taaaggctcgtattgttgtgtg

SEQ ID NO: 9433036 - DNA, 22 bp, Homo sapiens
taaaggcttcggagtgcacact

SEQ ID NO: 9433037 - DNA, 20 bp, Homo sapiens
taaaggctgtgaggtggccc

SEQ ID NO: 9433038 - DNA, 22 bp, Homo sapiens
taaaggcttctgcagggactga

SEQ ID NO: 9433039 - DNA, 22 bp, Homo sapiens
taaaggcagccactgagctcaa

SEQ ID NO: 9433040 - DNA, 22 bp, Homo sapiens
taaaggcagcctaggaagtgtt

SEQ ID NO: 9433041 - DNA, 22 bp, Homo sapiens
taaaggcagtaattcctgagtt

SEQ ID NO: 9433042 - DNA, 22 bp, Homo sapiens
taaaggcagttctgattaggtc

SEQ ID NO: 9433043 - DNA, 22 bp, Homo sapiens
taaaggcagttctgattaggtc

SEQ ID NO: 9433044 - DNA, 22 bp, Homo sapiens
taaaggcatgcaggtgaatgta

SEQ ID NO: 9433045 - DNA, 22 bp, Homo sapiens
taaaggcagttggagttgagga

SEQ ID NO: 9433046 - DNA, 22 bp, Homo sapiens
taaaggcatgcaggtgaatgta

SEQ ID NO: 9433047 - DNA, 22 bp, Homo sapiens
taaaggctcagggaaccagatc

SEQ ID NO: 9433048 - DNA, 22 bp, Homo sapiens
taaaggctcagggaaccagatc

SEQ ID NO: 9433049 - DNA, 22 bp, Homo sapiens
taaaggctcactggcttggggt

SEQ ID NO: 9433050 - DNA, 22 bp, Homo sapiens
taaaggcaattcagcaagccac

SEQ ID NO: 9433051 - DNA, 22 bp, Homo sapiens
taaaggcaaatgtgtgtttgtg

SEQ ID NO: 9433052 - DNA, 22 bp, Homo sapiens
taaaggcaaatgtgtgtttgtg

SEQ ID NO: 9433053 - DNA, 22 bp, Homo sapiens
taaaggcactgcgtccctcaaa

SEQ ID NO: 9433054 - DNA, 22 bp, Homo sapiens
taaaggcacggagttgttatgg

SEQ ID NO: 9433055 - DNA, 22 bp, Homo sapiens
taaaggcacggagttgttatgg

SEQ ID NO: 9433056 - DNA, 22 bp, Homo sapiens
taaaggcaaactctccaaggat

SEQ ID NO: 9433057 - DNA, 22 bp, Homo sapiens
taaaggcaaatgtgtgtttgtg

SEQ ID NO: 9433058 - DNA, 22 bp, Homo sapiens
taaaggagtgtgatgaaaggga

SEQ ID NO: 9433059 - DNA, 22 bp, Homo sapiens
taaaggaggagttaatgagact

SEQ ID NO: 9433060 - DNA, 22 bp, Homo sapiens
taaaggaggagttaatgagact

SEQ ID NO: 9433061 - DNA, 22 bp, Homo sapiens
taaaggaatcagttttagagat

SEQ ID NO: 9433062 - DNA, 22 bp, Homo sapiens
taaaggaatcagttttagagat

SEQ ID NO: 9433063 - DNA, 18 bp, Homo sapiens
taaaggaagtgggagagg

SEQ ID NO: 9433064 - DNA, 19 bp, Homo sapiens
taaaggaagaagggaggat

SEQ ID NO: 9433065 - DNA, 22 bp, Homo sapiens
taaaggaagaattctctgtgat

SEQ ID NO: 9433066 - DNA, 22 bp, Homo sapiens
taaaggaagaattctctgtgat

SEQ ID NO: 9433067 - DNA, 19 bp, Homo sapiens
taaaggaagaggaagggaa

SEQ ID NO: 9433068 - DNA, 22 bp, Homo sapiens
taaagcagcgtgggtggggcag

SEQ ID NO: 9433069 - DNA, 22 bp, Homo sapiens
taaagcagcgtgggtggggcag

SEQ ID NO: 9433070 - DNA, 22 bp, Homo sapiens
taaagcaggccacatatgtgat

SEQ ID NO: 9433071 - DNA, 22 bp, Homo sapiens
taaagcaggcatctctctcctc

SEQ ID NO: 9433072 - DNA, 22 bp, Homo sapiens
taaagcaggccacatatgtgat

SEQ ID NO: 9433073 - DNA, 22 bp, Homo sapiens
taaagcaggtgctcagtgacca

SEQ ID NO: 9433074 - DNA, 22 bp, Homo sapiens
taaaactagtggttgggactaa

SEQ ID NO: 9433075 - DNA, 22 bp, Homo sapiens
taaaactagtggttgggactaa

SEQ ID NO: 9433076 - DNA, 22 bp, Homo sapiens
taaaactagaccgtgagtctaa

SEQ ID NO: 9433077 - DNA, 22 bp, Homo sapiens
taaaactagaccgtgagtctaa

SEQ ID NO: 9433078 - DNA, 22 bp, Homo sapiens
taaaactagtggttgggactaa

SEQ ID NO: 9433079 - DNA, 22 bp, Homo sapiens
taaaactagaccgtgagtctaa

SEQ ID NO: 9433080 - DNA, 22 bp, Homo sapiens
taaaactagaccgtgagtctaa

SEQ ID NO: 9433081 - DNA, 22 bp, Homo sapiens
taaaacagcagggcagagaagt

SEQ ID NO: 9433082 - DNA, 22 bp, Homo sapiens
taaaaccataaggctggaagga

SEQ ID NO: 9433083 - DNA, 22 bp, Homo sapiens
taaaaccataaggctggaagga

SEQ ID NO: 9433084 - DNA, 22 bp, Homo sapiens
taaaaccataaggctggaagga

SEQ ID NO: 9433085 - DNA, 22 bp, Homo sapiens
taaaaccattcctgctttcatg

SEQ ID NO: 9433086 - DNA, 22 bp, Homo sapiens
taaaaccattcctgctttcatg

SEQ ID NO: 9433087 - DNA, 19 bp, Homo sapiens
taaaacgtgcatggcagca

SEQ ID NO: 9433088 - DNA, 22 bp, Homo sapiens
taaagctgttagagtagtaaga

SEQ ID NO: 9433089 - DNA, 22 bp, Homo sapiens
taaagctgcaggctcagaaaac

SEQ ID NO: 9433090 - DNA, 22 bp, Homo sapiens
taaagctgttcagtgcagaaag

SEQ ID NO: 9433091 - DNA, 22 bp, Homo sapiens
taaagctgcaggctcagaaaac

SEQ ID NO: 9433092 - DNA, 22 bp, Homo sapiens
taaagctgcaggctcagaaaac

SEQ ID NO: 9433093 - DNA, 22 bp, Homo sapiens
taaagctgaaatgattatgaca

SEQ ID NO: 9433094 - DNA, 22 bp, Homo sapiens
taaaggaacagaggactcattt

SEQ ID NO: 9433095 - DNA, 22 bp, Homo sapiens
taaaggaactgctgctatggaa

SEQ ID NO: 9433096 - DNA, 22 bp, Homo sapiens
taaagcagtatgatggaaggat

SEQ ID NO: 9433097 - DNA, 22 bp, Homo sapiens
taaagcagtctgtgtatgtgaa

SEQ ID NO: 9433098 - DNA, 22 bp, Homo sapiens
taaagctagaaggtgctgtaca

SEQ ID NO: 9433099 - DNA, 21 bp, Homo sapiens
taaagctagaaccttagcttt

SEQ ID NO: 9433100 - DNA, 21 bp, Homo sapiens
taaagctagaaccttagcttt

SEQ ID NO: 9433101 - DNA, 22 bp, Homo sapiens
taaagctagaattgttccagca

SEQ ID NO: 9433102 - DNA, 22 bp, Homo sapiens
taaagctagccaaccactgtct

SEQ ID NO: 9433103 - DNA, 21 bp, Homo sapiens
taaagctcgttcaggaaagtc

SEQ ID NO: 9433104 - DNA, 22 bp, Homo sapiens
taaagctattgctgtttattgt

SEQ ID NO: 9433105 - DNA, 22 bp, Homo sapiens
gtttaaataattaggggcctgt

SEQ ID NO: 9433106 - DNA, 22 bp, Homo sapiens
gtttaaataattaggggcctgt

SEQ ID NO: 9433107 - DNA, 22 bp, Homo sapiens
gtttaacatctgtgaagctgct

SEQ ID NO: 9433108 - DNA, 22 bp, Homo sapiens
gtttaaataattaggggcctgt

SEQ ID NO: 9433109 - DNA, 22 bp, Homo sapiens
gtttttcctgctgacttgggtc

SEQ ID NO: 9433110 - DNA, 22 bp, Homo sapiens
gtttttcctgctgacttgggtc

SEQ ID NO: 9433111 - DNA, 19 bp, Homo sapiens
gtttttcccagacgaggca

SEQ ID NO: 9433112 - DNA, 19 bp, Homo sapiens
gtttttcccagacgaggca

SEQ ID NO: 9433113 - DNA, 21 bp, Homo sapiens
gtttttcagccctgaggtgag

SEQ ID NO: 9433114 - DNA, 22 bp, Homo sapiens
gtttttccttgctgaggacccg

SEQ ID NO: 9433115 - DNA, 22 bp, Homo sapiens
gtttttccttgctgaggacccg

SEQ ID NO: 9433116 - DNA, 22 bp, Homo sapiens
gtttttctaagtagcgatattt

SEQ ID NO: 9433117 - DNA, 22 bp, Homo sapiens
gtttttctaagtagcgatattt

SEQ ID NO: 9433118 - DNA, 22 bp, Homo sapiens
gtttttctagaaatctcctcct

SEQ ID NO: 9433119 - DNA, 22 bp, Homo sapiens
gtttaagagggtttcattccca

SEQ ID NO: 9433120 - DNA, 22 bp, Homo sapiens
gtttaagtttcagaagctaaga

SEQ ID NO: 9433121 - DNA, 22 bp, Homo sapiens
gtttaagaaaattcatgttgtt

SEQ ID NO: 9433122 - DNA, 22 bp, Homo sapiens
gtttaacattgtaccaacacct

SEQ ID NO: 9433123 - DNA, 22 bp, Homo sapiens
gtttaatcagaggaattataga

SEQ ID NO: 9433124 - DNA, 20 bp, Homo sapiens
gtttttctctcttgccacta

SEQ ID NO: 9433125 - DNA, 22 bp, Homo sapiens
gtttttctaggaccatgtgatt

SEQ ID NO: 9433126 - DNA, 22 bp, Homo sapiens
gtttttctaggaccatgtgatt

SEQ ID NO: 9433127 - DNA, 22 bp, Homo sapiens
gtttttctaggaccatgtgatt

SEQ ID NO: 9433128 - DNA, 22 bp, Homo sapiens
gtttttctagactgggagtttg

SEQ ID NO: 9433129 - DNA, 22 bp, Homo sapiens
gtttttctagactgggagtttg

SEQ ID NO: 9433130 - DNA, 22 bp, Homo sapiens
gtttttctaggaccatgtgatt

SEQ ID NO: 9433131 - DNA, 22 bp, Homo sapiens
gtttttctagaaatctcctcct

SEQ ID NO: 9433132 - DNA, 22 bp, Homo sapiens
gtttttctagaaatctcctcct

SEQ ID NO: 9433133 - DNA, 22 bp, Homo sapiens
gtttttctagaaatctcctcct

SEQ ID NO: 9433134 - DNA, 22 bp, Homo sapiens
gtttttctagactgggagtttg

SEQ ID NO: 9433135 - DNA, 22 bp, Homo sapiens
gtttttctagactgggagtttg

SEQ ID NO: 9433136 - DNA, 20 bp, Homo sapiens
gtttttctctcttgccacta

SEQ ID NO: 9433137 - DNA, 20 bp, Homo sapiens
gtttttctctcttgccacta

SEQ ID NO: 9433138 - DNA, 22 bp, Homo sapiens
gtttttctctgaaatagttgac

SEQ ID NO: 9433139 - DNA, 22 bp, Homo sapiens
gtttttctctgaaatagttgac

SEQ ID NO: 9433140 - DNA, 22 bp, Homo sapiens
gtttttctctgaaatagttgac

SEQ ID NO: 9433141 - DNA, 22 bp, Homo sapiens
gtttttctgtgagcggtaaagg

SEQ ID NO: 9433142 - DNA, 22 bp, Homo sapiens
gtttttctgtgagcggtaaagg

SEQ ID NO: 9433143 - DNA, 20 bp, Homo sapiens
gtttttcttgggcgagctat

SEQ ID NO: 9433144 - DNA, 20 bp, Homo sapiens
gtttttcttgggcgagctat

SEQ ID NO: 9433145 - DNA, 22 bp, Homo sapiens
gttttttcatgagtagttatct

SEQ ID NO: 9433146 - DNA, 22 bp, Homo sapiens
gtttttgtccatggaggcaaac

SEQ ID NO: 9433147 - DNA, 22 bp, Homo sapiens
gtttttctttgtgtgaagacaa

SEQ ID NO: 9433148 - DNA, 22 bp, Homo sapiens
gtttttctttgtgtgaagacaa

SEQ ID NO: 9433149 - DNA, 22 bp, Homo sapiens
gtttttctttgtgtgaagacaa

SEQ ID NO: 9433150 - DNA, 22 bp, Homo sapiens
gtttttctttgtgtgaagacaa

SEQ ID NO: 9433151 - DNA, 22 bp, Homo sapiens
gtttttctttgtgtgaagacaa

SEQ ID NO: 9433152 - DNA, 22 bp, Homo sapiens
gtttttctttgtgtgaagacaa

SEQ ID NO: 9433153 - DNA, 22 bp, Homo sapiens
taaaacacctgtagtgtctgcc

SEQ ID NO: 9433154 - DNA, 22 bp, Homo sapiens
gttttttgggtgtatatcttct

SEQ ID NO: 9433155 - DNA, 22 bp, Homo sapiens
gttttttgggtgtatatcttct

SEQ ID NO: 9433156 - DNA, 22 bp, Homo sapiens
gttttttcatgagtagttatct

SEQ ID NO: 9433157 - DNA, 22 bp, Homo sapiens
gttttttcatgagtagttatct

SEQ ID NO: 9433158 - DNA, 22 bp, Homo sapiens
gtgtgcagggatgagtgcaggt

SEQ ID NO: 9433159 - DNA, 22 bp, Homo sapiens
gtgtgcagggatgagtgcaggt

SEQ ID NO: 9433160 - DNA, 22 bp, Homo sapiens
gtgtgcagggatgagtgcaggt

SEQ ID NO: 9433161 - DNA, 22 bp, Homo sapiens
gtgtgcagggatgagtgcaggt

SEQ ID NO: 9433162 - DNA, 22 bp, Homo sapiens
gtgtgcagggctgcctgtgccg

SEQ ID NO: 9433163 - DNA, 22 bp, Homo sapiens
gtgtgcagggctgcctgtgccg

SEQ ID NO: 9433164 - DNA, 22 bp, Homo sapiens
gtgtgcagggatgagtgcaggt

SEQ ID NO: 9433165 - DNA, 22 bp, Homo sapiens
gtgtgcaggccacaggccaggg

SEQ ID NO: 9433166 - DNA, 22 bp, Homo sapiens
gtgtgcagcagagacaggactc

SEQ ID NO: 9433167 - DNA, 22 bp, Homo sapiens
gtgtgcagcagagacaggactc

SEQ ID NO: 9433168 - DNA, 22 bp, Homo sapiens
gtgtgcagcagagacaggactc

SEQ ID NO: 9433169 - DNA, 23 bp, Homo sapiens
gtgtgcaggattatttgcagaca

SEQ ID NO: 9433170 - DNA, 22 bp, Homo sapiens
gtgtgcaggccacaggccaggg

SEQ ID NO: 9433171 - DNA, 22 bp, Homo sapiens
gtgtgcaggccacaggccaggg

SEQ ID NO: 9433172 - DNA, 22 bp, Homo sapiens
gtgtgcaggggcttggtggagc

SEQ ID NO: 9433173 - DNA, 22 bp, Homo sapiens
gtgtgcagggggccagcgcagc

SEQ ID NO: 9433174 - DNA, 22 bp, Homo sapiens
gtgtgcagggggccagcgcagc

SEQ ID NO: 9433175 - DNA, 22 bp, Homo sapiens
gtgtgcaggggcttggtggagc

SEQ ID NO: 9433176 - DNA, 22 bp, Homo sapiens
gtgtgcagggctgcctgtgccg

SEQ ID NO: 9433177 - DNA, 22 bp, Homo sapiens
gtgtgcagggctgcctgtgccg

SEQ ID NO: 9433178 - DNA, 22 bp, Homo sapiens
gtgtgcagggctgcctgtgccg

SEQ ID NO: 9433179 - DNA, 22 bp, Homo sapiens
gtgtgcaggtgtcagtgcagct

SEQ ID NO: 9433180 - DNA, 22 bp, Homo sapiens
gtgtgcaggtgtcagtgcagct

SEQ ID NO: 9433181 - DNA, 22 bp, Homo sapiens
gtgtgcaggtgtcagtgcagct

SEQ ID NO: 9433182 - DNA, 22 bp, Homo sapiens
gtgtgcagggggccagcgcagc

SEQ ID NO: 9433183 - DNA, 22 bp, Homo sapiens
gtgtgcagggggccagcgcagc

SEQ ID NO: 9433184 - DNA, 22 bp, Homo sapiens
gtgtgcaggtgtcagtgcagct

SEQ ID NO: 9433185 - DNA, 22 bp, Homo sapiens
gtgtgcagcagagacaggactc

SEQ ID NO: 9433186 - DNA, 22 bp, Homo sapiens
gtgtgcagcagagacaggactc

SEQ ID NO: 9433187 - DNA, 22 bp, Homo sapiens
gtgtgcagaggcaggaggtgct

SEQ ID NO: 9433188 - DNA, 22 bp, Homo sapiens
gtgtgcagaggcaggaggtgct

SEQ ID NO: 9433189 - DNA, 22 bp, Homo sapiens
gtgtgcagaagacacaagacat

SEQ ID NO: 9433190 - DNA, 22 bp, Homo sapiens
gtgtgcagatgtgatgctgggc

SEQ ID NO: 9433191 - DNA, 22 bp, Homo sapiens
gtgtgcagaacagggagtgggt

SEQ ID NO: 9433192 - DNA, 22 bp, Homo sapiens
gtgtgcagaagacacaagacat

SEQ ID NO: 9433193 - DNA, 22 bp, Homo sapiens
gtgtgcagaggcaggaggtgct

SEQ ID NO: 9433194 - DNA, 21 bp, Homo sapiens
gtgtgagtagcatgtgtctca

SEQ ID NO: 9433195 - DNA, 21 bp, Homo sapiens
gtgtgagtagcatgtgtctca

SEQ ID NO: 9433196 - DNA, 22 bp, Homo sapiens
gtgtgagtgaaagtagtttgat

SEQ ID NO: 9433197 - DNA, 21 bp, Homo sapiens
gtgtgagtagcatgtgtctca

SEQ ID NO: 9433198 - DNA, 22 bp, Homo sapiens
gtgtgagtgaaagtagtttgat

SEQ ID NO: 9433199 - DNA, 22 bp, Homo sapiens
gtgtgcaactttcattaatatt

SEQ ID NO: 9433200 - DNA, 22 bp, Homo sapiens
gtgtgcagaacagggagtgggt

SEQ ID NO: 9433201 - DNA, 22 bp, Homo sapiens
gtgtgggggcagctctgatatg

SEQ ID NO: 9433202 - DNA, 22 bp, Homo sapiens
gtgtgggggcagctctgatatg

SEQ ID NO: 9433203 - DNA, 22 bp, Homo sapiens
gtgtgggggcagctctgatatg

SEQ ID NO: 9433204 - DNA, 22 bp, Homo sapiens
gtgtggggctcagtgggaatgt

SEQ ID NO: 9433205 - DNA, 22 bp, Homo sapiens
gtgtggggctcagtgggaatgt

SEQ ID NO: 9433206 - DNA, 22 bp, Homo sapiens
gtgtggggctcagtgggaatgt

SEQ ID NO: 9433207 - DNA, 22 bp, Homo sapiens
gtgtggggtcttctcttggcct

SEQ ID NO: 9433208 - DNA, 22 bp, Homo sapiens
gtgtggggtcttctcttggcct

SEQ ID NO: 9433209 - DNA, 22 bp, Homo sapiens
gtgtggggtcttctcttggcct

SEQ ID NO: 9433210 - DNA, 22 bp, Homo sapiens
gtgtggggtcttctcttggcct

SEQ ID NO: 9433211 - DNA, 22 bp, Homo sapiens
gtgtgggtgtactgttctagat

SEQ ID NO: 9433212 - DNA, 22 bp, Homo sapiens
gtgtggtcgaagttctcccgga

SEQ ID NO: 9433213 - DNA, 22 bp, Homo sapiens
gtgtggtcgaagttctcccgga

SEQ ID NO: 9433214 - DNA, 22 bp, Homo sapiens
gtgtgtcagagctcagagaagt

SEQ ID NO: 9433215 - DNA, 22 bp, Homo sapiens
gtgtgtatgtagaactatgtat

SEQ ID NO: 9433216 - DNA, 22 bp, Homo sapiens
gtgtgtcaggtactgtgctagg

SEQ ID NO: 9433217 - DNA, 22 bp, Homo sapiens
gtgtgtcagagctcagagaagt

SEQ ID NO: 9433218 - DNA, 22 bp, Homo sapiens
gtgtgtagatgtgagaggactg

SEQ ID NO: 9433219 - DNA, 22 bp, Homo sapiens
gtgtgtaatgcttattgtgctt

SEQ ID NO: 9433220 - DNA, 22 bp, Homo sapiens
gtgtgggctgcagaggcacagc

SEQ ID NO: 9433221 - DNA, 22 bp, Homo sapiens
gtgtgggctatgtgcgtgggca

SEQ ID NO: 9433222 - DNA, 22 bp, Homo sapiens
gtgtgggctatgtgcgtgggca

SEQ ID NO: 9433223 - DNA, 22 bp, Homo sapiens
gtgtgggcagggccgtgctccc

SEQ ID NO: 9433224 - DNA, 22 bp, Homo sapiens
gtgtgcagtctgctaggcaggg

SEQ ID NO: 9433225 - DNA, 22 bp, Homo sapiens
gtgtgcagtagagaaagagcag

SEQ ID NO: 9433226 - DNA, 22 bp, Homo sapiens
gtgtgcaggtgtcagtgcagct

SEQ ID NO: 9433227 - DNA, 22 bp, Homo sapiens
gtgtgcagtctgctaggcaggg

SEQ ID NO: 9433228 - DNA, 22 bp, Homo sapiens
gtgtgcagtctgctaggcaggg

SEQ ID NO: 9433229 - DNA, 22 bp, Homo sapiens
gtgtgggaggaaggtgaacaga

SEQ ID NO: 9433230 - DNA, 22 bp, Homo sapiens
gtgtggggccaggatcagggct

SEQ ID NO: 9433231 - DNA, 22 bp, Homo sapiens
gtgtggggctcagtgggaatgt

SEQ ID NO: 9433232 - DNA, 22 bp, Homo sapiens
gtgtggggccaggatcagggct

SEQ ID NO: 9433233 - DNA, 22 bp, Homo sapiens
gtgtggggccaggatcagggct

SEQ ID NO: 9433234 - DNA, 22 bp, Homo sapiens
gtgtggggccaggatcagggct

SEQ ID NO: 9433235 - DNA, 22 bp, Homo sapiens
gtgtggggccaggatcagggct

SEQ ID NO: 9433236 - DNA, 22 bp, Homo sapiens
gtgtggggagctgcagccacat

SEQ ID NO: 9433237 - DNA, 22 bp, Homo sapiens
gtgtggggagctgcagccacat

SEQ ID NO: 9433238 - DNA, 22 bp, Homo sapiens
gtgtggggaggagagagccctt

SEQ ID NO: 9433239 - DNA, 22 bp, Homo sapiens
gtgtggggaggagagagccctt

SEQ ID NO: 9433240 - DNA, 22 bp, Homo sapiens
gtgtggggagctgcagccacat

SEQ ID NO: 9433241 - DNA, 22 bp, Homo sapiens
gtgtcctgccaccctgggcttt

SEQ ID NO: 9433242 - DNA, 22 bp, Homo sapiens
gtgtcctgcattggctctgccc

SEQ ID NO: 9433243 - DNA, 22 bp, Homo sapiens
gtgtcctgcattggctctgccc

SEQ ID NO: 9433244 - DNA, 22 bp, Homo sapiens
gtgtcctgatcaattgagctgg

SEQ ID NO: 9433245 - DNA, 18 bp, Homo sapiens
gtgtcctggctgcggcgc

SEQ ID NO: 9433246 - DNA, 22 bp, Homo sapiens
gtgtcctgccaccctgggcttt

SEQ ID NO: 9433247 - DNA, 22 bp, Homo sapiens
gtgtcctgccaccctgggcttt

SEQ ID NO: 9433248 - DNA, 22 bp, Homo sapiens
gtgtcccaggcctctggaatta

SEQ ID NO: 9433249 - DNA, 22 bp, Homo sapiens
gtgtcccaggagaggagacaat

SEQ ID NO: 9433250 - DNA, 22 bp, Homo sapiens
gtgtcccagccccacaggcctg

SEQ ID NO: 9433251 - DNA, 22 bp, Homo sapiens
gtgtcctgagtgaggcctggcc

SEQ ID NO: 9433252 - DNA, 22 bp, Homo sapiens
gtgtcctgagtgaggcctggcc

SEQ ID NO: 9433253 - DNA, 22 bp, Homo sapiens
gtgtccttcattggaatctctc

SEQ ID NO: 9433254 - DNA, 22 bp, Homo sapiens
gtgtccttatttctgtctctca

SEQ ID NO: 9433255 - DNA, 22 bp, Homo sapiens
gtgtccttcattggaatctctc

SEQ ID NO: 9433256 - DNA, 22 bp, Homo sapiens
gtgtccttttatgtgactggtt

SEQ ID NO: 9433257 - DNA, 22 bp, Homo sapiens
gtgtcctgtttccctgtctata

SEQ ID NO: 9433258 - DNA, 22 bp, Homo sapiens
gtgtcctgttcagaagcttggg

SEQ ID NO: 9433259 - DNA, 22 bp, Homo sapiens
gtgtcctgggctggtagagctg

SEQ ID NO: 9433260 - DNA, 22 bp, Homo sapiens
gtgtcctgggctggtagagctg

SEQ ID NO: 9433261 - DNA, 22 bp, Homo sapiens
gtgtcctgggtctctgattctt

SEQ ID NO: 9433262 - DNA, 22 bp, Homo sapiens
gtgtctgagtttggaaagtcca

SEQ ID NO: 9433263 - DNA, 22 bp, Homo sapiens
gtgtctcttagcctgctaatgc

SEQ ID NO: 9433264 - DNA, 22 bp, Homo sapiens
gtgtgagccatgatgtgtccag

SEQ ID NO: 9433265 - DNA, 22 bp, Homo sapiens
gtgtccttttgagggtccacag

SEQ ID NO: 9433266 - DNA, 22 bp, Homo sapiens
gtgtcgtgcttgccatgggtac

SEQ ID NO: 9433267 - DNA, 22 bp, Homo sapiens
gtgtcaggcagtcagcatggag

SEQ ID NO: 9433268 - DNA, 22 bp, Homo sapiens
gtgtcaggccctgcattatgtg

SEQ ID NO: 9433269 - DNA, 22 bp, Homo sapiens
gtgtcaggcagtcagcatggag

SEQ ID NO: 9433270 - DNA, 22 bp, Homo sapiens
gtgtcaggggcagccaggaaat

SEQ ID NO: 9433271 - DNA, 19 bp, Homo sapiens
gtgtcaggatgtgcagggg

SEQ ID NO: 9433272 - DNA, 22 bp, Homo sapiens
gtgtcaggcagtcagcatggag

SEQ ID NO: 9433273 - DNA, 22 bp, Homo sapiens
gtgtcaggagccttccatgggc

SEQ ID NO: 9433274 - DNA, 22 bp, Homo sapiens
gtgtcaggagaattagggcttt

SEQ ID NO: 9433275 - DNA, 22 bp, Homo sapiens
gtgtcaggagaattagggcttt

SEQ ID NO: 9433276 - DNA, 22 bp, Homo sapiens
gtgtcagatagtacaccaaggg

SEQ ID NO: 9433277 - DNA, 22 bp, Homo sapiens
gtgtccacggctgagaatgatt

SEQ ID NO: 9433278 - DNA, 22 bp, Homo sapiens
gtgtcatggggtttgttataca

SEQ ID NO: 9433279 - DNA, 22 bp, Homo sapiens
gtgtcatgcacactcagtgttg

SEQ ID NO: 9433280 - DNA, 22 bp, Homo sapiens
gtgtcccaaagattagaaatca

SEQ ID NO: 9433281 - DNA, 22 bp, Homo sapiens
gtgtccattcactgcaacactt

SEQ ID NO: 9433282 - DNA, 19 bp, Homo sapiens
gtgtccatggagcatggag

SEQ ID NO: 9433283 - DNA, 22 bp, Homo sapiens
gtgtcccaatgttcaggacggc

SEQ ID NO: 9433284 - DNA, 22 bp, Homo sapiens
gtgtcccaatctacttttccct

SEQ ID NO: 9433285 - DNA, 22 bp, Homo sapiens
gtgtcccagcagcacattggct

SEQ ID NO: 9433286 - DNA, 22 bp, Homo sapiens
gtgtcccactctggaggtgaag

SEQ ID NO: 9433287 - DNA, 22 bp, Homo sapiens
gtgtccagggctggaagtgagg

SEQ ID NO: 9433288 - DNA, 22 bp, Homo sapiens
gtgtccagagaaactcacagct

SEQ ID NO: 9433289 - DNA, 22 bp, Homo sapiens
gtgtccagcctgcacagggtgc

SEQ ID NO: 9433290 - DNA, 22 bp, Homo sapiens
gtgtccagatgaggagacgatg

SEQ ID NO: 9433291 - DNA, 22 bp, Homo sapiens
gttctccactgcagagtctctc

SEQ ID NO: 9433292 - DNA, 22 bp, Homo sapiens
gttctccaggggctgttcatct

SEQ ID NO: 9433293 - DNA, 22 bp, Homo sapiens
gttctccaggggctgttcatct

SEQ ID NO: 9433294 - DNA, 22 bp, Homo sapiens
gttctccattcagcttcctgtg

SEQ ID NO: 9433295 - DNA, 22 bp, Homo sapiens
gttctccaggggctgttcatct

SEQ ID NO: 9433296 - DNA, 22 bp, Homo sapiens
gttctccactgcagagtctctc

SEQ ID NO: 9433297 - DNA, 21 bp, Homo sapiens
gttctattttgcaaacttctg

SEQ ID NO: 9433298 - DNA, 22 bp, Homo sapiens
gttctattccccttatctgtga

SEQ ID NO: 9433299 - DNA, 22 bp, Homo sapiens
gttctattctccagttacatat

SEQ ID NO: 9433300 - DNA, 22 bp, Homo sapiens
gttctatttcagtaagcaggca

SEQ ID NO: 9433301 - DNA, 22 bp, Homo sapiens
gttctccttgtggctgcagcag

SEQ ID NO: 9433302 - DNA, 22 bp, Homo sapiens
gttctccttgtggctgcagcag

SEQ ID NO: 9433303 - DNA, 22 bp, Homo sapiens
gttctgagtcctcctttgaagg

SEQ ID NO: 9433304 - DNA, 22 bp, Homo sapiens
gttctctggagtccctgggccc

SEQ ID NO: 9433305 - DNA, 22 bp, Homo sapiens
gttctgaatgtgcctgtactct

SEQ ID NO: 9433306 - DNA, 22 bp, Homo sapiens
gttctctctgcttccaagatgg

SEQ ID NO: 9433307 - DNA, 22 bp, Homo sapiens
gttctgctcctgtggcaatcta

SEQ ID NO: 9433308 - DNA, 22 bp, Homo sapiens
gttctgagtggcccaagccctg

SEQ ID NO: 9433309 - DNA, 22 bp, Homo sapiens
gttctgagtggcccaagccctg

SEQ ID NO: 9433310 - DNA, 22 bp, Homo sapiens
gttctgcacatcacacaggtgc

SEQ ID NO: 9433311 - DNA, 22 bp, Homo sapiens
gttctgagtcctcctttgaagg

SEQ ID NO: 9433312 - DNA, 22 bp, Homo sapiens
gttgtatagagggcatgaatct

SEQ ID NO: 9433313 - DNA, 22 bp, Homo sapiens
gttgtattcttcaatatcagag

SEQ ID NO: 9433314 - DNA, 21 bp, Homo sapiens
gttgtggttggggctgcagct

SEQ ID NO: 9433315 - DNA, 22 bp, Homo sapiens
gttgtgtttttctgctggaagc

SEQ ID NO: 9433316 - DNA, 22 bp, Homo sapiens
gttgtgaatagtgccgcaataa

SEQ ID NO: 9433317 - DNA, 22 bp, Homo sapiens
gttgtgaatagtgccgcaataa

SEQ ID NO: 9433318 - DNA, 22 bp, Homo sapiens
gttgtttataaaaatatctagc

SEQ ID NO: 9433319 - DNA, 22 bp, Homo sapiens
gttattttatctctgagaggtt

SEQ ID NO: 9433320 - DNA, 22 bp, Homo sapiens
gttattttatctctgagaggtt

SEQ ID NO: 9433321 - DNA, 22 bp, Homo sapiens
gttattttatctctgagaggtt

SEQ ID NO: 9433322 - DNA, 22 bp, Homo sapiens
gttattttatctctgagaggtt

SEQ ID NO: 9433323 - DNA, 22 bp, Homo sapiens
gttattttcattggctcagact

SEQ ID NO: 9433324 - DNA, 22 bp, Homo sapiens
gttattttatctctgagaggtt

SEQ ID NO: 9433325 - DNA, 22 bp, Homo sapiens
gttattttatctctgagaggtt

SEQ ID NO: 9433326 - DNA, 22 bp, Homo sapiens
gttattttatctctgagaggtt

SEQ ID NO: 9433327 - DNA, 21 bp, Homo sapiens
gttattttaagtgagctttgc

SEQ ID NO: 9433328 - DNA, 21 bp, Homo sapiens
gttattttaagtgagctttgc

SEQ ID NO: 9433329 - DNA, 22 bp, Homo sapiens
gttcaaaattcaaatggtatac

SEQ ID NO: 9433330 - DNA, 22 bp, Homo sapiens
gttattttcattggctcagact

SEQ ID NO: 9433331 - DNA, 22 bp, Homo sapiens
gttattttcattggctcagact

SEQ ID NO: 9433332 - DNA, 22 bp, Homo sapiens
gttattttcattggctcagact

SEQ ID NO: 9433333 - DNA, 22 bp, Homo sapiens
gttattttcattggctcagact

SEQ ID NO: 9433334 - DNA, 21 bp, Homo sapiens
gttattttaagtgagctttgc

SEQ ID NO: 9433335 - DNA, 21 bp, Homo sapiens
gttattttaagtgagctttgc

SEQ ID NO: 9433336 - DNA, 21 bp, Homo sapiens
gttattttaagtgagctttgc

SEQ ID NO: 9433337 - DNA, 22 bp, Homo sapiens
gttattttaacttctcagtaat

SEQ ID NO: 9433338 - DNA, 22 bp, Homo sapiens
gtgtgtcctcagtagtggcatg

SEQ ID NO: 9433339 - DNA, 22 bp, Homo sapiens
gtgtgtcctcagtagtggcatg

SEQ ID NO: 9433340 - DNA, 22 bp, Homo sapiens
gttattttaacttctcagtaat

SEQ ID NO: 9433341 - DNA, 22 bp, Homo sapiens
gttattttaacttctcagtaat

SEQ ID NO: 9433342 - DNA, 22 bp, Homo sapiens
gttattttaacttctcagtaat

SEQ ID NO: 9433343 - DNA, 22 bp, Homo sapiens
gtgtgtcaggtactgtgctagg

SEQ ID NO: 9433344 - DNA, 22 bp, Homo sapiens
gttctacagttcctattactta

SEQ ID NO: 9433345 - DNA, 22 bp, Homo sapiens
gttctaatattttaaaagccaa

SEQ ID NO: 9433346 - DNA, 22 bp, Homo sapiens
gttcaaggttttacagagtgta

SEQ ID NO: 9433347 - DNA, 22 bp, Homo sapiens
gttcaaggttttacagagtgta

SEQ ID NO: 9433348 - DNA, 18 bp, Homo sapiens
gttcaaggtcaagagaga

SEQ ID NO: 9433349 - DNA, 22 bp, Homo sapiens
gttctaagggcttgaaatgtat

SEQ ID NO: 9433350 - DNA, 22 bp, Homo sapiens
gttctaataggagaaaagacag

SEQ ID NO: 9433351 - DNA, 22 bp, Homo sapiens
gttcaagaccagcctggccaac

SEQ ID NO: 9433352 - DNA, 22 bp, Homo sapiens
gttcaaggaagggaggaaagcc

SEQ ID NO: 9433353 - DNA, 18 bp, Homo sapiens
gttcaaggtcaagagaga

SEQ ID NO: 9433354 - DNA, 22 bp, Homo sapiens
gttcaaggaagggaggaaagcc

SEQ ID NO: 9433355 - DNA, 18 bp, Homo sapiens
gttcaagccaacatcaag

SEQ ID NO: 9433356 - DNA, 22 bp, Homo sapiens
gttcaaattctatgaaatatgt

SEQ ID NO: 9433357 - DNA, 22 bp, Homo sapiens
gttcaaattgagatggtataaa

SEQ ID NO: 9433358 - DNA, 21 bp, Homo sapiens
gttcaaatgggtagattcaca

SEQ ID NO: 9433359 - DNA, 21 bp, Homo sapiens
gttcaaatgggtagattcaca

SEQ ID NO: 9433360 - DNA, 21 bp, Homo sapiens
gttcaaatgggtagattcaca

SEQ ID NO: 9433361 - DNA, 21 bp, Homo sapiens
gttcaaatcctgacactacac

SEQ ID NO: 9433362 - DNA, 22 bp, Homo sapiens
gttcaaatctcaggacttcaga

SEQ ID NO: 9433363 - DNA, 22 bp, Homo sapiens
gttcaaatggctgcagttacca

SEQ ID NO: 9433364 - DNA, 22 bp, Homo sapiens
gttcaaatggctgcagttacca

SEQ ID NO: 9433365 - DNA, 22 bp, Homo sapiens
gttcaaatctcaggacttcaga

SEQ ID NO: 9433366 - DNA, 22 bp, Homo sapiens
gttcaagaccagcctggccaac

SEQ ID NO: 9433367 - DNA, 22 bp, Homo sapiens
gttcaaattttggctgtactgc

SEQ ID NO: 9433368 - DNA, 22 bp, Homo sapiens
gtgggggtggaaaggcaagttg

SEQ ID NO: 9433369 - DNA, 22 bp, Homo sapiens
gtgggggtggaaaggcaagttg

SEQ ID NO: 9433370 - DNA, 22 bp, Homo sapiens
gtgggggtggaaaggcaagttg

SEQ ID NO: 9433371 - DNA, 22 bp, Homo sapiens
gtgggggtttcattaagacaat

SEQ ID NO: 9433372 - DNA, 22 bp, Homo sapiens
gtgggggtggaaaggcaagttg

SEQ ID NO: 9433373 - DNA, 22 bp, Homo sapiens
gtgggggtggaaaggcaagttg

SEQ ID NO: 9433374 - DNA, 22 bp, Homo sapiens
gtgggggtggaaaggcaagttg

SEQ ID NO: 9433375 - DNA, 22 bp, Homo sapiens
gtgggggtttcattaagacaat

SEQ ID NO: 9433376 - DNA, 22 bp, Homo sapiens
gtggggtagatctttctcagga

SEQ ID NO: 9433377 - DNA, 22 bp, Homo sapiens
gtggggtagatctttctcagga

SEQ ID NO: 9433378 - DNA, 22 bp, Homo sapiens
gtggggggagctgcaagctgga

SEQ ID NO: 9433379 - DNA, 22 bp, Homo sapiens
gtggggggacgttggtcacttt

SEQ ID NO: 9433380 - DNA, 22 bp, Homo sapiens
gtggggggacgttggtcacttt

SEQ ID NO: 9433381 - DNA, 22 bp, Homo sapiens
gtggggggagctgcaagctgga

SEQ ID NO: 9433382 - DNA, 22 bp, Homo sapiens
gtggggggagctgcaagctgga

SEQ ID NO: 9433383 - DNA, 22 bp, Homo sapiens
gtggggggagctgcaagctgga

SEQ ID NO: 9433384 - DNA, 22 bp, Homo sapiens
gtggggggacgttggtcacttt

SEQ ID NO: 9433385 - DNA, 22 bp, Homo sapiens
gtgggggctggctcgtcctgtg

SEQ ID NO: 9433386 - DNA, 22 bp, Homo sapiens
gtgggggctggctcgtcctgtg

SEQ ID NO: 9433387 - DNA, 22 bp, Homo sapiens
gtgggggctggctcgtcctgtg

SEQ ID NO: 9433388 - DNA, 22 bp, Homo sapiens
gtgggggctggctcgtcctgtg

SEQ ID NO: 9433389 - DNA, 18 bp, Homo sapiens
gtggggtgttgtgaggat

SEQ ID NO: 9433390 - DNA, 18 bp, Homo sapiens
gtggggtgttgtgaggat

SEQ ID NO: 9433391 - DNA, 22 bp, Homo sapiens
gtggggtgtccagcagcgagct

SEQ ID NO: 9433392 - DNA, 22 bp, Homo sapiens
gtggggtgtccagcagcgagct

SEQ ID NO: 9433393 - DNA, 18 bp, Homo sapiens
gtggggtgttgtgaggat

SEQ ID NO: 9433394 - DNA, 22 bp, Homo sapiens
gtggggtgtccagcagcgagct

SEQ ID NO: 9433395 - DNA, 22 bp, Homo sapiens
gtggggtgggctgagttaggcc

SEQ ID NO: 9433396 - DNA, 22 bp, Homo sapiens
gtggggtgggctgagttaggcc

SEQ ID NO: 9433397 - DNA, 22 bp, Homo sapiens
gtggggtgggctgagttaggcc

SEQ ID NO: 9433398 - DNA, 22 bp, Homo sapiens
gtggggtgcagcagtactgtgt

SEQ ID NO: 9433399 - DNA, 22 bp, Homo sapiens
gtggtcagaaatctcagtggca

SEQ ID NO: 9433400 - DNA, 22 bp, Homo sapiens
gtggtcaggggctgaggtgccc

SEQ ID NO: 9433401 - DNA, 22 bp, Homo sapiens
gtggtcagcagcagtgggagtg

SEQ ID NO: 9433402 - DNA, 22 bp, Homo sapiens
gtgggtgatgtactggaggcca

SEQ ID NO: 9433403 - DNA, 22 bp, Homo sapiens
gtgggtgatgtactggaggcca

SEQ ID NO: 9433404 - DNA, 22 bp, Homo sapiens
gtgggtgcggggagccgaggcg

SEQ ID NO: 9433405 - DNA, 22 bp, Homo sapiens
gtgggtgcggggagccgaggcg

SEQ ID NO: 9433406 - DNA, 22 bp, Homo sapiens
gtgggtgatgtactggaggcca

SEQ ID NO: 9433407 - DNA, 22 bp, Homo sapiens
gtgggtgcggggagccgaggcg

SEQ ID NO: 9433408 - DNA, 22 bp, Homo sapiens
gtgggtggagactgggtgcaag

SEQ ID NO: 9433409 - DNA, 22 bp, Homo sapiens
gtgggtggagactgggtgcaag

SEQ ID NO: 9433410 - DNA, 22 bp, Homo sapiens
gtgggtggacggtgcttttgtt

SEQ ID NO: 9433411 - DNA, 22 bp, Homo sapiens
gtgggtggaggcgtcgagggca

SEQ ID NO: 9433412 - DNA, 22 bp, Homo sapiens
gtgggtggagactgggtgcaag

SEQ ID NO: 9433413 - DNA, 22 bp, Homo sapiens
gtgtaagtatctttgtatcttt

SEQ ID NO: 9433414 - DNA, 22 bp, Homo sapiens
gtgtaatgttgtcagcatcatc

SEQ ID NO: 9433415 - DNA, 22 bp, Homo sapiens
gtgtaagtatctttgtatcttt

SEQ ID NO: 9433416 - DNA, 22 bp, Homo sapiens
gtgtaattatataaagatctac

SEQ ID NO: 9433417 - DNA, 22 bp, Homo sapiens
gtgtacaaaatgtctccatgga

SEQ ID NO: 9433418 - DNA, 17 bp, Homo sapiens
gtgtacaagcagaaggc

SEQ ID NO: 9433419 - DNA, 22 bp, Homo sapiens
gtgtacaaaatgtctccatgga

SEQ ID NO: 9433420 - DNA, 22 bp, Homo sapiens
gtgtaatttctaggtaatttga

SEQ ID NO: 9433421 - DNA, 22 bp, Homo sapiens
gtgtcacaggcccagctcttca

SEQ ID NO: 9433422 - DNA, 22 bp, Homo sapiens
gtgtcaatgaggtttatttttg

SEQ ID NO: 9433423 - DNA, 19 bp, Homo sapiens
gtgtacagctcagtgaatt

SEQ ID NO: 9433424 - DNA, 19 bp, Homo sapiens
gtggttttctgaggagtct

SEQ ID NO: 9433425 - DNA, 22 bp, Homo sapiens
gtggttttattcgttcctctgt

SEQ ID NO: 9433426 - DNA, 22 bp, Homo sapiens
gtggtttgttttattcctggaa

SEQ ID NO: 9433427 - DNA, 22 bp, Homo sapiens
gtggttttgctttatgagtgaa

SEQ ID NO: 9433428 - DNA, 22 bp, Homo sapiens
gtgtaaaaacatactatttcta

SEQ ID NO: 9433429 - DNA, 22 bp, Homo sapiens
gtggtttttagatttctacagt

SEQ ID NO: 9433430 - DNA, 17 bp, Homo sapiens
gtgtaaatgctagaaac

SEQ ID NO: 9433431 - DNA, 22 bp, Homo sapiens
gtgtaaatcagcttgtgtaata

SEQ ID NO: 9433432 - DNA, 22 bp, Homo sapiens
gtgtaaatgccccattcattga

SEQ ID NO: 9433433 - DNA, 22 bp, Homo sapiens
gtgtaaatttgtacttgtaaat

SEQ ID NO: 9433434 - DNA, 22 bp, Homo sapiens
gtgtaacttttattcatgctct

SEQ ID NO: 9433435 - DNA, 22 bp, Homo sapiens
gtgtaaacacccttactgtggc

SEQ ID NO: 9433436 - DNA, 22 bp, Homo sapiens
gtgtaaacaatgaaaacagagc

SEQ ID NO: 9433437 - DNA, 22 bp, Homo sapiens
gtgtaaacaacagtggtttgaa

SEQ ID NO: 9433438 - DNA, 18 bp, Homo sapiens
gtgtaaacagccattgag

SEQ ID NO: 9433439 - DNA, 21 bp, Homo sapiens
gtgtaaacggactcatgcagt

SEQ ID NO: 9433440 - DNA, 22 bp, Homo sapiens
gtgtaaatcagcttgtgtaata

SEQ ID NO: 9433441 - DNA, 22 bp, Homo sapiens
gtggtccccagagctgtgtaca

SEQ ID NO: 9433442 - DNA, 22 bp, Homo sapiens
gtggtcctgcacccgcttggcc

SEQ ID NO: 9433443 - DNA, 22 bp, Homo sapiens
gtggtcctgccagccaggtcca

SEQ ID NO: 9433444 - DNA, 22 bp, Homo sapiens
gtggtcctcataattcagtgag

SEQ ID NO: 9433445 - DNA, 22 bp, Homo sapiens
gtggtcccttctggccctggtc

SEQ ID NO: 9433446 - DNA, 22 bp, Homo sapiens
gtggtcctttagaggatgtaat

SEQ ID NO: 9433447 - DNA, 22 bp, Homo sapiens
gtggtcctggcaaccatggtga

SEQ ID NO: 9433448 - DNA, 22 bp, Homo sapiens
gtggtcctggcaaccatggtga

SEQ ID NO: 9433449 - DNA, 22 bp, Homo sapiens
gtggtgagattgctggatcaaa

SEQ ID NO: 9433450 - DNA, 22 bp, Homo sapiens
gtggtgagagtaggtgtcctct

SEQ ID NO: 9433451 - DNA, 22 bp, Homo sapiens
gtggtgagattgctggatcaaa

SEQ ID NO: 9433452 - DNA, 22 bp, Homo sapiens
gtggtgaagccccatctctgct

SEQ ID NO: 9433453 - DNA, 22 bp, Homo sapiens
gtggtgaagcattgagaagtca

SEQ ID NO: 9433454 - DNA, 22 bp, Homo sapiens
gtggtgcaggaagcatctggct

SEQ ID NO: 9433455 - DNA, 22 bp, Homo sapiens
gtggtgcaggccagcaggggcg

SEQ ID NO: 9433456 - DNA, 22 bp, Homo sapiens
gtggtgagttcaggctggggtg

SEQ ID NO: 9433457 - DNA, 22 bp, Homo sapiens
gtggtgcatgcatgcatatgta

SEQ ID NO: 9433458 - DNA, 22 bp, Homo sapiens
gtggtgcatccttgagtaagct

SEQ ID NO: 9433459 - DNA, 22 bp, Homo sapiens
gtggtgcatccttgagtaagct

SEQ ID NO: 9433460 - DNA, 22 bp, Homo sapiens
gtggtgtaggtcacagttagga

SEQ ID NO: 9433461 - DNA, 22 bp, Homo sapiens
gtggtgcatccttgagtaagct

SEQ ID NO: 9433462 - DNA, 22 bp, Homo sapiens
gtggttgtttaggtcgtggatc

SEQ ID NO: 9433463 - DNA, 22 bp, Homo sapiens
gtggtttgtgcatagctcctat

SEQ ID NO: 9433464 - DNA, 23 bp, Homo sapiens
gtggttcttaaaggtccccagtc

SEQ ID NO: 9433465 - DNA, 21 bp, Homo sapiens
gtggttctagagaaacagaat

SEQ ID NO: 9433466 - DNA, 22 bp, Homo sapiens
gtggttatgagcatggacttgg

SEQ ID NO: 9433467 - DNA, 21 bp, Homo sapiens
gtggttattttcattagcatc

SEQ ID NO: 9433468 - DNA, 22 bp, Homo sapiens
gtggtgtgtgcttagggctagg

SEQ ID NO: 9433469 - DNA, 22 bp, Homo sapiens
gtgggccactgggaggcaaggg

SEQ ID NO: 9433470 - DNA, 22 bp, Homo sapiens
gtgggccacatcccagggctct

SEQ ID NO: 9433471 - DNA, 22 bp, Homo sapiens
gtgggcattggagggggtacag

SEQ ID NO: 9433472 - DNA, 22 bp, Homo sapiens
gtgggcagttggtgattctcgt

SEQ ID NO: 9433473 - DNA, 20 bp, Homo sapiens
gtgggcatcagtcacagtgt

SEQ ID NO: 9433474 - DNA, 22 bp, Homo sapiens
gtgggcaggaggccctgccctg

SEQ ID NO: 9433475 - DNA, 22 bp, Homo sapiens
gtgggcagccccttcaaggcca

SEQ ID NO: 9433476 - DNA, 22 bp, Homo sapiens
gtgggcagccccttcaaggcca

SEQ ID NO: 9433477 - DNA, 22 bp, Homo sapiens
gtgggcagcctgtccggagacc

SEQ ID NO: 9433478 - DNA, 22 bp, Homo sapiens
gtgggcagttcaattctgggag

SEQ ID NO: 9433479 - DNA, 22 bp, Homo sapiens
gtgggcagttcaattctgggag

SEQ ID NO: 9433480 - DNA, 22 bp, Homo sapiens
gtgggcagtggtttgcgcggtc

SEQ ID NO: 9433481 - DNA, 22 bp, Homo sapiens
gtgggcagtggtttgcgcggtc

SEQ ID NO: 9433482 - DNA, 22 bp, Homo sapiens
gtgggcagtggtttgcgcggtc

SEQ ID NO: 9433483 - DNA, 22 bp, Homo sapiens
gtgggcagccccttcaaggcca

SEQ ID NO: 9433484 - DNA, 20 bp, Homo sapiens
gtgggcagcaggcatactgg

SEQ ID NO: 9433485 - DNA, 22 bp, Homo sapiens
gtgggcagcaccagggaagtgt

SEQ ID NO: 9433486 - DNA, 22 bp, Homo sapiens
gtgggcagcaccagggaagtgt

SEQ ID NO: 9433487 - DNA, 20 bp, Homo sapiens
gtgggcagatgtgtgcatgg

SEQ ID NO: 9433488 - DNA, 22 bp, Homo sapiens
gtgggcagatacatttgatatg

SEQ ID NO: 9433489 - DNA, 22 bp, Homo sapiens
gtgggcagaggagagaacatta

SEQ ID NO: 9433490 - DNA, 22 bp, Homo sapiens
gtgggcagacagtgctttgcag

SEQ ID NO: 9433491 - DNA, 22 bp, Homo sapiens
gtgggcagacatgatagaagga

SEQ ID NO: 9433492 - DNA, 22 bp, Homo sapiens
gtgggcagacatgatagaagga

SEQ ID NO: 9433493 - DNA, 22 bp, Homo sapiens
gtgggcagacagtgctttgcag

SEQ ID NO: 9433494 - DNA, 22 bp, Homo sapiens
gtgggcagagcaagggaactca

SEQ ID NO: 9433495 - DNA, 22 bp, Homo sapiens
gtgggcagagcaagggaactca

SEQ ID NO: 9433496 - DNA, 22 bp, Homo sapiens
gtgggcagagcaagggaactca

SEQ ID NO: 9433497 - DNA, 22 bp, Homo sapiens
gtgggcagaggagagaacatta

SEQ ID NO: 9433498 - DNA, 20 bp, Homo sapiens
gtgggcagagcaccacctgg

SEQ ID NO: 9433499 - DNA, 22 bp, Homo sapiens
gtggggaggcattcttctccct

SEQ ID NO: 9433500 - DNA, 22 bp, Homo sapiens
gtggggaggcattcttctccct

SEQ ID NO: 9433501 - DNA, 22 bp, Homo sapiens
gtggggaggcctaagcaagttg

SEQ ID NO: 9433502 - DNA, 22 bp, Homo sapiens
gtggggaggcctaagcaagttg

SEQ ID NO: 9433503 - DNA, 22 bp, Homo sapiens
gtggggctggaagatgggtact

SEQ ID NO: 9433504 - DNA, 22 bp, Homo sapiens
gtggggctggaagatgggtact

SEQ ID NO: 9433505 - DNA, 22 bp, Homo sapiens
gtggggaaaggagtggggctca

SEQ ID NO: 9433506 - DNA, 22 bp, Homo sapiens
gtggggaaaggagtggggctca

SEQ ID NO: 9433507 - DNA, 22 bp, Homo sapiens
gtggggacgggatggctcactg

SEQ ID NO: 9433508 - DNA, 22 bp, Homo sapiens
gtggggagcagccttagcccct

SEQ ID NO: 9433509 - DNA, 22 bp, Homo sapiens
gtggggagcagccttagcccct

SEQ ID NO: 9433510 - DNA, 22 bp, Homo sapiens
gtggggaggcattcttctccct

SEQ ID NO: 9433511 - DNA, 22 bp, Homo sapiens
gtggggagcagccttagcccct

SEQ ID NO: 9433512 - DNA, 22 bp, Homo sapiens
gtgggggagatgcttaggtccg

SEQ ID NO: 9433513 - DNA, 22 bp, Homo sapiens
gtgggggacccaggtgctgtcc

SEQ ID NO: 9433514 - DNA, 22 bp, Homo sapiens
gtgggggatgctgagttggaaa

SEQ ID NO: 9433515 - DNA, 22 bp, Homo sapiens
gtggggcttcctggggcaagtt

SEQ ID NO: 9433516 - DNA, 22 bp, Homo sapiens
gtggggcttcctggggcaagtt

SEQ ID NO: 9433517 - DNA, 22 bp, Homo sapiens
gtggggcttcctggggcaagtt

SEQ ID NO: 9433518 - DNA, 22 bp, Homo sapiens
gtgggggcagtgggcttcgagc

SEQ ID NO: 9433519 - DNA, 22 bp, Homo sapiens
gtgggggctggaaatcttgcca

SEQ ID NO: 9433520 - DNA, 22 bp, Homo sapiens
gtgggggcagtgggcttcgagc

SEQ ID NO: 9433521 - DNA, 22 bp, Homo sapiens
gtgggggctggaaatcttgcca

SEQ ID NO: 9433522 - DNA, 22 bp, Homo sapiens
gtgggggctggaaatcttgcca

SEQ ID NO: 9433523 - DNA, 22 bp, Homo sapiens
gtgggggcaggcagtgctagga

SEQ ID NO: 9433524 - DNA, 22 bp, Homo sapiens
gtgggggcaggcagtgctagga

SEQ ID NO: 9433525 - DNA, 22 bp, Homo sapiens
gtgggggcaggcagtgctagga

SEQ ID NO: 9433526 - DNA, 22 bp, Homo sapiens
gtgggggcaggcagtgctagga

SEQ ID NO: 9433527 - DNA, 22 bp, Homo sapiens
gtgggctgttgttccctgttct

SEQ ID NO: 9433528 - DNA, 22 bp, Homo sapiens
gtgggctggaccctcctgctcc

SEQ ID NO: 9433529 - DNA, 22 bp, Homo sapiens
gtgggctggaccctcctgctcc

SEQ ID NO: 9433530 - DNA, 22 bp, Homo sapiens
gtgggctggaccctcctgctcc

SEQ ID NO: 9433531 - DNA, 22 bp, Homo sapiens
gtgggctggatttgcttgcaga

SEQ ID NO: 9433532 - DNA, 22 bp, Homo sapiens
gtgggctggatttgcttgcaga

SEQ ID NO: 9433533 - DNA, 22 bp, Homo sapiens
gtgggctggatttgcttgcaga

SEQ ID NO: 9433534 - DNA, 22 bp, Homo sapiens
gtgggctggatttgcttgcaga

SEQ ID NO: 9433535 - DNA, 22 bp, Homo sapiens
gtgggctggaccctcctgctcc

SEQ ID NO: 9433536 - DNA, 22 bp, Homo sapiens
gtgggctgcttcctccttccac

SEQ ID NO: 9433537 - DNA, 22 bp, Homo sapiens
gtgggctgcttcctccttccac

SEQ ID NO: 9433538 - DNA, 22 bp, Homo sapiens
gtgggctgcttcctccttccac

SEQ ID NO: 9433539 - DNA, 22 bp, Homo sapiens
gtgggctgcccttgaggtcagc

SEQ ID NO: 9433540 - DNA, 22 bp, Homo sapiens
gtgggctgcccttgaggtcagc

SEQ ID NO: 9433541 - DNA, 22 bp, Homo sapiens
gtgggcctcccctttacgagcc

SEQ ID NO: 9433542 - DNA, 22 bp, Homo sapiens
gtgggcctgatgctgccatgag

SEQ ID NO: 9433543 - DNA, 22 bp, Homo sapiens
gtgggccttgcagggtgcaggg

SEQ ID NO: 9433544 - DNA, 22 bp, Homo sapiens
gtgggctgcccttgaggtcagc

SEQ ID NO: 9433545 - DNA, 22 bp, Homo sapiens
gtgggctgaggggacaccaagg

SEQ ID NO: 9433546 - DNA, 22 bp, Homo sapiens
tggactcccagagctgctctcc

SEQ ID NO: 9433547 - DNA, 20 bp, Homo sapiens
tggacctgtctctttaggga

SEQ ID NO: 9433548 - DNA, 20 bp, Homo sapiens
tggacctgtctctttaggga

SEQ ID NO: 9433549 - DNA, 21 bp, Homo sapiens
tggacctgtccttctcgctgt

SEQ ID NO: 9433550 - DNA, 22 bp, Homo sapiens
tggacctggggtggcctcctct

SEQ ID NO: 9433551 - DNA, 19 bp, Homo sapiens
tggacctgtgcccatggct

SEQ ID NO: 9433552 - DNA, 21 bp, Homo sapiens
tggactggtgagtttaggctg

SEQ ID NO: 9433553 - DNA, 22 bp, Homo sapiens
tggactcttggaccttctctaa

SEQ ID NO: 9433554 - DNA, 22 bp, Homo sapiens
tggactctaagcagaggatcta

SEQ ID NO: 9433555 - DNA, 22 bp, Homo sapiens
tggactctatgatgcgccagca

SEQ ID NO: 9433556 - DNA, 22 bp, Homo sapiens
tggactctgaactggcactgac

SEQ ID NO: 9433557 - DNA, 22 bp, Homo sapiens
tggacctgagcctggccctgcc

SEQ ID NO: 9433558 - DNA, 22 bp, Homo sapiens
tggacctgaagaataggaagta

SEQ ID NO: 9433559 - DNA, 22 bp, Homo sapiens
tggacctgaagaataggaagta

SEQ ID NO: 9433560 - DNA, 22 bp, Homo sapiens
tggacctggggtggcctcctct

SEQ ID NO: 9433561 - DNA, 22 bp, Homo sapiens
tggacctgctggatgggcaggt

SEQ ID NO: 9433562 - DNA, 22 bp, Homo sapiens
tggacctgagcctggccctgcc

SEQ ID NO: 9433563 - DNA, 22 bp, Homo sapiens
tggacctgcgtaggtgctgggc

SEQ ID NO: 9433564 - DNA, 22 bp, Homo sapiens
tggacctgctggatgggcaggt

SEQ ID NO: 9433565 - DNA, 23 bp, Homo sapiens
tggaccctgcacaccagctctac

SEQ ID NO: 9433566 - DNA, 22 bp, Homo sapiens
tggaccctgaagcaacagggag

SEQ ID NO: 9433567 - DNA, 22 bp, Homo sapiens
tggaccgcagggatgcccggca

SEQ ID NO: 9433568 - DNA, 22 bp, Homo sapiens
tggaccctggactgccctggcc

SEQ ID NO: 9433569 - DNA, 22 bp, Homo sapiens
tggacccaggcaggtctgtcct

SEQ ID NO: 9433570 - DNA, 22 bp, Homo sapiens
tggaccccagacaagccagggt

SEQ ID NO: 9433571 - DNA, 22 bp, Homo sapiens
tggaccctacccggccctcggc

SEQ ID NO: 9433572 - DNA, 22 bp, Homo sapiens
tggacagggcagagaccgagtc

SEQ ID NO: 9433573 - DNA, 22 bp, Homo sapiens
tggacaggctcctaggggttcc

SEQ ID NO: 9433574 - DNA, 22 bp, Homo sapiens
tggacaggctcctaggggttcc

SEQ ID NO: 9433575 - DNA, 20 bp, Homo sapiens
tggacaggggcataggttgc

SEQ ID NO: 9433576 - DNA, 22 bp, Homo sapiens
tggacagggcagagaccgagtc

SEQ ID NO: 9433577 - DNA, 20 bp, Homo sapiens
tggacaggggcataggttgc

SEQ ID NO: 9433578 - DNA, 23 bp, Homo sapiens
tggacagggtaactggtggtttt

SEQ ID NO: 9433579 - DNA, 18 bp, Homo sapiens
tggacagggtggagaaaa

SEQ ID NO: 9433580 - DNA, 18 bp, Homo sapiens
tggacagggtggagaaaa

SEQ ID NO: 9433581 - DNA, 23 bp, Homo sapiens
tggacagggtaactggtggtttt

SEQ ID NO: 9433582 - DNA, 22 bp, Homo sapiens
tggacaggggctgctgttgtca

SEQ ID NO: 9433583 - DNA, 20 bp, Homo sapiens
tggacaggggcataggttgc

SEQ ID NO: 9433584 - DNA, 22 bp, Homo sapiens
tggacaggggctgctgttgtca

SEQ ID NO: 9433585 - DNA, 23 bp, Homo sapiens
tggacagggtaactggtggtttt

SEQ ID NO: 9433586 - DNA, 21 bp, Homo sapiens
tggacattatggagagagtag

SEQ ID NO: 9433587 - DNA, 22 bp, Homo sapiens
tggacatttggaatactatatt

SEQ ID NO: 9433588 - DNA, 21 bp, Homo sapiens
tggaccaaagtaatttgcctt

SEQ ID NO: 9433589 - DNA, 22 bp, Homo sapiens
tggaccaacattcactggcata

SEQ ID NO: 9433590 - DNA, 22 bp, Homo sapiens
tggaccaattctcagttttctt

SEQ ID NO: 9433591 - DNA, 18 bp, Homo sapiens
tggacagggtggagaaaa

SEQ ID NO: 9433592 - DNA, 22 bp, Homo sapiens
tggacaggtgagtgactcaggg

SEQ ID NO: 9433593 - DNA, 21 bp, Homo sapiens
tggaccaggaaggtggtggtg

SEQ ID NO: 9433594 - DNA, 22 bp, Homo sapiens
tggaccagctcctcgggagacg

SEQ ID NO: 9433595 - DNA, 22 bp, Homo sapiens
tggaccagcagccccagtgcct

SEQ ID NO: 9433596 - DNA, 22 bp, Homo sapiens
tggaccatgagctgcaggtgtt

SEQ ID NO: 9433597 - DNA, 20 bp, Homo sapiens
tggaccataaacaccaggta

SEQ ID NO: 9433598 - DNA, 22 bp, Homo sapiens
tggacccaccccagggcctgct

SEQ ID NO: 9433599 - DNA, 22 bp, Homo sapiens
tggaccagggtcccagagtatg

SEQ ID NO: 9433600 - DNA, 22 bp, Homo sapiens
tggaccagggtcccagagtatg

SEQ ID NO: 9433601 - DNA, 22 bp, Homo sapiens
tggaccagggtcccagagtatg

SEQ ID NO: 9433602 - DNA, 22 bp, Homo sapiens
tggacagcgaaagtgcctggga

SEQ ID NO: 9433603 - DNA, 22 bp, Homo sapiens
tggacagccatgcaaatgagct

SEQ ID NO: 9433604 - DNA, 22 bp, Homo sapiens
tggacagcaaacatggagagaa

SEQ ID NO: 9433605 - DNA, 23 bp, Homo sapiens
tggacagcagcagcagtgtcacc

SEQ ID NO: 9433606 - DNA, 23 bp, Homo sapiens
tggacaggacccccttcggaccc

SEQ ID NO: 9433607 - DNA, 22 bp, Homo sapiens
tggacagcttgcagagccaccc

SEQ ID NO: 9433608 - DNA, 23 bp, Homo sapiens
tggacaggacccccttcggaccc

SEQ ID NO: 9433609 - DNA, 22 bp, Homo sapiens
tggacaggatctgagactgaga

SEQ ID NO: 9433610 - DNA, 22 bp, Homo sapiens
tggacaggcaagcaagacatac

SEQ ID NO: 9433611 - DNA, 22 bp, Homo sapiens
tggacaggatctgagactgaga

SEQ ID NO: 9433612 - DNA, 22 bp, Homo sapiens
tggacaggatagtgcagtacgc

SEQ ID NO: 9433613 - DNA, 22 bp, Homo sapiens
tggacaggatctgagactgaga

SEQ ID NO: 9433614 - DNA, 22 bp, Homo sapiens
tggacaggatagtgcagtacgc

SEQ ID NO: 9433615 - DNA, 22 bp, Homo sapiens
tggacagagaggaaggccattt

SEQ ID NO: 9433616 - DNA, 22 bp, Homo sapiens
tggacactggtggatatggaat

SEQ ID NO: 9433617 - DNA, 22 bp, Homo sapiens
tggacactggtcttactcagct

SEQ ID NO: 9433618 - DNA, 22 bp, Homo sapiens
tggacactggagattcgtcagt

SEQ ID NO: 9433619 - DNA, 22 bp, Homo sapiens
tggacactggccatttgagtag

SEQ ID NO: 9433620 - DNA, 23 bp, Homo sapiens
tggacactgtgcggggactaggt

SEQ ID NO: 9433621 - DNA, 20 bp, Homo sapiens
tggacagaattagacacttt

SEQ ID NO: 9433622 - DNA, 20 bp, Homo sapiens
tggacagaattagacacttt

SEQ ID NO: 9433623 - DNA, 22 bp, Homo sapiens
tggacacacatgtatgtcagag

SEQ ID NO: 9433624 - DNA, 22 bp, Homo sapiens
tggacaactggtttttgacaaa

SEQ ID NO: 9433625 - DNA, 22 bp, Homo sapiens
tggacaatcaatggaggtaagt

SEQ ID NO: 9433626 - DNA, 22 bp, Homo sapiens
tggacacagtaggagctgcgca

SEQ ID NO: 9433627 - DNA, 22 bp, Homo sapiens
tggacacagtggtgaaggtaca

SEQ ID NO: 9433628 - DNA, 22 bp, Homo sapiens
tggacacagtggtgaaggtaca

SEQ ID NO: 9433629 - DNA, 20 bp, Homo sapiens
tggacacagccctgttgagt

SEQ ID NO: 9433630 - DNA, 22 bp, Homo sapiens
tggaatgatgactaggaattgt

SEQ ID NO: 9433631 - DNA, 22 bp, Homo sapiens
tggaatgatctgatgtatttta

SEQ ID NO: 9433632 - DNA, 22 bp, Homo sapiens
tggaatgagtggctaagattca

SEQ ID NO: 9433633 - DNA, 23 bp, Homo sapiens
tggaatgagctgggaagctgagc

SEQ ID NO: 9433634 - DNA, 21 bp, Homo sapiens
tggaatgaggctgagcagtgc

SEQ ID NO: 9433635 - DNA, 22 bp, Homo sapiens
tggaatggaaacaaactgagga

SEQ ID NO: 9433636 - DNA, 22 bp, Homo sapiens
tggaatgccgggccaggctccg

SEQ ID NO: 9433637 - DNA, 22 bp, Homo sapiens
tggaatgccgggccaggctccg

SEQ ID NO: 9433638 - DNA, 22 bp, Homo sapiens
tggaatggaaacaaactgagga

SEQ ID NO: 9433639 - DNA, 22 bp, Homo sapiens
tggaatgcagtgggagcttacc

SEQ ID NO: 9433640 - DNA, 22 bp, Homo sapiens
tggaatgagctggctaataacc

SEQ ID NO: 9433641 - DNA, 22 bp, Homo sapiens
tggaatgagctggctaataacc

SEQ ID NO: 9433642 - DNA, 22 bp, Homo sapiens
tggaatgacaagttgttcagag

SEQ ID NO: 9433643 - DNA, 22 bp, Homo sapiens
tggaatgacagagagtctgaat

SEQ ID NO: 9433644 - DNA, 22 bp, Homo sapiens
tggaatgaaggagatggccttt

SEQ ID NO: 9433645 - DNA, 22 bp, Homo sapiens
tggaatgaaggagatggccttt

SEQ ID NO: 9433646 - DNA, 22 bp, Homo sapiens
tggaatgaatttggcttcctcc

SEQ ID NO: 9433647 - DNA, 22 bp, Homo sapiens
tggaatgaatatgttttaagga

SEQ ID NO: 9433648 - DNA, 22 bp, Homo sapiens
tggaatgaaaagtacttcagaa

SEQ ID NO: 9433649 - DNA, 22 bp, Homo sapiens
tggaatgaagacatgttgtttg

SEQ ID NO: 9433650 - DNA, 22 bp, Homo sapiens
tggaatgaaaatggagatcttg

SEQ ID NO: 9433651 - DNA, 22 bp, Homo sapiens
tggaatggaaacaaactgagga

SEQ ID NO: 9433652 - DNA, 22 bp, Homo sapiens
tggaatgtttgacttattcagt

SEQ ID NO: 9433653 - DNA, 22 bp, Homo sapiens
tggaatttagttaattccattt

SEQ ID NO: 9433654 - DNA, 22 bp, Homo sapiens
tggaattttgtattagctttga

SEQ ID NO: 9433655 - DNA, 22 bp, Homo sapiens
tggacaacatagtgagacctca

SEQ ID NO: 9433656 - DNA, 22 bp, Homo sapiens
tggacaacatagtgagacctca

SEQ ID NO: 9433657 - DNA, 22 bp, Homo sapiens
tggacaaatagcatgacacttg

SEQ ID NO: 9433658 - DNA, 22 bp, Homo sapiens
tggaaggggagctggaaagggg

SEQ ID NO: 9433659 - DNA, 22 bp, Homo sapiens
tggaaggggagctggaaagggg

SEQ ID NO: 9433660 - DNA, 22 bp, Homo sapiens
tggaaggggagctggaaagggg

SEQ ID NO: 9433661 - DNA, 22 bp, Homo sapiens
tggaaggggagctggaaagggg

SEQ ID NO: 9433662 - DNA, 22 bp, Homo sapiens
tggaaggagctaaggacctggg

SEQ ID NO: 9433663 - DNA, 22 bp, Homo sapiens
tggaaggagctaaggacctggg

SEQ ID NO: 9433664 - DNA, 22 bp, Homo sapiens
tggaaggagctaaggacctggg

SEQ ID NO: 9433665 - DNA, 22 bp, Homo sapiens
tggaaggagactgggaagtgtg

SEQ ID NO: 9433666 - DNA, 22 bp, Homo sapiens
tggaaggagactgggaagtgtg

SEQ ID NO: 9433667 - DNA, 22 bp, Homo sapiens
tggaaggaagccaaggaaggtt

SEQ ID NO: 9433668 - DNA, 22 bp, Homo sapiens
tggaaggaagccaaggaaggtt

SEQ ID NO: 9433669 - DNA, 22 bp, Homo sapiens
tggaaggaacagagtttgaaac

SEQ ID NO: 9433670 - DNA, 22 bp, Homo sapiens
tggaaggaagccaaggaaggtt

SEQ ID NO: 9433671 - DNA, 22 bp, Homo sapiens
tggaagggggaagacagctctg

SEQ ID NO: 9433672 - DNA, 22 bp, Homo sapiens
tggaaggtggatatcctagtca

SEQ ID NO: 9433673 - DNA, 22 bp, Homo sapiens
tggaaggggttacgcagcagga

SEQ ID NO: 9433674 - DNA, 22 bp, Homo sapiens
tggaagggggaagacagctctg

SEQ ID NO: 9433675 - DNA, 22 bp, Homo sapiens
tggaaggggccaggcgcggagt

SEQ ID NO: 9433676 - DNA, 22 bp, Homo sapiens
tggaaggggagctggaaagggg

SEQ ID NO: 9433677 - DNA, 22 bp, Homo sapiens
tggaaggggagctggaaagggg

SEQ ID NO: 9433678 - DNA, 22 bp, Homo sapiens
tggaaggggagctggaaagggg

SEQ ID NO: 9433679 - DNA, 22 bp, Homo sapiens
tggaaggggagctggaaagggg

SEQ ID NO: 9433680 - DNA, 17 bp, Homo sapiens
tggaagtgaggacactg

SEQ ID NO: 9433681 - DNA, 22 bp, Homo sapiens
tggaagtgagaagtttcctcag

SEQ ID NO: 9433682 - DNA, 17 bp, Homo sapiens
tggaagtgaggacactg

SEQ ID NO: 9433683 - DNA, 22 bp, Homo sapiens
tggaagtggcagaggaagtggt

SEQ ID NO: 9433684 - DNA, 22 bp, Homo sapiens
tggaagtggcagaaaatgaaca

SEQ ID NO: 9433685 - DNA, 22 bp, Homo sapiens
tggaagtgctaaactggagtgt

SEQ ID NO: 9433686 - DNA, 22 bp, Homo sapiens
tggaagtgctcttctgaccaac

SEQ ID NO: 9433687 - DNA, 22 bp, Homo sapiens
tggaagtgtctacatgtggagt

SEQ ID NO: 9433688 - DNA, 20 bp, Homo sapiens
tggaagttctgttgcattgg

SEQ ID NO: 9433689 - DNA, 22 bp, Homo sapiens
tggaagtggcagaggaagtggt

SEQ ID NO: 9433690 - DNA, 22 bp, Homo sapiens
tggaataactcaccaaggtcat

SEQ ID NO: 9433691 - DNA, 22 bp, Homo sapiens
tggaataaagtaagtctctatt

SEQ ID NO: 9433692 - DNA, 22 bp, Homo sapiens
tggaagttgaatctcagtcatg

SEQ ID NO: 9433693 - DNA, 22 bp, Homo sapiens
tggaataaaatgtcagttctta

SEQ ID NO: 9433694 - DNA, 22 bp, Homo sapiens
tggaataactcaccaaggtcat

SEQ ID NO: 9433695 - DNA, 23 bp, Homo sapiens
tggaataataaggtacattaaca

SEQ ID NO: 9433696 - DNA, 23 bp, Homo sapiens
tggaataataaggtacattaaca

SEQ ID NO: 9433697 - DNA, 22 bp, Homo sapiens
tggaataatgaccacagaaaca

SEQ ID NO: 9433698 - DNA, 22 bp, Homo sapiens
tggaatatgcaattgcatttca

SEQ ID NO: 9433699 - DNA, 22 bp, Homo sapiens
tggaatcagactcctgcatttt

SEQ ID NO: 9433700 - DNA, 19 bp, Homo sapiens
tggaatcagcaagaatatt

SEQ ID NO: 9433701 - DNA, 22 bp, Homo sapiens
tggaatgaaaagtacttcagaa

SEQ ID NO: 9433702 - DNA, 22 bp, Homo sapiens
tggaatcattggagagctgtaa

SEQ ID NO: 9433703 - DNA, 22 bp, Homo sapiens
tggaatcagttacatgtggttg

SEQ ID NO: 9433704 - DNA, 18 bp, Homo sapiens
tggaatcattgtcaccat

SEQ ID NO: 9433705 - DNA, 22 bp, Homo sapiens
tggaagccaggcccgctcctaa

SEQ ID NO: 9433706 - DNA, 23 bp, Homo sapiens
tggaagcagttccagcacaaata

SEQ ID NO: 9433707 - DNA, 23 bp, Homo sapiens
tggaagcagaagtttcaatatcc

SEQ ID NO: 9433708 - DNA, 23 bp, Homo sapiens
tggaagcagaagtttcaatatcc

SEQ ID NO: 9433709 - DNA, 22 bp, Homo sapiens
tggaagcagcattaatgagtta

SEQ ID NO: 9433710 - DNA, 22 bp, Homo sapiens
tggaagcagcattaatgagtta

SEQ ID NO: 9433711 - DNA, 22 bp, Homo sapiens
tggaagcacaggatcagtggaa

SEQ ID NO: 9433712 - DNA, 22 bp, Homo sapiens
tggaagcactgaagagacaacc

SEQ ID NO: 9433713 - DNA, 22 bp, Homo sapiens
tggaagcactgaagagacaacc

SEQ ID NO: 9433714 - DNA, 23 bp, Homo sapiens
tggaagcaatcactgtagtgaat

SEQ ID NO: 9433715 - DNA, 23 bp, Homo sapiens
tggaagcaatcactgtagtgaat

SEQ ID NO: 9433716 - DNA, 22 bp, Homo sapiens
tggaagcaacaactatggacca

SEQ ID NO: 9433717 - DNA, 18 bp, Homo sapiens
tggaagctggtgagcaga

SEQ ID NO: 9433718 - DNA, 18 bp, Homo sapiens
tggaagctggtgagcaga

SEQ ID NO: 9433719 - DNA, 17 bp, Homo sapiens
tggaagcttcatgttgg

SEQ ID NO: 9433720 - DNA, 22 bp, Homo sapiens
tggaagctcaaggcagggtgag

SEQ ID NO: 9433721 - DNA, 22 bp, Homo sapiens
tggaagcctcagtttgccttct

SEQ ID NO: 9433722 - DNA, 22 bp, Homo sapiens
tggaaggaagccaaggaaggtt

SEQ ID NO: 9433723 - DNA, 22 bp, Homo sapiens
tggaaggaacagagtttgaaac

SEQ ID NO: 9433724 - DNA, 22 bp, Homo sapiens
tggaaggaaaggtagcagagaa

SEQ ID NO: 9433725 - DNA, 22 bp, Homo sapiens
tggaaggaaaggtagcagagaa

SEQ ID NO: 9433726 - DNA, 22 bp, Homo sapiens
tggaaggaaaggtagcagagaa

SEQ ID NO: 9433727 - DNA, 22 bp, Homo sapiens
tggaagagggagctgggtggcc

SEQ ID NO: 9433728 - DNA, 22 bp, Homo sapiens
tggaagaggtggaagtggcttc

SEQ ID NO: 9433729 - DNA, 22 bp, Homo sapiens
tggaagaggtggaagtggcttc

SEQ ID NO: 9433730 - DNA, 22 bp, Homo sapiens
tggaagaggtggaagtggcttc

SEQ ID NO: 9433731 - DNA, 22 bp, Homo sapiens
tggaagataagagattgggaag

SEQ ID NO: 9433732 - DNA, 22 bp, Homo sapiens
tggaagatatgctgattctctg

SEQ ID NO: 9433733 - DNA, 22 bp, Homo sapiens
tggaagaggccagaaagtggga

SEQ ID NO: 9433734 - DNA, 22 bp, Homo sapiens
tggaagaggccagaaagtggga

SEQ ID NO: 9433735 - DNA, 22 bp, Homo sapiens
tggaagaccagacttcccgaac

SEQ ID NO: 9433736 - DNA, 22 bp, Homo sapiens
tggaagaccagacttcccgaac

SEQ ID NO: 9433737 - DNA, 22 bp, Homo sapiens
tggaagaccagacttcccgaac

SEQ ID NO: 9433738 - DNA, 22 bp, Homo sapiens
tggaagacattttggaccttgg

SEQ ID NO: 9433739 - DNA, 22 bp, Homo sapiens
tggaagacatactgttttctta

SEQ ID NO: 9433740 - DNA, 22 bp, Homo sapiens
tggaagagaaaggagtggatct

SEQ ID NO: 9433741 - DNA, 22 bp, Homo sapiens
tggaagagacacttacattcag

SEQ ID NO: 9433742 - DNA, 22 bp, Homo sapiens
tggaagagcaggcagacaatgc

SEQ ID NO: 9433743 - DNA, 19 bp, Homo sapiens
tggaagaggaagggaaata

SEQ ID NO: 9433744 - DNA, 22 bp, Homo sapiens
tggaagagcaggcagacaatgc

SEQ ID NO: 9433745 - DNA, 22 bp, Homo sapiens
tggaagagcaggcagacaatgc

SEQ ID NO: 9433746 - DNA, 22 bp, Homo sapiens
tgctttatagacaaggaagtag

SEQ ID NO: 9433747 - DNA, 22 bp, Homo sapiens
tgctttataggggattgcaggc

SEQ ID NO: 9433748 - DNA, 22 bp, Homo sapiens
tgctttataaccatttctgtgg

SEQ ID NO: 9433749 - DNA, 22 bp, Homo sapiens
tgctttataacttagtttatgg

SEQ ID NO: 9433750 - DNA, 22 bp, Homo sapiens
tgctttatcaaagctatagtga

SEQ ID NO: 9433751 - DNA, 18 bp, Homo sapiens
tgctttatgcttatataa

SEQ ID NO: 9433752 - DNA, 22 bp, Homo sapiens
tgctttatgtggctgatactca

SEQ ID NO: 9433753 - DNA, 22 bp, Homo sapiens
tgctttatgtggctgatactca

SEQ ID NO: 9433754 - DNA, 21 bp, Homo sapiens
tgctttatgggaaaaatgtca

SEQ ID NO: 9433755 - DNA, 21 bp, Homo sapiens
tgctttatgggaaaaatgtca

SEQ ID NO: 9433756 - DNA, 20 bp, Homo sapiens
tgctttgatggaaatacagc

SEQ ID NO: 9433757 - DNA, 20 bp, Homo sapiens
tgctttgatggaaatacagc

SEQ ID NO: 9433758 - DNA, 22 bp, Homo sapiens
tgctttctttagctcctgagtc

SEQ ID NO: 9433759 - DNA, 22 bp, Homo sapiens
tgctttctgtttttcatataat

SEQ ID NO: 9433760 - DNA, 22 bp, Homo sapiens
tgctttctgctcttgtccacac

SEQ ID NO: 9433761 - DNA, 22 bp, Homo sapiens
tgctttattaagagagaaattt

SEQ ID NO: 9433762 - DNA, 22 bp, Homo sapiens
tgctttattcagggtttacccc

SEQ ID NO: 9433763 - DNA, 22 bp, Homo sapiens
tgctttatgttatcagaagggt

SEQ ID NO: 9433764 - DNA, 22 bp, Homo sapiens
tgctttattaagagagaaattt

SEQ ID NO: 9433765 - DNA, 22 bp, Homo sapiens
tgctttattaagagagaaattt

SEQ ID NO: 9433766 - DNA, 22 bp, Homo sapiens
tgctttattcccttctgatgtg

SEQ ID NO: 9433767 - DNA, 22 bp, Homo sapiens
tgctttattcgacatctggtag

SEQ ID NO: 9433768 - DNA, 22 bp, Homo sapiens
tgcttctttactataggcaatt

SEQ ID NO: 9433769 - DNA, 22 bp, Homo sapiens
tgcttctttaaatgatagtcaa

SEQ ID NO: 9433770 - DNA, 22 bp, Homo sapiens
tgcttcttcctccatgtgttct

SEQ ID NO: 9433771 - DNA, 22 bp, Homo sapiens
tgcttctgtttgtttctgtcat

SEQ ID NO: 9433772 - DNA, 22 bp, Homo sapiens
tgcttctgtttcattgatctta

SEQ ID NO: 9433773 - DNA, 22 bp, Homo sapiens
tgcttctgggtaggcctcagga

SEQ ID NO: 9433774 - DNA, 22 bp, Homo sapiens
tgcttctgtattttgggcttga

SEQ ID NO: 9433775 - DNA, 22 bp, Homo sapiens
tgcttctgtattttgggcttga

SEQ ID NO: 9433776 - DNA, 22 bp, Homo sapiens
tgcttctgtctcttatgccttg

SEQ ID NO: 9433777 - DNA, 22 bp, Homo sapiens
tgcttctgtctcttatgccttg

SEQ ID NO: 9433778 - DNA, 22 bp, Homo sapiens
tgcttctgttacataccagaac

SEQ ID NO: 9433779 - DNA, 22 bp, Homo sapiens
tgcttctgttacataccagaac

SEQ ID NO: 9433780 - DNA, 22 bp, Homo sapiens
tgcttctgttctttcacctacg

SEQ ID NO: 9433781 - DNA, 22 bp, Homo sapiens
tgcttctgttctttcacctacg

SEQ ID NO: 9433782 - DNA, 22 bp, Homo sapiens
tgcttctggggacaggctgcct

SEQ ID NO: 9433783 - DNA, 22 bp, Homo sapiens
tgcttctggggacaggctgcct

SEQ ID NO: 9433784 - DNA, 22 bp, Homo sapiens
tgcttctgggcctggtgttccc

SEQ ID NO: 9433785 - DNA, 22 bp, Homo sapiens
tgcttctggcttatctcgtgcc

SEQ ID NO: 9433786 - DNA, 22 bp, Homo sapiens
tgcttctgggtaggcctcagga

SEQ ID NO: 9433787 - DNA, 19 bp, Homo sapiens
tgcttctggggcttctcca

SEQ ID NO: 9433788 - DNA, 19 bp, Homo sapiens
tgcttctggggcttctcca

SEQ ID NO: 9433789 - DNA, 22 bp, Homo sapiens
tgcttctggggacaggctgcct

SEQ ID NO: 9433790 - DNA, 22 bp, Homo sapiens
tgcttctggggacaggctgcct

SEQ ID NO: 9433791 - DNA, 22 bp, Homo sapiens
tgcttctggagtaacagggtga

SEQ ID NO: 9433792 - DNA, 19 bp, Homo sapiens
tgcttctggaatgcaaggc

SEQ ID NO: 9433793 - DNA, 22 bp, Homo sapiens
tgcttctggcttatctcgtgcc

SEQ ID NO: 9433794 - DNA, 22 bp, Homo sapiens
tgcttctggcacttgagggggt

SEQ ID NO: 9433795 - DNA, 22 bp, Homo sapiens
tgcttctggcacttgagggggt

SEQ ID NO: 9433796 - DNA, 22 bp, Homo sapiens
tgcttctggaaacagtggctgt

SEQ ID NO: 9433797 - DNA, 22 bp, Homo sapiens
tgcttctggaaacagtggctgt

SEQ ID NO: 9433798 - DNA, 19 bp, Homo sapiens
tgcttctggaaccatgatc

SEQ ID NO: 9433799 - DNA, 22 bp, Homo sapiens
tgcttctgctttacttggttca

SEQ ID NO: 9433800 - DNA, 22 bp, Homo sapiens
tgcttctggaaacagtggctgt

SEQ ID NO: 9433801 - DNA, 22 bp, Homo sapiens
tgctttaacgctgagggtctca

SEQ ID NO: 9433802 - DNA, 22 bp, Homo sapiens
tgctttaaccatcttgtttgga

SEQ ID NO: 9433803 - DNA, 22 bp, Homo sapiens
tgctttaagacactaagtttga

SEQ ID NO: 9433804 - DNA, 22 bp, Homo sapiens
tgctttaagacactaagtttga

SEQ ID NO: 9433805 - DNA, 22 bp, Homo sapiens
tgctttaagagattgttagtac

SEQ ID NO: 9433806 - DNA, 22 bp, Homo sapiens
tgcttgtgtgagggcctgggag

SEQ ID NO: 9433807 - DNA, 22 bp, Homo sapiens
tgcttgtgtgagggcctgggag

SEQ ID NO: 9433808 - DNA, 22 bp, Homo sapiens
tgctttaaaatggactgttttg

SEQ ID NO: 9433809 - DNA, 22 bp, Homo sapiens
tgcttgaacaaggataaatttg

SEQ ID NO: 9433810 - DNA, 19 bp, Homo sapiens
tgcttgaggtgtgctagag

SEQ ID NO: 9433811 - DNA, 22 bp, Homo sapiens
tgcttgatttggcagtgtattc

SEQ ID NO: 9433812 - DNA, 22 bp, Homo sapiens
tgcttgattagggaagtcacat

SEQ ID NO: 9433813 - DNA, 22 bp, Homo sapiens
tgcttgctatgcatcctgaact

SEQ ID NO: 9433814 - DNA, 22 bp, Homo sapiens
tgcttgtcttcaggaatgctga

SEQ ID NO: 9433815 - DNA, 21 bp, Homo sapiens
tgcttgtctgcctagaggctt

SEQ ID NO: 9433816 - DNA, 22 bp, Homo sapiens
tgcttgtctctctgtgcccact

SEQ ID NO: 9433817 - DNA, 22 bp, Homo sapiens
tgcttgtcttcaggattatggt

SEQ ID NO: 9433818 - DNA, 22 bp, Homo sapiens
tgcttgtcttcaggaatgctga

SEQ ID NO: 9433819 - DNA, 22 bp, Homo sapiens
tgcttgtgagagttttttcaga

SEQ ID NO: 9433820 - DNA, 22 bp, Homo sapiens
tgcttgtgacagaactgtgtcc

SEQ ID NO: 9433821 - DNA, 22 bp, Homo sapiens
tggaaagtgagacatatttata

SEQ ID NO: 9433822 - DNA, 22 bp, Homo sapiens
tggaaaggtgtaaagcagaacc

SEQ ID NO: 9433823 - DNA, 22 bp, Homo sapiens
tggaaaggaggcttgtggaata

SEQ ID NO: 9433824 - DNA, 22 bp, Homo sapiens
tggaaagggacttatgagttcc

SEQ ID NO: 9433825 - DNA, 22 bp, Homo sapiens
tggaaatattgggtaatagttg

SEQ ID NO: 9433826 - DNA, 22 bp, Homo sapiens
tggaaatatgctccattctttt

SEQ ID NO: 9433827 - DNA, 22 bp, Homo sapiens
tggaaatatgctccattctttt

SEQ ID NO: 9433828 - DNA, 22 bp, Homo sapiens
tggaaatatttgctcattatct

SEQ ID NO: 9433829 - DNA, 22 bp, Homo sapiens
tggaaatattgggtaatagttg

SEQ ID NO: 9433830 - DNA, 22 bp, Homo sapiens
tggaaatatttgctcattatct

SEQ ID NO: 9433831 - DNA, 21 bp, Homo sapiens
tggaaatggaatactttggat

SEQ ID NO: 9433832 - DNA, 22 bp, Homo sapiens
tggaaatgcctggcttcctgaa

SEQ ID NO: 9433833 - DNA, 22 bp, Homo sapiens
tggaaatagctccagtttcatt

SEQ ID NO: 9433834 - DNA, 22 bp, Homo sapiens
tggaaatagatagtatcattca

SEQ ID NO: 9433835 - DNA, 22 bp, Homo sapiens
tggaaatagatagtatcattca

SEQ ID NO: 9433836 - DNA, 22 bp, Homo sapiens
tggaaatagatagtatcattca

SEQ ID NO: 9433837 - DNA, 22 bp, Homo sapiens
tggaaatatacaatgtgtctct

SEQ ID NO: 9433838 - DNA, 22 bp, Homo sapiens
tggaaatagttgtgagtcaggc

SEQ ID NO: 9433839 - DNA, 22 bp, Homo sapiens
tggaacactttgttgaaatgca

SEQ ID NO: 9433840 - DNA, 22 bp, Homo sapiens
tggaacactgtggatgagaaga

SEQ ID NO: 9433841 - DNA, 22 bp, Homo sapiens
tggaacactgatcattgccttt

SEQ ID NO: 9433842 - DNA, 22 bp, Homo sapiens
tggaacaccttgctccagaaag

SEQ ID NO: 9433843 - DNA, 22 bp, Homo sapiens
tggaacacatctcgctgcaggg

SEQ ID NO: 9433844 - DNA, 22 bp, Homo sapiens
tggaacacaggactatcagctg

SEQ ID NO: 9433845 - DNA, 22 bp, Homo sapiens
tggaacacagtgattgatagcg

SEQ ID NO: 9433846 - DNA, 22 bp, Homo sapiens
tggaacacatctaaggaagcag

SEQ ID NO: 9433847 - DNA, 22 bp, Homo sapiens
tggaacaattcttgaagggaat

SEQ ID NO: 9433848 - DNA, 22 bp, Homo sapiens
tggaacaatcccggtttagctc

SEQ ID NO: 9433849 - DNA, 22 bp, Homo sapiens
tggaacacacttcaaggagaaa

SEQ ID NO: 9433850 - DNA, 22 bp, Homo sapiens
tggaacctggcctgagctacca

SEQ ID NO: 9433851 - DNA, 23 bp, Homo sapiens
tggaagaaaatggtttggctgtg

SEQ ID NO: 9433852 - DNA, 22 bp, Homo sapiens
tggaactaaggtagaaactatt

SEQ ID NO: 9433853 - DNA, 22 bp, Homo sapiens
tggaagaaaattcaatcgagtt

SEQ ID NO: 9433854 - DNA, 23 bp, Homo sapiens
tggaagaaaatggtttggctgtg

SEQ ID NO: 9433855 - DNA, 22 bp, Homo sapiens
tggaagaaaattcaatcgagtt

SEQ ID NO: 9433856 - DNA, 22 bp, Homo sapiens
tggaacaagggcgtggcggtcg

SEQ ID NO: 9433857 - DNA, 22 bp, Homo sapiens
tggaacaatcccggtttagctc

SEQ ID NO: 9433858 - DNA, 22 bp, Homo sapiens
tggaacaagggttcatttaaat

SEQ ID NO: 9433859 - DNA, 22 bp, Homo sapiens
tggaacaactccctcggagcct

SEQ ID NO: 9433860 - DNA, 22 bp, Homo sapiens
tggaacaagaagcaggtcgctt

SEQ ID NO: 9433861 - DNA, 22 bp, Homo sapiens
tggaacaagacagcatagagct

SEQ ID NO: 9433862 - DNA, 19 bp, Homo sapiens
tggaacaaactgcaatgac

SEQ ID NO: 9433863 - DNA, 22 bp, Homo sapiens
tggaacaaacatggtgatggct

SEQ ID NO: 9433864 - DNA, 22 bp, Homo sapiens
tggaacaaaatatttatgtttg

SEQ ID NO: 9433865 - DNA, 22 bp, Homo sapiens
tggaacaacatgctggaaaatt

SEQ ID NO: 9433866 - DNA, 22 bp, Homo sapiens
tggaacaaattttggggacctt

SEQ ID NO: 9433867 - DNA, 22 bp, Homo sapiens
tggaacaaattacaattaactt

SEQ ID NO: 9433868 - DNA, 18 bp, Homo sapiens
tggaaattgaaacagaaa

SEQ ID NO: 9433869 - DNA, 22 bp, Homo sapiens
tggaaattgctattaccgatga

SEQ ID NO: 9433870 - DNA, 22 bp, Homo sapiens
tggaaatttatcaagatataca

SEQ ID NO: 9433871 - DNA, 22 bp, Homo sapiens
tggaaatttattcatcattcat

SEQ ID NO: 9433872 - DNA, 22 bp, Homo sapiens
tggaaattttgaacagtttcta

SEQ ID NO: 9433873 - DNA, 22 bp, Homo sapiens
tggaaattactaacacttagag

SEQ ID NO: 9433874 - DNA, 22 bp, Homo sapiens
tggaaattaacttggtacatat

SEQ ID NO: 9433875 - DNA, 22 bp, Homo sapiens
tggaaattaaaattcctcttaa

SEQ ID NO: 9433876 - DNA, 22 bp, Homo sapiens
tggaaatggatctgatgagtct

SEQ ID NO: 9433877 - DNA, 22 bp, Homo sapiens
tggaaatgtatttgggcatgcc

SEQ ID NO: 9433878 - DNA, 22 bp, Homo sapiens
tggaaatgtcaaaacctctgat

SEQ ID NO: 9433879 - DNA, 21 bp, Homo sapiens
tggaaagattcaaagaccagg

SEQ ID NO: 9433880 - DNA, 21 bp, Homo sapiens
tggaaagattcaaagaccagg

SEQ ID NO: 9433881 - DNA, 22 bp, Homo sapiens
tggaaagatgaagatgtttaag

SEQ ID NO: 9433882 - DNA, 22 bp, Homo sapiens
tggaaagaggtagaggatctgg

SEQ ID NO: 9433883 - DNA, 22 bp, Homo sapiens
tggaaagaggaagtgcccagca

SEQ ID NO: 9433884 - DNA, 22 bp, Homo sapiens
tggaaacatctctgcctttatt

SEQ ID NO: 9433885 - DNA, 22 bp, Homo sapiens
tggaaagagatgttgtttctga

SEQ ID NO: 9433886 - DNA, 22 bp, Homo sapiens
tggaaacaggagaatatcttct

SEQ ID NO: 9433887 - DNA, 21 bp, Homo sapiens
tggaaacagcgccatctgccg

SEQ ID NO: 9433888 - DNA, 22 bp, Homo sapiens
tggaaacactcaagcttatatt

SEQ ID NO: 9433889 - DNA, 22 bp, Homo sapiens
tggaaacactcaagcttatatt

SEQ ID NO: 9433890 - DNA, 22 bp, Homo sapiens
tggaaacacccacgcatgcata

SEQ ID NO: 9433891 - DNA, 22 bp, Homo sapiens
tggaaacacccacgcatgcata

SEQ ID NO: 9433892 - DNA, 22 bp, Homo sapiens
tggaaaattagtagtgaaaggc

SEQ ID NO: 9433893 - DNA, 22 bp, Homo sapiens
tggaaacaaagctggatgtagt

SEQ ID NO: 9433894 - DNA, 22 bp, Homo sapiens
tggaaacaaagtcataagctca

SEQ ID NO: 9433895 - DNA, 22 bp, Homo sapiens
tggaaaatgtgactattctaaa

SEQ ID NO: 9433896 - DNA, 22 bp, Homo sapiens
tggaaaatgtgactattctaaa

SEQ ID NO: 9433897 - DNA, 22 bp, Homo sapiens
tggaaaacataaagcttttcct

SEQ ID NO: 9433898 - DNA, 22 bp, Homo sapiens
tggaaaatcaggggacattgat

SEQ ID NO: 9433899 - DNA, 22 bp, Homo sapiens
tgctttggcccaacattgatgc

SEQ ID NO: 9433900 - DNA, 22 bp, Homo sapiens
tgctttggctgacacgctcctg

SEQ ID NO: 9433901 - DNA, 22 bp, Homo sapiens
tgctttgggtctctctagtttc

SEQ ID NO: 9433902 - DNA, 22 bp, Homo sapiens
tgctttgggtttgactctcatg

SEQ ID NO: 9433903 - DNA, 22 bp, Homo sapiens
tgctttgtgacagattagtttt

SEQ ID NO: 9433904 - DNA, 22 bp, Homo sapiens
tgcttttagctagtaactagta

SEQ ID NO: 9433905 - DNA, 22 bp, Homo sapiens
tgcttttaggagattaaaatta

SEQ ID NO: 9433906 - DNA, 22 bp, Homo sapiens
tgcttttaggagattaaaatta

SEQ ID NO: 9433907 - DNA, 22 bp, Homo sapiens
tgctttgtgtttgaatagataa

SEQ ID NO: 9433908 - DNA, 22 bp, Homo sapiens
tgctttgtgatatgctgtgtct

SEQ ID NO: 9433909 - DNA, 22 bp, Homo sapiens
tgctttgtgatatgctgtgtct

SEQ ID NO: 9433910 - DNA, 22 bp, Homo sapiens
tgcttttatttaatatcttgca

SEQ ID NO: 9433911 - DNA, 22 bp, Homo sapiens
tgcttttatttaatatcttgca

SEQ ID NO: 9433912 - DNA, 22 bp, Homo sapiens
tgcttttatttaatatcttgca

SEQ ID NO: 9433913 - DNA, 20 bp, Homo sapiens
tgcttttatacctataatga

SEQ ID NO: 9433914 - DNA, 20 bp, Homo sapiens
tgcttttatacctataatga

SEQ ID NO: 9433915 - DNA, 20 bp, Homo sapiens
tgcttttatacctataatga

SEQ ID NO: 9433916 - DNA, 22 bp, Homo sapiens
tgcttttaggagattaaaatta

SEQ ID NO: 9433917 - DNA, 22 bp, Homo sapiens
tgcttttaggagattaaaatta

SEQ ID NO: 9433918 - DNA, 22 bp, Homo sapiens
tgctttttagtactgtcttatt

SEQ ID NO: 9433919 - DNA, 22 bp, Homo sapiens
tgctttttagtactgtcttatt

SEQ ID NO: 9433920 - DNA, 22 bp, Homo sapiens
tgctttttagtactgtcttatt

SEQ ID NO: 9433921 - DNA, 22 bp, Homo sapiens
tgctttttgcaccctttgccgt

SEQ ID NO: 9433922 - DNA, 22 bp, Homo sapiens
tgctttttccccttctggcgag

SEQ ID NO: 9433923 - DNA, 22 bp, Homo sapiens
tgctttttagtactgtcttatt

SEQ ID NO: 9433924 - DNA, 22 bp, Homo sapiens
tggaaaaaacccagactctaga

SEQ ID NO: 9433925 - DNA, 22 bp, Homo sapiens
tgctttttgcaccctttgccgt

SEQ ID NO: 9433926 - DNA, 22 bp, Homo sapiens
tggaaaaaaattggctagcttc

SEQ ID NO: 9433927 - DNA, 22 bp, Homo sapiens
tggaaaaactgagacttagaca

SEQ ID NO: 9433928 - DNA, 22 bp, Homo sapiens
tggaaaaactgagacttagaca

SEQ ID NO: 9433929 - DNA, 21 bp, Homo sapiens
tggaaaaatgtggcctagtga

SEQ ID NO: 9433930 - DNA, 22 bp, Homo sapiens
tggaaaaactgagacttagaca

SEQ ID NO: 9433931 - DNA, 22 bp, Homo sapiens
tggaaaaactgagacttagaca

SEQ ID NO: 9433932 - DNA, 22 bp, Homo sapiens
tggagcccacggatgtcgcttt

SEQ ID NO: 9433933 - DNA, 18 bp, Homo sapiens
tggagccattgccaccat

SEQ ID NO: 9433934 - DNA, 22 bp, Homo sapiens
tggagccagtgttgcccaacac

SEQ ID NO: 9433935 - DNA, 22 bp, Homo sapiens
tggagccagggtagaagcagag

SEQ ID NO: 9433936 - DNA, 22 bp, Homo sapiens
tggagcccagacactggcattg

SEQ ID NO: 9433937 - DNA, 22 bp, Homo sapiens
tggagcccagacactggcattg

SEQ ID NO: 9433938 - DNA, 22 bp, Homo sapiens
tggagcctcctcacactgtggc

SEQ ID NO: 9433939 - DNA, 22 bp, Homo sapiens
tggagccttttacccacaggag

SEQ ID NO: 9433940 - DNA, 22 bp, Homo sapiens
tggagctgaactttgaggccag

SEQ ID NO: 9433941 - DNA, 22 bp, Homo sapiens
tggagctgaggggaatgctgag

SEQ ID NO: 9433942 - DNA, 18 bp, Homo sapiens
tggagctgagtgctgtgc

SEQ ID NO: 9433943 - DNA, 23 bp, Homo sapiens
tggagctgacagtcagagggagg

SEQ ID NO: 9433944 - DNA, 22 bp, Homo sapiens
tggagctgaactttgaggccag

SEQ ID NO: 9433945 - DNA, 21 bp, Homo sapiens
tggagctgaatttttggcatc

SEQ ID NO: 9433946 - DNA, 21 bp, Homo sapiens
tggagctgaatttttggcatc

SEQ ID NO: 9433947 - DNA, 22 bp, Homo sapiens
tggagctgaactttgaggccag

SEQ ID NO: 9433948 - DNA, 22 bp, Homo sapiens
tggagctgaactttgaggccag

SEQ ID NO: 9433949 - DNA, 22 bp, Homo sapiens
tggagctggcttgtggaagttg

SEQ ID NO: 9433950 - DNA, 22 bp, Homo sapiens
tggagctggcttgtggaagttg

SEQ ID NO: 9433951 - DNA, 22 bp, Homo sapiens
tggagctggcttgtggaagttg

SEQ ID NO: 9433952 - DNA, 22 bp, Homo sapiens
tggagctggcttgtggaagttg

SEQ ID NO: 9433953 - DNA, 22 bp, Homo sapiens
tggagctggcttgtggaagttg

SEQ ID NO: 9433954 - DNA, 22 bp, Homo sapiens
tggagctggaatttgagctgga

SEQ ID NO: 9433955 - DNA, 22 bp, Homo sapiens
tggagctggaatttgagctgga

SEQ ID NO: 9433956 - DNA, 22 bp, Homo sapiens
tggagctggcagcggaaaaggg

SEQ ID NO: 9433957 - DNA, 22 bp, Homo sapiens
tggagctggaagacagtgatat

SEQ ID NO: 9433958 - DNA, 22 bp, Homo sapiens
tggagctggaatttctgggcct

SEQ ID NO: 9433959 - DNA, 22 bp, Homo sapiens
tggagctggaatttgagctgga

SEQ ID NO: 9433960 - DNA, 22 bp, Homo sapiens
tggagctggaatttctgggcct

SEQ ID NO: 9433961 - DNA, 22 bp, Homo sapiens
tggagctggaatttctgggcct

SEQ ID NO: 9433962 - DNA, 22 bp, Homo sapiens
tggagctgatacagctggcttt

SEQ ID NO: 9433963 - DNA, 22 bp, Homo sapiens
tggagctgatacagctggcttt

SEQ ID NO: 9433964 - DNA, 21 bp, Homo sapiens
tggagctgccacttgagctgc

SEQ ID NO: 9433965 - DNA, 22 bp, Homo sapiens
tggagctgatacagctggcttt

SEQ ID NO: 9433966 - DNA, 18 bp, Homo sapiens
tggagctgagtgctgtgc

SEQ ID NO: 9433967 - DNA, 18 bp, Homo sapiens
tggagctgagtgctgtgc

SEQ ID NO: 9433968 - DNA, 18 bp, Homo sapiens
tggagctgagtgctgtgc

SEQ ID NO: 9433969 - DNA, 18 bp, Homo sapiens
tggagctgagtgctgtgc

SEQ ID NO: 9433970 - DNA, 21 bp, Homo sapiens
tggagctgccacttgagctgc

SEQ ID NO: 9433971 - DNA, 21 bp, Homo sapiens
tggagctgccacttgtcctcc

SEQ ID NO: 9433972 - DNA, 21 bp, Homo sapiens
tggagctgccacttgtcctcc

SEQ ID NO: 9433973 - DNA, 22 bp, Homo sapiens
tggagctgcctggcacctacag

SEQ ID NO: 9433974 - DNA, 22 bp, Homo sapiens
tggagctggaagaatgtagacg

SEQ ID NO: 9433975 - DNA, 22 bp, Homo sapiens
tggagctggaagaatgtagacg

SEQ ID NO: 9433976 - DNA, 22 bp, Homo sapiens
tggagctggaagaatgtagacg

SEQ ID NO: 9433977 - DNA, 22 bp, Homo sapiens
tggagctggaagaatgtagacg

SEQ ID NO: 9433978 - DNA, 22 bp, Homo sapiens
tggagcagtggtcctggagatg

SEQ ID NO: 9433979 - DNA, 22 bp, Homo sapiens
tggagcagtggtcctggagatg

SEQ ID NO: 9433980 - DNA, 22 bp, Homo sapiens
tggagcagtggtcctggagatg

SEQ ID NO: 9433981 - DNA, 22 bp, Homo sapiens
tggagccaaaaagggaaggaga

SEQ ID NO: 9433982 - DNA, 20 bp, Homo sapiens
tggagccaaggtgtgtctgg

SEQ ID NO: 9433983 - DNA, 22 bp, Homo sapiens
tggagcaggtgctcagggtaat

SEQ ID NO: 9433984 - DNA, 22 bp, Homo sapiens
tggagcaggtgctcagggtaat

SEQ ID NO: 9433985 - DNA, 22 bp, Homo sapiens
tggagcaggtgctcagggtaat

SEQ ID NO: 9433986 - DNA, 22 bp, Homo sapiens
tggagcaggtgctcagggtaat

SEQ ID NO: 9433987 - DNA, 22 bp, Homo sapiens
tggagcagtggtcctggagatg

SEQ ID NO: 9433988 - DNA, 22 bp, Homo sapiens
tggagcagtggtcctggagatg

SEQ ID NO: 9433989 - DNA, 22 bp, Homo sapiens
tggagcaggtgggatgtcgtga

SEQ ID NO: 9433990 - DNA, 22 bp, Homo sapiens
tggagccagcaggactcagagg

SEQ ID NO: 9433991 - DNA, 22 bp, Homo sapiens
tggagccagcccaggcccctct

SEQ ID NO: 9433992 - DNA, 22 bp, Homo sapiens
tggagccagcccaggcccctct

SEQ ID NO: 9433993 - DNA, 22 bp, Homo sapiens
tggagccactcactatctgagt

SEQ ID NO: 9433994 - DNA, 22 bp, Homo sapiens
tggagccaccttcttatttgtc

SEQ ID NO: 9433995 - DNA, 22 bp, Homo sapiens
tggagccagagcgcagcctggg

SEQ ID NO: 9433996 - DNA, 22 bp, Homo sapiens
tggagccagcgagccgaggcgg

SEQ ID NO: 9433997 - DNA, 22 bp, Homo sapiens
tggagccagcggcctgctgagg

SEQ ID NO: 9433998 - DNA, 22 bp, Homo sapiens
tggagccagcggcctgctgagg

SEQ ID NO: 9433999 - DNA, 18 bp, Homo sapiens
tggagccagctctaggat

SEQ ID NO: 9434000 - DNA, 22 bp, Homo sapiens
tggagccaggagcctgggagtc

SEQ ID NO: 9434001 - DNA, 22 bp, Homo sapiens
tggagccaggctggccctgcca

SEQ ID NO: 9434002 - DNA, 22 bp, Homo sapiens
tggagccaggagcctgggagtc

SEQ ID NO: 9434003 - DNA, 22 bp, Homo sapiens
tggagcagctaagcctctgaga

SEQ ID NO: 9434004 - DNA, 22 bp, Homo sapiens
tggagcagctctagcgggcgcc

SEQ ID NO: 9434005 - DNA, 22 bp, Homo sapiens
tggagcagctctagcgggcgcc

SEQ ID NO: 9434006 - DNA, 22 bp, Homo sapiens
tggagcaggaaacatctagagg

SEQ ID NO: 9434007 - DNA, 22 bp, Homo sapiens
tggagcagctgaacagagttga

SEQ ID NO: 9434008 - DNA, 22 bp, Homo sapiens
tggagcagctgaacagagttga

SEQ ID NO: 9434009 - DNA, 18 bp, Homo sapiens
tggagcaggaagcctggc

SEQ ID NO: 9434010 - DNA, 22 bp, Homo sapiens
tggagcaggaaacatctagagg

SEQ ID NO: 9434011 - DNA, 22 bp, Homo sapiens
tggagcaggtcggcaccatttg

SEQ ID NO: 9434012 - DNA, 22 bp, Homo sapiens
tggagcaggtcggcaccatttg

SEQ ID NO: 9434013 - DNA, 22 bp, Homo sapiens
tggagcaggtgccaggtgtgtg

SEQ ID NO: 9434014 - DNA, 22 bp, Homo sapiens
tggagcaggtgccaggtgtgtg

SEQ ID NO: 9434015 - DNA, 22 bp, Homo sapiens
tggagcaggtgccaggtgtgtg

SEQ ID NO: 9434016 - DNA, 22 bp, Homo sapiens
tggagcaggtgccaggtgtgtg

SEQ ID NO: 9434017 - DNA, 22 bp, Homo sapiens
tggagcaggacggggagtggta

SEQ ID NO: 9434018 - DNA, 22 bp, Homo sapiens
tggagcaggaagtctatggctg

SEQ ID NO: 9434019 - DNA, 22 bp, Homo sapiens
tggagcaggaagtctatggctg

SEQ ID NO: 9434020 - DNA, 22 bp, Homo sapiens
tggagcaggacggggagtggta

SEQ ID NO: 9434021 - DNA, 18 bp, Homo sapiens
tggagcaggtaggcatga

SEQ ID NO: 9434022 - DNA, 21 bp, Homo sapiens
tggagagcccttgcctgagtc

SEQ ID NO: 9434023 - DNA, 22 bp, Homo sapiens
tggagagcaggggatgcgggcg

SEQ ID NO: 9434024 - DNA, 18 bp, Homo sapiens
tggagagcagcagtgggg

SEQ ID NO: 9434025 - DNA, 22 bp, Homo sapiens
tggagagcaatgaggggcaggc

SEQ ID NO: 9434026 - DNA, 22 bp, Homo sapiens
tggagagcacagttcctgcttc

SEQ ID NO: 9434027 - DNA, 22 bp, Homo sapiens
tggagagcaagtcgcagacatg

SEQ ID NO: 9434028 - DNA, 19 bp, Homo sapiens
tggagaggaaatgctgctc

SEQ ID NO: 9434029 - DNA, 22 bp, Homo sapiens
tggagaggaaagtgcagttttg

SEQ ID NO: 9434030 - DNA, 22 bp, Homo sapiens
tggagaggaaagtgcagttttg

SEQ ID NO: 9434031 - DNA, 22 bp, Homo sapiens
tggagagctggttcaaagcaga

SEQ ID NO: 9434032 - DNA, 22 bp, Homo sapiens
tggagagccttcccggcatcgc

SEQ ID NO: 9434033 - DNA, 22 bp, Homo sapiens
tggagagcgcgacgggaggaag

SEQ ID NO: 9434034 - DNA, 22 bp, Homo sapiens
tggagagcgtgcttagcactct

SEQ ID NO: 9434035 - DNA, 22 bp, Homo sapiens
tggagaagattggtcaccattc

SEQ ID NO: 9434036 - DNA, 22 bp, Homo sapiens
tggagaaagctgcatatggaaa

SEQ ID NO: 9434037 - DNA, 22 bp, Homo sapiens
tggagaagattggtcaccattc

SEQ ID NO: 9434038 - DNA, 22 bp, Homo sapiens
tggagaagctgtaggtggactc

SEQ ID NO: 9434039 - DNA, 22 bp, Homo sapiens
tggagaagctgtaggtggactc

SEQ ID NO: 9434040 - DNA, 19 bp, Homo sapiens
tggacttgagctgctttga

SEQ ID NO: 9434041 - DNA, 22 bp, Homo sapiens
tggactttcacatagcaaagga

SEQ ID NO: 9434042 - DNA, 22 bp, Homo sapiens
tggagaaagctgcatatggaaa

SEQ ID NO: 9434043 - DNA, 22 bp, Homo sapiens
tggagaaggggcagggtctcca

SEQ ID NO: 9434044 - DNA, 22 bp, Homo sapiens
tggagaaggccggccaggagtg

SEQ ID NO: 9434045 - DNA, 22 bp, Homo sapiens
tggagaaggccggccaggagtg

SEQ ID NO: 9434046 - DNA, 22 bp, Homo sapiens
tggagaaggacagcctgagaaa

SEQ ID NO: 9434047 - DNA, 22 bp, Homo sapiens
tggagaaggacagcctgagaaa

SEQ ID NO: 9434048 - DNA, 22 bp, Homo sapiens
tggagagagtcgggatagtaca

SEQ ID NO: 9434049 - DNA, 22 bp, Homo sapiens
tggagagaagaggcagtgtgct

SEQ ID NO: 9434050 - DNA, 22 bp, Homo sapiens
tggagagaagaggcagtgtgct

SEQ ID NO: 9434051 - DNA, 22 bp, Homo sapiens
tggagagaacagtgtctgaaag

SEQ ID NO: 9434052 - DNA, 22 bp, Homo sapiens
tggagaagtcaaagtgaacagg

SEQ ID NO: 9434053 - DNA, 22 bp, Homo sapiens
tggagaagtcaaagtgaacagg

SEQ ID NO: 9434054 - DNA, 22 bp, Homo sapiens
tggagagaaagttgaatggagg

SEQ ID NO: 9434055 - DNA, 22 bp, Homo sapiens
tggagagaaagttgaatggagg

SEQ ID NO: 9434056 - DNA, 22 bp, Homo sapiens
tggagcagaggaagaaggcttt

SEQ ID NO: 9434057 - DNA, 22 bp, Homo sapiens
tggagcagaggaagaaggcttt

SEQ ID NO: 9434058 - DNA, 22 bp, Homo sapiens
tggagcagaggaagaaggcttt

SEQ ID NO: 9434059 - DNA, 22 bp, Homo sapiens
tggagcagagatggtggccttc

SEQ ID NO: 9434060 - DNA, 22 bp, Homo sapiens
tggagcagcacaagaaagggga

SEQ ID NO: 9434061 - DNA, 22 bp, Homo sapiens
tggagcagagttcagcggggag

SEQ ID NO: 9434062 - DNA, 22 bp, Homo sapiens
tggagcagagttcagcggggag

SEQ ID NO: 9434063 - DNA, 22 bp, Homo sapiens
tggagcagagttcagcggggag

SEQ ID NO: 9434064 - DNA, 22 bp, Homo sapiens
tggagcagaggctgaggttggg

SEQ ID NO: 9434065 - DNA, 22 bp, Homo sapiens
tggagcagaggctgaggttggg

SEQ ID NO: 9434066 - DNA, 22 bp, Homo sapiens
tggagcagaggctgaggttggg

SEQ ID NO: 9434067 - DNA, 22 bp, Homo sapiens
tggagcagaggctgaggttggg

SEQ ID NO: 9434068 - DNA, 22 bp, Homo sapiens
tggagcagccatgatgacagag

SEQ ID NO: 9434069 - DNA, 22 bp, Homo sapiens
tggagcagccatgatgacagag

SEQ ID NO: 9434070 - DNA, 22 bp, Homo sapiens
tggagcagccatgatgacagag

SEQ ID NO: 9434071 - DNA, 22 bp, Homo sapiens
tggagcagccttttctaagcaa

SEQ ID NO: 9434072 - DNA, 22 bp, Homo sapiens
tggagcagccatgatgacagag

SEQ ID NO: 9434073 - DNA, 22 bp, Homo sapiens
tggagcagccatgatgacagag

SEQ ID NO: 9434074 - DNA, 22 bp, Homo sapiens
tggagcagccttttctaagcaa

SEQ ID NO: 9434075 - DNA, 22 bp, Homo sapiens
tggagcagccttttctaagcaa

SEQ ID NO: 9434076 - DNA, 22 bp, Homo sapiens
tggagcagcacaagaaagggga

SEQ ID NO: 9434077 - DNA, 22 bp, Homo sapiens
tggagcagcacaagaaagggga

SEQ ID NO: 9434078 - DNA, 22 bp, Homo sapiens
tggagcagcacaagaaagggga

SEQ ID NO: 9434079 - DNA, 22 bp, Homo sapiens
tggagcagcatcactttgagct

SEQ ID NO: 9434080 - DNA, 22 bp, Homo sapiens
tggagcagcattcatccagcag

SEQ ID NO: 9434081 - DNA, 22 bp, Homo sapiens
tggagcagcattcatccagcag

SEQ ID NO: 9434082 - DNA, 22 bp, Homo sapiens
tggagcagcattcatccagcag

SEQ ID NO: 9434083 - DNA, 22 bp, Homo sapiens
tggagagtctctgagccagggc

SEQ ID NO: 9434084 - DNA, 22 bp, Homo sapiens
tggagagtctctgagccagggc

SEQ ID NO: 9434085 - DNA, 22 bp, Homo sapiens
tggagagtctctgagccagggc

SEQ ID NO: 9434086 - DNA, 22 bp, Homo sapiens
tggagagtgtagacttcagagt

SEQ ID NO: 9434087 - DNA, 22 bp, Homo sapiens
tggagagtggtttgggggacat

SEQ ID NO: 9434088 - DNA, 22 bp, Homo sapiens
tggagagtgtagacttcagagt

SEQ ID NO: 9434089 - DNA, 22 bp, Homo sapiens
tggagagtggtttgggggacat

SEQ ID NO: 9434090 - DNA, 22 bp, Homo sapiens
tggagagtggatatgggagcaa

SEQ ID NO: 9434091 - DNA, 22 bp, Homo sapiens
tggagagtggatatgggagcaa

SEQ ID NO: 9434092 - DNA, 22 bp, Homo sapiens
tggagcagaaatggcctcttgt

SEQ ID NO: 9434093 - DNA, 22 bp, Homo sapiens
tggagagttctgtagatatcta

SEQ ID NO: 9434094 - DNA, 22 bp, Homo sapiens
tggagcagaaatttgaagccat

SEQ ID NO: 9434095 - DNA, 22 bp, Homo sapiens
tggagcagagatgggagcccaa

SEQ ID NO: 9434096 - DNA, 22 bp, Homo sapiens
tggagcagagatgggagcccaa

SEQ ID NO: 9434097 - DNA, 22 bp, Homo sapiens
tggagagtaatttctgaagacc

SEQ ID NO: 9434098 - DNA, 22 bp, Homo sapiens
tggagagtctcaaggcaggaaa

SEQ ID NO: 9434099 - DNA, 22 bp, Homo sapiens
tggagagtaatttctgaagacc

SEQ ID NO: 9434100 - DNA, 22 bp, Homo sapiens
tggagagtaaatggcagaatca

SEQ ID NO: 9434101 - DNA, 22 bp, Homo sapiens
tggagagtaaatggcagaatca

SEQ ID NO: 9434102 - DNA, 19 bp, Homo sapiens
tggagaggaaatgctgctc

SEQ ID NO: 9434103 - DNA, 22 bp, Homo sapiens
tggagaggagcaccatggccat

SEQ ID NO: 9434104 - DNA, 19 bp, Homo sapiens
tggaggagaggaaaagtca

SEQ ID NO: 9434105 - DNA, 19 bp, Homo sapiens
tggaggagaggaaaagtca

SEQ ID NO: 9434106 - DNA, 22 bp, Homo sapiens
tggaggagggctggtgtctgta

SEQ ID NO: 9434107 - DNA, 22 bp, Homo sapiens
tggaggaggaacttcttatctc

SEQ ID NO: 9434108 - DNA, 22 bp, Homo sapiens
tggaggagaatttatggtcgaa

SEQ ID NO: 9434109 - DNA, 22 bp, Homo sapiens
tggaggagaccattccactcag

SEQ ID NO: 9434110 - DNA, 22 bp, Homo sapiens
tggaggagaccattccactcag

SEQ ID NO: 9434111 - DNA, 22 bp, Homo sapiens
tggaggattaatctggaaagat

SEQ ID NO: 9434112 - DNA, 22 bp, Homo sapiens
tggaggattccacttacatgag

SEQ ID NO: 9434113 - DNA, 22 bp, Homo sapiens
tggaggatgcctggggaggcct

SEQ ID NO: 9434114 - DNA, 22 bp, Homo sapiens
tggaggatgcctggggaggcct

SEQ ID NO: 9434115 - DNA, 22 bp, Homo sapiens
tggaggattaatctggaaagat

SEQ ID NO: 9434116 - DNA, 22 bp, Homo sapiens
tggaggatgcctggggaggcct

SEQ ID NO: 9434117 - DNA, 22 bp, Homo sapiens
tggaggatgcctggggaggcct

SEQ ID NO: 9434118 - DNA, 22 bp, Homo sapiens
tggaggatgcctggggaggcct

SEQ ID NO: 9434119 - DNA, 22 bp, Homo sapiens
tggaggagtagattttcagagg

SEQ ID NO: 9434120 - DNA, 22 bp, Homo sapiens
tggaggagggctggtgtctgta

SEQ ID NO: 9434121 - DNA, 22 bp, Homo sapiens
tggaggagtgtgattgtctgcc

SEQ ID NO: 9434122 - DNA, 22 bp, Homo sapiens
tggaggagtgtgattgtctgcc

SEQ ID NO: 9434123 - DNA, 22 bp, Homo sapiens
tggaggagggctggtgtctgta

SEQ ID NO: 9434124 - DNA, 22 bp, Homo sapiens
tggaggagggctggtgtctgta

SEQ ID NO: 9434125 - DNA, 19 bp, Homo sapiens
tggaggagaggaaaagtca

SEQ ID NO: 9434126 - DNA, 22 bp, Homo sapiens
tggaggagggctggtgtctgta

SEQ ID NO: 9434127 - DNA, 22 bp, Homo sapiens
tggaggagggctggtgtctgta

SEQ ID NO: 9434128 - DNA, 22 bp, Homo sapiens
tggaggagggctggtgtctgta

SEQ ID NO: 9434129 - DNA, 22 bp, Homo sapiens
tggaggaaaaaaccaggcagag

SEQ ID NO: 9434130 - DNA, 22 bp, Homo sapiens
tggaggaaaaaaccaggcagag

SEQ ID NO: 9434131 - DNA, 20 bp, Homo sapiens
tggagctgtggtaaggagca

SEQ ID NO: 9434132 - DNA, 20 bp, Homo sapiens
tggagctgtggtaaggagca

SEQ ID NO: 9434133 - DNA, 22 bp, Homo sapiens
tggagctgtcactcagaaccaa

SEQ ID NO: 9434134 - DNA, 22 bp, Homo sapiens
tggagctgtcactcagaaccaa

SEQ ID NO: 9434135 - DNA, 20 bp, Homo sapiens
tggagctgtaatcttgtctg

SEQ ID NO: 9434136 - DNA, 20 bp, Homo sapiens
tggagctgtaatcttgtctg

SEQ ID NO: 9434137 - DNA, 22 bp, Homo sapiens
tggagctgtagccaccaccctg

SEQ ID NO: 9434138 - DNA, 22 bp, Homo sapiens
tggagctggttctggggaagct

SEQ ID NO: 9434139 - DNA, 22 bp, Homo sapiens
tggagctggttctggggaagct

SEQ ID NO: 9434140 - DNA, 22 bp, Homo sapiens
tggagctggtaaacagtgacat

SEQ ID NO: 9434141 - DNA, 23 bp, Homo sapiens
tggagctgggatttgatttgatt

SEQ ID NO: 9434142 - DNA, 23 bp, Homo sapiens
tggagctgggcagctgggaaagt

SEQ ID NO: 9434143 - DNA, 23 bp, Homo sapiens
tggagctgggatttgatttgatt

SEQ ID NO: 9434144 - DNA, 23 bp, Homo sapiens
tggagctgggcagctgggaaagt

SEQ ID NO: 9434145 - DNA, 23 bp, Homo sapiens
tggagctgggcagctgggaaagt

SEQ ID NO: 9434146 - DNA, 22 bp, Homo sapiens
tggagctgggagtcctgggctg

SEQ ID NO: 9434147 - DNA, 22 bp, Homo sapiens
tggagctgggatttgaactgca

SEQ ID NO: 9434148 - DNA, 22 bp, Homo sapiens
tggagctgggatttgaactgca

SEQ ID NO: 9434149 - DNA, 22 bp, Homo sapiens
tggagctgggagtcctgggctg

SEQ ID NO: 9434150 - DNA, 22 bp, Homo sapiens
tggagctggggtttgaatctgg

SEQ ID NO: 9434151 - DNA, 22 bp, Homo sapiens
tggagctggtaaacagtgacat

SEQ ID NO: 9434152 - DNA, 22 bp, Homo sapiens
tggagctggtaaacagtgacat

SEQ ID NO: 9434153 - DNA, 23 bp, Homo sapiens
tggagctgggctcagaccctggg

SEQ ID NO: 9434154 - DNA, 23 bp, Homo sapiens
tggagctgggctcagaccctggg

SEQ ID NO: 9434155 - DNA, 23 bp, Homo sapiens
tggagctgggctcagaccctggg

SEQ ID NO: 9434156 - DNA, 22 bp, Homo sapiens
tggagctggggtttgaatctgg

SEQ ID NO: 9434157 - DNA, 18 bp, Homo sapiens
tggaggcagagttctggc

SEQ ID NO: 9434158 - DNA, 22 bp, Homo sapiens
tggaggcagatacactgtaaaa

SEQ ID NO: 9434159 - DNA, 22 bp, Homo sapiens
tggaggcaggagacagggcaaa

SEQ ID NO: 9434160 - DNA, 22 bp, Homo sapiens
tggaggcaggtggaggagtgaa

SEQ ID NO: 9434161 - DNA, 22 bp, Homo sapiens
tggaggcaggtggaggagtgaa

SEQ ID NO: 9434162 - DNA, 20 bp, Homo sapiens
tggaggcagagccagaggga

SEQ ID NO: 9434163 - DNA, 20 bp, Homo sapiens
tggaggcacctgtggagatc

SEQ ID NO: 9434164 - DNA, 20 bp, Homo sapiens
tggaggcacctgtggagatc

SEQ ID NO: 9434165 - DNA, 20 bp, Homo sapiens
tggaggcacctgtggagatc

SEQ ID NO: 9434166 - DNA, 19 bp, Homo sapiens
tggaggcaagacatggagg

SEQ ID NO: 9434167 - DNA, 19 bp, Homo sapiens
tggaggcaagacatggagg

SEQ ID NO: 9434168 - DNA, 22 bp, Homo sapiens
tggaggcaccactggctgcccg

SEQ ID NO: 9434169 - DNA, 22 bp, Homo sapiens
tggaggcagtaactgagcaaca

SEQ ID NO: 9434170 - DNA, 22 bp, Homo sapiens
tggaggcagtcaaatgactgac

SEQ ID NO: 9434171 - DNA, 22 bp, Homo sapiens
tggaggcagtcaaatgactgac

SEQ ID NO: 9434172 - DNA, 22 bp, Homo sapiens
tggaggcagtcaaatgactgac

SEQ ID NO: 9434173 - DNA, 19 bp, Homo sapiens
tggaggccaggacacaggt

SEQ ID NO: 9434174 - DNA, 19 bp, Homo sapiens
tggaggccaggacacaggt

SEQ ID NO: 9434175 - DNA, 19 bp, Homo sapiens
tggaggccaggacacaggt

SEQ ID NO: 9434176 - DNA, 22 bp, Homo sapiens
tggaggcgagagcgcgcgggct

SEQ ID NO: 9434177 - DNA, 19 bp, Homo sapiens
tggaggcctcaggaaaaga

SEQ ID NO: 9434178 - DNA, 22 bp, Homo sapiens
tggaggccgcgtagtctgagca

SEQ ID NO: 9434179 - DNA, 22 bp, Homo sapiens
tggaggcccccaggcaacagca

SEQ ID NO: 9434180 - DNA, 22 bp, Homo sapiens
tggaggcccccaggcaacagca

SEQ ID NO: 9434181 - DNA, 22 bp, Homo sapiens
tggaggccgaattagagcgttg

SEQ ID NO: 9434182 - DNA, 22 bp, Homo sapiens
tggagggctaagctgagggata

SEQ ID NO: 9434183 - DNA, 22 bp, Homo sapiens
tggagggctaagctgagggata

SEQ ID NO: 9434184 - DNA, 22 bp, Homo sapiens
tggagggcgcttagatggaggg

SEQ ID NO: 9434185 - DNA, 22 bp, Homo sapiens
tggagggcgcttagatggaggg

SEQ ID NO: 9434186 - DNA, 22 bp, Homo sapiens
tggagggcgcttagatggaggg

SEQ ID NO: 9434187 - DNA, 22 bp, Homo sapiens
tggagggctaagctgagggata

SEQ ID NO: 9434188 - DNA, 18 bp, Homo sapiens
tggagggcttgctgcagc

SEQ ID NO: 9434189 - DNA, 22 bp, Homo sapiens
tggaggtggagttggaaactga

SEQ ID NO: 9434190 - DNA, 22 bp, Homo sapiens
tggagggctctttcacctggta

SEQ ID NO: 9434191 - DNA, 22 bp, Homo sapiens
tggagggctctttcacctggta

SEQ ID NO: 9434192 - DNA, 18 bp, Homo sapiens
tggagggcttgctgcagc

SEQ ID NO: 9434193 - DNA, 22 bp, Homo sapiens
tggaggtggcacaagggaggtc

SEQ ID NO: 9434194 - DNA, 22 bp, Homo sapiens
tggaggtggcacaagggaggtc

SEQ ID NO: 9434195 - DNA, 22 bp, Homo sapiens
tggaggtggcacaagggaggtc

SEQ ID NO: 9434196 - DNA, 22 bp, Homo sapiens
tggaggtggcacaagggaggtc

SEQ ID NO: 9434197 - DNA, 22 bp, Homo sapiens
tggaggtggcacaagggaggtc

SEQ ID NO: 9434198 - DNA, 22 bp, Homo sapiens
tggaggtggcacaagggaggtc

SEQ ID NO: 9434199 - DNA, 22 bp, Homo sapiens
tggaggtggcatctgacagctg

SEQ ID NO: 9434200 - DNA, 22 bp, Homo sapiens
tggaggtgggagggactgtcct

SEQ ID NO: 9434201 - DNA, 22 bp, Homo sapiens
tggaggtgggagggactgtcct

SEQ ID NO: 9434202 - DNA, 22 bp, Homo sapiens
tggaggtgggagggactgtcct

SEQ ID NO: 9434203 - DNA, 22 bp, Homo sapiens
tggaggtggtgcccagcaattt

SEQ ID NO: 9434204 - DNA, 22 bp, Homo sapiens
tggaggtgtataaggtagcttc

SEQ ID NO: 9434205 - DNA, 22 bp, Homo sapiens
tggaggtggtgcccagcaattt

SEQ ID NO: 9434206 - DNA, 20 bp, Homo sapiens
tggaggtggtctgctgtcct

SEQ ID NO: 9434207 - DNA, 20 bp, Homo sapiens
tggaggtggtctgctgtcct

SEQ ID NO: 9434208 - DNA, 20 bp, Homo sapiens
tggaggtggtctgctgtcct

SEQ ID NO: 9434209 - DNA, 22 bp, Homo sapiens
tggaggtggggctcaggaatct

SEQ ID NO: 9434210 - DNA, 22 bp, Homo sapiens
tggagggaacccaggctgctct

SEQ ID NO: 9434211 - DNA, 22 bp, Homo sapiens
tggagggaacccaggctgctct

SEQ ID NO: 9434212 - DNA, 22 bp, Homo sapiens
tggagggaacccaggctgctct

SEQ ID NO: 9434213 - DNA, 22 bp, Homo sapiens
tggagggaacccaggctgctct

SEQ ID NO: 9434214 - DNA, 22 bp, Homo sapiens
tggagggaacccaggctgctct

SEQ ID NO: 9434215 - DNA, 22 bp, Homo sapiens
tggagggaacccaggctgctct

SEQ ID NO: 9434216 - DNA, 22 bp, Homo sapiens
tggagggatacaaagatgaaaa

SEQ ID NO: 9434217 - DNA, 22 bp, Homo sapiens
tggagggaacccaggctgctct

SEQ ID NO: 9434218 - DNA, 22 bp, Homo sapiens
tggaggctgtgtgcatgagacc

SEQ ID NO: 9434219 - DNA, 22 bp, Homo sapiens
tggagggaacaaaggagtccca

SEQ ID NO: 9434220 - DNA, 22 bp, Homo sapiens
tggagggaacaaaggagtccca

SEQ ID NO: 9434221 - DNA, 22 bp, Homo sapiens
tggaggctgtgtgcatgagacc

SEQ ID NO: 9434222 - DNA, 22 bp, Homo sapiens
tggaggctgtgtgcatgagacc

SEQ ID NO: 9434223 - DNA, 22 bp, Homo sapiens
tggaggctggtttctgctgagg

SEQ ID NO: 9434224 - DNA, 22 bp, Homo sapiens
tggaggctgtgtgcatgagacc

SEQ ID NO: 9434225 - DNA, 22 bp, Homo sapiens
tggaggctggtttctgctgagg

SEQ ID NO: 9434226 - DNA, 22 bp, Homo sapiens
tggagggcatctgtggtcaggc

SEQ ID NO: 9434227 - DNA, 22 bp, Homo sapiens
tggagggcatctgtggtcaggc

SEQ ID NO: 9434228 - DNA, 22 bp, Homo sapiens
tggagggcatctgtggtcaggc

SEQ ID NO: 9434229 - DNA, 22 bp, Homo sapiens
tggagggcatgctgtccatggg

SEQ ID NO: 9434230 - DNA, 22 bp, Homo sapiens
tggagggcgcttagatggaggg

SEQ ID NO: 9434231 - DNA, 22 bp, Homo sapiens
tggagggcgcttagatggaggg

SEQ ID NO: 9434232 - DNA, 22 bp, Homo sapiens
tggagggcgcttagatggaggg

SEQ ID NO: 9434233 - DNA, 22 bp, Homo sapiens
tggagggcatagctgttctttc

SEQ ID NO: 9434234 - DNA, 22 bp, Homo sapiens
tggagggcatctgtggtcaggc

SEQ ID NO: 9434235 - DNA, 22 bp, Homo sapiens
tggagggcatctgtggtcaggc

SEQ ID NO: 9434236 - DNA, 20 bp, Homo sapiens
tggagggattgttggcaaat

SEQ ID NO: 9434237 - DNA, 22 bp, Homo sapiens
tggatatgcccagggcacccta

SEQ ID NO: 9434238 - DNA, 22 bp, Homo sapiens
tggatatgttggaggtgaaggt

SEQ ID NO: 9434239 - DNA, 22 bp, Homo sapiens
tggatatgggccatggaaaaaa

SEQ ID NO: 9434240 - DNA, 19 bp, Homo sapiens
tggatggagcctgtggttg

SEQ ID NO: 9434241 - DNA, 19 bp, Homo sapiens
tggatggagcctgtggttg

SEQ ID NO: 9434242 - DNA, 22 bp, Homo sapiens
tggatggatctcaagggaatta

SEQ ID NO: 9434243 - DNA, 22 bp, Homo sapiens
tggatggattgacgaaggcagc

SEQ ID NO: 9434244 - DNA, 22 bp, Homo sapiens
tggatggagactgatatgggta

SEQ ID NO: 9434245 - DNA, 22 bp, Homo sapiens
tggatgctggatgaacagatgc

SEQ ID NO: 9434246 - DNA, 22 bp, Homo sapiens
tggatggattgacgaaggcagc

SEQ ID NO: 9434247 - DNA, 22 bp, Homo sapiens
tggatggggcagcttaggtgtg

SEQ ID NO: 9434248 - DNA, 22 bp, Homo sapiens
tggatggggcagcttaggtgtg

SEQ ID NO: 9434249 - DNA, 22 bp, Homo sapiens
tggatggctggggaagagcagg

SEQ ID NO: 9434250 - DNA, 22 bp, Homo sapiens
tggagtgggcaatgtaggcaag

SEQ ID NO: 9434251 - DNA, 22 bp, Homo sapiens
tggagtgggcaatgtaggcaag

SEQ ID NO: 9434252 - DNA, 22 bp, Homo sapiens
tggagtggacttcatgaggcca

SEQ ID NO: 9434253 - DNA, 22 bp, Homo sapiens
tggagtgggcaatgtaggcaag

SEQ ID NO: 9434254 - DNA, 22 bp, Homo sapiens
tggataaactcactgtaagttg

SEQ ID NO: 9434255 - DNA, 22 bp, Homo sapiens
tggataaactcactgtaagttg

SEQ ID NO: 9434256 - DNA, 23 bp, Homo sapiens
tggataaagctgtgctgcatagg

SEQ ID NO: 9434257 - DNA, 21 bp, Homo sapiens
tggataaaggcacttttcatc

SEQ ID NO: 9434258 - DNA, 22 bp, Homo sapiens
tggagttgtgtcatctttgtaa

SEQ ID NO: 9434259 - DNA, 23 bp, Homo sapiens
tggataaaatacttacattcaac

SEQ ID NO: 9434260 - DNA, 16 bp, Homo sapiens
tggaggtgtttctagt

SEQ ID NO: 9434261 - DNA, 22 bp, Homo sapiens
tggaggtgtggagtcaaaggga

SEQ ID NO: 9434262 - DNA, 22 bp, Homo sapiens
tggaggtgtggagtcaaaggga

SEQ ID NO: 9434263 - DNA, 22 bp, Homo sapiens
tggaggtgtccaactcgtgggt

SEQ ID NO: 9434264 - DNA, 22 bp, Homo sapiens
tggaggtgtccaactcgtgggt

SEQ ID NO: 9434265 - DNA, 22 bp, Homo sapiens
tggaggtgtataaggtagcttc

SEQ ID NO: 9434266 - DNA, 22 bp, Homo sapiens
tggaggtgtataaggtagcttc

SEQ ID NO: 9434267 - DNA, 22 bp, Homo sapiens
tggaggtgtccaactcgtgggt

SEQ ID NO: 9434268 - DNA, 22 bp, Homo sapiens
tggaggtgtataaggtagcttc

SEQ ID NO: 9434269 - DNA, 22 bp, Homo sapiens
tggagtcagaatgcgacaggcc

SEQ ID NO: 9434270 - DNA, 22 bp, Homo sapiens
tggagtcagtctgggttgcaat

SEQ ID NO: 9434271 - DNA, 22 bp, Homo sapiens
tggagtcagctagacctgtgtt

SEQ ID NO: 9434272 - DNA, 22 bp, Homo sapiens
tggagtcaggcaatgcttgctt

SEQ ID NO: 9434273 - DNA, 22 bp, Homo sapiens
tggagtcagagggggaagtcac

SEQ ID NO: 9434274 - DNA, 22 bp, Homo sapiens
tggagtgcaatagtaataaggt

SEQ ID NO: 9434275 - DNA, 22 bp, Homo sapiens
tggagtgaagggttggcacggt

SEQ ID NO: 9434276 - DNA, 22 bp, Homo sapiens
tggagtgcagttgggaggacac

SEQ ID NO: 9434277 - DNA, 20 bp, Homo sapiens
tggagtgctgtgttgagaag

SEQ ID NO: 9434278 - DNA, 20 bp, Homo sapiens
tggagtctgacagatgggta

SEQ ID NO: 9434279 - DNA, 22 bp, Homo sapiens
tggagtctgtgatgctctgggt

SEQ ID NO: 9434280 - DNA, 22 bp, Homo sapiens
tggagtccgctccaagttctct

SEQ ID NO: 9434281 - DNA, 22 bp, Homo sapiens
tggagtcatgatggctgctgat

SEQ ID NO: 9434282 - DNA, 20 bp, Homo sapiens
tggagtcatgggacactcac

SEQ ID NO: 9434283 - DNA, 22 bp, Homo sapiens
tgctggaggcctgactgtgttt

SEQ ID NO: 9434284 - DNA, 22 bp, Homo sapiens
tgctggaggcctgactgtgttt

SEQ ID NO: 9434285 - DNA, 20 bp, Homo sapiens
tgctggaggcgccggcgctc

SEQ ID NO: 9434286 - DNA, 20 bp, Homo sapiens
tgctggaggcgccggcgctc

SEQ ID NO: 9434287 - DNA, 22 bp, Homo sapiens
tgctggaggccgagaagcagca

SEQ ID NO: 9434288 - DNA, 22 bp, Homo sapiens
tgctggaggccgagaagcagca

SEQ ID NO: 9434289 - DNA, 22 bp, Homo sapiens
tgctggaggcagtggaggtgcc

SEQ ID NO: 9434290 - DNA, 22 bp, Homo sapiens
tgctggaggccagaagtctgag

SEQ ID NO: 9434291 - DNA, 22 bp, Homo sapiens
tgctggaggagtttactgtggc

SEQ ID NO: 9434292 - DNA, 22 bp, Homo sapiens
tgctggaggattaaacaagtca

SEQ ID NO: 9434293 - DNA, 22 bp, Homo sapiens
tgctggaggagaaggttgctca

SEQ ID NO: 9434294 - DNA, 22 bp, Homo sapiens
tgctggagtaacaagacactca

SEQ ID NO: 9434295 - DNA, 22 bp, Homo sapiens
tgctggagtaacaagacactca

SEQ ID NO: 9434296 - DNA, 19 bp, Homo sapiens
tgctggagtgacattctga

SEQ ID NO: 9434297 - DNA, 19 bp, Homo sapiens
tgctggaggttgacagggt

SEQ ID NO: 9434298 - DNA, 19 bp, Homo sapiens
tgctggaggttgacagggt

SEQ ID NO: 9434299 - DNA, 19 bp, Homo sapiens
tgctggaggttgacagggt

SEQ ID NO: 9434300 - DNA, 17 bp, Homo sapiens
tgctggaggcggggtat

SEQ ID NO: 9434301 - DNA, 22 bp, Homo sapiens
tgctggaggggatgccttcact

SEQ ID NO: 9434302 - DNA, 22 bp, Homo sapiens
tgctggagggggtaccactcaa

SEQ ID NO: 9434303 - DNA, 22 bp, Homo sapiens
tgctggaggggcctgaccagga

SEQ ID NO: 9434304 - DNA, 22 bp, Homo sapiens
tgctggaggggcctgaccagga

SEQ ID NO: 9434305 - DNA, 22 bp, Homo sapiens
tgctggaggggcctgaccagga

SEQ ID NO: 9434306 - DNA, 22 bp, Homo sapiens
tgctggcaccagaatgactgca

SEQ ID NO: 9434307 - DNA, 22 bp, Homo sapiens
tgctggcacatagagactggct

SEQ ID NO: 9434308 - DNA, 22 bp, Homo sapiens
tgctggcatgcatgctgtagga

SEQ ID NO: 9434309 - DNA, 22 bp, Homo sapiens
tgctggcaggcacctcctgggg

SEQ ID NO: 9434310 - DNA, 22 bp, Homo sapiens
tgctggcaggcacctcctgggg

SEQ ID NO: 9434311 - DNA, 22 bp, Homo sapiens
tgctggagtgagtggtttctta

SEQ ID NO: 9434312 - DNA, 22 bp, Homo sapiens
tgctggagttcgacattgcaaa

SEQ ID NO: 9434313 - DNA, 22 bp, Homo sapiens
tgctggagttcgacattgcaaa

SEQ ID NO: 9434314 - DNA, 22 bp, Homo sapiens
tgctggagtggcactgtgtggc

SEQ ID NO: 9434315 - DNA, 22 bp, Homo sapiens
tgctggagtggcactgtgtggc

SEQ ID NO: 9434316 - DNA, 22 bp, Homo sapiens
tgctggagtggcactgtgtggc

SEQ ID NO: 9434317 - DNA, 23 bp, Homo sapiens
tgctggagtttactcaggccagc

SEQ ID NO: 9434318 - DNA, 23 bp, Homo sapiens
tgctggagtttactcaggccagc

SEQ ID NO: 9434319 - DNA, 22 bp, Homo sapiens
tgctggatggagtaaaactgga

SEQ ID NO: 9434320 - DNA, 22 bp, Homo sapiens
tgctggatggagtaaaactgga

SEQ ID NO: 9434321 - DNA, 22 bp, Homo sapiens
tgctggctggatcagagattgg

SEQ ID NO: 9434322 - DNA, 22 bp, Homo sapiens
tgctggctggagtgcctctgga

SEQ ID NO: 9434323 - DNA, 22 bp, Homo sapiens
tgctggctgccaggttccctgt

SEQ ID NO: 9434324 - DNA, 22 bp, Homo sapiens
tgctggctgccaggttccctgt

SEQ ID NO: 9434325 - DNA, 22 bp, Homo sapiens
tgctggctgcagtgctgtcaaa

SEQ ID NO: 9434326 - DNA, 22 bp, Homo sapiens
tgctggctgcagtgctgtcaaa

SEQ ID NO: 9434327 - DNA, 22 bp, Homo sapiens
tgctggctgggctgctggagac

SEQ ID NO: 9434328 - DNA, 22 bp, Homo sapiens
tgctggctggcctggcctggac

SEQ ID NO: 9434329 - DNA, 22 bp, Homo sapiens
tgctggctggcctggcctggac

SEQ ID NO: 9434330 - DNA, 22 bp, Homo sapiens
tgctggctgtatatgtgagagt

SEQ ID NO: 9434331 - DNA, 22 bp, Homo sapiens
tgctggctgtatatgtgagagt

SEQ ID NO: 9434332 - DNA, 22 bp, Homo sapiens
tgctggctgtatatgtgagagt

SEQ ID NO: 9434333 - DNA, 22 bp, Homo sapiens
tgctggctgtatatgtgagagt

SEQ ID NO: 9434334 - DNA, 22 bp, Homo sapiens
tgctggctgggctgctggagac

SEQ ID NO: 9434335 - DNA, 22 bp, Homo sapiens
tgctggctgggctgctggagac

SEQ ID NO: 9434336 - DNA, 22 bp, Homo sapiens
tgctggctgggctgctggagac

SEQ ID NO: 9434337 - DNA, 23 bp, Homo sapiens
tgctggcttccagctgctccctc

SEQ ID NO: 9434338 - DNA, 22 bp, Homo sapiens
tgctggcttatttagtaaatgt

SEQ ID NO: 9434339 - DNA, 23 bp, Homo sapiens
tgctggcttccagctgctccctc

SEQ ID NO: 9434340 - DNA, 23 bp, Homo sapiens
tgctggcttccagctgctccctc

SEQ ID NO: 9434341 - DNA, 22 bp, Homo sapiens
tgctggctgttctagggaggcc

SEQ ID NO: 9434342 - DNA, 22 bp, Homo sapiens
tgctggcttatttagtaaatgt

SEQ ID NO: 9434343 - DNA, 22 bp, Homo sapiens
tgctggcttagatatcactgcc

SEQ ID NO: 9434344 - DNA, 22 bp, Homo sapiens
tgctggcttagatatcactgcc

SEQ ID NO: 9434345 - DNA, 22 bp, Homo sapiens
tgctggctgtccctacctggct

SEQ ID NO: 9434346 - DNA, 22 bp, Homo sapiens
tgctggctgtccctacctggct

SEQ ID NO: 9434347 - DNA, 22 bp, Homo sapiens
tgctggctgtgtaccatctcaa

SEQ ID NO: 9434348 - DNA, 23 bp, Homo sapiens
tgctggctgtgttattgccaaca

SEQ ID NO: 9434349 - DNA, 23 bp, Homo sapiens
tgctggctgtgttattgccaaca

SEQ ID NO: 9434350 - DNA, 22 bp, Homo sapiens
tgctggctgtgtaccatctcaa

SEQ ID NO: 9434351 - DNA, 22 bp, Homo sapiens
tgctggctgttctagggaggcc

SEQ ID NO: 9434352 - DNA, 22 bp, Homo sapiens
tgctggctatttaaagaagaaa

SEQ ID NO: 9434353 - DNA, 22 bp, Homo sapiens
tgctggctactgatggcaggcc

SEQ ID NO: 9434354 - DNA, 22 bp, Homo sapiens
tgctggctactgatggcaggcc

SEQ ID NO: 9434355 - DNA, 22 bp, Homo sapiens
tgctggctcagtttgcagactc

SEQ ID NO: 9434356 - DNA, 22 bp, Homo sapiens
tgctggctcagtttgcagactc

SEQ ID NO: 9434357 - DNA, 22 bp, Homo sapiens
tgctggctccaacctggcatct

SEQ ID NO: 9434358 - DNA, 22 bp, Homo sapiens
tgctggctcccaggagccgctg

SEQ ID NO: 9434359 - DNA, 22 bp, Homo sapiens
tgctggctccaacctggcatct

SEQ ID NO: 9434360 - DNA, 22 bp, Homo sapiens
tgctggctccaacctggcatct

SEQ ID NO: 9434361 - DNA, 22 bp, Homo sapiens
tgctggccaacaaggctccaag

SEQ ID NO: 9434362 - DNA, 22 bp, Homo sapiens
tgctggccaacaaggctccaag

SEQ ID NO: 9434363 - DNA, 22 bp, Homo sapiens
tgctggcatttcaggactcacc

SEQ ID NO: 9434364 - DNA, 22 bp, Homo sapiens
tgctggcattgcataggcagtt

SEQ ID NO: 9434365 - DNA, 22 bp, Homo sapiens
tgctggccaagcagaggtcaat

SEQ ID NO: 9434366 - DNA, 22 bp, Homo sapiens
tgctggctactgatggcaggcc

SEQ ID NO: 9434367 - DNA, 22 bp, Homo sapiens
tgctggccaacaaggctccaag

SEQ ID NO: 9434368 - DNA, 22 bp, Homo sapiens
tgctggctactgatggcaggcc

SEQ ID NO: 9434369 - DNA, 22 bp, Homo sapiens
tgctggctctgggccaagcagg

SEQ ID NO: 9434370 - DNA, 22 bp, Homo sapiens
tgctggctctgggccaagcagg

SEQ ID NO: 9434371 - DNA, 22 bp, Homo sapiens
tgctggctctaggctgagacag

SEQ ID NO: 9434372 - DNA, 22 bp, Homo sapiens
tgctggctctaggctgagacag

SEQ ID NO: 9434373 - DNA, 22 bp, Homo sapiens
tgctggctcccaggagccgctg

SEQ ID NO: 9434374 - DNA, 22 bp, Homo sapiens
tgctggctcctcgaggcttcgt

SEQ ID NO: 9434375 - DNA, 22 bp, Homo sapiens
tgctggctgaggcctgagcggg

SEQ ID NO: 9434376 - DNA, 22 bp, Homo sapiens
tgctggctgaggcctgagcggg

SEQ ID NO: 9434377 - DNA, 22 bp, Homo sapiens
tgctggctgaggcctgagcggg

SEQ ID NO: 9434378 - DNA, 21 bp, Homo sapiens
tgctggctgaaaggcacagag

SEQ ID NO: 9434379 - DNA, 21 bp, Homo sapiens
tgctggctgaaaggcacagag

SEQ ID NO: 9434380 - DNA, 23 bp, Homo sapiens
tgctggctgaaacagccaaagga

SEQ ID NO: 9434381 - DNA, 23 bp, Homo sapiens
tgctggctgaaacagccaaagga

SEQ ID NO: 9434382 - DNA, 21 bp, Homo sapiens
tgctggctgaaaggcacagag

SEQ ID NO: 9434383 - DNA, 22 bp, Homo sapiens
tgctggagaagctcctgggact

SEQ ID NO: 9434384 - DNA, 23 bp, Homo sapiens
tgctggagaagcaaagttctgag

SEQ ID NO: 9434385 - DNA, 22 bp, Homo sapiens
tgctggagaactgctctgtgtt

SEQ ID NO: 9434386 - DNA, 22 bp, Homo sapiens
tgctggagaactgctctgtgtt

SEQ ID NO: 9434387 - DNA, 22 bp, Homo sapiens
tgctggagctccgggctgtagg

SEQ ID NO: 9434388 - DNA, 21 bp, Homo sapiens
tgctggaggacagggtttcat

SEQ ID NO: 9434389 - DNA, 21 bp, Homo sapiens
tgctggaggacagggtttcat

SEQ ID NO: 9434390 - DNA, 22 bp, Homo sapiens
tgctggaggagaaggttgctca

SEQ ID NO: 9434391 - DNA, 22 bp, Homo sapiens
tgctggaggagaaggttgctca

SEQ ID NO: 9434392 - DNA, 23 bp, Homo sapiens
tgctggagacaagtgtgagaagg

SEQ ID NO: 9434393 - DNA, 22 bp, Homo sapiens
tgctggagcggaggtgagccag

SEQ ID NO: 9434394 - DNA, 23 bp, Homo sapiens
tgctggaaggtccaatttgctca

SEQ ID NO: 9434395 - DNA, 22 bp, Homo sapiens
tgctggaataatttcatgttaa

SEQ ID NO: 9434396 - DNA, 22 bp, Homo sapiens
tgctggaagctcctgcatgtct

SEQ ID NO: 9434397 - DNA, 22 bp, Homo sapiens
tgctggagaaagtttttctgaa

SEQ ID NO: 9434398 - DNA, 22 bp, Homo sapiens
tgctggaatttttctaggattt

SEQ ID NO: 9434399 - DNA, 22 bp, Homo sapiens
tgctggaattgacctagaagga

SEQ ID NO: 9434400 - DNA, 22 bp, Homo sapiens
tgctggaattgacctagaagga

SEQ ID NO: 9434401 - DNA, 22 bp, Homo sapiens
tgctggaaaaatcatttgcttt

SEQ ID NO: 9434402 - DNA, 22 bp, Homo sapiens
tgctggaaagaattttctgtta

SEQ ID NO: 9434403 - DNA, 22 bp, Homo sapiens
tgctggaaataggcattgtagc

SEQ ID NO: 9434404 - DNA, 22 bp, Homo sapiens
tgctggaaagttaaattttgga

SEQ ID NO: 9434405 - DNA, 22 bp, Homo sapiens
tgctgctgtatccttagtgtca

SEQ ID NO: 9434406 - DNA, 19 bp, Homo sapiens
tgctgctgtccttgcaggg

SEQ ID NO: 9434407 - DNA, 19 bp, Homo sapiens
tgctgctgtccttgcaggg

SEQ ID NO: 9434408 - DNA, 22 bp, Homo sapiens
tgctgctgtagctaggctttct

SEQ ID NO: 9434409 - DNA, 22 bp, Homo sapiens
tgctgctgggtttgacagtcac

SEQ ID NO: 9434410 - DNA, 22 bp, Homo sapiens
tgctgctgtatccttagtgtca

SEQ ID NO: 9434411 - DNA, 22 bp, Homo sapiens
tgctgctgatggcacctaggca

SEQ ID NO: 9434412 - DNA, 22 bp, Homo sapiens
tgctgctgatggcacctaggca

SEQ ID NO: 9434413 - DNA, 20 bp, Homo sapiens
tgctgctgcctccgcctctg

SEQ ID NO: 9434414 - DNA, 22 bp, Homo sapiens
tgctgcttcctggtagatagga

SEQ ID NO: 9434415 - DNA, 22 bp, Homo sapiens
tgctgctgttgacggctgtcca

SEQ ID NO: 9434416 - DNA, 20 bp, Homo sapiens
tgctgctgtgagcgtccctg

SEQ ID NO: 9434417 - DNA, 20 bp, Homo sapiens
tgctgctgtgagcgtccctg

SEQ ID NO: 9434418 - DNA, 22 bp, Homo sapiens
tgctgctttgatgtgtaaatca

SEQ ID NO: 9434419 - DNA, 22 bp, Homo sapiens
tgctgcttttagttggatagaa

SEQ ID NO: 9434420 - DNA, 22 bp, Homo sapiens
tgctgccacatttaaagagggg

SEQ ID NO: 9434421 - DNA, 22 bp, Homo sapiens
tgctgccacatttaaagagggg

SEQ ID NO: 9434422 - DNA, 22 bp, Homo sapiens
tgctgccacccctcaccagagc

SEQ ID NO: 9434423 - DNA, 22 bp, Homo sapiens
tgctgccacctggtggctgaag

SEQ ID NO: 9434424 - DNA, 22 bp, Homo sapiens
tgctgccacaaattcagctgcc

SEQ ID NO: 9434425 - DNA, 22 bp, Homo sapiens
tgctgccacaaattcagctgcc

SEQ ID NO: 9434426 - DNA, 22 bp, Homo sapiens
tgctgccaatttctggtcttga

SEQ ID NO: 9434427 - DNA, 17 bp, Homo sapiens
tgctgccaagtcccaac

SEQ ID NO: 9434428 - DNA, 22 bp, Homo sapiens
tgctgcatttgcagtcctttaa

SEQ ID NO: 9434429 - DNA, 22 bp, Homo sapiens
tgctgcatttgcagtcctttaa

SEQ ID NO: 9434430 - DNA, 20 bp, Homo sapiens
tgctgcagtttcatgggact

SEQ ID NO: 9434431 - DNA, 23 bp, Homo sapiens
tgctgccaagcacgagttgagtt

SEQ ID NO: 9434432 - DNA, 23 bp, Homo sapiens
tgctgccaagcacgagttgagtt

SEQ ID NO: 9434433 - DNA, 22 bp, Homo sapiens
tgctgccaaatgcgagctctgt

SEQ ID NO: 9434434 - DNA, 22 bp, Homo sapiens
tgctgccaaatgcgagctctgt

SEQ ID NO: 9434435 - DNA, 22 bp, Homo sapiens
tgctgccagggctctgcccaca

SEQ ID NO: 9434436 - DNA, 22 bp, Homo sapiens
tgctgccagggctctgcccaca

SEQ ID NO: 9434437 - DNA, 22 bp, Homo sapiens
tgctgccaggtcttgctgtcca

SEQ ID NO: 9434438 - DNA, 22 bp, Homo sapiens
tgctgccaggtcttgctgtcca

SEQ ID NO: 9434439 - DNA, 21 bp, Homo sapiens
tgctgccatagacctgaggga

SEQ ID NO: 9434440 - DNA, 21 bp, Homo sapiens
tgctgccatagacctgaggga

SEQ ID NO: 9434441 - DNA, 21 bp, Homo sapiens
tgctgccatcatgcagagatg

SEQ ID NO: 9434442 - DNA, 22 bp, Homo sapiens
tgctgccagccaggccatggag

SEQ ID NO: 9434443 - DNA, 22 bp, Homo sapiens
tgctgccagccaggccatggag

SEQ ID NO: 9434444 - DNA, 22 bp, Homo sapiens
tgctgccagagagacagggact

SEQ ID NO: 9434445 - DNA, 22 bp, Homo sapiens
tgctgccagagagacagggact

SEQ ID NO: 9434446 - DNA, 22 bp, Homo sapiens
tgctgccacctggtggctgaag

SEQ ID NO: 9434447 - DNA, 22 bp, Homo sapiens
tgctgccacctggtggctgaag

SEQ ID NO: 9434448 - DNA, 22 bp, Homo sapiens
tgctgctcctgcctggctccca

SEQ ID NO: 9434449 - DNA, 22 bp, Homo sapiens
tgctgcctctgctgatatggcc

SEQ ID NO: 9434450 - DNA, 22 bp, Homo sapiens
tgctgctcttcaccatggcctc

SEQ ID NO: 9434451 - DNA, 22 bp, Homo sapiens
tgctgctctggccaggaactgc

SEQ ID NO: 9434452 - DNA, 22 bp, Homo sapiens
tgctgctcgccacggcccaggg

SEQ ID NO: 9434453 - DNA, 22 bp, Homo sapiens
tgctgctgatgcatagtctgct

SEQ ID NO: 9434454 - DNA, 21 bp, Homo sapiens
tgctgctgatcggggttggct

SEQ ID NO: 9434455 - DNA, 22 bp, Homo sapiens
tgctgctgatgcatagtctgct

SEQ ID NO: 9434456 - DNA, 22 bp, Homo sapiens
tgctgctgaggctaaagtatag

SEQ ID NO: 9434457 - DNA, 22 bp, Homo sapiens
tgctgcccgtacctgtgcactt

SEQ ID NO: 9434458 - DNA, 22 bp, Homo sapiens
tgctgcccgtacctgtgcactt

SEQ ID NO: 9434459 - DNA, 23 bp, Homo sapiens
tgctgcccactcttccagccctc

SEQ ID NO: 9434460 - DNA, 22 bp, Homo sapiens
tgctgccatctcaactgccctt

SEQ ID NO: 9434461 - DNA, 22 bp, Homo sapiens
tgctgcctcaactgtcaggaac

SEQ ID NO: 9434462 - DNA, 22 bp, Homo sapiens
tgctgcctcaactgtcaggaac

SEQ ID NO: 9434463 - DNA, 20 bp, Homo sapiens
tgctgcctactaagccctca

SEQ ID NO: 9434464 - DNA, 22 bp, Homo sapiens
tgctgcctccaactcctgggct

SEQ ID NO: 9434465 - DNA, 22 bp, Homo sapiens
tgctgcctccttcctgccagga

SEQ ID NO: 9434466 - DNA, 22 bp, Homo sapiens
tgctgcctcagcttcctgggct

SEQ ID NO: 9434467 - DNA, 19 bp, Homo sapiens
tgctgggtcatatggaaac

SEQ ID NO: 9434468 - DNA, 22 bp, Homo sapiens
tgctggggtctctccggtgccc

SEQ ID NO: 9434469 - DNA, 22 bp, Homo sapiens
tgctggggtctctccggtgccc

SEQ ID NO: 9434470 - DNA, 23 bp, Homo sapiens
tgctgggtaaatagctgagtaac

SEQ ID NO: 9434471 - DNA, 22 bp, Homo sapiens
tgctggggtcatggggcgcccg

SEQ ID NO: 9434472 - DNA, 23 bp, Homo sapiens
tgctggggtagtttgtggcacag

SEQ ID NO: 9434473 - DNA, 23 bp, Homo sapiens
tgctggggtagtttgtggcacag

SEQ ID NO: 9434474 - DNA, 23 bp, Homo sapiens
tgctggggtagtttgtggcacag

SEQ ID NO: 9434475 - DNA, 22 bp, Homo sapiens
tgctgggcttgaaagctgctaa

SEQ ID NO: 9434476 - DNA, 22 bp, Homo sapiens
tgctgggcttgaaagctgctaa

SEQ ID NO: 9434477 - DNA, 20 bp, Homo sapiens
tgctggggacatacagggtg

SEQ ID NO: 9434478 - DNA, 22 bp, Homo sapiens
tgctggggcagaagagccaaga

SEQ ID NO: 9434479 - DNA, 22 bp, Homo sapiens
tgctgtcaaggttacatgcttt

SEQ ID NO: 9434480 - DNA, 22 bp, Homo sapiens
tgctgtcaagaaaacaagcaat

SEQ ID NO: 9434481 - DNA, 22 bp, Homo sapiens
tgctgtcaagaaaacaagcaat

SEQ ID NO: 9434482 - DNA, 22 bp, Homo sapiens
tgctgtattacttttacaaact

SEQ ID NO: 9434483 - DNA, 22 bp, Homo sapiens
tgctgtatatattttgaagtga

SEQ ID NO: 9434484 - DNA, 22 bp, Homo sapiens
tgctgtatatattttgaagtga

SEQ ID NO: 9434485 - DNA, 23 bp, Homo sapiens
tgctgtccaacagactggccatg

SEQ ID NO: 9434486 - DNA, 22 bp, Homo sapiens
tgctgtagggagaaagagttga

SEQ ID NO: 9434487 - DNA, 22 bp, Homo sapiens
tgctggttcttaagatgcctcc

SEQ ID NO: 9434488 - DNA, 23 bp, Homo sapiens
tgctggtgtttttgggaccaggg

SEQ ID NO: 9434489 - DNA, 22 bp, Homo sapiens
tgctggtggagaaagtggaggt

SEQ ID NO: 9434490 - DNA, 22 bp, Homo sapiens
tgctggtgaggtccttgctgga

SEQ ID NO: 9434491 - DNA, 22 bp, Homo sapiens
tgctggtgaggtccttgctgga

SEQ ID NO: 9434492 - DNA, 22 bp, Homo sapiens
tgctggtgattaaatcctgaag

SEQ ID NO: 9434493 - DNA, 22 bp, Homo sapiens
tgctggtggagaaagtggaggt

SEQ ID NO: 9434494 - DNA, 21 bp, Homo sapiens
tgctggtgagctcatgtggct

SEQ ID NO: 9434495 - DNA, 22 bp, Homo sapiens
tgctggtcccctgcagcctgtg

SEQ ID NO: 9434496 - DNA, 22 bp, Homo sapiens
tgctggtcctggagctgggttc

SEQ ID NO: 9434497 - DNA, 22 bp, Homo sapiens
tgctgggtcccttgagagctca

SEQ ID NO: 9434498 - DNA, 22 bp, Homo sapiens
tgctgggtggttgctcctcccg

SEQ ID NO: 9434499 - DNA, 22 bp, Homo sapiens
tgctggtaccgcgcctccgcca

SEQ ID NO: 9434500 - DNA, 22 bp, Homo sapiens
tgctggtcccctgcagcctgtg

SEQ ID NO: 9434501 - DNA, 20 bp, Homo sapiens
tgctgggccatcttgcatgc

SEQ ID NO: 9434502 - DNA, 22 bp, Homo sapiens
tgctgggcccagggagcctctg

SEQ ID NO: 9434503 - DNA, 20 bp, Homo sapiens
tgctgggccatcttgcatgc

SEQ ID NO: 9434504 - DNA, 22 bp, Homo sapiens
tgctgggcccccagtgaccttc

SEQ ID NO: 9434505 - DNA, 22 bp, Homo sapiens
tgctgggcccagggagcctctg

SEQ ID NO: 9434506 - DNA, 22 bp, Homo sapiens
tgctgggcctcttccctggata

SEQ ID NO: 9434507 - DNA, 22 bp, Homo sapiens
tgctgggccaaagcagggtttt

SEQ ID NO: 9434508 - DNA, 22 bp, Homo sapiens
tgctgggccaaagcagggtttt

SEQ ID NO: 9434509 - DNA, 22 bp, Homo sapiens
tgctgggcatttttatggctcc

SEQ ID NO: 9434510 - DNA, 22 bp, Homo sapiens
tgctgggcatttttatggctcc

SEQ ID NO: 9434511 - DNA, 20 bp, Homo sapiens
tgctgggcatgcagtggaaa

SEQ ID NO: 9434512 - DNA, 20 bp, Homo sapiens
tgctgggcatgcagtggaaa

SEQ ID NO: 9434513 - DNA, 18 bp, Homo sapiens
tgctgggcattaggctta

SEQ ID NO: 9434514 - DNA, 18 bp, Homo sapiens
tgctgggcattaggctta

SEQ ID NO: 9434515 - DNA, 18 bp, Homo sapiens
tgctgggcattaggctta

SEQ ID NO: 9434516 - DNA, 22 bp, Homo sapiens
tgctgggcatttatgcagatgg

SEQ ID NO: 9434517 - DNA, 22 bp, Homo sapiens
tgctggcttggaaggaaagcgc

SEQ ID NO: 9434518 - DNA, 22 bp, Homo sapiens
tgctgggcactgtctaggtact

SEQ ID NO: 9434519 - DNA, 22 bp, Homo sapiens
tgctggcttcctgtgcacagca

SEQ ID NO: 9434520 - DNA, 22 bp, Homo sapiens
tgctggcttcctgtgcacagca

SEQ ID NO: 9434521 - DNA, 22 bp, Homo sapiens
tgctggcttcctgtgcacagca

SEQ ID NO: 9434522 - DNA, 22 bp, Homo sapiens
tgctgggcactgtctctgggga

SEQ ID NO: 9434523 - DNA, 22 bp, Homo sapiens
tgctgggcactgtctctgggga

SEQ ID NO: 9434524 - DNA, 22 bp, Homo sapiens
tgctgggcatcgtaggaggtac

SEQ ID NO: 9434525 - DNA, 22 bp, Homo sapiens
tgctgggcatcgtaggaggtac

SEQ ID NO: 9434526 - DNA, 20 bp, Homo sapiens
tgctgggcatgcagtggaaa

SEQ ID NO: 9434527 - DNA, 20 bp, Homo sapiens
tgctgggcatgcagtggaaa

SEQ ID NO: 9434528 - DNA, 22 bp, Homo sapiens
tgctgggcagtgtgccctcgag

SEQ ID NO: 9434529 - DNA, 23 bp, Homo sapiens
tgctgggcagagctggtgctgag

SEQ ID NO: 9434530 - DNA, 23 bp, Homo sapiens
tgctgggcagagctggtgctgag

SEQ ID NO: 9434531 - DNA, 23 bp, Homo sapiens
tgctgggcagagctggtgctgag

SEQ ID NO: 9434532 - DNA, 21 bp, Homo sapiens
tgctgggctgcaggggatgca

SEQ ID NO: 9434533 - DNA, 21 bp, Homo sapiens
tgctgggctgcaggggatgca

SEQ ID NO: 9434534 - DNA, 21 bp, Homo sapiens
tgctgggctgcaggggatgca

SEQ ID NO: 9434535 - DNA, 21 bp, Homo sapiens
tgctgggctgcaggggatgca

SEQ ID NO: 9434536 - DNA, 22 bp, Homo sapiens
tgctgggctgcacccccagagt

SEQ ID NO: 9434537 - DNA, 22 bp, Homo sapiens
tgctgggctggagctgccaggg

SEQ ID NO: 9434538 - DNA, 22 bp, Homo sapiens
tgctgggctggagctgccaggg

SEQ ID NO: 9434539 - DNA, 22 bp, Homo sapiens
tgctgggctggagctgccaggg

SEQ ID NO: 9434540 - DNA, 22 bp, Homo sapiens
tgctgggctgttcctgtccatg

SEQ ID NO: 9434541 - DNA, 22 bp, Homo sapiens
tgctgggcttcaactgcctgag

SEQ ID NO: 9434542 - DNA, 22 bp, Homo sapiens
tgctgggcttgaaagctgctaa

SEQ ID NO: 9434543 - DNA, 22 bp, Homo sapiens
tgctgggcttgaaagctgctaa

SEQ ID NO: 9434544 - DNA, 22 bp, Homo sapiens
tgctgggctagggtggagctct

SEQ ID NO: 9434545 - DNA, 22 bp, Homo sapiens
tgctgggctagaagctgaggcc

SEQ ID NO: 9434546 - DNA, 22 bp, Homo sapiens
tgctgggctagaagctgaggcc

SEQ ID NO: 9434547 - DNA, 22 bp, Homo sapiens
tgctgggctagaagctgaggcc

SEQ ID NO: 9434548 - DNA, 22 bp, Homo sapiens
tgctgggctagaagctgaggcc

SEQ ID NO: 9434549 - DNA, 22 bp, Homo sapiens
tgctgggctagaagctgaggcc

SEQ ID NO: 9434550 - DNA, 22 bp, Homo sapiens
tgctgggctagggtggagctct

SEQ ID NO: 9434551 - DNA, 22 bp, Homo sapiens
tgctgggctagggtggagctct

SEQ ID NO: 9434552 - DNA, 22 bp, Homo sapiens
tgctgggctagggtggagctct

SEQ ID NO: 9434553 - DNA, 22 bp, Homo sapiens
tgctgggctagggtggagctct

SEQ ID NO: 9434554 - DNA, 22 bp, Homo sapiens
tgctgggctagaagctgaggcc

SEQ ID NO: 9434555 - DNA, 22 bp, Homo sapiens
tgctgggcggtgggctcatccc

SEQ ID NO: 9434556 - DNA, 22 bp, Homo sapiens
tgctgggcctgcccctgtcagc

SEQ ID NO: 9434557 - DNA, 22 bp, Homo sapiens
tgctgggcctttacctccaggg

SEQ ID NO: 9434558 - DNA, 22 bp, Homo sapiens
tgcttctgagttgcaggacttg

SEQ ID NO: 9434559 - DNA, 22 bp, Homo sapiens
tgcttctgagttgcaggacttg

SEQ ID NO: 9434560 - DNA, 22 bp, Homo sapiens
tgcttctgatgtgagcagcccc

SEQ ID NO: 9434561 - DNA, 22 bp, Homo sapiens
tgcttctgatgtgagcagcccc

SEQ ID NO: 9434562 - DNA, 22 bp, Homo sapiens
tgcttctgatgtgagcagcccc

SEQ ID NO: 9434563 - DNA, 22 bp, Homo sapiens
tgcttctgcaggagctcctgat

SEQ ID NO: 9434564 - DNA, 22 bp, Homo sapiens
tgcttctgcaggagctcctgat

SEQ ID NO: 9434565 - DNA, 22 bp, Homo sapiens
tgcttctgcaggagctcctgat

SEQ ID NO: 9434566 - DNA, 22 bp, Homo sapiens
tgcttctgcaggagctcctgat

SEQ ID NO: 9434567 - DNA, 22 bp, Homo sapiens
tgcttctgctcagcttcctact

SEQ ID NO: 9434568 - DNA, 22 bp, Homo sapiens
tgcttctgctcagcttcctact

SEQ ID NO: 9434569 - DNA, 22 bp, Homo sapiens
tgcttctgactaagctgcatga

SEQ ID NO: 9434570 - DNA, 22 bp, Homo sapiens
tgcttctgacatgttcttggtt

SEQ ID NO: 9434571 - DNA, 22 bp, Homo sapiens
tgcttctgactaagctgcatga

SEQ ID NO: 9434572 - DNA, 22 bp, Homo sapiens
tgcttctgaagtggatgggtgc

SEQ ID NO: 9434573 - DNA, 22 bp, Homo sapiens
tgcttctgaaatgcaggtcttc

SEQ ID NO: 9434574 - DNA, 22 bp, Homo sapiens
tgcttctgaactcagcatgtgg

SEQ ID NO: 9434575 - DNA, 22 bp, Homo sapiens
tgcttctgaactcagcatgtgg

SEQ ID NO: 9434576 - DNA, 22 bp, Homo sapiens
tgcttctctgttctaacccttg

SEQ ID NO: 9434577 - DNA, 22 bp, Homo sapiens
tgcttctctttatttgtaggtt

SEQ ID NO: 9434578 - DNA, 23 bp, Homo sapiens
tgcttctctgcttgacagttctg

SEQ ID NO: 9434579 - DNA, 22 bp, Homo sapiens
tgcttctgaaatgcaggtcttc

SEQ ID NO: 9434580 - DNA, 21 bp, Homo sapiens
tgcttctctagatcaactact

SEQ ID NO: 9434581 - DNA, 22 bp, Homo sapiens
tgcttccttgatcattcccaaa

SEQ ID NO: 9434582 - DNA, 22 bp, Homo sapiens
tgcttccctgaaggcacaggag

SEQ ID NO: 9434583 - DNA, 22 bp, Homo sapiens
tgcttctccattgatgctaagt

SEQ ID NO: 9434584 - DNA, 22 bp, Homo sapiens
tgcttctcaaagaagcataatg

SEQ ID NO: 9434585 - DNA, 22 bp, Homo sapiens
tgcttctcaaaaggaggtaggt

SEQ ID NO: 9434586 - DNA, 22 bp, Homo sapiens
tgcttctagacactgcaattga

SEQ ID NO: 9434587 - DNA, 22 bp, Homo sapiens
tgcttccaggaatccatctggc

SEQ ID NO: 9434588 - DNA, 22 bp, Homo sapiens
tgcttccactaatgagctgtgt

SEQ ID NO: 9434589 - DNA, 19 bp, Homo sapiens
tgcttcatttcttttatgt

SEQ ID NO: 9434590 - DNA, 22 bp, Homo sapiens
tgcttcatttccttatattgta

SEQ ID NO: 9434591 - DNA, 22 bp, Homo sapiens
tgcttcatttccttatattgta

SEQ ID NO: 9434592 - DNA, 22 bp, Homo sapiens
tgcttcattaaaacaatatttt

SEQ ID NO: 9434593 - DNA, 22 bp, Homo sapiens
tgcttcattaaaacaatatttt

SEQ ID NO: 9434594 - DNA, 20 bp, Homo sapiens
tgcttcattatgtgagatag

SEQ ID NO: 9434595 - DNA, 22 bp, Homo sapiens
tgcttcattaaaacaatatttt

SEQ ID NO: 9434596 - DNA, 22 bp, Homo sapiens
tgcttcatgcttctgacaatag

SEQ ID NO: 9434597 - DNA, 22 bp, Homo sapiens
tgcttcagtgtgtcattattta

SEQ ID NO: 9434598 - DNA, 22 bp, Homo sapiens
tgcttcatgaggtagtggcagt

SEQ ID NO: 9434599 - DNA, 22 bp, Homo sapiens
tgcttcatgcttctgacaatag

SEQ ID NO: 9434600 - DNA, 22 bp, Homo sapiens
tgcttcatgaggctgagagaag

SEQ ID NO: 9434601 - DNA, 17 bp, Homo sapiens
tgcttcatcccgatcct

SEQ ID NO: 9434602 - DNA, 22 bp, Homo sapiens
tgcttcatgaggctgagagaag

SEQ ID NO: 9434603 - DNA, 22 bp, Homo sapiens
tgcttcagcagggatcgggggg

SEQ ID NO: 9434604 - DNA, 22 bp, Homo sapiens
tgcttcagcactttgagagcct

SEQ ID NO: 9434605 - DNA, 22 bp, Homo sapiens
tgcttatttgaatttattctca

SEQ ID NO: 9434606 - DNA, 22 bp, Homo sapiens
tgcttcaaaaggcagcttaatg

SEQ ID NO: 9434607 - DNA, 22 bp, Homo sapiens
tgcttcaaggacactgactttt

SEQ ID NO: 9434608 - DNA, 22 bp, Homo sapiens
tgcttatttaggtagatattaa

SEQ ID NO: 9434609 - DNA, 22 bp, Homo sapiens
tgcttatttatagtcaatagag

SEQ ID NO: 9434610 - DNA, 22 bp, Homo sapiens
tgcttatttaggtagatattaa

SEQ ID NO: 9434611 - DNA, 22 bp, Homo sapiens
tgcttattaaacatgcatattc

SEQ ID NO: 9434612 - DNA, 22 bp, Homo sapiens
tgcttattaaacatgcatattc

SEQ ID NO: 9434613 - DNA, 22 bp, Homo sapiens
tgcttattgctttcaagactgt

SEQ ID NO: 9434614 - DNA, 22 bp, Homo sapiens
tgcttattgctttcaagactgt

SEQ ID NO: 9434615 - DNA, 22 bp, Homo sapiens
tgcttattctttccacaattca

SEQ ID NO: 9434616 - DNA, 22 bp, Homo sapiens
tgcttcaagttgaaatattctt

SEQ ID NO: 9434617 - DNA, 22 bp, Homo sapiens
tgcttcaaggccatgtcaagct

SEQ ID NO: 9434618 - DNA, 22 bp, Homo sapiens
tgcttcacaagaattcaggacc

SEQ ID NO: 9434619 - DNA, 19 bp, Homo sapiens
tgcttcagaaatagaaagc

SEQ ID NO: 9434620 - DNA, 22 bp, Homo sapiens
tgcttcagcactttgagagcct

SEQ ID NO: 9434621 - DNA, 22 bp, Homo sapiens
tgcttcagagaagaatggaaag

SEQ ID NO: 9434622 - DNA, 22 bp, Homo sapiens
tgcttcagagacatcctactca

SEQ ID NO: 9434623 - DNA, 22 bp, Homo sapiens
tgcttaaagtgttaaccctgtt

SEQ ID NO: 9434624 - DNA, 22 bp, Homo sapiens
tgcttaaatttcagcagcttaa

SEQ ID NO: 9434625 - DNA, 22 bp, Homo sapiens
tgcttaaatagctggaggctac

SEQ ID NO: 9434626 - DNA, 22 bp, Homo sapiens
tgcttaataggagttgaacatt

SEQ ID NO: 9434627 - DNA, 22 bp, Homo sapiens
tgcttaatgtacgtgagtgtac

SEQ ID NO: 9434628 - DNA, 19 bp, Homo sapiens
tgcttaattcctagtaggt

SEQ ID NO: 9434629 - DNA, 22 bp, Homo sapiens
tgcttacaactttattgaggaa

SEQ ID NO: 9434630 - DNA, 22 bp, Homo sapiens
tgcttacaactttattgaggaa

SEQ ID NO: 9434631 - DNA, 22 bp, Homo sapiens
tgcttaatcaagaagcctattt

SEQ ID NO: 9434632 - DNA, 22 bp, Homo sapiens
tgcttaatattgtgatgtaata

SEQ ID NO: 9434633 - DNA, 22 bp, Homo sapiens
tgcttattaaacatgcatattc

SEQ ID NO: 9434634 - DNA, 22 bp, Homo sapiens
tgcttataaagatattagtttc

SEQ ID NO: 9434635 - DNA, 22 bp, Homo sapiens
tgcttaggtgttatgtaatatc

SEQ ID NO: 9434636 - DNA, 22 bp, Homo sapiens
tgcttaggttggtctagaccat

SEQ ID NO: 9434637 - DNA, 17 bp, Homo sapiens
tgcttataaactctgct

SEQ ID NO: 9434638 - DNA, 22 bp, Homo sapiens
tgcttagggctcctccaataga

SEQ ID NO: 9434639 - DNA, 22 bp, Homo sapiens
tgcttaggctaacaaaaatagc

SEQ ID NO: 9434640 - DNA, 22 bp, Homo sapiens
tgcttaaacacatacatacata

SEQ ID NO: 9434641 - DNA, 22 bp, Homo sapiens
tgcttaaacacatacatacata

SEQ ID NO: 9434642 - DNA, 22 bp, Homo sapiens
tgcttaaaattttccaaggatt

SEQ ID NO: 9434643 - DNA, 22 bp, Homo sapiens
tgcttaaacacatacatacata

SEQ ID NO: 9434644 - DNA, 22 bp, Homo sapiens
tgcttaaacatccagacagtat

SEQ ID NO: 9434645 - DNA, 22 bp, Homo sapiens
tgcttaaacatactatttatat

SEQ ID NO: 9434646 - DNA, 22 bp, Homo sapiens
tgcttaaaggatagtttaaact

SEQ ID NO: 9434647 - DNA, 22 bp, Homo sapiens
tgcttaaagtagtggattgtta

SEQ ID NO: 9434648 - DNA, 22 bp, Homo sapiens
tgcttaaaccctgatcatgtgt

SEQ ID NO: 9434649 - DNA, 22 bp, Homo sapiens
tgcttaaagctgctcagttgta

SEQ ID NO: 9434650 - DNA, 22 bp, Homo sapiens
tgcttaaaccctgatcatgtgt

SEQ ID NO: 9434651 - DNA, 22 bp, Homo sapiens
tgctgtgcatcatagtgtttgg

SEQ ID NO: 9434652 - DNA, 22 bp, Homo sapiens
tgctgtgaggttgagaaggaag

SEQ ID NO: 9434653 - DNA, 22 bp, Homo sapiens
tgctgtgatggagaattctgga

SEQ ID NO: 9434654 - DNA, 22 bp, Homo sapiens
tgctgtgcaaaggtgatgtgag

SEQ ID NO: 9434655 - DNA, 22 bp, Homo sapiens
tgctgtgaggttgagaaggaag

SEQ ID NO: 9434656 - DNA, 22 bp, Homo sapiens
tgctgtgacgcctcaggaatcc

SEQ ID NO: 9434657 - DNA, 22 bp, Homo sapiens
tgctgtgaggttgagaaggaag

SEQ ID NO: 9434658 - DNA, 22 bp, Homo sapiens
tgctgtgaggttgagaaggaag

SEQ ID NO: 9434659 - DNA, 22 bp, Homo sapiens
tgctgtgcatcatagtgtttgg

SEQ ID NO: 9434660 - DNA, 22 bp, Homo sapiens
tgcttaaaaagtaactgctgat

SEQ ID NO: 9434661 - DNA, 22 bp, Homo sapiens
tgcttaaaaagctccatcaata

SEQ ID NO: 9434662 - DNA, 22 bp, Homo sapiens
tgcttaaaaagctccatcaata

SEQ ID NO: 9434663 - DNA, 22 bp, Homo sapiens
tgcttaaaaagctccatcaata

SEQ ID NO: 9434664 - DNA, 22 bp, Homo sapiens
tgcttaaaaacagtatggtagt

SEQ ID NO: 9434665 - DNA, 22 bp, Homo sapiens
tgcttaaaaagtaactgctgat

SEQ ID NO: 9434666 - DNA, 17 bp, Homo sapiens
tgctgtctgcttcccta

SEQ ID NO: 9434667 - DNA, 17 bp, Homo sapiens
tgctgtctgcttcccta

SEQ ID NO: 9434668 - DNA, 22 bp, Homo sapiens
tgctgtcttctctgaggtccct

SEQ ID NO: 9434669 - DNA, 22 bp, Homo sapiens
tgctgtctttttcccttcctaa

SEQ ID NO: 9434670 - DNA, 22 bp, Homo sapiens
tgctgtcttttcccaatcctgg

SEQ ID NO: 9434671 - DNA, 22 bp, Homo sapiens
tgctgtcttttcccaatcctgg

SEQ ID NO: 9434672 - DNA, 22 bp, Homo sapiens
tgctgtcttttcccaatcctgg

SEQ ID NO: 9434673 - DNA, 22 bp, Homo sapiens
tgctgtcctgttttggagtaat

SEQ ID NO: 9434674 - DNA, 22 bp, Homo sapiens
tgctgtctgcaacagtactaca

SEQ ID NO: 9434675 - DNA, 21 bp, Homo sapiens
tgctgtcctagaaccagggcc

SEQ ID NO: 9434676 - DNA, 22 bp, Homo sapiens
tgcgtactgtttatacatgtgt

SEQ ID NO: 9434677 - DNA, 23 bp, Homo sapiens
tgcgtacggctgccagtgtgact

SEQ ID NO: 9434678 - DNA, 22 bp, Homo sapiens
tgcgggtcccagggtcacaggc

SEQ ID NO: 9434679 - DNA, 22 bp, Homo sapiens
tgcgtagtacgaatttgtgcct

SEQ ID NO: 9434680 - DNA, 22 bp, Homo sapiens
tgcgtctggagtggagtttgaa

SEQ ID NO: 9434681 - DNA, 22 bp, Homo sapiens
tgcgtggcgcagcgtgtgggat

SEQ ID NO: 9434682 - DNA, 22 bp, Homo sapiens
tgcgtggcgcagcgtgtgggat

SEQ ID NO: 9434683 - DNA, 22 bp, Homo sapiens
tgcgtggctggtccctgtgacc

SEQ ID NO: 9434684 - DNA, 21 bp, Homo sapiens
tgcgtgtgcatggccttcggg

SEQ ID NO: 9434685 - DNA, 22 bp, Homo sapiens
tgcgtggctgcgaggacccagc

SEQ ID NO: 9434686 - DNA, 22 bp, Homo sapiens
tgcgtggctggtccctgtgacc

SEQ ID NO: 9434687 - DNA, 20 bp, Homo sapiens
tgcgtgtgtatttattttct

SEQ ID NO: 9434688 - DNA, 23 bp, Homo sapiens
tgcgtgtgtgctgaggggcgtcc

SEQ ID NO: 9434689 - DNA, 23 bp, Homo sapiens
tgcgtgtgtgctgaggggcgtcc

SEQ ID NO: 9434690 - DNA, 22 bp, Homo sapiens
tgcgtgtgtgtatatacacagg

SEQ ID NO: 9434691 - DNA, 22 bp, Homo sapiens
tgctaaattcattattgattta

SEQ ID NO: 9434692 - DNA, 22 bp, Homo sapiens
tgcgcaggagctctgccaggag

SEQ ID NO: 9434693 - DNA, 22 bp, Homo sapiens
tgcgcaggacacttgcagtgac

SEQ ID NO: 9434694 - DNA, 22 bp, Homo sapiens
tgcgcatgcgtggctctccggc

SEQ ID NO: 9434695 - DNA, 22 bp, Homo sapiens
tgcgccatgtgctctcggccct

SEQ ID NO: 9434696 - DNA, 22 bp, Homo sapiens
tgcgcccagccaagtctggcac

SEQ ID NO: 9434697 - DNA, 22 bp, Homo sapiens
tgcgcccagccaagtctggcac

SEQ ID NO: 9434698 - DNA, 22 bp, Homo sapiens
tgcggggccctcccgtgcactg

SEQ ID NO: 9434699 - DNA, 22 bp, Homo sapiens
tgctataagtagacattcaaca

SEQ ID NO: 9434700 - DNA, 22 bp, Homo sapiens
tgctataagagtcacttttcct

SEQ ID NO: 9434701 - DNA, 22 bp, Homo sapiens
tgctagtgtgtgagatgttcaa

SEQ ID NO: 9434702 - DNA, 22 bp, Homo sapiens
tgctagtgtgtgagatgttcaa

SEQ ID NO: 9434703 - DNA, 22 bp, Homo sapiens
tgctataagaattatattactc

SEQ ID NO: 9434704 - DNA, 22 bp, Homo sapiens
tgctataagaattatattactc

SEQ ID NO: 9434705 - DNA, 22 bp, Homo sapiens
tgctataagtagacattcaaca

SEQ ID NO: 9434706 - DNA, 22 bp, Homo sapiens
tgctattacctgctggacagtc

SEQ ID NO: 9434707 - DNA, 22 bp, Homo sapiens
tgctattaatgaggctgcattt

SEQ ID NO: 9434708 - DNA, 22 bp, Homo sapiens
tgctatttaacttttatgtgta

SEQ ID NO: 9434709 - DNA, 21 bp, Homo sapiens
tgctatttaatttttctgttc

SEQ ID NO: 9434710 - DNA, 21 bp, Homo sapiens
tgctatttaatttttctgttc

SEQ ID NO: 9434711 - DNA, 19 bp, Homo sapiens
tgctatttagaacgcctgg

SEQ ID NO: 9434712 - DNA, 22 bp, Homo sapiens
tgctattagaagccatgctgtt

SEQ ID NO: 9434713 - DNA, 22 bp, Homo sapiens
tgctattattgtcaccactgta

SEQ ID NO: 9434714 - DNA, 22 bp, Homo sapiens
tgctatttggcacttttgacct

SEQ ID NO: 9434715 - DNA, 22 bp, Homo sapiens
tgctatttggaaaagcatttgg

SEQ ID NO: 9434716 - DNA, 22 bp, Homo sapiens
tgctatttgggggctacatgat

SEQ ID NO: 9434717 - DNA, 22 bp, Homo sapiens
tgctatttggaaaagcatttgg

SEQ ID NO: 9434718 - DNA, 22 bp, Homo sapiens
tgctatttctatctcatttaaa

SEQ ID NO: 9434719 - DNA, 19 bp, Homo sapiens
tgctatttagaacgcctgg

SEQ ID NO: 9434720 - DNA, 22 bp, Homo sapiens
tgctatttctatctcatttaaa

SEQ ID NO: 9434721 - DNA, 22 bp, Homo sapiens
tgctatttctctgctgtaaaat

SEQ ID NO: 9434722 - DNA, 22 bp, Homo sapiens
tgctatttttatcttgatcaaa

SEQ ID NO: 9434723 - DNA, 22 bp, Homo sapiens
tgctatttttatcttgatcaaa

SEQ ID NO: 9434724 - DNA, 22 bp, Homo sapiens
tgctattttagacatactttgt

SEQ ID NO: 9434725 - DNA, 22 bp, Homo sapiens
tgctattttagacatactttgt

SEQ ID NO: 9434726 - DNA, 22 bp, Homo sapiens
tgctattttggtctacagcact

SEQ ID NO: 9434727 - DNA, 22 bp, Homo sapiens
tgctatttgtgagtgtcttcgt

SEQ ID NO: 9434728 - DNA, 22 bp, Homo sapiens
tgctatttgtgagtgtcttcgt

SEQ ID NO: 9434729 - DNA, 22 bp, Homo sapiens
tgctatttgggggctacatgat

SEQ ID NO: 9434730 - DNA, 22 bp, Homo sapiens
tgctatttgggggctacatgat

SEQ ID NO: 9434731 - DNA, 19 bp, Homo sapiens
tgctcagtggctaaaagca

SEQ ID NO: 9434732 - DNA, 19 bp, Homo sapiens
tgctcagtggctaaaagca

SEQ ID NO: 9434733 - DNA, 22 bp, Homo sapiens
tgctcagtgagtctgtgacagg

SEQ ID NO: 9434734 - DNA, 22 bp, Homo sapiens
tgctcagttcaaggaaggtgga

SEQ ID NO: 9434735 - DNA, 22 bp, Homo sapiens
tgctcagttcaaggaaggtgga

SEQ ID NO: 9434736 - DNA, 22 bp, Homo sapiens
tgctcagttaagcagaggaaat

SEQ ID NO: 9434737 - DNA, 22 bp, Homo sapiens
tgctcattaggactgcaaattc

SEQ ID NO: 9434738 - DNA, 21 bp, Homo sapiens
tgctcatgcaatgcatgtcca

SEQ ID NO: 9434739 - DNA, 21 bp, Homo sapiens
tgctcatgcaatgcatgtcca

SEQ ID NO: 9434740 - DNA, 22 bp, Homo sapiens
tgctcatcaacatgatgatcat

SEQ ID NO: 9434741 - DNA, 22 bp, Homo sapiens
tgctcatcaacatgatgatcat

SEQ ID NO: 9434742 - DNA, 21 bp, Homo sapiens
tgctcagtctgtctccagctt

SEQ ID NO: 9434743 - DNA, 21 bp, Homo sapiens
tgctcagtctgtctccagctt

SEQ ID NO: 9434744 - DNA, 22 bp, Homo sapiens
tgctcagtcctcctgcagtgcc

SEQ ID NO: 9434745 - DNA, 22 bp, Homo sapiens
tgctcagtcctcctgcagtgcc

SEQ ID NO: 9434746 - DNA, 22 bp, Homo sapiens
tgctcagtcctcctgcagtgcc

SEQ ID NO: 9434747 - DNA, 22 bp, Homo sapiens
tgctcagtcctaccttggctcc

SEQ ID NO: 9434748 - DNA, 22 bp, Homo sapiens
tgctcagctggtgccagggtcc

SEQ ID NO: 9434749 - DNA, 22 bp, Homo sapiens
tgctcagtatagaaaatgatat

SEQ ID NO: 9434750 - DNA, 22 bp, Homo sapiens
tgctccacctcccagctaacat

SEQ ID NO: 9434751 - DNA, 22 bp, Homo sapiens
tgctcattggcgatctgaggga

SEQ ID NO: 9434752 - DNA, 22 bp, Homo sapiens
tgctccactgtgcgtggccata

SEQ ID NO: 9434753 - DNA, 22 bp, Homo sapiens
tgctccacctcccagctaacat

SEQ ID NO: 9434754 - DNA, 22 bp, Homo sapiens
tgctccacctcccagctaacat

SEQ ID NO: 9434755 - DNA, 22 bp, Homo sapiens
tgctcattggcgatctgaggga

SEQ ID NO: 9434756 - DNA, 22 bp, Homo sapiens
tgctcattggcgatctgaggga

SEQ ID NO: 9434757 - DNA, 22 bp, Homo sapiens
tgctccacttgggcacccccca

SEQ ID NO: 9434758 - DNA, 16 bp, Homo sapiens
tgctccagaggaccca

SEQ ID NO: 9434759 - DNA, 22 bp, Homo sapiens
tgctccagcaacaggcttagct

SEQ ID NO: 9434760 - DNA, 22 bp, Homo sapiens
tgctcacaggtgaccctgggca

SEQ ID NO: 9434761 - DNA, 22 bp, Homo sapiens
tgctcactctattcacagtgcc

SEQ ID NO: 9434762 - DNA, 22 bp, Homo sapiens
tgctcactgaactcttgctgtc

SEQ ID NO: 9434763 - DNA, 22 bp, Homo sapiens
tgctcagaactgtgaatacatg

SEQ ID NO: 9434764 - DNA, 22 bp, Homo sapiens
tgctcagaaagccaccagagcg

SEQ ID NO: 9434765 - DNA, 17 bp, Homo sapiens
tgctcaaatacttttga

SEQ ID NO: 9434766 - DNA, 22 bp, Homo sapiens
tgctcacaattatcagaagtat

SEQ ID NO: 9434767 - DNA, 18 bp, Homo sapiens
tgctcacactgacctctg

SEQ ID NO: 9434768 - DNA, 18 bp, Homo sapiens
tgctcacactgacctctg

SEQ ID NO: 9434769 - DNA, 22 bp, Homo sapiens
tgctcagagctccagctctcct

SEQ ID NO: 9434770 - DNA, 22 bp, Homo sapiens
tgctcagagggtgatgtcattt

SEQ ID NO: 9434771 - DNA, 22 bp, Homo sapiens
tgctcagacttaagaagatcag

SEQ ID NO: 9434772 - DNA, 22 bp, Homo sapiens
tgctcagactagctccagggaa

SEQ ID NO: 9434773 - DNA, 22 bp, Homo sapiens
tgctcagacaagctgaacagta

SEQ ID NO: 9434774 - DNA, 22 bp, Homo sapiens
tgcctgtcttcaggagtgtcac

SEQ ID NO: 9434775 - DNA, 22 bp, Homo sapiens
tgcctgtcttcaggagtgtcac

SEQ ID NO: 9434776 - DNA, 22 bp, Homo sapiens
tgcctgtcttaatatctggaaa

SEQ ID NO: 9434777 - DNA, 22 bp, Homo sapiens
tgcctgtctctgactgccatta

SEQ ID NO: 9434778 - DNA, 22 bp, Homo sapiens
tgcctgtctctgactgccatta

SEQ ID NO: 9434779 - DNA, 19 bp, Homo sapiens
tgcctgtcagtagatctca

SEQ ID NO: 9434780 - DNA, 22 bp, Homo sapiens
tgcctgtcagggggagtgggaa

SEQ ID NO: 9434781 - DNA, 19 bp, Homo sapiens
tgcctgtcagtagatctca

SEQ ID NO: 9434782 - DNA, 22 bp, Homo sapiens
tgcctgtcctgaggatgagggt

SEQ ID NO: 9434783 - DNA, 22 bp, Homo sapiens
tgcctgtctcctctgcagggtg

SEQ ID NO: 9434784 - DNA, 22 bp, Homo sapiens
tgcctgtgatcagctgagttca

SEQ ID NO: 9434785 - DNA, 22 bp, Homo sapiens
tgcctgtcttggagtcctggcc

SEQ ID NO: 9434786 - DNA, 22 bp, Homo sapiens
tgcctgtcttggagtcctggcc

SEQ ID NO: 9434787 - DNA, 22 bp, Homo sapiens
tgcctgtctttcctccctcgta

SEQ ID NO: 9434788 - DNA, 22 bp, Homo sapiens
tgcctgggtgccctctgctcct

SEQ ID NO: 9434789 - DNA, 22 bp, Homo sapiens
tgcctgggtgctggctggtcac

SEQ ID NO: 9434790 - DNA, 22 bp, Homo sapiens
tgcctgggtgctggctggtcac

SEQ ID NO: 9434791 - DNA, 22 bp, Homo sapiens
tgcctgggtgtaaagggccaac

SEQ ID NO: 9434792 - DNA, 22 bp, Homo sapiens
tgcctgggtgtaaagggccaac

SEQ ID NO: 9434793 - DNA, 22 bp, Homo sapiens
tgcctgggtgtaaagggccaac

SEQ ID NO: 9434794 - DNA, 22 bp, Homo sapiens
tgcctgtaataatgctaagcac

SEQ ID NO: 9434795 - DNA, 22 bp, Homo sapiens
tgcctgggttgactcttagctg

SEQ ID NO: 9434796 - DNA, 22 bp, Homo sapiens
tgcctgggttgactcttagctg

SEQ ID NO: 9434797 - DNA, 20 bp, Homo sapiens
tgcctggcctttctctgccc

SEQ ID NO: 9434798 - DNA, 20 bp, Homo sapiens
tgcctggcctttctctgccc

SEQ ID NO: 9434799 - DNA, 21 bp, Homo sapiens
tgcctggcctttgcttttcct

SEQ ID NO: 9434800 - DNA, 22 bp, Homo sapiens
tgcctggccctgacagccctgg

SEQ ID NO: 9434801 - DNA, 22 bp, Homo sapiens
tgcctggccctgacagccctgg

SEQ ID NO: 9434802 - DNA, 22 bp, Homo sapiens
tgcctggccctgacagccctgg

SEQ ID NO: 9434803 - DNA, 20 bp, Homo sapiens
tgcctggcctttctctgccc

SEQ ID NO: 9434804 - DNA, 22 bp, Homo sapiens
tgcctggccctgacagccctgg

SEQ ID NO: 9434805 - DNA, 22 bp, Homo sapiens
tgcctggccctgacagccctgg

SEQ ID NO: 9434806 - DNA, 22 bp, Homo sapiens
tgcctggcatgttatagacaca

SEQ ID NO: 9434807 - DNA, 22 bp, Homo sapiens
tgcctggccagaccctatagag

SEQ ID NO: 9434808 - DNA, 22 bp, Homo sapiens
tgcctggctaatttttgtatcc

SEQ ID NO: 9434809 - DNA, 21 bp, Homo sapiens
tgcctggcctttgcttttcct

SEQ ID NO: 9434810 - DNA, 21 bp, Homo sapiens
tgcctggcctttgcttttcct

SEQ ID NO: 9434811 - DNA, 22 bp, Homo sapiens
tgcctggctctatcagtggtgg

SEQ ID NO: 9434812 - DNA, 22 bp, Homo sapiens
tgcctggctctatcagtggtgg

SEQ ID NO: 9434813 - DNA, 22 bp, Homo sapiens
tgcctggctctatcagtggtgg

SEQ ID NO: 9434814 - DNA, 22 bp, Homo sapiens
tgcctggctgaggtgacaggtt

SEQ ID NO: 9434815 - DNA, 22 bp, Homo sapiens
tgcctggctgaggtgacaggtt

SEQ ID NO: 9434816 - DNA, 22 bp, Homo sapiens
tgcctggctgggctgctcatgg

SEQ ID NO: 9434817 - DNA, 22 bp, Homo sapiens
tgcctggctgaggtgacaggtt

SEQ ID NO: 9434818 - DNA, 22 bp, Homo sapiens
tgcctggctgaggtgacaggtt

SEQ ID NO: 9434819 - DNA, 22 bp, Homo sapiens
tgcctggctctatcagtggtgg

SEQ ID NO: 9434820 - DNA, 22 bp, Homo sapiens
tgcctggggattgctctgggcc

SEQ ID NO: 9434821 - DNA, 22 bp, Homo sapiens
tgcctgggctcggtagccatcg

SEQ ID NO: 9434822 - DNA, 22 bp, Homo sapiens
tgcctgggctcggtagccatcg

SEQ ID NO: 9434823 - DNA, 22 bp, Homo sapiens
tgcctgggaaccaatcctggct

SEQ ID NO: 9434824 - DNA, 22 bp, Homo sapiens
tgcctgggaaccaatcctggct

SEQ ID NO: 9434825 - DNA, 22 bp, Homo sapiens
tgcctggctgggctgctcatgg

SEQ ID NO: 9434826 - DNA, 22 bp, Homo sapiens
tgcctggctgggctgctcatgg

SEQ ID NO: 9434827 - DNA, 22 bp, Homo sapiens
tgcctggctgggctgctcatgg

SEQ ID NO: 9434828 - DNA, 22 bp, Homo sapiens
tgcctggctgggctgctcatgg

SEQ ID NO: 9434829 - DNA, 22 bp, Homo sapiens
tgcctgggggactaaggccaaa

SEQ ID NO: 9434830 - DNA, 22 bp, Homo sapiens
tgcctgggtccaggccaagcct

SEQ ID NO: 9434831 - DNA, 19 bp, Homo sapiens
tgcctgtggcgagcatctt

SEQ ID NO: 9434832 - DNA, 22 bp, Homo sapiens
tgcctgtgggtgatgatttgat

SEQ ID NO: 9434833 - DNA, 22 bp, Homo sapiens
tgcctgtgggtgatgatttgat

SEQ ID NO: 9434834 - DNA, 22 bp, Homo sapiens
tgcctgtgtatgtgcatgcaca

SEQ ID NO: 9434835 - DNA, 22 bp, Homo sapiens
tgcctgtgccctttgctgggag

SEQ ID NO: 9434836 - DNA, 22 bp, Homo sapiens
tgcctgtgccctttgctgggag

SEQ ID NO: 9434837 - DNA, 22 bp, Homo sapiens
tgcctgtgcccttcttggcatt

SEQ ID NO: 9434838 - DNA, 22 bp, Homo sapiens
tgcctgtgcccttcttggcatt

SEQ ID NO: 9434839 - DNA, 22 bp, Homo sapiens
tgcctgtggaaaggctggtgct

SEQ ID NO: 9434840 - DNA, 22 bp, Homo sapiens
tgcctgtgctgggattgcatgt

SEQ ID NO: 9434841 - DNA, 22 bp, Homo sapiens
tgcctgtgtcacagtgatgttt

SEQ ID NO: 9434842 - DNA, 22 bp, Homo sapiens
tgcctgtgtatttccggcctgc

SEQ ID NO: 9434843 - DNA, 22 bp, Homo sapiens
tgccttgctgctttggagtcct

SEQ ID NO: 9434844 - DNA, 22 bp, Homo sapiens
tgccttgcttcaatcaaaccgt

SEQ ID NO: 9434845 - DNA, 22 bp, Homo sapiens
tgccttggactctttattccag

SEQ ID NO: 9434846 - DNA, 22 bp, Homo sapiens
tgccttggactctttattccag

SEQ ID NO: 9434847 - DNA, 22 bp, Homo sapiens
tgccttcttgaatatggttctt

SEQ ID NO: 9434848 - DNA, 22 bp, Homo sapiens
tgccttgcaggttttaaataca

SEQ ID NO: 9434849 - DNA, 22 bp, Homo sapiens
tgccttggtggcagtctgcggt

SEQ ID NO: 9434850 - DNA, 22 bp, Homo sapiens
tgccttggtgcttcttcatgtg

SEQ ID NO: 9434851 - DNA, 22 bp, Homo sapiens
tgccttgggtcaacctttgagt

SEQ ID NO: 9434852 - DNA, 22 bp, Homo sapiens
tgccttgggagccagcatgcca

SEQ ID NO: 9434853 - DNA, 22 bp, Homo sapiens
tgccttggtttccccatctgta

SEQ ID NO: 9434854 - DNA, 22 bp, Homo sapiens
tgccttggtttccccatctgta

SEQ ID NO: 9434855 - DNA, 22 bp, Homo sapiens
tgccttgtccttcgtcagggct

SEQ ID NO: 9434856 - DNA, 22 bp, Homo sapiens
tgccttttgttagggctgccag

SEQ ID NO: 9434857 - DNA, 22 bp, Homo sapiens
tgccttttgaagcctcacaggt

SEQ ID NO: 9434858 - DNA, 22 bp, Homo sapiens
tgccttttgaagcctcacaggt

SEQ ID NO: 9434859 - DNA, 22 bp, Homo sapiens
tgccttttgtatgcaggccatg

SEQ ID NO: 9434860 - DNA, 22 bp, Homo sapiens
tgcgatggcgtagacaaatccc

SEQ ID NO: 9434861 - DNA, 22 bp, Homo sapiens
tgcgatgtatgcagtatttgtt

SEQ ID NO: 9434862 - DNA, 17 bp, Homo sapiens
tgcgatgtctgtgtttg

SEQ ID NO: 9434863 - DNA, 22 bp, Homo sapiens
tgccttttccagttcctagaag

SEQ ID NO: 9434864 - DNA, 22 bp, Homo sapiens
tgccttttctgtagctctggaa

SEQ ID NO: 9434865 - DNA, 22 bp, Homo sapiens
tgccttttccagtttctagggg

SEQ ID NO: 9434866 - DNA, 22 bp, Homo sapiens
tgccttttatggctagcctcag

SEQ ID NO: 9434867 - DNA, 22 bp, Homo sapiens
tgccttttatggctagcctcag

SEQ ID NO: 9434868 - DNA, 22 bp, Homo sapiens
tgccttttccagcttccagagg

SEQ ID NO: 9434869 - DNA, 22 bp, Homo sapiens
tgccttttccagcttccaggag

SEQ ID NO: 9434870 - DNA, 22 bp, Homo sapiens
tgccttttagtgctcaataaag

SEQ ID NO: 9434871 - DNA, 20 bp, Homo sapiens
tgccttttatacctttaaac

SEQ ID NO: 9434872 - DNA, 22 bp, Homo sapiens
tgccttttaccttgtaattctg

SEQ ID NO: 9434873 - DNA, 22 bp, Homo sapiens
tgccttttagtgctcaataaag

SEQ ID NO: 9434874 - DNA, 22 bp, Homo sapiens
tgctgaggtcaccttgctgcta

SEQ ID NO: 9434875 - DNA, 22 bp, Homo sapiens
tgctgaggtcacggcggccaga

SEQ ID NO: 9434876 - DNA, 22 bp, Homo sapiens
tgctgaggtcacggcggccaga

SEQ ID NO: 9434877 - DNA, 22 bp, Homo sapiens
tgctgaggtcatttccaagtga

SEQ ID NO: 9434878 - DNA, 22 bp, Homo sapiens
tgctgaggtcacggcggccaga

SEQ ID NO: 9434879 - DNA, 20 bp, Homo sapiens
tgctgaggttgacatgccca

SEQ ID NO: 9434880 - DNA, 20 bp, Homo sapiens
tgctgaggttgacatgccca

SEQ ID NO: 9434881 - DNA, 20 bp, Homo sapiens
tgctgaggcctgaggcctgg

SEQ ID NO: 9434882 - DNA, 22 bp, Homo sapiens
tgctgaggcccaggagcacttt

SEQ ID NO: 9434883 - DNA, 22 bp, Homo sapiens
tgctgaggcccaggagcacttt

SEQ ID NO: 9434884 - DNA, 20 bp, Homo sapiens
tgctgaggcctgaggcctgg

SEQ ID NO: 9434885 - DNA, 20 bp, Homo sapiens
tgctgaggcctgaggcctgg

SEQ ID NO: 9434886 - DNA, 20 bp, Homo sapiens
tgctgaggcctgaggcctgg

SEQ ID NO: 9434887 - DNA, 22 bp, Homo sapiens
tgctgaggcagatgtctgtgac

SEQ ID NO: 9434888 - DNA, 22 bp, Homo sapiens
tgctgaggcatttggacagagt

SEQ ID NO: 9434889 - DNA, 22 bp, Homo sapiens
tgctgaggcagtcctaacagga

SEQ ID NO: 9434890 - DNA, 21 bp, Homo sapiens
tgctgatgtcagagaagcaag

SEQ ID NO: 9434891 - DNA, 22 bp, Homo sapiens
tgctgattttgcctactgatcc

SEQ ID NO: 9434892 - DNA, 22 bp, Homo sapiens
tgctgagtatttgtttgaataa

SEQ ID NO: 9434893 - DNA, 22 bp, Homo sapiens
tgctgaggtttctgactatgga

SEQ ID NO: 9434894 - DNA, 22 bp, Homo sapiens
tgctgaggttgtggagtgcatt

SEQ ID NO: 9434895 - DNA, 20 bp, Homo sapiens
tgctgaggttgacatgccca

SEQ ID NO: 9434896 - DNA, 22 bp, Homo sapiens
tgctgaggttgtggagtgcatt

SEQ ID NO: 9434897 - DNA, 22 bp, Homo sapiens
tgctgcaaattctttaattctt

SEQ ID NO: 9434898 - DNA, 22 bp, Homo sapiens
tgctgcagggatttcagagaca

SEQ ID NO: 9434899 - DNA, 22 bp, Homo sapiens
tgctgcagggatttcagagaca

SEQ ID NO: 9434900 - DNA, 22 bp, Homo sapiens
tgctgcagggccttccctgcat

SEQ ID NO: 9434901 - DNA, 22 bp, Homo sapiens
tgctgcaggtgtgttcagtgag

SEQ ID NO: 9434902 - DNA, 22 bp, Homo sapiens
tgctgcagggccttccctgcat

SEQ ID NO: 9434903 - DNA, 22 bp, Homo sapiens
tgctgcagggccttccctgcat

SEQ ID NO: 9434904 - DNA, 22 bp, Homo sapiens
tgctgcagttcaccctgccgtc

SEQ ID NO: 9434905 - DNA, 22 bp, Homo sapiens
tgctgcagttcaccctgccgtc

SEQ ID NO: 9434906 - DNA, 22 bp, Homo sapiens
tgctgcagttcaccctgccgtc

SEQ ID NO: 9434907 - DNA, 22 bp, Homo sapiens
tgctgcagtgtttgctgaagtt

SEQ ID NO: 9434908 - DNA, 22 bp, Homo sapiens
tgctgcagtgtttgctgaagtt

SEQ ID NO: 9434909 - DNA, 22 bp, Homo sapiens
tgctgcagtgtttgctgaagtt

SEQ ID NO: 9434910 - DNA, 22 bp, Homo sapiens
tgctgcaggtgtgttcagtgag

SEQ ID NO: 9434911 - DNA, 22 bp, Homo sapiens
tgctgcagtcacacggctatct

SEQ ID NO: 9434912 - DNA, 19 bp, Homo sapiens
tgctgcagtcaggcgaggg

SEQ ID NO: 9434913 - DNA, 19 bp, Homo sapiens
tgctgcagtcaggcgaggg

SEQ ID NO: 9434914 - DNA, 22 bp, Homo sapiens
tgctctgtcaagaaaagatgcc

SEQ ID NO: 9434915 - DNA, 22 bp, Homo sapiens
tgctctgtaacaaattgacatg

SEQ ID NO: 9434916 - DNA, 22 bp, Homo sapiens
tgctctgtaggggaaagagagc

SEQ ID NO: 9434917 - DNA, 22 bp, Homo sapiens
tgctctgtccagtgcaccatca

SEQ ID NO: 9434918 - DNA, 22 bp, Homo sapiens
tgctcttcaccattacatcatg

SEQ ID NO: 9434919 - DNA, 22 bp, Homo sapiens
tgctcttcacagtttcagcatc

SEQ ID NO: 9434920 - DNA, 17 bp, Homo sapiens
tgctctgtggtctttta

SEQ ID NO: 9434921 - DNA, 18 bp, Homo sapiens
tgctctgtttaatgattt

SEQ ID NO: 9434922 - DNA, 20 bp, Homo sapiens
tgctctgggggtggagagac

SEQ ID NO: 9434923 - DNA, 20 bp, Homo sapiens
tgctctgggggtggagagac

SEQ ID NO: 9434924 - DNA, 20 bp, Homo sapiens
tgctctgggggtggagagac

SEQ ID NO: 9434925 - DNA, 20 bp, Homo sapiens
tgctctgggggtggagagac

SEQ ID NO: 9434926 - DNA, 20 bp, Homo sapiens
tgctctgggggtggagagac

SEQ ID NO: 9434927 - DNA, 22 bp, Homo sapiens
tgctctgggtcctgggcctcct

SEQ ID NO: 9434928 - DNA, 22 bp, Homo sapiens
tgctctgggtcctgggcctcct

SEQ ID NO: 9434929 - DNA, 20 bp, Homo sapiens
tgctctgggggtggagagac

SEQ ID NO: 9434930 - DNA, 20 bp, Homo sapiens
tgctctgggggtggagagac

SEQ ID NO: 9434931 - DNA, 22 bp, Homo sapiens
tgctctggtaactcacttccat

SEQ ID NO: 9434932 - DNA, 22 bp, Homo sapiens
tgctctggtcctccctcggcgc

SEQ ID NO: 9434933 - DNA, 18 bp, Homo sapiens
tgctctggtctcacttgg

SEQ ID NO: 9434934 - DNA, 21 bp, Homo sapiens
tgctctggtgttttatttaac

SEQ ID NO: 9434935 - DNA, 22 bp, Homo sapiens
tgctgaggactaaaggagatga

SEQ ID NO: 9434936 - DNA, 22 bp, Homo sapiens
tgctgaggaggtggctgtgctt

SEQ ID NO: 9434937 - DNA, 22 bp, Homo sapiens
tgctgaggaggtggctgtgctt

SEQ ID NO: 9434938 - DNA, 22 bp, Homo sapiens
tgctgaggactaaaggagatga

SEQ ID NO: 9434939 - DNA, 22 bp, Homo sapiens
tgctgagcgcatccggcggccg

SEQ ID NO: 9434940 - DNA, 22 bp, Homo sapiens
tgctgagcgcatccggcggccg

SEQ ID NO: 9434941 - DNA, 22 bp, Homo sapiens
tgctgagatgaatagggctgtc

SEQ ID NO: 9434942 - DNA, 22 bp, Homo sapiens
tgctgaagggaaggtcttgaat

SEQ ID NO: 9434943 - DNA, 22 bp, Homo sapiens
tgctgaaggcaggggaggtggc

SEQ ID NO: 9434944 - DNA, 22 bp, Homo sapiens
tgctgaaaatgcgtatcttcca

SEQ ID NO: 9434945 - DNA, 22 bp, Homo sapiens
tgctctagctcataggactcat

SEQ ID NO: 9434946 - DNA, 22 bp, Homo sapiens
tgctctagtgggtagagcattg

SEQ ID NO: 9434947 - DNA, 22 bp, Homo sapiens
tgctctagtgggtagagcattg

SEQ ID NO: 9434948 - DNA, 22 bp, Homo sapiens
tgctctatctaaaagtcctgga

SEQ ID NO: 9434949 - DNA, 22 bp, Homo sapiens
tgctctcagagtcaggaggtaa

SEQ ID NO: 9434950 - DNA, 22 bp, Homo sapiens
tgctctattaattttaacgatg

SEQ ID NO: 9434951 - DNA, 22 bp, Homo sapiens
tgctcgaggtccccaccggctc

SEQ ID NO: 9434952 - DNA, 22 bp, Homo sapiens
tgctcgccccacatgccctcat

SEQ ID NO: 9434953 - DNA, 22 bp, Homo sapiens
tgctcgccccacatgccctcat

SEQ ID NO: 9434954 - DNA, 22 bp, Homo sapiens
tgctcgccccacatgccctcat

SEQ ID NO: 9434955 - DNA, 22 bp, Homo sapiens
tgctcgaggtccccaccggctc

SEQ ID NO: 9434956 - DNA, 22 bp, Homo sapiens
tgctcctggatgaggtactcca

SEQ ID NO: 9434957 - DNA, 22 bp, Homo sapiens
tgctcctggatgaggtactcca

SEQ ID NO: 9434958 - DNA, 22 bp, Homo sapiens
tgctcctggactggtgtgagat

SEQ ID NO: 9434959 - DNA, 22 bp, Homo sapiens
tgctcctggcatctctgcgtcc

SEQ ID NO: 9434960 - DNA, 22 bp, Homo sapiens
tgctcctggcttcaggttgggc

SEQ ID NO: 9434961 - DNA, 22 bp, Homo sapiens
tgctcctggcttcaggttgggc

SEQ ID NO: 9434962 - DNA, 17 bp, Homo sapiens
tgctcctgtggcagcct

SEQ ID NO: 9434963 - DNA, 17 bp, Homo sapiens
tgctcctgtggcagcct

SEQ ID NO: 9434964 - DNA, 17 bp, Homo sapiens
tgctcctgtggcagcct

SEQ ID NO: 9434965 - DNA, 17 bp, Homo sapiens
tgctcctgtggcagcct

SEQ ID NO: 9434966 - DNA, 17 bp, Homo sapiens
tgctcctgggacaagga

SEQ ID NO: 9434967 - DNA, 22 bp, Homo sapiens
tgctcctgtttcatcagctata

SEQ ID NO: 9434968 - DNA, 22 bp, Homo sapiens
tgctcctgtttcatcagctata

SEQ ID NO: 9434969 - DNA, 17 bp, Homo sapiens
tgctcctgtggcagcct

SEQ ID NO: 9434970 - DNA, 22 bp, Homo sapiens
tgctcctgtttcatcagctata

SEQ ID NO: 9434971 - DNA, 22 bp, Homo sapiens
tgctcctgtttcatcagctata

SEQ ID NO: 9434972 - DNA, 22 bp, Homo sapiens
tgctctgggctatctgagaaag

SEQ ID NO: 9434973 - DNA, 22 bp, Homo sapiens
tgctctgggctatctgagaaag

SEQ ID NO: 9434974 - DNA, 22 bp, Homo sapiens
tgctctgggcaacagcctccct

SEQ ID NO: 9434975 - DNA, 22 bp, Homo sapiens
tgctctgggcaacagcctccct

SEQ ID NO: 9434976 - DNA, 22 bp, Homo sapiens
tgctctgggctatctgagaaag

SEQ ID NO: 9434977 - DNA, 22 bp, Homo sapiens
tgctctgggctatctgagaaag

SEQ ID NO: 9434978 - DNA, 22 bp, Homo sapiens
tgctctgggctcaatggcagct

SEQ ID NO: 9434979 - DNA, 22 bp, Homo sapiens
tgctctgggctcaatggcagct

SEQ ID NO: 9434980 - DNA, 22 bp, Homo sapiens
tgctctgggctcaatggcagct

SEQ ID NO: 9434981 - DNA, 22 bp, Homo sapiens
tgctctggggagctcctctgcg

SEQ ID NO: 9434982 - DNA, 22 bp, Homo sapiens
tgctctgggctcaatggcagct

SEQ ID NO: 9434983 - DNA, 22 bp, Homo sapiens
tgctctggggagctcctctgcg

SEQ ID NO: 9434984 - DNA, 22 bp, Homo sapiens
tgctctggggagctcctctgcg

SEQ ID NO: 9434985 - DNA, 22 bp, Homo sapiens
tgctctgggggaagccagctgt

SEQ ID NO: 9434986 - DNA, 22 bp, Homo sapiens
tgctctgggggaagccagctgt

SEQ ID NO: 9434987 - DNA, 22 bp, Homo sapiens
tgctctgggggaagccagctgt

SEQ ID NO: 9434988 - DNA, 22 bp, Homo sapiens
tgctctgggggaagccagctgt

SEQ ID NO: 9434989 - DNA, 23 bp, Homo sapiens
tgctctgggaggccctggagagc

SEQ ID NO: 9434990 - DNA, 23 bp, Homo sapiens
tgctctgggaggccctggagagc

SEQ ID NO: 9434991 - DNA, 23 bp, Homo sapiens
tgctctgggaggccctggagagc

SEQ ID NO: 9434992 - DNA, 22 bp, Homo sapiens
tgctctgggattcagcagcctg

SEQ ID NO: 9434993 - DNA, 22 bp, Homo sapiens
tgctctgggattcagcagcctg

SEQ ID NO: 9434994 - DNA, 22 bp, Homo sapiens
tgctctggctgggatgagtgca

SEQ ID NO: 9434995 - DNA, 22 bp, Homo sapiens
tgctctggctggagcaatgact

SEQ ID NO: 9434996 - DNA, 22 bp, Homo sapiens
tgctctggctgggatgagtgca

SEQ ID NO: 9434997 - DNA, 22 bp, Homo sapiens
tgctctggctgggatgagtgca

SEQ ID NO: 9434998 - DNA, 22 bp, Homo sapiens
tgctctggctggagcaatgact

SEQ ID NO: 9434999 - DNA, 19 bp, Homo sapiens
tgctctctggtgcttcatg

SEQ ID NO: 9435000 - DNA, 22 bp, Homo sapiens
tgctctcatggaggtagagaat

SEQ ID NO: 9435001 - DNA, 21 bp, Homo sapiens
tgctccagggcagcttccagc

SEQ ID NO: 9435002 - DNA, 22 bp, Homo sapiens
tgctccagggcctccagtgggg

SEQ ID NO: 9435003 - DNA, 21 bp, Homo sapiens
tgctccagggcagcttccagc

SEQ ID NO: 9435004 - DNA, 22 bp, Homo sapiens
tgctccaggccgcctggggctg

SEQ ID NO: 9435005 - DNA, 22 bp, Homo sapiens
tgctccaggcaagctgagagtt

SEQ ID NO: 9435006 - DNA, 21 bp, Homo sapiens
tgctccaggagggggcagtcc

SEQ ID NO: 9435007 - DNA, 22 bp, Homo sapiens
tgctccaggagcactttccatt

SEQ ID NO: 9435008 - DNA, 21 bp, Homo sapiens
tgctccaggagggggcagtcc

SEQ ID NO: 9435009 - DNA, 22 bp, Homo sapiens
tgctccaggagcactttccatt

SEQ ID NO: 9435010 - DNA, 18 bp, Homo sapiens
tgctccaggcccatgggc

SEQ ID NO: 9435011 - DNA, 22 bp, Homo sapiens
tgctccagcaccaagagctcca

SEQ ID NO: 9435012 - DNA, 22 bp, Homo sapiens
tgctccagcctatgctctccgg

SEQ ID NO: 9435013 - DNA, 20 bp, Homo sapiens
tgctccaggaacactggccg

SEQ ID NO: 9435014 - DNA, 22 bp, Homo sapiens
tgctccaggagcaacctttgag

SEQ ID NO: 9435015 - DNA, 22 bp, Homo sapiens
tgctccagctggagatgggggc

SEQ ID NO: 9435016 - DNA, 22 bp, Homo sapiens
tgctccagcgctgccaccagtt

SEQ ID NO: 9435017 - DNA, 22 bp, Homo sapiens
tgctcctgagcggtttccatga

SEQ ID NO: 9435018 - DNA, 22 bp, Homo sapiens
tgctcctgatatctaatgtgta

SEQ ID NO: 9435019 - DNA, 22 bp, Homo sapiens
tgctcctgatatctaatgtgta

SEQ ID NO: 9435020 - DNA, 22 bp, Homo sapiens
tgctcctgaacacagccctatg

SEQ ID NO: 9435021 - DNA, 22 bp, Homo sapiens
tgctcctgaacacagccctatg

SEQ ID NO: 9435022 - DNA, 22 bp, Homo sapiens
tgctcctgacagttttaggctc

SEQ ID NO: 9435023 - DNA, 22 bp, Homo sapiens
tgctcctgctgcatgcatctcc

SEQ ID NO: 9435024 - DNA, 22 bp, Homo sapiens
tgctcctgatatctaatgtgta

SEQ ID NO: 9435025 - DNA, 22 bp, Homo sapiens
tgctcctgctggccctcgtgcc

SEQ ID NO: 9435026 - DNA, 22 bp, Homo sapiens
tgctcctgctgcatgcatctcc

SEQ ID NO: 9435027 - DNA, 22 bp, Homo sapiens
tgctcctatcctcctgctgaca

SEQ ID NO: 9435028 - DNA, 22 bp, Homo sapiens
tgctcccttgccagaggggaag

SEQ ID NO: 9435029 - DNA, 20 bp, Homo sapiens
tgctcccttgcgagtcgctg

SEQ ID NO: 9435030 - DNA, 22 bp, Homo sapiens
tgctcccttgccagaggggaag

SEQ ID NO: 9435031 - DNA, 22 bp, Homo sapiens
tgctcccatgtgtgggtacaga

SEQ ID NO: 9435032 - DNA, 22 bp, Homo sapiens
tgctccctgacccaggtcttct

SEQ ID NO: 9435033 - DNA, 22 bp, Homo sapiens
tgctccctgacccaggtcttct

SEQ ID NO: 9435034 - DNA, 23 bp, Homo sapiens
tgctcccaggtgacgctgctgtt

SEQ ID NO: 9435035 - DNA, 22 bp, Homo sapiens
tgctcccaggactcttgagcca

SEQ ID NO: 9435036 - DNA, 22 bp, Homo sapiens
tgctccagggcctccagtgggg

SEQ ID NO: 9435037 - DNA, 22 bp, Homo sapiens
tgctcccaggcattctctgttg

SEQ ID NO: 9435038 - DNA, 22 bp, Homo sapiens
tgctcccaggctctgtggtctg

SEQ ID NO: 9435039 - DNA, 22 bp, Homo sapiens
tgctcccagggactctggctgg

SEQ ID NO: 9435040 - DNA, 22 bp, Homo sapiens
tgctcccagggactctggctgg

SEQ ID NO: 9435041 - DNA, 22 bp, Homo sapiens
tgctcccaggctctgtggtctg

SEQ ID NO: 9435042 - DNA, 22 bp, Homo sapiens
tgggagctggggttggacgtct

SEQ ID NO: 9435043 - DNA, 22 bp, Homo sapiens
tgggagctggggttggacgtct

SEQ ID NO: 9435044 - DNA, 20 bp, Homo sapiens
tgggagctggtgaggtctca

SEQ ID NO: 9435045 - DNA, 22 bp, Homo sapiens
tgggagctggggttggacgtct

SEQ ID NO: 9435046 - DNA, 22 bp, Homo sapiens
tgggagctctgagcctgctgtg

SEQ ID NO: 9435047 - DNA, 22 bp, Homo sapiens
tgggagctctgagcctgctgtg

SEQ ID NO: 9435048 - DNA, 22 bp, Homo sapiens
tgggagctcctggagggcagga

SEQ ID NO: 9435049 - DNA, 22 bp, Homo sapiens
tgggagctctgagcctgctatg

SEQ ID NO: 9435050 - DNA, 22 bp, Homo sapiens
tgggaggaatgtcactgagcca

SEQ ID NO: 9435051 - DNA, 22 bp, Homo sapiens
tgggaggacttgtgggcttcat

SEQ ID NO: 9435052 - DNA, 22 bp, Homo sapiens
tgggaggatctcttgaggccag

SEQ ID NO: 9435053 - DNA, 22 bp, Homo sapiens
tgggaggcagaagttgactgga

SEQ ID NO: 9435054 - DNA, 22 bp, Homo sapiens
tgggaggcaggtaggtgatgat

SEQ ID NO: 9435055 - DNA, 22 bp, Homo sapiens
tgggaggcagaagttgactgga

SEQ ID NO: 9435056 - DNA, 22 bp, Homo sapiens
tgggaggatctcttgaggccag

SEQ ID NO: 9435057 - DNA, 22 bp, Homo sapiens
tgggaggatcgcttgagcccag

SEQ ID NO: 9435058 - DNA, 22 bp, Homo sapiens
tgggaggatcgcttgagcccag

SEQ ID NO: 9435059 - DNA, 22 bp, Homo sapiens
tgggaggatcgcttgagcccag

SEQ ID NO: 9435060 - DNA, 22 bp, Homo sapiens
tgggagcagccaacatggcctt

SEQ ID NO: 9435061 - DNA, 22 bp, Homo sapiens
tgggagcagccaacatggcctt

SEQ ID NO: 9435062 - DNA, 22 bp, Homo sapiens
tgggagcagcagggagatgcgg

SEQ ID NO: 9435063 - DNA, 22 bp, Homo sapiens
tgggagcagcattgccatgtgc

SEQ ID NO: 9435064 - DNA, 22 bp, Homo sapiens
tgggagcagctttgcgagggag

SEQ ID NO: 9435065 - DNA, 22 bp, Homo sapiens
tgggagctcctggagggcagga

SEQ ID NO: 9435066 - DNA, 22 bp, Homo sapiens
tgggagctcctggagggcagga

SEQ ID NO: 9435067 - DNA, 22 bp, Homo sapiens
tgggagcagctttgcgagggag

SEQ ID NO: 9435068 - DNA, 22 bp, Homo sapiens
tgggagcaagctggtgctggag

SEQ ID NO: 9435069 - DNA, 22 bp, Homo sapiens
tgggagcaagctggtgctggag

SEQ ID NO: 9435070 - DNA, 22 bp, Homo sapiens
tgggagcaagctggtgctggag

SEQ ID NO: 9435071 - DNA, 22 bp, Homo sapiens
tgggagcaagctggtgctggag

SEQ ID NO: 9435072 - DNA, 22 bp, Homo sapiens
tgggagcaagctggtgctggag

SEQ ID NO: 9435073 - DNA, 22 bp, Homo sapiens
tgggagcaccctgaggagcttc

SEQ ID NO: 9435074 - DNA, 22 bp, Homo sapiens
tgggagcaccctgaggagcttc

SEQ ID NO: 9435075 - DNA, 22 bp, Homo sapiens
tgggagcaccctgaggagcttc

SEQ ID NO: 9435076 - DNA, 22 bp, Homo sapiens
tgggagcaccctgaggagcttc

SEQ ID NO: 9435077 - DNA, 22 bp, Homo sapiens
tgggagcactctttgggaagca

SEQ ID NO: 9435078 - DNA, 22 bp, Homo sapiens
tgggagcaccttgagggcagaa

SEQ ID NO: 9435079 - DNA, 22 bp, Homo sapiens
tgggagcactctttgggaagca

SEQ ID NO: 9435080 - DNA, 22 bp, Homo sapiens
tgggagcaccttgagggcagaa

SEQ ID NO: 9435081 - DNA, 22 bp, Homo sapiens
tgggagcaccctgaggagcttc

SEQ ID NO: 9435082 - DNA, 22 bp, Homo sapiens
tgggagcaccctgaggagcttc

SEQ ID NO: 9435083 - DNA, 22 bp, Homo sapiens
tgggagcaccttgagggcagaa

SEQ ID NO: 9435084 - DNA, 22 bp, Homo sapiens
tgggagcaccttgagggcagaa

SEQ ID NO: 9435085 - DNA, 22 bp, Homo sapiens
tgggacttcaatgcaatgaggt

SEQ ID NO: 9435086 - DNA, 22 bp, Homo sapiens
tgggagaaactgtctctcccac

SEQ ID NO: 9435087 - DNA, 22 bp, Homo sapiens
tgggagaacccagggtcaggct

SEQ ID NO: 9435088 - DNA, 22 bp, Homo sapiens
tgggagaacccagggtcaggct

SEQ ID NO: 9435089 - DNA, 22 bp, Homo sapiens
tgggagaacccagggtcaggct

SEQ ID NO: 9435090 - DNA, 22 bp, Homo sapiens
tgggagaaagaaccctgagtga

SEQ ID NO: 9435091 - DNA, 22 bp, Homo sapiens
tgggagaagacgtactttagac

SEQ ID NO: 9435092 - DNA, 22 bp, Homo sapiens
tgggagaagcagtgggacagta

SEQ ID NO: 9435093 - DNA, 22 bp, Homo sapiens
tgggagaagcagcagccaagtg

SEQ ID NO: 9435094 - DNA, 22 bp, Homo sapiens
tgggagaagcagcagccaagtg

SEQ ID NO: 9435095 - DNA, 22 bp, Homo sapiens
tgggagacactggtgggagctt

SEQ ID NO: 9435096 - DNA, 21 bp, Homo sapiens
tgggagacacagccttgagct

SEQ ID NO: 9435097 - DNA, 21 bp, Homo sapiens
tgggagaccgccttcctggga

SEQ ID NO: 9435098 - DNA, 22 bp, Homo sapiens
tgggagagcttcatgccttcag

SEQ ID NO: 9435099 - DNA, 23 bp, Homo sapiens
tgggagacttttcattttgttct

SEQ ID NO: 9435100 - DNA, 22 bp, Homo sapiens
tgggagagaataatcaataggt

SEQ ID NO: 9435101 - DNA, 22 bp, Homo sapiens
tgggagaagcagtgggacagta

SEQ ID NO: 9435102 - DNA, 22 bp, Homo sapiens
tgggagaagcagtgggacagta

SEQ ID NO: 9435103 - DNA, 22 bp, Homo sapiens
tgggagaagcatggggtgcaga

SEQ ID NO: 9435104 - DNA, 19 bp, Homo sapiens
tgggagaggcaacagagta

SEQ ID NO: 9435105 - DNA, 19 bp, Homo sapiens
tgggagaggcaacagagta

SEQ ID NO: 9435106 - DNA, 22 bp, Homo sapiens
tgggagaggctgccatcttgca

SEQ ID NO: 9435107 - DNA, 19 bp, Homo sapiens
tgggagaggcaacagagta

SEQ ID NO: 9435108 - DNA, 22 bp, Homo sapiens
tgggagagtaaccaattccttc

SEQ ID NO: 9435109 - DNA, 21 bp, Homo sapiens
tgggagagggctcagctaccc

SEQ ID NO: 9435110 - DNA, 20 bp, Homo sapiens
tgggagatgatctccttgct

SEQ ID NO: 9435111 - DNA, 22 bp, Homo sapiens
tgggagcaaatgactgggagat

SEQ ID NO: 9435112 - DNA, 22 bp, Homo sapiens
tgggagcaaatgactgggagat

SEQ ID NO: 9435113 - DNA, 22 bp, Homo sapiens
tgggagcaaatgactgggagat

SEQ ID NO: 9435114 - DNA, 22 bp, Homo sapiens
tgggagcaagctacttagggaa

SEQ ID NO: 9435115 - DNA, 22 bp, Homo sapiens
tgggagcaagctacttagggaa

SEQ ID NO: 9435116 - DNA, 22 bp, Homo sapiens
tgggagagtctaaaaccgaggt

SEQ ID NO: 9435117 - DNA, 22 bp, Homo sapiens
tgggagagtgctcaatgtgcaa

SEQ ID NO: 9435118 - DNA, 22 bp, Homo sapiens
tgggagagtttgtttagagtga

SEQ ID NO: 9435119 - DNA, 22 bp, Homo sapiens
tgggagatattgctgtggctgt

SEQ ID NO: 9435120 - DNA, 22 bp, Homo sapiens
tgggaagggtcagtttcttcat

SEQ ID NO: 9435121 - DNA, 22 bp, Homo sapiens
tgggaagggtcagtttcttcat

SEQ ID NO: 9435122 - DNA, 22 bp, Homo sapiens
tgggaagggtctgaatctgaga

SEQ ID NO: 9435123 - DNA, 22 bp, Homo sapiens
tgggaagggtctgaatctgaga

SEQ ID NO: 9435124 - DNA, 22 bp, Homo sapiens
tgggaagggtctgaatctgaga

SEQ ID NO: 9435125 - DNA, 22 bp, Homo sapiens
tgggaaggtacacgggaaagag

SEQ ID NO: 9435126 - DNA, 22 bp, Homo sapiens
tgggaaggtacacgggaaagag

SEQ ID NO: 9435127 - DNA, 22 bp, Homo sapiens
tgggaaggtacacgggaaagag

SEQ ID NO: 9435128 - DNA, 22 bp, Homo sapiens
tgggaaggtacacgggaaagag

SEQ ID NO: 9435129 - DNA, 22 bp, Homo sapiens
tgggaaggtacacgggaaagag

SEQ ID NO: 9435130 - DNA, 22 bp, Homo sapiens
tgggaaggtgtagaaagaacaa

SEQ ID NO: 9435131 - DNA, 22 bp, Homo sapiens
tgggaaggtgtagaaagaacaa

SEQ ID NO: 9435132 - DNA, 22 bp, Homo sapiens
tgggaaggtgattttccaaaag

SEQ ID NO: 9435133 - DNA, 22 bp, Homo sapiens
tgggaaggtgattttccaaaag

SEQ ID NO: 9435134 - DNA, 22 bp, Homo sapiens
tgggaaggtgtagaaagaacaa

SEQ ID NO: 9435135 - DNA, 22 bp, Homo sapiens
tgggaaggggagctggaaagga

SEQ ID NO: 9435136 - DNA, 22 bp, Homo sapiens
tgggaaggggagctggaaagga

SEQ ID NO: 9435137 - DNA, 22 bp, Homo sapiens
tgggaaggggagctggaaagga

SEQ ID NO: 9435138 - DNA, 22 bp, Homo sapiens
tgggaaggggagctggaaagga

SEQ ID NO: 9435139 - DNA, 22 bp, Homo sapiens
tgggaagggcctgcccttcctc

SEQ ID NO: 9435140 - DNA, 22 bp, Homo sapiens
tgggaagggcctgcccttcctc

SEQ ID NO: 9435141 - DNA, 22 bp, Homo sapiens
tgggaaggggagctggaaagga

SEQ ID NO: 9435142 - DNA, 22 bp, Homo sapiens
tgggaagggtcaacagctggaa

SEQ ID NO: 9435143 - DNA, 22 bp, Homo sapiens
tgggaagggtcaacagctggaa

SEQ ID NO: 9435144 - DNA, 22 bp, Homo sapiens
tgggaagggtcaacagctggaa

SEQ ID NO: 9435145 - DNA, 22 bp, Homo sapiens
tgggaagggtcaacagctggaa

SEQ ID NO: 9435146 - DNA, 23 bp, Homo sapiens
tgggaagatatgtatgttcaagg

SEQ ID NO: 9435147 - DNA, 22 bp, Homo sapiens
tgggaagatatgagtgaccaac

SEQ ID NO: 9435148 - DNA, 22 bp, Homo sapiens
tgggaagcattaatgatagggg

SEQ ID NO: 9435149 - DNA, 22 bp, Homo sapiens
tgggaagatggagtgacaggca

SEQ ID NO: 9435150 - DNA, 22 bp, Homo sapiens
tgggaagatggagtgacaggca

SEQ ID NO: 9435151 - DNA, 22 bp, Homo sapiens
tgggaagatgataattcacagt

SEQ ID NO: 9435152 - DNA, 22 bp, Homo sapiens
tgggaagatgaggtgccatggg

SEQ ID NO: 9435153 - DNA, 22 bp, Homo sapiens
tgggaagatgataattcacagt

SEQ ID NO: 9435154 - DNA, 22 bp, Homo sapiens
tgggaagatgaggtgccatggg

SEQ ID NO: 9435155 - DNA, 22 bp, Homo sapiens
tgggaagggagagtgtcctgga

SEQ ID NO: 9435156 - DNA, 22 bp, Homo sapiens
tgggaagggagagtgtcctgga

SEQ ID NO: 9435157 - DNA, 22 bp, Homo sapiens
tgggaagggagagtgtcctgga

SEQ ID NO: 9435158 - DNA, 22 bp, Homo sapiens
tgggaagcctagcagacagctg

SEQ ID NO: 9435159 - DNA, 22 bp, Homo sapiens
tgggaagcctagcagacagctg

SEQ ID NO: 9435160 - DNA, 22 bp, Homo sapiens
tgggaagctactcatgcaggca

SEQ ID NO: 9435161 - DNA, 22 bp, Homo sapiens
tgggaaggcgtggaagtagaag

SEQ ID NO: 9435162 - DNA, 22 bp, Homo sapiens
tgggaaggcgtggaagtagaag

SEQ ID NO: 9435163 - DNA, 22 bp, Homo sapiens
tgggaaggcgtggaagtagaag

SEQ ID NO: 9435164 - DNA, 22 bp, Homo sapiens
tgggaagggccgatggagcctc

SEQ ID NO: 9435165 - DNA, 22 bp, Homo sapiens
tgggaagggccgatggagcctc

SEQ ID NO: 9435166 - DNA, 22 bp, Homo sapiens
tgggaagggccgatggagcctc

SEQ ID NO: 9435167 - DNA, 22 bp, Homo sapiens
tgggaagggccgatggagcctc

SEQ ID NO: 9435168 - DNA, 22 bp, Homo sapiens
tgggaagggccgatggagcctc

SEQ ID NO: 9435169 - DNA, 22 bp, Homo sapiens
tgggaagggagtttcttggagt

SEQ ID NO: 9435170 - DNA, 22 bp, Homo sapiens
tgggaagggagtttcttggagt

SEQ ID NO: 9435171 - DNA, 22 bp, Homo sapiens
tgggaagggagtttcttggagt

SEQ ID NO: 9435172 - DNA, 22 bp, Homo sapiens
tgggaagggagagtgtcctgga

SEQ ID NO: 9435173 - DNA, 22 bp, Homo sapiens
tgggactgagaatatgatgggg

SEQ ID NO: 9435174 - DNA, 22 bp, Homo sapiens
tgggactgagaatatgatgggg

SEQ ID NO: 9435175 - DNA, 22 bp, Homo sapiens
tgggactgctcttgctggggtc

SEQ ID NO: 9435176 - DNA, 20 bp, Homo sapiens
tgggactgacccatctgagc

SEQ ID NO: 9435177 - DNA, 20 bp, Homo sapiens
tgggactgacccatctgagc

SEQ ID NO: 9435178 - DNA, 22 bp, Homo sapiens
tgggactcactcttttggccag

SEQ ID NO: 9435179 - DNA, 21 bp, Homo sapiens
tgggacctagctttgcacagg

SEQ ID NO: 9435180 - DNA, 22 bp, Homo sapiens
tgggacctgctcttggaatgag

SEQ ID NO: 9435181 - DNA, 22 bp, Homo sapiens
tgggacctgctcctggaatgag

SEQ ID NO: 9435182 - DNA, 22 bp, Homo sapiens
tgggacagtgaccccagaggtc

SEQ ID NO: 9435183 - DNA, 22 bp, Homo sapiens
tgggacagtgaccccagaggtc

SEQ ID NO: 9435184 - DNA, 22 bp, Homo sapiens
tgggacagtgaccccagaggtc

SEQ ID NO: 9435185 - DNA, 21 bp, Homo sapiens
tgggacagtgatggctcctcc

SEQ ID NO: 9435186 - DNA, 22 bp, Homo sapiens
tgggacagtgaccccagaggtc

SEQ ID NO: 9435187 - DNA, 22 bp, Homo sapiens
tgggacagtgtgccttgctcct

SEQ ID NO: 9435188 - DNA, 21 bp, Homo sapiens
tgggacagtgatggctcctcc

SEQ ID NO: 9435189 - DNA, 21 bp, Homo sapiens
tgggacagtgatggctcctcc

SEQ ID NO: 9435190 - DNA, 22 bp, Homo sapiens
tgggacagttgtcctccactct

SEQ ID NO: 9435191 - DNA, 22 bp, Homo sapiens
tgggacagttgtcctccactct

SEQ ID NO: 9435192 - DNA, 22 bp, Homo sapiens
tgggacagttgtcctccactct

SEQ ID NO: 9435193 - DNA, 22 bp, Homo sapiens
tgggaccaagtcatttctttag

SEQ ID NO: 9435194 - DNA, 22 bp, Homo sapiens
tgggaccagataaagggaggtc

SEQ ID NO: 9435195 - DNA, 22 bp, Homo sapiens
tgggacagtgtgccttgctcct

SEQ ID NO: 9435196 - DNA, 22 bp, Homo sapiens
tgggacagtgtgccttgctcct

SEQ ID NO: 9435197 - DNA, 22 bp, Homo sapiens
tgggacagttgtcctccactct

SEQ ID NO: 9435198 - DNA, 22 bp, Homo sapiens
tgggacagggaatctgatcccc

SEQ ID NO: 9435199 - DNA, 22 bp, Homo sapiens
tgggacagggaatctgatcccc

SEQ ID NO: 9435200 - DNA, 22 bp, Homo sapiens
tgggacagggaatctgatcccc

SEQ ID NO: 9435201 - DNA, 22 bp, Homo sapiens
tgggacacaaaccagaccagga

SEQ ID NO: 9435202 - DNA, 22 bp, Homo sapiens
tgggacacaaaccagaccagga

SEQ ID NO: 9435203 - DNA, 22 bp, Homo sapiens
tgggacacacaaggtcagctct

SEQ ID NO: 9435204 - DNA, 22 bp, Homo sapiens
tgggaatgtggcaaggcataga

SEQ ID NO: 9435205 - DNA, 22 bp, Homo sapiens
tgggacacagaaaaggcaggtt

SEQ ID NO: 9435206 - DNA, 22 bp, Homo sapiens
tgggacagtgaccccagaggtc

SEQ ID NO: 9435207 - DNA, 22 bp, Homo sapiens
tgggacagtgaccccagaggtc

SEQ ID NO: 9435208 - DNA, 22 bp, Homo sapiens
tgggacagtgaccccagaggtc

SEQ ID NO: 9435209 - DNA, 22 bp, Homo sapiens
tgggacaggttggagagaagca

SEQ ID NO: 9435210 - DNA, 22 bp, Homo sapiens
tgggacaggttggagagaagca

SEQ ID NO: 9435211 - DNA, 22 bp, Homo sapiens
tgggacaggttggagagaagca

SEQ ID NO: 9435212 - DNA, 22 bp, Homo sapiens
tgggacaggttggagagaagca

SEQ ID NO: 9435213 - DNA, 22 bp, Homo sapiens
tgggacaggttggagagaagca

SEQ ID NO: 9435214 - DNA, 22 bp, Homo sapiens
tgggacaggttggagagaagca

SEQ ID NO: 9435215 - DNA, 22 bp, Homo sapiens
tgggacaggttggagagaagca

SEQ ID NO: 9435216 - DNA, 22 bp, Homo sapiens
tgggaaggttagcagtttgtca

SEQ ID NO: 9435217 - DNA, 22 bp, Homo sapiens
tgggaaggttagcagtttgtca

SEQ ID NO: 9435218 - DNA, 22 bp, Homo sapiens
tgggaaggttagcagtttgtca

SEQ ID NO: 9435219 - DNA, 22 bp, Homo sapiens
tgggaatgtgagcattcattca

SEQ ID NO: 9435220 - DNA, 22 bp, Homo sapiens
tgggacaaggactagctccaat

SEQ ID NO: 9435221 - DNA, 22 bp, Homo sapiens
tgggaatgctgagcccatgtat

SEQ ID NO: 9435222 - DNA, 22 bp, Homo sapiens
tgggaatgggcctagaaggctg

SEQ ID NO: 9435223 - DNA, 22 bp, Homo sapiens
tgggaagactcctcaggaggcg

SEQ ID NO: 9435224 - DNA, 22 bp, Homo sapiens
tgggaagactcctcaggaggcg

SEQ ID NO: 9435225 - DNA, 22 bp, Homo sapiens
tgggaagactcctcaggaggcg

SEQ ID NO: 9435226 - DNA, 22 bp, Homo sapiens
tgggaagaggagcactggaatg

SEQ ID NO: 9435227 - DNA, 22 bp, Homo sapiens
tgggaagaggatgaggcatatg

SEQ ID NO: 9435228 - DNA, 22 bp, Homo sapiens
tgggaagaggatgaggcatatg

SEQ ID NO: 9435229 - DNA, 22 bp, Homo sapiens
tgggaactctctgggaggcatc

SEQ ID NO: 9435230 - DNA, 22 bp, Homo sapiens
tgggaaccatgtagctgagatg

SEQ ID NO: 9435231 - DNA, 22 bp, Homo sapiens
tgggaaccaggactggctgagg

SEQ ID NO: 9435232 - DNA, 22 bp, Homo sapiens
tgggaacattttgagctgagag

SEQ ID NO: 9435233 - DNA, 22 bp, Homo sapiens
tgggaagaagcagagaactgga

SEQ ID NO: 9435234 - DNA, 22 bp, Homo sapiens
tgggaagaagcagagaactgga

SEQ ID NO: 9435235 - DNA, 22 bp, Homo sapiens
tgggaaatattctaaaagtctt

SEQ ID NO: 9435236 - DNA, 23 bp, Homo sapiens
tgggaaatgtagccttggcatga

SEQ ID NO: 9435237 - DNA, 22 bp, Homo sapiens
tgggaaattgtatttctatttc

SEQ ID NO: 9435238 - DNA, 22 bp, Homo sapiens
tgggaacaacatgcactgccac

SEQ ID NO: 9435239 - DNA, 22 bp, Homo sapiens
tgggaaagtgttgaggtgtctt

SEQ ID NO: 9435240 - DNA, 22 bp, Homo sapiens
tgggaaagtgttgaggtgtctt

SEQ ID NO: 9435241 - DNA, 22 bp, Homo sapiens
tgggaaatataatttagctgtg

SEQ ID NO: 9435242 - DNA, 18 bp, Homo sapiens
tgggaaagtttatagaat

SEQ ID NO: 9435243 - DNA, 22 bp, Homo sapiens
tgggaaagtgttgaggtgtctt

SEQ ID NO: 9435244 - DNA, 22 bp, Homo sapiens
tgggaaagtgtagcctgcaggc

SEQ ID NO: 9435245 - DNA, 22 bp, Homo sapiens
tgggaaagtgtagcctgcaggc

SEQ ID NO: 9435246 - DNA, 22 bp, Homo sapiens
tgggaaagtgtagcctgcaggc

SEQ ID NO: 9435247 - DNA, 22 bp, Homo sapiens
tgggaaagtctttatttctctt

SEQ ID NO: 9435248 - DNA, 22 bp, Homo sapiens
tgggaaagtgtagcctgcaggc

SEQ ID NO: 9435249 - DNA, 22 bp, Homo sapiens
tgggaaagtgtagcctgcaggc

SEQ ID NO: 9435250 - DNA, 19 bp, Homo sapiens
tgggaaagtaacatacaaa

SEQ ID NO: 9435251 - DNA, 22 bp, Homo sapiens
tgggaaagccagcagtgtcacc

SEQ ID NO: 9435252 - DNA, 22 bp, Homo sapiens
tgggaaagctgcagaaattctc

SEQ ID NO: 9435253 - DNA, 22 bp, Homo sapiens
tgggaaagccagcagtgtcacc

SEQ ID NO: 9435254 - DNA, 22 bp, Homo sapiens
tgggaaagccagcagtgtcacc

SEQ ID NO: 9435255 - DNA, 22 bp, Homo sapiens
tgggaaagtaattgtcatcctt

SEQ ID NO: 9435256 - DNA, 22 bp, Homo sapiens
tgggaaagtaattgtcatcctt

SEQ ID NO: 9435257 - DNA, 20 bp, Homo sapiens
tgggaaagtctaagtgcctc

SEQ ID NO: 9435258 - DNA, 22 bp, Homo sapiens
tgggaaagtaattgtcatcctt

SEQ ID NO: 9435259 - DNA, 20 bp, Homo sapiens
tgggaaagtctaagtgcctc

SEQ ID NO: 9435260 - DNA, 22 bp, Homo sapiens
tgggaaagactcaggacaggag

SEQ ID NO: 9435261 - DNA, 22 bp, Homo sapiens
tgggaaagactcaggacaggag

SEQ ID NO: 9435262 - DNA, 22 bp, Homo sapiens
tgggaaagactcaggacaggag

SEQ ID NO: 9435263 - DNA, 22 bp, Homo sapiens
tggctttgatggacagaggtca

SEQ ID NO: 9435264 - DNA, 22 bp, Homo sapiens
tggcttttgcctttcaaattgg

SEQ ID NO: 9435265 - DNA, 22 bp, Homo sapiens
tggcttcttgacttcttggctg

SEQ ID NO: 9435266 - DNA, 22 bp, Homo sapiens
tggcttcttgacttcttggctg

SEQ ID NO: 9435267 - DNA, 22 bp, Homo sapiens
tggcttcttgggatgggtcatt

SEQ ID NO: 9435268 - DNA, 22 bp, Homo sapiens
tggcttcttgatcttggacttg

SEQ ID NO: 9435269 - DNA, 16 bp, Homo sapiens
tggcttcttatttcta

SEQ ID NO: 9435270 - DNA, 19 bp, Homo sapiens
tggcttcttcggtgttccc

SEQ ID NO: 9435271 - DNA, 19 bp, Homo sapiens
tggcttcttcggtgttccc

SEQ ID NO: 9435272 - DNA, 22 bp, Homo sapiens
tggctttatacttaagcacaat

SEQ ID NO: 9435273 - DNA, 19 bp, Homo sapiens
tggcttcctgactctcatc

SEQ ID NO: 9435274 - DNA, 22 bp, Homo sapiens
tggcttcctccagagcaggagg

SEQ ID NO: 9435275 - DNA, 22 bp, Homo sapiens
tggcttcctaaactgatttcca

SEQ ID NO: 9435276 - DNA, 22 bp, Homo sapiens
tggcttcaggagcacctggctt

SEQ ID NO: 9435277 - DNA, 22 bp, Homo sapiens
tggcttcagagtctgagttctt

SEQ ID NO: 9435278 - DNA, 22 bp, Homo sapiens
tggcttcagacttctgctacgt

SEQ ID NO: 9435279 - DNA, 22 bp, Homo sapiens
tggcttcagagacagaatctat

SEQ ID NO: 9435280 - DNA, 22 bp, Homo sapiens
tggcttctagtttgaggaaaaa

SEQ ID NO: 9435281 - DNA, 22 bp, Homo sapiens
tggcttctagcagtgttgattt

SEQ ID NO: 9435282 - DNA, 22 bp, Homo sapiens
tggcttctagagcccatccttc

SEQ ID NO: 9435283 - DNA, 22 bp, Homo sapiens
tggcttctagagcccatccttc

SEQ ID NO: 9435284 - DNA, 22 bp, Homo sapiens
tggcttctagagcccatccttc

SEQ ID NO: 9435285 - DNA, 22 bp, Homo sapiens
tggcttctaaagtttcttttag

SEQ ID NO: 9435286 - DNA, 22 bp, Homo sapiens
tggcttctaaagtttcttttag

SEQ ID NO: 9435287 - DNA, 22 bp, Homo sapiens
tggcttctcagaatactctgga

SEQ ID NO: 9435288 - DNA, 22 bp, Homo sapiens
tggcttctcagaatactctgga

SEQ ID NO: 9435289 - DNA, 22 bp, Homo sapiens
tggcttctcagtttcataatga

SEQ ID NO: 9435290 - DNA, 22 bp, Homo sapiens
tggcttctcagtttcataatga

SEQ ID NO: 9435291 - DNA, 18 bp, Homo sapiens
tggcttctattttactca

SEQ ID NO: 9435292 - DNA, 22 bp, Homo sapiens
tggcttctattgctgtggcatt

SEQ ID NO: 9435293 - DNA, 22 bp, Homo sapiens
tggcttctgctcccagaatgat

SEQ ID NO: 9435294 - DNA, 22 bp, Homo sapiens
tggcttctgctttcagtggagg

SEQ ID NO: 9435295 - DNA, 22 bp, Homo sapiens
tggcttctgctttcagtggagg

SEQ ID NO: 9435296 - DNA, 19 bp, Homo sapiens
tggcttctggcaacagatg

SEQ ID NO: 9435297 - DNA, 22 bp, Homo sapiens
tggcttctggccaggcacagga

SEQ ID NO: 9435298 - DNA, 23 bp, Homo sapiens
tggcttctgccccattctctcca

SEQ ID NO: 9435299 - DNA, 22 bp, Homo sapiens
tggcttctgctcccagaatgat

SEQ ID NO: 9435300 - DNA, 18 bp, Homo sapiens
tggcttctgctagctgga

SEQ ID NO: 9435301 - DNA, 22 bp, Homo sapiens
tggcttctgggacttgtgagca

SEQ ID NO: 9435302 - DNA, 22 bp, Homo sapiens
tggcttctggggtggcctgcat

SEQ ID NO: 9435303 - DNA, 22 bp, Homo sapiens
tggcttctggggtggcctgcat

SEQ ID NO: 9435304 - DNA, 22 bp, Homo sapiens
tggcttctggctggtgagaaat

SEQ ID NO: 9435305 - DNA, 19 bp, Homo sapiens
tggcttctgttttcatgtt

SEQ ID NO: 9435306 - DNA, 19 bp, Homo sapiens
tggcttctgttttcatgtt

SEQ ID NO: 9435307 - DNA, 22 bp, Homo sapiens
tggcttctgtccctgctacatt

SEQ ID NO: 9435308 - DNA, 22 bp, Homo sapiens
tggcttctccctacaacatgcc

SEQ ID NO: 9435309 - DNA, 22 bp, Homo sapiens
tggcttctccctccccatctag

SEQ ID NO: 9435310 - DNA, 22 bp, Homo sapiens
tggcttctccctacaacatgcc

SEQ ID NO: 9435311 - DNA, 22 bp, Homo sapiens
tggcttctcccgacaccctggc

SEQ ID NO: 9435312 - DNA, 22 bp, Homo sapiens
tggcttctcccgacaccctggc

SEQ ID NO: 9435313 - DNA, 22 bp, Homo sapiens
tggcttctcccgacaccctggc

SEQ ID NO: 9435314 - DNA, 22 bp, Homo sapiens
tggcttctccagaaatcttggt

SEQ ID NO: 9435315 - DNA, 22 bp, Homo sapiens
tggcttctcccgacaccctggc

SEQ ID NO: 9435316 - DNA, 22 bp, Homo sapiens
tggcttctcgcctgtcatcccg

SEQ ID NO: 9435317 - DNA, 22 bp, Homo sapiens
tggcttctccctccccatctag

SEQ ID NO: 9435318 - DNA, 22 bp, Homo sapiens
tggcttctccctctgcctgatt

SEQ ID NO: 9435319 - DNA, 22 bp, Homo sapiens
tggcttctctgtgtgagggaga

SEQ ID NO: 9435320 - DNA, 22 bp, Homo sapiens
tggcttctctggcatccccatc

SEQ ID NO: 9435321 - DNA, 22 bp, Homo sapiens
tggcttctctggcatccccatc

SEQ ID NO: 9435322 - DNA, 22 bp, Homo sapiens
tggcttctgagtctcctgacat

SEQ ID NO: 9435323 - DNA, 22 bp, Homo sapiens
tggcttctgagtctcctgacat

SEQ ID NO: 9435324 - DNA, 22 bp, Homo sapiens
tggcttctgcatatttttagag

SEQ ID NO: 9435325 - DNA, 22 bp, Homo sapiens
tggcttctgagtctcctgacat

SEQ ID NO: 9435326 - DNA, 22 bp, Homo sapiens
tggcttctgagtctcctgacat

SEQ ID NO: 9435327 - DNA, 18 bp, Homo sapiens
tggcttctgaacaactgc

SEQ ID NO: 9435328 - DNA, 22 bp, Homo sapiens
tggcttctgagcattgaaacgt

SEQ ID NO: 9435329 - DNA, 20 bp, Homo sapiens
tggcttctcttcactcctgt

SEQ ID NO: 9435330 - DNA, 20 bp, Homo sapiens
tggcttctcttcactcctgt

SEQ ID NO: 9435331 - DNA, 20 bp, Homo sapiens
tggcttctcttcactcctgt

SEQ ID NO: 9435332 - DNA, 22 bp, Homo sapiens
tggcttctctgttttagtattt

SEQ ID NO: 9435333 - DNA, 22 bp, Homo sapiens
tggcttctctgtgtgagggaga

SEQ ID NO: 9435334 - DNA, 22 bp, Homo sapiens
tggctgggtgctatccagtact

SEQ ID NO: 9435335 - DNA, 22 bp, Homo sapiens
tggctgggtgctatccagtact

SEQ ID NO: 9435336 - DNA, 22 bp, Homo sapiens
tggctgggtgctatccagtact

SEQ ID NO: 9435337 - DNA, 22 bp, Homo sapiens
tggctgggtgctatccagtact

SEQ ID NO: 9435338 - DNA, 22 bp, Homo sapiens
tggctgtcagctgcctggtgcg

SEQ ID NO: 9435339 - DNA, 22 bp, Homo sapiens
tggctggttttggtgagctccg

SEQ ID NO: 9435340 - DNA, 22 bp, Homo sapiens
tggctggttttggtgagctccg

SEQ ID NO: 9435341 - DNA, 22 bp, Homo sapiens
tggctggtcacatggtaggtct

SEQ ID NO: 9435342 - DNA, 21 bp, Homo sapiens
tggctggtggcagggcttctc

SEQ ID NO: 9435343 - DNA, 22 bp, Homo sapiens
tggctgggggtgctatagctgc

SEQ ID NO: 9435344 - DNA, 22 bp, Homo sapiens
tggctgggggtgctatagctgc

SEQ ID NO: 9435345 - DNA, 22 bp, Homo sapiens
tggctgggggtgctatagctgc

SEQ ID NO: 9435346 - DNA, 22 bp, Homo sapiens
tggctgggggtgctatagctgc

SEQ ID NO: 9435347 - DNA, 19 bp, Homo sapiens
tggctgggtgccaatggcc

SEQ ID NO: 9435348 - DNA, 19 bp, Homo sapiens
tggctgggtgccaatggcc

SEQ ID NO: 9435349 - DNA, 19 bp, Homo sapiens
tggctgggtgccaatggcc

SEQ ID NO: 9435350 - DNA, 19 bp, Homo sapiens
tggctgggtgccaatggcc

SEQ ID NO: 9435351 - DNA, 22 bp, Homo sapiens
tggctgggccgggccttgtgcc

SEQ ID NO: 9435352 - DNA, 22 bp, Homo sapiens
tggctgggccgggccttgtgcc

SEQ ID NO: 9435353 - DNA, 22 bp, Homo sapiens
tggctgggccgggccttgtgcc

SEQ ID NO: 9435354 - DNA, 19 bp, Homo sapiens
tggctgggcgtgcctccgt

SEQ ID NO: 9435355 - DNA, 19 bp, Homo sapiens
tggctgggcgtgcctccgt

SEQ ID NO: 9435356 - DNA, 19 bp, Homo sapiens
tggctgggcgtgcctccgt

SEQ ID NO: 9435357 - DNA, 22 bp, Homo sapiens
tggctggggagccccgactccc

SEQ ID NO: 9435358 - DNA, 22 bp, Homo sapiens
tggctggggcctgaatcctgca

SEQ ID NO: 9435359 - DNA, 22 bp, Homo sapiens
tggctggggccacagttttcct

SEQ ID NO: 9435360 - DNA, 22 bp, Homo sapiens
tggctggggcctgaatcctgca

SEQ ID NO: 9435361 - DNA, 22 bp, Homo sapiens
tggctggggcctgaatcctgca

SEQ ID NO: 9435362 - DNA, 22 bp, Homo sapiens
tggctggggccacagttttcct

SEQ ID NO: 9435363 - DNA, 22 bp, Homo sapiens
tggctggggccacagttttcct

SEQ ID NO: 9435364 - DNA, 22 bp, Homo sapiens
tggctggggagccccgactccc

SEQ ID NO: 9435365 - DNA, 22 bp, Homo sapiens
tggctggggagccccgactccc

SEQ ID NO: 9435366 - DNA, 19 bp, Homo sapiens
tggctgggcgtgcctccgt

SEQ ID NO: 9435367 - DNA, 22 bp, Homo sapiens
tggctgtcatgcccttcttacc

SEQ ID NO: 9435368 - DNA, 22 bp, Homo sapiens
tggctgtcagtcgcctgcattc

SEQ ID NO: 9435369 - DNA, 22 bp, Homo sapiens
tggctgtcagtcgcctgcattc

SEQ ID NO: 9435370 - DNA, 22 bp, Homo sapiens
tggctgtgatttgcacgagatg

SEQ ID NO: 9435371 - DNA, 22 bp, Homo sapiens
tggctgtgaacaaagagaataa

SEQ ID NO: 9435372 - DNA, 22 bp, Homo sapiens
tggctgtgaatggcaaataatc

SEQ ID NO: 9435373 - DNA, 22 bp, Homo sapiens
tggctgtgcggcctcgggcaga

SEQ ID NO: 9435374 - DNA, 22 bp, Homo sapiens
tggctgtgcggcctcgggcaga

SEQ ID NO: 9435375 - DNA, 22 bp, Homo sapiens
tggctgtggactcagatggctc

SEQ ID NO: 9435376 - DNA, 19 bp, Homo sapiens
tggctgtggggaaatgctt

SEQ ID NO: 9435377 - DNA, 19 bp, Homo sapiens
tggctgtggggaaatgctt

SEQ ID NO: 9435378 - DNA, 22 bp, Homo sapiens
tggctgtgggatatgtgactga

SEQ ID NO: 9435379 - DNA, 22 bp, Homo sapiens
tggctgtgggatatgtgactga

SEQ ID NO: 9435380 - DNA, 22 bp, Homo sapiens
tggctgtggactcagatggctc

SEQ ID NO: 9435381 - DNA, 22 bp, Homo sapiens
tggcttcacaatttcataacta

SEQ ID NO: 9435382 - DNA, 22 bp, Homo sapiens
tggcttcaaaggtagcatacaa

SEQ ID NO: 9435383 - DNA, 22 bp, Homo sapiens
tggcttcaaaatctagtggtct

SEQ ID NO: 9435384 - DNA, 22 bp, Homo sapiens
tggcttacatgcctttctatct

SEQ ID NO: 9435385 - DNA, 22 bp, Homo sapiens
tggctgtgttaccacttcatgt

SEQ ID NO: 9435386 - DNA, 22 bp, Homo sapiens
tggctgtgtccctgtccagagt

SEQ ID NO: 9435387 - DNA, 22 bp, Homo sapiens
tggctgtgtccctgtccagagt

SEQ ID NO: 9435388 - DNA, 22 bp, Homo sapiens
tggctggagggttagtgagata

SEQ ID NO: 9435389 - DNA, 22 bp, Homo sapiens
tggctggagggttagtgagata

SEQ ID NO: 9435390 - DNA, 22 bp, Homo sapiens
tggctggaggaaggaactgagg

SEQ ID NO: 9435391 - DNA, 22 bp, Homo sapiens
tggctggagcccctcaagagca

SEQ ID NO: 9435392 - DNA, 22 bp, Homo sapiens
tggctggagcccctcaagagca

SEQ ID NO: 9435393 - DNA, 22 bp, Homo sapiens
tggctggacagtgggcagtgga

SEQ ID NO: 9435394 - DNA, 22 bp, Homo sapiens
tggctggaatggagctgagcct

SEQ ID NO: 9435395 - DNA, 22 bp, Homo sapiens
tggctggatatcagaggaagtg

SEQ ID NO: 9435396 - DNA, 22 bp, Homo sapiens
tggctggatatcagaggaagtg

SEQ ID NO: 9435397 - DNA, 22 bp, Homo sapiens
tggctggagtgggagaagttta

SEQ ID NO: 9435398 - DNA, 22 bp, Homo sapiens
tggctggagtataggagtagga

SEQ ID NO: 9435399 - DNA, 22 bp, Homo sapiens
tggctggagtctggtgctagcc

SEQ ID NO: 9435400 - DNA, 22 bp, Homo sapiens
tggctggatatcaggcaagggg

SEQ ID NO: 9435401 - DNA, 22 bp, Homo sapiens
tggctggatatcaggcaagggg

SEQ ID NO: 9435402 - DNA, 22 bp, Homo sapiens
tggctggatgtgagatcaagag

SEQ ID NO: 9435403 - DNA, 22 bp, Homo sapiens
tggctggcaaggctggagtcag

SEQ ID NO: 9435404 - DNA, 23 bp, Homo sapiens
tggctggcagaaactgaagcatg

SEQ ID NO: 9435405 - DNA, 22 bp, Homo sapiens
tggctggcaaggctggagtcag

SEQ ID NO: 9435406 - DNA, 22 bp, Homo sapiens
tggctggcaaggctggagtcag

SEQ ID NO: 9435407 - DNA, 22 bp, Homo sapiens
tggctggcaaggctggagtcag

SEQ ID NO: 9435408 - DNA, 22 bp, Homo sapiens
tggctgggcccccacctgcctc

SEQ ID NO: 9435409 - DNA, 22 bp, Homo sapiens
tggctgggccgggccttgtgcc

SEQ ID NO: 9435410 - DNA, 22 bp, Homo sapiens
tggctgggcccccacctgcctc

SEQ ID NO: 9435411 - DNA, 22 bp, Homo sapiens
tggctgggagctggaactgggc

SEQ ID NO: 9435412 - DNA, 22 bp, Homo sapiens
tggctgggagctggaactgggc

SEQ ID NO: 9435413 - DNA, 22 bp, Homo sapiens
tggctgggagctggaactgggc

SEQ ID NO: 9435414 - DNA, 22 bp, Homo sapiens
tggctgggagctggaactgggc

SEQ ID NO: 9435415 - DNA, 22 bp, Homo sapiens
tggctgggagctggaactgggc

SEQ ID NO: 9435416 - DNA, 22 bp, Homo sapiens
tggctgggcccccacctgcctc

SEQ ID NO: 9435417 - DNA, 22 bp, Homo sapiens
tggctgggagctggaactgggc

SEQ ID NO: 9435418 - DNA, 22 bp, Homo sapiens
tggctgggagctggaactgggc

SEQ ID NO: 9435419 - DNA, 22 bp, Homo sapiens
tggctggcgttggggccagtga

SEQ ID NO: 9435420 - DNA, 22 bp, Homo sapiens
tggctggctagaatggaaatgt

SEQ ID NO: 9435421 - DNA, 22 bp, Homo sapiens
tggctggcgttggggccagtga

SEQ ID NO: 9435422 - DNA, 22 bp, Homo sapiens
tggctggcgttggggccagtga

SEQ ID NO: 9435423 - DNA, 23 bp, Homo sapiens
tggctggcgcctgcctcaccctg

SEQ ID NO: 9435424 - DNA, 22 bp, Homo sapiens
tggctggcgccgggctagccac

SEQ ID NO: 9435425 - DNA, 22 bp, Homo sapiens
tggctggcatagccattgctcc

SEQ ID NO: 9435426 - DNA, 22 bp, Homo sapiens
tggctggcagttatctttggat

SEQ ID NO: 9435427 - DNA, 22 bp, Homo sapiens
tggctggccctgggagtgcaga

SEQ ID NO: 9435428 - DNA, 22 bp, Homo sapiens
tggctggcatagccattgctcc

SEQ ID NO: 9435429 - DNA, 22 bp, Homo sapiens
tggctggcatagccattgctcc

SEQ ID NO: 9435430 - DNA, 22 bp, Homo sapiens
tggctggcgccgggctagccac

SEQ ID NO: 9435431 - DNA, 22 bp, Homo sapiens
tggctggccctgggagtgcaga

SEQ ID NO: 9435432 - DNA, 22 bp, Homo sapiens
tggctggccctgggagtgcaga

SEQ ID NO: 9435433 - DNA, 22 bp, Homo sapiens
tggctggccctgggagtgcaga

SEQ ID NO: 9435434 - DNA, 22 bp, Homo sapiens
tggctggcagtaggctagtggc

SEQ ID NO: 9435435 - DNA, 22 bp, Homo sapiens
tggctggcagtaggctagtggc

SEQ ID NO: 9435436 - DNA, 22 bp, Homo sapiens
tggctggcagtaggctagtggc

SEQ ID NO: 9435437 - DNA, 18 bp, Homo sapiens
tggctggcagtgggcagc

SEQ ID NO: 9435438 - DNA, 18 bp, Homo sapiens
tggctggcagtgggcagc

SEQ ID NO: 9435439 - DNA, 22 bp, Homo sapiens
tggctggcagtaggctagtggc

SEQ ID NO: 9435440 - DNA, 23 bp, Homo sapiens
tggctggcagaaactgaagcatg

SEQ ID NO: 9435441 - DNA, 22 bp, Homo sapiens
tggctcaggtgtgagctgaaga

SEQ ID NO: 9435442 - DNA, 22 bp, Homo sapiens
tggctcaggtgtgagctgaaga

SEQ ID NO: 9435443 - DNA, 23 bp, Homo sapiens
tggctcagggtctcttatgaagt

SEQ ID NO: 9435444 - DNA, 22 bp, Homo sapiens
tggctcagtagcagtgtggtca

SEQ ID NO: 9435445 - DNA, 22 bp, Homo sapiens
tggctcagtagcagtgtggtca

SEQ ID NO: 9435446 - DNA, 22 bp, Homo sapiens
tggctcagtagcagtgtggtca

SEQ ID NO: 9435447 - DNA, 22 bp, Homo sapiens
tggctcagggtccccaaatggt

SEQ ID NO: 9435448 - DNA, 23 bp, Homo sapiens
tggctcagggtctcttatgaagt

SEQ ID NO: 9435449 - DNA, 23 bp, Homo sapiens
tggctcagggtctcttatgaagt

SEQ ID NO: 9435450 - DNA, 22 bp, Homo sapiens
tggctcagtctgggttgactga

SEQ ID NO: 9435451 - DNA, 22 bp, Homo sapiens
tggctcagtgaagagataactt

SEQ ID NO: 9435452 - DNA, 22 bp, Homo sapiens
tggctcagtgaagagataactt

SEQ ID NO: 9435453 - DNA, 22 bp, Homo sapiens
tggctcagtcatggatgagtaa

SEQ ID NO: 9435454 - DNA, 22 bp, Homo sapiens
tggctcagtcatggatgagtaa

SEQ ID NO: 9435455 - DNA, 22 bp, Homo sapiens
tggctcagtgacattcctccca

SEQ ID NO: 9435456 - DNA, 22 bp, Homo sapiens
tggctcagtggcagccgcagct

SEQ ID NO: 9435457 - DNA, 22 bp, Homo sapiens
tggctcagtggcagccgcagct

SEQ ID NO: 9435458 - DNA, 22 bp, Homo sapiens
tggctcagtgcattcacagtaa

SEQ ID NO: 9435459 - DNA, 22 bp, Homo sapiens
tggctcagcttacttttgaggg

SEQ ID NO: 9435460 - DNA, 22 bp, Homo sapiens
tggctcagcttacttttgaggg

SEQ ID NO: 9435461 - DNA, 22 bp, Homo sapiens
tggctcagctgtcacagcctgg

SEQ ID NO: 9435462 - DNA, 22 bp, Homo sapiens
tggctcagccagccctaggaac

SEQ ID NO: 9435463 - DNA, 22 bp, Homo sapiens
tggctcagccagccctaggaac

SEQ ID NO: 9435464 - DNA, 22 bp, Homo sapiens
tggctcagccagccctaggaac

SEQ ID NO: 9435465 - DNA, 22 bp, Homo sapiens
tggctcagctgtcacagcctgg

SEQ ID NO: 9435466 - DNA, 22 bp, Homo sapiens
tggctcagctgtcacagcctgg

SEQ ID NO: 9435467 - DNA, 22 bp, Homo sapiens
tggctcagcaggttagaaacta

SEQ ID NO: 9435468 - DNA, 22 bp, Homo sapiens
tggctcagcattcactggtctt

SEQ ID NO: 9435469 - DNA, 22 bp, Homo sapiens
tggctcagcaagacattgacct

SEQ ID NO: 9435470 - DNA, 22 bp, Homo sapiens
tggctcagcaagacattgacct

SEQ ID NO: 9435471 - DNA, 22 bp, Homo sapiens
tggctcagatttttgtaggctt

SEQ ID NO: 9435472 - DNA, 22 bp, Homo sapiens
tggctcagatttttgtaggctt

SEQ ID NO: 9435473 - DNA, 22 bp, Homo sapiens
tggctcaggccacttcttttat

SEQ ID NO: 9435474 - DNA, 22 bp, Homo sapiens
tggctcaggatctaagcagaat

SEQ ID NO: 9435475 - DNA, 22 bp, Homo sapiens
tggctcaggatctaagcagaat

SEQ ID NO: 9435476 - DNA, 22 bp, Homo sapiens
tggctcaggcttgaaaatagat

SEQ ID NO: 9435477 - DNA, 22 bp, Homo sapiens
tggctcaggcttgaaaatagat

SEQ ID NO: 9435478 - DNA, 22 bp, Homo sapiens
tggctcaggcttgaaaatagat

SEQ ID NO: 9435479 - DNA, 22 bp, Homo sapiens
tggctcaggataattttcccaa

SEQ ID NO: 9435480 - DNA, 22 bp, Homo sapiens
tggctcaggataattttcccaa

SEQ ID NO: 9435481 - DNA, 22 bp, Homo sapiens
tggctcaggagggatctttgct

SEQ ID NO: 9435482 - DNA, 22 bp, Homo sapiens
tggctcaggagggatctttgct

SEQ ID NO: 9435483 - DNA, 22 bp, Homo sapiens
tggctcaggagggatctttgct

SEQ ID NO: 9435484 - DNA, 22 bp, Homo sapiens
tggctcagctttccccatctgg

SEQ ID NO: 9435485 - DNA, 22 bp, Homo sapiens
tggctcagctttccccatctgg

SEQ ID NO: 9435486 - DNA, 23 bp, Homo sapiens
tggctccaggagaagccagaagc

SEQ ID NO: 9435487 - DNA, 23 bp, Homo sapiens
tggctccaggagaagccagaagc

SEQ ID NO: 9435488 - DNA, 22 bp, Homo sapiens
tggctccagctcaagtatggca

SEQ ID NO: 9435489 - DNA, 22 bp, Homo sapiens
tggctccagcgtccacgtcctg

SEQ ID NO: 9435490 - DNA, 22 bp, Homo sapiens
tggctccagatttcctgctgca

SEQ ID NO: 9435491 - DNA, 22 bp, Homo sapiens
tggctccagatttcctgctgca

SEQ ID NO: 9435492 - DNA, 22 bp, Homo sapiens
tggctccagccctgagcaagct

SEQ ID NO: 9435493 - DNA, 20 bp, Homo sapiens
tggctccagcctcccctacc

SEQ ID NO: 9435494 - DNA, 22 bp, Homo sapiens
tggctccagccctgagcaagct

SEQ ID NO: 9435495 - DNA, 22 bp, Homo sapiens
tggctccagatttcctgctgca

SEQ ID NO: 9435496 - DNA, 22 bp, Homo sapiens
tggctccagatttcctgctgca

SEQ ID NO: 9435497 - DNA, 22 bp, Homo sapiens
tggctcagttaggtcagaaaca

SEQ ID NO: 9435498 - DNA, 22 bp, Homo sapiens
tggctcagttaggtcagaaaca

SEQ ID NO: 9435499 - DNA, 22 bp, Homo sapiens
tggctcagttccatcatctgga

SEQ ID NO: 9435500 - DNA, 22 bp, Homo sapiens
tggctcagttccatcatctgga

SEQ ID NO: 9435501 - DNA, 22 bp, Homo sapiens
tggctcagttccatcatctgga

SEQ ID NO: 9435502 - DNA, 22 bp, Homo sapiens
tggctcatgcctgtaatcttag

SEQ ID NO: 9435503 - DNA, 22 bp, Homo sapiens
tggctcatggaattagctatta

SEQ ID NO: 9435504 - DNA, 22 bp, Homo sapiens
tggctcattctactctccctgg

SEQ ID NO: 9435505 - DNA, 22 bp, Homo sapiens
tggctcattctactctccctgg

SEQ ID NO: 9435506 - DNA, 22 bp, Homo sapiens
tggctcattctttagaatatac

SEQ ID NO: 9435507 - DNA, 22 bp, Homo sapiens
tggctccaccgccgcggagctc

SEQ ID NO: 9435508 - DNA, 22 bp, Homo sapiens
tggctccacaggccagggtgtg

SEQ ID NO: 9435509 - DNA, 22 bp, Homo sapiens
tggctccaaaaacaaatgacat

SEQ ID NO: 9435510 - DNA, 22 bp, Homo sapiens
tggctcctcacgtcctcagagc

SEQ ID NO: 9435511 - DNA, 22 bp, Homo sapiens
tggctcctcacgtcctcagagc

SEQ ID NO: 9435512 - DNA, 22 bp, Homo sapiens
tggctcctcttctgggtgtccc

SEQ ID NO: 9435513 - DNA, 22 bp, Homo sapiens
tggctcctccctgtgtgtgcgt

SEQ ID NO: 9435514 - DNA, 20 bp, Homo sapiens
tggctcctcttggctgtggc

SEQ ID NO: 9435515 - DNA, 22 bp, Homo sapiens
tggctcctcttctgggtgtccc

SEQ ID NO: 9435516 - DNA, 22 bp, Homo sapiens
tggctcctgcagaccatctgga

SEQ ID NO: 9435517 - DNA, 18 bp, Homo sapiens
tggctcctgcctcctgca

SEQ ID NO: 9435518 - DNA, 18 bp, Homo sapiens
tggctcctgcctcctgca

SEQ ID NO: 9435519 - DNA, 19 bp, Homo sapiens
tggctcctgcctgccttct

SEQ ID NO: 9435520 - DNA, 20 bp, Homo sapiens
tggctcctgcggtggaacca

SEQ ID NO: 9435521 - DNA, 22 bp, Homo sapiens
tggctccatcatccatgcaaga

SEQ ID NO: 9435522 - DNA, 23 bp, Homo sapiens
tggctccaggagaagccagaagc

SEQ ID NO: 9435523 - DNA, 22 bp, Homo sapiens
tggctccaggggacacgcagta

SEQ ID NO: 9435524 - DNA, 22 bp, Homo sapiens
tggctccaggggacacgcagta

SEQ ID NO: 9435525 - DNA, 22 bp, Homo sapiens
tggctccattctttatgagttg

SEQ ID NO: 9435526 - DNA, 22 bp, Homo sapiens
tggctcccacaaactcactact

SEQ ID NO: 9435527 - DNA, 22 bp, Homo sapiens
tggctcccacaaactcactact

SEQ ID NO: 9435528 - DNA, 22 bp, Homo sapiens
tggctcccaaggagctcctgcc

SEQ ID NO: 9435529 - DNA, 22 bp, Homo sapiens
tggctcccaaggagctcctgcc

SEQ ID NO: 9435530 - DNA, 22 bp, Homo sapiens
tggctcccaaggagctcctgcc

SEQ ID NO: 9435531 - DNA, 22 bp, Homo sapiens
tggctcctaggatggtgcctgg

SEQ ID NO: 9435532 - DNA, 22 bp, Homo sapiens
tggctcctatcaaggagtgggt

SEQ ID NO: 9435533 - DNA, 22 bp, Homo sapiens
tggctcccacaaactcactact

SEQ ID NO: 9435534 - DNA, 22 bp, Homo sapiens
tggctcccgcagaccctgtgct

SEQ ID NO: 9435535 - DNA, 22 bp, Homo sapiens
tggctcccgcttgcacctaaga

SEQ ID NO: 9435536 - DNA, 21 bp, Homo sapiens
tggctcccttgaattgtctgt

SEQ ID NO: 9435537 - DNA, 22 bp, Homo sapiens
tggctcccgcttgcacctaaga

SEQ ID NO: 9435538 - DNA, 22 bp, Homo sapiens
tggccttgcccagcgcctaggt

SEQ ID NO: 9435539 - DNA, 22 bp, Homo sapiens
tggcctgtgactgcctctgggc

SEQ ID NO: 9435540 - DNA, 22 bp, Homo sapiens
tggcctgtcactgcccagggct

SEQ ID NO: 9435541 - DNA, 22 bp, Homo sapiens
tggcctgtggcttaaggtctgt

SEQ ID NO: 9435542 - DNA, 22 bp, Homo sapiens
tggcctgtggatcccagctctg

SEQ ID NO: 9435543 - DNA, 22 bp, Homo sapiens
tggcctgtggcatgacctctag

SEQ ID NO: 9435544 - DNA, 22 bp, Homo sapiens
tggcctgtggcacgtgctccat

SEQ ID NO: 9435545 - DNA, 22 bp, Homo sapiens
tggccttcctggtgactcatga

SEQ ID NO: 9435546 - DNA, 22 bp, Homo sapiens
tggccttcctggtgactcatga

SEQ ID NO: 9435547 - DNA, 22 bp, Homo sapiens
tggccttgtctctcagaaccgc

SEQ ID NO: 9435548 - DNA, 22 bp, Homo sapiens
tggcgagctttgttctccagga

SEQ ID NO: 9435549 - DNA, 22 bp, Homo sapiens
tggcgcagtttctctgctgcct

SEQ ID NO: 9435550 - DNA, 22 bp, Homo sapiens
tggcgcagtttctctgctgcct

SEQ ID NO: 9435551 - DNA, 22 bp, Homo sapiens
tggcgaggtttcagagagcggc

SEQ ID NO: 9435552 - DNA, 22 bp, Homo sapiens
tggcgaggtttcagagagcggc

SEQ ID NO: 9435553 - DNA, 22 bp, Homo sapiens
tggcctggtgctcaggcagtag

SEQ ID NO: 9435554 - DNA, 22 bp, Homo sapiens
tggcctggtccttgtcaaggca

SEQ ID NO: 9435555 - DNA, 22 bp, Homo sapiens
tggcctggtgctcaggcagtag

SEQ ID NO: 9435556 - DNA, 22 bp, Homo sapiens
tggcctggtgtctgcgaggcct

SEQ ID NO: 9435557 - DNA, 22 bp, Homo sapiens
tggcctggtgtctgcgaggcct

SEQ ID NO: 9435558 - DNA, 22 bp, Homo sapiens
tggcctggtgtctgcgaggcct

SEQ ID NO: 9435559 - DNA, 22 bp, Homo sapiens
tggcctggtgtctgcgaggcct

SEQ ID NO: 9435560 - DNA, 22 bp, Homo sapiens
tggcctggttgttgctgccgtt

SEQ ID NO: 9435561 - DNA, 22 bp, Homo sapiens
tggcctggttgttgctgccgtt

SEQ ID NO: 9435562 - DNA, 22 bp, Homo sapiens
tggcctggttgttgctgccgtt

SEQ ID NO: 9435563 - DNA, 22 bp, Homo sapiens
tggcctgtcactgcccagggct

SEQ ID NO: 9435564 - DNA, 22 bp, Homo sapiens
tggcctggttgttgctgccgtt

SEQ ID NO: 9435565 - DNA, 22 bp, Homo sapiens
tggcctgggtgctgctgacatc

SEQ ID NO: 9435566 - DNA, 22 bp, Homo sapiens
tggcctggtaccacatagattt

SEQ ID NO: 9435567 - DNA, 22 bp, Homo sapiens
tggcctggctcacagtgagatt

SEQ ID NO: 9435568 - DNA, 22 bp, Homo sapiens
tggcctggccctgaggccctgt

SEQ ID NO: 9435569 - DNA, 22 bp, Homo sapiens
tggcctggccctgaggccctgt

SEQ ID NO: 9435570 - DNA, 20 bp, Homo sapiens
tggcggggatgagggagtta

SEQ ID NO: 9435571 - DNA, 22 bp, Homo sapiens
tggcgtctctcataagtatgtg

SEQ ID NO: 9435572 - DNA, 20 bp, Homo sapiens
tggcggggatgagggagtta

SEQ ID NO: 9435573 - DNA, 22 bp, Homo sapiens
tggcgtgccctccagacttggc

SEQ ID NO: 9435574 - DNA, 22 bp, Homo sapiens
tggctaaacttgggtcagatgt

SEQ ID NO: 9435575 - DNA, 22 bp, Homo sapiens
tggcggagttccagctgggatc

SEQ ID NO: 9435576 - DNA, 22 bp, Homo sapiens
tggcggagttccagctgggatc

SEQ ID NO: 9435577 - DNA, 22 bp, Homo sapiens
tggcggctcaggaggggcagtt

SEQ ID NO: 9435578 - DNA, 21 bp, Homo sapiens
tggcggggacttgtggctgcc

SEQ ID NO: 9435579 - DNA, 22 bp, Homo sapiens
tggctcagaactacttctagtt

SEQ ID NO: 9435580 - DNA, 22 bp, Homo sapiens
tggctcagaactacttctagtt

SEQ ID NO: 9435581 - DNA, 22 bp, Homo sapiens
tggctcagaagaaaaggtaaac

SEQ ID NO: 9435582 - DNA, 22 bp, Homo sapiens
tggctcagaagaaaaggtaaac

SEQ ID NO: 9435583 - DNA, 22 bp, Homo sapiens
tggctcactgtagccttgacct

SEQ ID NO: 9435584 - DNA, 22 bp, Homo sapiens
tggctcacttccgtggagaggt

SEQ ID NO: 9435585 - DNA, 22 bp, Homo sapiens
tggctcacttccgtggagaggt

SEQ ID NO: 9435586 - DNA, 22 bp, Homo sapiens
tggctcagaactacttctagtt

SEQ ID NO: 9435587 - DNA, 22 bp, Homo sapiens
tggctcagaactacttctagtt

SEQ ID NO: 9435588 - DNA, 22 bp, Homo sapiens
tggctcacaatctcccatgaag

SEQ ID NO: 9435589 - DNA, 22 bp, Homo sapiens
tggctcacaatctcccatgaag

SEQ ID NO: 9435590 - DNA, 22 bp, Homo sapiens
tggctcacaggactctctgggc

SEQ ID NO: 9435591 - DNA, 22 bp, Homo sapiens
tggctcaccttcagaatatacc

SEQ ID NO: 9435592 - DNA, 22 bp, Homo sapiens
tggctcactgtagccttgacct

SEQ ID NO: 9435593 - DNA, 22 bp, Homo sapiens
tggctatgcaaacctgaggctg

SEQ ID NO: 9435594 - DNA, 22 bp, Homo sapiens
tggctatactctcagttaatac

SEQ ID NO: 9435595 - DNA, 22 bp, Homo sapiens
tggctcagataattcaaggggc

SEQ ID NO: 9435596 - DNA, 22 bp, Homo sapiens
tggctcagataattcaaggggc

SEQ ID NO: 9435597 - DNA, 22 bp, Homo sapiens
tggctcagagttcatcttttag

SEQ ID NO: 9435598 - DNA, 22 bp, Homo sapiens
tggctcagaggggaagtggttt

SEQ ID NO: 9435599 - DNA, 18 bp, Homo sapiens
tggctcagatggctttaa

SEQ ID NO: 9435600 - DNA, 22 bp, Homo sapiens
tggctcagatttttgtaggctt

SEQ ID NO: 9435601 - DNA, 22 bp, Homo sapiens
tggctcagatgctcttccagtg

SEQ ID NO: 9435602 - DNA, 22 bp, Homo sapiens
tggctcagaaggctgccttcac

SEQ ID NO: 9435603 - DNA, 22 bp, Homo sapiens
tggctcagaaggctgccttcac

SEQ ID NO: 9435604 - DNA, 22 bp, Homo sapiens
tggctcagagagggagtgtgga

SEQ ID NO: 9435605 - DNA, 22 bp, Homo sapiens
tggctcagagagggagtgtgga

SEQ ID NO: 9435606 - DNA, 22 bp, Homo sapiens
tggctcagaaggctgccttcac

SEQ ID NO: 9435607 - DNA, 22 bp, Homo sapiens
tggctcagaaggctgccttcac

SEQ ID NO: 9435608 - DNA, 22 bp, Homo sapiens
tggctcagagccttgagagctg

SEQ ID NO: 9435609 - DNA, 22 bp, Homo sapiens
tggctcagagccttgagagctg

SEQ ID NO: 9435610 - DNA, 22 bp, Homo sapiens
tggctcagagccttgagagctg

SEQ ID NO: 9435611 - DNA, 22 bp, Homo sapiens
tggctcagagcagggactctgg

SEQ ID NO: 9435612 - DNA, 22 bp, Homo sapiens
tggctgagttcctggcacacgg

SEQ ID NO: 9435613 - DNA, 22 bp, Homo sapiens
tggctgagttacgaacagagca

SEQ ID NO: 9435614 - DNA, 22 bp, Homo sapiens
tggctgagtgttccaaggagca

SEQ ID NO: 9435615 - DNA, 22 bp, Homo sapiens
tggctgagttacgaacagagca

SEQ ID NO: 9435616 - DNA, 22 bp, Homo sapiens
tggctgagttcctggcacacgg

SEQ ID NO: 9435617 - DNA, 22 bp, Homo sapiens
tggctgagttacgaacagagca

SEQ ID NO: 9435618 - DNA, 22 bp, Homo sapiens
tggctgagttcctggcacacgg

SEQ ID NO: 9435619 - DNA, 22 bp, Homo sapiens
tggctgagttctccaggagtag

SEQ ID NO: 9435620 - DNA, 22 bp, Homo sapiens
tggctgagtgatatttgcaaag

SEQ ID NO: 9435621 - DNA, 21 bp, Homo sapiens
tggctgagtggatgcatgaat

SEQ ID NO: 9435622 - DNA, 21 bp, Homo sapiens
tggctgagtggatgcatgaat

SEQ ID NO: 9435623 - DNA, 22 bp, Homo sapiens
tggctgagtgttccaaggagca

SEQ ID NO: 9435624 - DNA, 22 bp, Homo sapiens
tggctgagtgttccaaggagca

SEQ ID NO: 9435625 - DNA, 22 bp, Homo sapiens
tggctgagtttcatgcatcatg

SEQ ID NO: 9435626 - DNA, 22 bp, Homo sapiens
tggctgagttctccaggagtag

SEQ ID NO: 9435627 - DNA, 21 bp, Homo sapiens
tggctgcaagcagctgcctcc

SEQ ID NO: 9435628 - DNA, 22 bp, Homo sapiens
tggctgcagacacctatggcag

SEQ ID NO: 9435629 - DNA, 22 bp, Homo sapiens
tggctgcagaacctcctcagga

SEQ ID NO: 9435630 - DNA, 22 bp, Homo sapiens
tggctgcagatcaagggcaggc

SEQ ID NO: 9435631 - DNA, 22 bp, Homo sapiens
tggctgcagatcaagggcaggc

SEQ ID NO: 9435632 - DNA, 22 bp, Homo sapiens
tggctgcagatcaagggcaggc

SEQ ID NO: 9435633 - DNA, 22 bp, Homo sapiens
tggctggaagtcagaaatggga

SEQ ID NO: 9435634 - DNA, 22 bp, Homo sapiens
tggctggaaacaggagattcag

SEQ ID NO: 9435635 - DNA, 22 bp, Homo sapiens
tggctggaatatgtggagacca

SEQ ID NO: 9435636 - DNA, 21 bp, Homo sapiens
tggctgctggccctctctcca

SEQ ID NO: 9435637 - DNA, 18 bp, Homo sapiens
tggctgctggagtagggt

SEQ ID NO: 9435638 - DNA, 18 bp, Homo sapiens
tggctgctggagtagggt

SEQ ID NO: 9435639 - DNA, 22 bp, Homo sapiens
tggctgctgcttggtcttcttc

SEQ ID NO: 9435640 - DNA, 22 bp, Homo sapiens
tggctgctgcagacagacagga

SEQ ID NO: 9435641 - DNA, 22 bp, Homo sapiens
tggctgctgcagacagacagga

SEQ ID NO: 9435642 - DNA, 22 bp, Homo sapiens
tggctgctgagaaggcagctgt

SEQ ID NO: 9435643 - DNA, 22 bp, Homo sapiens
tggctgctgagaaggcagctgt

SEQ ID NO: 9435644 - DNA, 22 bp, Homo sapiens
tggctgcagttcacaggagcaa

SEQ ID NO: 9435645 - DNA, 22 bp, Homo sapiens
tggctgcagtgcttgagatgtc

SEQ ID NO: 9435646 - DNA, 22 bp, Homo sapiens
tggctgcagtgcttgagatgtc

SEQ ID NO: 9435647 - DNA, 22 bp, Homo sapiens
tggctgcagatctgtgggacac

SEQ ID NO: 9435648 - DNA, 22 bp, Homo sapiens
tggctgccaatggcttggaaag

SEQ ID NO: 9435649 - DNA, 22 bp, Homo sapiens
tggctgccaagcaggtcagaga

SEQ ID NO: 9435650 - DNA, 22 bp, Homo sapiens
tggctgccatgacgcctgggga

SEQ ID NO: 9435651 - DNA, 22 bp, Homo sapiens
tggctgccccctcccgtggaca

SEQ ID NO: 9435652 - DNA, 22 bp, Homo sapiens
tggctgccatgacgcctgggga

SEQ ID NO: 9435653 - DNA, 22 bp, Homo sapiens
tggctgccagctcctcgccttg

SEQ ID NO: 9435654 - DNA, 22 bp, Homo sapiens
tggctgccatgacgcctgggga

SEQ ID NO: 9435655 - DNA, 20 bp, Homo sapiens
tggctgcccgaggcacacac

SEQ ID NO: 9435656 - DNA, 22 bp, Homo sapiens
tggctgctgagaaggcagctgt

SEQ ID NO: 9435657 - DNA, 22 bp, Homo sapiens
tggctgaggctggagtgcagtg

SEQ ID NO: 9435658 - DNA, 22 bp, Homo sapiens
tggctgaggctggagtgcagtg

SEQ ID NO: 9435659 - DNA, 22 bp, Homo sapiens
tggctgaggcacagctgccgcc

SEQ ID NO: 9435660 - DNA, 22 bp, Homo sapiens
tggctgagggcactatgaagcc

SEQ ID NO: 9435661 - DNA, 22 bp, Homo sapiens
tggctgagggcactatgaagcc

SEQ ID NO: 9435662 - DNA, 22 bp, Homo sapiens
tggctgaggctggagtgcagtg

SEQ ID NO: 9435663 - DNA, 22 bp, Homo sapiens
tggctgaggctggagtgcagtg

SEQ ID NO: 9435664 - DNA, 22 bp, Homo sapiens
tggctgaggcttttcttaaaga

SEQ ID NO: 9435665 - DNA, 22 bp, Homo sapiens
tggctgaggctggagtgcagtg

SEQ ID NO: 9435666 - DNA, 22 bp, Homo sapiens
tggctgaggtctggggcttctg

SEQ ID NO: 9435667 - DNA, 22 bp, Homo sapiens
tggctgaggttatgctggttgt

SEQ ID NO: 9435668 - DNA, 22 bp, Homo sapiens
tggctgaggttatgctggttgt

SEQ ID NO: 9435669 - DNA, 22 bp, Homo sapiens
tggctgaggttatgctggttgt

SEQ ID NO: 9435670 - DNA, 22 bp, Homo sapiens
tggctgagtgaacatgtccatt

SEQ ID NO: 9435671 - DNA, 22 bp, Homo sapiens
tggctgagtaagttgtgatatg

SEQ ID NO: 9435672 - DNA, 22 bp, Homo sapiens
tggctgagctgcagcgtggctt

SEQ ID NO: 9435673 - DNA, 22 bp, Homo sapiens
tggctgagctgcagcgtggctt

SEQ ID NO: 9435674 - DNA, 19 bp, Homo sapiens
tggctgagctggactgagg

SEQ ID NO: 9435675 - DNA, 22 bp, Homo sapiens
tggctgagctccctgtgtgttg

SEQ ID NO: 9435676 - DNA, 22 bp, Homo sapiens
tggctgagcctttggggctttc

SEQ ID NO: 9435677 - DNA, 22 bp, Homo sapiens
tggctgagctgcagcgtggctt

SEQ ID NO: 9435678 - DNA, 22 bp, Homo sapiens
tggctgagctgcagcgtggctt

SEQ ID NO: 9435679 - DNA, 22 bp, Homo sapiens
tggctgaggcacagctgccgcc

SEQ ID NO: 9435680 - DNA, 22 bp, Homo sapiens
tggctgaggcacagctgccgcc

SEQ ID NO: 9435681 - DNA, 22 bp, Homo sapiens
tggctgaggagggtcttctggt

SEQ ID NO: 9435682 - DNA, 22 bp, Homo sapiens
tggctgaggagggtcttctggt

SEQ ID NO: 9435683 - DNA, 22 bp, Homo sapiens
tggctgaggagggtcttctggt

SEQ ID NO: 9435684 - DNA, 22 bp, Homo sapiens
tggctgaggagagggcggaagt

SEQ ID NO: 9435685 - DNA, 22 bp, Homo sapiens
tggctgaggagagggcggaagt

SEQ ID NO: 9435686 - DNA, 22 bp, Homo sapiens
tggctgagaaaaaagagctata

SEQ ID NO: 9435687 - DNA, 22 bp, Homo sapiens
tggctgagaaaaaagagctata

SEQ ID NO: 9435688 - DNA, 22 bp, Homo sapiens
tggctgagaaaatggttttagg

SEQ ID NO: 9435689 - DNA, 22 bp, Homo sapiens
tggctgagaaaaaagagctata

SEQ ID NO: 9435690 - DNA, 22 bp, Homo sapiens
tggctgagaagttctggtggga

SEQ ID NO: 9435691 - DNA, 22 bp, Homo sapiens
tggctgagaagttctggtggga

SEQ ID NO: 9435692 - DNA, 22 bp, Homo sapiens
tggctgagaagttctggtggga

SEQ ID NO: 9435693 - DNA, 22 bp, Homo sapiens
tggctgaataaaatatggtgtt

SEQ ID NO: 9435694 - DNA, 23 bp, Homo sapiens
tggctgagatcctactgtttgct

SEQ ID NO: 9435695 - DNA, 22 bp, Homo sapiens
tggctgagccacttgttcagat

SEQ ID NO: 9435696 - DNA, 22 bp, Homo sapiens
tggctgagccacttgttcagat

SEQ ID NO: 9435697 - DNA, 22 bp, Homo sapiens
tggctgagagtcatcctgtgtg

SEQ ID NO: 9435698 - DNA, 22 bp, Homo sapiens
tggctgagagtcatcctgtgtg

SEQ ID NO: 9435699 - DNA, 21 bp, Homo sapiens
tggctgagccaggtgtgtgga

SEQ ID NO: 9435700 - DNA, 22 bp, Homo sapiens
tggctgagccacttgttcagat

SEQ ID NO: 9435701 - DNA, 22 bp, Homo sapiens
tggctgagcctttggggctttc

SEQ ID NO: 9435702 - DNA, 22 bp, Homo sapiens
tggctgagcctttggggctttc

SEQ ID NO: 9435703 - DNA, 23 bp, Homo sapiens
tggctgagcccactatcttggcc

SEQ ID NO: 9435704 - DNA, 23 bp, Homo sapiens
tggctgagcccactatcttggcc

SEQ ID NO: 9435705 - DNA, 22 bp, Homo sapiens
tggctctgttcgccatcaggag

SEQ ID NO: 9435706 - DNA, 22 bp, Homo sapiens
tggctctgttcgccatcaggag

SEQ ID NO: 9435707 - DNA, 22 bp, Homo sapiens
tggctctgttcgccatcaggag

SEQ ID NO: 9435708 - DNA, 22 bp, Homo sapiens
tggctctgttgtaaagaaattt

SEQ ID NO: 9435709 - DNA, 22 bp, Homo sapiens
tggctctgttgtaaagaaattt

SEQ ID NO: 9435710 - DNA, 22 bp, Homo sapiens
tggctctgttgctcgcagtttt

SEQ ID NO: 9435711 - DNA, 22 bp, Homo sapiens
tggctctgttgaggtatggatt

SEQ ID NO: 9435712 - DNA, 22 bp, Homo sapiens
tggctctgttgctcgcagtttt

SEQ ID NO: 9435713 - DNA, 22 bp, Homo sapiens
tggctctgtgtctcccagcagc

SEQ ID NO: 9435714 - DNA, 23 bp, Homo sapiens
tggctctgtgtcacatacaggat

SEQ ID NO: 9435715 - DNA, 23 bp, Homo sapiens
tggctctgtgtcacatacaggat

SEQ ID NO: 9435716 - DNA, 23 bp, Homo sapiens
tggctctgtgtcacatacaggat

SEQ ID NO: 9435717 - DNA, 22 bp, Homo sapiens
tggctctgtgtctcccagcagc

SEQ ID NO: 9435718 - DNA, 22 bp, Homo sapiens
tggctctgtgtctcccagcagc

SEQ ID NO: 9435719 - DNA, 22 bp, Homo sapiens
tggctctgttcgccatcaggag

SEQ ID NO: 9435720 - DNA, 22 bp, Homo sapiens
tggctctgttcgccatcaggag

SEQ ID NO: 9435721 - DNA, 22 bp, Homo sapiens
tggctcttttcacgtcccctct

SEQ ID NO: 9435722 - DNA, 22 bp, Homo sapiens
tggctctttctgtctgggatcc

SEQ ID NO: 9435723 - DNA, 22 bp, Homo sapiens
tggctctgtttgttaactagac

SEQ ID NO: 9435724 - DNA, 22 bp, Homo sapiens
tggctctgtttgttaactagac

SEQ ID NO: 9435725 - DNA, 22 bp, Homo sapiens
tggctcttaaggtccctgtgct

SEQ ID NO: 9435726 - DNA, 22 bp, Homo sapiens
tggctcttaaggtccctgtgct

SEQ ID NO: 9435727 - DNA, 22 bp, Homo sapiens
tggctctgttgtgctgagccag

SEQ ID NO: 9435728 - DNA, 22 bp, Homo sapiens
tggctctgttgtgctgagccag

SEQ ID NO: 9435729 - DNA, 22 bp, Homo sapiens
tggctctgttgtgctgagccag

SEQ ID NO: 9435730 - DNA, 19 bp, Homo sapiens
tggctctgtttctctggag

SEQ ID NO: 9435731 - DNA, 22 bp, Homo sapiens
tggctctgttgtgctgagccag

SEQ ID NO: 9435732 - DNA, 19 bp, Homo sapiens
tggctctgtttctctggag

SEQ ID NO: 9435733 - DNA, 22 bp, Homo sapiens
tggctctggattaatctaggaa

SEQ ID NO: 9435734 - DNA, 22 bp, Homo sapiens
tggctctggagctggcggctga

SEQ ID NO: 9435735 - DNA, 22 bp, Homo sapiens
tggctctggattaatctaggaa

SEQ ID NO: 9435736 - DNA, 22 bp, Homo sapiens
tggctctggcgtgaagcccaga

SEQ ID NO: 9435737 - DNA, 22 bp, Homo sapiens
tggctctggccaccgggagggc

SEQ ID NO: 9435738 - DNA, 22 bp, Homo sapiens
tggctctgggaatgggaagatg

SEQ ID NO: 9435739 - DNA, 22 bp, Homo sapiens
tggctctgggaatgggaagatg

SEQ ID NO: 9435740 - DNA, 22 bp, Homo sapiens
tggctctggggacagtaagtcc

SEQ ID NO: 9435741 - DNA, 22 bp, Homo sapiens
tggctctgggaatctgttgctt

SEQ ID NO: 9435742 - DNA, 22 bp, Homo sapiens
tggctctgggaatctgttgctt

SEQ ID NO: 9435743 - DNA, 22 bp, Homo sapiens
tggctctggcgtgaagcccaga

SEQ ID NO: 9435744 - DNA, 22 bp, Homo sapiens
tggctctgtgcttctagtatct

SEQ ID NO: 9435745 - DNA, 22 bp, Homo sapiens
tggctctgtgcttctagtatct

SEQ ID NO: 9435746 - DNA, 22 bp, Homo sapiens
tggctctgtgcttctagtatct

SEQ ID NO: 9435747 - DNA, 22 bp, Homo sapiens
tggctctgtgaacagacgactg

SEQ ID NO: 9435748 - DNA, 22 bp, Homo sapiens
tggctctgtgcttctagtatct

SEQ ID NO: 9435749 - DNA, 22 bp, Homo sapiens
tggctctggggacagtaagtcc

SEQ ID NO: 9435750 - DNA, 19 bp, Homo sapiens
tggctctgtcgaaggcaca

SEQ ID NO: 9435751 - DNA, 22 bp, Homo sapiens
tggctctgtcgccgtttggaat

SEQ ID NO: 9435752 - DNA, 22 bp, Homo sapiens
tggctctgtcgccgtttggaat

SEQ ID NO: 9435753 - DNA, 22 bp, Homo sapiens
tggctctgtgaacagacgactg

SEQ ID NO: 9435754 - DNA, 22 bp, Homo sapiens
tggctctgtggatgttctgacc

SEQ ID NO: 9435755 - DNA, 22 bp, Homo sapiens
tggctctgtggatgttctgacc

SEQ ID NO: 9435756 - DNA, 22 bp, Homo sapiens
tggctctgtggatgttctgacc

SEQ ID NO: 9435757 - DNA, 22 bp, Homo sapiens
tggctctgtggtcttagcatgc

SEQ ID NO: 9435758 - DNA, 23 bp, Homo sapiens
tggctctgtggatccctcaggag

SEQ ID NO: 9435759 - DNA, 23 bp, Homo sapiens
tggctctgtggatccctcaggag

SEQ ID NO: 9435760 - DNA, 23 bp, Homo sapiens
tggctctgtggatccctcaggag

SEQ ID NO: 9435761 - DNA, 22 bp, Homo sapiens
tggctctgtggatgttctgacc

SEQ ID NO: 9435762 - DNA, 23 bp, Homo sapiens
tggctctgtggatccctcaggag

SEQ ID NO: 9435763 - DNA, 22 bp, Homo sapiens
tggctctgccacctttccctaa

SEQ ID NO: 9435764 - DNA, 18 bp, Homo sapiens
tggctctgcagccagatg

SEQ ID NO: 9435765 - DNA, 18 bp, Homo sapiens
tggctctgcagccagatg

SEQ ID NO: 9435766 - DNA, 22 bp, Homo sapiens
tggctctgccccatacccctgc

SEQ ID NO: 9435767 - DNA, 18 bp, Homo sapiens
tggctctgccactcaccg

SEQ ID NO: 9435768 - DNA, 22 bp, Homo sapiens
tggctctgatcagatgtccagt

SEQ ID NO: 9435769 - DNA, 22 bp, Homo sapiens
tggctctgatcagatgtccagt

SEQ ID NO: 9435770 - DNA, 22 bp, Homo sapiens
tggctctgcacctcagtgtacc

SEQ ID NO: 9435771 - DNA, 18 bp, Homo sapiens
tggctctgcagccagatg

SEQ ID NO: 9435772 - DNA, 22 bp, Homo sapiens
tggctctgcacctcagtgtacc

SEQ ID NO: 9435773 - DNA, 22 bp, Homo sapiens
tggctctgcagcagtgtgcgtg

SEQ ID NO: 9435774 - DNA, 22 bp, Homo sapiens
tggctctgcacctcagtgtacc

SEQ ID NO: 9435775 - DNA, 21 bp, Homo sapiens
tggctctgctcagagcagtcc

SEQ ID NO: 9435776 - DNA, 21 bp, Homo sapiens
tggctctgctcagagcagtcc

SEQ ID NO: 9435777 - DNA, 21 bp, Homo sapiens
tggctctgctcagagcagtcc

SEQ ID NO: 9435778 - DNA, 21 bp, Homo sapiens
tggctctgctcagagcagtcc

SEQ ID NO: 9435779 - DNA, 22 bp, Homo sapiens
tggctctgcgtctgttcgtggg

SEQ ID NO: 9435780 - DNA, 21 bp, Homo sapiens
tggctctgctcagagcagtcc

SEQ ID NO: 9435781 - DNA, 22 bp, Homo sapiens
tggctctgccccatacccctgc

SEQ ID NO: 9435782 - DNA, 22 bp, Homo sapiens
tggctctgcgtctgttcgtggg

SEQ ID NO: 9435783 - DNA, 22 bp, Homo sapiens
tggctctggagctcctgggccc

SEQ ID NO: 9435784 - DNA, 22 bp, Homo sapiens
tggctctggagctcctgggccc

SEQ ID NO: 9435785 - DNA, 22 bp, Homo sapiens
tggctctggagctcctgggccc

SEQ ID NO: 9435786 - DNA, 22 bp, Homo sapiens
tggctctgctgaacctagtgca

SEQ ID NO: 9435787 - DNA, 22 bp, Homo sapiens
tggctctgctgaacctagtgca

SEQ ID NO: 9435788 - DNA, 22 bp, Homo sapiens
tggctctgctgaacctagtgca

SEQ ID NO: 9435789 - DNA, 22 bp, Homo sapiens
tggctccttcattctcctgcca

SEQ ID NO: 9435790 - DNA, 22 bp, Homo sapiens
tggctccttcattctcctgcca

SEQ ID NO: 9435791 - DNA, 22 bp, Homo sapiens
tggctccttcattctcctgcca

SEQ ID NO: 9435792 - DNA, 20 bp, Homo sapiens
tggctcctggctcctccctc

SEQ ID NO: 9435793 - DNA, 20 bp, Homo sapiens
tggctcctggctcctccctc

SEQ ID NO: 9435794 - DNA, 21 bp, Homo sapiens
tggctcgatttatagcatttc

SEQ ID NO: 9435795 - DNA, 22 bp, Homo sapiens
tggctcggccacctgccagcca

SEQ ID NO: 9435796 - DNA, 20 bp, Homo sapiens
tggctctcaccctgtgcgat

SEQ ID NO: 9435797 - DNA, 22 bp, Homo sapiens
tggctctcaatggctgtactat

SEQ ID NO: 9435798 - DNA, 22 bp, Homo sapiens
tggctctcaatggctgtactat

SEQ ID NO: 9435799 - DNA, 20 bp, Homo sapiens
tggctctcaccctgtgcgat

SEQ ID NO: 9435800 - DNA, 20 bp, Homo sapiens
tggctctcaccctgtgcgat

SEQ ID NO: 9435801 - DNA, 22 bp, Homo sapiens
tggctctgagacacaggctctc

SEQ ID NO: 9435802 - DNA, 23 bp, Homo sapiens
tggctctgagaggttcagatgct

SEQ ID NO: 9435803 - DNA, 22 bp, Homo sapiens
tggctctgagacacaggctctc

SEQ ID NO: 9435804 - DNA, 23 bp, Homo sapiens
tggctctgagaggttcagatgct

SEQ ID NO: 9435805 - DNA, 21 bp, Homo sapiens
tggctctgagcctcatggctg

SEQ ID NO: 9435806 - DNA, 22 bp, Homo sapiens
tggctctgagctgcaaagctgc

SEQ ID NO: 9435807 - DNA, 21 bp, Homo sapiens
tggctctgagcctcatggctg

SEQ ID NO: 9435808 - DNA, 17 bp, Homo sapiens
tggctctgaggctgaat

SEQ ID NO: 9435809 - DNA, 22 bp, Homo sapiens
tggctctgagtctgcccttggc

SEQ ID NO: 9435810 - DNA, 17 bp, Homo sapiens
tggctctgaggctgaat

SEQ ID NO: 9435811 - DNA, 22 bp, Homo sapiens
tggctctgagctgcaaagctgc

SEQ ID NO: 9435812 - DNA, 23 bp, Homo sapiens
tggctctgagcttcctggtggcc

SEQ ID NO: 9435813 - DNA, 22 bp, Homo sapiens
tggcagaggaaaaagtcactgg

SEQ ID NO: 9435814 - DNA, 22 bp, Homo sapiens
tggcagaggaaaaagtcactgg

SEQ ID NO: 9435815 - DNA, 22 bp, Homo sapiens
tggcagaggtatattgggagga

SEQ ID NO: 9435816 - DNA, 22 bp, Homo sapiens
tggcagaggtatattgggagga

SEQ ID NO: 9435817 - DNA, 22 bp, Homo sapiens
tggcagagccttgccaaactcc

SEQ ID NO: 9435818 - DNA, 22 bp, Homo sapiens
tggcagagctggctgcggatga

SEQ ID NO: 9435819 - DNA, 22 bp, Homo sapiens
tggcagagctggctgcggatga

SEQ ID NO: 9435820 - DNA, 22 bp, Homo sapiens
tggcagagcaaaaagatagaat

SEQ ID NO: 9435821 - DNA, 22 bp, Homo sapiens
tggcagagcaaaaagatagaat

SEQ ID NO: 9435822 - DNA, 22 bp, Homo sapiens
tggcagagatgaagagttgttt

SEQ ID NO: 9435823 - DNA, 22 bp, Homo sapiens
tggcagagcccagaactgagca

SEQ ID NO: 9435824 - DNA, 22 bp, Homo sapiens
tggcagagcccagaactgagca

SEQ ID NO: 9435825 - DNA, 22 bp, Homo sapiens
tggcagagcccagactccagtc

SEQ ID NO: 9435826 - DNA, 22 bp, Homo sapiens
tggcagagcccagactccagtc

SEQ ID NO: 9435827 - DNA, 22 bp, Homo sapiens
tggcagagagactctccttgat

SEQ ID NO: 9435828 - DNA, 22 bp, Homo sapiens
tggcagagagactctccttgat

SEQ ID NO: 9435829 - DNA, 22 bp, Homo sapiens
tggcagagagagtgcagtcgac

SEQ ID NO: 9435830 - DNA, 22 bp, Homo sapiens
tggcagagagagtgcagtcgac

SEQ ID NO: 9435831 - DNA, 22 bp, Homo sapiens
tggcagagactcctcctgggag

SEQ ID NO: 9435832 - DNA, 22 bp, Homo sapiens
tggcagagagactctccttgat

SEQ ID NO: 9435833 - DNA, 22 bp, Homo sapiens
tggcagagacaaggccgggcct

SEQ ID NO: 9435834 - DNA, 22 bp, Homo sapiens
tggcagagacaaggccgggcct

SEQ ID NO: 9435835 - DNA, 23 bp, Homo sapiens
tggcagagacccagaatctacat

SEQ ID NO: 9435836 - DNA, 22 bp, Homo sapiens
tggcagagacaaggccgggcct

SEQ ID NO: 9435837 - DNA, 22 bp, Homo sapiens
tggcactgcctggcagggcccc

SEQ ID NO: 9435838 - DNA, 21 bp, Homo sapiens
tggcactgcttagcaggttcc

SEQ ID NO: 9435839 - DNA, 22 bp, Homo sapiens
tggcactggaatcgtagccttg

SEQ ID NO: 9435840 - DNA, 22 bp, Homo sapiens
tggcactggaatcgtagccttg

SEQ ID NO: 9435841 - DNA, 22 bp, Homo sapiens
tggcactggaatcgtagccttg

SEQ ID NO: 9435842 - DNA, 22 bp, Homo sapiens
tggcactgaccccaggcctgtg

SEQ ID NO: 9435843 - DNA, 22 bp, Homo sapiens
tggcactgccaacctgctaggt

SEQ ID NO: 9435844 - DNA, 22 bp, Homo sapiens
tggcactgccaacctgctaggt

SEQ ID NO: 9435845 - DNA, 22 bp, Homo sapiens
tggcacttagatcaggttgggt

SEQ ID NO: 9435846 - DNA, 22 bp, Homo sapiens
tggcactgtggatttcacaagt

SEQ ID NO: 9435847 - DNA, 22 bp, Homo sapiens
tggcacttagcagggaaggtgt

SEQ ID NO: 9435848 - DNA, 22 bp, Homo sapiens
tggcacttccactgtggctgct

SEQ ID NO: 9435849 - DNA, 22 bp, Homo sapiens
tggcacttccactgtggctgct

SEQ ID NO: 9435850 - DNA, 22 bp, Homo sapiens
tggcactgggacagatgctctc

SEQ ID NO: 9435851 - DNA, 22 bp, Homo sapiens
tggcactgggatgctactgtta

SEQ ID NO: 9435852 - DNA, 22 bp, Homo sapiens
tggcactgtagccactactgcc

SEQ ID NO: 9435853 - DNA, 22 bp, Homo sapiens
tggcactgggatgctactgtta

SEQ ID NO: 9435854 - DNA, 22 bp, Homo sapiens
tggcactgtcaccaatgctgtc

SEQ ID NO: 9435855 - DNA, 22 bp, Homo sapiens
tggcactgaagctggaaagcct

SEQ ID NO: 9435856 - DNA, 22 bp, Homo sapiens
tggcactgaagctggaaagcct

SEQ ID NO: 9435857 - DNA, 22 bp, Homo sapiens
tggcactgaagctggaaagcct

SEQ ID NO: 9435858 - DNA, 22 bp, Homo sapiens
tggcactgaaaaaggagaggtt

SEQ ID NO: 9435859 - DNA, 22 bp, Homo sapiens
tggcactgaaaaaggagaggtt

SEQ ID NO: 9435860 - DNA, 22 bp, Homo sapiens
tggcacgacaattggcaccaat

SEQ ID NO: 9435861 - DNA, 22 bp, Homo sapiens
tggcacctggtgcagggtggcc

SEQ ID NO: 9435862 - DNA, 22 bp, Homo sapiens
tggcacgacaattggcaccaat

SEQ ID NO: 9435863 - DNA, 22 bp, Homo sapiens
tggcaccatgttggcaaatgtt

SEQ ID NO: 9435864 - DNA, 22 bp, Homo sapiens
tggcacatagtaggtgctcaat

SEQ ID NO: 9435865 - DNA, 22 bp, Homo sapiens
tggcacagttaaagttgtagaa

SEQ ID NO: 9435866 - DNA, 22 bp, Homo sapiens
tggcacagttaaagttgtagaa

SEQ ID NO: 9435867 - DNA, 22 bp, Homo sapiens
tggcacatggttaatcataatt

SEQ ID NO: 9435868 - DNA, 22 bp, Homo sapiens
tggcacatccacagaatctgga

SEQ ID NO: 9435869 - DNA, 23 bp, Homo sapiens
tggcaccaggcattctaggggta

SEQ ID NO: 9435870 - DNA, 22 bp, Homo sapiens
tggcaccagggaacaagcattt

SEQ ID NO: 9435871 - DNA, 22 bp, Homo sapiens
tggcaccaccagacaccaggag

SEQ ID NO: 9435872 - DNA, 22 bp, Homo sapiens
tggcaccaccagacaccaggag

SEQ ID NO: 9435873 - DNA, 22 bp, Homo sapiens
tggcaactactaatcatttaac

SEQ ID NO: 9435874 - DNA, 22 bp, Homo sapiens
tggcaacatgtcgaagtgctgt

SEQ ID NO: 9435875 - DNA, 22 bp, Homo sapiens
tggcaatacataatcttaatgg

SEQ ID NO: 9435876 - DNA, 22 bp, Homo sapiens
tggcaataattgtaattcaatt

SEQ ID NO: 9435877 - DNA, 22 bp, Homo sapiens
tggcaataaagaccaacaggtt

SEQ ID NO: 9435878 - DNA, 22 bp, Homo sapiens
tggcaataattgtaattcaatt

SEQ ID NO: 9435879 - DNA, 22 bp, Homo sapiens
tggcaatattaacagtacttat

SEQ ID NO: 9435880 - DNA, 22 bp, Homo sapiens
tggcaatataatcatctgctct

SEQ ID NO: 9435881 - DNA, 22 bp, Homo sapiens
tggcaatatccacaattacttt

SEQ ID NO: 9435882 - DNA, 22 bp, Homo sapiens
tggcaacacctggaagacatgg

SEQ ID NO: 9435883 - DNA, 22 bp, Homo sapiens
tggcaacatggacaggtctgcc

SEQ ID NO: 9435884 - DNA, 22 bp, Homo sapiens
tggcaacatgtcgaagtgctgt

SEQ ID NO: 9435885 - DNA, 22 bp, Homo sapiens
tggcaacatgtcgaagtgctgt

SEQ ID NO: 9435886 - DNA, 22 bp, Homo sapiens
tggcaacaagaaaggcagaggg

SEQ ID NO: 9435887 - DNA, 22 bp, Homo sapiens
tggcaaagtttatcaggaatat

SEQ ID NO: 9435888 - DNA, 22 bp, Homo sapiens
tggcaaagtgactccttggggc

SEQ ID NO: 9435889 - DNA, 22 bp, Homo sapiens
tggcaaagtatctgtcccagct

SEQ ID NO: 9435890 - DNA, 22 bp, Homo sapiens
tggcaaagtaattgggtttctc

SEQ ID NO: 9435891 - DNA, 22 bp, Homo sapiens
tggcaaaggggaccatgttgaa

SEQ ID NO: 9435892 - DNA, 22 bp, Homo sapiens
tggcaaaggcgctcacatgcct

SEQ ID NO: 9435893 - DNA, 22 bp, Homo sapiens
tggcaaaggaacctattttaaa

SEQ ID NO: 9435894 - DNA, 22 bp, Homo sapiens
tggcaaaggaaatgatttaaga

SEQ ID NO: 9435895 - DNA, 22 bp, Homo sapiens
tggcaaaggaaatgatttaaga

SEQ ID NO: 9435896 - DNA, 22 bp, Homo sapiens
tggcaaagctagacattccctc

SEQ ID NO: 9435897 - DNA, 22 bp, Homo sapiens
tggcaaagattaccacatctac

SEQ ID NO: 9435898 - DNA, 23 bp, Homo sapiens
tggcaaagcattcttataacagt

SEQ ID NO: 9435899 - DNA, 23 bp, Homo sapiens
tggcaaagcattcttataacagt

SEQ ID NO: 9435900 - DNA, 22 bp, Homo sapiens
tggcaaagatggttctcaccat

SEQ ID NO: 9435901 - DNA, 22 bp, Homo sapiens
tggcaaagatgaagcatttcgt

SEQ ID NO: 9435902 - DNA, 22 bp, Homo sapiens
tggcaaagatgaagcatttcgt

SEQ ID NO: 9435903 - DNA, 22 bp, Homo sapiens
tggcaaagacgctagctaagat

SEQ ID NO: 9435904 - DNA, 22 bp, Homo sapiens
tggcaaagactgcaaggacttt

SEQ ID NO: 9435905 - DNA, 22 bp, Homo sapiens
tggcaaagaccgcaattacttt

SEQ ID NO: 9435906 - DNA, 22 bp, Homo sapiens
tggcaaaacccacaattatatc

SEQ ID NO: 9435907 - DNA, 22 bp, Homo sapiens
tggattttagcatgtaactgtg

SEQ ID NO: 9435908 - DNA, 22 bp, Homo sapiens
tggatttattaggttggtgaaa

SEQ ID NO: 9435909 - DNA, 22 bp, Homo sapiens
tggatttctccagctctccatt

SEQ ID NO: 9435910 - DNA, 22 bp, Homo sapiens
tggatttgctaccttctgatat

SEQ ID NO: 9435911 - DNA, 22 bp, Homo sapiens
tggatttaacagaataccaggt

SEQ ID NO: 9435912 - DNA, 22 bp, Homo sapiens
tggattgcagcagctcctgtgg

SEQ ID NO: 9435913 - DNA, 22 bp, Homo sapiens
tggatttagttcttcacaggcc

SEQ ID NO: 9435914 - DNA, 22 bp, Homo sapiens
tggattgataaaatgggatgtt

SEQ ID NO: 9435915 - DNA, 18 bp, Homo sapiens
tggattgaattgagaggt

SEQ ID NO: 9435916 - DNA, 22 bp, Homo sapiens
tggattctggggagaaagtcac

SEQ ID NO: 9435917 - DNA, 22 bp, Homo sapiens
tggattctgggagagttctata

SEQ ID NO: 9435918 - DNA, 22 bp, Homo sapiens
tggattccacgcctgctcctgt

SEQ ID NO: 9435919 - DNA, 22 bp, Homo sapiens
tggatgtgtcgccctggctctc

SEQ ID NO: 9435920 - DNA, 17 bp, Homo sapiens
tggatgtgggatctgga

SEQ ID NO: 9435921 - DNA, 17 bp, Homo sapiens
tggatgtgggatctgga

SEQ ID NO: 9435922 - DNA, 22 bp, Homo sapiens
tggatgtgtcgccctggctctc

SEQ ID NO: 9435923 - DNA, 22 bp, Homo sapiens
tggatgtttgaagttgcatgtg

SEQ ID NO: 9435924 - DNA, 22 bp, Homo sapiens
tggattaaagattaaaatgaca

SEQ ID NO: 9435925 - DNA, 22 bp, Homo sapiens
tggattcaaatttcagctctgt

SEQ ID NO: 9435926 - DNA, 22 bp, Homo sapiens
tggatgtaggacacatagaatt

SEQ ID NO: 9435927 - DNA, 22 bp, Homo sapiens
tggatgtgagaaggatcaggct

SEQ ID NO: 9435928 - DNA, 22 bp, Homo sapiens
tggatgggttgaaatgtgagcc

SEQ ID NO: 9435929 - DNA, 22 bp, Homo sapiens
tggatgggttgaaatgtgagcc

SEQ ID NO: 9435930 - DNA, 22 bp, Homo sapiens
tggatgggttgaaatgtgagcc

SEQ ID NO: 9435931 - DNA, 22 bp, Homo sapiens
tggatgggttgaaatgtgagcc

SEQ ID NO: 9435932 - DNA, 22 bp, Homo sapiens
tggcacaaaagtaattgcagtt

SEQ ID NO: 9435933 - DNA, 22 bp, Homo sapiens
tggcaattttaggtggtttagt

SEQ ID NO: 9435934 - DNA, 22 bp, Homo sapiens
tggcaatttcagaaaatagaat

SEQ ID NO: 9435935 - DNA, 22 bp, Homo sapiens
tggcacagaaaaatgctccatt

SEQ ID NO: 9435936 - DNA, 22 bp, Homo sapiens
tggcacagaaaaatgctccatt

SEQ ID NO: 9435937 - DNA, 22 bp, Homo sapiens
tggcacaagggctattccttag

SEQ ID NO: 9435938 - DNA, 22 bp, Homo sapiens
tggcacacagagaagacacttg

SEQ ID NO: 9435939 - DNA, 22 bp, Homo sapiens
tggcaatgtggcatcaacgaag

SEQ ID NO: 9435940 - DNA, 22 bp, Homo sapiens
tggcaatgtggaatggtccagg

SEQ ID NO: 9435941 - DNA, 22 bp, Homo sapiens
tggcaatgtggcatcaacgaag

SEQ ID NO: 9435942 - DNA, 22 bp, Homo sapiens
tggcaattgtccactgtctgcc

SEQ ID NO: 9435943 - DNA, 22 bp, Homo sapiens
tggcaatgtaaattgaactaga

SEQ ID NO: 9435944 - DNA, 21 bp, Homo sapiens
tggcaatggccaacagtcatc

SEQ ID NO: 9435945 - DNA, 22 bp, Homo sapiens
tggcaatgtaggcaagaacatt

SEQ ID NO: 9435946 - DNA, 22 bp, Homo sapiens
tggcaatgtggcatcaacgaag

SEQ ID NO: 9435947 - DNA, 22 bp, Homo sapiens
tggcaatgtaggcaagaacatt

SEQ ID NO: 9435948 - DNA, 21 bp, Homo sapiens
tggcaatggccaacagtcatc

SEQ ID NO: 9435949 - DNA, 22 bp, Homo sapiens
tggcaatgaggtcagatgtctt

SEQ ID NO: 9435950 - DNA, 22 bp, Homo sapiens
tggcaatgagcaggtgctctgg

SEQ ID NO: 9435951 - DNA, 22 bp, Homo sapiens
tggcaatgagcaggtgctctgg

SEQ ID NO: 9435952 - DNA, 22 bp, Homo sapiens
tggcacagaccttatcttctct

SEQ ID NO: 9435953 - DNA, 22 bp, Homo sapiens
tggcacagacagcacagcaatg

SEQ ID NO: 9435954 - DNA, 22 bp, Homo sapiens
tggcacagacagcacagcaatg

SEQ ID NO: 9435955 - DNA, 22 bp, Homo sapiens
tggcacagacagatcaggagtc

SEQ ID NO: 9435956 - DNA, 22 bp, Homo sapiens
tggcacagacagcacagcaatg

SEQ ID NO: 9435957 - DNA, 22 bp, Homo sapiens
tggcacagacagcacagcaatg

SEQ ID NO: 9435958 - DNA, 20 bp, Homo sapiens
tggcacagaacccttgccta

SEQ ID NO: 9435959 - DNA, 20 bp, Homo sapiens
tggcacagaacccttgccta

SEQ ID NO: 9435960 - DNA, 21 bp, Homo sapiens
tggcacagaaaggaaagttca

SEQ ID NO: 9435961 - DNA, 20 bp, Homo sapiens
tggcacagaacccttgccta

SEQ ID NO: 9435962 - DNA, 23 bp, Homo sapiens
tggcacagaggaccatgctttgc

SEQ ID NO: 9435963 - DNA, 22 bp, Homo sapiens
tggcacagagggacccagcagc

SEQ ID NO: 9435964 - DNA, 23 bp, Homo sapiens
tggcacagaggaccatgctttgc

SEQ ID NO: 9435965 - DNA, 22 bp, Homo sapiens
tggcacagactgggccaaggaa

SEQ ID NO: 9435966 - DNA, 22 bp, Homo sapiens
tggcacagactgggccaaggaa

SEQ ID NO: 9435967 - DNA, 22 bp, Homo sapiens
tggcacagactgggccaaggaa

SEQ ID NO: 9435968 - DNA, 22 bp, Homo sapiens
tggcacagactgggccaaggaa

SEQ ID NO: 9435969 - DNA, 17 bp, Homo sapiens
tggcacagaggtgctat

SEQ ID NO: 9435970 - DNA, 22 bp, Homo sapiens
tggcacagagggacccagcagc

SEQ ID NO: 9435971 - DNA, 22 bp, Homo sapiens
tggcacagagggacccagcagc

SEQ ID NO: 9435972 - DNA, 22 bp, Homo sapiens
tggcacagagggacccagcagc

SEQ ID NO: 9435973 - DNA, 22 bp, Homo sapiens
tggcacagagggacccagcagc

SEQ ID NO: 9435974 - DNA, 22 bp, Homo sapiens
tggcacagcaagagtttgggaa

SEQ ID NO: 9435975 - DNA, 17 bp, Homo sapiens
tggcacagaggtgctat

SEQ ID NO: 9435976 - DNA, 22 bp, Homo sapiens
tggcacagtgctggatggtgct

SEQ ID NO: 9435977 - DNA, 22 bp, Homo sapiens
tggcacagtgctggatggtgct

SEQ ID NO: 9435978 - DNA, 22 bp, Homo sapiens
tggcacagcccagagctcttga

SEQ ID NO: 9435979 - DNA, 22 bp, Homo sapiens
tggcacagcccagagctcttga

SEQ ID NO: 9435980 - DNA, 22 bp, Homo sapiens
tggcacagcctccatgtcgtcc

SEQ ID NO: 9435981 - DNA, 22 bp, Homo sapiens
tggcacagcccggattctatga

SEQ ID NO: 9435982 - DNA, 22 bp, Homo sapiens
tggcacagcccattcagagaag

SEQ ID NO: 9435983 - DNA, 22 bp, Homo sapiens
tggcacagcccattcagagaag

SEQ ID NO: 9435984 - DNA, 21 bp, Homo sapiens
tggcacagcaagtgggctcat

SEQ ID NO: 9435985 - DNA, 23 bp, Homo sapiens
tggcacagcaggtgtgctttgtt

SEQ ID NO: 9435986 - DNA, 21 bp, Homo sapiens
tggcacagcaagtgggctcat

SEQ ID NO: 9435987 - DNA, 22 bp, Homo sapiens
tggcacagccactgaatcggga

SEQ ID NO: 9435988 - DNA, 22 bp, Homo sapiens
tggcacagccactgaatcggga

SEQ ID NO: 9435989 - DNA, 23 bp, Homo sapiens
tggcacagcaggtgtgctttgtt

SEQ ID NO: 9435990 - DNA, 18 bp, Homo sapiens
tggcagggaggaaatata

SEQ ID NO: 9435991 - DNA, 22 bp, Homo sapiens
tggcagggagccaccggtcatg

SEQ ID NO: 9435992 - DNA, 22 bp, Homo sapiens
tggcaggcatccggcaccttct

SEQ ID NO: 9435993 - DNA, 22 bp, Homo sapiens
tggcagggagttcgttcacaac

SEQ ID NO: 9435994 - DNA, 19 bp, Homo sapiens
tggcagggagtgatattag

SEQ ID NO: 9435995 - DNA, 22 bp, Homo sapiens
tggcaggcagagagcggccttt

SEQ ID NO: 9435996 - DNA, 22 bp, Homo sapiens
tggcaggcaagttcagctccac

SEQ ID NO: 9435997 - DNA, 22 bp, Homo sapiens
tggcaggaggttttctccagga

SEQ ID NO: 9435998 - DNA, 22 bp, Homo sapiens
tggcaggatctttgagagtgaa

SEQ ID NO: 9435999 - DNA, 22 bp, Homo sapiens
tggcaggatttgcccggaagga

SEQ ID NO: 9436000 - DNA, 21 bp, Homo sapiens
tggcaggcagctggaagcttg

SEQ ID NO: 9436001 - DNA, 22 bp, Homo sapiens
tggcaggcaggcagccttctga

SEQ ID NO: 9436002 - DNA, 22 bp, Homo sapiens
tggcaggcaggcagccttctga

SEQ ID NO: 9436003 - DNA, 22 bp, Homo sapiens
tggcaggcagtgtgggagctgg

SEQ ID NO: 9436004 - DNA, 21 bp, Homo sapiens
tggcaggggtagtagtacagc

SEQ ID NO: 9436005 - DNA, 18 bp, Homo sapiens
tggcaggggcagtacgcc

SEQ ID NO: 9436006 - DNA, 22 bp, Homo sapiens
tggcagggtacaccttaacacc

SEQ ID NO: 9436007 - DNA, 18 bp, Homo sapiens
tggcaggggcagtacgcc

SEQ ID NO: 9436008 - DNA, 22 bp, Homo sapiens
tggcaggggaggtgcttgctta

SEQ ID NO: 9436009 - DNA, 22 bp, Homo sapiens
tggcaggggaggtgcttgctta

SEQ ID NO: 9436010 - DNA, 22 bp, Homo sapiens
tggcagggagttcgttcacaac

SEQ ID NO: 9436011 - DNA, 22 bp, Homo sapiens
tggcagggagttgcaggatttc

SEQ ID NO: 9436012 - DNA, 22 bp, Homo sapiens
tggcagggagttgcaggatttc

SEQ ID NO: 9436013 - DNA, 22 bp, Homo sapiens
tggcagggcctaccccaatatc

SEQ ID NO: 9436014 - DNA, 22 bp, Homo sapiens
tggcagggcctgctcatcatcc

SEQ ID NO: 9436015 - DNA, 22 bp, Homo sapiens
tggcagggcctgaatcttatac

SEQ ID NO: 9436016 - DNA, 22 bp, Homo sapiens
tggcaggaagacgtggggcacc

SEQ ID NO: 9436017 - DNA, 22 bp, Homo sapiens
tggcaggaagacgtggggcacc

SEQ ID NO: 9436018 - DNA, 22 bp, Homo sapiens
tggcaggaagcatctataggtc

SEQ ID NO: 9436019 - DNA, 22 bp, Homo sapiens
tggcaggaagcatctataggtc

SEQ ID NO: 9436020 - DNA, 20 bp, Homo sapiens
tggcaggaatagggccagag

SEQ ID NO: 9436021 - DNA, 22 bp, Homo sapiens
tggcaggaaggagactcagccc

SEQ ID NO: 9436022 - DNA, 20 bp, Homo sapiens
tggcaggaatagggccagag

SEQ ID NO: 9436023 - DNA, 22 bp, Homo sapiens
tggcaggaaggagactcagccc

SEQ ID NO: 9436024 - DNA, 22 bp, Homo sapiens
tggcaggagagcgtcagatcag

SEQ ID NO: 9436025 - DNA, 22 bp, Homo sapiens
tggcaggagacacatggcatag

SEQ ID NO: 9436026 - DNA, 22 bp, Homo sapiens
tggcaggagacacatggcatag

SEQ ID NO: 9436027 - DNA, 20 bp, Homo sapiens
tggcaggactggctccaccc

SEQ ID NO: 9436028 - DNA, 22 bp, Homo sapiens
tggcaggaggatgaggcggcta

SEQ ID NO: 9436029 - DNA, 22 bp, Homo sapiens
tggcaggaggatgaggcggcta

SEQ ID NO: 9436030 - DNA, 22 bp, Homo sapiens
tggcaggaggatgaggcggcta

SEQ ID NO: 9436031 - DNA, 22 bp, Homo sapiens
tggcaggaggatgaggcggcta

SEQ ID NO: 9436032 - DNA, 20 bp, Homo sapiens
tggcaggagccactggaagc

SEQ ID NO: 9436033 - DNA, 20 bp, Homo sapiens
tggcaggagccactggaagc

SEQ ID NO: 9436034 - DNA, 22 bp, Homo sapiens
tggcaggagcctgcggggaggt

SEQ ID NO: 9436035 - DNA, 22 bp, Homo sapiens
tggcaggagcctgcggggaggt

SEQ ID NO: 9436036 - DNA, 20 bp, Homo sapiens
tggcaggaggcagcagtgga

SEQ ID NO: 9436037 - DNA, 20 bp, Homo sapiens
tggcaggaggcagcagtgga

SEQ ID NO: 9436038 - DNA, 22 bp, Homo sapiens
tggcaggatctttgagagtgaa

SEQ ID NO: 9436039 - DNA, 22 bp, Homo sapiens
tggcaggaggttttctccagga

SEQ ID NO: 9436040 - DNA, 22 bp, Homo sapiens
tggcaggaaagtaacagagcac

SEQ ID NO: 9436041 - DNA, 22 bp, Homo sapiens
tggcaggaaaaagggccagagg

SEQ ID NO: 9436042 - DNA, 22 bp, Homo sapiens
tggcaggaaagtaacagagcac

SEQ ID NO: 9436043 - DNA, 18 bp, Homo sapiens
tggcaggaaatgcacttt

SEQ ID NO: 9436044 - DNA, 23 bp, Homo sapiens
tggcaggaaatgagaatgttcct

SEQ ID NO: 9436045 - DNA, 23 bp, Homo sapiens
tggcaggaaatgagaatgttcct

SEQ ID NO: 9436046 - DNA, 22 bp, Homo sapiens
tggcaggaaataccctgcctag

SEQ ID NO: 9436047 - DNA, 22 bp, Homo sapiens
tggcaggaaataccctgcctag

SEQ ID NO: 9436048 - DNA, 22 bp, Homo sapiens
tggcaggaaataccctgcctag

SEQ ID NO: 9436049 - DNA, 22 bp, Homo sapiens
tggcaggaaccaggaggctctc

SEQ ID NO: 9436050 - DNA, 22 bp, Homo sapiens
tggcaggaaccaggaggctctc

SEQ ID NO: 9436051 - DNA, 18 bp, Homo sapiens
tggcaggaaatgcacttt

SEQ ID NO: 9436052 - DNA, 18 bp, Homo sapiens
tggcaggaaatgcacttt

SEQ ID NO: 9436053 - DNA, 22 bp, Homo sapiens
tggcaggaagacgtggggcacc

SEQ ID NO: 9436054 - DNA, 22 bp, Homo sapiens
tggcaggaaccttaaccacaaa

SEQ ID NO: 9436055 - DNA, 22 bp, Homo sapiens
tggcagctgaggggaggctttg

SEQ ID NO: 9436056 - DNA, 22 bp, Homo sapiens
tggcagctgaggggaggctttg

SEQ ID NO: 9436057 - DNA, 22 bp, Homo sapiens
tggcagctctgttcaacatgag

SEQ ID NO: 9436058 - DNA, 22 bp, Homo sapiens
tggcagctctgttcaacatgag

SEQ ID NO: 9436059 - DNA, 22 bp, Homo sapiens
tggcaggaaagtaacagagcac

SEQ ID NO: 9436060 - DNA, 22 bp, Homo sapiens
tggcaggaaaaagggccagagg

SEQ ID NO: 9436061 - DNA, 22 bp, Homo sapiens
tggcagctgcaggcctcctgag

SEQ ID NO: 9436062 - DNA, 22 bp, Homo sapiens
tggcagctgccatgtccacgtg

SEQ ID NO: 9436063 - DNA, 22 bp, Homo sapiens
tggcagataaaataatagggaa

SEQ ID NO: 9436064 - DNA, 22 bp, Homo sapiens
tggcagataacctgctgtgccc

SEQ ID NO: 9436065 - DNA, 22 bp, Homo sapiens
tggcagataaacatgtgataaa

SEQ ID NO: 9436066 - DNA, 22 bp, Homo sapiens
tggcagcacttgaacttgagcc

SEQ ID NO: 9436067 - DNA, 22 bp, Homo sapiens
tggcagcagaacatgaaaccca

SEQ ID NO: 9436068 - DNA, 22 bp, Homo sapiens
tggcagatacccaggcaaatgg

SEQ ID NO: 9436069 - DNA, 22 bp, Homo sapiens
tggcagcactaggtactgagct

SEQ ID NO: 9436070 - DNA, 20 bp, Homo sapiens
tggcagagttgtcccaccca

SEQ ID NO: 9436071 - DNA, 22 bp, Homo sapiens
tggcagagttggaggtggaaga

SEQ ID NO: 9436072 - DNA, 22 bp, Homo sapiens
tggcagagttggaggtggaaga

SEQ ID NO: 9436073 - DNA, 22 bp, Homo sapiens
tggcagagttggaggtggaaga

SEQ ID NO: 9436074 - DNA, 22 bp, Homo sapiens
tggcagagttggaggtggaaga

SEQ ID NO: 9436075 - DNA, 22 bp, Homo sapiens
tggcagagttatgggtatttat

SEQ ID NO: 9436076 - DNA, 22 bp, Homo sapiens
tggcagagttcgctgtgccttt

SEQ ID NO: 9436077 - DNA, 22 bp, Homo sapiens
tggcagagttcgctgtgccttt

SEQ ID NO: 9436078 - DNA, 22 bp, Homo sapiens
tggcagagtggaccatactcaa

SEQ ID NO: 9436079 - DNA, 22 bp, Homo sapiens
tggcagagtggaccatactcaa

SEQ ID NO: 9436080 - DNA, 22 bp, Homo sapiens
tggcagagtggaccatactcaa

SEQ ID NO: 9436081 - DNA, 22 bp, Homo sapiens
tggcagagtgcggcatcccctg

SEQ ID NO: 9436082 - DNA, 22 bp, Homo sapiens
tggcagagtgcggcatcccctg

SEQ ID NO: 9436083 - DNA, 21 bp, Homo sapiens
tggcagagtgcagtctataca

SEQ ID NO: 9436084 - DNA, 22 bp, Homo sapiens
tggcagagtgcagaagaggcat

SEQ ID NO: 9436085 - DNA, 22 bp, Homo sapiens
tggcagagtgcagaagaggcat

SEQ ID NO: 9436086 - DNA, 21 bp, Homo sapiens
tggcagagtgcagtctataca

SEQ ID NO: 9436087 - DNA, 22 bp, Homo sapiens
tggcagagtgcagaagaggcat

SEQ ID NO: 9436088 - DNA, 22 bp, Homo sapiens
tggcagagtgcagaagaggcat

SEQ ID NO: 9436089 - DNA, 22 bp, Homo sapiens
tggcagagtctgggcttgggca

SEQ ID NO: 9436090 - DNA, 22 bp, Homo sapiens
tggcagagtctctcctttccag

SEQ ID NO: 9436091 - DNA, 22 bp, Homo sapiens
tggcagagtctgggcttgggca

SEQ ID NO: 9436092 - DNA, 22 bp, Homo sapiens
tggcagagtaggatggccctgt

SEQ ID NO: 9436093 - DNA, 22 bp, Homo sapiens
tggcagagtaggatggccctgt

SEQ ID NO: 9436094 - DNA, 22 bp, Homo sapiens
tggcagagtaggatggccctgt

SEQ ID NO: 9436095 - DNA, 22 bp, Homo sapiens
tggcagagtaggatggccctgt

SEQ ID NO: 9436096 - DNA, 22 bp, Homo sapiens
tggcagagtcatcacatctgga

SEQ ID NO: 9436097 - DNA, 22 bp, Homo sapiens
tggcagccttctctgagaaggt

SEQ ID NO: 9436098 - DNA, 22 bp, Homo sapiens
tggcagccttctctgagaaggt

SEQ ID NO: 9436099 - DNA, 22 bp, Homo sapiens
tggcagctacagacagaggtga

SEQ ID NO: 9436100 - DNA, 18 bp, Homo sapiens
tggcagctaggtaaagaa

SEQ ID NO: 9436101 - DNA, 22 bp, Homo sapiens
tggcagctacagacagaggtga

SEQ ID NO: 9436102 - DNA, 22 bp, Homo sapiens
tggcagctattacaaggaagtc

SEQ ID NO: 9436103 - DNA, 22 bp, Homo sapiens
tggcagctcatttggaaatgga

SEQ ID NO: 9436104 - DNA, 22 bp, Homo sapiens
tggcagctcctggggccagcac

SEQ ID NO: 9436105 - DNA, 22 bp, Homo sapiens
tggcagctcctggggccagcac

SEQ ID NO: 9436106 - DNA, 22 bp, Homo sapiens
tggcagcattttttccagaaca

SEQ ID NO: 9436107 - DNA, 19 bp, Homo sapiens
tggcagcattggtaccttg

SEQ ID NO: 9436108 - DNA, 22 bp, Homo sapiens
tggcagcattttttccagaaca

SEQ ID NO: 9436109 - DNA, 22 bp, Homo sapiens
tggcagcatgttatgtaaggaa

SEQ ID NO: 9436110 - DNA, 22 bp, Homo sapiens
tggcagcattaattattcaggt

SEQ ID NO: 9436111 - DNA, 22 bp, Homo sapiens
tggcagccatctgagggtgggg

SEQ ID NO: 9436112 - DNA, 22 bp, Homo sapiens
tggcagcagggaggccagtgtt

SEQ ID NO: 9436113 - DNA, 22 bp, Homo sapiens
tggcagcagggaggccagtgtt

SEQ ID NO: 9436114 - DNA, 18 bp, Homo sapiens
tggcagcaggaagccatt

SEQ ID NO: 9436115 - DNA, 18 bp, Homo sapiens
tggcagcaggaagccatt

SEQ ID NO: 9436116 - DNA, 22 bp, Homo sapiens
tggcagcagggaggccagtgtt

SEQ ID NO: 9436117 - DNA, 22 bp, Homo sapiens
tggcagcagtagccaccccagc

SEQ ID NO: 9436118 - DNA, 22 bp, Homo sapiens
tggcagcagggcccctggagga

SEQ ID NO: 9436119 - DNA, 22 bp, Homo sapiens
tggcagcatgttatgtaaggaa

SEQ ID NO: 9436120 - DNA, 22 bp, Homo sapiens
tggcagcatgttatgtaaggaa

SEQ ID NO: 9436121 - DNA, 22 bp, Homo sapiens
tggcagcatgttatgtaaggaa

SEQ ID NO: 9436122 - DNA, 22 bp, Homo sapiens
tggcagcatgtcccggcctcag

SEQ ID NO: 9436123 - DNA, 22 bp, Homo sapiens
tggcagcataaagcatttagct

SEQ ID NO: 9436124 - DNA, 22 bp, Homo sapiens
tggcagcatgtcccggcctcag

SEQ ID NO: 9436125 - DNA, 22 bp, Homo sapiens
tggcagcataaagcatttagct

SEQ ID NO: 9436126 - DNA, 22 bp, Homo sapiens
tggcagcagtggaggtagaaag

SEQ ID NO: 9436127 - DNA, 22 bp, Homo sapiens
tggcagcagtagccaccccagc

SEQ ID NO: 9436128 - DNA, 22 bp, Homo sapiens
tggcagcagtggaggtagaaag

SEQ ID NO: 9436129 - DNA, 22 bp, Homo sapiens
tggcagcagtggaggtagaaag

SEQ ID NO: 9436130 - DNA, 22 bp, Homo sapiens
tggcagcagacaaaaggccatt

SEQ ID NO: 9436131 - DNA, 22 bp, Homo sapiens
tggcagcagacatctgaggtct

SEQ ID NO: 9436132 - DNA, 22 bp, Homo sapiens
tggcagcagacaaaaggccatt

SEQ ID NO: 9436133 - DNA, 22 bp, Homo sapiens
tggcagcagacaaaaggccatt

SEQ ID NO: 9436134 - DNA, 23 bp, Homo sapiens
tggcagcagatcttaaagtgacc

SEQ ID NO: 9436135 - DNA, 22 bp, Homo sapiens
tggcagcagacatctgaggtct

SEQ ID NO: 9436136 - DNA, 22 bp, Homo sapiens
tggcagcagcaaatggcatatc

SEQ ID NO: 9436137 - DNA, 22 bp, Homo sapiens
tggcagcagcaaatggcatatc

SEQ ID NO: 9436138 - DNA, 22 bp, Homo sapiens
tggcagcagccatggaaggccc

SEQ ID NO: 9436139 - DNA, 22 bp, Homo sapiens
tggcagcagccatggaaggccc

SEQ ID NO: 9436140 - DNA, 22 bp, Homo sapiens
tggcagcagccatggaaggccc

SEQ ID NO: 9436141 - DNA, 22 bp, Homo sapiens
tggcagcagccatggaaggccc

SEQ ID NO: 9436142 - DNA, 22 bp, Homo sapiens
tggcagcagccatggaaggccc

SEQ ID NO: 9436143 - DNA, 18 bp, Homo sapiens
tggcagcaggaagccatt

SEQ ID NO: 9436144 - DNA, 22 bp, Homo sapiens
tggcagcagctaacttaggcag

SEQ ID NO: 9436145 - DNA, 22 bp, Homo sapiens
tggcagcagctaacttaggcag

SEQ ID NO: 9436146 - DNA, 22 bp, Homo sapiens
tggcccaggccaaagccctgga

SEQ ID NO: 9436147 - DNA, 22 bp, Homo sapiens
tggcccaggccaaagccctgga

SEQ ID NO: 9436148 - DNA, 22 bp, Homo sapiens
tggcccaggcgaggtgggcaga

SEQ ID NO: 9436149 - DNA, 22 bp, Homo sapiens
tggcccaggcgaggtgggcaga

SEQ ID NO: 9436150 - DNA, 22 bp, Homo sapiens
tggcccaggcgaggtgggcaga

SEQ ID NO: 9436151 - DNA, 22 bp, Homo sapiens
tggcccaggcgaggtgggcaga

SEQ ID NO: 9436152 - DNA, 22 bp, Homo sapiens
tggcccagggagttcatggtgt

SEQ ID NO: 9436153 - DNA, 22 bp, Homo sapiens
tggcccagggagttcatggtgt

SEQ ID NO: 9436154 - DNA, 22 bp, Homo sapiens
tggcccagggagttcatggtgt

SEQ ID NO: 9436155 - DNA, 22 bp, Homo sapiens
tggcccaggcgaggtgggcaga

SEQ ID NO: 9436156 - DNA, 22 bp, Homo sapiens
tggcccaggccaaagccctgga

SEQ ID NO: 9436157 - DNA, 22 bp, Homo sapiens
tggcccaggccaaagccctgga

SEQ ID NO: 9436158 - DNA, 22 bp, Homo sapiens
tggcccaggaggccagagggca

SEQ ID NO: 9436159 - DNA, 22 bp, Homo sapiens
tggcccaggaggccagagggca

SEQ ID NO: 9436160 - DNA, 22 bp, Homo sapiens
tggcccaggaggccagagggca

SEQ ID NO: 9436161 - DNA, 22 bp, Homo sapiens
tggcccaggaggccagagggca

SEQ ID NO: 9436162 - DNA, 22 bp, Homo sapiens
tggcccaggaggccagagggca

SEQ ID NO: 9436163 - DNA, 22 bp, Homo sapiens
tggcccagctgcagatggtgga

SEQ ID NO: 9436164 - DNA, 22 bp, Homo sapiens
tggcccagctgcagatggtgga

SEQ ID NO: 9436165 - DNA, 22 bp, Homo sapiens
tggcccagggcacagcagggag

SEQ ID NO: 9436166 - DNA, 22 bp, Homo sapiens
tggcccagggcacagcagggag

SEQ ID NO: 9436167 - DNA, 22 bp, Homo sapiens
tggcccagggcacagcagggag

SEQ ID NO: 9436168 - DNA, 22 bp, Homo sapiens
tggcccaggggctcttggtgtt

SEQ ID NO: 9436169 - DNA, 22 bp, Homo sapiens
tggcccaggggctcttggtgtt

SEQ ID NO: 9436170 - DNA, 22 bp, Homo sapiens
tggcccaggggctcttggtgtt

SEQ ID NO: 9436171 - DNA, 22 bp, Homo sapiens
tggcccaggggctcttggtgtt

SEQ ID NO: 9436172 - DNA, 22 bp, Homo sapiens
tggcccagggtctacagcctca

SEQ ID NO: 9436173 - DNA, 22 bp, Homo sapiens
tggcccagggtctacagcctca

SEQ ID NO: 9436174 - DNA, 22 bp, Homo sapiens
tggcccagggtctacagcctca

SEQ ID NO: 9436175 - DNA, 22 bp, Homo sapiens
tggcccagggtctacagcctca

SEQ ID NO: 9436176 - DNA, 22 bp, Homo sapiens
tggcccagggtctacagcctca

SEQ ID NO: 9436177 - DNA, 22 bp, Homo sapiens
tggcccaggtctctctgagccc

SEQ ID NO: 9436178 - DNA, 22 bp, Homo sapiens
tggcccaggtctctctgagccc

SEQ ID NO: 9436179 - DNA, 22 bp, Homo sapiens
tggcccaggtctctctgagccc

SEQ ID NO: 9436180 - DNA, 22 bp, Homo sapiens
tggcccaggtctctctgagccc

SEQ ID NO: 9436181 - DNA, 22 bp, Homo sapiens
tggcccaggtctctctgagccc

SEQ ID NO: 9436182 - DNA, 22 bp, Homo sapiens
tggcccagccctgctctagggc

SEQ ID NO: 9436183 - DNA, 22 bp, Homo sapiens
tggcccagccctgctctagggc

SEQ ID NO: 9436184 - DNA, 22 bp, Homo sapiens
tggcccagactctgctcttatc

SEQ ID NO: 9436185 - DNA, 22 bp, Homo sapiens
tggcccaagtctgctagaagag

SEQ ID NO: 9436186 - DNA, 22 bp, Homo sapiens
tggcccagactctgctcttatc

SEQ ID NO: 9436187 - DNA, 22 bp, Homo sapiens
tggcccagctcagggtgggcgg

SEQ ID NO: 9436188 - DNA, 22 bp, Homo sapiens
tggcccagctcagggtgggcgg

SEQ ID NO: 9436189 - DNA, 22 bp, Homo sapiens
tggcccagctcagggtgggcgg

SEQ ID NO: 9436190 - DNA, 22 bp, Homo sapiens
tggcccagccctgctctagggc

SEQ ID NO: 9436191 - DNA, 22 bp, Homo sapiens
tggcccagccctgctctagggc

SEQ ID NO: 9436192 - DNA, 22 bp, Homo sapiens
tggcccagccctgctctagggc

SEQ ID NO: 9436193 - DNA, 22 bp, Homo sapiens
tggcccagctcagggtgggcgg

SEQ ID NO: 9436194 - DNA, 22 bp, Homo sapiens
tggcccagctgcagatggtgga

SEQ ID NO: 9436195 - DNA, 22 bp, Homo sapiens
tggcccagctgcagatggtgga

SEQ ID NO: 9436196 - DNA, 22 bp, Homo sapiens
tggcccagctgcagatggtgga

SEQ ID NO: 9436197 - DNA, 22 bp, Homo sapiens
tggccagtgattaatgacgctt

SEQ ID NO: 9436198 - DNA, 22 bp, Homo sapiens
tggccagtgtgtgctgccggct

SEQ ID NO: 9436199 - DNA, 22 bp, Homo sapiens
tggccagtgtcggaggccagga

SEQ ID NO: 9436200 - DNA, 22 bp, Homo sapiens
tggccagtggggttgagcagga

SEQ ID NO: 9436201 - DNA, 22 bp, Homo sapiens
tggccagtggggttgagcagga

SEQ ID NO: 9436202 - DNA, 22 bp, Homo sapiens
tggccagtggggttgagcagga

SEQ ID NO: 9436203 - DNA, 22 bp, Homo sapiens
tggccagtttgctcaggcagtc

SEQ ID NO: 9436204 - DNA, 22 bp, Homo sapiens
tggccagtttgctcaggcagtc

SEQ ID NO: 9436205 - DNA, 22 bp, Homo sapiens
tggccatgggatagtgcagggg

SEQ ID NO: 9436206 - DNA, 22 bp, Homo sapiens
tggcccaaagcagcccagcagg

SEQ ID NO: 9436207 - DNA, 22 bp, Homo sapiens
tggccatgggatagtgcagggg

SEQ ID NO: 9436208 - DNA, 22 bp, Homo sapiens
tggccctgaatcaaggccagca

SEQ ID NO: 9436209 - DNA, 22 bp, Homo sapiens
tggccctgaatcaaggccagca

SEQ ID NO: 9436210 - DNA, 22 bp, Homo sapiens
tggccctgaatcaaggccagca

SEQ ID NO: 9436211 - DNA, 23 bp, Homo sapiens
tggccctgaatctgtcctggagg

SEQ ID NO: 9436212 - DNA, 22 bp, Homo sapiens
tggccctgacacgtggtactgg

SEQ ID NO: 9436213 - DNA, 23 bp, Homo sapiens
tggccctgaatctgtcctggagg

SEQ ID NO: 9436214 - DNA, 22 bp, Homo sapiens
tggccctcagcactgagacctt

SEQ ID NO: 9436215 - DNA, 22 bp, Homo sapiens
tggccctcagtcttgctcctgc

SEQ ID NO: 9436216 - DNA, 22 bp, Homo sapiens
tggccctcagtcttgctcctgc

SEQ ID NO: 9436217 - DNA, 17 bp, Homo sapiens
tggccctagactccagc

SEQ ID NO: 9436218 - DNA, 22 bp, Homo sapiens
tggccctatttggaaatagagc

SEQ ID NO: 9436219 - DNA, 22 bp, Homo sapiens
tggccctcgtccgacaggtggg

SEQ ID NO: 9436220 - DNA, 22 bp, Homo sapiens
tggccctgaaggccttgagcat

SEQ ID NO: 9436221 - DNA, 22 bp, Homo sapiens
tggccctgaaggccttgagcat

SEQ ID NO: 9436222 - DNA, 22 bp, Homo sapiens
tggccctcgtccgacaggtggg

SEQ ID NO: 9436223 - DNA, 22 bp, Homo sapiens
tggccctcgtccgacaggtggg

SEQ ID NO: 9436224 - DNA, 22 bp, Homo sapiens
tggcccaggtgcacccagaggc

SEQ ID NO: 9436225 - DNA, 22 bp, Homo sapiens
tggcccaggtgcacccagaggc

SEQ ID NO: 9436226 - DNA, 22 bp, Homo sapiens
tggcccagtagaaaagggatcg

SEQ ID NO: 9436227 - DNA, 22 bp, Homo sapiens
tggcccagtagaaaagggatcg

SEQ ID NO: 9436228 - DNA, 22 bp, Homo sapiens
tggcccagtagaaaagggatcg

SEQ ID NO: 9436229 - DNA, 22 bp, Homo sapiens
tggcccaggtgcaagagacaga

SEQ ID NO: 9436230 - DNA, 22 bp, Homo sapiens
tggcccaggtgcaagagacaga

SEQ ID NO: 9436231 - DNA, 22 bp, Homo sapiens
tggcccaggtgcaagagacaga

SEQ ID NO: 9436232 - DNA, 22 bp, Homo sapiens
tggcccaggtgcacccagaggc

SEQ ID NO: 9436233 - DNA, 22 bp, Homo sapiens
tggcccaggtgcaagagacaga

SEQ ID NO: 9436234 - DNA, 22 bp, Homo sapiens
tggcccaggtgcaagagacaga

SEQ ID NO: 9436235 - DNA, 22 bp, Homo sapiens
tggcccagtcagcaggagaggg

SEQ ID NO: 9436236 - DNA, 22 bp, Homo sapiens
tggcccagtcagcaggagaggg

SEQ ID NO: 9436237 - DNA, 22 bp, Homo sapiens
tggcccgccggaagaagatgtc

SEQ ID NO: 9436238 - DNA, 22 bp, Homo sapiens
tggcccggctctgagctgtgct

SEQ ID NO: 9436239 - DNA, 22 bp, Homo sapiens
tggcccagtcagcaggagaggg

SEQ ID NO: 9436240 - DNA, 22 bp, Homo sapiens
tggcccagtcagcaggagaggg

SEQ ID NO: 9436241 - DNA, 22 bp, Homo sapiens
tggcccagtcagcaggagaggg

SEQ ID NO: 9436242 - DNA, 22 bp, Homo sapiens
tggcccagtatgtataatctta

SEQ ID NO: 9436243 - DNA, 22 bp, Homo sapiens
tggcccagtatgtataatctta

SEQ ID NO: 9436244 - DNA, 22 bp, Homo sapiens
tggcccagtatgtataatctta

SEQ ID NO: 9436245 - DNA, 22 bp, Homo sapiens
tggccctgaggacccagtgtgg

SEQ ID NO: 9436246 - DNA, 22 bp, Homo sapiens
tggccctgaggacccagtgtgg

SEQ ID NO: 9436247 - DNA, 22 bp, Homo sapiens
tggccctgaggacccagtgtgg

SEQ ID NO: 9436248 - DNA, 22 bp, Homo sapiens
tggccctgactgatgtggaggg

SEQ ID NO: 9436249 - DNA, 22 bp, Homo sapiens
tggccctgacttggaggcctga

SEQ ID NO: 9436250 - DNA, 22 bp, Homo sapiens
tggccctgacttggaggcctga

SEQ ID NO: 9436251 - DNA, 22 bp, Homo sapiens
tggccctgactgatgtggaggg

SEQ ID NO: 9436252 - DNA, 22 bp, Homo sapiens
tggccctgacaggtcctgggca

SEQ ID NO: 9436253 - DNA, 22 bp, Homo sapiens
tggccctgacaggtcctgggca

SEQ ID NO: 9436254 - DNA, 22 bp, Homo sapiens
tggccctgacaggtcctgggca

SEQ ID NO: 9436255 - DNA, 22 bp, Homo sapiens
tggccctgacaggtcctgggca

SEQ ID NO: 9436256 - DNA, 22 bp, Homo sapiens
tggccctgacacgtggtactgg

SEQ ID NO: 9436257 - DNA, 22 bp, Homo sapiens
tggccctgaggggctgtgcccc

SEQ ID NO: 9436258 - DNA, 22 bp, Homo sapiens
tggccctgaggggctgtgcccc

SEQ ID NO: 9436259 - DNA, 22 bp, Homo sapiens
tggccctgaggggctgtgcccc

SEQ ID NO: 9436260 - DNA, 22 bp, Homo sapiens
tggccctgaggggctgtgcccc

SEQ ID NO: 9436261 - DNA, 22 bp, Homo sapiens
tggccctgaggggctgtgcccc

SEQ ID NO: 9436262 - DNA, 22 bp, Homo sapiens
tggccctgagggctcggagcca

SEQ ID NO: 9436263 - DNA, 22 bp, Homo sapiens
tggccctgagggctcggagcca

SEQ ID NO: 9436264 - DNA, 22 bp, Homo sapiens
tggccctgagggctcggagcca

SEQ ID NO: 9436265 - DNA, 22 bp, Homo sapiens
tggccctgcacccagagcagtt

SEQ ID NO: 9436266 - DNA, 22 bp, Homo sapiens
tggccctgcacccagagcagtt

SEQ ID NO: 9436267 - DNA, 22 bp, Homo sapiens
tggccctgccactcactgctga

SEQ ID NO: 9436268 - DNA, 22 bp, Homo sapiens
tggccctgcagaactagcctgg

SEQ ID NO: 9436269 - DNA, 22 bp, Homo sapiens
tggccctgcagaactagcctgg

SEQ ID NO: 9436270 - DNA, 22 bp, Homo sapiens
tggccctgcagaactagcctgg

SEQ ID NO: 9436271 - DNA, 22 bp, Homo sapiens
tggccctgcagaactagcctgg

SEQ ID NO: 9436272 - DNA, 22 bp, Homo sapiens
tggcctggaacctggcagggac

SEQ ID NO: 9436273 - DNA, 22 bp, Homo sapiens
tggcctggaacctggcagggac

SEQ ID NO: 9436274 - DNA, 22 bp, Homo sapiens
tggcctggaacctggcagggac

SEQ ID NO: 9436275 - DNA, 22 bp, Homo sapiens
tggcctggaaaaatgcagatgg

SEQ ID NO: 9436276 - DNA, 22 bp, Homo sapiens
tggcctggaaaaatgcagatgg

SEQ ID NO: 9436277 - DNA, 22 bp, Homo sapiens
tggcctgccttcgctgagctga

SEQ ID NO: 9436278 - DNA, 22 bp, Homo sapiens
tggcctgccttcgctgagctga

SEQ ID NO: 9436279 - DNA, 22 bp, Homo sapiens
tggcctggaaaaatgcagatgg

SEQ ID NO: 9436280 - DNA, 23 bp, Homo sapiens
tggcctggagagaaaagatgagt

SEQ ID NO: 9436281 - DNA, 22 bp, Homo sapiens
tggcctggaagagaggtcgagg

SEQ ID NO: 9436282 - DNA, 22 bp, Homo sapiens
tggcctggcagagcaaggcctg

SEQ ID NO: 9436283 - DNA, 22 bp, Homo sapiens
tggcctggcagagcaaggcctg

SEQ ID NO: 9436284 - DNA, 22 bp, Homo sapiens
tggcctggccacatccagcagg

SEQ ID NO: 9436285 - DNA, 22 bp, Homo sapiens
tggcctggccacatccagcagg

SEQ ID NO: 9436286 - DNA, 22 bp, Homo sapiens
tggcctgcccagagcagctctg

SEQ ID NO: 9436287 - DNA, 22 bp, Homo sapiens
tggcctgccccgagatcctggc

SEQ ID NO: 9436288 - DNA, 23 bp, Homo sapiens
tggcctgcagagtttctgctggg

SEQ ID NO: 9436289 - DNA, 22 bp, Homo sapiens
tggcctgcaaagtcttcttgct

SEQ ID NO: 9436290 - DNA, 22 bp, Homo sapiens
tggcctgcagaggctgtggggc

SEQ ID NO: 9436291 - DNA, 20 bp, Homo sapiens
tggcctctgtagaggccaag

SEQ ID NO: 9436292 - DNA, 22 bp, Homo sapiens
tggcctctggctgaggactaac

SEQ ID NO: 9436293 - DNA, 22 bp, Homo sapiens
tggcctctgggaaagcagattc

SEQ ID NO: 9436294 - DNA, 22 bp, Homo sapiens
tggcctctggctgaggactaac

SEQ ID NO: 9436295 - DNA, 22 bp, Homo sapiens
tggcctctggctgaggactaac

SEQ ID NO: 9436296 - DNA, 20 bp, Homo sapiens
tggcctctgagatgccacgg

SEQ ID NO: 9436297 - DNA, 20 bp, Homo sapiens
tggcctctgagatgccacgg

SEQ ID NO: 9436298 - DNA, 22 bp, Homo sapiens
tggcctctgcactgggctcccc

SEQ ID NO: 9436299 - DNA, 22 bp, Homo sapiens
tggcctcttaaggatgacacaa

SEQ ID NO: 9436300 - DNA, 22 bp, Homo sapiens
tggcctcttaggacatcctcta

SEQ ID NO: 9436301 - DNA, 22 bp, Homo sapiens
tggcctcttaaggatgacacaa

SEQ ID NO: 9436302 - DNA, 22 bp, Homo sapiens
tggcctctgtgggagctgagca

SEQ ID NO: 9436303 - DNA, 22 bp, Homo sapiens
tggcctgactgtcaggctgtat

SEQ ID NO: 9436304 - DNA, 22 bp, Homo sapiens
tggcctcttaggacatcctcta

SEQ ID NO: 9436305 - DNA, 22 bp, Homo sapiens
tggcctcttaggacatcctcta

SEQ ID NO: 9436306 - DNA, 22 bp, Homo sapiens
tggcctcttaggacatcctcta

SEQ ID NO: 9436307 - DNA, 16 bp, Homo sapiens
tggccgcagaggcctc

SEQ ID NO: 9436308 - DNA, 22 bp, Homo sapiens
tggccgctatgagtcacctgca

SEQ ID NO: 9436309 - DNA, 22 bp, Homo sapiens
tggcctagagaagccaaaagat

SEQ ID NO: 9436310 - DNA, 22 bp, Homo sapiens
tggcctcaaccgtcctaagcac

SEQ ID NO: 9436311 - DNA, 22 bp, Homo sapiens
tggccctttgggtgcaggggca

SEQ ID NO: 9436312 - DNA, 22 bp, Homo sapiens
tggcccttgttcaaatatgtca

SEQ ID NO: 9436313 - DNA, 22 bp, Homo sapiens
tggcccttgtcctgggagagtt

SEQ ID NO: 9436314 - DNA, 22 bp, Homo sapiens
tggcccttctgagcacagggcc

SEQ ID NO: 9436315 - DNA, 22 bp, Homo sapiens
tggcccttttgtgaagtggcca

SEQ ID NO: 9436316 - DNA, 22 bp, Homo sapiens
tggccctttggtttatgactga

SEQ ID NO: 9436317 - DNA, 22 bp, Homo sapiens
tggccctttgggtgcaggggca

SEQ ID NO: 9436318 - DNA, 22 bp, Homo sapiens
tggccctttggtttatgactga

SEQ ID NO: 9436319 - DNA, 20 bp, Homo sapiens
tggccctgttttctccaggc

SEQ ID NO: 9436320 - DNA, 20 bp, Homo sapiens
tggccctgttttctccaggc

SEQ ID NO: 9436321 - DNA, 22 bp, Homo sapiens
tggccctgttctgtacctcata

SEQ ID NO: 9436322 - DNA, 22 bp, Homo sapiens
tggccctgttctgtacctcata

SEQ ID NO: 9436323 - DNA, 22 bp, Homo sapiens
tggccctgttctgtacctcata

SEQ ID NO: 9436324 - DNA, 22 bp, Homo sapiens
tggcccttcaaattccctagtc

SEQ ID NO: 9436325 - DNA, 22 bp, Homo sapiens
tggcccttctgagcacagggcc

SEQ ID NO: 9436326 - DNA, 20 bp, Homo sapiens
tggccctgttttctccaggc

SEQ ID NO: 9436327 - DNA, 20 bp, Homo sapiens
tggccctgttttctccaggc

SEQ ID NO: 9436328 - DNA, 22 bp, Homo sapiens
tggccctgtggcttcagaacag

SEQ ID NO: 9436329 - DNA, 22 bp, Homo sapiens
tggccctgtggcttcagaacag

SEQ ID NO: 9436330 - DNA, 22 bp, Homo sapiens
tggccctgtggcttcagaacag

SEQ ID NO: 9436331 - DNA, 22 bp, Homo sapiens
tggccctgtggaggtcagtgag

SEQ ID NO: 9436332 - DNA, 22 bp, Homo sapiens
tggccctgtggaggtcagtgag

SEQ ID NO: 9436333 - DNA, 22 bp, Homo sapiens
tggccctgtggaggtcagtgag

SEQ ID NO: 9436334 - DNA, 23 bp, Homo sapiens
tggccctgtgcatgctgcttccc

SEQ ID NO: 9436335 - DNA, 22 bp, Homo sapiens
tggccctgtgtgcaggctgcac

SEQ ID NO: 9436336 - DNA, 22 bp, Homo sapiens
tggccctgtgtgcaggctgcac

SEQ ID NO: 9436337 - DNA, 22 bp, Homo sapiens
tggccctgtgtgcaggctgcac

SEQ ID NO: 9436338 - DNA, 22 bp, Homo sapiens
tggccctgtgtcctgctgccag

SEQ ID NO: 9436339 - DNA, 22 bp, Homo sapiens
tggccctgtgtcctgctgccag

SEQ ID NO: 9436340 - DNA, 22 bp, Homo sapiens
tggccctgtgtcctgctgccag

SEQ ID NO: 9436341 - DNA, 22 bp, Homo sapiens
tggccctgtgtcctgctgccag

SEQ ID NO: 9436342 - DNA, 22 bp, Homo sapiens
tggccctgtgtcctgctgccag

SEQ ID NO: 9436343 - DNA, 22 bp, Homo sapiens
tggccctgtgtcctgctgccag

SEQ ID NO: 9436344 - DNA, 22 bp, Homo sapiens
tggccctgtgactgagttctag

SEQ ID NO: 9436345 - DNA, 23 bp, Homo sapiens
tggccctgtgcatgctgcttccc

SEQ ID NO: 9436346 - DNA, 22 bp, Homo sapiens
tggccctgtgactgagttctag

SEQ ID NO: 9436347 - DNA, 22 bp, Homo sapiens
tggccctgtctgcacacaggat

SEQ ID NO: 9436348 - DNA, 22 bp, Homo sapiens
tggccctgtcctcatttcatct

SEQ ID NO: 9436349 - DNA, 22 bp, Homo sapiens
tggccctgtcctcatttcatct

SEQ ID NO: 9436350 - DNA, 22 bp, Homo sapiens
tggccctggtggcacagcctgc

SEQ ID NO: 9436351 - DNA, 22 bp, Homo sapiens
tggccctgggtggaatgtccca

SEQ ID NO: 9436352 - DNA, 22 bp, Homo sapiens
tggccctgggtggaatgtccca

SEQ ID NO: 9436353 - DNA, 22 bp, Homo sapiens
tggccctggtggcacagcctgc

SEQ ID NO: 9436354 - DNA, 22 bp, Homo sapiens
tggccctgtccctggagcctgg

SEQ ID NO: 9436355 - DNA, 22 bp, Homo sapiens
tggccctgtccctggagcctgg

SEQ ID NO: 9436356 - DNA, 22 bp, Homo sapiens
tggccctgggcagaggcaacat

SEQ ID NO: 9436357 - DNA, 22 bp, Homo sapiens
tggccctgggcagaggcaacat

SEQ ID NO: 9436358 - DNA, 22 bp, Homo sapiens
tggccctgggcagaggcaacat

SEQ ID NO: 9436359 - DNA, 22 bp, Homo sapiens
tggccctgggcagaggcaacat

SEQ ID NO: 9436360 - DNA, 22 bp, Homo sapiens
tggccctgggcatctttcgtga

SEQ ID NO: 9436361 - DNA, 22 bp, Homo sapiens
tggccctggctgagttagattt

SEQ ID NO: 9436362 - DNA, 21 bp, Homo sapiens
tggccctggccacggctgcca

SEQ ID NO: 9436363 - DNA, 22 bp, Homo sapiens
tggccctgccactcactgctga

SEQ ID NO: 9436364 - DNA, 22 bp, Homo sapiens
tggccctgccactcactgctga

SEQ ID NO: 9436365 - DNA, 22 bp, Homo sapiens
tggccctgccactcactgctga

SEQ ID NO: 9436366 - DNA, 22 bp, Homo sapiens
tggccctgccactcactgctga

SEQ ID NO: 9436367 - DNA, 22 bp, Homo sapiens
tggccctgccactcactgctga

SEQ ID NO: 9436368 - DNA, 22 bp, Homo sapiens
tggccctgccctcttcatcttt

SEQ ID NO: 9436369 - DNA, 22 bp, Homo sapiens
tggccctgccgcactatcctca

SEQ ID NO: 9436370 - DNA, 22 bp, Homo sapiens
tggccctgccgccacgacgtct

SEQ ID NO: 9436371 - DNA, 22 bp, Homo sapiens
tggcaggtgaagttgttaggga

SEQ ID NO: 9436372 - DNA, 18 bp, Homo sapiens
tggcaggtccagctgtgg

SEQ ID NO: 9436373 - DNA, 18 bp, Homo sapiens
tggcaggtccagctgtgg

SEQ ID NO: 9436374 - DNA, 19 bp, Homo sapiens
tggcaggtagtgagcagtc

SEQ ID NO: 9436375 - DNA, 22 bp, Homo sapiens
tggcagggtgccagttgcgagt

SEQ ID NO: 9436376 - DNA, 22 bp, Homo sapiens
tggcagggtgccagttgcgagt

SEQ ID NO: 9436377 - DNA, 22 bp, Homo sapiens
tggcagggtcttgctgtgttgc

SEQ ID NO: 9436378 - DNA, 22 bp, Homo sapiens
tggcagggtcttgctgtgttgc

SEQ ID NO: 9436379 - DNA, 22 bp, Homo sapiens
tggcagtgaaccaaggctccaa

SEQ ID NO: 9436380 - DNA, 22 bp, Homo sapiens
tggcagtgaaagacaattgggc

SEQ ID NO: 9436381 - DNA, 22 bp, Homo sapiens
tggcagtgaaccaaggctccaa

SEQ ID NO: 9436382 - DNA, 18 bp, Homo sapiens
tggcagtgaggtaggcat

SEQ ID NO: 9436383 - DNA, 18 bp, Homo sapiens
tggcagtgccaccttctc

SEQ ID NO: 9436384 - DNA, 18 bp, Homo sapiens
tggcagtgaggtaggcat

SEQ ID NO: 9436385 - DNA, 22 bp, Homo sapiens
tggcagtgatgcggcaggacat

SEQ ID NO: 9436386 - DNA, 22 bp, Homo sapiens
tggcagtgatgcggcaggacat

SEQ ID NO: 9436387 - DNA, 22 bp, Homo sapiens
tggcagtgatgcggcaggacat

SEQ ID NO: 9436388 - DNA, 22 bp, Homo sapiens
tggcagtccctctggtagcacc

SEQ ID NO: 9436389 - DNA, 22 bp, Homo sapiens
tggcagtccctctggtagcacc

SEQ ID NO: 9436390 - DNA, 22 bp, Homo sapiens
tggcagtcgatcatattcagca

SEQ ID NO: 9436391 - DNA, 22 bp, Homo sapiens
tggcaggtttcctcctcatagt

SEQ ID NO: 9436392 - DNA, 22 bp, Homo sapiens
tggcagtcattatcgctgagtc

SEQ ID NO: 9436393 - DNA, 22 bp, Homo sapiens
tggcagtccagaccctggactc

SEQ ID NO: 9436394 - DNA, 22 bp, Homo sapiens
tggcatgggccagggagagctg

SEQ ID NO: 9436395 - DNA, 22 bp, Homo sapiens
tggcatgggcaaaccagggaaa

SEQ ID NO: 9436396 - DNA, 22 bp, Homo sapiens
tggcatggcatttagagaatta

SEQ ID NO: 9436397 - DNA, 22 bp, Homo sapiens
tggcatggcaaccctgcaggga

SEQ ID NO: 9436398 - DNA, 22 bp, Homo sapiens
tggcatggactagtgctgaggt

SEQ ID NO: 9436399 - DNA, 22 bp, Homo sapiens
tggcatgaagtcagcagctggg

SEQ ID NO: 9436400 - DNA, 22 bp, Homo sapiens
tggcatgaagtcagcagctggg

SEQ ID NO: 9436401 - DNA, 19 bp, Homo sapiens
tggcatgatgatggatggg

SEQ ID NO: 9436402 - DNA, 22 bp, Homo sapiens
tggcatgataggaggtgcagaa

SEQ ID NO: 9436403 - DNA, 22 bp, Homo sapiens
tggcagtgctgcagtgccctta

SEQ ID NO: 9436404 - DNA, 22 bp, Homo sapiens
tggcagtgccccttgaccagtg

SEQ ID NO: 9436405 - DNA, 23 bp, Homo sapiens
tggcagtgcccagggagatgatc

SEQ ID NO: 9436406 - DNA, 22 bp, Homo sapiens
tggcagtgccccttgaccagtg

SEQ ID NO: 9436407 - DNA, 22 bp, Homo sapiens
tggcagtggcgggactcagggc

SEQ ID NO: 9436408 - DNA, 22 bp, Homo sapiens
tggcagtggcatcaccccaata

SEQ ID NO: 9436409 - DNA, 22 bp, Homo sapiens
tggcagtggcactgcccccata

SEQ ID NO: 9436410 - DNA, 22 bp, Homo sapiens
tggcagtgttgtgccacattcc

SEQ ID NO: 9436411 - DNA, 22 bp, Homo sapiens
tggcagtgtttctaaggggctc

SEQ ID NO: 9436412 - DNA, 22 bp, Homo sapiens
tggcagtgtgtgagctgttatt

SEQ ID NO: 9436413 - DNA, 22 bp, Homo sapiens
tggcagtggctcagagtgcaga

SEQ ID NO: 9436414 - DNA, 22 bp, Homo sapiens
tggcagtggctcagagtgcaga

SEQ ID NO: 9436415 - DNA, 22 bp, Homo sapiens
tggcagttcaggctgcaatcat

SEQ ID NO: 9436416 - DNA, 22 bp, Homo sapiens
tggcagttcaggctgcaatcat

SEQ ID NO: 9436417 - DNA, 22 bp, Homo sapiens
tggcagtgtttctaaggggctc

SEQ ID NO: 9436418 - DNA, 22 bp, Homo sapiens
tggcagtgtttctaaggggctc

SEQ ID NO: 9436419 - DNA, 22 bp, Homo sapiens
tggcagttggggatgaagtgag

SEQ ID NO: 9436420 - DNA, 22 bp, Homo sapiens
tggcagtttacagagttctgaa

SEQ ID NO: 9436421 - DNA, 23 bp, Homo sapiens
tggcagttttcttttgtgccagc

SEQ ID NO: 9436422 - DNA, 22 bp, Homo sapiens
tggcagttttcaagagttctgt

SEQ ID NO: 9436423 - DNA, 23 bp, Homo sapiens
tggcatagtgaggggcacagaga

SEQ ID NO: 9436424 - DNA, 18 bp, Homo sapiens
tggcataaaatcagagtc

SEQ ID NO: 9436425 - DNA, 22 bp, Homo sapiens
tggcatccagataccctgaggg

SEQ ID NO: 9436426 - DNA, 22 bp, Homo sapiens
tggcatccacaaatgcttagat

SEQ ID NO: 9436427 - DNA, 23 bp, Homo sapiens
tggcatagtgaggggcacagaga

SEQ ID NO: 9436428 - DNA, 22 bp, Homo sapiens
tggccaccaccaatacttgcct

SEQ ID NO: 9436429 - DNA, 22 bp, Homo sapiens
tggccacccctttctctgcact

SEQ ID NO: 9436430 - DNA, 22 bp, Homo sapiens
tggccacccctttctctgcact

SEQ ID NO: 9436431 - DNA, 22 bp, Homo sapiens
tggccacccccaatgtcagtag

SEQ ID NO: 9436432 - DNA, 22 bp, Homo sapiens
tggccacatcctttccttgtca

SEQ ID NO: 9436433 - DNA, 22 bp, Homo sapiens
tggccacatcctttccttgtca

SEQ ID NO: 9436434 - DNA, 23 bp, Homo sapiens
tggccacagtccatgcatgccca

SEQ ID NO: 9436435 - DNA, 23 bp, Homo sapiens
tggccacagtccatgcatgccca

SEQ ID NO: 9436436 - DNA, 22 bp, Homo sapiens
tggccacagtgtccagcagcag

SEQ ID NO: 9436437 - DNA, 20 bp, Homo sapiens
tggccacctgcgtcccagcc

SEQ ID NO: 9436438 - DNA, 22 bp, Homo sapiens
tggccagaacctgcagtaggcc

SEQ ID NO: 9436439 - DNA, 22 bp, Homo sapiens
tggccagaaggtttaaaagagg

SEQ ID NO: 9436440 - DNA, 22 bp, Homo sapiens
tggccagaactcagacatgtgg

SEQ ID NO: 9436441 - DNA, 22 bp, Homo sapiens
tggccagaactcagacatgtgg

SEQ ID NO: 9436442 - DNA, 22 bp, Homo sapiens
tggccagagtccagtgagcctt

SEQ ID NO: 9436443 - DNA, 22 bp, Homo sapiens
tggcatttagagaaatgaagga

SEQ ID NO: 9436444 - DNA, 23 bp, Homo sapiens
tggccacagggtgctccattgta

SEQ ID NO: 9436445 - DNA, 22 bp, Homo sapiens
tggccacactgcccccactggg

SEQ ID NO: 9436446 - DNA, 22 bp, Homo sapiens
tggcatgtttaatgtactgtat

SEQ ID NO: 9436447 - DNA, 22 bp, Homo sapiens
tggcatgtttaatgtactgtat

SEQ ID NO: 9436448 - DNA, 22 bp, Homo sapiens
tggcatgtccacttcaacagtt

SEQ ID NO: 9436449 - DNA, 17 bp, Homo sapiens
tggccaggccccgccag

SEQ ID NO: 9436450 - DNA, 17 bp, Homo sapiens
tggccaggccccgccag

SEQ ID NO: 9436451 - DNA, 22 bp, Homo sapiens
tggccaggcattcagataagac

SEQ ID NO: 9436452 - DNA, 22 bp, Homo sapiens
tggccaggccggggacagaact

SEQ ID NO: 9436453 - DNA, 22 bp, Homo sapiens
tggccaggccggggacagaact

SEQ ID NO: 9436454 - DNA, 22 bp, Homo sapiens
tggccaggccggggacagaact

SEQ ID NO: 9436455 - DNA, 22 bp, Homo sapiens
tggccaggcctcttggtgccca

SEQ ID NO: 9436456 - DNA, 22 bp, Homo sapiens
tggccaggcattcagataagac

SEQ ID NO: 9436457 - DNA, 21 bp, Homo sapiens
tggccagctggagtctccaca

SEQ ID NO: 9436458 - DNA, 21 bp, Homo sapiens
tggccagctgctcgtctcctc

SEQ ID NO: 9436459 - DNA, 21 bp, Homo sapiens
tggccagctgctcgtctcctc

SEQ ID NO: 9436460 - DNA, 22 bp, Homo sapiens
tggccagcctggtgcttgctcc

SEQ ID NO: 9436461 - DNA, 22 bp, Homo sapiens
tggccagcccttcagccatgcc

SEQ ID NO: 9436462 - DNA, 22 bp, Homo sapiens
tggccagccttgtcatcgcttt

SEQ ID NO: 9436463 - DNA, 22 bp, Homo sapiens
tggccagctgagatttagcaca

SEQ ID NO: 9436464 - DNA, 22 bp, Homo sapiens
tggccagctgagatttagcaca

SEQ ID NO: 9436465 - DNA, 22 bp, Homo sapiens
tggccagccctcttcccacact

SEQ ID NO: 9436466 - DNA, 22 bp, Homo sapiens
tggccagccctcttcccacact

SEQ ID NO: 9436467 - DNA, 22 bp, Homo sapiens
tggccagccctcttcccacact

SEQ ID NO: 9436468 - DNA, 22 bp, Homo sapiens
tggccagccagaaagaagcctt

SEQ ID NO: 9436469 - DNA, 22 bp, Homo sapiens
tggccagccataaaagaaccca

SEQ ID NO: 9436470 - DNA, 22 bp, Homo sapiens
tggccagccctcttcccacact

SEQ ID NO: 9436471 - DNA, 22 bp, Homo sapiens
tggccagcccttcagccatgcc

SEQ ID NO: 9436472 - DNA, 22 bp, Homo sapiens
tggccagcccttcagccatgcc

SEQ ID NO: 9436473 - DNA, 22 bp, Homo sapiens
tggccagcccttcagccatgcc

SEQ ID NO: 9436474 - DNA, 22 bp, Homo sapiens
tggccagcccttcagccatgcc

SEQ ID NO: 9436475 - DNA, 22 bp, Homo sapiens
tggccagcccttcagccatgcc

SEQ ID NO: 9436476 - DNA, 22 bp, Homo sapiens
tggccagcccttcagccatgcc

SEQ ID NO: 9436477 - DNA, 22 bp, Homo sapiens
tggccagcagagttcactctct

SEQ ID NO: 9436478 - DNA, 22 bp, Homo sapiens
tggccagccacaatataaagta

SEQ ID NO: 9436479 - DNA, 22 bp, Homo sapiens
tggccagccagaaagaagcctt

SEQ ID NO: 9436480 - DNA, 22 bp, Homo sapiens
tggccagccagaaagaagcctt

SEQ ID NO: 9436481 - DNA, 22 bp, Homo sapiens
tggccagattcatgcatgtatc

SEQ ID NO: 9436482 - DNA, 23 bp, Homo sapiens
tggccagcagaagcaaggggagc

SEQ ID NO: 9436483 - DNA, 22 bp, Homo sapiens
tggccagcacttagcccttacc

SEQ ID NO: 9436484 - DNA, 22 bp, Homo sapiens
tggccagcacttagcccttacc

SEQ ID NO: 9436485 - DNA, 22 bp, Homo sapiens
tggccagcacttagcccttacc

SEQ ID NO: 9436486 - DNA, 22 bp, Homo sapiens
tggccaggtgtgggttctcaga

SEQ ID NO: 9436487 - DNA, 22 bp, Homo sapiens
tggccaggtgtgggttctcaga

SEQ ID NO: 9436488 - DNA, 22 bp, Homo sapiens
tggccaggttgggctttgcagc

SEQ ID NO: 9436489 - DNA, 22 bp, Homo sapiens
tggccagtagataggcaggcaa

SEQ ID NO: 9436490 - DNA, 22 bp, Homo sapiens
tggccagtagataggcaggcaa

SEQ ID NO: 9436491 - DNA, 19 bp, Homo sapiens
tggccaggtactgtctgct

SEQ ID NO: 9436492 - DNA, 19 bp, Homo sapiens
tggccaggtactgtctgct

SEQ ID NO: 9436493 - DNA, 19 bp, Homo sapiens
tggccaggtactgtctgct

SEQ ID NO: 9436494 - DNA, 23 bp, Homo sapiens
tggccaggtagaggaggtagtga

SEQ ID NO: 9436495 - DNA, 23 bp, Homo sapiens
tggccaggtagaggaggtagtga

SEQ ID NO: 9436496 - DNA, 22 bp, Homo sapiens
tggccaggctggtctggaacgc

SEQ ID NO: 9436497 - DNA, 22 bp, Homo sapiens
tggccaggctggtctggaacgc

SEQ ID NO: 9436498 - DNA, 22 bp, Homo sapiens
tggccaggctggtctggaacgc

SEQ ID NO: 9436499 - DNA, 22 bp, Homo sapiens
tggccaggcctcttggtgccca

SEQ ID NO: 9436500 - DNA, 22 bp, Homo sapiens
tggccaggcctcttggtgccca

SEQ ID NO: 9436501 - DNA, 23 bp, Homo sapiens
tggccagggtactacacccaccc

SEQ ID NO: 9436502 - DNA, 23 bp, Homo sapiens
tggccagggtactacacccaccc

SEQ ID NO: 9436503 - DNA, 23 bp, Homo sapiens
tggccagggtactacacccaccc

SEQ ID NO: 9436504 - DNA, 22 bp, Homo sapiens
tggccaggggagttcccctcca

SEQ ID NO: 9436505 - DNA, 22 bp, Homo sapiens
tggccaggctggtctggaacgc

SEQ ID NO: 9436506 - DNA, 22 bp, Homo sapiens
tggccaggggagttcccctcca

SEQ ID NO: 9436507 - DNA, 22 bp, Homo sapiens
tgtccccacctaaatcttatct

SEQ ID NO: 9436508 - DNA, 22 bp, Homo sapiens
tgtcccatggcttttctggtgg

SEQ ID NO: 9436509 - DNA, 22 bp, Homo sapiens
tgtcccatggataccaggctat

SEQ ID NO: 9436510 - DNA, 22 bp, Homo sapiens
tgtcccatggataccaggctat

SEQ ID NO: 9436511 - DNA, 22 bp, Homo sapiens
tgtcccatggacacaacttctt

SEQ ID NO: 9436512 - DNA, 22 bp, Homo sapiens
tgtccccaaggttcagcccaca

SEQ ID NO: 9436513 - DNA, 22 bp, Homo sapiens
tgtcccctttacctccgcagcc

SEQ ID NO: 9436514 - DNA, 20 bp, Homo sapiens
tgtcccctagatcccagctc

SEQ ID NO: 9436515 - DNA, 22 bp, Homo sapiens
tgtccctgatccactggacccc

SEQ ID NO: 9436516 - DNA, 18 bp, Homo sapiens
tgtccctgcaaataacat

SEQ ID NO: 9436517 - DNA, 18 bp, Homo sapiens
tgtccctgcaaataacat

SEQ ID NO: 9436518 - DNA, 22 bp, Homo sapiens
tgtccctggaactatggctcca

SEQ ID NO: 9436519 - DNA, 19 bp, Homo sapiens
tgtccctggtcaccagact

SEQ ID NO: 9436520 - DNA, 19 bp, Homo sapiens
tgtccctggtcaccagact

SEQ ID NO: 9436521 - DNA, 22 bp, Homo sapiens
tgtccctggtggaggctggcag

SEQ ID NO: 9436522 - DNA, 22 bp, Homo sapiens
tgtccctggtggaggctggcag

SEQ ID NO: 9436523 - DNA, 19 bp, Homo sapiens
tgtccgtggccttctggat

SEQ ID NO: 9436524 - DNA, 22 bp, Homo sapiens
tgtccctggtggaggctggcag

SEQ ID NO: 9436525 - DNA, 22 bp, Homo sapiens
tgtcccagttgggtattgaatt

SEQ ID NO: 9436526 - DNA, 22 bp, Homo sapiens
tgtcccagttcccagggttgct

SEQ ID NO: 9436527 - DNA, 22 bp, Homo sapiens
tgtcccagtcaaggctgtcatc

SEQ ID NO: 9436528 - DNA, 22 bp, Homo sapiens
tgtcccagtcaaggctgtcatc

SEQ ID NO: 9436529 - DNA, 22 bp, Homo sapiens
tgtcccagtttatctgggactg

SEQ ID NO: 9436530 - DNA, 22 bp, Homo sapiens
tgtcccagggaaggcccagcac

SEQ ID NO: 9436531 - DNA, 22 bp, Homo sapiens
tgtcccaggtcctagatgacca

SEQ ID NO: 9436532 - DNA, 22 bp, Homo sapiens
tgtcccagggaaggcccagcac

SEQ ID NO: 9436533 - DNA, 17 bp, Homo sapiens
tgtcccaggctcaacgc

SEQ ID NO: 9436534 - DNA, 22 bp, Homo sapiens
tgtcccaggcctcatgttgcca

SEQ ID NO: 9436535 - DNA, 22 bp, Homo sapiens
tgtccaggtggcctctgctgct

SEQ ID NO: 9436536 - DNA, 22 bp, Homo sapiens
tgtccaggtgtgtctaaagaga

SEQ ID NO: 9436537 - DNA, 22 bp, Homo sapiens
tgtcccagcactttgggagtct

SEQ ID NO: 9436538 - DNA, 22 bp, Homo sapiens
tgtccaggtggcctctgctgct

SEQ ID NO: 9436539 - DNA, 22 bp, Homo sapiens
tgtccaggtcagcagcagggac

SEQ ID NO: 9436540 - DNA, 22 bp, Homo sapiens
tgtccaggtcagcagcagggac

SEQ ID NO: 9436541 - DNA, 22 bp, Homo sapiens
tgtccaggtcagcagcagggac

SEQ ID NO: 9436542 - DNA, 22 bp, Homo sapiens
tgtccagggatggggtcaggga

SEQ ID NO: 9436543 - DNA, 22 bp, Homo sapiens
tgtccaggcactgggactctag

SEQ ID NO: 9436544 - DNA, 22 bp, Homo sapiens
tgtccaggcactgggactctag

SEQ ID NO: 9436545 - DNA, 22 bp, Homo sapiens
tgtccaggcggccttgcctgtt

SEQ ID NO: 9436546 - DNA, 22 bp, Homo sapiens
tgtcctgggaaatcccttaggc

SEQ ID NO: 9436547 - DNA, 22 bp, Homo sapiens
tgtcctggcctccagaaagtcg

SEQ ID NO: 9436548 - DNA, 22 bp, Homo sapiens
tgtcctggccaaggccttgctt

SEQ ID NO: 9436549 - DNA, 22 bp, Homo sapiens
tgtcctgggtcaaccaggtcga

SEQ ID NO: 9436550 - DNA, 22 bp, Homo sapiens
tgtcctgggtcaaatcctggtc

SEQ ID NO: 9436551 - DNA, 22 bp, Homo sapiens
tgtcctggggcgacttggggcc

SEQ ID NO: 9436552 - DNA, 22 bp, Homo sapiens
tgtcctgggtcaaatcctggtc

SEQ ID NO: 9436553 - DNA, 22 bp, Homo sapiens
tgtcctggggacaagaggccct

SEQ ID NO: 9436554 - DNA, 22 bp, Homo sapiens
tgtcctggggcgacttggggcc

SEQ ID NO: 9436555 - DNA, 22 bp, Homo sapiens
tgtcctggggacaagaggccct

SEQ ID NO: 9436556 - DNA, 22 bp, Homo sapiens
tgtcctgggccggcgactggtc

SEQ ID NO: 9436557 - DNA, 22 bp, Homo sapiens
tgtcctgggaggcggggtccag

SEQ ID NO: 9436558 - DNA, 22 bp, Homo sapiens
tgtcctgggaatgggatgcagt

SEQ ID NO: 9436559 - DNA, 22 bp, Homo sapiens
tgtcctgggaggcggggtccag

SEQ ID NO: 9436560 - DNA, 22 bp, Homo sapiens
tgtcctgggaatgggatgcagt

SEQ ID NO: 9436561 - DNA, 22 bp, Homo sapiens
tgtcctgggaatgggatgcagt

SEQ ID NO: 9436562 - DNA, 22 bp, Homo sapiens
tgtcctgggaactcacagtcca

SEQ ID NO: 9436563 - DNA, 22 bp, Homo sapiens
tgtccttataagaaaaggaaat

SEQ ID NO: 9436564 - DNA, 22 bp, Homo sapiens
tgtccttgatgaatatgaaatt

SEQ ID NO: 9436565 - DNA, 22 bp, Homo sapiens
tgtccttgtgacattctggctt

SEQ ID NO: 9436566 - DNA, 22 bp, Homo sapiens
tgtccttggccagtttctggtg

SEQ ID NO: 9436567 - DNA, 22 bp, Homo sapiens
tgtccttgatgaatatgaaatt

SEQ ID NO: 9436568 - DNA, 22 bp, Homo sapiens
tgtcctgttcatggctctggac

SEQ ID NO: 9436569 - DNA, 22 bp, Homo sapiens
tgtcctgttcttgctgtgtcct

SEQ ID NO: 9436570 - DNA, 21 bp, Homo sapiens
tgtccttaatgcaatgtcctt

SEQ ID NO: 9436571 - DNA, 22 bp, Homo sapiens
tgtccttttggctgtctatggt

SEQ ID NO: 9436572 - DNA, 22 bp, Homo sapiens
tgtcctttttcttaggaaatat

SEQ ID NO: 9436573 - DNA, 22 bp, Homo sapiens
tgtcctttttcttaggaaatat

SEQ ID NO: 9436574 - DNA, 22 bp, Homo sapiens
tgtccttttctttagtgcagct

SEQ ID NO: 9436575 - DNA, 22 bp, Homo sapiens
tgtccttttccccaaattcact

SEQ ID NO: 9436576 - DNA, 22 bp, Homo sapiens
tgtccttttccccaaattcact

SEQ ID NO: 9436577 - DNA, 22 bp, Homo sapiens
tgtcctttgttccctgtctctg

SEQ ID NO: 9436578 - DNA, 22 bp, Homo sapiens
tgtcctttgtgtatctatagta

SEQ ID NO: 9436579 - DNA, 22 bp, Homo sapiens
tgtcctttgtgtatctatagta

SEQ ID NO: 9436580 - DNA, 22 bp, Homo sapiens
tgtcctttgggagggcacagct

SEQ ID NO: 9436581 - DNA, 22 bp, Homo sapiens
tgtccttgttcctaatgtaaaa

SEQ ID NO: 9436582 - DNA, 22 bp, Homo sapiens
tgtcctttactgattgcttctg

SEQ ID NO: 9436583 - DNA, 22 bp, Homo sapiens
tgtcctttatgaaatggtgttt

SEQ ID NO: 9436584 - DNA, 22 bp, Homo sapiens
tgtccttgttcctaatgtaaaa

SEQ ID NO: 9436585 - DNA, 22 bp, Homo sapiens
tgtccttgtgacattctggctt

SEQ ID NO: 9436586 - DNA, 22 bp, Homo sapiens
tgtcctggtgctccaggtggct

SEQ ID NO: 9436587 - DNA, 22 bp, Homo sapiens
tgtcctggtgcttcttgggatt

SEQ ID NO: 9436588 - DNA, 22 bp, Homo sapiens
tgtcctggtgcttcttgggatt

SEQ ID NO: 9436589 - DNA, 22 bp, Homo sapiens
tgtcctgtacgaagccggagaa

SEQ ID NO: 9436590 - DNA, 19 bp, Homo sapiens
tgtcctgtcctgctctgac

SEQ ID NO: 9436591 - DNA, 22 bp, Homo sapiens
tgtcctgtgccaccttcctgag

SEQ ID NO: 9436592 - DNA, 22 bp, Homo sapiens
tgtcctgtgattccagctcttc

SEQ ID NO: 9436593 - DNA, 19 bp, Homo sapiens
tgtcctgtcctgctctgac

SEQ ID NO: 9436594 - DNA, 22 bp, Homo sapiens
tgtcctgtccttcctggaagtc

SEQ ID NO: 9436595 - DNA, 22 bp, Homo sapiens
tgtcctgtgacctggcaccaca

SEQ ID NO: 9436596 - DNA, 22 bp, Homo sapiens
tgtcctgggtccctgctagaag

SEQ ID NO: 9436597 - DNA, 22 bp, Homo sapiens
tgtcctgggtccctgctagaag

SEQ ID NO: 9436598 - DNA, 22 bp, Homo sapiens
tgtcctggtgctccaggtggct

SEQ ID NO: 9436599 - DNA, 22 bp, Homo sapiens
tgtcctgggtggatgcttcatt

SEQ ID NO: 9436600 - DNA, 21 bp, Homo sapiens
tgtcctggtcactgctctccc

SEQ ID NO: 9436601 - DNA, 22 bp, Homo sapiens
tgtcagttcaattatagtaatt

SEQ ID NO: 9436602 - DNA, 22 bp, Homo sapiens
tgtcagtttagttgaagaaaga

SEQ ID NO: 9436603 - DNA, 22 bp, Homo sapiens
tgtcagtttggctctaaagttt

SEQ ID NO: 9436604 - DNA, 22 bp, Homo sapiens
tgtcagtttcctgtgccctgct

SEQ ID NO: 9436605 - DNA, 22 bp, Homo sapiens
tgtcatagtgtggtagcagtgg

SEQ ID NO: 9436606 - DNA, 22 bp, Homo sapiens
tgtcatagtgtggtagcagtgg

SEQ ID NO: 9436607 - DNA, 22 bp, Homo sapiens
tgtcataaaacacaagctgttg

SEQ ID NO: 9436608 - DNA, 19 bp, Homo sapiens
tgtcagtgatacatgcttt

SEQ ID NO: 9436609 - DNA, 20 bp, Homo sapiens
tgtcagtgcctgaggcacag

SEQ ID NO: 9436610 - DNA, 22 bp, Homo sapiens
tgtcagtgagttgggtcctgag

SEQ ID NO: 9436611 - DNA, 22 bp, Homo sapiens
tgtcagtgtctatgaagaattt

SEQ ID NO: 9436612 - DNA, 22 bp, Homo sapiens
tgtcagtggtcatagtagaaaa

SEQ ID NO: 9436613 - DNA, 22 bp, Homo sapiens
tgtcagtggtagacccagaggt

SEQ ID NO: 9436614 - DNA, 22 bp, Homo sapiens
tgtcactttggggagagttttg

SEQ ID NO: 9436615 - DNA, 22 bp, Homo sapiens
tgtcaggagggtccagagaaaa

SEQ ID NO: 9436616 - DNA, 22 bp, Homo sapiens
tgtcactttgccttctggactt

SEQ ID NO: 9436617 - DNA, 22 bp, Homo sapiens
tgtcactttggggagagttttg

SEQ ID NO: 9436618 - DNA, 22 bp, Homo sapiens
tgtcacttcagttttgaaacaa

SEQ ID NO: 9436619 - DNA, 22 bp, Homo sapiens
tgtcactcaagttccaatttac

SEQ ID NO: 9436620 - DNA, 22 bp, Homo sapiens
tgtcactacatcataaatatat

SEQ ID NO: 9436621 - DNA, 22 bp, Homo sapiens
tgtcacctttacccttttatag

SEQ ID NO: 9436622 - DNA, 22 bp, Homo sapiens
tgtcaccttgcagggctggggc

SEQ ID NO: 9436623 - DNA, 22 bp, Homo sapiens
tgtcaccttgctcatcctcgga

SEQ ID NO: 9436624 - DNA, 19 bp, Homo sapiens
tgtcaccttctgtcagttt

SEQ ID NO: 9436625 - DNA, 22 bp, Homo sapiens
tgtcaccttgatgatggcctag

SEQ ID NO: 9436626 - DNA, 22 bp, Homo sapiens
tgtcacctggaaatcactctaa

SEQ ID NO: 9436627 - DNA, 22 bp, Homo sapiens
tgtcaggttcaaatcttggtcc

SEQ ID NO: 9436628 - DNA, 22 bp, Homo sapiens
tgtcaggtgcagcttggatgca

SEQ ID NO: 9436629 - DNA, 22 bp, Homo sapiens
tgtcaggtgacagtttttacca

SEQ ID NO: 9436630 - DNA, 22 bp, Homo sapiens
tgtcaggtgacacactaggagc

SEQ ID NO: 9436631 - DNA, 15 bp, Homo sapiens
tgtcaggtgaatggt

SEQ ID NO: 9436632 - DNA, 22 bp, Homo sapiens
tgtcaggtctctgtgatggtaa

SEQ ID NO: 9436633 - DNA, 22 bp, Homo sapiens
tgtcaggtctacaaaaatgctg

SEQ ID NO: 9436634 - DNA, 22 bp, Homo sapiens
tgtcaggttctttaattctgca

SEQ ID NO: 9436635 - DNA, 22 bp, Homo sapiens
tgtcaggttcagtgattttact

SEQ ID NO: 9436636 - DNA, 22 bp, Homo sapiens
tgtcaggtttcagttaatggtt

SEQ ID NO: 9436637 - DNA, 22 bp, Homo sapiens
tgtcaggttggttttcagagaa

SEQ ID NO: 9436638 - DNA, 22 bp, Homo sapiens
tgtcaggtttctccaacttata

SEQ ID NO: 9436639 - DNA, 18 bp, Homo sapiens
tgtcagtaaagtgacaga

SEQ ID NO: 9436640 - DNA, 22 bp, Homo sapiens
tgtcaggtagagataatggggg

SEQ ID NO: 9436641 - DNA, 22 bp, Homo sapiens
tgtcaggtagtaggtagaaact

SEQ ID NO: 9436642 - DNA, 22 bp, Homo sapiens
tgtcaggtcagacttggttttt

SEQ ID NO: 9436643 - DNA, 22 bp, Homo sapiens
tgtcaggtatgcaacagaatgc

SEQ ID NO: 9436644 - DNA, 22 bp, Homo sapiens
tgtcaggtcattgccatggaaa

SEQ ID NO: 9436645 - DNA, 22 bp, Homo sapiens
tgtcaggtcagtatttgatgcc

SEQ ID NO: 9436646 - DNA, 22 bp, Homo sapiens
tgtcaggtctaaaatgggtctc

SEQ ID NO: 9436647 - DNA, 22 bp, Homo sapiens
tgtcaggtctaaaatgggtctc

SEQ ID NO: 9436648 - DNA, 22 bp, Homo sapiens
tgtcaggagccaccagcactcc

SEQ ID NO: 9436649 - DNA, 22 bp, Homo sapiens
tgtcaggcaaaggaaggtattt

SEQ ID NO: 9436650 - DNA, 23 bp, Homo sapiens
tgtcaggtaaggaaggattcact

SEQ ID NO: 9436651 - DNA, 22 bp, Homo sapiens
tgtcatttaatagatatgatgg

SEQ ID NO: 9436652 - DNA, 22 bp, Homo sapiens
tgtcatttaatagatatgatgg

SEQ ID NO: 9436653 - DNA, 22 bp, Homo sapiens
tgtcatttagtcctctgtgtgt

SEQ ID NO: 9436654 - DNA, 22 bp, Homo sapiens
tgtcatttaaagctttccagat

SEQ ID NO: 9436655 - DNA, 22 bp, Homo sapiens
tgtcattggtacaaattgattg

SEQ ID NO: 9436656 - DNA, 20 bp, Homo sapiens
tgtcattcttctttcacagg

SEQ ID NO: 9436657 - DNA, 22 bp, Homo sapiens
tgtcatttattctcttattcta

SEQ ID NO: 9436658 - DNA, 22 bp, Homo sapiens
tgtcatttatgcttcttcagtg

SEQ ID NO: 9436659 - DNA, 22 bp, Homo sapiens
tgtcatttattttgctgtctgt

SEQ ID NO: 9436660 - DNA, 22 bp, Homo sapiens
tgtcatttattctcttattcta

SEQ ID NO: 9436661 - DNA, 22 bp, Homo sapiens
tgtcatatcctccttaaaggtg

SEQ ID NO: 9436662 - DNA, 22 bp, Homo sapiens
tgtcatatagatattagacagg

SEQ ID NO: 9436663 - DNA, 22 bp, Homo sapiens
tgtcatatctattaaatgtcta

SEQ ID NO: 9436664 - DNA, 22 bp, Homo sapiens
tgtcatatgctgtcatagccat

SEQ ID NO: 9436665 - DNA, 22 bp, Homo sapiens
tgtcatatgtaatatgttcatt

SEQ ID NO: 9436666 - DNA, 22 bp, Homo sapiens
tgtcatctcactgatatagatg

SEQ ID NO: 9436667 - DNA, 22 bp, Homo sapiens
tgtcatcatttgagagaagaaa

SEQ ID NO: 9436668 - DNA, 21 bp, Homo sapiens
tgtcatatttcaatacagttt

SEQ ID NO: 9436669 - DNA, 22 bp, Homo sapiens
tgtcatctgatattacttatag

SEQ ID NO: 9436670 - DNA, 22 bp, Homo sapiens
tgtcatctcactgatatagatg

SEQ ID NO: 9436671 - DNA, 23 bp, Homo sapiens
tgtcatctccagactcccagtgc

SEQ ID NO: 9436672 - DNA, 22 bp, Homo sapiens
tgtcattccttcaatgtagata

SEQ ID NO: 9436673 - DNA, 22 bp, Homo sapiens
tgtcatgatgtgcacaccacag

SEQ ID NO: 9436674 - DNA, 22 bp, Homo sapiens
tgtcatcttaaatcattcccac

SEQ ID NO: 9436675 - DNA, 22 bp, Homo sapiens
tgtcatttcctgaatgctgagt

SEQ ID NO: 9436676 - DNA, 22 bp, Homo sapiens
tgtcatttggactttggtatta

SEQ ID NO: 9436677 - DNA, 22 bp, Homo sapiens
tgtcatttattttgctgtctgt

SEQ ID NO: 9436678 - DNA, 22 bp, Homo sapiens
tgtcatttcacaatatcactca

SEQ ID NO: 9436679 - DNA, 22 bp, Homo sapiens
tgtcatttcacaatatcactca

SEQ ID NO: 9436680 - DNA, 22 bp, Homo sapiens
tgtcatttcctgaatgctgagt

SEQ ID NO: 9436681 - DNA, 22 bp, Homo sapiens
tgtcattttcatcctaaggagc

SEQ ID NO: 9436682 - DNA, 22 bp, Homo sapiens
tgtcattttctaatctgttgtc

SEQ ID NO: 9436683 - DNA, 22 bp, Homo sapiens
tgtcattttctaatctgttgtc

SEQ ID NO: 9436684 - DNA, 22 bp, Homo sapiens
tgtcattttcagcttatgcttc

SEQ ID NO: 9436685 - DNA, 22 bp, Homo sapiens
tgtcattttcagcttatgcttc

SEQ ID NO: 9436686 - DNA, 22 bp, Homo sapiens
tgtcattttgtctcactgctat

SEQ ID NO: 9436687 - DNA, 22 bp, Homo sapiens
tgtccaatgccctttccacatg

SEQ ID NO: 9436688 - DNA, 22 bp, Homo sapiens
tgtccaccgttcagcaccagag

SEQ ID NO: 9436689 - DNA, 22 bp, Homo sapiens
tgtccaccggtcctgtgatggg

SEQ ID NO: 9436690 - DNA, 22 bp, Homo sapiens
tgtccaccgttcagcaccagag

SEQ ID NO: 9436691 - DNA, 22 bp, Homo sapiens
tgtccaggagtaaaaagacctg

SEQ ID NO: 9436692 - DNA, 22 bp, Homo sapiens
tgtccaggagtaaaaagacctg

SEQ ID NO: 9436693 - DNA, 22 bp, Homo sapiens
tgtccaggaccctattctcact

SEQ ID NO: 9436694 - DNA, 22 bp, Homo sapiens
tgtccaggaattgaccctgcaa

SEQ ID NO: 9436695 - DNA, 22 bp, Homo sapiens
tgtccagcggcctggctgctga

SEQ ID NO: 9436696 - DNA, 22 bp, Homo sapiens
tgtccagcggcctggctgctga

SEQ ID NO: 9436697 - DNA, 22 bp, Homo sapiens
tgtccagctcgagacactatct

SEQ ID NO: 9436698 - DNA, 22 bp, Homo sapiens
tgtccagcacagccaggcttac

SEQ ID NO: 9436699 - DNA, 22 bp, Homo sapiens
tgtccagagtcacagagctcaa

SEQ ID NO: 9436700 - DNA, 22 bp, Homo sapiens
tgtagaggaaagatgaaggccg

SEQ ID NO: 9436701 - DNA, 18 bp, Homo sapiens
tgtagagccaggtttgcc

SEQ ID NO: 9436702 - DNA, 22 bp, Homo sapiens
tgtagatatagaaaaagactga

SEQ ID NO: 9436703 - DNA, 22 bp, Homo sapiens
tgtagatattaattattccttt

SEQ ID NO: 9436704 - DNA, 22 bp, Homo sapiens
tgtagatgagtcagggtgcatg

SEQ ID NO: 9436705 - DNA, 22 bp, Homo sapiens
tgtagatgagtcagggtgcatg

SEQ ID NO: 9436706 - DNA, 22 bp, Homo sapiens
tgtagatgagtcagggtgcacc

SEQ ID NO: 9436707 - DNA, 22 bp, Homo sapiens
tgtagatgagtcagggtgcacc

SEQ ID NO: 9436708 - DNA, 22 bp, Homo sapiens
tgtagcactatgcactacacat

SEQ ID NO: 9436709 - DNA, 19 bp, Homo sapiens
tgtagcagtttaaaacaac

SEQ ID NO: 9436710 - DNA, 19 bp, Homo sapiens
tgtagcagtttaaaacaac

SEQ ID NO: 9436711 - DNA, 22 bp, Homo sapiens
tgtagcaagagcaatccattgt

SEQ ID NO: 9436712 - DNA, 22 bp, Homo sapiens
tgtagattttggagtctacaag

SEQ ID NO: 9436713 - DNA, 22 bp, Homo sapiens
tgtagcaagagcaatccattgt

SEQ ID NO: 9436714 - DNA, 22 bp, Homo sapiens
tgtagattttggagtctacaag

SEQ ID NO: 9436715 - DNA, 22 bp, Homo sapiens
tgtagcacaagatagatacttc

SEQ ID NO: 9436716 - DNA, 22 bp, Homo sapiens
tgtaggaaaaacaatgatctgc

SEQ ID NO: 9436717 - DNA, 22 bp, Homo sapiens
tgtaggaaaaacaatgatctgc

SEQ ID NO: 9436718 - DNA, 17 bp, Homo sapiens
tgtagcttctccttctc

SEQ ID NO: 9436719 - DNA, 22 bp, Homo sapiens
tgtaggaactcacagatattct

SEQ ID NO: 9436720 - DNA, 22 bp, Homo sapiens
tgtaggaatggattctagaagg

SEQ ID NO: 9436721 - DNA, 20 bp, Homo sapiens
tgtaggaaggaccctgtctg

SEQ ID NO: 9436722 - DNA, 18 bp, Homo sapiens
tgtagctggaggccaggc

SEQ ID NO: 9436723 - DNA, 22 bp, Homo sapiens
tgtagctatagaggctgtacct

SEQ ID NO: 9436724 - DNA, 19 bp, Homo sapiens
tgtagctagtgtctatcca

SEQ ID NO: 9436725 - DNA, 22 bp, Homo sapiens
tgtagcagtttttcattatcca

SEQ ID NO: 9436726 - DNA, 23 bp, Homo sapiens
tgtagcatctcttatttctcagc

SEQ ID NO: 9436727 - DNA, 22 bp, Homo sapiens
tgtactaatgcatttaactaac

SEQ ID NO: 9436728 - DNA, 19 bp, Homo sapiens
tgtacgtgtgggtgtttaa

SEQ ID NO: 9436729 - DNA, 22 bp, Homo sapiens
tgtactattaagaggcctaaat

SEQ ID NO: 9436730 - DNA, 22 bp, Homo sapiens
tgtactgtatgccaggcactat

SEQ ID NO: 9436731 - DNA, 22 bp, Homo sapiens
tgtactgtattcatctttaact

SEQ ID NO: 9436732 - DNA, 22 bp, Homo sapiens
tgtacttgaacttgactgtaga

SEQ ID NO: 9436733 - DNA, 22 bp, Homo sapiens
tgtacttgaacttgactgtaga

SEQ ID NO: 9436734 - DNA, 22 bp, Homo sapiens
tgtacttgcttattagaaatct

SEQ ID NO: 9436735 - DNA, 22 bp, Homo sapiens
tgtacttattttatgtcagcac

SEQ ID NO: 9436736 - DNA, 22 bp, Homo sapiens
tgtacttatgagatcctagtcg

SEQ ID NO: 9436737 - DNA, 22 bp, Homo sapiens
tgtagaaaattggagcattcat

SEQ ID NO: 9436738 - DNA, 18 bp, Homo sapiens
tgtagaaaagataggaat

SEQ ID NO: 9436739 - DNA, 22 bp, Homo sapiens
tgtacttgcttattagaaatct

SEQ ID NO: 9436740 - DNA, 22 bp, Homo sapiens
tgtagaaactacacatgcaaca

SEQ ID NO: 9436741 - DNA, 22 bp, Homo sapiens
tgtagaaactacacatgcaaca

SEQ ID NO: 9436742 - DNA, 22 bp, Homo sapiens
tgtagaaactacacatgcaaca

SEQ ID NO: 9436743 - DNA, 22 bp, Homo sapiens
tgtagaagttcttcaggagaat

SEQ ID NO: 9436744 - DNA, 18 bp, Homo sapiens
tgtagagccaggtttgcc

SEQ ID NO: 9436745 - DNA, 22 bp, Homo sapiens
tgtagacagtgggatctctggg

SEQ ID NO: 9436746 - DNA, 22 bp, Homo sapiens
tgtagaagtaggagtcatctca

SEQ ID NO: 9436747 - DNA, 22 bp, Homo sapiens
tgtagaagttcttcaggagaat

SEQ ID NO: 9436748 - DNA, 22 bp, Homo sapiens
tgtagaagttcttcaggagaat

SEQ ID NO: 9436749 - DNA, 22 bp, Homo sapiens
tgtagaagctagcctggagcca

SEQ ID NO: 9436750 - DNA, 22 bp, Homo sapiens
tgtagaacctgtttattataga

SEQ ID NO: 9436751 - DNA, 22 bp, Homo sapiens
tgtagaaattagtaagatcaac

SEQ ID NO: 9436752 - DNA, 22 bp, Homo sapiens
tgtatctgtgatgtaggggttt

SEQ ID NO: 9436753 - DNA, 22 bp, Homo sapiens
tgtatcaatcatgtaatttggt

SEQ ID NO: 9436754 - DNA, 22 bp, Homo sapiens
tgtatcactcagcaaagtgtct

SEQ ID NO: 9436755 - DNA, 22 bp, Homo sapiens
tgtatcttagtgtgaaaatatt

SEQ ID NO: 9436756 - DNA, 22 bp, Homo sapiens
tgtatcttcagtttgtctttcc

SEQ ID NO: 9436757 - DNA, 22 bp, Homo sapiens
tgtatattctgcctaaaagctt

SEQ ID NO: 9436758 - DNA, 22 bp, Homo sapiens
tgtatcaaaccaaattaattct

SEQ ID NO: 9436759 - DNA, 22 bp, Homo sapiens
tgtatcaaaccaaattaattct

SEQ ID NO: 9436760 - DNA, 22 bp, Homo sapiens
tgtatcaagggtttatgtaagc

SEQ ID NO: 9436761 - DNA, 22 bp, Homo sapiens
tgtatcaagggtttatgtaagc

SEQ ID NO: 9436762 - DNA, 22 bp, Homo sapiens
tgtatatgtcctggcatgtcat

SEQ ID NO: 9436763 - DNA, 22 bp, Homo sapiens
tgtatatgtgcacatgtgcttc

SEQ ID NO: 9436764 - DNA, 22 bp, Homo sapiens
tgtataaacttaagcaggaacc

SEQ ID NO: 9436765 - DNA, 22 bp, Homo sapiens
tgtataaatttaaattcctgct

SEQ ID NO: 9436766 - DNA, 22 bp, Homo sapiens
tgtataaacttaagcaggaacc

SEQ ID NO: 9436767 - DNA, 22 bp, Homo sapiens
tgtataagcctagtgaaatttc

SEQ ID NO: 9436768 - DNA, 22 bp, Homo sapiens
tgtataagtgtgtagagtaaga

SEQ ID NO: 9436769 - DNA, 19 bp, Homo sapiens
tgtataagaatgtatctgt

SEQ ID NO: 9436770 - DNA, 23 bp, Homo sapiens
tgtatacaccctgtgcatctggg

SEQ ID NO: 9436771 - DNA, 21 bp, Homo sapiens
tgtatacacacatatatgtac

SEQ ID NO: 9436772 - DNA, 22 bp, Homo sapiens
tgtatacaagtcgtgtaaactt

SEQ ID NO: 9436773 - DNA, 21 bp, Homo sapiens
tgtatacacacatatatgtac

SEQ ID NO: 9436774 - DNA, 23 bp, Homo sapiens
tgtatacaccctgtgcatctggg

SEQ ID NO: 9436775 - DNA, 22 bp, Homo sapiens
tgtatacatttaactagataga

SEQ ID NO: 9436776 - DNA, 22 bp, Homo sapiens
tgtatacatgtctgtgtgcaca

SEQ ID NO: 9436777 - DNA, 22 bp, Homo sapiens
tgtatacaggcataagagatac

SEQ ID NO: 9436778 - DNA, 22 bp, Homo sapiens
tgtatacatacatatgtgtgtg

SEQ ID NO: 9436779 - DNA, 22 bp, Homo sapiens
tgtatacatgtctgtgtgcaca

SEQ ID NO: 9436780 - DNA, 22 bp, Homo sapiens
tgtatacatacatatgtgtgtg

SEQ ID NO: 9436781 - DNA, 22 bp, Homo sapiens
tgtatagtttcttagttactga

SEQ ID NO: 9436782 - DNA, 22 bp, Homo sapiens
tgtatagttgagtcaagtttca

SEQ ID NO: 9436783 - DNA, 22 bp, Homo sapiens
tgtatagtgtggaaagaacagt

SEQ ID NO: 9436784 - DNA, 22 bp, Homo sapiens
tgtatataagcatttacttgtt

SEQ ID NO: 9436785 - DNA, 22 bp, Homo sapiens
tgtatataagcatttacttgtt

SEQ ID NO: 9436786 - DNA, 22 bp, Homo sapiens
tgtatacatttaactagataga

SEQ ID NO: 9436787 - DNA, 22 bp, Homo sapiens
tgtatagactagctttcacgat

SEQ ID NO: 9436788 - DNA, 22 bp, Homo sapiens
tgtatacatgtctgtgtgcaca

SEQ ID NO: 9436789 - DNA, 22 bp, Homo sapiens
tgtatagagttggaagatgact

SEQ ID NO: 9436790 - DNA, 22 bp, Homo sapiens
tgtcaaaatgactttactacag

SEQ ID NO: 9436791 - DNA, 22 bp, Homo sapiens
tgtcaaagacagaaggaaatgg

SEQ ID NO: 9436792 - DNA, 22 bp, Homo sapiens
tgtcaaactgtgacttctaatg

SEQ ID NO: 9436793 - DNA, 22 bp, Homo sapiens
tgtcaaaaccttggaggcaagg

SEQ ID NO: 9436794 - DNA, 22 bp, Homo sapiens
tgtcaaaaataagagagattgt

SEQ ID NO: 9436795 - DNA, 22 bp, Homo sapiens
tgtcaaaaataagagagattgt

SEQ ID NO: 9436796 - DNA, 22 bp, Homo sapiens
tgtcaaaaagctgggacaagca

SEQ ID NO: 9436797 - DNA, 22 bp, Homo sapiens
tgtatttttagacctttagacc

SEQ ID NO: 9436798 - DNA, 22 bp, Homo sapiens
tgtatttttagacctttagacc

SEQ ID NO: 9436799 - DNA, 22 bp, Homo sapiens
tgtatttttagacctttagacc

SEQ ID NO: 9436800 - DNA, 22 bp, Homo sapiens
tgtcacacctcgtttagcattc

SEQ ID NO: 9436801 - DNA, 22 bp, Homo sapiens
tgtcacactgaccacatctgta

SEQ ID NO: 9436802 - DNA, 22 bp, Homo sapiens
tgtcacagagcgtgcaacagaa

SEQ ID NO: 9436803 - DNA, 22 bp, Homo sapiens
tgtcacagagcaactatttctt

SEQ ID NO: 9436804 - DNA, 22 bp, Homo sapiens
tgtcacaaacatacattataga

SEQ ID NO: 9436805 - DNA, 22 bp, Homo sapiens
tgtcacaatttatttctcttga

SEQ ID NO: 9436806 - DNA, 22 bp, Homo sapiens
tgtcacaagtaactggcaatgc

SEQ ID NO: 9436807 - DNA, 22 bp, Homo sapiens
tgtcacaagtaactggcaatgc

SEQ ID NO: 9436808 - DNA, 22 bp, Homo sapiens
tgtcacaaacatacattataga

SEQ ID NO: 9436809 - DNA, 22 bp, Homo sapiens
tgtcaatgaagatatgaataat

SEQ ID NO: 9436810 - DNA, 22 bp, Homo sapiens
tgtcaatatgtaataactgaat

SEQ ID NO: 9436811 - DNA, 22 bp, Homo sapiens
tgtcaaagcctgaatcacatag

SEQ ID NO: 9436812 - DNA, 22 bp, Homo sapiens
tgtcaaagggtaagctggataa

SEQ ID NO: 9436813 - DNA, 22 bp, Homo sapiens
tgtcacctctttggctgcagct

SEQ ID NO: 9436814 - DNA, 22 bp, Homo sapiens
tgtcacattgaatatgatttat

SEQ ID NO: 9436815 - DNA, 22 bp, Homo sapiens
tgtcacattgaatatgatttat

SEQ ID NO: 9436816 - DNA, 22 bp, Homo sapiens
tgtcacattctgatgtgaggtg

SEQ ID NO: 9436817 - DNA, 23 bp, Homo sapiens
tgtcacatttagttggcattgtt

SEQ ID NO: 9436818 - DNA, 21 bp, Homo sapiens
tgtcacattgtccctgctgct

SEQ ID NO: 9436819 - DNA, 22 bp, Homo sapiens
tgtcacattatatgtgaggata

SEQ ID NO: 9436820 - DNA, 22 bp, Homo sapiens
tgtcacattatatgtgaggata

SEQ ID NO: 9436821 - DNA, 22 bp, Homo sapiens
tgtcacatgtttaatgtggact

SEQ ID NO: 9436822 - DNA, 21 bp, Homo sapiens
tgtcacatgtggatggtattt

SEQ ID NO: 9436823 - DNA, 22 bp, Homo sapiens
tgtcacatgtgtggcatttttc

SEQ ID NO: 9436824 - DNA, 22 bp, Homo sapiens
tgtcacatgacacaaatatcta

SEQ ID NO: 9436825 - DNA, 22 bp, Homo sapiens
tgtcacatgacacaaatatcta

SEQ ID NO: 9436826 - DNA, 22 bp, Homo sapiens
tgtcacatgacacaaatatcta

SEQ ID NO: 9436827 - DNA, 22 bp, Homo sapiens
tgtcacatgaagccaacatagc

SEQ ID NO: 9436828 - DNA, 22 bp, Homo sapiens
tgtcacatgaagccaacatagc

SEQ ID NO: 9436829 - DNA, 22 bp, Homo sapiens
tgtcacatccattttgcaagta

SEQ ID NO: 9436830 - DNA, 22 bp, Homo sapiens
tgtcacatgaaacttgctcatc

SEQ ID NO: 9436831 - DNA, 22 bp, Homo sapiens
tgtcacatcaggtggtggctgt

SEQ ID NO: 9436832 - DNA, 22 bp, Homo sapiens
tgtcacatcaggggtgttgaca

SEQ ID NO: 9436833 - DNA, 22 bp, Homo sapiens
tgtcacatatataatgttcaat

SEQ ID NO: 9436834 - DNA, 22 bp, Homo sapiens
tgtcacatatataatgttcaat

SEQ ID NO: 9436835 - DNA, 22 bp, Homo sapiens
tgtcacataatttatctgtagg

SEQ ID NO: 9436836 - DNA, 22 bp, Homo sapiens
tgtcacataggcaaaatgtttt

SEQ ID NO: 9436837 - DNA, 22 bp, Homo sapiens
tgtcacagtgcacagctaagaa

SEQ ID NO: 9436838 - DNA, 22 bp, Homo sapiens
tgtcacagtctcgtgagcatct

SEQ ID NO: 9436839 - DNA, 22 bp, Homo sapiens
tgtcacagggataccatggggc

SEQ ID NO: 9436840 - DNA, 22 bp, Homo sapiens
tgtcacagtctcgtgagcatct

SEQ ID NO: 9436841 - DNA, 22 bp, Homo sapiens
tgtcacagtctcgtgagcatct

SEQ ID NO: 9436842 - DNA, 22 bp, Homo sapiens
tgtcacagggataccatggggc

SEQ ID NO: 9436843 - DNA, 21 bp, Homo sapiens
tgtcacagattctcagcttgc

SEQ ID NO: 9436844 - DNA, 22 bp, Homo sapiens
tgtcacagatcgtttttgagct

SEQ ID NO: 9436845 - DNA, 17 bp, Homo sapiens
tgtatgcataaaattta

SEQ ID NO: 9436846 - DNA, 22 bp, Homo sapiens
tgtatgcaccattgtattacct

SEQ ID NO: 9436847 - DNA, 22 bp, Homo sapiens
tgtatgcaccattgtattacct

SEQ ID NO: 9436848 - DNA, 22 bp, Homo sapiens
tgtatgtaaaggtcttcatgtt

SEQ ID NO: 9436849 - DNA, 22 bp, Homo sapiens
tgtatggcttggaaatagttta

SEQ ID NO: 9436850 - DNA, 22 bp, Homo sapiens
tgtatgtatacacatagatacg

SEQ ID NO: 9436851 - DNA, 22 bp, Homo sapiens
tgtattcttagttttaatcaga

SEQ ID NO: 9436852 - DNA, 22 bp, Homo sapiens
tgtattcttagttttaatcaga

SEQ ID NO: 9436853 - DNA, 22 bp, Homo sapiens
tgtattctctcaatatttcata

SEQ ID NO: 9436854 - DNA, 22 bp, Homo sapiens
tgtatttaattgtatcatcaca

SEQ ID NO: 9436855 - DNA, 20 bp, Homo sapiens
tgtatttaatgaaggctttt

SEQ ID NO: 9436856 - DNA, 22 bp, Homo sapiens
tgtatttaattgtatcatcaca

SEQ ID NO: 9436857 - DNA, 22 bp, Homo sapiens
tgtatttatattagaatggttg

SEQ ID NO: 9436858 - DNA, 22 bp, Homo sapiens
tgtatttagtccagtctctcat

SEQ ID NO: 9436859 - DNA, 22 bp, Homo sapiens
tgtatttaattgtatcatcaca

SEQ ID NO: 9436860 - DNA, 22 bp, Homo sapiens
tgtatttaattgtatcatcaca

SEQ ID NO: 9436861 - DNA, 20 bp, Homo sapiens
tgtatttaatgaaggctttt

SEQ ID NO: 9436862 - DNA, 20 bp, Homo sapiens
tgtatttaatgaaggctttt

SEQ ID NO: 9436863 - DNA, 22 bp, Homo sapiens
tgtatttaagctttacctaaaa

SEQ ID NO: 9436864 - DNA, 22 bp, Homo sapiens
tgtatttaagctttacctaaaa

SEQ ID NO: 9436865 - DNA, 22 bp, Homo sapiens
tgtatttaagctttacctaaaa

SEQ ID NO: 9436866 - DNA, 22 bp, Homo sapiens
tgtattgttataatttgtatgt

SEQ ID NO: 9436867 - DNA, 22 bp, Homo sapiens
tgtattttctgaagataatcaa

SEQ ID NO: 9436868 - DNA, 22 bp, Homo sapiens
tgtattttcagagtggcatttc

SEQ ID NO: 9436869 - DNA, 22 bp, Homo sapiens
tgtattttcagagtggcatttc

SEQ ID NO: 9436870 - DNA, 22 bp, Homo sapiens
tgtattttctgaagataatcaa

SEQ ID NO: 9436871 - DNA, 22 bp, Homo sapiens
tgtattttctgaggagcattag

SEQ ID NO: 9436872 - DNA, 22 bp, Homo sapiens
tgtattttgagtccaatctcct

SEQ ID NO: 9436873 - DNA, 22 bp, Homo sapiens
tgtattttgagtccaatctcct

SEQ ID NO: 9436874 - DNA, 22 bp, Homo sapiens
tgtattttctgaggagcattag

SEQ ID NO: 9436875 - DNA, 22 bp, Homo sapiens
tgtattttcttctggaagctta

SEQ ID NO: 9436876 - DNA, 22 bp, Homo sapiens
tgtattttgtgaggatcactct

SEQ ID NO: 9436877 - DNA, 22 bp, Homo sapiens
tgtatttcctggtttagatcaa

SEQ ID NO: 9436878 - DNA, 17 bp, Homo sapiens
tgtatttgtaccacagc

SEQ ID NO: 9436879 - DNA, 22 bp, Homo sapiens
tgtatttattcaggatgtaact

SEQ ID NO: 9436880 - DNA, 22 bp, Homo sapiens
tgtatttattcaggatgtaact

SEQ ID NO: 9436881 - DNA, 22 bp, Homo sapiens
tgtatttattcaggatgtaact

SEQ ID NO: 9436882 - DNA, 17 bp, Homo sapiens
tgtatttatcatgtcag

SEQ ID NO: 9436883 - DNA, 17 bp, Homo sapiens
tgtatttatcatgtcag

SEQ ID NO: 9436884 - DNA, 17 bp, Homo sapiens
tgtatttatcatgtcag

SEQ ID NO: 9436885 - DNA, 22 bp, Homo sapiens
tgtatttattcttctggtgttt

SEQ ID NO: 9436886 - DNA, 22 bp, Homo sapiens
tgtatttattcaggatgtaact

SEQ ID NO: 9436887 - DNA, 22 bp, Homo sapiens
tgtatttattcaggatgtaact

SEQ ID NO: 9436888 - DNA, 22 bp, Homo sapiens
tgtatttattcaggatgtaact

SEQ ID NO: 9436889 - DNA, 22 bp, Homo sapiens
tgtacagtcatgctttctgttc

SEQ ID NO: 9436890 - DNA, 22 bp, Homo sapiens
tgtacagattgatcatggagag

SEQ ID NO: 9436891 - DNA, 22 bp, Homo sapiens
tgtacagatatcaggagtgagg

SEQ ID NO: 9436892 - DNA, 22 bp, Homo sapiens
tgtacagattgatcatggagag

SEQ ID NO: 9436893 - DNA, 22 bp, Homo sapiens
tgtacaggagaacaatgagaaa

SEQ ID NO: 9436894 - DNA, 22 bp, Homo sapiens
tgtacagaggtgtacatatgat

SEQ ID NO: 9436895 - DNA, 22 bp, Homo sapiens
tgtacactgcaggatgcattgc

SEQ ID NO: 9436896 - DNA, 22 bp, Homo sapiens
tgtacacatggtgtacactccc

SEQ ID NO: 9436897 - DNA, 22 bp, Homo sapiens
tgtacacatggtgtacactccc

SEQ ID NO: 9436898 - DNA, 22 bp, Homo sapiens
tgtacacatttattctctctca

SEQ ID NO: 9436899 - DNA, 22 bp, Homo sapiens
tgtacacctgtctttacacata

SEQ ID NO: 9436900 - DNA, 22 bp, Homo sapiens
tgtacaaattcattgaactgta

SEQ ID NO: 9436901 - DNA, 22 bp, Homo sapiens
tgtacaaattcagttctagggt

SEQ ID NO: 9436902 - DNA, 22 bp, Homo sapiens
tgtacaaagttaaacctatata

SEQ ID NO: 9436903 - DNA, 22 bp, Homo sapiens
tgtacaaattcagttctagggt

SEQ ID NO: 9436904 - DNA, 22 bp, Homo sapiens
tgtacaaattcattgaactgta

SEQ ID NO: 9436905 - DNA, 22 bp, Homo sapiens
tgtacaaattcattgaactgta

SEQ ID NO: 9436906 - DNA, 22 bp, Homo sapiens
tgtacaaattcattgaactgta

SEQ ID NO: 9436907 - DNA, 17 bp, Homo sapiens
tgtacaacagtaccttc

SEQ ID NO: 9436908 - DNA, 22 bp, Homo sapiens
tgtacaagcaaatagaccttca

SEQ ID NO: 9436909 - DNA, 19 bp, Homo sapiens
tgtacaaggattatgcagg

SEQ ID NO: 9436910 - DNA, 22 bp, Homo sapiens
tgtacaatagctattatctcca

SEQ ID NO: 9436911 - DNA, 22 bp, Homo sapiens
tgtacaatctgatgatgtatgg

SEQ ID NO: 9436912 - DNA, 22 bp, Homo sapiens
tgtacaatcttggtccctttat

SEQ ID NO: 9436913 - DNA, 22 bp, Homo sapiens
tgtacaatgccagggaacacca

SEQ ID NO: 9436914 - DNA, 22 bp, Homo sapiens
tgtacaatctgatgatgtatgg

SEQ ID NO: 9436915 - DNA, 22 bp, Homo sapiens
tgtacaatagctattatctcca

SEQ ID NO: 9436916 - DNA, 22 bp, Homo sapiens
tgtacaatctgatgatgtatgg

SEQ ID NO: 9436917 - DNA, 22 bp, Homo sapiens
tgtacacaattcttaacataca

SEQ ID NO: 9436918 - DNA, 22 bp, Homo sapiens
tgtacacaattcttaacataca

SEQ ID NO: 9436919 - DNA, 22 bp, Homo sapiens
tgtacacaattcttaacataca

SEQ ID NO: 9436920 - DNA, 22 bp, Homo sapiens
tgtacacaattcttaacataca

SEQ ID NO: 9436921 - DNA, 22 bp, Homo sapiens
tgtacacataccactgagtgaa

SEQ ID NO: 9436922 - DNA, 20 bp, Homo sapiens
tgtacacagtactttacaat

SEQ ID NO: 9436923 - DNA, 22 bp, Homo sapiens
tgtacacagtatgaggcatctt

SEQ ID NO: 9436924 - DNA, 22 bp, Homo sapiens
tgtacacacacgtgtgtatcta

SEQ ID NO: 9436925 - DNA, 20 bp, Homo sapiens
tgtacacagtactttacaat

SEQ ID NO: 9436926 - DNA, 22 bp, Homo sapiens
tgtacaatgctgaggtttgggg

SEQ ID NO: 9436927 - DNA, 22 bp, Homo sapiens
tgtacacaacctacagtctgct

SEQ ID NO: 9436928 - DNA, 22 bp, Homo sapiens
tgtaagattctaagagttaatg

SEQ ID NO: 9436929 - DNA, 22 bp, Homo sapiens
tgtaagatatgagtacatgtaa

SEQ ID NO: 9436930 - DNA, 22 bp, Homo sapiens
tgtaagatattcagcttattga

SEQ ID NO: 9436931 - DNA, 22 bp, Homo sapiens
tgtaagatatgagtacatgtaa

SEQ ID NO: 9436932 - DNA, 22 bp, Homo sapiens
tgtaagaatcagtctttaatgt

SEQ ID NO: 9436933 - DNA, 20 bp, Homo sapiens
tgtaagaagtaggagggtta

SEQ ID NO: 9436934 - DNA, 22 bp, Homo sapiens
tgtaactataaaattaattgct

SEQ ID NO: 9436935 - DNA, 23 bp, Homo sapiens
tgtaactttgggcatgttgcttc

SEQ ID NO: 9436936 - DNA, 23 bp, Homo sapiens
tgtaacttcttaaattcttcact

SEQ ID NO: 9436937 - DNA, 23 bp, Homo sapiens
tgtaacttcttaaattcttcact

SEQ ID NO: 9436938 - DNA, 23 bp, Homo sapiens
tgtaacttcttaaattcttcact

SEQ ID NO: 9436939 - DNA, 22 bp, Homo sapiens
tgtaagaaaagtaaatagtgac

SEQ ID NO: 9436940 - DNA, 22 bp, Homo sapiens
tgtacaaaacaagatgggggta

SEQ ID NO: 9436941 - DNA, 22 bp, Homo sapiens
tgtaattttctcaagtttctac

SEQ ID NO: 9436942 - DNA, 22 bp, Homo sapiens
tgtacaaagagtatagctttga

SEQ ID NO: 9436943 - DNA, 22 bp, Homo sapiens
tgtaattttacgtgacacagtt

SEQ ID NO: 9436944 - DNA, 22 bp, Homo sapiens
tgtaattttctcaagtttctac

SEQ ID NO: 9436945 - DNA, 22 bp, Homo sapiens
tgtaattttacgtgacacagtt

SEQ ID NO: 9436946 - DNA, 22 bp, Homo sapiens
tgtacaaagttaaacctatata

SEQ ID NO: 9436947 - DNA, 22 bp, Homo sapiens
tgtacaaaggtactttgatgtt

SEQ ID NO: 9436948 - DNA, 22 bp, Homo sapiens
tgtacaaagttaaacctatata

SEQ ID NO: 9436949 - DNA, 22 bp, Homo sapiens
tgtacaaagttaaacctatata

SEQ ID NO: 9436950 - DNA, 22 bp, Homo sapiens
tgtacaaagccagaactcccaa

SEQ ID NO: 9436951 - DNA, 22 bp, Homo sapiens
tgtacaaagccagaactcccaa

SEQ ID NO: 9436952 - DNA, 22 bp, Homo sapiens
tgtacaaaggtactttgatgtt

SEQ ID NO: 9436953 - DNA, 22 bp, Homo sapiens
tgtacaaagagtatagctttga

SEQ ID NO: 9436954 - DNA, 22 bp, Homo sapiens
tgtacaaagagtatagctttga

SEQ ID NO: 9436955 - DNA, 22 bp, Homo sapiens
tgtacaaagagtatagctttga

SEQ ID NO: 9436956 - DNA, 22 bp, Homo sapiens
tgtacaaagagtatagctttga

SEQ ID NO: 9436957 - DNA, 22 bp, Homo sapiens
tgtaacatatagcatgttcttg

SEQ ID NO: 9436958 - DNA, 23 bp, Homo sapiens
tgtaacaatttcatatacatgca

SEQ ID NO: 9436959 - DNA, 23 bp, Homo sapiens
tgtaacaatttcatatacatgca

SEQ ID NO: 9436960 - DNA, 23 bp, Homo sapiens
tgtaacaatttcatatacatgca

SEQ ID NO: 9436961 - DNA, 23 bp, Homo sapiens
tgtaacaatttcatatacatgca

SEQ ID NO: 9436962 - DNA, 22 bp, Homo sapiens
tgtaacaatttcttactattgt

SEQ ID NO: 9436963 - DNA, 23 bp, Homo sapiens
tgtaaattttgtagtcacatttt

SEQ ID NO: 9436964 - DNA, 23 bp, Homo sapiens
tgtaaattttgtagtcacatttt

SEQ ID NO: 9436965 - DNA, 23 bp, Homo sapiens
tgtaaattttgtagtcacatttt

SEQ ID NO: 9436966 - DNA, 22 bp, Homo sapiens
tgtaacaaaataccttggattg

SEQ ID NO: 9436967 - DNA, 21 bp, Homo sapiens
tgtaacaaaatactgcagatt

SEQ ID NO: 9436968 - DNA, 22 bp, Homo sapiens
tgtaaattctatacacttaaaa

SEQ ID NO: 9436969 - DNA, 22 bp, Homo sapiens
tgtaaattgaaggaaatttgtg

SEQ ID NO: 9436970 - DNA, 22 bp, Homo sapiens
tgtaaattgaaggaaatttgtg

SEQ ID NO: 9436971 - DNA, 22 bp, Homo sapiens
tgtaaattgaaggaaatttgtg

SEQ ID NO: 9436972 - DNA, 22 bp, Homo sapiens
tgtaacaatgaatatagtgact

SEQ ID NO: 9436973 - DNA, 22 bp, Homo sapiens
tgtaacaatgaatatagtgact

SEQ ID NO: 9436974 - DNA, 21 bp, Homo sapiens
tgtaacaagttccctaggtga

SEQ ID NO: 9436975 - DNA, 22 bp, Homo sapiens
tgtaacaaatacccttgaagtt

SEQ ID NO: 9436976 - DNA, 21 bp, Homo sapiens
tgtaacaaaatactgcagatt

SEQ ID NO: 9436977 - DNA, 22 bp, Homo sapiens
tgtaacaagtaatccatgggag

SEQ ID NO: 9436978 - DNA, 17 bp, Homo sapiens
tgtaacaactcctatta

SEQ ID NO: 9436979 - DNA, 17 bp, Homo sapiens
tgtaacaactcctatta

SEQ ID NO: 9436980 - DNA, 22 bp, Homo sapiens
tggtgtctcttagtacatagat

SEQ ID NO: 9436981 - DNA, 22 bp, Homo sapiens
tggtgtcttggaagtaggtgct

SEQ ID NO: 9436982 - DNA, 22 bp, Homo sapiens
tggtgtgaggcgggagtgtagt

SEQ ID NO: 9436983 - DNA, 22 bp, Homo sapiens
tggttaaaatgcagattcagta

SEQ ID NO: 9436984 - DNA, 21 bp, Homo sapiens
tggttaaagttgtgtcatccc

SEQ ID NO: 9436985 - DNA, 22 bp, Homo sapiens
tggtgtgtacatttttgcttct

SEQ ID NO: 9436986 - DNA, 22 bp, Homo sapiens
tggtgtgttagagctcagggca

SEQ ID NO: 9436987 - DNA, 22 bp, Homo sapiens
tggtggggtcatcgtcagatgc

SEQ ID NO: 9436988 - DNA, 22 bp, Homo sapiens
tggtggggtcatcgtcagatgc

SEQ ID NO: 9436989 - DNA, 23 bp, Homo sapiens
tggtggggtcttggagacagcac

SEQ ID NO: 9436990 - DNA, 22 bp, Homo sapiens
tggtggggtcatcgtcagatgc

SEQ ID NO: 9436991 - DNA, 23 bp, Homo sapiens
tggtggggtcttggagacagcac

SEQ ID NO: 9436992 - DNA, 23 bp, Homo sapiens
tggtggggtcttggagacagcac

SEQ ID NO: 9436993 - DNA, 23 bp, Homo sapiens
tggtggggtcttggagacagcac

SEQ ID NO: 9436994 - DNA, 23 bp, Homo sapiens
tggtggggtcttggagacagcac

SEQ ID NO: 9436995 - DNA, 22 bp, Homo sapiens
tggtgggtcggctgggagagct

SEQ ID NO: 9436996 - DNA, 22 bp, Homo sapiens
tggtgggtcggctgggagagct

SEQ ID NO: 9436997 - DNA, 22 bp, Homo sapiens
tggtgggtcggctgggagagct

SEQ ID NO: 9436998 - DNA, 22 bp, Homo sapiens
tggtgggtcggctgggagagct

SEQ ID NO: 9436999 - DNA, 22 bp, Homo sapiens
tggtgggtcggctgggagagct

SEQ ID NO: 9437000 - DNA, 22 bp, Homo sapiens
tggtgtcatgttggggtttatt

SEQ ID NO: 9437001 - DNA, 22 bp, Homo sapiens
tggtgtctccatcctgccctgc

SEQ ID NO: 9437002 - DNA, 22 bp, Homo sapiens
tggtttcccattatctgcagga

SEQ ID NO: 9437003 - DNA, 22 bp, Homo sapiens
tggtttcagtgccaatacagta

SEQ ID NO: 9437004 - DNA, 22 bp, Homo sapiens
tggtttcatgagatgagaattt

SEQ ID NO: 9437005 - DNA, 22 bp, Homo sapiens
tggtttctctgaactctacgac

SEQ ID NO: 9437006 - DNA, 22 bp, Homo sapiens
tggtttctcagactctttgcag

SEQ ID NO: 9437007 - DNA, 22 bp, Homo sapiens
tggtttctgccctcagagctca

SEQ ID NO: 9437008 - DNA, 22 bp, Homo sapiens
tggtttctgggtttgtctagga

SEQ ID NO: 9437009 - DNA, 22 bp, Homo sapiens
tggtttatatcttgattctagt

SEQ ID NO: 9437010 - DNA, 23 bp, Homo sapiens
tggtttatgatatgtatgggaat

SEQ ID NO: 9437011 - DNA, 22 bp, Homo sapiens
tggttgcattaactgagagggg

SEQ ID NO: 9437012 - DNA, 22 bp, Homo sapiens
tggttctgctcaagccagactg

SEQ ID NO: 9437013 - DNA, 22 bp, Homo sapiens
tggttgtgagcgatggatggag

SEQ ID NO: 9437014 - DNA, 22 bp, Homo sapiens
tggttaagtccagaaaggaagc

SEQ ID NO: 9437015 - DNA, 22 bp, Homo sapiens
tggttaacttctgagcaggctg

SEQ ID NO: 9437016 - DNA, 22 bp, Homo sapiens
tggttcctcagggcagctgtac

SEQ ID NO: 9437017 - DNA, 22 bp, Homo sapiens
tggttccttctgcattttcagc

SEQ ID NO: 9437018 - DNA, 18 bp, Homo sapiens
tggttccttgaaggggca

SEQ ID NO: 9437019 - DNA, 22 bp, Homo sapiens
tggttcctggttcacttggcag

SEQ ID NO: 9437020 - DNA, 22 bp, Homo sapiens
tggttcctcagggcagctgtac

SEQ ID NO: 9437021 - DNA, 22 bp, Homo sapiens
tggttcgtctcttttacagttc

SEQ ID NO: 9437022 - DNA, 18 bp, Homo sapiens
tggtttgtcatgagaatt

SEQ ID NO: 9437023 - DNA, 22 bp, Homo sapiens
tggtttctttccactctccacc

SEQ ID NO: 9437024 - DNA, 22 bp, Homo sapiens
tggtttctttccactctccacc

SEQ ID NO: 9437025 - DNA, 22 bp, Homo sapiens
tggtttgtatatgtttgtgaga

SEQ ID NO: 9437026 - DNA, 22 bp, Homo sapiens
tgtaaaataattctccatgttt

SEQ ID NO: 9437027 - DNA, 22 bp, Homo sapiens
tgtaaaaggaaatcaaagcact

SEQ ID NO: 9437028 - DNA, 23 bp, Homo sapiens
tgtaaaatggggtagtgttacca

SEQ ID NO: 9437029 - DNA, 22 bp, Homo sapiens
tgtaaaaagcccagccgctgag

SEQ ID NO: 9437030 - DNA, 22 bp, Homo sapiens
tgtaaaacaaaatttgtggaga

SEQ ID NO: 9437031 - DNA, 22 bp, Homo sapiens
tgtaaaaagcccagccgctgag

SEQ ID NO: 9437032 - DNA, 22 bp, Homo sapiens
tgtaaaaagcccagccgctgag

SEQ ID NO: 9437033 - DNA, 22 bp, Homo sapiens
tggtttttggtgttcacagagg

SEQ ID NO: 9437034 - DNA, 22 bp, Homo sapiens
tggtttttggtttaacactatg

SEQ ID NO: 9437035 - DNA, 22 bp, Homo sapiens
tgtaaaaagcccagccgctgag

SEQ ID NO: 9437036 - DNA, 22 bp, Homo sapiens
tgtaaaaccaaatcaatctagt

SEQ ID NO: 9437037 - DNA, 22 bp, Homo sapiens
tgtaaaaccaaatcaatctagt

SEQ ID NO: 9437038 - DNA, 22 bp, Homo sapiens
tgtaaaagacatttctaagcaa

SEQ ID NO: 9437039 - DNA, 23 bp, Homo sapiens
tgtaaaagcatttgtcagcctgg

SEQ ID NO: 9437040 - DNA, 23 bp, Homo sapiens
tgtaaaagcatttgtcagcctgg

SEQ ID NO: 9437041 - DNA, 22 bp, Homo sapiens
tgtaaatagttagcttgcctct

SEQ ID NO: 9437042 - DNA, 20 bp, Homo sapiens
tgtaaataggcattgtagtt

SEQ ID NO: 9437043 - DNA, 20 bp, Homo sapiens
tgtaaataggcattgtagtt

SEQ ID NO: 9437044 - DNA, 20 bp, Homo sapiens
tgtaaataggcattgtagtt

SEQ ID NO: 9437045 - DNA, 20 bp, Homo sapiens
tgtaaataggcattgtagtt

SEQ ID NO: 9437046 - DNA, 22 bp, Homo sapiens
tgtaaatgaagtatgctttact

SEQ ID NO: 9437047 - DNA, 22 bp, Homo sapiens
tgtaaatggtcagataaaccta

SEQ ID NO: 9437048 - DNA, 22 bp, Homo sapiens
tgtaaatcactgaactaaatga

SEQ ID NO: 9437049 - DNA, 22 bp, Homo sapiens
tgtaaatcactgaactaaatga

SEQ ID NO: 9437050 - DNA, 22 bp, Homo sapiens
tgtaaatcactgaactaaatga

SEQ ID NO: 9437051 - DNA, 22 bp, Homo sapiens
tgtaaataatgcatgtaaatca

SEQ ID NO: 9437052 - DNA, 22 bp, Homo sapiens
tgtaaataatgcatgtaaatca

SEQ ID NO: 9437053 - DNA, 22 bp, Homo sapiens
tgtaaataatgcatgtaaatca

SEQ ID NO: 9437054 - DNA, 22 bp, Homo sapiens
tgtaaagttttattgttccttc

SEQ ID NO: 9437055 - DNA, 22 bp, Homo sapiens
tgtaaataatgcatgtaaatca

SEQ ID NO: 9437056 - DNA, 22 bp, Homo sapiens
tgtaaataattcctaggctttt

SEQ ID NO: 9437057 - DNA, 22 bp, Homo sapiens
tgtaaataatgcatgtaaatca

SEQ ID NO: 9437058 - DNA, 22 bp, Homo sapiens
tgtaaataatgcatgtaaatca

SEQ ID NO: 9437059 - DNA, 22 bp, Homo sapiens
tgtaaataatgcatgtaaatca

SEQ ID NO: 9437060 - DNA, 22 bp, Homo sapiens
tgtaaataatgcatgtaaatca

SEQ ID NO: 9437061 - DNA, 22 bp, Homo sapiens
tgtaaagtatctgtgagctctc

SEQ ID NO: 9437062 - DNA, 22 bp, Homo sapiens
tgtaaagcatttcctaaatcca

SEQ ID NO: 9437063 - DNA, 22 bp, Homo sapiens
tgtaaagcatctctgtcatata

SEQ ID NO: 9437064 - DNA, 22 bp, Homo sapiens
tgtaaagattagattacatgaa

SEQ ID NO: 9437065 - DNA, 22 bp, Homo sapiens
tgtaaagatccttagcaacatc

SEQ ID NO: 9437066 - DNA, 18 bp, Homo sapiens
tgtaaacactttcattct

SEQ ID NO: 9437067 - DNA, 18 bp, Homo sapiens
tgtaaacactttcattct

SEQ ID NO: 9437068 - DNA, 22 bp, Homo sapiens
tgtaaacagccccatggagagc

SEQ ID NO: 9437069 - DNA, 22 bp, Homo sapiens
tgtaaagagaatggtatatgga

SEQ ID NO: 9437070 - DNA, 23 bp, Homo sapiens
tgtaaaatggggtagtgttacca

SEQ ID NO: 9437071 - DNA, 22 bp, Homo sapiens
tggtcctggccttgaccccagg

SEQ ID NO: 9437072 - DNA, 22 bp, Homo sapiens
tggtcctgggcacagtatatgc

SEQ ID NO: 9437073 - DNA, 22 bp, Homo sapiens
tggtcctgggcacagtatatgc

SEQ ID NO: 9437074 - DNA, 22 bp, Homo sapiens
tggtcctggagatcaatatgca

SEQ ID NO: 9437075 - DNA, 22 bp, Homo sapiens
tggtcctggccttgaccccagg

SEQ ID NO: 9437076 - DNA, 22 bp, Homo sapiens
tggtcctggccttgaccccagg

SEQ ID NO: 9437077 - DNA, 22 bp, Homo sapiens
tggtcctggagagtgttccata

SEQ ID NO: 9437078 - DNA, 22 bp, Homo sapiens
tggtcctggagagtgttccata

SEQ ID NO: 9437079 - DNA, 22 bp, Homo sapiens
tggtcctggaaggtcctgaggg

SEQ ID NO: 9437080 - DNA, 23 bp, Homo sapiens
tggtcctgccaacggtgcccctc

SEQ ID NO: 9437081 - DNA, 22 bp, Homo sapiens
tggtcctgccccgtgcacagag

SEQ ID NO: 9437082 - DNA, 22 bp, Homo sapiens
tggtcctgcccacgcccatctg

SEQ ID NO: 9437083 - DNA, 22 bp, Homo sapiens
tggtcctgcccacgcccatctg

SEQ ID NO: 9437084 - DNA, 22 bp, Homo sapiens
tggtcctgcttgctgcttaaga

SEQ ID NO: 9437085 - DNA, 22 bp, Homo sapiens
tggtcctgccccgtgcacagag

SEQ ID NO: 9437086 - DNA, 22 bp, Homo sapiens
tggtcctgctacaggggattag

SEQ ID NO: 9437087 - DNA, 22 bp, Homo sapiens
tggtcctgagcaccagcctgac

SEQ ID NO: 9437088 - DNA, 22 bp, Homo sapiens
tggtcctgagaatcctgtcctc

SEQ ID NO: 9437089 - DNA, 22 bp, Homo sapiens
tggtcctgcagtaatagacatc

SEQ ID NO: 9437090 - DNA, 22 bp, Homo sapiens
tggtcctgatcaccgctgggca

SEQ ID NO: 9437091 - DNA, 22 bp, Homo sapiens
tggtcctgagcaccagcctgac

SEQ ID NO: 9437092 - DNA, 22 bp, Homo sapiens
tggtcctgagcaccagcctgac

SEQ ID NO: 9437093 - DNA, 22 bp, Homo sapiens
tggtcctgagcaccagcctgac

SEQ ID NO: 9437094 - DNA, 22 bp, Homo sapiens
tggtcctgaggcttgtttccac

SEQ ID NO: 9437095 - DNA, 22 bp, Homo sapiens
tggtccagggtgtagtacagag

SEQ ID NO: 9437096 - DNA, 22 bp, Homo sapiens
tggtcctcaggttctctgtgcg

SEQ ID NO: 9437097 - DNA, 20 bp, Homo sapiens
tggtcctcacatgccatctt

SEQ ID NO: 9437098 - DNA, 22 bp, Homo sapiens
tggtccagcttgattctcttct

SEQ ID NO: 9437099 - DNA, 22 bp, Homo sapiens
tggtcaggattctcagcccttc

SEQ ID NO: 9437100 - DNA, 22 bp, Homo sapiens
tggtcagcttcagagtgttcca

SEQ ID NO: 9437101 - DNA, 22 bp, Homo sapiens
tggtcagcgtttgtcagagcag

SEQ ID NO: 9437102 - DNA, 22 bp, Homo sapiens
tggtcagcttcagagtgttcca

SEQ ID NO: 9437103 - DNA, 22 bp, Homo sapiens
tggtcagcgtttgtcagagcag

SEQ ID NO: 9437104 - DNA, 22 bp, Homo sapiens
tggtcaggggcttctgagctgt

SEQ ID NO: 9437105 - DNA, 22 bp, Homo sapiens
tggtcaggggcttctgagctgt

SEQ ID NO: 9437106 - DNA, 22 bp, Homo sapiens
tggtcaggctgctctgcggcgt

SEQ ID NO: 9437107 - DNA, 22 bp, Homo sapiens
tggtcagatgctgagtggatct

SEQ ID NO: 9437108 - DNA, 19 bp, Homo sapiens
tggtcagcattaggatttg

SEQ ID NO: 9437109 - DNA, 22 bp, Homo sapiens
tggtcagactaggacactccgg

SEQ ID NO: 9437110 - DNA, 22 bp, Homo sapiens
tggtcagacaaaggagaatgtt

SEQ ID NO: 9437111 - DNA, 22 bp, Homo sapiens
tggtcagagaagtagggacaat

SEQ ID NO: 9437112 - DNA, 18 bp, Homo sapiens
tggtcactgtggatagtg

SEQ ID NO: 9437113 - DNA, 22 bp, Homo sapiens
tggtcagaaggaagggctccta

SEQ ID NO: 9437114 - DNA, 22 bp, Homo sapiens
tggtcagaactcagcgtgcttg

SEQ ID NO: 9437115 - DNA, 22 bp, Homo sapiens
tggtcacttttgccagtggatg

SEQ ID NO: 9437116 - DNA, 22 bp, Homo sapiens
tggtcaggtacctctggctgtc

SEQ ID NO: 9437117 - DNA, 22 bp, Homo sapiens
tggtcagttgtgactagaacac

SEQ ID NO: 9437118 - DNA, 22 bp, Homo sapiens
tggtcatgtagtagagacagct

SEQ ID NO: 9437119 - DNA, 22 bp, Homo sapiens
tggtccagaagatattcaacca

SEQ ID NO: 9437120 - DNA, 22 bp, Homo sapiens
tggtcctggggtgcaggctgac

SEQ ID NO: 9437121 - DNA, 22 bp, Homo sapiens
tggtcctggggtgcaggctgac

SEQ ID NO: 9437122 - DNA, 22 bp, Homo sapiens
tggtcctggggtgcaggctgac

SEQ ID NO: 9437123 - DNA, 22 bp, Homo sapiens
tggtcctggggatctgcagtga

SEQ ID NO: 9437124 - DNA, 22 bp, Homo sapiens
tggtcctggggatctgcagtga

SEQ ID NO: 9437125 - DNA, 22 bp, Homo sapiens
tggtcctggtgcaagtgcattt

SEQ ID NO: 9437126 - DNA, 22 bp, Homo sapiens
tggtcctggtagcggtgtgctt

SEQ ID NO: 9437127 - DNA, 22 bp, Homo sapiens
tggtcctggtcatctgggctgg

SEQ ID NO: 9437128 - DNA, 22 bp, Homo sapiens
tggtcctgtgttcttcctgcct

SEQ ID NO: 9437129 - DNA, 22 bp, Homo sapiens
tggtcctgtctcaaggagcctt

SEQ ID NO: 9437130 - DNA, 22 bp, Homo sapiens
tggtcctgtctcaaggagcctt

SEQ ID NO: 9437131 - DNA, 22 bp, Homo sapiens
tggtcctgtagcacttgattag

SEQ ID NO: 9437132 - DNA, 23 bp, Homo sapiens
tggtcctggttgaggtgggcccc

SEQ ID NO: 9437133 - DNA, 20 bp, Homo sapiens
tggtcctgtcccacccactc

SEQ ID NO: 9437134 - DNA, 22 bp, Homo sapiens
tggtcctgtagctctctaagtt

SEQ ID NO: 9437135 - DNA, 23 bp, Homo sapiens
tggtctcacttggtaagatgaag

SEQ ID NO: 9437136 - DNA, 23 bp, Homo sapiens
tggtctcacttggtaagatgaag

SEQ ID NO: 9437137 - DNA, 22 bp, Homo sapiens
tggtccttgtaggcatttgagc

SEQ ID NO: 9437138 - DNA, 22 bp, Homo sapiens
tggtcctttaagtctttctctg

SEQ ID NO: 9437139 - DNA, 22 bp, Homo sapiens
tggtccttcttgaagagtgagt

SEQ ID NO: 9437140 - DNA, 22 bp, Homo sapiens
tggtccttgctatagagtgata

SEQ ID NO: 9437141 - DNA, 21 bp, Homo sapiens
tggtccttctttactgcctcc

SEQ ID NO: 9437142 - DNA, 22 bp, Homo sapiens
tggtctctacggaggaaagctg

SEQ ID NO: 9437143 - DNA, 22 bp, Homo sapiens
tggtctctccatgccctccacc

SEQ ID NO: 9437144 - DNA, 23 bp, Homo sapiens
tggtctcagcctgtgagagctga

SEQ ID NO: 9437145 - DNA, 22 bp, Homo sapiens
tggtctcaggagagtctcttca

SEQ ID NO: 9437146 - DNA, 22 bp, Homo sapiens
tggtctcccagagcagggacgc

SEQ ID NO: 9437147 - DNA, 22 bp, Homo sapiens
tggtctctccatgccctccacc

SEQ ID NO: 9437148 - DNA, 22 bp, Homo sapiens
tggtctctgagccttcctgtgg

SEQ ID NO: 9437149 - DNA, 18 bp, Homo sapiens
tggtgaagggtggaggag

SEQ ID NO: 9437150 - DNA, 18 bp, Homo sapiens
tggtgaagggtggaggag

SEQ ID NO: 9437151 - DNA, 22 bp, Homo sapiens
tggtctctgtgctcgggcatgg

SEQ ID NO: 9437152 - DNA, 22 bp, Homo sapiens
tggtgaatagtagcttcagact

SEQ ID NO: 9437153 - DNA, 19 bp, Homo sapiens
tggtctctgtctctttgca

SEQ ID NO: 9437154 - DNA, 22 bp, Homo sapiens
tggtctctgtaggctaccccat

SEQ ID NO: 9437155 - DNA, 22 bp, Homo sapiens
tggtctctgtaggctaccccat

SEQ ID NO: 9437156 - DNA, 22 bp, Homo sapiens
tggtctctgctgcagcttctca

SEQ ID NO: 9437157 - DNA, 22 bp, Homo sapiens
tggtctctgcaggccaggctca

SEQ ID NO: 9437158 - DNA, 22 bp, Homo sapiens
tggtgacagcatggaagaagtg

SEQ ID NO: 9437159 - DNA, 22 bp, Homo sapiens
tggtgaagtcagcggagcccgg

SEQ ID NO: 9437160 - DNA, 22 bp, Homo sapiens
tggtgactgattggtgttctct

SEQ ID NO: 9437161 - DNA, 22 bp, Homo sapiens
tggtgagagctgaccgtgcgag

SEQ ID NO: 9437162 - DNA, 22 bp, Homo sapiens
tggtgagataactttcggcaag

SEQ ID NO: 9437163 - DNA, 22 bp, Homo sapiens
tggtgagaccttgttccttatg

SEQ ID NO: 9437164 - DNA, 20 bp, Homo sapiens
tggtgagagcacctgatggg

SEQ ID NO: 9437165 - DNA, 22 bp, Homo sapiens
tggtgcagagagggatctaggg

SEQ ID NO: 9437166 - DNA, 22 bp, Homo sapiens
tggtgcagagagggatctaggg

SEQ ID NO: 9437167 - DNA, 22 bp, Homo sapiens
tggtgcagagagggatctaggg

SEQ ID NO: 9437168 - DNA, 22 bp, Homo sapiens
tggtgcagacaggagccccgct

SEQ ID NO: 9437169 - DNA, 22 bp, Homo sapiens
tggtgatcagtcaactgtcttc

SEQ ID NO: 9437170 - DNA, 22 bp, Homo sapiens
tggtgaggccaaagccatgaca

SEQ ID NO: 9437171 - DNA, 22 bp, Homo sapiens
tggtgaggaagacctgctcctg

SEQ ID NO: 9437172 - DNA, 22 bp, Homo sapiens
tggtgaggaagacctgctcctg

SEQ ID NO: 9437173 - DNA, 22 bp, Homo sapiens
tggtgaggccaaagccatgaca

SEQ ID NO: 9437174 - DNA, 22 bp, Homo sapiens
tggtgagcgatgctgcatgttc

SEQ ID NO: 9437175 - DNA, 22 bp, Homo sapiens
tggtgagatgtatggagggttg

SEQ ID NO: 9437176 - DNA, 22 bp, Homo sapiens
tggtgagatgtatggagggttg

SEQ ID NO: 9437177 - DNA, 22 bp, Homo sapiens
tggtgagctctttagactggga

SEQ ID NO: 9437178 - DNA, 22 bp, Homo sapiens
tggtgagctctttagactggga

SEQ ID NO: 9437179 - DNA, 22 bp, Homo sapiens
tggtgagctggaaggggctttg

SEQ ID NO: 9437180 - DNA, 22 bp, Homo sapiens
tggtgagctctttagactggga

SEQ ID NO: 9437181 - DNA, 22 bp, Homo sapiens
tggtgagctctggcagtctgtg

SEQ ID NO: 9437182 - DNA, 22 bp, Homo sapiens
tggtggcagctgggacagaggt

SEQ ID NO: 9437183 - DNA, 22 bp, Homo sapiens
tggtggcagctgggacagaggt

SEQ ID NO: 9437184 - DNA, 22 bp, Homo sapiens
tggtggcagctgggacagaggt

SEQ ID NO: 9437185 - DNA, 22 bp, Homo sapiens
tggtggcagtctcctggctgtg

SEQ ID NO: 9437186 - DNA, 22 bp, Homo sapiens
tggtggcagtctcctggctgtg

SEQ ID NO: 9437187 - DNA, 22 bp, Homo sapiens
tggtggcagtgagaaggagagg

SEQ ID NO: 9437188 - DNA, 22 bp, Homo sapiens
tggtggcagtgagaaggagagg

SEQ ID NO: 9437189 - DNA, 22 bp, Homo sapiens
tggtggcagctgagtgtcaggt

SEQ ID NO: 9437190 - DNA, 22 bp, Homo sapiens
tggtggcagctgagtgtcaggt

SEQ ID NO: 9437191 - DNA, 22 bp, Homo sapiens
tggtggccacgtgggcgcgagc

SEQ ID NO: 9437192 - DNA, 22 bp, Homo sapiens
tggtggcatgatagtgtgaatg

SEQ ID NO: 9437193 - DNA, 22 bp, Homo sapiens
tggtggcatgatagtgtgaatg

SEQ ID NO: 9437194 - DNA, 22 bp, Homo sapiens
tggtggcatgatagtgtgaatg

SEQ ID NO: 9437195 - DNA, 22 bp, Homo sapiens
tggtggcatcagtgaagtacac

SEQ ID NO: 9437196 - DNA, 22 bp, Homo sapiens
tggtggcagtgagaaggagagg

SEQ ID NO: 9437197 - DNA, 23 bp, Homo sapiens
tggtggcagaagtagcagatgac

SEQ ID NO: 9437198 - DNA, 22 bp, Homo sapiens
tggtggcacaagggagagaatc

SEQ ID NO: 9437199 - DNA, 22 bp, Homo sapiens
tggtggcacaagggagagaatc

SEQ ID NO: 9437200 - DNA, 22 bp, Homo sapiens
tggtggcacaagggagagaatc

SEQ ID NO: 9437201 - DNA, 23 bp, Homo sapiens
tggtggcagaagtagcagatgac

SEQ ID NO: 9437202 - DNA, 23 bp, Homo sapiens
tggtggcagaagtagcagatgac

SEQ ID NO: 9437203 - DNA, 22 bp, Homo sapiens
tggtggcagagcaagagctgga

SEQ ID NO: 9437204 - DNA, 22 bp, Homo sapiens
tggtggcagagcaagagctgga

SEQ ID NO: 9437205 - DNA, 22 bp, Homo sapiens
tggtggcagagcaagagctgga

SEQ ID NO: 9437206 - DNA, 22 bp, Homo sapiens
tggtggcaacattgctggagtg

SEQ ID NO: 9437207 - DNA, 22 bp, Homo sapiens
tggtggcaaggtgataagtggg

SEQ ID NO: 9437208 - DNA, 19 bp, Homo sapiens
tggtggcaatgtcagctaa

SEQ ID NO: 9437209 - DNA, 22 bp, Homo sapiens
tggtggcaatgtcctggagaag

SEQ ID NO: 9437210 - DNA, 22 bp, Homo sapiens
tggtggcaatgtcctggagaag

SEQ ID NO: 9437211 - DNA, 22 bp, Homo sapiens
tggtggcaatgtcctggagaag

SEQ ID NO: 9437212 - DNA, 22 bp, Homo sapiens
tggtggcaatgtcctggagaag

SEQ ID NO: 9437213 - DNA, 22 bp, Homo sapiens
tggtggcaattcaaagacagca

SEQ ID NO: 9437214 - DNA, 22 bp, Homo sapiens
tggtggcaattcaaagacagca

SEQ ID NO: 9437215 - DNA, 23 bp, Homo sapiens
tggtgggccctgcttgctcactg

SEQ ID NO: 9437216 - DNA, 22 bp, Homo sapiens
tggtgggcacagtgcccaggct

SEQ ID NO: 9437217 - DNA, 16 bp, Homo sapiens
tggtggggaggacagc

SEQ ID NO: 9437218 - DNA, 16 bp, Homo sapiens
tggtggggaggacagc

SEQ ID NO: 9437219 - DNA, 22 bp, Homo sapiens
tggtgggagtgagggcatgcca

SEQ ID NO: 9437220 - DNA, 22 bp, Homo sapiens
tggtgggcacagtgcccaggct

SEQ ID NO: 9437221 - DNA, 22 bp, Homo sapiens
tggtgggagtccgctgtgctgc

SEQ ID NO: 9437222 - DNA, 22 bp, Homo sapiens
tggtgggagtgacgttgccttc

SEQ ID NO: 9437223 - DNA, 22 bp, Homo sapiens
tggtgggagtccgctgtgctgc

SEQ ID NO: 9437224 - DNA, 22 bp, Homo sapiens
tggtggggccagacttcagctc

SEQ ID NO: 9437225 - DNA, 22 bp, Homo sapiens
tggtggggattccctccctggc

SEQ ID NO: 9437226 - DNA, 22 bp, Homo sapiens
tggtggggattccctccctggc

SEQ ID NO: 9437227 - DNA, 22 bp, Homo sapiens
tggtggggccagacttcagctc

SEQ ID NO: 9437228 - DNA, 22 bp, Homo sapiens
tggtggggccagacttcagctc

SEQ ID NO: 9437229 - DNA, 22 bp, Homo sapiens
tggtggggctttccttctgctt

SEQ ID NO: 9437230 - DNA, 22 bp, Homo sapiens
tggtggggtcatcgtcagatgc

SEQ ID NO: 9437231 - DNA, 22 bp, Homo sapiens
tggtggggtcatcgtcagatgc

SEQ ID NO: 9437232 - DNA, 22 bp, Homo sapiens
tggtgggggaggctgtctagca

SEQ ID NO: 9437233 - DNA, 22 bp, Homo sapiens
tggtgggggaggctgtctagca

SEQ ID NO: 9437234 - DNA, 22 bp, Homo sapiens
tggtggggctttccttctgctt

SEQ ID NO: 9437235 - DNA, 22 bp, Homo sapiens
tggtggggctttccttctgctt

SEQ ID NO: 9437236 - DNA, 22 bp, Homo sapiens
tggtgggggaggctgtctagca

SEQ ID NO: 9437237 - DNA, 22 bp, Homo sapiens
tggtgggggaggctgtctagca

SEQ ID NO: 9437238 - DNA, 22 bp, Homo sapiens
tggtgcagtagagctgtctggg

SEQ ID NO: 9437239 - DNA, 22 bp, Homo sapiens
tggtgcagtagagctgtctggg

SEQ ID NO: 9437240 - DNA, 22 bp, Homo sapiens
tggtgcagtagagctgtctggg

SEQ ID NO: 9437241 - DNA, 22 bp, Homo sapiens
tggtgcagtagagctgtctggg

SEQ ID NO: 9437242 - DNA, 22 bp, Homo sapiens
tggtgcagtagaaggccgactt

SEQ ID NO: 9437243 - DNA, 22 bp, Homo sapiens
tggtgcagtagaaggccgactt

SEQ ID NO: 9437244 - DNA, 22 bp, Homo sapiens
tggtgcaggagttggcagggac

SEQ ID NO: 9437245 - DNA, 22 bp, Homo sapiens
tggtgcaggtgttgatgcagga

SEQ ID NO: 9437246 - DNA, 22 bp, Homo sapiens
tggtgcaggccaagctgcgagc

SEQ ID NO: 9437247 - DNA, 22 bp, Homo sapiens
tggtgcagatagtggtgtagta

SEQ ID NO: 9437248 - DNA, 22 bp, Homo sapiens
tggtgcagatagtggtgtagta

SEQ ID NO: 9437249 - DNA, 22 bp, Homo sapiens
tggtgcagatgcaggtcactgg

SEQ ID NO: 9437250 - DNA, 22 bp, Homo sapiens
tggtgccaccctccttcagctg

SEQ ID NO: 9437251 - DNA, 22 bp, Homo sapiens
tggtgccatcatagctcactgc

SEQ ID NO: 9437252 - DNA, 22 bp, Homo sapiens
tggtgcccactccagacaccta

SEQ ID NO: 9437253 - DNA, 22 bp, Homo sapiens
tggtgccattagccctgctgtt

SEQ ID NO: 9437254 - DNA, 22 bp, Homo sapiens
tggtgcccactctggacccagc

SEQ ID NO: 9437255 - DNA, 22 bp, Homo sapiens
tggtgcccattctggtcccatg

SEQ ID NO: 9437256 - DNA, 22 bp, Homo sapiens
tggtgcccattctggtcccatg

SEQ ID NO: 9437257 - DNA, 22 bp, Homo sapiens
tggtgcagtccaaagggagcag

SEQ ID NO: 9437258 - DNA, 22 bp, Homo sapiens
tggtgcagttcccagggccggg

SEQ ID NO: 9437259 - DNA, 22 bp, Homo sapiens
tggtgcagttcccagggccggg

SEQ ID NO: 9437260 - DNA, 22 bp, Homo sapiens
tggtgccaagcatgaggactct

SEQ ID NO: 9437261 - DNA, 22 bp, Homo sapiens
tggtgcagtcattggcccaggg

SEQ ID NO: 9437262 - DNA, 22 bp, Homo sapiens
tggtgcagtccaaagggagcag

SEQ ID NO: 9437263 - DNA, 22 bp, Homo sapiens
tggtgcagtccaaagggagcag

SEQ ID NO: 9437264 - DNA, 21 bp, Homo sapiens
tggtggagtgtgctgagcatg

SEQ ID NO: 9437265 - DNA, 19 bp, Homo sapiens
tggtggaggtgcacctgac

SEQ ID NO: 9437266 - DNA, 19 bp, Homo sapiens
tggtggaggtgcacctgac

SEQ ID NO: 9437267 - DNA, 22 bp, Homo sapiens
tggtggcaacattgctggagtg

SEQ ID NO: 9437268 - DNA, 22 bp, Homo sapiens
tggtggcaacattgctggagtg

SEQ ID NO: 9437269 - DNA, 22 bp, Homo sapiens
tggtggcaacattgctggagtg

SEQ ID NO: 9437270 - DNA, 22 bp, Homo sapiens
tggtggcaacattgctggagtg

SEQ ID NO: 9437271 - DNA, 22 bp, Homo sapiens
tggtggcaaagtacaaagtgac

SEQ ID NO: 9437272 - DNA, 22 bp, Homo sapiens
tggtggcaaatcaggacacttc

SEQ ID NO: 9437273 - DNA, 22 bp, Homo sapiens
tggtggcaaagtacaaagtgac

SEQ ID NO: 9437274 - DNA, 22 bp, Homo sapiens
tggtggcaaaagaggcaaagtg

SEQ ID NO: 9437275 - DNA, 22 bp, Homo sapiens
tggtggcaaaagaggcaaagtg

SEQ ID NO: 9437276 - DNA, 22 bp, Homo sapiens
tggtggagcctaggctaagtct

SEQ ID NO: 9437277 - DNA, 22 bp, Homo sapiens
tggtggacattctggatgtgct

SEQ ID NO: 9437278 - DNA, 22 bp, Homo sapiens
tggggaggatatgtgagttatt

SEQ ID NO: 9437279 - DNA, 22 bp, Homo sapiens
tggggaggatatgtgagttatt

SEQ ID NO: 9437280 - DNA, 22 bp, Homo sapiens
tggggaggacgggcgccttcct

SEQ ID NO: 9437281 - DNA, 23 bp, Homo sapiens
tggggagggaagtcatttctgta

SEQ ID NO: 9437282 - DNA, 23 bp, Homo sapiens
tggggagggaagtcatttctgta

SEQ ID NO: 9437283 - DNA, 22 bp, Homo sapiens
tggggacagggctcagcaattt

SEQ ID NO: 9437284 - DNA, 22 bp, Homo sapiens
tggggacagggctcagcaattt

SEQ ID NO: 9437285 - DNA, 22 bp, Homo sapiens
tggggacaggagacttacagct

SEQ ID NO: 9437286 - DNA, 22 bp, Homo sapiens
tggggacagggctcagcaattt

SEQ ID NO: 9437287 - DNA, 22 bp, Homo sapiens
tggggacaggagacttacagct

SEQ ID NO: 9437288 - DNA, 22 bp, Homo sapiens
tggggacattcatgcaggttgt

SEQ ID NO: 9437289 - DNA, 22 bp, Homo sapiens
tggggacattcatgcaggttgt

SEQ ID NO: 9437290 - DNA, 22 bp, Homo sapiens
tggggacattcatgcaggttgt

SEQ ID NO: 9437291 - DNA, 22 bp, Homo sapiens
tggggacatagccagtctggct

SEQ ID NO: 9437292 - DNA, 22 bp, Homo sapiens
tggggaggaagtcagatttcag

SEQ ID NO: 9437293 - DNA, 22 bp, Homo sapiens
tggggaggaagtcagatttcag

SEQ ID NO: 9437294 - DNA, 22 bp, Homo sapiens
tggggacattcatgcaggttgt

SEQ ID NO: 9437295 - DNA, 22 bp, Homo sapiens
tggggactgacagccaggcctc

SEQ ID NO: 9437296 - DNA, 22 bp, Homo sapiens
tggggactgacagccaggcctc

SEQ ID NO: 9437297 - DNA, 22 bp, Homo sapiens
tggggaggttcgggaatcttgt

SEQ ID NO: 9437298 - DNA, 22 bp, Homo sapiens
tggggaggttcgggaatcttgt

SEQ ID NO: 9437299 - DNA, 22 bp, Homo sapiens
tggggaggttcgggaatcttgt

SEQ ID NO: 9437300 - DNA, 22 bp, Homo sapiens
tggggagtcgctgcagagcgat

SEQ ID NO: 9437301 - DNA, 22 bp, Homo sapiens
tggggagtgatgcctcggataa

SEQ ID NO: 9437302 - DNA, 22 bp, Homo sapiens
tggggaggtaacaatttcaggc

SEQ ID NO: 9437303 - DNA, 22 bp, Homo sapiens
tggggaggtaacaatttcaggc

SEQ ID NO: 9437304 - DNA, 22 bp, Homo sapiens
tggggaggtaacaatttcaggc

SEQ ID NO: 9437305 - DNA, 21 bp, Homo sapiens
tggggaggggacctgattatg

SEQ ID NO: 9437306 - DNA, 21 bp, Homo sapiens
tggggaggggacctgattatg

SEQ ID NO: 9437307 - DNA, 22 bp, Homo sapiens
tggggatgtaaatgaggtgata

SEQ ID NO: 9437308 - DNA, 22 bp, Homo sapiens
tggggatgtaaatgaggtgata

SEQ ID NO: 9437309 - DNA, 16 bp, Homo sapiens
tggggatggggaagag

SEQ ID NO: 9437310 - DNA, 22 bp, Homo sapiens
tggggatgtaaatgaggtgata

SEQ ID NO: 9437311 - DNA, 22 bp, Homo sapiens
tggggcaaagtaggtatttagt

SEQ ID NO: 9437312 - DNA, 20 bp, Homo sapiens
tggggagttgagcacgagca

SEQ ID NO: 9437313 - DNA, 22 bp, Homo sapiens
tggggatgaaacccaggcatct

SEQ ID NO: 9437314 - DNA, 20 bp, Homo sapiens
tggggagttgagcacgagca

SEQ ID NO: 9437315 - DNA, 22 bp, Homo sapiens
tggggagtgatgcctcggataa

SEQ ID NO: 9437316 - DNA, 22 bp, Homo sapiens
tgggctggcgtggagagtttag

SEQ ID NO: 9437317 - DNA, 22 bp, Homo sapiens
tgggctggcgtggagagtttag

SEQ ID NO: 9437318 - DNA, 22 bp, Homo sapiens
tgggctggctgaacttcaacct

SEQ ID NO: 9437319 - DNA, 22 bp, Homo sapiens
tgggctggctgaacttcaacct

SEQ ID NO: 9437320 - DNA, 22 bp, Homo sapiens
tgggctggctgaacttcaacct

SEQ ID NO: 9437321 - DNA, 22 bp, Homo sapiens
tgggctggctgaacttcaacct

SEQ ID NO: 9437322 - DNA, 22 bp, Homo sapiens
tgggctggctgaacttcaacct

SEQ ID NO: 9437323 - DNA, 18 bp, Homo sapiens
tgggctgcctggcctctg

SEQ ID NO: 9437324 - DNA, 22 bp, Homo sapiens
tgggctggcgtggagagtttag

SEQ ID NO: 9437325 - DNA, 22 bp, Homo sapiens
tgggctggcgtggagagtttag

SEQ ID NO: 9437326 - DNA, 22 bp, Homo sapiens
tgggctggctgaggcattcact

SEQ ID NO: 9437327 - DNA, 22 bp, Homo sapiens
tgggctggctgaggcattcact

SEQ ID NO: 9437328 - DNA, 22 bp, Homo sapiens
tgggctggctgaggcattcact

SEQ ID NO: 9437329 - DNA, 22 bp, Homo sapiens
tgggctggctgaggcattcact

SEQ ID NO: 9437330 - DNA, 22 bp, Homo sapiens
tgggctggctgaggcattcact

SEQ ID NO: 9437331 - DNA, 22 bp, Homo sapiens
tgggctggtgagggatcattta

SEQ ID NO: 9437332 - DNA, 22 bp, Homo sapiens
tgggctggtgagggatcattta

SEQ ID NO: 9437333 - DNA, 22 bp, Homo sapiens
tgggctggctgaggcattcact

SEQ ID NO: 9437334 - DNA, 22 bp, Homo sapiens
tgggctggtgagggatcattta

SEQ ID NO: 9437335 - DNA, 22 bp, Homo sapiens
tgggctggtgagggatcattta

SEQ ID NO: 9437336 - DNA, 22 bp, Homo sapiens
tgggctggtgagggatcattta

SEQ ID NO: 9437337 - DNA, 22 bp, Homo sapiens
tggggaaaatgcagaagattac

SEQ ID NO: 9437338 - DNA, 22 bp, Homo sapiens
tggggaaaacagaggaaattag

SEQ ID NO: 9437339 - DNA, 22 bp, Homo sapiens
tgggcttggaaagctgctgtgc

SEQ ID NO: 9437340 - DNA, 22 bp, Homo sapiens
tgggcttctggagtggggcaga

SEQ ID NO: 9437341 - DNA, 22 bp, Homo sapiens
tgggctgtggagaggagctgga

SEQ ID NO: 9437342 - DNA, 22 bp, Homo sapiens
tgggcttcataattggtcctag

SEQ ID NO: 9437343 - DNA, 22 bp, Homo sapiens
tgggcttcctggagcctgtgct

SEQ ID NO: 9437344 - DNA, 19 bp, Homo sapiens
tgggcttccccagggcaga

SEQ ID NO: 9437345 - DNA, 23 bp, Homo sapiens
tgggcttctgagaaagcacctaa

SEQ ID NO: 9437346 - DNA, 23 bp, Homo sapiens
tgggcttctgagaaagcacctaa

SEQ ID NO: 9437347 - DNA, 22 bp, Homo sapiens
tggggacacagagccaaactat

SEQ ID NO: 9437348 - DNA, 22 bp, Homo sapiens
tggggacacagaggttcgttgg

SEQ ID NO: 9437349 - DNA, 22 bp, Homo sapiens
tggggaagggcaccctggagac

SEQ ID NO: 9437350 - DNA, 22 bp, Homo sapiens
tggggaagggcaccctggagac

SEQ ID NO: 9437351 - DNA, 22 bp, Homo sapiens
tggggaaggcggagcttgcagc

SEQ ID NO: 9437352 - DNA, 22 bp, Homo sapiens
tggggaaggcggagcttgcagc

SEQ ID NO: 9437353 - DNA, 22 bp, Homo sapiens
tggggaaggcggagcttgcagc

SEQ ID NO: 9437354 - DNA, 17 bp, Homo sapiens
tggggaagctcagattt

SEQ ID NO: 9437355 - DNA, 17 bp, Homo sapiens
tggggaagctcagattt

SEQ ID NO: 9437356 - DNA, 22 bp, Homo sapiens
tggggaaggatcaccacaatct

SEQ ID NO: 9437357 - DNA, 16 bp, Homo sapiens
tggggaagctcgtgag

SEQ ID NO: 9437358 - DNA, 22 bp, Homo sapiens
tggggaaagatagttttctcta

SEQ ID NO: 9437359 - DNA, 22 bp, Homo sapiens
tggggaaactatttccttgtcc

SEQ ID NO: 9437360 - DNA, 22 bp, Homo sapiens
tggggaagcactttgaacttaa

SEQ ID NO: 9437361 - DNA, 22 bp, Homo sapiens
tggggaagacagcagacactgt

SEQ ID NO: 9437362 - DNA, 22 bp, Homo sapiens
tggggaagaataatgtatgtac

SEQ ID NO: 9437363 - DNA, 22 bp, Homo sapiens
tggggaagacagcagacactgt

SEQ ID NO: 9437364 - DNA, 22 bp, Homo sapiens
tggggaagacagcagacactgt

SEQ ID NO: 9437365 - DNA, 22 bp, Homo sapiens
tgggggagccttcacagtagct

SEQ ID NO: 9437366 - DNA, 22 bp, Homo sapiens
tgggggagccttcacagtagct

SEQ ID NO: 9437367 - DNA, 22 bp, Homo sapiens
tgggggagccttcacagtagct

SEQ ID NO: 9437368 - DNA, 22 bp, Homo sapiens
tgggggagtatagtctggcctc

SEQ ID NO: 9437369 - DNA, 22 bp, Homo sapiens
tgggggcacttcgaggtcgcct

SEQ ID NO: 9437370 - DNA, 22 bp, Homo sapiens
tgggggagtatagtctggcctc

SEQ ID NO: 9437371 - DNA, 22 bp, Homo sapiens
tgggggcacttcgaggtcgcct

SEQ ID NO: 9437372 - DNA, 22 bp, Homo sapiens
tgggggcacttcgaggtcgcct

SEQ ID NO: 9437373 - DNA, 22 bp, Homo sapiens
tgggggctccaggctccaggga

SEQ ID NO: 9437374 - DNA, 22 bp, Homo sapiens
tgggggctgggatgtcactttc

SEQ ID NO: 9437375 - DNA, 22 bp, Homo sapiens
tgggggctgagtaagatgagat

SEQ ID NO: 9437376 - DNA, 22 bp, Homo sapiens
tgggggcatggaccagcctggc

SEQ ID NO: 9437377 - DNA, 22 bp, Homo sapiens
tgggggcagccaggctgtcaag

SEQ ID NO: 9437378 - DNA, 22 bp, Homo sapiens
tgggggcatggaccagcctggc

SEQ ID NO: 9437379 - DNA, 22 bp, Homo sapiens
tgggggcagccaggctgtcaag

SEQ ID NO: 9437380 - DNA, 22 bp, Homo sapiens
tgggggcagccaggctgtcaag

SEQ ID NO: 9437381 - DNA, 22 bp, Homo sapiens
tgggggcagaggattcaggaat

SEQ ID NO: 9437382 - DNA, 22 bp, Homo sapiens
tggggctgtccttagtctgaga

SEQ ID NO: 9437383 - DNA, 22 bp, Homo sapiens
tggggctgtccttagtctgaga

SEQ ID NO: 9437384 - DNA, 22 bp, Homo sapiens
tggggctggggatcttgagcct

SEQ ID NO: 9437385 - DNA, 22 bp, Homo sapiens
tggggctggggatcttgagcct

SEQ ID NO: 9437386 - DNA, 22 bp, Homo sapiens
tggggctggctattgtctccct

SEQ ID NO: 9437387 - DNA, 22 bp, Homo sapiens
tggggctggctattgtctccct

SEQ ID NO: 9437388 - DNA, 22 bp, Homo sapiens
tggggctggctattgtctccct

SEQ ID NO: 9437389 - DNA, 22 bp, Homo sapiens
tggggctggcacagtctctatt

SEQ ID NO: 9437390 - DNA, 22 bp, Homo sapiens
tggggctggcacagtctctatt

SEQ ID NO: 9437391 - DNA, 22 bp, Homo sapiens
tggggctggcacagtctctatt

SEQ ID NO: 9437392 - DNA, 22 bp, Homo sapiens
tgggggagattagagcttctta

SEQ ID NO: 9437393 - DNA, 22 bp, Homo sapiens
tgggggagattgtgcatctcta

SEQ ID NO: 9437394 - DNA, 22 bp, Homo sapiens
tgggggagattagagcttctta

SEQ ID NO: 9437395 - DNA, 22 bp, Homo sapiens
tggggctgtccttagtctgaga

SEQ ID NO: 9437396 - DNA, 22 bp, Homo sapiens
tgggggagagtgcaagcatgaa

SEQ ID NO: 9437397 - DNA, 22 bp, Homo sapiens
tgggggagagtgcaagcatgaa

SEQ ID NO: 9437398 - DNA, 22 bp, Homo sapiens
tgggggagagtgcaagcatgaa

SEQ ID NO: 9437399 - DNA, 22 bp, Homo sapiens
tgggggagagtttagatgattt

SEQ ID NO: 9437400 - DNA, 22 bp, Homo sapiens
tgggggagagtttagatgattt

SEQ ID NO: 9437401 - DNA, 22 bp, Homo sapiens
tgggggagagtttagatgattt

SEQ ID NO: 9437402 - DNA, 22 bp, Homo sapiens
tgggggagagtttagatgattt

SEQ ID NO: 9437403 - DNA, 22 bp, Homo sapiens
tggggctaaacacgcctggcct

SEQ ID NO: 9437404 - DNA, 22 bp, Homo sapiens
tggggctcacctaggctggaag

SEQ ID NO: 9437405 - DNA, 20 bp, Homo sapiens
tggggcctgtttctgtggtt

SEQ ID NO: 9437406 - DNA, 22 bp, Homo sapiens
tggggcgcccccactccacaga

SEQ ID NO: 9437407 - DNA, 22 bp, Homo sapiens
tggggcctggtcagagctgcac

SEQ ID NO: 9437408 - DNA, 22 bp, Homo sapiens
tggggcctgaggtggagctgca

SEQ ID NO: 9437409 - DNA, 22 bp, Homo sapiens
tggggctctccacagtgtctca

SEQ ID NO: 9437410 - DNA, 22 bp, Homo sapiens
tggggctctccacagtgtctca

SEQ ID NO: 9437411 - DNA, 23 bp, Homo sapiens
tggggctctggcaggcctgaggt

SEQ ID NO: 9437412 - DNA, 23 bp, Homo sapiens
tggggctctggcaggcctgaggt

SEQ ID NO: 9437413 - DNA, 22 bp, Homo sapiens
tggggctcctcctggcaggagg

SEQ ID NO: 9437414 - DNA, 22 bp, Homo sapiens
tggggctcctcctggcaggagg

SEQ ID NO: 9437415 - DNA, 22 bp, Homo sapiens
tggggctcacctaggctggaag

SEQ ID NO: 9437416 - DNA, 22 bp, Homo sapiens
tggggctcatgcctgctggaac

SEQ ID NO: 9437417 - DNA, 22 bp, Homo sapiens
tggggctcatgcctgctggaac

SEQ ID NO: 9437418 - DNA, 22 bp, Homo sapiens
tggggctgaggagcctcactct

SEQ ID NO: 9437419 - DNA, 22 bp, Homo sapiens
tggggctgaggagcctcactct

SEQ ID NO: 9437420 - DNA, 23 bp, Homo sapiens
tggggctgatggagacggaccag

SEQ ID NO: 9437421 - DNA, 22 bp, Homo sapiens
tggggccatctcacccactgtt

SEQ ID NO: 9437422 - DNA, 22 bp, Homo sapiens
tggggccaggtggctgcaggtc

SEQ ID NO: 9437423 - DNA, 22 bp, Homo sapiens
tggggccaggtggctgcaggtc

SEQ ID NO: 9437424 - DNA, 22 bp, Homo sapiens
tggggcctgaaaggttctcgcc

SEQ ID NO: 9437425 - DNA, 19 bp, Homo sapiens
tggggcctcctgtccctgg

SEQ ID NO: 9437426 - DNA, 22 bp, Homo sapiens
tggggccagggaggaccagaca

SEQ ID NO: 9437427 - DNA, 22 bp, Homo sapiens
tggggccagcggggaggactca

SEQ ID NO: 9437428 - DNA, 22 bp, Homo sapiens
tggggccagcggggaggactca

SEQ ID NO: 9437429 - DNA, 22 bp, Homo sapiens
tggggccagagatggggcgcag

SEQ ID NO: 9437430 - DNA, 22 bp, Homo sapiens
tggggccacactgatctcccag

SEQ ID NO: 9437431 - DNA, 22 bp, Homo sapiens
tggggcagcagacctttcttgg

SEQ ID NO: 9437432 - DNA, 22 bp, Homo sapiens
tggggcagagtaggattttggc

SEQ ID NO: 9437433 - DNA, 22 bp, Homo sapiens
tggggcagagtaggattttggc

SEQ ID NO: 9437434 - DNA, 20 bp, Homo sapiens
tggggcacatgcagattggt

SEQ ID NO: 9437435 - DNA, 22 bp, Homo sapiens
tggggcaagaagtgccctgaag

SEQ ID NO: 9437436 - DNA, 22 bp, Homo sapiens
tggggcaagaagtgccctgaag

SEQ ID NO: 9437437 - DNA, 22 bp, Homo sapiens
tggggcacttatgatgtgccac

SEQ ID NO: 9437438 - DNA, 22 bp, Homo sapiens
tggggcacttatgatgtgccac

SEQ ID NO: 9437439 - DNA, 22 bp, Homo sapiens
tgggtaggggacgtggaagaaa

SEQ ID NO: 9437440 - DNA, 22 bp, Homo sapiens
tgggtagggacttagctggctg

SEQ ID NO: 9437441 - DNA, 22 bp, Homo sapiens
tgggtagggcctgcgcctgtgc

SEQ ID NO: 9437442 - DNA, 22 bp, Homo sapiens
tgggtagggacttagctggctg

SEQ ID NO: 9437443 - DNA, 22 bp, Homo sapiens
tgggtagggagctggaatccta

SEQ ID NO: 9437444 - DNA, 22 bp, Homo sapiens
tgggtaggccaggaagcagtgt

SEQ ID NO: 9437445 - DNA, 22 bp, Homo sapiens
tgggtaggaatcgagtgtatgg

SEQ ID NO: 9437446 - DNA, 22 bp, Homo sapiens
tgggtaggaccagaaatgcact

SEQ ID NO: 9437447 - DNA, 22 bp, Homo sapiens
tgggtaggccaggaagcagtgt

SEQ ID NO: 9437448 - DNA, 22 bp, Homo sapiens
tgggtactcctattagttcagt

SEQ ID NO: 9437449 - DNA, 22 bp, Homo sapiens
tgggtactcctattagttcagt

SEQ ID NO: 9437450 - DNA, 22 bp, Homo sapiens
tgggtaggaatcgagtgtatgg

SEQ ID NO: 9437451 - DNA, 22 bp, Homo sapiens
tgggtagcagggctgagctgtg

SEQ ID NO: 9437452 - DNA, 23 bp, Homo sapiens
tggggttgaattgtagctgtgcc

SEQ ID NO: 9437453 - DNA, 22 bp, Homo sapiens
tggggttacctacaagtctgag

SEQ ID NO: 9437454 - DNA, 22 bp, Homo sapiens
tggggttctttgtttcctgcct

SEQ ID NO: 9437455 - DNA, 22 bp, Homo sapiens
tgggtccttgctgattgctgag

SEQ ID NO: 9437456 - DNA, 22 bp, Homo sapiens
tgggtccttgctggcttcaaag

SEQ ID NO: 9437457 - DNA, 22 bp, Homo sapiens
tgggtctccagttcagggcagg

SEQ ID NO: 9437458 - DNA, 22 bp, Homo sapiens
tgggtcctttttggacttcttc
